United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 37

SEQ ID NO: 1325130 - RNA, 13 nt, Mycobacterium tuberculosis H37Rv
aagucucccggcc

SEQ ID NO: 1325131 - RNA, 11 nt, Mycobacterium tuberculosis H37Rv
aaguccagcag

SEQ ID NO: 1325132 - RNA, 15 nt, Mycobacterium tuberculosis H37Rv
aagaaucagcagcag

SEQ ID NO: 1325133 - RNA, 18 nt, Mycobacterium tuberculosis H37Rv
aagaccggaucgccuugg

SEQ ID NO: 1325134 - RNA, 23 nt, Mycobacterium tuberculosis H37Rv
aagaccgggucguagccgaaccc

SEQ ID NO: 1325135 - RNA, 18 nt, Mycobacterium tuberculosis H37Rv
aagaccaccgcccacagc

SEQ ID NO: 1325136 - RNA, 14 nt, Mycobacterium tuberculosis H37Rv
aagacaacccgcuc

SEQ ID NO: 1325137 - RNA, 15 nt, Mycobacterium tuberculosis H37Rv
aagacuagcugcuag

SEQ ID NO: 1325138 - RNA, 20 nt, Mycobacterium tuberculosis H37Rv
aagacuuagcgggugccagc

SEQ ID NO: 1325139 - RNA, 19 nt, Mycobacterium tuberculosis H37Rv
aagacuuagcgggugccag

SEQ ID NO: 1325140 - RNA, 17 nt, Mycobacterium tuberculosis H37Rv
aagacgcccgaguuugc

SEQ ID NO: 1325141 - RNA, 24 nt, Mycobacterium tuberculosis H37Rv
aagagcacgucaacagccagggca

SEQ ID NO: 1325142 - RNA, 16 nt, Mycobacterium tuberculosis H37Rv
aagagguggggcagga

SEQ ID NO: 1325143 - RNA, 10 nt, Mycobacterium tuberculosis H37Rv
aagcaccagc

SEQ ID NO: 1325144 - RNA, 21 nt, Mycobacterium tuberculosis H37Rv
aagcaauuccaccgccgagau

SEQ ID NO: 1325145 - RNA, 17 nt, Mycobacterium tuberculosis H37Rv
aagcacagcgaacagac

SEQ ID NO: 1325146 - RNA, 20 nt, Mycobacterium tuberculosis H37Rv
aagcacaccgccagcggcaa

SEQ ID NO: 1325147 - RNA, 20 nt, Mycobacterium tuberculosis H37Rv
aagcaucgcguuguaggcuu

SEQ ID NO: 1325148 - RNA, 21 nt, Mycobacterium tuberculosis H37Rv
aagcagccagcaacaccagau

SEQ ID NO: 1325149 - RNA, 18 nt, Mycobacterium tuberculosis H37Rv
aagaucagcggauccaga

SEQ ID NO: 1325150 - RNA, 21 nt, Mycobacterium tuberculosis H37Rv
aagaucagcaugguccacagc

SEQ ID NO: 1325151 - RNA, 22 nt, Mycobacterium tuberculosis H37Rv
aagaucaccucccgcggcaccu

SEQ ID NO: 1325152 - RNA, 13 nt, Mycobacterium tuberculosis H37Rv
aagauccagcgca

SEQ ID NO: 1325153 - RNA, 19 nt, Mycobacterium tuberculosis H37Rv
aagaucgcgugccacagca

SEQ ID NO: 1325154 - RNA, 22 nt, Mycobacterium tuberculosis H37Rv
aagaucgcugcgaagccgagca

SEQ ID NO: 1325155 - RNA, 18 nt, Mycobacterium tuberculosis H37Rv
aagaucgcgugccacagc

SEQ ID NO: 1325156 - RNA, 13 nt, Mycobacterium tuberculosis H37Rv
aagaucuccuccu

SEQ ID NO: 1325157 - RNA, 18 nt, Mycobacterium tuberculosis H37Rv
aagaucucggccaggaug

SEQ ID NO: 1325158 - RNA, 18 nt, Mycobacterium tuberculosis H37Rv
aagauggccucaacgcca

SEQ ID NO: 1325159 - RNA, 14 nt, Mycobacterium tuberculosis H37Rv
uuugucgccuucuu

SEQ ID NO: 1325160 - RNA, 12 nt, Mycobacterium tuberculosis H37Rv
uuuggccgccgu

SEQ ID NO: 1325161 - RNA, 13 nt, Mycobacterium tuberculosis H37Rv
uuuggguuuuguu

SEQ ID NO: 1325162 - RNA, 13 nt, Mycobacterium tuberculosis H37Rv
uuuugcugcaugc

SEQ ID NO: 1325163 - RNA, 16 nt, Mycobacterium tuberculosis H37Rv
uuuccccgcccuugcc

SEQ ID NO: 1325164 - RNA, 16 nt, Mycobacterium tuberculosis H37Rv
uuuccgccgccgccau

SEQ ID NO: 1325165 - RNA, 21 nt, Mycobacterium tuberculosis H37Rv
uuuccuugcgcgccauuggcg

SEQ ID NO: 1325166 - RNA, 18 nt, Mycobacterium tuberculosis H37Rv
uuucgauauagccgccgg

SEQ ID NO: 1325167 - RNA, 22 nt, Mycobacterium tuberculosis H37Rv
uuucgauauagccgccggugcc

SEQ ID NO: 1325168 - RNA, 17 nt, Mycobacterium tuberculosis H37Rv
uuucgccgugaugaugu

SEQ ID NO: 1325169 - RNA, 15 nt, Mycobacterium tuberculosis H37Rv
uuucuccgccgccca

SEQ ID NO: 1325170 - RNA, 21 nt, Mycobacterium tuberculosis H37Rv
uuucggaugcaacccggugau

SEQ ID NO: 1325171 - RNA, 14 nt, Mycobacterium tuberculosis H37Rv
uuugaucaccgugg

SEQ ID NO: 1325172 - RNA, 17 nt, Mycobacterium tuberculosis H37Rv
uuugauccuggcucagg

SEQ ID NO: 1325173 - RNA, 14 nt, Mycobacterium tuberculosis H37Rv
uuugagcgcacuca

SEQ ID NO: 1325174 - RNA, 16 nt, Mycobacterium tuberculosis H37Rv
uuugauuccaggucau

SEQ ID NO: 1325175 - RNA, 20 nt, Mycobacterium tuberculosis H37Rv
uuugcaggcccgaguuguug

SEQ ID NO: 1325176 - RNA, 19 nt, Mycobacterium tuberculosis H37Rv
uuugcgucugcucgccagg

SEQ ID NO: 1325177 - RNA, 13 nt, Mycobacterium tuberculosis H37Rv
uuugcgaagccca

SEQ ID NO: 1325178 - RNA, 20 nt, Mycobacterium tuberculosis H37Rv
uuugcgaaucggcccgugcc

SEQ ID NO: 1325179 - RNA, 22 nt, Mycobacterium tuberculosis H37Rv
uuugacgacaaacggcgaccca

SEQ ID NO: 1325180 - RNA, 15 nt, Mycobacterium tuberculosis H37Rv
uuugacgggauagcc

SEQ ID NO: 1325181 - RNA, 17 nt, Mycobacterium tuberculosis H37Rv
uuuccaccguuagccag

SEQ ID NO: 1325182 - RNA, 12 nt, Mycobacterium tuberculosis H37Rv
uuuaggcagccc

SEQ ID NO: 1325183 - RNA, 13 nt, Mycobacterium tuberculosis H37Rv
uuuaggcguggcc

SEQ ID NO: 1325184 - RNA, 23 nt, Mycobacterium tuberculosis H37Rv
uuuagggugcccgcguugccaaa

SEQ ID NO: 1325185 - RNA, 20 nt, Mycobacterium tuberculosis H37Rv
uugcugcggcuuucagcgcu

SEQ ID NO: 1325186 - RNA, 15 nt, Mycobacterium tuberculosis H37Rv
uuguugcugcugccg

SEQ ID NO: 1325187 - RNA, 18 nt, Mycobacterium tuberculosis H37Rv
uuguuggauccggccacc

SEQ ID NO: 1325188 - RNA, 16 nt, Mycobacterium tuberculosis H37Rv
uuguuaucgaagcccg

SEQ ID NO: 1325189 - RNA, 15 nt, Mycobacterium tuberculosis H37Rv
uuaagucuggaguga

SEQ ID NO: 1325190 - RNA, 19 nt, Mycobacterium tuberculosis H37Rv
ugugccgggcgaugcuggg

SEQ ID NO: 1325191 - RNA, 19 nt, Mycobacterium tuberculosis H37Rv
uguggacggcauagcagcc

SEQ ID NO: 1325192 - RNA, 19 nt, Mycobacterium tuberculosis H37Rv
uguggacuucagcaggccc

SEQ ID NO: 1325193 - RNA, 16 nt, Mycobacterium tuberculosis H37Rv
uguggaauacgcugcu

SEQ ID NO: 1325194 - RNA, 17 nt, Mycobacterium tuberculosis H37Rv
uuaacuacggugcccug

SEQ ID NO: 1325195 - RNA, 19 nt, Mycobacterium tuberculosis H37Rv
uuacccaucgccacaccca

SEQ ID NO: 1325196 - RNA, 17 nt, Mycobacterium tuberculosis H37Rv
uuacccaucgccacacc

SEQ ID NO: 1325197 - RNA, 14 nt, Mycobacterium tuberculosis H37Rv
uuaccaccgucucc

SEQ ID NO: 1325198 - RNA, 18 nt, Mycobacterium tuberculosis H37Rv
uuagcccacccauggccu

SEQ ID NO: 1325199 - RNA, 21 nt, Mycobacterium tuberculosis H37Rv
uuagcccgauggugccgaccc

SEQ ID NO: 1325200 - RNA, 14 nt, Mycobacterium tuberculosis H37Rv
uuaccgaagcccga

SEQ ID NO: 1325201 - RNA, 17 nt, Mycobacterium tuberculosis H37Rv
uuaguuucguccccaga

SEQ ID NO: 1325202 - RNA, 20 nt, Mycobacterium tuberculosis H37Rv
uucagcacggugaucagcag

SEQ ID NO: 1325203 - RNA, 15 nt, Mycobacterium tuberculosis H37Rv
uucaggaugccagga

SEQ ID NO: 1325204 - RNA, 22 nt, Mycobacterium tuberculosis H37Rv
uucagcaggcccuucaguucga

SEQ ID NO: 1325205 - RNA, 12 nt, Mycobacterium tuberculosis H37Rv
uuaugccaggcg

SEQ ID NO: 1325206 - RNA, 16 nt, Mycobacterium tuberculosis H37Rv
uuaugcgacugcucgc

SEQ ID NO: 1325207 - RNA, 14 nt, Mycobacterium tuberculosis H37Rv
uuaucgaagcccga

SEQ ID NO: 1325208 - RNA, 20 nt, Mycobacterium tuberculosis H37Rv
uugaaauugaugaucugcag

SEQ ID NO: 1325209 - RNA, 16 nt, Mycobacterium tuberculosis H37Rv
uugaaauugaugaucu

SEQ ID NO: 1325210 - RNA, 14 nt, Mycobacterium tuberculosis H37Rv
uugaacgccgccag

SEQ ID NO: 1325211 - RNA, 19 nt, Mycobacterium tuberculosis H37Rv
uugaacgcccgcuucagca

SEQ ID NO: 1325212 - RNA, 20 nt, Mycobacterium tuberculosis H37Rv
uugaaccgguacaaccccca

SEQ ID NO: 1325213 - RNA, 13 nt, Mycobacterium tuberculosis H37Rv
uugaagaagcccg

SEQ ID NO: 1325214 - RNA, 17 nt, Mycobacterium tuberculosis H37Rv
uugacggucagccgcgg

SEQ ID NO: 1325215 - RNA, 19 nt, Mycobacterium tuberculosis H37Rv
uugacugaacucaacacca

SEQ ID NO: 1325216 - RNA, 19 nt, Mycobacterium tuberculosis H37Rv
uugacgccguugccgccgu

SEQ ID NO: 1325217 - RNA, 14 nt, Mycobacterium tuberculosis H37Rv
uugaccgcggugac

SEQ ID NO: 1325218 - RNA, 23 nt, Mycobacterium tuberculosis H37Rv
uugacccacgagagcgcuguccc

SEQ ID NO: 1325219 - RNA, 23 nt, Mycobacterium tuberculosis H37Rv
uugacccauggcuccgcccagga

SEQ ID NO: 1325220 - RNA, 24 nt, Mycobacterium tuberculosis H37Rv
uugacccccucguccugcgagagg

SEQ ID NO: 1325221 - RNA, 17 nt, Mycobacterium tuberculosis H37Rv
uugacaacccuguuguu

SEQ ID NO: 1325222 - RNA, 20 nt, Mycobacterium tuberculosis H37Rv
uugaccaaugugccggucac

SEQ ID NO: 1325223 - RNA, 15 nt, Mycobacterium tuberculosis H37Rv
uugacagcuuucuug

SEQ ID NO: 1325224 - RNA, 21 nt, Mycobacterium tuberculosis H37Rv
uugccuucuuggcgggagccu

SEQ ID NO: 1325225 - RNA, 14 nt, Mycobacterium tuberculosis H37Rv
uugcgcagcaccag

SEQ ID NO: 1325226 - RNA, 14 nt, Mycobacterium tuberculosis H37Rv
uugcgcagccgcag

SEQ ID NO: 1325227 - RNA, 13 nt, Mycobacterium tuberculosis H37Rv
uugcgcagcagcg

SEQ ID NO: 1325228 - RNA, 18 nt, Mycobacterium tuberculosis H37Rv
uugcgccgacaccgggcc

SEQ ID NO: 1325229 - RNA, 12 nt, Mycobacterium tuberculosis H37Rv
uugcgccagcgg

SEQ ID NO: 1325230 - RNA, 18 nt, Mycobacterium tuberculosis H37Rv
uugcgucgcgccugcccg

SEQ ID NO: 1325231 - RNA, 15 nt, Mycobacterium tuberculosis H37Rv
uugcguccauccgca

SEQ ID NO: 1325232 - RNA, 15 nt, Mycobacterium tuberculosis H37Rv
uugcucggcgagccu

SEQ ID NO: 1325233 - RNA, 23 nt, Mycobacterium tuberculosis H37Rv
uugcucggugaugcccagcgccg

SEQ ID NO: 1325234 - RNA, 16 nt, Mycobacterium tuberculosis H37Rv
uugcucagccggcccu

SEQ ID NO: 1325235 - RNA, 13 nt, Mycobacterium tuberculosis H37Rv
uugcucaccagac

SEQ ID NO: 1325236 - RNA, 16 nt, Mycobacterium tuberculosis H37Rv
uugcuccacaucggcu

SEQ ID NO: 1325237 - RNA, 13 nt, Mycobacterium tuberculosis H37Rv
uugccgaucaacc

SEQ ID NO: 1325238 - RNA, 13 nt, Mycobacterium tuberculosis H37Rv
uugccgaagccgg

SEQ ID NO: 1325239 - RNA, 18 nt, Mycobacterium tuberculosis H37Rv
uugccgaccgucacugau

SEQ ID NO: 1325240 - RNA, 21 nt, Mycobacterium tuberculosis H37Rv
uugcccguguuaaagaagccu

SEQ ID NO: 1325241 - RNA, 12 nt, Mycobacterium tuberculosis H37Rv
uugcccugcaac

SEQ ID NO: 1325242 - RNA, 14 nt, Mycobacterium tuberculosis H37Rv
uugccgccuuggcc

SEQ ID NO: 1325243 - RNA, 23 nt, Mycobacterium tuberculosis H37Rv
uugccgccguuaccgccguugcc

SEQ ID NO: 1325244 - RNA, 23 nt, Mycobacterium tuberculosis H37Rv
uugccgccguugccaccguagcc

SEQ ID NO: 1325245 - RNA, 13 nt, Mycobacterium tuberculosis H37Rv
uugccgccguccc

SEQ ID NO: 1325246 - RNA, 20 nt, Mycobacterium tuberculosis H37Rv
uugccgccgucgccgccgcu

SEQ ID NO: 1325247 - RNA, 18 nt, Mycobacterium tuberculosis H37Rv
uugccgccaucaccgccg

SEQ ID NO: 1325248 - RNA, 11 nt, Mycobacterium tuberculosis H37Rv
uugccgcccac

SEQ ID NO: 1325249 - RNA, 10 nt, Mycobacterium tuberculosis H37Rv
uugccgccgg

SEQ ID NO: 1325250 - RNA, 19 nt, Mycobacterium tuberculosis H37Rv
uugccgccggccaugugca

SEQ ID NO: 1325251 - RNA, 23 nt, Mycobacterium tuberculosis H37Rv
uugccgccgccuccgccgaggcc

SEQ ID NO: 1325252 - RNA, 10 nt, Mycobacterium tuberculosis H37Rv
uugccgccga

SEQ ID NO: 1325253 - RNA, 22 nt, Mycobacterium tuberculosis H37Rv
uugccgccgaacgccucugcga

SEQ ID NO: 1325254 - RNA, 16 nt, Mycobacterium tuberculosis H37Rv
uugccggcccaccgcc

SEQ ID NO: 1325255 - RNA, 17 nt, Mycobacterium tuberculosis H37Rv
uugccucggcgagguca

SEQ ID NO: 1325256 - RNA, 23 nt, Mycobacterium tuberculosis H37Rv
uugccggaguugucgacggccac

SEQ ID NO: 1325257 - RNA, 13 nt, Mycobacterium tuberculosis H37Rv
uugccaacgccca

SEQ ID NO: 1325258 - RNA, 12 nt, Mycobacterium tuberculosis H37Rv
uugccaccgccg

SEQ ID NO: 1325259 - RNA, 15 nt, Mycobacterium tuberculosis H37Rv
uugccaccagaaaca

SEQ ID NO: 1325260 - RNA, 13 nt, Mycobacterium tuberculosis H37Rv
uugccccgccuug

SEQ ID NO: 1325261 - RNA, 16 nt, Mycobacterium tuberculosis H37Rv
uugccccgccuuggcc

SEQ ID NO: 1325262 - RNA, 13 nt, Mycobacterium tuberculosis H37Rv
uugcccccagggc

SEQ ID NO: 1325263 - RNA, 12 nt, Mycobacterium tuberculosis H37Rv
uugcccagguga

SEQ ID NO: 1325264 - RNA, 21 nt, Mycobacterium tuberculosis H37Rv
uugcccagcaugaagucccgg

SEQ ID NO: 1325265 - RNA, 13 nt, Mycobacterium tuberculosis H37Rv
uugccaaagcccg

SEQ ID NO: 1325266 - RNA, 22 nt, Mycobacterium tuberculosis H37Rv
uugaugcauccagaaguaggcg

SEQ ID NO: 1325267 - RNA, 19 nt, Mycobacterium tuberculosis H37Rv
uugaugaucugcagcucca

SEQ ID NO: 1325268 - RNA, 14 nt, Mycobacterium tuberculosis H37Rv
uugauccccagcuc

SEQ ID NO: 1325269 - RNA, 21 nt, Mycobacterium tuberculosis H37Rv
uugagacgccggggaaccuug

SEQ ID NO: 1325270 - RNA, 15 nt, Mycobacterium tuberculosis H37Rv
uuccgcggguuugau

SEQ ID NO: 1325271 - RNA, 19 nt, Mycobacterium tuberculosis H37Rv
uuccgcucguucgugcagc

SEQ ID NO: 1325272 - RNA, 15 nt, Mycobacterium tuberculosis H37Rv
uuccuccggcagcag

SEQ ID NO: 1325273 - RNA, 16 nt, Mycobacterium tuberculosis H37Rv
uuccucgagccagcuc

SEQ ID NO: 1325274 - RNA, 17 nt, Mycobacterium tuberculosis H37Rv
uuccucgagccagcucc

SEQ ID NO: 1325275 - RNA, 18 nt, Mycobacterium tuberculosis H37Rv
uuccucgagccagcuccg

SEQ ID NO: 1325276 - RNA, 14 nt, Mycobacterium tuberculosis H37Rv
uuccuccggcagca

SEQ ID NO: 1325277 - RNA, 19 nt, Mycobacterium tuberculosis H37Rv
uuccucaaggucggccagg

SEQ ID NO: 1325278 - RNA, 22 nt, Mycobacterium tuberculosis H37Rv
uuccucaaggucggccaggcug

SEQ ID NO: 1325279 - RNA, 17 nt, Mycobacterium tuberculosis H37Rv
uuccuggcgcagcgccu

SEQ ID NO: 1325280 - RNA, 16 nt, Mycobacterium tuberculosis H37Rv
uuccuggguugugccg

SEQ ID NO: 1325281 - RNA, 13 nt, Mycobacterium tuberculosis H37Rv
uucccgaaccccg

SEQ ID NO: 1325282 - RNA, 19 nt, Mycobacterium tuberculosis H37Rv
uucccgaguugcccucugg

SEQ ID NO: 1325283 - RNA, 13 nt, Mycobacterium tuberculosis H37Rv
uuccgaagcccgg

SEQ ID NO: 1325284 - RNA, 17 nt, Mycobacterium tuberculosis H37Rv
uucccgcggacagcccg

SEQ ID NO: 1325285 - RNA, 15 nt, Mycobacterium tuberculosis H37Rv
uuccgaggagggccg

SEQ ID NO: 1325286 - RNA, 14 nt, Mycobacterium tuberculosis H37Rv
uucccacuggaggu

SEQ ID NO: 1325287 - RNA, 19 nt, Mycobacterium tuberculosis H37Rv
uucccaugcgggucugaca

SEQ ID NO: 1325288 - RNA, 20 nt, Mycobacterium tuberculosis H37Rv
uucccaucccucgguguaca

SEQ ID NO: 1325289 - RNA, 17 nt, Mycobacterium tuberculosis H37Rv
uucccaccaccaccgcc

SEQ ID NO: 1325290 - RNA, 14 nt, Mycobacterium tuberculosis H37Rv
uucccaacacagcc

SEQ ID NO: 1325291 - RNA, 15 nt, Mycobacterium tuberculosis H37Rv
uuccagggcggccau

SEQ ID NO: 1325292 - RNA, 21 nt, Mycobacterium tuberculosis H37Rv
uuccagcggguggccaucacc

SEQ ID NO: 1325293 - RNA, 19 nt, Mycobacterium tuberculosis H37Rv
uuccaucacggaccaggcc

SEQ ID NO: 1325294 - RNA, 15 nt, Mycobacterium tuberculosis H37Rv
uuccaucgcgaccuc

SEQ ID NO: 1325295 - RNA, 19 nt, Mycobacterium tuberculosis H37Rv
uuccauucgcgguccauca

SEQ ID NO: 1325296 - RNA, 20 nt, Mycobacterium tuberculosis H37Rv
uucaggccgaggaaggagcc

SEQ ID NO: 1325297 - RNA, 21 nt, Mycobacterium tuberculosis H37Rv
uuccacggguggugccagguc

SEQ ID NO: 1325298 - RNA, 15 nt, Mycobacterium tuberculosis H37Rv
uuccaccguuagcca

SEQ ID NO: 1325299 - RNA, 20 nt, Mycobacterium tuberculosis H37Rv
uuccacugggccugccaguc

SEQ ID NO: 1325300 - RNA, 16 nt, Mycobacterium tuberculosis H37Rv
uuccagcccgagcaga

SEQ ID NO: 1325301 - RNA, 15 nt, Mycobacterium tuberculosis H37Rv
uuccagcaguacacc

SEQ ID NO: 1325302 - RNA, 21 nt, Mycobacterium tuberculosis H37Rv
uuccagcaucaguuugacgcc

SEQ ID NO: 1325303 - RNA, 18 nt, Mycobacterium tuberculosis H37Rv
uucucguagucaaccaag

SEQ ID NO: 1325304 - RNA, 14 nt, Mycobacterium tuberculosis H37Rv
uucucuagcucgaa

SEQ ID NO: 1325305 - RNA, 19 nt, Mycobacterium tuberculosis H37Rv
uucucuagcucgaacaggu

SEQ ID NO: 1325306 - RNA, 17 nt, Mycobacterium tuberculosis H37Rv
uucucgguaccaccggc

SEQ ID NO: 1325307 - RNA, 12 nt, Mycobacterium tuberculosis H37Rv
uucucgcuguug

SEQ ID NO: 1325308 - RNA, 14 nt, Mycobacterium tuberculosis H37Rv
uucugcaccagcuc

SEQ ID NO: 1325309 - RNA, 17 nt, Mycobacterium tuberculosis H37Rv
uucggugagcgggagga

SEQ ID NO: 1325310 - RNA, 12 nt, Mycobacterium tuberculosis H37Rv
uucggucggccu

SEQ ID NO: 1325311 - RNA, 22 nt, Mycobacterium tuberculosis H37Rv
uucggucugguugggccagcuc

SEQ ID NO: 1325312 - RNA, 20 nt, Mycobacterium tuberculosis H37Rv
uucggaaaaccgcaccgucc

SEQ ID NO: 1325313 - RNA, 14 nt, Mycobacterium tuberculosis H37Rv
uucggagucacgca

SEQ ID NO: 1325314 - RNA, 16 nt, Mycobacterium tuberculosis H37Rv
uucgguggagggcgag

SEQ ID NO: 1325315 - RNA, 14 nt, Mycobacterium tuberculosis H37Rv
uucggugccagcag

SEQ ID NO: 1325316 - RNA, 14 nt, Mycobacterium tuberculosis H37Rv
uucguagucucgac

SEQ ID NO: 1325317 - RNA, 20 nt, Mycobacterium tuberculosis H37Rv
uucgccgacuagcugggguc

SEQ ID NO: 1325318 - RNA, 16 nt, Mycobacterium tuberculosis H37Rv
uucgccggaauacacc

SEQ ID NO: 1325319 - RNA, 23 nt, Mycobacterium tuberculosis H37Rv
uucgccggaucgaaacucagccc

SEQ ID NO: 1325320 - RNA, 18 nt, Mycobacterium tuberculosis H37Rv
uucgccgaguugaccgcc

SEQ ID NO: 1325321 - RNA, 21 nt, Mycobacterium tuberculosis H37Rv
uucgccgcgaaugucgccgcc

SEQ ID NO: 1325322 - RNA, 15 nt, Mycobacterium tuberculosis H37Rv
uucgcuaccuucuug

SEQ ID NO: 1325323 - RNA, 18 nt, Mycobacterium tuberculosis H37Rv
uucgcacccguucgugag

SEQ ID NO: 1325324 - RNA, 20 nt, Mycobacterium tuberculosis H37Rv
uggagaagauuuucucggug

SEQ ID NO: 1325325 - RNA, 22 nt, Mycobacterium tuberculosis H37Rv
uggacuccggucagcgcggcga

SEQ ID NO: 1325326 - RNA, 23 nt, Mycobacterium tuberculosis H37Rv
uggacugggucgccuccugccgc

SEQ ID NO: 1325327 - RNA, 18 nt, Mycobacterium tuberculosis H37Rv
uggacuucagcaggccca

SEQ ID NO: 1325328 - RNA, 13 nt, Mycobacterium tuberculosis H37Rv
uggacggccaggu

SEQ ID NO: 1325329 - RNA, 16 nt, Mycobacterium tuberculosis H37Rv
uggacgcgggccgacc

SEQ ID NO: 1325330 - RNA, 14 nt, Mycobacterium tuberculosis H37Rv
uggacgcagaguca

SEQ ID NO: 1325331 - RNA, 19 nt, Mycobacterium tuberculosis H37Rv
uggacgccuugcacaagcu

SEQ ID NO: 1325332 - RNA, 19 nt, Mycobacterium tuberculosis H37Rv
uggagcucaucgacgagcc

SEQ ID NO: 1325333 - RNA, 21 nt, Mycobacterium tuberculosis H37Rv
uggagcucaucgacgagccgc

SEQ ID NO: 1325334 - RNA, 21 nt, Mycobacterium tuberculosis H37Rv
uggagcuuggcccagcguguc

SEQ ID NO: 1325335 - RNA, 22 nt, Mycobacterium tuberculosis H37Rv
uggagggaaucuccggcuggcc

SEQ ID NO: 1325336 - RNA, 11 nt, Mycobacterium tuberculosis H37Rv
uggagcacagc

SEQ ID NO: 1325337 - RNA, 19 nt, Mycobacterium tuberculosis H37Rv
uggagcgccagccgcugcc

SEQ ID NO: 1325338 - RNA, 15 nt, Mycobacterium tuberculosis H37Rv
uggagaucgccgccg

SEQ ID NO: 1325339 - RNA, 15 nt, Mycobacterium tuberculosis H37Rv
uggauccggccacca

SEQ ID NO: 1325340 - RNA, 19 nt, Mycobacterium tuberculosis H37Rv
uggauccccugauggaccc

SEQ ID NO: 1325341 - RNA, 22 nt, Mycobacterium tuberculosis H37Rv
uggaucaucccgaccagcagau

SEQ ID NO: 1325342 - RNA, 18 nt, Mycobacterium tuberculosis H37Rv
uggauccaaccgugcucu

SEQ ID NO: 1325343 - RNA, 20 nt, Mycobacterium tuberculosis H37Rv
uggaucauguucggccacca

SEQ ID NO: 1325344 - RNA, 16 nt, Mycobacterium tuberculosis H37Rv
uggauggcgcucacaa

SEQ ID NO: 1325345 - RNA, 16 nt, Mycobacterium tuberculosis H37Rv
uggaugcccguagacg

SEQ ID NO: 1325346 - RNA, 22 nt, Mycobacterium tuberculosis H37Rv
uggaugcccguagacgccgagc

SEQ ID NO: 1325347 - RNA, 19 nt, Mycobacterium tuberculosis H37Rv
uggaucuuggccagcagcg

SEQ ID NO: 1325348 - RNA, 15 nt, Mycobacterium tuberculosis H37Rv
uggaucuuggccagc

SEQ ID NO: 1325349 - RNA, 13 nt, Mycobacterium tuberculosis H37Rv
uggaucuucaccu

SEQ ID NO: 1325350 - RNA, 19 nt, Mycobacterium tuberculosis H37Rv
uggaucgucgggagcacac

SEQ ID NO: 1325351 - RNA, 19 nt, Mycobacterium tuberculosis H37Rv
uggaucgucucgcgcaccu

SEQ ID NO: 1325352 - RNA, 14 nt, Mycobacterium tuberculosis H37Rv
uggaucugccucuc

SEQ ID NO: 1325353 - RNA, 19 nt, Mycobacterium tuberculosis H37Rv
uggagugaggcugugcccc

SEQ ID NO: 1325354 - RNA, 22 nt, Mycobacterium tuberculosis H37Rv
uggagugaggcugugccccagg

SEQ ID NO: 1325355 - RNA, 20 nt, Mycobacterium tuberculosis H37Rv
uggaguggugauccagccgu

SEQ ID NO: 1325356 - RNA, 22 nt, Mycobacterium tuberculosis H37Rv
uggaguaggugugcgggaagaa

SEQ ID NO: 1325357 - RNA, 13 nt, Mycobacterium tuberculosis H37Rv
uggaguuggcugc

SEQ ID NO: 1325358 - RNA, 14 nt, Mycobacterium tuberculosis H37Rv
uggccaccgcccag

SEQ ID NO: 1325359 - RNA, 19 nt, Mycobacterium tuberculosis H37Rv
uggccaccgaacgcggcca

SEQ ID NO: 1325360 - RNA, 24 nt, Mycobacterium tuberculosis H37Rv
uggccacggaaguaucgccggccg

SEQ ID NO: 1325361 - RNA, 18 nt, Mycobacterium tuberculosis H37Rv
uggccacgcccaggcaag

SEQ ID NO: 1325362 - RNA, 21 nt, Mycobacterium tuberculosis H37Rv
uggccacucacauuggccagg

SEQ ID NO: 1325363 - RNA, 18 nt, Mycobacterium tuberculosis H37Rv
uggccauguccaccagcg

SEQ ID NO: 1325364 - RNA, 18 nt, Mycobacterium tuberculosis H37Rv
uggccagacccaccaccg

SEQ ID NO: 1325365 - RNA, 22 nt, Mycobacterium tuberculosis H37Rv
uggccagacccaccaccgcaac

SEQ ID NO: 1325366 - RNA, 14 nt, Mycobacterium tuberculosis H37Rv
uggccagcacaccg

SEQ ID NO: 1325367 - RNA, 13 nt, Mycobacterium tuberculosis H37Rv
uggccccggcucu

SEQ ID NO: 1325368 - RNA, 23 nt, Mycobacterium tuberculosis H37Rv
uggccccaccgaacgugugggcc

SEQ ID NO: 1325369 - RNA, 22 nt, Mycobacterium tuberculosis H37Rv
uggccccgggcggugaggcagc

SEQ ID NO: 1325370 - RNA, 23 nt, Mycobacterium tuberculosis H37Rv
uggcccgaguuggcgaagcccga

SEQ ID NO: 1325371 - RNA, 22 nt, Mycobacterium tuberculosis H37Rv
uggcccacauguccagcguccu

SEQ ID NO: 1325372 - RNA, 20 nt, Mycobacterium tuberculosis H37Rv
uggcccaguccgcuggccau

SEQ ID NO: 1325373 - RNA, 21 nt, Mycobacterium tuberculosis H37Rv
uggcccaguccgcuggccaug

SEQ ID NO: 1325374 - RNA, 14 nt, Mycobacterium tuberculosis H37Rv
uggcaugcaggugg

SEQ ID NO: 1325375 - RNA, 19 nt, Mycobacterium tuberculosis H37Rv
uggcaugccggcgugcggc

SEQ ID NO: 1325376 - RNA, 20 nt, Mycobacterium tuberculosis H37Rv
uggccaccaggggaccgcgg

SEQ ID NO: 1325377 - RNA, 12 nt, Mycobacterium tuberculosis H37Rv
uggccacccggc

SEQ ID NO: 1325378 - RNA, 18 nt, Mycobacterium tuberculosis H37Rv
uggccaccaucgccgccg

SEQ ID NO: 1325379 - RNA, 22 nt, Mycobacterium tuberculosis H37Rv
uggccacccgcggaauccgcgg

SEQ ID NO: 1325380 - RNA, 13 nt, Mycobacterium tuberculosis H37Rv
uggccaccaucac

SEQ ID NO: 1325381 - RNA, 22 nt, Mycobacterium tuberculosis H37Rv
uggcauucgauaccgcaccaaa

SEQ ID NO: 1325382 - RNA, 19 nt, Mycobacterium tuberculosis H37Rv
uggcauccaaaaucgccug

SEQ ID NO: 1325383 - RNA, 15 nt, Mycobacterium tuberculosis H37Rv
uggcauccagcagcg

SEQ ID NO: 1325384 - RNA, 22 nt, Mycobacterium tuberculosis H37Rv
uggcaucccgggcaguccaggc

SEQ ID NO: 1325385 - RNA, 23 nt, Mycobacterium tuberculosis H37Rv
uggcaucccgggcaguccaggca

SEQ ID NO: 1325386 - RNA, 17 nt, Mycobacterium tuberculosis H37Rv
uggcauccgccccgccc

SEQ ID NO: 1325387 - RNA, 14 nt, Mycobacterium tuberculosis H37Rv
uggcaucgccucca

SEQ ID NO: 1325388 - RNA, 18 nt, Mycobacterium tuberculosis H37Rv
uggcaucgcgagccagcu

SEQ ID NO: 1325389 - RNA, 13 nt, Mycobacterium tuberculosis H37Rv
uggcaguccagcc

SEQ ID NO: 1325390 - RNA, 14 nt, Mycobacterium tuberculosis H37Rv
uggcaguggcgcgg

SEQ ID NO: 1325391 - RNA, 13 nt, Mycobacterium tuberculosis H37Rv
uggcaggugccuu

SEQ ID NO: 1325392 - RNA, 13 nt, Mycobacterium tuberculosis H37Rv
uggcagggaacca

SEQ ID NO: 1325393 - RNA, 12 nt, Mycobacterium tuberculosis H37Rv
uggcagagccgc

SEQ ID NO: 1325394 - RNA, 22 nt, Mycobacterium tuberculosis H37Rv
uggcagagccgccguugccgcc

SEQ ID NO: 1325395 - RNA, 17 nt, Mycobacterium tuberculosis H37Rv
uggcaagggccgacguc

SEQ ID NO: 1325396 - RNA, 18 nt, Mycobacterium tuberculosis H37Rv
uggcacggccccugccac

SEQ ID NO: 1325397 - RNA, 14 nt, Mycobacterium tuberculosis H37Rv
uggauuuuggcuga

SEQ ID NO: 1325398 - RNA, 16 nt, Mycobacterium tuberculosis H37Rv
uggauggccgccaggc

SEQ ID NO: 1325399 - RNA, 22 nt, Mycobacterium tuberculosis H37Rv
uggauguaguuggcgaccugcg

SEQ ID NO: 1325400 - RNA, 14 nt, Mycobacterium tuberculosis H37Rv
uggauguguaggug

SEQ ID NO: 1325401 - RNA, 17 nt, Mycobacterium tuberculosis H37Rv
ugggccagugaaaccac

SEQ ID NO: 1325402 - RNA, 21 nt, Mycobacterium tuberculosis H37Rv
ugggccaugcuaggaccacca

SEQ ID NO: 1325403 - RNA, 15 nt, Mycobacterium tuberculosis H37Rv
ugggcccagcggccg

SEQ ID NO: 1325404 - RNA, 19 nt, Mycobacterium tuberculosis H37Rv
ugggcccagcggccgcgau

SEQ ID NO: 1325405 - RNA, 13 nt, Mycobacterium tuberculosis H37Rv
ugggccagcuccu

SEQ ID NO: 1325406 - RNA, 15 nt, Mycobacterium tuberculosis H37Rv
ugggccaggcccagc

SEQ ID NO: 1325407 - RNA, 14 nt, Mycobacterium tuberculosis H37Rv
ugggccgagcgcgc

SEQ ID NO: 1325408 - RNA, 17 nt, Mycobacterium tuberculosis H37Rv
ugggcccgccagcccag

SEQ ID NO: 1325409 - RNA, 16 nt, Mycobacterium tuberculosis H37Rv
ugggcccgccagccca

SEQ ID NO: 1325410 - RNA, 15 nt, Mycobacterium tuberculosis H37Rv
ugggcccgccagccc

SEQ ID NO: 1325411 - RNA, 22 nt, Mycobacterium tuberculosis H37Rv
ugggccccgaucccgaggggag

SEQ ID NO: 1325412 - RNA, 19 nt, Mycobacterium tuberculosis H37Rv
ugggccuccaccgcgucca

SEQ ID NO: 1325413 - RNA, 15 nt, Mycobacterium tuberculosis H37Rv
ugggcaucaccgccg

SEQ ID NO: 1325414 - RNA, 16 nt, Mycobacterium tuberculosis H37Rv
ugggcauugcggcgcg

SEQ ID NO: 1325415 - RNA, 21 nt, Mycobacterium tuberculosis H37Rv
ugggcagcgcgcccgacaccc

SEQ ID NO: 1325416 - RNA, 16 nt, Mycobacterium tuberculosis H37Rv
ugggcugaggguggac

SEQ ID NO: 1325417 - RNA, 13 nt, Mycobacterium tuberculosis H37Rv
ugggcgagaccgc

SEQ ID NO: 1325418 - RNA, 23 nt, Mycobacterium tuberculosis H37Rv
ugggcgagaccgcgagcagcaca

SEQ ID NO: 1325419 - RNA, 14 nt, Mycobacterium tuberculosis H37Rv
ugggcgagcugcug

SEQ ID NO: 1325420 - RNA, 20 nt, Mycobacterium tuberculosis H37Rv
ugggcgagaaguccgggccc

SEQ ID NO: 1325421 - RNA, 23 nt, Mycobacterium tuberculosis H37Rv
ugggcgagaaguccgggccccuu

SEQ ID NO: 1325422 - RNA, 22 nt, Mycobacterium tuberculosis H37Rv
ugggcgacgcggcgccgccauc

SEQ ID NO: 1325423 - RNA, 18 nt, Mycobacterium tuberculosis H37Rv
uggggaacagcagcgcac

SEQ ID NO: 1325424 - RNA, 13 nt, Mycobacterium tuberculosis H37Rv
ugggcuuggcugu

SEQ ID NO: 1325425 - RNA, 12 nt, Mycobacterium tuberculosis H37Rv
ugggcuuggugc

SEQ ID NO: 1325426 - RNA, 14 nt, Mycobacterium tuberculosis H37Rv
ugggguuguuggcg

SEQ ID NO: 1325427 - RNA, 12 nt, Mycobacterium tuberculosis H37Rv
ugggguggcagc

SEQ ID NO: 1325428 - RNA, 21 nt, Mycobacterium tuberculosis H37Rv
uggcugcgccgaacaccacac

SEQ ID NO: 1325429 - RNA, 16 nt, Mycobacterium tuberculosis H37Rv
uggcuccggccagggg

SEQ ID NO: 1325430 - RNA, 17 nt, Mycobacterium tuberculosis H37Rv
uggcuccggccagggga

SEQ ID NO: 1325431 - RNA, 22 nt, Mycobacterium tuberculosis H37Rv
uggcucuguagcgucgcaccca

SEQ ID NO: 1325432 - RNA, 13 nt, Mycobacterium tuberculosis H37Rv
uggcucgccgaac

SEQ ID NO: 1325433 - RNA, 16 nt, Mycobacterium tuberculosis H37Rv
uggcugacgauuucca

SEQ ID NO: 1325434 - RNA, 22 nt, Mycobacterium tuberculosis H37Rv
uggcugacgauuuccaugcugg

SEQ ID NO: 1325435 - RNA, 17 nt, Mycobacterium tuberculosis H37Rv
uggcuguccgcgggccg

SEQ ID NO: 1325436 - RNA, 21 nt, Mycobacterium tuberculosis H37Rv
ugggacaggacgacuggaagg

SEQ ID NO: 1325437 - RNA, 18 nt, Mycobacterium tuberculosis H37Rv
ugggacaggucggcaucc

SEQ ID NO: 1325438 - RNA, 17 nt, Mycobacterium tuberculosis H37Rv
uggcgguuccggccggc

SEQ ID NO: 1325439 - RNA, 16 nt, Mycobacterium tuberculosis H37Rv
uggcggcgccgcagau

SEQ ID NO: 1325440 - RNA, 13 nt, Mycobacterium tuberculosis H37Rv
uggcggcgcugcg

SEQ ID NO: 1325441 - RNA, 16 nt, Mycobacterium tuberculosis H37Rv
uggcggcggugcagca

SEQ ID NO: 1325442 - RNA, 19 nt, Mycobacterium tuberculosis H37Rv
uggcgcguggucgggaacc

SEQ ID NO: 1325443 - RNA, 12 nt, Mycobacterium tuberculosis H37Rv
uggcggcccggu

SEQ ID NO: 1325444 - RNA, 21 nt, Mycobacterium tuberculosis H37Rv
uggcggccaguucggcggccg

SEQ ID NO: 1325445 - RNA, 19 nt, Mycobacterium tuberculosis H37Rv
uggcggccuccuccccgac

SEQ ID NO: 1325446 - RNA, 14 nt, Mycobacterium tuberculosis H37Rv
uggcggcgcgcgcu

SEQ ID NO: 1325447 - RNA, 14 nt, Mycobacterium tuberculosis H37Rv
uggcgcggacccgc

SEQ ID NO: 1325448 - RNA, 11 nt, Mycobacterium tuberculosis H37Rv
uggcgcggccg

SEQ ID NO: 1325449 - RNA, 15 nt, Mycobacterium tuberculosis H37Rv
uggcgcggggccgcc

SEQ ID NO: 1325450 - RNA, 17 nt, Mycobacterium tuberculosis H37Rv
uggcgcggcgagcacgc

SEQ ID NO: 1325451 - RNA, 19 nt, Mycobacterium tuberculosis H37Rv
uggcgcggagcugauugug

SEQ ID NO: 1325452 - RNA, 13 nt, Mycobacterium tuberculosis H37Rv
uggcgcggggccg

SEQ ID NO: 1325453 - RNA, 13 nt, Mycobacterium tuberculosis H37Rv
uggcgcccgccgg

SEQ ID NO: 1325454 - RNA, 17 nt, Mycobacterium tuberculosis H37Rv
uggcgcccauggccacc

SEQ ID NO: 1325455 - RNA, 14 nt, Mycobacterium tuberculosis H37Rv
uggcgucagcagca

SEQ ID NO: 1325456 - RNA, 15 nt, Mycobacterium tuberculosis H37Rv
uggcguagugcagcu

SEQ ID NO: 1325457 - RNA, 21 nt, Mycobacterium tuberculosis H37Rv
uggcguuugaugcgggcggca

SEQ ID NO: 1325458 - RNA, 18 nt, Mycobacterium tuberculosis H37Rv
uggcgucgaugcgggcca

SEQ ID NO: 1325459 - RNA, 13 nt, Mycobacterium tuberculosis H37Rv
uggcuacgcccca

SEQ ID NO: 1325460 - RNA, 18 nt, Mycobacterium tuberculosis H37Rv
uggcucaccgacaugacg

SEQ ID NO: 1325461 - RNA, 14 nt, Mycobacterium tuberculosis H37Rv
uggcucaucgaugc

SEQ ID NO: 1325462 - RNA, 23 nt, Mycobacterium tuberculosis H37Rv
uggcuaguugggugggugcagca

SEQ ID NO: 1325463 - RNA, 22 nt, Mycobacterium tuberculosis H37Rv
uggcuauaaaccacgcuggugu

SEQ ID NO: 1325464 - RNA, 21 nt, Mycobacterium tuberculosis H37Rv
uggcuauccaccugcuggggc

SEQ ID NO: 1325465 - RNA, 21 nt, Mycobacterium tuberculosis H37Rv
uggcuacgggccgcgguaccc

SEQ ID NO: 1325466 - RNA, 22 nt, Mycobacterium tuberculosis H37Rv
uggcuagcagguacucgcccca

SEQ ID NO: 1325467 - RNA, 19 nt, Mycobacterium tuberculosis H37Rv
uggcgcaacccccgaagac

SEQ ID NO: 1325468 - RNA, 20 nt, Mycobacterium tuberculosis H37Rv
uggcgacucgugucugccuc

SEQ ID NO: 1325469 - RNA, 12 nt, Mycobacterium tuberculosis H37Rv
uggcgaccuggu

SEQ ID NO: 1325470 - RNA, 20 nt, Mycobacterium tuberculosis H37Rv
uggcgacggugcgcuggaug

SEQ ID NO: 1325471 - RNA, 15 nt, Mycobacterium tuberculosis H37Rv
uggcgcaccggcguc

SEQ ID NO: 1325472 - RNA, 21 nt, Mycobacterium tuberculosis H37Rv
uggcgccaguucggcgggagc

SEQ ID NO: 1325473 - RNA, 14 nt, Mycobacterium tuberculosis H37Rv
uggcgccaccaguc

SEQ ID NO: 1325474 - RNA, 15 nt, Mycobacterium tuberculosis H37Rv
uggcgccaccggccg

SEQ ID NO: 1325475 - RNA, 16 nt, Mycobacterium tuberculosis H37Rv
uggcgccaaaaaggau

SEQ ID NO: 1325476 - RNA, 16 nt, Mycobacterium tuberculosis H37Rv
uggccgacgcugcuga

SEQ ID NO: 1325477 - RNA, 21 nt, Mycobacterium tuberculosis H37Rv
uggccgaacagcaggccucca

SEQ ID NO: 1325478 - RNA, 18 nt, Mycobacterium tuberculosis H37Rv
uggccgaacgacgggucc

SEQ ID NO: 1325479 - RNA, 22 nt, Mycobacterium tuberculosis H37Rv
uggcccguucgaccguguaacc

SEQ ID NO: 1325480 - RNA, 18 nt, Mycobacterium tuberculosis H37Rv
uggcccguuggcagcaca

SEQ ID NO: 1325481 - RNA, 12 nt, Mycobacterium tuberculosis H37Rv
uggcccgggccc

SEQ ID NO: 1325482 - RNA, 17 nt, Mycobacterium tuberculosis H37Rv
uggcccgggccaccgga

SEQ ID NO: 1325483 - RNA, 21 nt, Mycobacterium tuberculosis H37Rv
uggcccgggcccgcgggauca

SEQ ID NO: 1325484 - RNA, 21 nt, Mycobacterium tuberculosis H37Rv
uggcccggacaugcgggcagc

SEQ ID NO: 1325485 - RNA, 22 nt, Mycobacterium tuberculosis H37Rv
uggcccggacaugcgggcagca

SEQ ID NO: 1325486 - RNA, 22 nt, Mycobacterium tuberculosis H37Rv
uggcccggcgaaagcuugggcg

SEQ ID NO: 1325487 - RNA, 16 nt, Mycobacterium tuberculosis H37Rv
uggccccgguggugcu

SEQ ID NO: 1325488 - RNA, 16 nt, Mycobacterium tuberculosis H37Rv
uggcgaccaccgcguc

SEQ ID NO: 1325489 - RNA, 19 nt, Mycobacterium tuberculosis H37Rv
uggcgacaucucggucaga

SEQ ID NO: 1325490 - RNA, 22 nt, Mycobacterium tuberculosis H37Rv
uggccugucaggcggcggaccc

SEQ ID NO: 1325491 - RNA, 23 nt, Mycobacterium tuberculosis H37Rv
uggccuucugguucggguuggag

SEQ ID NO: 1325492 - RNA, 17 nt, Mycobacterium tuberculosis H37Rv
uggccuugacagcuuuc

SEQ ID NO: 1325493 - RNA, 19 nt, Mycobacterium tuberculosis H37Rv
uggccugcccagcaccacc

SEQ ID NO: 1325494 - RNA, 13 nt, Mycobacterium tuberculosis H37Rv
uggccugcccagc

SEQ ID NO: 1325495 - RNA, 20 nt, Mycobacterium tuberculosis H37Rv
uggccugccauaggcccacg

SEQ ID NO: 1325496 - RNA, 13 nt, Mycobacterium tuberculosis H37Rv
uggccugcaacgc

SEQ ID NO: 1325497 - RNA, 16 nt, Mycobacterium tuberculosis H37Rv
ugguuccagaggcccg

SEQ ID NO: 1325498 - RNA, 17 nt, Mycobacterium tuberculosis H37Rv
ugguugaaccgguacaa

SEQ ID NO: 1325499 - RNA, 14 nt, Mycobacterium tuberculosis H37Rv
ugguugaaccggua

SEQ ID NO: 1325500 - RNA, 22 nt, Mycobacterium tuberculosis H37Rv
ugguugaaccagucgacccagc

SEQ ID NO: 1325501 - RNA, 19 nt, Mycobacterium tuberculosis H37Rv
ugguucggcgucgacccag

SEQ ID NO: 1325502 - RNA, 14 nt, Mycobacterium tuberculosis H37Rv
ugguucgcacaccu

SEQ ID NO: 1325503 - RNA, 23 nt, Mycobacterium tuberculosis H37Rv
ugguucggcgucgacccagaaca

SEQ ID NO: 1325504 - RNA, 15 nt, Mycobacterium tuberculosis H37Rv
ugguugugucggccu

SEQ ID NO: 1325505 - RNA, 16 nt, Mycobacterium tuberculosis H37Rv
ugguugggccagcucc

SEQ ID NO: 1325506 - RNA, 16 nt, Mycobacterium tuberculosis H37Rv
uguacauugccgaccc

SEQ ID NO: 1325507 - RNA, 14 nt, Mycobacterium tuberculosis H37Rv
uguacgcccgcucg

SEQ ID NO: 1325508 - RNA, 15 nt, Mycobacterium tuberculosis H37Rv
uggugggaucgcagc

SEQ ID NO: 1325509 - RNA, 21 nt, Mycobacterium tuberculosis H37Rv
uggugggggagcggccgccgc

SEQ ID NO: 1325510 - RNA, 18 nt, Mycobacterium tuberculosis H37Rv
ugguggcgguguugcucc

SEQ ID NO: 1325511 - RNA, 12 nt, Mycobacterium tuberculosis H37Rv
ugguggcccggc

SEQ ID NO: 1325512 - RNA, 16 nt, Mycobacterium tuberculosis H37Rv
ugguggcccgggccac

SEQ ID NO: 1325513 - RNA, 23 nt, Mycobacterium tuberculosis H37Rv
ugguggaccucacugugguaggc

SEQ ID NO: 1325514 - RNA, 16 nt, Mycobacterium tuberculosis H37Rv
ugguggcagcgcaccc

SEQ ID NO: 1325515 - RNA, 17 nt, Mycobacterium tuberculosis H37Rv
ugguggcccgggccacc

SEQ ID NO: 1325516 - RNA, 18 nt, Mycobacterium tuberculosis H37Rv
ugguggcccgggccaccg

SEQ ID NO: 1325517 - RNA, 14 nt, Mycobacterium tuberculosis H37Rv
ugguggcagcgcac

SEQ ID NO: 1325518 - RNA, 12 nt, Mycobacterium tuberculosis H37Rv
ugguggccacca

SEQ ID NO: 1325519 - RNA, 12 nt, Mycobacterium tuberculosis H37Rv
uggugguggagu

SEQ ID NO: 1325520 - RNA, 15 nt, Mycobacterium tuberculosis H37Rv
ugguggugccgaccu

SEQ ID NO: 1325521 - RNA, 22 nt, Mycobacterium tuberculosis H37Rv
ugguguacccgccucgggccgg

SEQ ID NO: 1325522 - RNA, 16 nt, Mycobacterium tuberculosis H37Rv
ugguguacugcugcuu

SEQ ID NO: 1325523 - RNA, 14 nt, Mycobacterium tuberculosis H37Rv
ugguggucaccacc

SEQ ID NO: 1325524 - RNA, 14 nt, Mycobacterium tuberculosis H37Rv
ugguggucgggcgc

SEQ ID NO: 1325525 - RNA, 18 nt, Mycobacterium tuberculosis H37Rv
ugguggugccaaccuggg

SEQ ID NO: 1325526 - RNA, 14 nt, Mycobacterium tuberculosis H37Rv
ugguggugccaacg

SEQ ID NO: 1325527 - RNA, 12 nt, Mycobacterium tuberculosis H37Rv
uggugugcagca

SEQ ID NO: 1325528 - RNA, 13 nt, Mycobacterium tuberculosis H37Rv
ugguguggggcgg

SEQ ID NO: 1325529 - RNA, 14 nt, Mycobacterium tuberculosis H37Rv
ugguguccaccacc

SEQ ID NO: 1325530 - RNA, 22 nt, Mycobacterium tuberculosis H37Rv
uggugugauacagcgccagggg

SEQ ID NO: 1325531 - RNA, 14 nt, Mycobacterium tuberculosis H37Rv
ugguguugaugagc

SEQ ID NO: 1325532 - RNA, 23 nt, Mycobacterium tuberculosis H37Rv
ugguguugaugagccgauccagg

SEQ ID NO: 1325533 - RNA, 21 nt, Mycobacterium tuberculosis H37Rv
ugguuagaggauggucagcag

SEQ ID NO: 1325534 - RNA, 19 nt, Mycobacterium tuberculosis H37Rv
ugguuacucaccaaccgca

SEQ ID NO: 1325535 - RNA, 16 nt, Mycobacterium tuberculosis H37Rv
uggugccgccugugcc

SEQ ID NO: 1325536 - RNA, 17 nt, Mycobacterium tuberculosis H37Rv
uggugccgucagguucu

SEQ ID NO: 1325537 - RNA, 19 nt, Mycobacterium tuberculosis H37Rv
uggugccggucaccucgcc

SEQ ID NO: 1325538 - RNA, 14 nt, Mycobacterium tuberculosis H37Rv
uggugccgacccgc

SEQ ID NO: 1325539 - RNA, 21 nt, Mycobacterium tuberculosis H37Rv
uggugcccgugugcagccagc

SEQ ID NO: 1325540 - RNA, 16 nt, Mycobacterium tuberculosis H37Rv
uggugcccuugaagaa

SEQ ID NO: 1325541 - RNA, 17 nt, Mycobacterium tuberculosis H37Rv
uggugcccuugaagaaa

SEQ ID NO: 1325542 - RNA, 12 nt, Mycobacterium tuberculosis H37Rv
uggugccgaccc

SEQ ID NO: 1325543 - RNA, 19 nt, Mycobacterium tuberculosis H37Rv
uggugcccaaggcagaccc

SEQ ID NO: 1325544 - RNA, 22 nt, Mycobacterium tuberculosis H37Rv
uggugcccaaggcagaccccca

SEQ ID NO: 1325545 - RNA, 17 nt, Mycobacterium tuberculosis H37Rv
uggugcccgugugcagc

SEQ ID NO: 1325546 - RNA, 15 nt, Mycobacterium tuberculosis H37Rv
uggugcgccacgcca

SEQ ID NO: 1325547 - RNA, 14 nt, Mycobacterium tuberculosis H37Rv
uggugcggcccugc

SEQ ID NO: 1325548 - RNA, 18 nt, Mycobacterium tuberculosis H37Rv
uggugccugcggguggau

SEQ ID NO: 1325549 - RNA, 17 nt, Mycobacterium tuberculosis H37Rv
uggugcuagcgccgcca

SEQ ID NO: 1325550 - RNA, 21 nt, Mycobacterium tuberculosis H37Rv
uggugcugacauuuccaccac

SEQ ID NO: 1325551 - RNA, 14 nt, Mycobacterium tuberculosis H37Rv
uggugcgcgucagc

SEQ ID NO: 1325552 - RNA, 14 nt, Mycobacterium tuberculosis H37Rv
uggugccaacugcg

SEQ ID NO: 1325553 - RNA, 10 nt, Mycobacterium tuberculosis H37Rv
uggugccaac

SEQ ID NO: 1325554 - RNA, 19 nt, Mycobacterium tuberculosis H37Rv
uggugccaggucggcgggc

SEQ ID NO: 1325555 - RNA, 18 nt, Mycobacterium tuberculosis H37Rv
uggugaugcaacucggca

SEQ ID NO: 1325556 - RNA, 22 nt, Mycobacterium tuberculosis H37Rv
uggugaucugcugggcaagauc

SEQ ID NO: 1325557 - RNA, 17 nt, Mycobacterium tuberculosis H37Rv
uggucuccggcaccgag

SEQ ID NO: 1325558 - RNA, 12 nt, Mycobacterium tuberculosis H37Rv
uggucugccagc

SEQ ID NO: 1325559 - RNA, 18 nt, Mycobacterium tuberculosis H37Rv
uggucggugggguauucg

SEQ ID NO: 1325560 - RNA, 11 nt, Mycobacterium tuberculosis H37Rv
uggguaggcuc

SEQ ID NO: 1325561 - RNA, 23 nt, Mycobacterium tuberculosis H37Rv
uggguagcugacgugucggcugc

SEQ ID NO: 1325562 - RNA, 15 nt, Mycobacterium tuberculosis H37Rv
uggguagccgcccag

SEQ ID NO: 1325563 - RNA, 19 nt, Mycobacterium tuberculosis H37Rv
ugggucaacgucaggcccu

SEQ ID NO: 1325564 - RNA, 18 nt, Mycobacterium tuberculosis H37Rv
ugggucgauccggugccg

SEQ ID NO: 1325565 - RNA, 20 nt, Mycobacterium tuberculosis H37Rv
uggguccucgagcggcagau

SEQ ID NO: 1325566 - RNA, 13 nt, Mycobacterium tuberculosis H37Rv
ugggucgugcagg

SEQ ID NO: 1325567 - RNA, 14 nt, Mycobacterium tuberculosis H37Rv
ugggucgcaauauc

SEQ ID NO: 1325568 - RNA, 20 nt, Mycobacterium tuberculosis H37Rv
ugggucgcaauauccggccg

SEQ ID NO: 1325569 - RNA, 16 nt, Mycobacterium tuberculosis H37Rv
uguagaucugggcugg

SEQ ID NO: 1325570 - RNA, 13 nt, Mycobacterium tuberculosis H37Rv
uguacugcugcuu

SEQ ID NO: 1325571 - RNA, 21 nt, Mycobacterium tuberculosis H37Rv
uguacuggucuggacugcagc

SEQ ID NO: 1325572 - RNA, 19 nt, Mycobacterium tuberculosis H37Rv
uguagcagcgccagcagcu

SEQ ID NO: 1325573 - RNA, 14 nt, Mycobacterium tuberculosis H37Rv
uguagcagcgcggc

SEQ ID NO: 1325574 - RNA, 14 nt, Mycobacterium tuberculosis H37Rv
uguagccgagcacg

SEQ ID NO: 1325575 - RNA, 12 nt, Mycobacterium tuberculosis H37Rv
uguagcccuccg

SEQ ID NO: 1325576 - RNA, 12 nt, Mycobacterium tuberculosis H37Rv
uguagcccagcc

SEQ ID NO: 1325577 - RNA, 14 nt, Mycobacterium tuberculosis H37Rv
uguagcccaucggc

SEQ ID NO: 1325578 - RNA, 15 nt, Mycobacterium tuberculosis H37Rv
ugucacccucgggcg

SEQ ID NO: 1325579 - RNA, 13 nt, Mycobacterium tuberculosis H37Rv
ugucaccgccggg

SEQ ID NO: 1325580 - RNA, 18 nt, Mycobacterium tuberculosis H37Rv
ugucaccgccgggaagcc

SEQ ID NO: 1325581 - RNA, 23 nt, Mycobacterium tuberculosis H37Rv
ugucagcaagaucggcagcgugg

SEQ ID NO: 1325582 - RNA, 21 nt, Mycobacterium tuberculosis H37Rv
ugucagcgcugagccgcucau

SEQ ID NO: 1325583 - RNA, 11 nt, Mycobacterium tuberculosis H37Rv
ugucagcggcc

SEQ ID NO: 1325584 - RNA, 21 nt, Mycobacterium tuberculosis H37Rv
ugucccgcgggccagcaccuc

SEQ ID NO: 1325585 - RNA, 17 nt, Mycobacterium tuberculosis H37Rv
ugucccgcacccggccc

SEQ ID NO: 1325586 - RNA, 15 nt, Mycobacterium tuberculosis H37Rv
uguccuacuuuucca

SEQ ID NO: 1325587 - RNA, 19 nt, Mycobacterium tuberculosis H37Rv
uguccuauuugcagccuuc

SEQ ID NO: 1325588 - RNA, 17 nt, Mycobacterium tuberculosis H37Rv
uguccgcagcggugcgc

SEQ ID NO: 1325589 - RNA, 23 nt, Mycobacterium tuberculosis H37Rv
uguccgauaccgcgaugauggcg

SEQ ID NO: 1325590 - RNA, 15 nt, Mycobacterium tuberculosis H37Rv
uguccggccgguccg

SEQ ID NO: 1325591 - RNA, 21 nt, Mycobacterium tuberculosis H37Rv
uguccggcgacgcguagcacg

SEQ ID NO: 1325592 - RNA, 16 nt, Mycobacterium tuberculosis H37Rv
ugucgaguugaauggc

SEQ ID NO: 1325593 - RNA, 15 nt, Mycobacterium tuberculosis H37Rv
ugucgaucagcgcga

SEQ ID NO: 1325594 - RNA, 16 nt, Mycobacterium tuberculosis H37Rv
ugucgcacucagucug

SEQ ID NO: 1325595 - RNA, 22 nt, Mycobacterium tuberculosis H37Rv
uguccuggcccgauaaaugccg

SEQ ID NO: 1325596 - RNA, 21 nt, Mycobacterium tuberculosis H37Rv
uguccuugagagauuucuuga

SEQ ID NO: 1325597 - RNA, 12 nt, Mycobacterium tuberculosis H37Rv
ugucgaacuggu

SEQ ID NO: 1325598 - RNA, 21 nt, Mycobacterium tuberculosis H37Rv
ugucgacuugugacggucguc

SEQ ID NO: 1325599 - RNA, 16 nt, Mycobacterium tuberculosis H37Rv
ugucgacggccacccc

SEQ ID NO: 1325600 - RNA, 14 nt, Mycobacterium tuberculosis H37Rv
ugucguccauguaa

SEQ ID NO: 1325601 - RNA, 21 nt, Mycobacterium tuberculosis H37Rv
ugucggcgaaccacggcagcc

SEQ ID NO: 1325602 - RNA, 19 nt, Mycobacterium tuberculosis H37Rv
ugucguggcgggugaugca

SEQ ID NO: 1325603 - RNA, 18 nt, Mycobacterium tuberculosis H37Rv
ugucgugguuccgcccag

SEQ ID NO: 1325604 - RNA, 15 nt, Mycobacterium tuberculosis H37Rv
ugucggccccggccg

SEQ ID NO: 1325605 - RNA, 14 nt, Mycobacterium tuberculosis H37Rv
ugucuccggcaaca

SEQ ID NO: 1325606 - RNA, 22 nt, Mycobacterium tuberculosis H37Rv
ugucuccuccggaaagcucucg

SEQ ID NO: 1325607 - RNA, 16 nt, Mycobacterium tuberculosis H37Rv
ugucucgcccaccacc

SEQ ID NO: 1325608 - RNA, 20 nt, Mycobacterium tuberculosis H37Rv
ugugcacggugugcacggcg

SEQ ID NO: 1325609 - RNA, 16 nt, Mycobacterium tuberculosis H37Rv
ugugccgcugugaauu

SEQ ID NO: 1325610 - RNA, 13 nt, Mycobacterium tuberculosis H37Rv
ugugcccaugaug

SEQ ID NO: 1325611 - RNA, 22 nt, Mycobacterium tuberculosis H37Rv
ugugcccaugaugcucgaugau

SEQ ID NO: 1325612 - RNA, 20 nt, Mycobacterium tuberculosis H37Rv
ugcucguccaggucggccgc

SEQ ID NO: 1325613 - RNA, 21 nt, Mycobacterium tuberculosis H37Rv
ugcucggugaugcccagcgcc

SEQ ID NO: 1325614 - RNA, 21 nt, Mycobacterium tuberculosis H37Rv
ugcucguagacuugcugcucc

SEQ ID NO: 1325615 - RNA, 14 nt, Mycobacterium tuberculosis H37Rv
ugcucgcgccgcua

SEQ ID NO: 1325616 - RNA, 14 nt, Mycobacterium tuberculosis H37Rv
ugcucggccugcuu

SEQ ID NO: 1325617 - RNA, 19 nt, Mycobacterium tuberculosis H37Rv
ugcucggcaucgagcagcc

SEQ ID NO: 1325618 - RNA, 16 nt, Mycobacterium tuberculosis H37Rv
ugcucgcacagcacca

SEQ ID NO: 1325619 - RNA, 19 nt, Mycobacterium tuberculosis H37Rv
ugcucgaucugucgcgccg

SEQ ID NO: 1325620 - RNA, 23 nt, Mycobacterium tuberculosis H37Rv
ugcucgcaaucguuggccaugcc

SEQ ID NO: 1325621 - RNA, 14 nt, Mycobacterium tuberculosis H37Rv
ugcucgaugaucag

SEQ ID NO: 1325622 - RNA, 23 nt, Mycobacterium tuberculosis H37Rv
ugcucgcgaggcucgcguggccg

SEQ ID NO: 1325623 - RNA, 12 nt, Mycobacterium tuberculosis H37Rv
ugcucgccggcc

SEQ ID NO: 1325624 - RNA, 21 nt, Mycobacterium tuberculosis H37Rv
ugcucgcgcagggaucgcagg

SEQ ID NO: 1325625 - RNA, 14 nt, Mycobacterium tuberculosis H37Rv
ugcucgccaggccu

SEQ ID NO: 1325626 - RNA, 23 nt, Mycobacterium tuberculosis H37Rv
ugcucgccgggucagcccggcgc

SEQ ID NO: 1325627 - RNA, 23 nt, Mycobacterium tuberculosis H37Rv
ugcucgccguaagcaccagccag

SEQ ID NO: 1325628 - RNA, 22 nt, Mycobacterium tuberculosis H37Rv
ugcucugcgcaucgguccaaag

SEQ ID NO: 1325629 - RNA, 18 nt, Mycobacterium tuberculosis H37Rv
ugcucgucuuggcggcgg

SEQ ID NO: 1325630 - RNA, 22 nt, Mycobacterium tuberculosis H37Rv
ugcucguguuguugaagcccga

SEQ ID NO: 1325631 - RNA, 19 nt, Mycobacterium tuberculosis H37Rv
ugcucguucaccgcagcgg

SEQ ID NO: 1325632 - RNA, 20 nt, Mycobacterium tuberculosis H37Rv
ugcucucgcucgugcacgcu

SEQ ID NO: 1325633 - RNA, 23 nt, Mycobacterium tuberculosis H37Rv
ugcugagcaaguccugcagcugg

SEQ ID NO: 1325634 - RNA, 18 nt, Mycobacterium tuberculosis H37Rv
ugcugagcgccaggccgc

SEQ ID NO: 1325635 - RNA, 18 nt, Mycobacterium tuberculosis H37Rv
ugcugagcguaggccagc

SEQ ID NO: 1325636 - RNA, 20 nt, Mycobacterium tuberculosis H37Rv
ugcugagcguaggccagcga

SEQ ID NO: 1325637 - RNA, 20 nt, Mycobacterium tuberculosis H37Rv
ugcugacgacgagggccagc

SEQ ID NO: 1325638 - RNA, 15 nt, Mycobacterium tuberculosis H37Rv
ugcugaccggaguuc

SEQ ID NO: 1325639 - RNA, 20 nt, Mycobacterium tuberculosis H37Rv
ugcugcagcgaugcggcguu

SEQ ID NO: 1325640 - RNA, 17 nt, Mycobacterium tuberculosis H37Rv
ugcugcagcgucaaggg

SEQ ID NO: 1325641 - RNA, 21 nt, Mycobacterium tuberculosis H37Rv
ugcugcaccguuuccggcgcu

SEQ ID NO: 1325642 - RNA, 22 nt, Mycobacterium tuberculosis H37Rv
ugcugcacggccaugaucacac

SEQ ID NO: 1325643 - RNA, 15 nt, Mycobacterium tuberculosis H37Rv
ugcugcacccggaga

SEQ ID NO: 1325644 - RNA, 16 nt, Mycobacterium tuberculosis H37Rv
ugcugaugggucaggc

SEQ ID NO: 1325645 - RNA, 14 nt, Mycobacterium tuberculosis H37Rv
ugcugcaugccgac

SEQ ID NO: 1325646 - RNA, 16 nt, Mycobacterium tuberculosis H37Rv
ugcugcaugccgaccc

SEQ ID NO: 1325647 - RNA, 13 nt, Mycobacterium tuberculosis H37Rv
ugcugcauguccu

SEQ ID NO: 1325648 - RNA, 21 nt, Mycobacterium tuberculosis H37Rv
ugcugcauguccuccccgagc

SEQ ID NO: 1325649 - RNA, 16 nt, Mycobacterium tuberculosis H37Rv
ugcugccagccauggc

SEQ ID NO: 1325650 - RNA, 15 nt, Mycobacterium tuberculosis H37Rv
ugcugccauugccgc

SEQ ID NO: 1325651 - RNA, 15 nt, Mycobacterium tuberculosis H37Rv
ugcugccagccaugg

SEQ ID NO: 1325652 - RNA, 21 nt, Mycobacterium tuberculosis H37Rv
ugcugccccauaaacucugug

SEQ ID NO: 1325653 - RNA, 17 nt, Mycobacterium tuberculosis H37Rv
ugcugcccggcaaccug

SEQ ID NO: 1325654 - RNA, 22 nt, Mycobacterium tuberculosis H37Rv
ugcugccggagacacccgccag

SEQ ID NO: 1325655 - RNA, 12 nt, Mycobacterium tuberculosis H37Rv
ugcuggccgcgg

SEQ ID NO: 1325656 - RNA, 14 nt, Mycobacterium tuberculosis H37Rv
ugcuggcggccagc

SEQ ID NO: 1325657 - RNA, 14 nt, Mycobacterium tuberculosis H37Rv
ugcuggccuuguug

SEQ ID NO: 1325658 - RNA, 24 nt, Mycobacterium tuberculosis H37Rv
aaauguaccugguugcugacgacu

SEQ ID NO: 1325659 - RNA, 17 nt, Mycobacterium tuberculosis H37Rv
ugcuggaacagguugaa

SEQ ID NO: 1325660 - RNA, 15 nt, Mycobacterium tuberculosis H37Rv
ugcugcugccguggc

SEQ ID NO: 1325661 - RNA, 14 nt, Mycobacterium tuberculosis H37Rv
ugcuggaacagguu

SEQ ID NO: 1325662 - RNA, 14 nt, Mycobacterium tuberculosis H37Rv
ugcugcgcgcggcg

SEQ ID NO: 1325663 - RNA, 16 nt, Mycobacterium tuberculosis H37Rv
ugcugcggcuuucagc

SEQ ID NO: 1325664 - RNA, 14 nt, Mycobacterium tuberculosis H37Rv
ugcugcucgugagc

SEQ ID NO: 1325665 - RNA, 17 nt, Mycobacterium tuberculosis H37Rv
ugcugccgggggcccga

SEQ ID NO: 1325666 - RNA, 21 nt, Mycobacterium tuberculosis H37Rv
ugcugcgcaccaaggccguga

SEQ ID NO: 1325667 - RNA, 13 nt, Mycobacterium tuberculosis H37Rv
ugcugccuuugcg

SEQ ID NO: 1325668 - RNA, 14 nt, Mycobacterium tuberculosis H37Rv
ugcugcggccaggg

SEQ ID NO: 1325669 - RNA, 15 nt, Mycobacterium tuberculosis H37Rv
ugcugcggccaggga

SEQ ID NO: 1325670 - RNA, 21 nt, Mycobacterium tuberculosis H37Rv
ugcugcgcgcggcggccgcgg

SEQ ID NO: 1325671 - RNA, 23 nt, Mycobacterium tuberculosis H37Rv
ugcuggugggccggaccuuguug

SEQ ID NO: 1325672 - RNA, 17 nt, Mycobacterium tuberculosis H37Rv
ugcuggugucggcucga

SEQ ID NO: 1325673 - RNA, 15 nt, Mycobacterium tuberculosis H37Rv
ugcuggggguaccuc

SEQ ID NO: 1325674 - RNA, 17 nt, Mycobacterium tuberculosis H37Rv
ugcugggcccgccagcc

SEQ ID NO: 1325675 - RNA, 17 nt, Mycobacterium tuberculosis H37Rv
ugcuggggguaccuccc

SEQ ID NO: 1325676 - RNA, 13 nt, Mycobacterium tuberculosis H37Rv
ugcugguccaggc

SEQ ID NO: 1325677 - RNA, 18 nt, Mycobacterium tuberculosis H37Rv
ugcugucgauuucgccgu

SEQ ID NO: 1325678 - RNA, 16 nt, Mycobacterium tuberculosis H37Rv
ugcuucaguggcaaca

SEQ ID NO: 1325679 - RNA, 22 nt, Mycobacterium tuberculosis H37Rv
ugcuucaguggcaacagcaacg

SEQ ID NO: 1325680 - RNA, 16 nt, Mycobacterium tuberculosis H37Rv
ugcuucgcgucgaccc

SEQ ID NO: 1325681 - RNA, 12 nt, Mycobacterium tuberculosis H37Rv
ugcuuccagcau

SEQ ID NO: 1325682 - RNA, 19 nt, Mycobacterium tuberculosis H37Rv
ugcuugcgcaucgccgaca

SEQ ID NO: 1325683 - RNA, 13 nt, Mycobacterium tuberculosis H37Rv
ugcuugcagggcc

SEQ ID NO: 1325684 - RNA, 22 nt, Mycobacterium tuberculosis H37Rv
ugcuugcagggccacuggccgg

SEQ ID NO: 1325685 - RNA, 17 nt, Mycobacterium tuberculosis H37Rv
ugcuuggucgcccagcc

SEQ ID NO: 1325686 - RNA, 21 nt, Mycobacterium tuberculosis H37Rv
ugcuuuccagaguucccgaaa

SEQ ID NO: 1325687 - RNA, 23 nt, Mycobacterium tuberculosis H37Rv
ugcuuucgggauuccggaugcag

SEQ ID NO: 1325688 - RNA, 15 nt, Mycobacterium tuberculosis H37Rv
uggaaacugaugucg

SEQ ID NO: 1325689 - RNA, 22 nt, Mycobacterium tuberculosis H37Rv
uggaaaagccacggcugcccau

SEQ ID NO: 1325690 - RNA, 20 nt, Mycobacterium tuberculosis H37Rv
uggaaaaagcccgacacgaa

SEQ ID NO: 1325691 - RNA, 21 nt, Mycobacterium tuberculosis H37Rv
uggaagaguuggggcacaacc

SEQ ID NO: 1325692 - RNA, 15 nt, Mycobacterium tuberculosis H37Rv
uggaagaucacgcgu

SEQ ID NO: 1325693 - RNA, 13 nt, Mycobacterium tuberculosis H37Rv
uggaagacgccgg

SEQ ID NO: 1325694 - RNA, 15 nt, Mycobacterium tuberculosis H37Rv
uggaagcggcgacua

SEQ ID NO: 1325695 - RNA, 15 nt, Mycobacterium tuberculosis H37Rv
uggaaggcggccagg

SEQ ID NO: 1325696 - RNA, 19 nt, Mycobacterium tuberculosis H37Rv
uggaagccgaccaccgccg

SEQ ID NO: 1325697 - RNA, 22 nt, Mycobacterium tuberculosis H37Rv
uggaagccgacgaccagcagau

SEQ ID NO: 1325698 - RNA, 13 nt, Mycobacterium tuberculosis H37Rv
uggaagccgcacc

SEQ ID NO: 1325699 - RNA, 22 nt, Mycobacterium tuberculosis H37Rv
uggaagauguugccgccgguca

SEQ ID NO: 1325700 - RNA, 13 nt, Mycobacterium tuberculosis H37Rv
uggaacagaucuu

SEQ ID NO: 1325701 - RNA, 13 nt, Mycobacterium tuberculosis H37Rv
uggaccaccgccg

SEQ ID NO: 1325702 - RNA, 16 nt, Mycobacterium tuberculosis H37Rv
uggaccaccgccgaag

SEQ ID NO: 1325703 - RNA, 15 nt, Mycobacterium tuberculosis H37Rv
uggaccggugccagc

SEQ ID NO: 1325704 - RNA, 16 nt, Mycobacterium tuberculosis H37Rv
uggaccgcggugaccc

SEQ ID NO: 1325705 - RNA, 17 nt, Mycobacterium tuberculosis H37Rv
uggacccugcgccgcca

SEQ ID NO: 1325706 - RNA, 20 nt, Mycobacterium tuberculosis H37Rv
uggacgcagagucaacagau

SEQ ID NO: 1325707 - RNA, 17 nt, Mycobacterium tuberculosis H37Rv
uggaccguugccgaugg

SEQ ID NO: 1325708 - RNA, 18 nt, Mycobacterium tuberculosis H37Rv
uggacaggucaauggucu

SEQ ID NO: 1325709 - RNA, 12 nt, Mycobacterium tuberculosis H37Rv
uggacaccagcc

SEQ ID NO: 1325710 - RNA, 16 nt, Mycobacterium tuberculosis H37Rv
uggacaccagccagau

SEQ ID NO: 1325711 - RNA, 12 nt, Mycobacterium tuberculosis H37Rv
uggacaccaacc

SEQ ID NO: 1325712 - RNA, 14 nt, Mycobacterium tuberculosis H37Rv
uggacaccaaccca

SEQ ID NO: 1325713 - RNA, 17 nt, Mycobacterium tuberculosis H37Rv
uggacaccaacccaccc

SEQ ID NO: 1325714 - RNA, 12 nt, Mycobacterium tuberculosis H37Rv
uggacaccaccu

SEQ ID NO: 1325715 - RNA, 12 nt, Mycobacterium tuberculosis H37Rv
uggacaacagca

SEQ ID NO: 1325716 - RNA, 18 nt, Mycobacterium tuberculosis H37Rv
uggaaucgcggagccagg

SEQ ID NO: 1325717 - RNA, 19 nt, Mycobacterium tuberculosis H37Rv
uggaaucgcggagccagga

SEQ ID NO: 1325718 - RNA, 20 nt, Mycobacterium tuberculosis H37Rv
uggaaugccgccacaaagaa

SEQ ID NO: 1325719 - RNA, 17 nt, Mycobacterium tuberculosis H37Rv
uggaauggaucucggcg

SEQ ID NO: 1325720 - RNA, 16 nt, Mycobacterium tuberculosis H37Rv
ugcgucgauugccgcg

SEQ ID NO: 1325721 - RNA, 19 nt, Mycobacterium tuberculosis H37Rv
ugcgucgcacgagccaaca

SEQ ID NO: 1325722 - RNA, 22 nt, Mycobacterium tuberculosis H37Rv
ugcguccguagcgauucugggc

SEQ ID NO: 1325723 - RNA, 17 nt, Mycobacterium tuberculosis H37Rv
ugcgucgaaauccacaa

SEQ ID NO: 1325724 - RNA, 21 nt, Mycobacterium tuberculosis H37Rv
ugcgucgaugcgcugcucacg

SEQ ID NO: 1325725 - RNA, 15 nt, Mycobacterium tuberculosis H37Rv
ugcguuggaugaagu

SEQ ID NO: 1325726 - RNA, 15 nt, Mycobacterium tuberculosis H37Rv
ugcgugccgacccgc

SEQ ID NO: 1325727 - RNA, 16 nt, Mycobacterium tuberculosis H37Rv
ugcgugccgacccgcu

SEQ ID NO: 1325728 - RNA, 19 nt, Mycobacterium tuberculosis H37Rv
ugcggugcccgcaccagaa

SEQ ID NO: 1325729 - RNA, 12 nt, Mycobacterium tuberculosis H37Rv
ugcgguggcagg

SEQ ID NO: 1325730 - RNA, 23 nt, Mycobacterium tuberculosis H37Rv
ugcggugcuaugcaacaccgcac

SEQ ID NO: 1325731 - RNA, 21 nt, Mycobacterium tuberculosis H37Rv
ugcggugaccgugaacggcuc

SEQ ID NO: 1325732 - RNA, 15 nt, Mycobacterium tuberculosis H37Rv
ugcggucggccacau

SEQ ID NO: 1325733 - RNA, 22 nt, Mycobacterium tuberculosis H37Rv
ugcggucuccgcccgcgggccc

SEQ ID NO: 1325734 - RNA, 15 nt, Mycobacterium tuberculosis H37Rv
ugcgggacgccgaau

SEQ ID NO: 1325735 - RNA, 19 nt, Mycobacterium tuberculosis H37Rv
ugcgggacuugucggggug

SEQ ID NO: 1325736 - RNA, 14 nt, Mycobacterium tuberculosis H37Rv
ugcgguccaggccg

SEQ ID NO: 1325737 - RNA, 16 nt, Mycobacterium tuberculosis H37Rv
ugcgguccaggccggc

SEQ ID NO: 1325738 - RNA, 18 nt, Mycobacterium tuberculosis H37Rv
ugcgggaaguugcccagg

SEQ ID NO: 1325739 - RNA, 19 nt, Mycobacterium tuberculosis H37Rv
ugcgucaaguccgagucgg

SEQ ID NO: 1325740 - RNA, 20 nt, Mycobacterium tuberculosis H37Rv
ugcguaaggcugugccggcc

SEQ ID NO: 1325741 - RNA, 21 nt, Mycobacterium tuberculosis H37Rv
ugcgguugcauccauccugcc

SEQ ID NO: 1325742 - RNA, 14 nt, Mycobacterium tuberculosis H37Rv
ugcgguuagcagcc

SEQ ID NO: 1325743 - RNA, 21 nt, Mycobacterium tuberculosis H37Rv
ugcgguucucguagucaacca

SEQ ID NO: 1325744 - RNA, 23 nt, Mycobacterium tuberculosis H37Rv
ugcgguugcauaccgccgggccc

SEQ ID NO: 1325745 - RNA, 15 nt, Mycobacterium tuberculosis H37Rv
ugcgguggccagugc

SEQ ID NO: 1325746 - RNA, 16 nt, Mycobacterium tuberculosis H37Rv
ugcggugggccagguu

SEQ ID NO: 1325747 - RNA, 17 nt, Mycobacterium tuberculosis H37Rv
ugcggugucgggcuggg

SEQ ID NO: 1325748 - RNA, 22 nt, Mycobacterium tuberculosis H37Rv
ugcgccggcguuugggcaucau

SEQ ID NO: 1325749 - RNA, 19 nt, Mycobacterium tuberculosis H37Rv
ugcggaaucagcaccccau

SEQ ID NO: 1325750 - RNA, 15 nt, Mycobacterium tuberculosis H37Rv
ugcggaaucagcacc

SEQ ID NO: 1325751 - RNA, 16 nt, Mycobacterium tuberculosis H37Rv
ugcggaaucagcaccc

SEQ ID NO: 1325752 - RNA, 22 nt, Mycobacterium tuberculosis H37Rv
ugcggaagaagugcucacaucc

SEQ ID NO: 1325753 - RNA, 17 nt, Mycobacterium tuberculosis H37Rv
ugcggcaagcgcacgcu

SEQ ID NO: 1325754 - RNA, 17 nt, Mycobacterium tuberculosis H37Rv
ugcggcaacagcggggu

SEQ ID NO: 1325755 - RNA, 18 nt, Mycobacterium tuberculosis H37Rv
ugcggaacaccagcaggc

SEQ ID NO: 1325756 - RNA, 22 nt, Mycobacterium tuberculosis H37Rv
ugcggaacaccaccaggcuguc

SEQ ID NO: 1325757 - RNA, 21 nt, Mycobacterium tuberculosis H37Rv
ugcggaacaccaccaggcugu

SEQ ID NO: 1325758 - RNA, 14 nt, Mycobacterium tuberculosis H37Rv
ugcggcugccagug

SEQ ID NO: 1325759 - RNA, 17 nt, Mycobacterium tuberculosis H37Rv
ugcggcucgcugaucug

SEQ ID NO: 1325760 - RNA, 13 nt, Mycobacterium tuberculosis H37Rv
ugcggcgugccgg

SEQ ID NO: 1325761 - RNA, 23 nt, Mycobacterium tuberculosis H37Rv
ugcggcaacgaggucugcggccg

SEQ ID NO: 1325762 - RNA, 12 nt, Mycobacterium tuberculosis H37Rv
ugcggcaccgcc

SEQ ID NO: 1325763 - RNA, 16 nt, Mycobacterium tuberculosis H37Rv
ugcggcaccgccgccc

SEQ ID NO: 1325764 - RNA, 18 nt, Mycobacterium tuberculosis H37Rv
ugcggcagcuggcgcagc

SEQ ID NO: 1325765 - RNA, 16 nt, Mycobacterium tuberculosis H37Rv
ugcggcagcgcggcca

SEQ ID NO: 1325766 - RNA, 15 nt, Mycobacterium tuberculosis H37Rv
ugcggcagaccaagc

SEQ ID NO: 1325767 - RNA, 23 nt, Mycobacterium tuberculosis H37Rv
ugcggcgaccgucaaccugcugc

SEQ ID NO: 1325768 - RNA, 19 nt, Mycobacterium tuberculosis H37Rv
ugcuaggaccaccagcgcu

SEQ ID NO: 1325769 - RNA, 17 nt, Mycobacterium tuberculosis H37Rv
ugcuaggaccaccagcg

SEQ ID NO: 1325770 - RNA, 17 nt, Mycobacterium tuberculosis H37Rv
ugcuauucgccagcgcc

SEQ ID NO: 1325771 - RNA, 13 nt, Mycobacterium tuberculosis H37Rv
ugcuacucugcaa

SEQ ID NO: 1325772 - RNA, 19 nt, Mycobacterium tuberculosis H37Rv
ugcuacacccguagaccuu

SEQ ID NO: 1325773 - RNA, 17 nt, Mycobacterium tuberculosis H37Rv
ugcuaaacuccgugccg

SEQ ID NO: 1325774 - RNA, 18 nt, Mycobacterium tuberculosis H37Rv
ugcucaucgcgcccgcca

SEQ ID NO: 1325775 - RNA, 13 nt, Mycobacterium tuberculosis H37Rv
ugcucagccggcc

SEQ ID NO: 1325776 - RNA, 15 nt, Mycobacterium tuberculosis H37Rv
ugcucagcgcggccc

SEQ ID NO: 1325777 - RNA, 21 nt, Mycobacterium tuberculosis H37Rv
ugcucaccaaucugcgggccg

SEQ ID NO: 1325778 - RNA, 19 nt, Mycobacterium tuberculosis H37Rv
ugcucacgagcaaaccaga

SEQ ID NO: 1325779 - RNA, 13 nt, Mycobacterium tuberculosis H37Rv
ugcucacgcagca

SEQ ID NO: 1325780 - RNA, 17 nt, Mycobacterium tuberculosis H37Rv
ugcucacgguccggcgg

SEQ ID NO: 1325781 - RNA, 18 nt, Mycobacterium tuberculosis H37Rv
ugcucacauccggucaga

SEQ ID NO: 1325782 - RNA, 18 nt, Mycobacterium tuberculosis H37Rv
ugcuccaggcgcgccgca

SEQ ID NO: 1325783 - RNA, 17 nt, Mycobacterium tuberculosis H37Rv
ugcuccgguuggcgcgg

SEQ ID NO: 1325784 - RNA, 21 nt, Mycobacterium tuberculosis H37Rv
ugcuccucgcgguaguugucc

SEQ ID NO: 1325785 - RNA, 18 nt, Mycobacterium tuberculosis H37Rv
ugcucgacgcccgccacc

SEQ ID NO: 1325786 - RNA, 21 nt, Mycobacterium tuberculosis H37Rv
ugcgccaaggucugccgggcg

SEQ ID NO: 1325787 - RNA, 23 nt, Mycobacterium tuberculosis H37Rv
ugcgccaaaauccgcccaccggu

SEQ ID NO: 1325788 - RNA, 19 nt, Mycobacterium tuberculosis H37Rv
ugcgccagcaacagcgcgg

SEQ ID NO: 1325789 - RNA, 18 nt, Mycobacterium tuberculosis H37Rv
ugcgccacgccacuucuu

SEQ ID NO: 1325790 - RNA, 17 nt, Mycobacterium tuberculosis H37Rv
ugcgccaccguggccgc

SEQ ID NO: 1325791 - RNA, 20 nt, Mycobacterium tuberculosis H37Rv
ugcgaugcacaaccgcugcu

SEQ ID NO: 1325792 - RNA, 14 nt, Mycobacterium tuberculosis H37Rv
ugcgauggcccggg

SEQ ID NO: 1325793 - RNA, 19 nt, Mycobacterium tuberculosis H37Rv
ugcgcaaugccgacgccaa

SEQ ID NO: 1325794 - RNA, 19 nt, Mycobacterium tuberculosis H37Rv
ugcgcaaggccgcguugcc

SEQ ID NO: 1325795 - RNA, 15 nt, Mycobacterium tuberculosis H37Rv
ugcgcacaccgaccc

SEQ ID NO: 1325796 - RNA, 19 nt, Mycobacterium tuberculosis H37Rv
ugcgccauaauauugccgc

SEQ ID NO: 1325797 - RNA, 17 nt, Mycobacterium tuberculosis H37Rv
ugcgccauugcgggaac

SEQ ID NO: 1325798 - RNA, 18 nt, Mycobacterium tuberculosis H37Rv
ugcgccaguaggcuucga

SEQ ID NO: 1325799 - RNA, 23 nt, Mycobacterium tuberculosis H37Rv
ugcgccagcgagcgcaaaucgau

SEQ ID NO: 1325800 - RNA, 19 nt, Mycobacterium tuberculosis H37Rv
ugcgccgaacaccacaccg

SEQ ID NO: 1325801 - RNA, 21 nt, Mycobacterium tuberculosis H37Rv
ugcgccgaacgcuccaggccu

SEQ ID NO: 1325802 - RNA, 22 nt, Mycobacterium tuberculosis H37Rv
ugcgccgacaccgggcccuugc

SEQ ID NO: 1325803 - RNA, 14 nt, Mycobacterium tuberculosis H37Rv
ugcgccgcacggcg

SEQ ID NO: 1325804 - RNA, 22 nt, Mycobacterium tuberculosis H37Rv
ugcgccgcacgccgaccggccc

SEQ ID NO: 1325805 - RNA, 22 nt, Mycobacterium tuberculosis H37Rv
ugcgccgagauccacgccagag

SEQ ID NO: 1325806 - RNA, 18 nt, Mycobacterium tuberculosis H37Rv
ugcgccgauacccagcgg

SEQ ID NO: 1325807 - RNA, 19 nt, Mycobacterium tuberculosis H37Rv
ugcgccgacccgcgcgccg

SEQ ID NO: 1325808 - RNA, 14 nt, Mycobacterium tuberculosis H37Rv
ugcgccgccagcgc

SEQ ID NO: 1325809 - RNA, 19 nt, Mycobacterium tuberculosis H37Rv
ugcgccgcccaugccucca

SEQ ID NO: 1325810 - RNA, 14 nt, Mycobacterium tuberculosis H37Rv
ugcgccggaccagc

SEQ ID NO: 1325811 - RNA, 18 nt, Mycobacterium tuberculosis H37Rv
ugcgccggaccagcuccu

SEQ ID NO: 1325812 - RNA, 16 nt, Mycobacterium tuberculosis H37Rv
ugcgagcgcagcgcau

SEQ ID NO: 1325813 - RNA, 19 nt, Mycobacterium tuberculosis H37Rv
ugcgagugagcucagcaag

SEQ ID NO: 1325814 - RNA, 22 nt, Mycobacterium tuberculosis H37Rv
ugcgaucgccgcgcuggucgga

SEQ ID NO: 1325815 - RNA, 12 nt, Mycobacterium tuberculosis H37Rv
ugcgaucggcac

SEQ ID NO: 1325816 - RNA, 16 nt, Mycobacterium tuberculosis H37Rv
ugcgaucggcacuuag

SEQ ID NO: 1325817 - RNA, 19 nt, Mycobacterium tuberculosis H37Rv
ugcgaucggcacuuagccc

SEQ ID NO: 1325818 - RNA, 13 nt, Mycobacterium tuberculosis H37Rv
ugcgaucccaccc

SEQ ID NO: 1325819 - RNA, 18 nt, Mycobacterium tuberculosis H37Rv
ugcgauauggucaccaag

SEQ ID NO: 1325820 - RNA, 18 nt, Mycobacterium tuberculosis H37Rv
ugcgaagaguccuuaaac

SEQ ID NO: 1325821 - RNA, 23 nt, Mycobacterium tuberculosis H37Rv
ugcgaaugcugggcccgccagcc

SEQ ID NO: 1325822 - RNA, 22 nt, Mycobacterium tuberculosis H37Rv
ugcgacacauagugcggcaccg

SEQ ID NO: 1325823 - RNA, 14 nt, Mycobacterium tuberculosis H37Rv
ugccuuggcagccc

SEQ ID NO: 1325824 - RNA, 17 nt, Mycobacterium tuberculosis H37Rv
ugcgaaacgcuggccac

SEQ ID NO: 1325825 - RNA, 17 nt, Mycobacterium tuberculosis H37Rv
ugcgaaacaucucggcg

SEQ ID NO: 1325826 - RNA, 14 nt, Mycobacterium tuberculosis H37Rv
ugcgaaaguggugg

SEQ ID NO: 1325827 - RNA, 18 nt, Mycobacterium tuberculosis H37Rv
ugccgggggcccgaccug

SEQ ID NO: 1325828 - RNA, 16 nt, Mycobacterium tuberculosis H37Rv
ugccggggccccaugc

SEQ ID NO: 1325829 - RNA, 18 nt, Mycobacterium tuberculosis H37Rv
ugccgggguuggucgucg

SEQ ID NO: 1325830 - RNA, 17 nt, Mycobacterium tuberculosis H37Rv
ugccgguaugcgccauc

SEQ ID NO: 1325831 - RNA, 24 nt, Mycobacterium tuberculosis H37Rv
ugccggucgagugccucgaccugg

SEQ ID NO: 1325832 - RNA, 21 nt, Mycobacterium tuberculosis H37Rv
ugccgguuugggcgcgugccg

SEQ ID NO: 1325833 - RNA, 18 nt, Mycobacterium tuberculosis H37Rv
ugccgguguugccgaagc

SEQ ID NO: 1325834 - RNA, 20 nt, Mycobacterium tuberculosis H37Rv
ugccaccgguuaaccuccag

SEQ ID NO: 1325835 - RNA, 16 nt, Mycobacterium tuberculosis H37Rv
ugccacccuugccgcc

SEQ ID NO: 1325836 - RNA, 13 nt, Mycobacterium tuberculosis H37Rv
ugccacccuugcc

SEQ ID NO: 1325837 - RNA, 14 nt, Mycobacterium tuberculosis H37Rv
ugccaccgcggccg

SEQ ID NO: 1325838 - RNA, 22 nt, Mycobacterium tuberculosis H37Rv
ugccacgacgaacaccagcgcg

SEQ ID NO: 1325839 - RNA, 19 nt, Mycobacterium tuberculosis H37Rv
ugccacgaucggcgggggu

SEQ ID NO: 1325840 - RNA, 14 nt, Mycobacterium tuberculosis H37Rv
ugccagaccagggc

SEQ ID NO: 1325841 - RNA, 15 nt, Mycobacterium tuberculosis H37Rv
ugccagaccagggca

SEQ ID NO: 1325842 - RNA, 22 nt, Mycobacterium tuberculosis H37Rv
ugccggccaaguugacccccuc

SEQ ID NO: 1325843 - RNA, 16 nt, Mycobacterium tuberculosis H37Rv
ugccggcccaccgccg

SEQ ID NO: 1325844 - RNA, 21 nt, Mycobacterium tuberculosis H37Rv
ugccggcccccacacaggcag

SEQ ID NO: 1325845 - RNA, 15 nt, Mycobacterium tuberculosis H37Rv
ugccggccaggauuu

SEQ ID NO: 1325846 - RNA, 19 nt, Mycobacterium tuberculosis H37Rv
ugccggccaggauuucgca

SEQ ID NO: 1325847 - RNA, 20 nt, Mycobacterium tuberculosis H37Rv
ugccggccaggauuucgcag

SEQ ID NO: 1325848 - RNA, 22 nt, Mycobacterium tuberculosis H37Rv
ugccggcgaagccggccgggaa

SEQ ID NO: 1325849 - RNA, 17 nt, Mycobacterium tuberculosis H37Rv
ugccggcgaaggccagc

SEQ ID NO: 1325850 - RNA, 21 nt, Mycobacterium tuberculosis H37Rv
ugccggcgagagcgucaacca

SEQ ID NO: 1325851 - RNA, 19 nt, Mycobacterium tuberculosis H37Rv
ugccggcgccgcccuugcc

SEQ ID NO: 1325852 - RNA, 14 nt, Mycobacterium tuberculosis H37Rv
ugccggggccccau

SEQ ID NO: 1325853 - RNA, 12 nt, Mycobacterium tuberculosis H37Rv
ugccugcaacgc

SEQ ID NO: 1325854 - RNA, 11 nt, Mycobacterium tuberculosis H37Rv
ugccugccacc

SEQ ID NO: 1325855 - RNA, 22 nt, Mycobacterium tuberculosis H37Rv
ugccucggcgaggucagagaaa

SEQ ID NO: 1325856 - RNA, 17 nt, Mycobacterium tuberculosis H37Rv
ugccuucguagaaggac

SEQ ID NO: 1325857 - RNA, 23 nt, Mycobacterium tuberculosis H37Rv
ugccuugaccgcggucuucuuca

SEQ ID NO: 1325858 - RNA, 18 nt, Mycobacterium tuberculosis H37Rv
ugccuuacacgccuggcu

SEQ ID NO: 1325859 - RNA, 23 nt, Mycobacterium tuberculosis H37Rv
ugaugacgccgucggcgcgcacc

SEQ ID NO: 1325860 - RNA, 13 nt, Mycobacterium tuberculosis H37Rv
ugaugaccgccgc

SEQ ID NO: 1325861 - RNA, 22 nt, Mycobacterium tuberculosis H37Rv
ugaugaccgccaucgccaacac

SEQ ID NO: 1325862 - RNA, 18 nt, Mycobacterium tuberculosis H37Rv
ugaugaccaggucgguca

SEQ ID NO: 1325863 - RNA, 16 nt, Mycobacterium tuberculosis H37Rv
ugaugacguugcagcc

SEQ ID NO: 1325864 - RNA, 14 nt, Mycobacterium tuberculosis H37Rv
ugaugaugaccaca

SEQ ID NO: 1325865 - RNA, 12 nt, Mycobacterium tuberculosis H37Rv
ugauuccggguc

SEQ ID NO: 1325866 - RNA, 14 nt, Mycobacterium tuberculosis H37Rv
ugauuccacugggc

SEQ ID NO: 1325867 - RNA, 23 nt, Mycobacterium tuberculosis H37Rv
ugaugcaacgccaaaauggugcc

SEQ ID NO: 1325868 - RNA, 22 nt, Mycobacterium tuberculosis H37Rv
ugaugaucgguucgggacgcga

SEQ ID NO: 1325869 - RNA, 19 nt, Mycobacterium tuberculosis H37Rv
ugauuuuucgcagugacgu

SEQ ID NO: 1325870 - RNA, 17 nt, Mycobacterium tuberculosis H37Rv
ugcaaucgcgugcugga

SEQ ID NO: 1325871 - RNA, 14 nt, Mycobacterium tuberculosis H37Rv
ugcaaugacuggac

SEQ ID NO: 1325872 - RNA, 20 nt, Mycobacterium tuberculosis H37Rv
ugcaagaccguuacaccauc

SEQ ID NO: 1325873 - RNA, 20 nt, Mycobacterium tuberculosis H37Rv
ugcaaccucggcuuggccgg

SEQ ID NO: 1325874 - RNA, 14 nt, Mycobacterium tuberculosis H37Rv
ugcaaccagcggca

SEQ ID NO: 1325875 - RNA, 19 nt, Mycobacterium tuberculosis H37Rv
ugcaaccccaaguccagca

SEQ ID NO: 1325876 - RNA, 22 nt, Mycobacterium tuberculosis H37Rv
ugcaaccccaaguccagcagcg

SEQ ID NO: 1325877 - RNA, 21 nt, Mycobacterium tuberculosis H37Rv
ugcaacacgccggcccgguga

SEQ ID NO: 1325878 - RNA, 15 nt, Mycobacterium tuberculosis H37Rv
ugcaacaccgcaccg

SEQ ID NO: 1325879 - RNA, 13 nt, Mycobacterium tuberculosis H37Rv
ugcaacacaccgc

SEQ ID NO: 1325880 - RNA, 18 nt, Mycobacterium tuberculosis H37Rv
ugcaaauuuguucuggug

SEQ ID NO: 1325881 - RNA, 21 nt, Mycobacterium tuberculosis H37Rv
ugcagcgucuccuugagcuuc

SEQ ID NO: 1325882 - RNA, 14 nt, Mycobacterium tuberculosis H37Rv
ugcagcgggaucau

SEQ ID NO: 1325883 - RNA, 22 nt, Mycobacterium tuberculosis H37Rv
ugcagcgggccacugagccaca

SEQ ID NO: 1325884 - RNA, 21 nt, Mycobacterium tuberculosis H37Rv
ugcagcggcgccgccaagggc

SEQ ID NO: 1325885 - RNA, 22 nt, Mycobacterium tuberculosis H37Rv
ugcagccgaccgaaucagcacg

SEQ ID NO: 1325886 - RNA, 17 nt, Mycobacterium tuberculosis H37Rv
ugcagcccugcgcagcc

SEQ ID NO: 1325887 - RNA, 18 nt, Mycobacterium tuberculosis H37Rv
ugcagcccugcgcagccg

SEQ ID NO: 1325888 - RNA, 14 nt, Mycobacterium tuberculosis H37Rv
ugcagcccgccgcu

SEQ ID NO: 1325889 - RNA, 23 nt, Mycobacterium tuberculosis H37Rv
ugcagcgaaaugccggugccggg

SEQ ID NO: 1325890 - RNA, 18 nt, Mycobacterium tuberculosis H37Rv
ugcagcaauugcaccuuc

SEQ ID NO: 1325891 - RNA, 19 nt, Mycobacterium tuberculosis H37Rv
ugcagcaauugcaccuucu

SEQ ID NO: 1325892 - RNA, 19 nt, Mycobacterium tuberculosis H37Rv
ugcagcacccccucggcuu

SEQ ID NO: 1325893 - RNA, 16 nt, Mycobacterium tuberculosis H37Rv
ugcagcacgauccagc

SEQ ID NO: 1325894 - RNA, 22 nt, Mycobacterium tuberculosis H37Rv
ugcagcccgccggauccgccag

SEQ ID NO: 1325895 - RNA, 21 nt, Mycobacterium tuberculosis H37Rv
ugcagcccgggcagcaccagc

SEQ ID NO: 1325896 - RNA, 12 nt, Mycobacterium tuberculosis H37Rv
ugcagaucggcc

SEQ ID NO: 1325897 - RNA, 13 nt, Mycobacterium tuberculosis H37Rv
ugcagaucggcuc

SEQ ID NO: 1325898 - RNA, 16 nt, Mycobacterium tuberculosis H37Rv
ugcagaucguagugcg

SEQ ID NO: 1325899 - RNA, 21 nt, Mycobacterium tuberculosis H37Rv
ugcagauaggacccagccagc

SEQ ID NO: 1325900 - RNA, 15 nt, Mycobacterium tuberculosis H37Rv
ugcacuguggaagaa

SEQ ID NO: 1325901 - RNA, 16 nt, Mycobacterium tuberculosis H37Rv
ugcacguacucggcca

SEQ ID NO: 1325902 - RNA, 21 nt, Mycobacterium tuberculosis H37Rv
ugcaccagcucacccggagca

SEQ ID NO: 1325903 - RNA, 12 nt, Mycobacterium tuberculosis H37Rv
ugcaccagcuca

SEQ ID NO: 1325904 - RNA, 21 nt, Mycobacterium tuberculosis H37Rv
ugcaccggcuugggccaggcc

SEQ ID NO: 1325905 - RNA, 16 nt, Mycobacterium tuberculosis H37Rv
ugcaccauucgcaccg

SEQ ID NO: 1325906 - RNA, 12 nt, Mycobacterium tuberculosis H37Rv
ugcacgugaccc

SEQ ID NO: 1325907 - RNA, 23 nt, Mycobacterium tuberculosis H37Rv
ugcacgucaucggcuggccgcgc

SEQ ID NO: 1325908 - RNA, 13 nt, Mycobacterium tuberculosis H37Rv
ugcacgucagcgg

SEQ ID NO: 1325909 - RNA, 15 nt, Mycobacterium tuberculosis H37Rv
ugcacgucgagcagg

SEQ ID NO: 1325910 - RNA, 20 nt, Mycobacterium tuberculosis H37Rv
ugcaccuggaucagggcuuu

SEQ ID NO: 1325911 - RNA, 18 nt, Mycobacterium tuberculosis H37Rv
ugcaccagguugcaaccu

SEQ ID NO: 1325912 - RNA, 18 nt, Mycobacterium tuberculosis H37Rv
ugcacaaccgcugcugcu

SEQ ID NO: 1325913 - RNA, 17 nt, Mycobacterium tuberculosis H37Rv
ugcacaacgcccaccac

SEQ ID NO: 1325914 - RNA, 13 nt, Mycobacterium tuberculosis H37Rv
ugcacacaggacu

SEQ ID NO: 1325915 - RNA, 19 nt, Mycobacterium tuberculosis H37Rv
ugcacaccgggcaccaguc

SEQ ID NO: 1325916 - RNA, 13 nt, Mycobacterium tuberculosis H37Rv
ugcacaccgucgc

SEQ ID NO: 1325917 - RNA, 21 nt, Mycobacterium tuberculosis H37Rv
ugcacagacacggcagcugca

SEQ ID NO: 1325918 - RNA, 20 nt, Mycobacterium tuberculosis H37Rv
ugcacagcagcgucaucagg

SEQ ID NO: 1325919 - RNA, 18 nt, Mycobacterium tuberculosis H37Rv
ugcacagcagugaacgua

SEQ ID NO: 1325920 - RNA, 18 nt, Mycobacterium tuberculosis H37Rv
ugcacaggcaucguccgc

SEQ ID NO: 1325921 - RNA, 21 nt, Mycobacterium tuberculosis H37Rv
ugcacagcggcaucgcgggcg

SEQ ID NO: 1325922 - RNA, 22 nt, Mycobacterium tuberculosis H37Rv
ugcacaucggugguuagguggc

SEQ ID NO: 1325923 - RNA, 20 nt, Mycobacterium tuberculosis H37Rv
ugcaucacaagggugcccgg

SEQ ID NO: 1325924 - RNA, 14 nt, Mycobacterium tuberculosis H37Rv
ugcaucaccacugg

SEQ ID NO: 1325925 - RNA, 20 nt, Mycobacterium tuberculosis H37Rv
ugcagcuccccgccggaacu

SEQ ID NO: 1325926 - RNA, 15 nt, Mycobacterium tuberculosis H37Rv
ugcagcucgggcagg

SEQ ID NO: 1325927 - RNA, 17 nt, Mycobacterium tuberculosis H37Rv
ugcagguuuccggccug

SEQ ID NO: 1325928 - RNA, 18 nt, Mycobacterium tuberculosis H37Rv
ugcaggucggcccagguu

SEQ ID NO: 1325929 - RNA, 20 nt, Mycobacterium tuberculosis H37Rv
ugcaggugaacaacagcgcu

SEQ ID NO: 1325930 - RNA, 16 nt, Mycobacterium tuberculosis H37Rv
ugcaggugaugcaugc

SEQ ID NO: 1325931 - RNA, 19 nt, Mycobacterium tuberculosis H37Rv
ugcaggucguccaucgcgu

SEQ ID NO: 1325932 - RNA, 21 nt, Mycobacterium tuberculosis H37Rv
ugcaggugcccggccaaaaug

SEQ ID NO: 1325933 - RNA, 16 nt, Mycobacterium tuberculosis H37Rv
ugcaggugcgggccgg

SEQ ID NO: 1325934 - RNA, 18 nt, Mycobacterium tuberculosis H37Rv
ugcagguuaggguccagg

SEQ ID NO: 1325935 - RNA, 22 nt, Mycobacterium tuberculosis H37Rv
ugcaguggauccggcagcagcc

SEQ ID NO: 1325936 - RNA, 13 nt, Mycobacterium tuberculosis H37Rv
ugcagugcgaccc

SEQ ID NO: 1325937 - RNA, 20 nt, Mycobacterium tuberculosis H37Rv
ugcaguguuuuugcagacuc

SEQ ID NO: 1325938 - RNA, 14 nt, Mycobacterium tuberculosis H37Rv
ugcagugcgccagc

SEQ ID NO: 1325939 - RNA, 22 nt, Mycobacterium tuberculosis H37Rv
ugcagucuuucccggggcuggg

SEQ ID NO: 1325940 - RNA, 15 nt, Mycobacterium tuberculosis H37Rv
ugccaaucgccguca

SEQ ID NO: 1325941 - RNA, 21 nt, Mycobacterium tuberculosis H37Rv
ugccaaucgccgucagcaccg

SEQ ID NO: 1325942 - RNA, 14 nt, Mycobacterium tuberculosis H37Rv
ugccaauuccagcc

SEQ ID NO: 1325943 - RNA, 16 nt, Mycobacterium tuberculosis H37Rv
ugccaauuccagcccc

SEQ ID NO: 1325944 - RNA, 20 nt, Mycobacterium tuberculosis H37Rv
ugccacccagaugcagcggu

SEQ ID NO: 1325945 - RNA, 15 nt, Mycobacterium tuberculosis H37Rv
ugccacccaucgcac

SEQ ID NO: 1325946 - RNA, 16 nt, Mycobacterium tuberculosis H37Rv
ugcaucauggccguga

SEQ ID NO: 1325947 - RNA, 19 nt, Mycobacterium tuberculosis H37Rv
ugcaucugaucaggccaca

SEQ ID NO: 1325948 - RNA, 20 nt, Mycobacterium tuberculosis H37Rv
ugagcggcagccaagcgagc

SEQ ID NO: 1325949 - RNA, 21 nt, Mycobacterium tuberculosis H37Rv
ugagcgcuucgagguggcugc

SEQ ID NO: 1325950 - RNA, 21 nt, Mycobacterium tuberculosis H37Rv
ugagcaagaaguacgugcaca

SEQ ID NO: 1325951 - RNA, 16 nt, Mycobacterium tuberculosis H37Rv
ugagcggccagcaucg

SEQ ID NO: 1325952 - RNA, 12 nt, Mycobacterium tuberculosis H37Rv
ugagcggccagc

SEQ ID NO: 1325953 - RNA, 22 nt, Mycobacterium tuberculosis H37Rv
ugagcggggauguccgcggcca

SEQ ID NO: 1325954 - RNA, 15 nt, Mycobacterium tuberculosis H37Rv
ugaggcgcagcgcca

SEQ ID NO: 1325955 - RNA, 22 nt, Mycobacterium tuberculosis H37Rv
ugaggacuugcacgucggcugc

SEQ ID NO: 1325956 - RNA, 18 nt, Mycobacterium tuberculosis H37Rv
ugaggagaugagcaccaa

SEQ ID NO: 1325957 - RNA, 21 nt, Mycobacterium tuberculosis H37Rv
ugagcuagccguucggcugcc

SEQ ID NO: 1325958 - RNA, 20 nt, Mycobacterium tuberculosis H37Rv
ugagcucuucggacacagcc

SEQ ID NO: 1325959 - RNA, 23 nt, Mycobacterium tuberculosis H37Rv
ugaguggcucgcucugcgcggcu

SEQ ID NO: 1325960 - RNA, 11 nt, Mycobacterium tuberculosis H37Rv
ugaguucggug

SEQ ID NO: 1325961 - RNA, 18 nt, Mycobacterium tuberculosis H37Rv
ugaguucggccaccaacc

SEQ ID NO: 1325962 - RNA, 17 nt, Mycobacterium tuberculosis H37Rv
ugaggcugccgaaguug

SEQ ID NO: 1325963 - RNA, 16 nt, Mycobacterium tuberculosis H37Rv
ugaggcugugccccag

SEQ ID NO: 1325964 - RNA, 13 nt, Mycobacterium tuberculosis H37Rv
ugaggcuggucug

SEQ ID NO: 1325965 - RNA, 15 nt, Mycobacterium tuberculosis H37Rv
ugagguggccgcgca

SEQ ID NO: 1325966 - RNA, 22 nt, Mycobacterium tuberculosis H37Rv
ugaggucuuugcucucggucug

SEQ ID NO: 1325967 - RNA, 22 nt, Mycobacterium tuberculosis H37Rv
ugagugcggacaucguugaccc

SEQ ID NO: 1325968 - RNA, 16 nt, Mycobacterium tuberculosis H37Rv
ugagugcgucucggug

SEQ ID NO: 1325969 - RNA, 22 nt, Mycobacterium tuberculosis H37Rv
ugagucuuucccgccaccaaac

SEQ ID NO: 1325970 - RNA, 13 nt, Mycobacterium tuberculosis H37Rv
ugauagccggaca

SEQ ID NO: 1325971 - RNA, 15 nt, Mycobacterium tuberculosis H37Rv
ugauagcggcgcagc

SEQ ID NO: 1325972 - RNA, 17 nt, Mycobacterium tuberculosis H37Rv
ugauaggcgcgcaguga

SEQ ID NO: 1325973 - RNA, 13 nt, Mycobacterium tuberculosis H37Rv
ugauagggcuguc

SEQ ID NO: 1325974 - RNA, 15 nt, Mycobacterium tuberculosis H37Rv
ugauauccguacagu

SEQ ID NO: 1325975 - RNA, 20 nt, Mycobacterium tuberculosis H37Rv
ugauauccggaaccggucag

SEQ ID NO: 1325976 - RNA, 15 nt, Mycobacterium tuberculosis H37Rv
ugaucgccacccggu

SEQ ID NO: 1325977 - RNA, 18 nt, Mycobacterium tuberculosis H37Rv
ugaucgacggccagccca

SEQ ID NO: 1325978 - RNA, 14 nt, Mycobacterium tuberculosis H37Rv
ugaucgaccggaca

SEQ ID NO: 1325979 - RNA, 14 nt, Mycobacterium tuberculosis H37Rv
ugaucgccgggccg

SEQ ID NO: 1325980 - RNA, 19 nt, Mycobacterium tuberculosis H37Rv
ugaucuugccacuccagga

SEQ ID NO: 1325981 - RNA, 21 nt, Mycobacterium tuberculosis H37Rv
ugaucugggcugcggccgcga

SEQ ID NO: 1325982 - RNA, 18 nt, Mycobacterium tuberculosis H37Rv
ugaucagggucagcgccg

SEQ ID NO: 1325983 - RNA, 19 nt, Mycobacterium tuberculosis H37Rv
ugaucaggaaccaguccuc

SEQ ID NO: 1325984 - RNA, 12 nt, Mycobacterium tuberculosis H37Rv
ugaucaugaacg

SEQ ID NO: 1325985 - RNA, 21 nt, Mycobacterium tuberculosis H37Rv
ugaucaugaacgccagcagcg

SEQ ID NO: 1325986 - RNA, 13 nt, Mycobacterium tuberculosis H37Rv
ugauccgcugggc

SEQ ID NO: 1325987 - RNA, 19 nt, Mycobacterium tuberculosis H37Rv
ugauccgcgcaacuuccau

SEQ ID NO: 1325988 - RNA, 16 nt, Mycobacterium tuberculosis H37Rv
ugacgucgccgggcgg

SEQ ID NO: 1325989 - RNA, 12 nt, Mycobacterium tuberculosis H37Rv
ugacgugcauga

SEQ ID NO: 1325990 - RNA, 22 nt, Mycobacterium tuberculosis H37Rv
ugacguuuggauggcuggccag

SEQ ID NO: 1325991 - RNA, 15 nt, Mycobacterium tuberculosis H37Rv
ugacggcgccaggca

SEQ ID NO: 1325992 - RNA, 13 nt, Mycobacterium tuberculosis H37Rv
ugacgguacagcu

SEQ ID NO: 1325993 - RNA, 22 nt, Mycobacterium tuberculosis H37Rv
ugacguagggcagcgccaggcc

SEQ ID NO: 1325994 - RNA, 12 nt, Mycobacterium tuberculosis H37Rv
ugacguagacgg

SEQ ID NO: 1325995 - RNA, 15 nt, Mycobacterium tuberculosis H37Rv
ugacguccagggcca

SEQ ID NO: 1325996 - RNA, 16 nt, Mycobacterium tuberculosis H37Rv
ugacugaacucaacac

SEQ ID NO: 1325997 - RNA, 19 nt, Mycobacterium tuberculosis H37Rv
ugacucugcguccaccgga

SEQ ID NO: 1325998 - RNA, 17 nt, Mycobacterium tuberculosis H37Rv
ugacucgcuccgaccgg

SEQ ID NO: 1325999 - RNA, 21 nt, Mycobacterium tuberculosis H37Rv
ugacucagaacguggccguua

SEQ ID NO: 1326000 - RNA, 17 nt, Mycobacterium tuberculosis H37Rv
ugagaaccggcucacca

SEQ ID NO: 1326001 - RNA, 12 nt, Mycobacterium tuberculosis H37Rv
ugagagaugguc

SEQ ID NO: 1326002 - RNA, 18 nt, Mycobacterium tuberculosis H37Rv
ugacgccgaugaagccaa

SEQ ID NO: 1326003 - RNA, 16 nt, Mycobacterium tuberculosis H37Rv
ugacgcccaucucaug

SEQ ID NO: 1326004 - RNA, 15 nt, Mycobacterium tuberculosis H37Rv
ugacgccguugccgc

SEQ ID NO: 1326005 - RNA, 20 nt, Mycobacterium tuberculosis H37Rv
ugacgccucgacacccagcc

SEQ ID NO: 1326006 - RNA, 15 nt, Mycobacterium tuberculosis H37Rv
ugacgcgccguaaca

SEQ ID NO: 1326007 - RNA, 14 nt, Mycobacterium tuberculosis H37Rv
ugacgcgcgccgga

SEQ ID NO: 1326008 - RNA, 18 nt, Mycobacterium tuberculosis H37Rv
ugacgcuacgacaguguu

SEQ ID NO: 1326009 - RNA, 18 nt, Mycobacterium tuberculosis H37Rv
ugacgaucgacagccccg

SEQ ID NO: 1326010 - RNA, 15 nt, Mycobacterium tuberculosis H37Rv
ugacgaucaggucgc

SEQ ID NO: 1326011 - RNA, 17 nt, Mycobacterium tuberculosis H37Rv
ugacgaucggcggcgcg

SEQ ID NO: 1326012 - RNA, 21 nt, Mycobacterium tuberculosis H37Rv
ugacgauuuccaugcugggga

SEQ ID NO: 1326013 - RNA, 23 nt, Mycobacterium tuberculosis H37Rv
ugacgagcagcuagcccggcagc

SEQ ID NO: 1326014 - RNA, 15 nt, Mycobacterium tuberculosis H37Rv
ugacgaccagccccg

SEQ ID NO: 1326015 - RNA, 22 nt, Mycobacterium tuberculosis H37Rv
ugacgacgagggccagcagccg

SEQ ID NO: 1326016 - RNA, 20 nt, Mycobacterium tuberculosis H37Rv
ugacgacgagggcgggaccc

SEQ ID NO: 1326017 - RNA, 17 nt, Mycobacterium tuberculosis H37Rv
ugaccgaagaagcccga

SEQ ID NO: 1326018 - RNA, 17 nt, Mycobacterium tuberculosis H37Rv
ugaccgggcagguagcu

SEQ ID NO: 1326019 - RNA, 22 nt, Mycobacterium tuberculosis H37Rv
ugaccgguauuaccgccguggc

SEQ ID NO: 1326020 - RNA, 14 nt, Mycobacterium tuberculosis H37Rv
ugaccuauugaacc

SEQ ID NO: 1326021 - RNA, 13 nt, Mycobacterium tuberculosis H37Rv
ugaccucaccaac

SEQ ID NO: 1326022 - RNA, 22 nt, Mycobacterium tuberculosis H37Rv
ugaccgucugcgacccgggccg

SEQ ID NO: 1326023 - RNA, 22 nt, Mycobacterium tuberculosis H37Rv
ugaccggggcgcccggccaggu

SEQ ID NO: 1326024 - RNA, 14 nt, Mycobacterium tuberculosis H37Rv
ugacaucgggccgc

SEQ ID NO: 1326025 - RNA, 22 nt, Mycobacterium tuberculosis H37Rv
ugacaucggccaagguugucgc

SEQ ID NO: 1326026 - RNA, 23 nt, Mycobacterium tuberculosis H37Rv
ugaccaaugucagugccccgccc

SEQ ID NO: 1326027 - RNA, 22 nt, Mycobacterium tuberculosis H37Rv
ugaccaacaccccccccaccca

SEQ ID NO: 1326028 - RNA, 22 nt, Mycobacterium tuberculosis H37Rv
ugacccaucaugguccgggccu

SEQ ID NO: 1326029 - RNA, 18 nt, Mycobacterium tuberculosis H37Rv
ugacccccagcagggugu

SEQ ID NO: 1326030 - RNA, 19 nt, Mycobacterium tuberculosis H37Rv
ugacccccgaccccgacgg

SEQ ID NO: 1326031 - RNA, 17 nt, Mycobacterium tuberculosis H37Rv
ugacccaucucgucguc

SEQ ID NO: 1326032 - RNA, 14 nt, Mycobacterium tuberculosis H37Rv
ugacccccuagacc

SEQ ID NO: 1326033 - RNA, 22 nt, Mycobacterium tuberculosis H37Rv
ugaccccgccggcugcggaggc

SEQ ID NO: 1326034 - RNA, 22 nt, Mycobacterium tuberculosis H37Rv
ugacccccggguagaccaccug

SEQ ID NO: 1326035 - RNA, 21 nt, Mycobacterium tuberculosis H37Rv
ugacccgacgaugccggcccg

SEQ ID NO: 1326036 - RNA, 13 nt, Mycobacterium tuberculosis H37Rv
ugaccccggcguu

SEQ ID NO: 1326037 - RNA, 18 nt, Mycobacterium tuberculosis H37Rv
ugaccccggcguugccgc

SEQ ID NO: 1326038 - RNA, 12 nt, Mycobacterium tuberculosis H37Rv
ugacccuggggu

SEQ ID NO: 1326039 - RNA, 16 nt, Mycobacterium tuberculosis H37Rv
ugacccguuccacgcc

SEQ ID NO: 1326040 - RNA, 15 nt, Mycobacterium tuberculosis H37Rv
ugacccgcugggccg

SEQ ID NO: 1326041 - RNA, 22 nt, Mycobacterium tuberculosis H37Rv
ugacccggcagcccggcggccg

SEQ ID NO: 1326042 - RNA, 23 nt, Mycobacterium tuberculosis H37Rv
ugacccgccgacgaccgccugca

SEQ ID NO: 1326043 - RNA, 17 nt, Mycobacterium tuberculosis H37Rv
ugacccgggccgggccg

SEQ ID NO: 1326044 - RNA, 17 nt, Mycobacterium tuberculosis H37Rv
ugaccagaaccuggagc

SEQ ID NO: 1326045 - RNA, 12 nt, Mycobacterium tuberculosis H37Rv
ugacccacugca

SEQ ID NO: 1326046 - RNA, 19 nt, Mycobacterium tuberculosis H37Rv
ugaccaccgccgacaggcc

SEQ ID NO: 1326047 - RNA, 12 nt, Mycobacterium tuberculosis H37Rv
ugaccaccgccg

SEQ ID NO: 1326048 - RNA, 13 nt, Mycobacterium tuberculosis H37Rv
ucucggucccgcc

SEQ ID NO: 1326049 - RNA, 19 nt, Mycobacterium tuberculosis H37Rv
ucucgguggacggcaggcg

SEQ ID NO: 1326050 - RNA, 23 nt, Mycobacterium tuberculosis H37Rv
ucucguaucgcacccgccggcgg

SEQ ID NO: 1326051 - RNA, 15 nt, Mycobacterium tuberculosis H37Rv
ucgcauucugcugcc

SEQ ID NO: 1326052 - RNA, 16 nt, Mycobacterium tuberculosis H37Rv
ucgcauucugcugcca

SEQ ID NO: 1326053 - RNA, 20 nt, Mycobacterium tuberculosis H37Rv
ucucuucgcgcgcugggcgc

SEQ ID NO: 1326054 - RNA, 20 nt, Mycobacterium tuberculosis H37Rv
ucugagaccucagccggcgg

SEQ ID NO: 1326055 - RNA, 15 nt, Mycobacterium tuberculosis H37Rv
ucugaucugagaccu

SEQ ID NO: 1326056 - RNA, 18 nt, Mycobacterium tuberculosis H37Rv
ucuggagugaggcugugc

SEQ ID NO: 1326057 - RNA, 22 nt, Mycobacterium tuberculosis H37Rv
ucuggagugaggcugugcccca

SEQ ID NO: 1326058 - RNA, 13 nt, Mycobacterium tuberculosis H37Rv
ucuggauacccag

SEQ ID NO: 1326059 - RNA, 20 nt, Mycobacterium tuberculosis H37Rv
ucuggacaucggccggcguc

SEQ ID NO: 1326060 - RNA, 19 nt, Mycobacterium tuberculosis H37Rv
ucuggcgacgauucacggc

SEQ ID NO: 1326061 - RNA, 14 nt, Mycobacterium tuberculosis H37Rv
ucuggccugcccca

SEQ ID NO: 1326062 - RNA, 15 nt, Mycobacterium tuberculosis H37Rv
ucuggcgaacaguga

SEQ ID NO: 1326063 - RNA, 14 nt, Mycobacterium tuberculosis H37Rv
ucugggcuuugcag

SEQ ID NO: 1326064 - RNA, 20 nt, Mycobacterium tuberculosis H37Rv
ucuggggcaccacgcugugc

SEQ ID NO: 1326065 - RNA, 14 nt, Mycobacterium tuberculosis H37Rv
ucugggugcagguu

SEQ ID NO: 1326066 - RNA, 17 nt, Mycobacterium tuberculosis H37Rv
ucugggcuuucagcacc

SEQ ID NO: 1326067 - RNA, 17 nt, Mycobacterium tuberculosis H37Rv
ucuggcgcugcuggcag

SEQ ID NO: 1326068 - RNA, 23 nt, Mycobacterium tuberculosis H37Rv
ucuggcgcgccaccgugguucgg

SEQ ID NO: 1326069 - RNA, 17 nt, Mycobacterium tuberculosis H37Rv
ucugcguauaggucaga

SEQ ID NO: 1326070 - RNA, 22 nt, Mycobacterium tuberculosis H37Rv
ucugcgcucccguacgccggcg

SEQ ID NO: 1326071 - RNA, 14 nt, Mycobacterium tuberculosis H37Rv
ucugcgugggccug

SEQ ID NO: 1326072 - RNA, 16 nt, Mycobacterium tuberculosis H37Rv
ucugcugaccggaguu

SEQ ID NO: 1326073 - RNA, 21 nt, Mycobacterium tuberculosis H37Rv
ucugcucgcccuauacgcaac

SEQ ID NO: 1326074 - RNA, 17 nt, Mycobacterium tuberculosis H37Rv
ucugcucggcaucggaa

SEQ ID NO: 1326075 - RNA, 15 nt, Mycobacterium tuberculosis H37Rv
ucugcucgccaggcc

SEQ ID NO: 1326076 - RNA, 17 nt, Mycobacterium tuberculosis H37Rv
ucugccuuggccggcuu

SEQ ID NO: 1326077 - RNA, 15 nt, Mycobacterium tuberculosis H37Rv
ucugcgacaagaccg

SEQ ID NO: 1326078 - RNA, 15 nt, Mycobacterium tuberculosis H37Rv
ucugcgacccgggcc

SEQ ID NO: 1326079 - RNA, 20 nt, Mycobacterium tuberculosis H37Rv
ucugcgagauguccucccau

SEQ ID NO: 1326080 - RNA, 14 nt, Mycobacterium tuberculosis H37Rv
ucugccggccggcg

SEQ ID NO: 1326081 - RNA, 23 nt, Mycobacterium tuberculosis H37Rv
ucugccucucagcacgguuguug

SEQ ID NO: 1326082 - RNA, 20 nt, Mycobacterium tuberculosis H37Rv
ucugcgcgucaggccagcgc

SEQ ID NO: 1326083 - RNA, 12 nt, Mycobacterium tuberculosis H37Rv
ucugcgccgccg

SEQ ID NO: 1326084 - RNA, 17 nt, Mycobacterium tuberculosis H37Rv
ucugcgcgaugcccacg

SEQ ID NO: 1326085 - RNA, 14 nt, Mycobacterium tuberculosis H37Rv
ucugcgccaaaauc

SEQ ID NO: 1326086 - RNA, 13 nt, Mycobacterium tuberculosis H37Rv
ucugcgccacagc

SEQ ID NO: 1326087 - RNA, 17 nt, Mycobacterium tuberculosis H37Rv
ucugcgaucccgaucgc

SEQ ID NO: 1326088 - RNA, 18 nt, Mycobacterium tuberculosis H37Rv
ucugcgccacagcagcgu

SEQ ID NO: 1326089 - RNA, 16 nt, Mycobacterium tuberculosis H37Rv
ucugccaggcgcagcu

SEQ ID NO: 1326090 - RNA, 23 nt, Mycobacterium tuberculosis H37Rv
ucugcccgagguccgcccucagu

SEQ ID NO: 1326091 - RNA, 17 nt, Mycobacterium tuberculosis H37Rv
ucugcccgcccagcccg

SEQ ID NO: 1326092 - RNA, 16 nt, Mycobacterium tuberculosis H37Rv
ucugccaugugucccg

SEQ ID NO: 1326093 - RNA, 20 nt, Mycobacterium tuberculosis H37Rv
ucugguaggcggccauguca

SEQ ID NO: 1326094 - RNA, 17 nt, Mycobacterium tuberculosis H37Rv
ucuuacucgucacgggg

SEQ ID NO: 1326095 - RNA, 13 nt, Mycobacterium tuberculosis H37Rv
ucuuagccagcag

SEQ ID NO: 1326096 - RNA, 18 nt, Mycobacterium tuberculosis H37Rv
ucuuccccucggccgccc

SEQ ID NO: 1326097 - RNA, 18 nt, Mycobacterium tuberculosis H37Rv
ucuucccauuucggcaaa

SEQ ID NO: 1326098 - RNA, 21 nt, Mycobacterium tuberculosis H37Rv
ucuucgccgucacgcacgccg

SEQ ID NO: 1326099 - RNA, 23 nt, Mycobacterium tuberculosis H37Rv
ucuugaccgcggugacucggccu

SEQ ID NO: 1326100 - RNA, 16 nt, Mycobacterium tuberculosis H37Rv
ucuugaccgcaccggc

SEQ ID NO: 1326101 - RNA, 15 nt, Mycobacterium tuberculosis H37Rv
ucuugaccagcagcu

SEQ ID NO: 1326102 - RNA, 16 nt, Mycobacterium tuberculosis H37Rv
ucuugaacugggccuc

SEQ ID NO: 1326103 - RNA, 19 nt, Mycobacterium tuberculosis H37Rv
ucuugcagugcgccagcga

SEQ ID NO: 1326104 - RNA, 19 nt, Mycobacterium tuberculosis H37Rv
ucuugccgucggccggcaa

SEQ ID NO: 1326105 - RNA, 20 nt, Mycobacterium tuberculosis H37Rv
ucuugccgccgcgccggcag

SEQ ID NO: 1326106 - RNA, 15 nt, Mycobacterium tuberculosis H37Rv
ucuugccggccagga

SEQ ID NO: 1326107 - RNA, 13 nt, Mycobacterium tuberculosis H37Rv
ucuugggccggga

SEQ ID NO: 1326108 - RNA, 15 nt, Mycobacterium tuberculosis H37Rv
ucuuggcgggugacu

SEQ ID NO: 1326109 - RNA, 19 nt, Mycobacterium tuberculosis H37Rv
ucuugggggccaaccgggu

SEQ ID NO: 1326110 - RNA, 16 nt, Mycobacterium tuberculosis H37Rv
ucuuggcgggcgccuu

SEQ ID NO: 1326111 - RNA, 15 nt, Mycobacterium tuberculosis H37Rv
ucuuggcgggagccu

SEQ ID NO: 1326112 - RNA, 21 nt, Mycobacterium tuberculosis H37Rv
ucuuggcguugaugucggcca

SEQ ID NO: 1326113 - RNA, 18 nt, Mycobacterium tuberculosis H37Rv
ucuuggcgauccaggcca

SEQ ID NO: 1326114 - RNA, 15 nt, Mycobacterium tuberculosis H37Rv
ucuuggacagcagca

SEQ ID NO: 1326115 - RNA, 16 nt, Mycobacterium tuberculosis H37Rv
ucuuugguagucugca

SEQ ID NO: 1326116 - RNA, 20 nt, Mycobacterium tuberculosis H37Rv
ucuuugcucucggucugcau

SEQ ID NO: 1326117 - RNA, 22 nt, Mycobacterium tuberculosis H37Rv
ucuuucccgccaccaaacccca

SEQ ID NO: 1326118 - RNA, 23 nt, Mycobacterium tuberculosis H37Rv
ucuuuggucgccggaccagagcc

SEQ ID NO: 1326119 - RNA, 14 nt, Mycobacterium tuberculosis H37Rv
ugaacaguugcaca

SEQ ID NO: 1326120 - RNA, 23 nt, Mycobacterium tuberculosis H37Rv
ugaaccgguugacacccgggcca

SEQ ID NO: 1326121 - RNA, 21 nt, Mycobacterium tuberculosis H37Rv
ugaaauccuaggguggcgauc

SEQ ID NO: 1326122 - RNA, 20 nt, Mycobacterium tuberculosis H37Rv
ugaacagcgacgccaugguc

SEQ ID NO: 1326123 - RNA, 18 nt, Mycobacterium tuberculosis H37Rv
ugaacucgaguugcucga

SEQ ID NO: 1326124 - RNA, 14 nt, Mycobacterium tuberculosis H37Rv
ugaacucgaagacc

SEQ ID NO: 1326125 - RNA, 16 nt, Mycobacterium tuberculosis H37Rv
ugaacgcguagucgcg

SEQ ID NO: 1326126 - RNA, 18 nt, Mycobacterium tuberculosis H37Rv
ugaacgcuguaagcaugc

SEQ ID NO: 1326127 - RNA, 22 nt, Mycobacterium tuberculosis H37Rv
ugaacggcaacguuuacgaugc

SEQ ID NO: 1326128 - RNA, 21 nt, Mycobacterium tuberculosis H37Rv
ugaacggcaaggucgcggcca

SEQ ID NO: 1326129 - RNA, 17 nt, Mycobacterium tuberculosis H37Rv
ugaacgcugucccagcc

SEQ ID NO: 1326130 - RNA, 15 nt, Mycobacterium tuberculosis H37Rv
ugaacggcaccagcg

SEQ ID NO: 1326131 - RNA, 19 nt, Mycobacterium tuberculosis H37Rv
ugaacggcucgggaacuuc

SEQ ID NO: 1326132 - RNA, 12 nt, Mycobacterium tuberculosis H37Rv
ugaaggagaucc

SEQ ID NO: 1326133 - RNA, 17 nt, Mycobacterium tuberculosis H37Rv
ugaaggcaaacaccagc

SEQ ID NO: 1326134 - RNA, 18 nt, Mycobacterium tuberculosis H37Rv
ugaagaccaccgcccaca

SEQ ID NO: 1326135 - RNA, 22 nt, Mycobacterium tuberculosis H37Rv
ugaagaccaccgcccacagcaa

SEQ ID NO: 1326136 - RNA, 23 nt, Mycobacterium tuberculosis H37Rv
ugaagaccaccgcccacagcaac

SEQ ID NO: 1326137 - RNA, 20 nt, Mycobacterium tuberculosis H37Rv
ugaagaaugccgucugauca

SEQ ID NO: 1326138 - RNA, 11 nt, Mycobacterium tuberculosis H37Rv
ugaagaagccc

SEQ ID NO: 1326139 - RNA, 22 nt, Mycobacterium tuberculosis H37Rv
ugaagccagcgcagcaccgaac

SEQ ID NO: 1326140 - RNA, 22 nt, Mycobacterium tuberculosis H37Rv
ugaagccaaaugcgcugucgcc

SEQ ID NO: 1326141 - RNA, 14 nt, Mycobacterium tuberculosis H37Rv
ugaagcagacguca

SEQ ID NO: 1326142 - RNA, 23 nt, Mycobacterium tuberculosis H37Rv
ugaaacgauugcugcggcuuuca

SEQ ID NO: 1326143 - RNA, 20 nt, Mycobacterium tuberculosis H37Rv
ugaaacggugucucgcccac

SEQ ID NO: 1326144 - RNA, 24 nt, Mycobacterium tuberculosis H37Rv
ucaugucgaagaaccggccgacga

SEQ ID NO: 1326145 - RNA, 14 nt, Mycobacterium tuberculosis H37Rv
ucauugucccggcc

SEQ ID NO: 1326146 - RNA, 19 nt, Mycobacterium tuberculosis H37Rv
uccaacaguucucgcgcuu

SEQ ID NO: 1326147 - RNA, 14 nt, Mycobacterium tuberculosis H37Rv
uccaacgaucaguc

SEQ ID NO: 1326148 - RNA, 22 nt, Mycobacterium tuberculosis H37Rv
uccaacgacuguggcgccgccg

SEQ ID NO: 1326149 - RNA, 14 nt, Mycobacterium tuberculosis H37Rv
uccaacgcggcgcg

SEQ ID NO: 1326150 - RNA, 19 nt, Mycobacterium tuberculosis H37Rv
uccaacuggccgcgucgcu

SEQ ID NO: 1326151 - RNA, 18 nt, Mycobacterium tuberculosis H37Rv
uccaacucggcggccagc

SEQ ID NO: 1326152 - RNA, 15 nt, Mycobacterium tuberculosis H37Rv
uccaacuggccgcgu

SEQ ID NO: 1326153 - RNA, 15 nt, Mycobacterium tuberculosis H37Rv
uccaagugggccggc

SEQ ID NO: 1326154 - RNA, 23 nt, Mycobacterium tuberculosis H37Rv
uccaagcggagacugguugcgga

SEQ ID NO: 1326155 - RNA, 20 nt, Mycobacterium tuberculosis H37Rv
uccaagcaauuccaccgccg

SEQ ID NO: 1326156 - RNA, 23 nt, Mycobacterium tuberculosis H37Rv
uccaagccgggugggagcagccg

SEQ ID NO: 1326157 - RNA, 17 nt, Mycobacterium tuberculosis H37Rv
uccaagcucgacaacug

SEQ ID NO: 1326158 - RNA, 18 nt, Mycobacterium tuberculosis H37Rv
uccacccagugccacgcc

SEQ ID NO: 1326159 - RNA, 22 nt, Mycobacterium tuberculosis H37Rv
uccaccagcguguagcgaugcc

SEQ ID NO: 1326160 - RNA, 14 nt, Mycobacterium tuberculosis H37Rv
uccacaauccugaa

SEQ ID NO: 1326161 - RNA, 12 nt, Mycobacterium tuberculosis H37Rv
uccacaccaggc

SEQ ID NO: 1326162 - RNA, 18 nt, Mycobacterium tuberculosis H37Rv
uccacacgcugcccgcca

SEQ ID NO: 1326163 - RNA, 14 nt, Mycobacterium tuberculosis H37Rv
uccacgucuccugu

SEQ ID NO: 1326164 - RNA, 20 nt, Mycobacterium tuberculosis H37Rv
uccacggcgaugcagccaca

SEQ ID NO: 1326165 - RNA, 13 nt, Mycobacterium tuberculosis H37Rv
uccacggccaggu

SEQ ID NO: 1326166 - RNA, 20 nt, Mycobacterium tuberculosis H37Rv
uccacgcacugccgcggacg

SEQ ID NO: 1326167 - RNA, 18 nt, Mycobacterium tuberculosis H37Rv
uccacgcagcccgucggc

SEQ ID NO: 1326168 - RNA, 21 nt, Mycobacterium tuberculosis H37Rv
uccacgcaccacgagcagccg

SEQ ID NO: 1326169 - RNA, 18 nt, Mycobacterium tuberculosis H37Rv
uccacgaucggcccagcc

SEQ ID NO: 1326170 - RNA, 23 nt, Mycobacterium tuberculosis H37Rv
uccagaagaagaugaucgcgaac

SEQ ID NO: 1326171 - RNA, 22 nt, Mycobacterium tuberculosis H37Rv
uccagaaccgaagccucggcau

SEQ ID NO: 1326172 - RNA, 18 nt, Mycobacterium tuberculosis H37Rv
uccacuuggggcgccagg

SEQ ID NO: 1326173 - RNA, 20 nt, Mycobacterium tuberculosis H37Rv
uccagaaguaggcgaccgcc

SEQ ID NO: 1326174 - RNA, 13 nt, Mycobacterium tuberculosis H37Rv
uccagaaggccgc

SEQ ID NO: 1326175 - RNA, 17 nt, Mycobacterium tuberculosis H37Rv
uccagcaguacaccgcc

SEQ ID NO: 1326176 - RNA, 18 nt, Mycobacterium tuberculosis H37Rv
uccagcaggucgccugcc

SEQ ID NO: 1326177 - RNA, 15 nt, Mycobacterium tuberculosis H37Rv
uccagcaugcccgcc

SEQ ID NO: 1326178 - RNA, 18 nt, Mycobacterium tuberculosis H37Rv
uccagccaacgggaacaa

SEQ ID NO: 1326179 - RNA, 15 nt, Mycobacterium tuberculosis H37Rv
uccagccacagcccg

SEQ ID NO: 1326180 - RNA, 21 nt, Mycobacterium tuberculosis H37Rv
uccaggagccccagguagucg

SEQ ID NO: 1326181 - RNA, 19 nt, Mycobacterium tuberculosis H37Rv
uccaggcacuccagcggcg

SEQ ID NO: 1326182 - RNA, 19 nt, Mycobacterium tuberculosis H37Rv
uccagcggguggccaucac

SEQ ID NO: 1326183 - RNA, 13 nt, Mycobacterium tuberculosis H37Rv
uccagcgcggccu

SEQ ID NO: 1326184 - RNA, 21 nt, Mycobacterium tuberculosis H37Rv
uccagcgcguaguccgcaucc

SEQ ID NO: 1326185 - RNA, 21 nt, Mycobacterium tuberculosis H37Rv
uccagcggaucgucguuguca

SEQ ID NO: 1326186 - RNA, 14 nt, Mycobacterium tuberculosis H37Rv
uccagcgccgaccu

SEQ ID NO: 1326187 - RNA, 14 nt, Mycobacterium tuberculosis H37Rv
uccaucaaggucau

SEQ ID NO: 1326188 - RNA, 19 nt, Mycobacterium tuberculosis H37Rv
uccagguucuucuccacca

SEQ ID NO: 1326189 - RNA, 21 nt, Mycobacterium tuberculosis H37Rv
uccagguggcgcggacccgcc

SEQ ID NO: 1326190 - RNA, 20 nt, Mycobacterium tuberculosis H37Rv
uccagguccaaguccuccac

SEQ ID NO: 1326191 - RNA, 23 nt, Mycobacterium tuberculosis H37Rv
uccaggccuaguccggcacugcg

SEQ ID NO: 1326192 - RNA, 13 nt, Mycobacterium tuberculosis H37Rv
uccaggccggcag

SEQ ID NO: 1326193 - RNA, 14 nt, Mycobacterium tuberculosis H37Rv
uccaguaaccgucc

SEQ ID NO: 1326194 - RNA, 17 nt, Mycobacterium tuberculosis H37Rv
uccaucacggaccaggc

SEQ ID NO: 1326195 - RNA, 19 nt, Mycobacterium tuberculosis H37Rv
uccaucacauccacgcacu

SEQ ID NO: 1326196 - RNA, 15 nt, Mycobacterium tuberculosis H37Rv
uccaugacaaaccug

SEQ ID NO: 1326197 - RNA, 16 nt, Mycobacterium tuberculosis H37Rv
uccaugacaaaccugc

SEQ ID NO: 1326198 - RNA, 14 nt, Mycobacterium tuberculosis H37Rv
uccaucgcgcugcg

SEQ ID NO: 1326199 - RNA, 19 nt, Mycobacterium tuberculosis H37Rv
uccaugaggauuugguggc

SEQ ID NO: 1326200 - RNA, 14 nt, Mycobacterium tuberculosis H37Rv
uccaugcuggggag

SEQ ID NO: 1326201 - RNA, 21 nt, Mycobacterium tuberculosis H37Rv
uccauguuuugcugcaugccg

SEQ ID NO: 1326202 - RNA, 15 nt, Mycobacterium tuberculosis H37Rv
uccaugugcccaggu

SEQ ID NO: 1326203 - RNA, 14 nt, Mycobacterium tuberculosis H37Rv
uccaugugcccagg

SEQ ID NO: 1326204 - RNA, 14 nt, Mycobacterium tuberculosis H37Rv
ucccaccaccaccg

SEQ ID NO: 1326205 - RNA, 17 nt, Mycobacterium tuberculosis H37Rv
ucccaccaccgcucguc

SEQ ID NO: 1326206 - RNA, 22 nt, Mycobacterium tuberculosis H37Rv
ucccacagguuugcgccgcgca

SEQ ID NO: 1326207 - RNA, 18 nt, Mycobacterium tuberculosis H37Rv
ucccaccgcuuccagguu

SEQ ID NO: 1326208 - RNA, 20 nt, Mycobacterium tuberculosis H37Rv
ucccacagguagaccgucuc

SEQ ID NO: 1326209 - RNA, 18 nt, Mycobacterium tuberculosis H37Rv
uccauuggaaccugaucc

SEQ ID NO: 1326210 - RNA, 15 nt, Mycobacterium tuberculosis H37Rv
ucccaucccaugucg

SEQ ID NO: 1326211 - RNA, 19 nt, Mycobacterium tuberculosis H37Rv
ucccaucaguugcacaccg

SEQ ID NO: 1326212 - RNA, 21 nt, Mycobacterium tuberculosis H37Rv
ucccagucgcggcgcgaggag

SEQ ID NO: 1326213 - RNA, 14 nt, Mycobacterium tuberculosis H37Rv
ucccacuggagguc

SEQ ID NO: 1326214 - RNA, 17 nt, Mycobacterium tuberculosis H37Rv
ucccacgaguuggccaa

SEQ ID NO: 1326215 - RNA, 21 nt, Mycobacterium tuberculosis H37Rv
ucccacggccggccgcugcca

SEQ ID NO: 1326216 - RNA, 16 nt, Mycobacterium tuberculosis H37Rv
ucccagauaugcagga

SEQ ID NO: 1326217 - RNA, 14 nt, Mycobacterium tuberculosis H37Rv
ucccccacacaccc

SEQ ID NO: 1326218 - RNA, 12 nt, Mycobacterium tuberculosis H37Rv
ucccccgcgaag

SEQ ID NO: 1326219 - RNA, 17 nt, Mycobacterium tuberculosis H37Rv
ucccccgccaaccccaa

SEQ ID NO: 1326220 - RNA, 12 nt, Mycobacterium tuberculosis H37Rv
uccccagcacca

SEQ ID NO: 1326221 - RNA, 14 nt, Mycobacterium tuberculosis H37Rv
uccccaggccgcuu

SEQ ID NO: 1326222 - RNA, 16 nt, Mycobacterium tuberculosis H37Rv
uccccaggugggcagc

SEQ ID NO: 1326223 - RNA, 22 nt, Mycobacterium tuberculosis H37Rv
uccccaggugggcagcaggccc

SEQ ID NO: 1326224 - RNA, 23 nt, Mycobacterium tuberculosis H37Rv
uccccaggugugugccucagugg

SEQ ID NO: 1326225 - RNA, 13 nt, Mycobacterium tuberculosis H37Rv
uccccauugcgcc

SEQ ID NO: 1326226 - RNA, 17 nt, Mycobacterium tuberculosis H37Rv
ucccauucccaacacag

SEQ ID NO: 1326227 - RNA, 15 nt, Mycobacterium tuberculosis H37Rv
ucccauucguagucg

SEQ ID NO: 1326228 - RNA, 14 nt, Mycobacterium tuberculosis H37Rv
uccccaccgucguc

SEQ ID NO: 1326229 - RNA, 18 nt, Mycobacterium tuberculosis H37Rv
uccccagaccggcggcua

SEQ ID NO: 1326230 - RNA, 18 nt, Mycobacterium tuberculosis H37Rv
uccccagacagaccccca

SEQ ID NO: 1326231 - RNA, 21 nt, Mycobacterium tuberculosis H37Rv
uccccguugacccagaccggc

SEQ ID NO: 1326232 - RNA, 20 nt, Mycobacterium tuberculosis H37Rv
uccccggcggcagcauaucc

SEQ ID NO: 1326233 - RNA, 22 nt, Mycobacterium tuberculosis H37Rv
uccccgguacgucgagggugac

SEQ ID NO: 1326234 - RNA, 22 nt, Mycobacterium tuberculosis H37Rv
uccccggagaacuugagcuccu

SEQ ID NO: 1326235 - RNA, 20 nt, Mycobacterium tuberculosis H37Rv
uccccgacggacuccggccg

SEQ ID NO: 1326236 - RNA, 12 nt, Mycobacterium tuberculosis H37Rv
uccccgccgccg

SEQ ID NO: 1326237 - RNA, 14 nt, Mycobacterium tuberculosis H37Rv
uccccgccgccguu

SEQ ID NO: 1326238 - RNA, 13 nt, Mycobacterium tuberculosis H37Rv
uccccgccggcgg

SEQ ID NO: 1326239 - RNA, 20 nt, Mycobacterium tuberculosis H37Rv
uccccgcggcgguaaaccug

SEQ ID NO: 1326240 - RNA, 15 nt, Mycobacterium tuberculosis H37Rv
uccccgcgcugagca

SEQ ID NO: 1326241 - RNA, 17 nt, Mycobacterium tuberculosis H37Rv
ucccgaucccggccagc

SEQ ID NO: 1326242 - RNA, 20 nt, Mycobacterium tuberculosis H37Rv
ucccgauguaugacagguca

SEQ ID NO: 1326243 - RNA, 15 nt, Mycobacterium tuberculosis H37Rv
ucccgaggcgcccaa

SEQ ID NO: 1326244 - RNA, 23 nt, Mycobacterium tuberculosis H37Rv
ucccgaacaauucacgcaccaca

SEQ ID NO: 1326245 - RNA, 23 nt, Mycobacterium tuberculosis H37Rv
ucccgaacaacucggugccuguc

SEQ ID NO: 1326246 - RNA, 13 nt, Mycobacterium tuberculosis H37Rv
uccccuggccagc

SEQ ID NO: 1326247 - RNA, 15 nt, Mycobacterium tuberculosis H37Rv
uccccugauggaccc

SEQ ID NO: 1326248 - RNA, 18 nt, Mycobacterium tuberculosis H37Rv
ucccggugaccacuugca

SEQ ID NO: 1326249 - RNA, 13 nt, Mycobacterium tuberculosis H37Rv
ucccgguagcggc

SEQ ID NO: 1326250 - RNA, 16 nt, Mycobacterium tuberculosis H37Rv
ucccguacgccggcgg

SEQ ID NO: 1326251 - RNA, 19 nt, Mycobacterium tuberculosis H37Rv
ucccguacucccguggccg

SEQ ID NO: 1326252 - RNA, 18 nt, Mycobacterium tuberculosis H37Rv
ucccgugcgcgcgcagcu

SEQ ID NO: 1326253 - RNA, 17 nt, Mycobacterium tuberculosis H37Rv
ucccguugccgcccacu

SEQ ID NO: 1326254 - RNA, 18 nt, Mycobacterium tuberculosis H37Rv
ucccguugccgcccacua

SEQ ID NO: 1326255 - RNA, 22 nt, Mycobacterium tuberculosis H37Rv
ucccguucggggccccgcggcg

SEQ ID NO: 1326256 - RNA, 19 nt, Mycobacterium tuberculosis H37Rv
ucccggccaggggcgcagc

SEQ ID NO: 1326257 - RNA, 12 nt, Mycobacterium tuberculosis H37Rv
ucccggccaggc

SEQ ID NO: 1326258 - RNA, 21 nt, Mycobacterium tuberculosis H37Rv
ucccggauauugccaucccuc

SEQ ID NO: 1326259 - RNA, 16 nt, Mycobacterium tuberculosis H37Rv
ucccggcggucagcgg

SEQ ID NO: 1326260 - RNA, 16 nt, Mycobacterium tuberculosis H37Rv
ucccggcucggccagc

SEQ ID NO: 1326261 - RNA, 22 nt, Mycobacterium tuberculosis H37Rv
ucccggcgaccggguccggcgu

SEQ ID NO: 1326262 - RNA, 15 nt, Mycobacterium tuberculosis H37Rv
ucccggccucgaugu

SEQ ID NO: 1326263 - RNA, 23 nt, Mycobacterium tuberculosis H37Rv
ucccgggcccgcugggcuugggg

SEQ ID NO: 1326264 - RNA, 17 nt, Mycobacterium tuberculosis H37Rv
ucccggaauauggcggc

SEQ ID NO: 1326265 - RNA, 20 nt, Mycobacterium tuberculosis H37Rv
ucccgcucgcaggccggcgg

SEQ ID NO: 1326266 - RNA, 16 nt, Mycobacterium tuberculosis H37Rv
ucccgcucgcaggccg

SEQ ID NO: 1326267 - RNA, 14 nt, Mycobacterium tuberculosis H37Rv
ucccgcggcaccuu

SEQ ID NO: 1326268 - RNA, 21 nt, Mycobacterium tuberculosis H37Rv
ucccgcgaugcgcaccagcgg

SEQ ID NO: 1326269 - RNA, 14 nt, Mycobacterium tuberculosis H37Rv
ucccgcgcgagccg

SEQ ID NO: 1326270 - RNA, 21 nt, Mycobacterium tuberculosis H37Rv
ucccgcaaugcgagcgcgccg

SEQ ID NO: 1326271 - RNA, 21 nt, Mycobacterium tuberculosis H37Rv
ucccgccggcuccgccacugg

SEQ ID NO: 1326272 - RNA, 23 nt, Mycobacterium tuberculosis H37Rv
ucccgccuucucccgcacggccg

SEQ ID NO: 1326273 - RNA, 14 nt, Mycobacterium tuberculosis H37Rv
ucccgccgccugga

SEQ ID NO: 1326274 - RNA, 15 nt, Mycobacterium tuberculosis H37Rv
ucccgccgaucgaac

SEQ ID NO: 1326275 - RNA, 11 nt, Mycobacterium tuberculosis H37Rv
ucccuggccuu

SEQ ID NO: 1326276 - RNA, 22 nt, Mycobacterium tuberculosis H37Rv
ucccugugccagcagcagcgcc

SEQ ID NO: 1326277 - RNA, 17 nt, Mycobacterium tuberculosis H37Rv
ucccucaugcuggaagu

SEQ ID NO: 1326278 - RNA, 14 nt, Mycobacterium tuberculosis H37Rv
ucccucgacagugc

SEQ ID NO: 1326279 - RNA, 23 nt, Mycobacterium tuberculosis H37Rv
uccgaccgauaacacccgggcca

SEQ ID NO: 1326280 - RNA, 15 nt, Mycobacterium tuberculosis H37Rv
uccgaccagcggccg

SEQ ID NO: 1326281 - RNA, 21 nt, Mycobacterium tuberculosis H37Rv
uccgacaguccgcgccggcgg

SEQ ID NO: 1326282 - RNA, 22 nt, Mycobacterium tuberculosis H37Rv
uccgaacggguagacccacauc

SEQ ID NO: 1326283 - RNA, 19 nt, Mycobacterium tuberculosis H37Rv
ucccuuuguggggccgggc

SEQ ID NO: 1326284 - RNA, 15 nt, Mycobacterium tuberculosis H37Rv
uccgacgggccacga

SEQ ID NO: 1326285 - RNA, 22 nt, Mycobacterium tuberculosis H37Rv
uccgacgggccgucgccgucca

SEQ ID NO: 1326286 - RNA, 16 nt, Mycobacterium tuberculosis H37Rv
uccgacgggggucggg

SEQ ID NO: 1326287 - RNA, 17 nt, Mycobacterium tuberculosis H37Rv
uccgacggccgcggcgu

SEQ ID NO: 1326288 - RNA, 14 nt, Mycobacterium tuberculosis H37Rv
uccgacggccgcgg

SEQ ID NO: 1326289 - RNA, 21 nt, Mycobacterium tuberculosis H37Rv
uccgacgcgugucugggaccc

SEQ ID NO: 1326290 - RNA, 20 nt, Mycobacterium tuberculosis H37Rv
uccgaccucugcguccagca

SEQ ID NO: 1326291 - RNA, 14 nt, Mycobacterium tuberculosis H37Rv
uccgacgaaccggg

SEQ ID NO: 1326292 - RNA, 17 nt, Mycobacterium tuberculosis H37Rv
uccgaggaauacagcuu

SEQ ID NO: 1326293 - RNA, 16 nt, Mycobacterium tuberculosis H37Rv
uccgagcuuggccgcc

SEQ ID NO: 1326294 - RNA, 21 nt, Mycobacterium tuberculosis H37Rv
uccgacuggccccgccagcgg

SEQ ID NO: 1326295 - RNA, 13 nt, Mycobacterium tuberculosis H37Rv
uccgccggcaccu

SEQ ID NO: 1326296 - RNA, 15 nt, Mycobacterium tuberculosis H37Rv
uccgccgccugcgca

SEQ ID NO: 1326297 - RNA, 22 nt, Mycobacterium tuberculosis H37Rv
uccgccgccgccaucgccgaug

SEQ ID NO: 1326298 - RNA, 18 nt, Mycobacterium tuberculosis H37Rv
uccgccgccucgucgucg

SEQ ID NO: 1326299 - RNA, 22 nt, Mycobacterium tuberculosis H37Rv
uccgccgggcucagcugggccg

SEQ ID NO: 1326300 - RNA, 17 nt, Mycobacterium tuberculosis H37Rv
uccgccguugccgaucc

SEQ ID NO: 1326301 - RNA, 20 nt, Mycobacterium tuberculosis H37Rv
uccgccguugccgaucccca

SEQ ID NO: 1326302 - RNA, 22 nt, Mycobacterium tuberculosis H37Rv
uccgccguugccgauccccagg

SEQ ID NO: 1326303 - RNA, 15 nt, Mycobacterium tuberculosis H37Rv
uccgccguugccgcc

SEQ ID NO: 1326304 - RNA, 19 nt, Mycobacterium tuberculosis H37Rv
uccgccguugccgccgccu

SEQ ID NO: 1326305 - RNA, 13 nt, Mycobacterium tuberculosis H37Rv
uccgccggcccca

SEQ ID NO: 1326306 - RNA, 16 nt, Mycobacterium tuberculosis H37Rv
uccgccgucgccgccg

SEQ ID NO: 1326307 - RNA, 20 nt, Mycobacterium tuberculosis H37Rv
uccgccgcagacgccgacuc

SEQ ID NO: 1326308 - RNA, 18 nt, Mycobacterium tuberculosis H37Rv
uccgccgccgccgggucg

SEQ ID NO: 1326309 - RNA, 14 nt, Mycobacterium tuberculosis H37Rv
uccgccgccggguu

SEQ ID NO: 1326310 - RNA, 14 nt, Mycobacterium tuberculosis H37Rv
uccgccgaggccgc

SEQ ID NO: 1326311 - RNA, 18 nt, Mycobacterium tuberculosis H37Rv
uccgccgaggccgccguu

SEQ ID NO: 1326312 - RNA, 15 nt, Mycobacterium tuberculosis H37Rv
uccgcccuugccgcc

SEQ ID NO: 1326313 - RNA, 14 nt, Mycobacterium tuberculosis H37Rv
uccgcccagcaccc

SEQ ID NO: 1326314 - RNA, 19 nt, Mycobacterium tuberculosis H37Rv
uccgccauuucucguaccc

SEQ ID NO: 1326315 - RNA, 15 nt, Mycobacterium tuberculosis H37Rv
uccgcccagccgcag

SEQ ID NO: 1326316 - RNA, 23 nt, Mycobacterium tuberculosis H37Rv
uccgcccauucccagaggcccgc

SEQ ID NO: 1326317 - RNA, 20 nt, Mycobacterium tuberculosis H37Rv
uccgccccgcccgcacccau

SEQ ID NO: 1326318 - RNA, 15 nt, Mycobacterium tuberculosis H37Rv
uccgcccgccgaccu

SEQ ID NO: 1326319 - RNA, 14 nt, Mycobacterium tuberculosis H37Rv
uccgcgaugugggc

SEQ ID NO: 1326320 - RNA, 18 nt, Mycobacterium tuberculosis H37Rv
uccgcgccaguggccacc

SEQ ID NO: 1326321 - RNA, 20 nt, Mycobacterium tuberculosis H37Rv
uccgcgaucugcagcgcgga

SEQ ID NO: 1326322 - RNA, 14 nt, Mycobacterium tuberculosis H37Rv
uccgcgaucggcug

SEQ ID NO: 1326323 - RNA, 13 nt, Mycobacterium tuberculosis H37Rv
uccgcggcacgcu

SEQ ID NO: 1326324 - RNA, 20 nt, Mycobacterium tuberculosis H37Rv
uccgcggaucugguccagug

SEQ ID NO: 1326325 - RNA, 22 nt, Mycobacterium tuberculosis H37Rv
uccgcggacgauuacgccggag

SEQ ID NO: 1326326 - RNA, 17 nt, Mycobacterium tuberculosis H37Rv
uccgcgcuucacagcca

SEQ ID NO: 1326327 - RNA, 16 nt, Mycobacterium tuberculosis H37Rv
uccgcggaucaccauc

SEQ ID NO: 1326328 - RNA, 15 nt, Mycobacterium tuberculosis H37Rv
uccgcgcccgagccg

SEQ ID NO: 1326329 - RNA, 21 nt, Mycobacterium tuberculosis H37Rv
uccgcgccgcucaucgggcac

SEQ ID NO: 1326330 - RNA, 16 nt, Mycobacterium tuberculosis H37Rv
uccgcgucgccggccu

SEQ ID NO: 1326331 - RNA, 11 nt, Mycobacterium tuberculosis H37Rv
uccgcggcgca

SEQ ID NO: 1326332 - RNA, 15 nt, Mycobacterium tuberculosis H37Rv
uccgcggcgcgcaac

SEQ ID NO: 1326333 - RNA, 18 nt, Mycobacterium tuberculosis H37Rv
uccgccagcgccgccgag

SEQ ID NO: 1326334 - RNA, 17 nt, Mycobacterium tuberculosis H37Rv
uccgccagaccgcggcg

SEQ ID NO: 1326335 - RNA, 24 nt, Mycobacterium tuberculosis H37Rv
uccgccaccgcgagcagaggauca

SEQ ID NO: 1326336 - RNA, 13 nt, Mycobacterium tuberculosis H37Rv
uccgcaggcccgc

SEQ ID NO: 1326337 - RNA, 15 nt, Mycobacterium tuberculosis H37Rv
uccgcagcggugcgc

SEQ ID NO: 1326338 - RNA, 15 nt, Mycobacterium tuberculosis H37Rv
uccgcagcgccaccc

SEQ ID NO: 1326339 - RNA, 19 nt, Mycobacterium tuberculosis H37Rv
uccgccacccgccaacgcc

SEQ ID NO: 1326340 - RNA, 14 nt, Mycobacterium tuberculosis H37Rv
uccgccaacaucuc

SEQ ID NO: 1326341 - RNA, 12 nt, Mycobacterium tuberculosis H37Rv
uccgcacaacga

SEQ ID NO: 1326342 - RNA, 12 nt, Mycobacterium tuberculosis H37Rv
uccgcacagcaa

SEQ ID NO: 1326343 - RNA, 14 nt, Mycobacterium tuberculosis H37Rv
uccgcacagguccg

SEQ ID NO: 1326344 - RNA, 14 nt, Mycobacterium tuberculosis H37Rv
uccgcacccggccg

SEQ ID NO: 1326345 - RNA, 21 nt, Mycobacterium tuberculosis H37Rv
uccgcacccggccgcgcaccc

SEQ ID NO: 1326346 - RNA, 16 nt, Mycobacterium tuberculosis H37Rv
uccgauccgcacagca

SEQ ID NO: 1326347 - RNA, 19 nt, Mycobacterium tuberculosis H37Rv
uccgaucaugucggccggg

SEQ ID NO: 1326348 - RNA, 20 nt, Mycobacterium tuberculosis H37Rv
uccgaucaugucggccgggg

SEQ ID NO: 1326349 - RNA, 13 nt, Mycobacterium tuberculosis H37Rv
uccgaucgcagac

SEQ ID NO: 1326350 - RNA, 12 nt, Mycobacterium tuberculosis H37Rv
uccgauccggug

SEQ ID NO: 1326351 - RNA, 15 nt, Mycobacterium tuberculosis H37Rv
uccgaugggaaucag

SEQ ID NO: 1326352 - RNA, 18 nt, Mycobacterium tuberculosis H37Rv
uccgaugguaugcccgcc

SEQ ID NO: 1326353 - RNA, 20 nt, Mycobacterium tuberculosis H37Rv
uccgaucgcguuagccaggu

SEQ ID NO: 1326354 - RNA, 19 nt, Mycobacterium tuberculosis H37Rv
uccgaugcaucggugcagc

SEQ ID NO: 1326355 - RNA, 15 nt, Mycobacterium tuberculosis H37Rv
uccgauuggcgaucu

SEQ ID NO: 1326356 - RNA, 19 nt, Mycobacterium tuberculosis H37Rv
uccgagggaacggugcaca

SEQ ID NO: 1326357 - RNA, 20 nt, Mycobacterium tuberculosis H37Rv
uccuugaacguucuuaaacg

SEQ ID NO: 1326358 - RNA, 21 nt, Mycobacterium tuberculosis H37Rv
uccuugagccgggcaaccagc

SEQ ID NO: 1326359 - RNA, 18 nt, Mycobacterium tuberculosis H37Rv
uccuucgaaugccgugcc

SEQ ID NO: 1326360 - RNA, 18 nt, Mycobacterium tuberculosis H37Rv
uccuugcgguccaggccg

SEQ ID NO: 1326361 - RNA, 22 nt, Mycobacterium tuberculosis H37Rv
uccuugcgcagcaccagggugg

SEQ ID NO: 1326362 - RNA, 19 nt, Mycobacterium tuberculosis H37Rv
uccuugcgccagcgggcug

SEQ ID NO: 1326363 - RNA, 14 nt, Mycobacterium tuberculosis H37Rv
uccuugaugccuuc

SEQ ID NO: 1326364 - RNA, 18 nt, Mycobacterium tuberculosis H37Rv
ucgaaaaccgaggcauuc

SEQ ID NO: 1326365 - RNA, 20 nt, Mycobacterium tuberculosis H37Rv
ucgaaagcgauauuggaugc

SEQ ID NO: 1326366 - RNA, 19 nt, Mycobacterium tuberculosis H37Rv
ucgaaauccugguggcaga

SEQ ID NO: 1326367 - RNA, 17 nt, Mycobacterium tuberculosis H37Rv
ucgaaagcgauauugga

SEQ ID NO: 1326368 - RNA, 21 nt, Mycobacterium tuberculosis H37Rv
ucgaaaccgcccguauugaug

SEQ ID NO: 1326369 - RNA, 21 nt, Mycobacterium tuberculosis H37Rv
ucgaacagcgaaccggcuggg

SEQ ID NO: 1326370 - RNA, 21 nt, Mycobacterium tuberculosis H37Rv
ucgaacaccguccaauuggcg

SEQ ID NO: 1326371 - RNA, 19 nt, Mycobacterium tuberculosis H37Rv
ucgaacaagaccgcggcgu

SEQ ID NO: 1326372 - RNA, 19 nt, Mycobacterium tuberculosis H37Rv
ucgaagaucgccugggggu

SEQ ID NO: 1326373 - RNA, 12 nt, Mycobacterium tuberculosis H37Rv
ucgaagcgggcu

SEQ ID NO: 1326374 - RNA, 14 nt, Mycobacterium tuberculosis H37Rv
ucgaagcggcugcu

SEQ ID NO: 1326375 - RNA, 22 nt, Mycobacterium tuberculosis H37Rv
ucgaaggcguaccaguugauuc

SEQ ID NO: 1326376 - RNA, 14 nt, Mycobacterium tuberculosis H37Rv
ucgaacgcccugac

SEQ ID NO: 1326377 - RNA, 15 nt, Mycobacterium tuberculosis H37Rv
ucgaaucaggcucca

SEQ ID NO: 1326378 - RNA, 14 nt, Mycobacterium tuberculosis H37Rv
ucgaauacaccugc

SEQ ID NO: 1326379 - RNA, 17 nt, Mycobacterium tuberculosis H37Rv
ucgaauagguguguggc

SEQ ID NO: 1326380 - RNA, 22 nt, Mycobacterium tuberculosis H37Rv
ucgaauucgcgcucuggcuccg

SEQ ID NO: 1326381 - RNA, 14 nt, Mycobacterium tuberculosis H37Rv
ucgaauuccggcuc

SEQ ID NO: 1326382 - RNA, 15 nt, Mycobacterium tuberculosis H37Rv
ucgaauuaaagccac

SEQ ID NO: 1326383 - RNA, 23 nt, Mycobacterium tuberculosis H37Rv
ucgacaccgagccacgacccagc

SEQ ID NO: 1326384 - RNA, 15 nt, Mycobacterium tuberculosis H37Rv
ucgacacccguugag

SEQ ID NO: 1326385 - RNA, 13 nt, Mycobacterium tuberculosis H37Rv
ucgacacccucgg

SEQ ID NO: 1326386 - RNA, 16 nt, Mycobacterium tuberculosis H37Rv
ucgacaccgcggugcc

SEQ ID NO: 1326387 - RNA, 15 nt, Mycobacterium tuberculosis H37Rv
ucgacaaagcggcug

SEQ ID NO: 1326388 - RNA, 13 nt, Mycobacterium tuberculosis H37Rv
ucgacgccgacca

SEQ ID NO: 1326389 - RNA, 15 nt, Mycobacterium tuberculosis H37Rv
ucgacgccggccagc

SEQ ID NO: 1326390 - RNA, 17 nt, Mycobacterium tuberculosis H37Rv
ucgacgccggccagcgg

SEQ ID NO: 1326391 - RNA, 22 nt, Mycobacterium tuberculosis H37Rv
ucgacggcggccuucggccggc

SEQ ID NO: 1326392 - RNA, 16 nt, Mycobacterium tuberculosis H37Rv
ucgacguaggccaggu

SEQ ID NO: 1326393 - RNA, 15 nt, Mycobacterium tuberculosis H37Rv
ucgacggugccgucg

SEQ ID NO: 1326394 - RNA, 14 nt, Mycobacterium tuberculosis H37Rv
ucgacguagucgcg

SEQ ID NO: 1326395 - RNA, 21 nt, Mycobacterium tuberculosis H37Rv
ucgacguccaucccggcgccg

SEQ ID NO: 1326396 - RNA, 16 nt, Mycobacterium tuberculosis H37Rv
ucgacgucgcggcgcc

SEQ ID NO: 1326397 - RNA, 18 nt, Mycobacterium tuberculosis H37Rv
ucgacgucgcggcgccug

SEQ ID NO: 1326398 - RNA, 16 nt, Mycobacterium tuberculosis H37Rv
ucgacgucugcccagu

SEQ ID NO: 1326399 - RNA, 16 nt, Mycobacterium tuberculosis H37Rv
ucgacguuaccgaccg

SEQ ID NO: 1326400 - RNA, 15 nt, Mycobacterium tuberculosis H37Rv
ucgacgaccaccuuc

SEQ ID NO: 1326401 - RNA, 21 nt, Mycobacterium tuberculosis H37Rv
ucgacgaucgucuugucgccg

SEQ ID NO: 1326402 - RNA, 16 nt, Mycobacterium tuberculosis H37Rv
ucgacgaucucuccug

SEQ ID NO: 1326403 - RNA, 20 nt, Mycobacterium tuberculosis H37Rv
ucgacgaugccguagagucg

SEQ ID NO: 1326404 - RNA, 15 nt, Mycobacterium tuberculosis H37Rv
ucgacgaugcgguca

SEQ ID NO: 1326405 - RNA, 18 nt, Mycobacterium tuberculosis H37Rv
ucgacgaucugcagcacu

SEQ ID NO: 1326406 - RNA, 13 nt, Mycobacterium tuberculosis H37Rv
ucgacgcacaccc

SEQ ID NO: 1326407 - RNA, 19 nt, Mycobacterium tuberculosis H37Rv
ucgacgaagaucgcgugcc

SEQ ID NO: 1326408 - RNA, 16 nt, Mycobacterium tuberculosis H37Rv
ucgaccucagacagcu

SEQ ID NO: 1326409 - RNA, 23 nt, Mycobacterium tuberculosis H37Rv
ucgaccugaggcaccucggccuu

SEQ ID NO: 1326410 - RNA, 22 nt, Mycobacterium tuberculosis H37Rv
ucgaccgccacguaauucccca

SEQ ID NO: 1326411 - RNA, 21 nt, Mycobacterium tuberculosis H37Rv
ucgacccgaugacccacugca

SEQ ID NO: 1326412 - RNA, 10 nt, Mycobacterium tuberculosis H37Rv
ucgaccgugu

SEQ ID NO: 1326413 - RNA, 21 nt, Mycobacterium tuberculosis H37Rv
ucgaccggaaugcccgggccc

SEQ ID NO: 1326414 - RNA, 22 nt, Mycobacterium tuberculosis H37Rv
ucgaccaagguguccagcaccu

SEQ ID NO: 1326415 - RNA, 15 nt, Mycobacterium tuberculosis H37Rv
ucgaccacgaccguc

SEQ ID NO: 1326416 - RNA, 19 nt, Mycobacterium tuberculosis H37Rv
ucgacaguugcgccagcgu

SEQ ID NO: 1326417 - RNA, 21 nt, Mycobacterium tuberculosis H37Rv
ucgacagccccgcggccagca

SEQ ID NO: 1326418 - RNA, 12 nt, Mycobacterium tuberculosis H37Rv
ucgacagcauca

SEQ ID NO: 1326419 - RNA, 16 nt, Mycobacterium tuberculosis H37Rv
ucgacagcaucacgcc

SEQ ID NO: 1326420 - RNA, 18 nt, Mycobacterium tuberculosis H37Rv
ucgacaggugccagacca

SEQ ID NO: 1326421 - RNA, 14 nt, Mycobacterium tuberculosis H37Rv
ucgacucacacacc

SEQ ID NO: 1326422 - RNA, 17 nt, Mycobacterium tuberculosis H37Rv
ucgacguuccagcagua

SEQ ID NO: 1326423 - RNA, 20 nt, Mycobacterium tuberculosis H37Rv
ucgacuacacauucauccac

SEQ ID NO: 1326424 - RNA, 17 nt, Mycobacterium tuberculosis H37Rv
ucgagacgcuuuccgcc

SEQ ID NO: 1326425 - RNA, 22 nt, Mycobacterium tuberculosis H37Rv
ucgagaaugcugacggugcagg

SEQ ID NO: 1326426 - RNA, 17 nt, Mycobacterium tuberculosis H37Rv
ucgagcaccgacaccgg

SEQ ID NO: 1326427 - RNA, 20 nt, Mycobacterium tuberculosis H37Rv
ucgagcgacccccagcgccc

SEQ ID NO: 1326428 - RNA, 23 nt, Mycobacterium tuberculosis H37Rv
ucgagccggauucggcugccacc

SEQ ID NO: 1326429 - RNA, 20 nt, Mycobacterium tuberculosis H37Rv
ucgagccggauucggcugcc

SEQ ID NO: 1326430 - RNA, 14 nt, Mycobacterium tuberculosis H37Rv
ucgagccagcuccg

SEQ ID NO: 1326431 - RNA, 19 nt, Mycobacterium tuberculosis H37Rv
ucgagcccgucgaguaggu

SEQ ID NO: 1326432 - RNA, 15 nt, Mycobacterium tuberculosis H37Rv
ucgagcaugcccagc

SEQ ID NO: 1326433 - RNA, 17 nt, Mycobacterium tuberculosis H37Rv
ucgagccacccaccgac

SEQ ID NO: 1326434 - RNA, 14 nt, Mycobacterium tuberculosis H37Rv
ucgagcaccggcug

SEQ ID NO: 1326435 - RNA, 11 nt, Mycobacterium tuberculosis H37Rv
ucgagcagcag

SEQ ID NO: 1326436 - RNA, 20 nt, Mycobacterium tuberculosis H37Rv
ucgagcgcgccgcgcucgcc

SEQ ID NO: 1326437 - RNA, 21 nt, Mycobacterium tuberculosis H37Rv
ucgagcgcgccuucacgcugg

SEQ ID NO: 1326438 - RNA, 23 nt, Mycobacterium tuberculosis H37Rv
ucgagcguaacgguaaccggccc

SEQ ID NO: 1326439 - RNA, 17 nt, Mycobacterium tuberculosis H37Rv
ucgagcucguccucguc

SEQ ID NO: 1326440 - RNA, 22 nt, Mycobacterium tuberculosis H37Rv
ucgagcucggcgaugcugagcc

SEQ ID NO: 1326441 - RNA, 22 nt, Mycobacterium tuberculosis H37Rv
ucgagcucguaggugaagagca

SEQ ID NO: 1326442 - RNA, 18 nt, Mycobacterium tuberculosis H37Rv
ucgagcgugcgcacggcg

SEQ ID NO: 1326443 - RNA, 13 nt, Mycobacterium tuberculosis H37Rv
ucgagcguggcga

SEQ ID NO: 1326444 - RNA, 14 nt, Mycobacterium tuberculosis H37Rv
ucgagcgugaaccu

SEQ ID NO: 1326445 - RNA, 19 nt, Mycobacterium tuberculosis H37Rv
ucgagcugacgauggccag

SEQ ID NO: 1326446 - RNA, 21 nt, Mycobacterium tuberculosis H37Rv
ucgagcuuuucgaccuucacc

SEQ ID NO: 1326447 - RNA, 19 nt, Mycobacterium tuberculosis H37Rv
ucgaggaagaucaccuccc

SEQ ID NO: 1326448 - RNA, 19 nt, Mycobacterium tuberculosis H37Rv
ucgaggaguuggugcagcg

SEQ ID NO: 1326449 - RNA, 11 nt, Mycobacterium tuberculosis H37Rv
ucgagggcuuu

SEQ ID NO: 1326450 - RNA, 15 nt, Mycobacterium tuberculosis H37Rv
ucgaggccagcagcu

SEQ ID NO: 1326451 - RNA, 17 nt, Mycobacterium tuberculosis H37Rv
ucgaguccaggcagcuu

SEQ ID NO: 1326452 - RNA, 18 nt, Mycobacterium tuberculosis H37Rv
ucgagguguagcccuccg

SEQ ID NO: 1326453 - RNA, 22 nt, Mycobacterium tuberculosis H37Rv
ucgaguaacaccccgacaccac

SEQ ID NO: 1326454 - RNA, 14 nt, Mycobacterium tuberculosis H37Rv
ucgaguuccggccg

SEQ ID NO: 1326455 - RNA, 17 nt, Mycobacterium tuberculosis H37Rv
ucgaguuccgcaucggc

SEQ ID NO: 1326456 - RNA, 14 nt, Mycobacterium tuberculosis H37Rv
ucgauaccggcgug

SEQ ID NO: 1326457 - RNA, 22 nt, Mycobacterium tuberculosis H37Rv
ucgauauaacccggcuccagca

SEQ ID NO: 1326458 - RNA, 21 nt, Mycobacterium tuberculosis H37Rv
ucgaucagcuccuguaacugc

SEQ ID NO: 1326459 - RNA, 19 nt, Mycobacterium tuberculosis H37Rv
ucgaucaucgaccuggcca

SEQ ID NO: 1326460 - RNA, 19 nt, Mycobacterium tuberculosis H37Rv
ucgaucagcaacucggcca

SEQ ID NO: 1326461 - RNA, 18 nt, Mycobacterium tuberculosis H37Rv
ucgaucaacaccaaucgg

SEQ ID NO: 1326462 - RNA, 19 nt, Mycobacterium tuberculosis H37Rv
ucgaucaacaggucuaccc

SEQ ID NO: 1326463 - RNA, 16 nt, Mycobacterium tuberculosis H37Rv
ucgaucaccugcagca

SEQ ID NO: 1326464 - RNA, 20 nt, Mycobacterium tuberculosis H37Rv
ucgaugccguguucagcacc

SEQ ID NO: 1326465 - RNA, 23 nt, Mycobacterium tuberculosis H37Rv
ucgaugaggcgcagcgccagcgg

SEQ ID NO: 1326466 - RNA, 19 nt, Mycobacterium tuberculosis H37Rv
ucgaucgcggcgcccagga

SEQ ID NO: 1326467 - RNA, 18 nt, Mycobacterium tuberculosis H37Rv
ucgaucggcagccagggc

SEQ ID NO: 1326468 - RNA, 22 nt, Mycobacterium tuberculosis H37Rv
ucgauccucgcccgcaccagcu

SEQ ID NO: 1326469 - RNA, 22 nt, Mycobacterium tuberculosis H37Rv
ucgaucuccucuugcaccaggg

SEQ ID NO: 1326470 - RNA, 19 nt, Mycobacterium tuberculosis H37Rv
ucgauggcggccaccagcg

SEQ ID NO: 1326471 - RNA, 20 nt, Mycobacterium tuberculosis H37Rv
ucgauggcguagggcugucc

SEQ ID NO: 1326472 - RNA, 17 nt, Mycobacterium tuberculosis H37Rv
ucgauguccgcagcacc

SEQ ID NO: 1326473 - RNA, 20 nt, Mycobacterium tuberculosis H37Rv
ucgauguccucgauccgggc

SEQ ID NO: 1326474 - RNA, 20 nt, Mycobacterium tuberculosis H37Rv
ucgauggucauccagccagc

SEQ ID NO: 1326475 - RNA, 23 nt, Mycobacterium tuberculosis H37Rv
ucgauggucucccggcugaugcc

SEQ ID NO: 1326476 - RNA, 15 nt, Mycobacterium tuberculosis H37Rv
ucgauuggcugcgcc

SEQ ID NO: 1326477 - RNA, 17 nt, Mycobacterium tuberculosis H37Rv
ucgauugccaccgagau

SEQ ID NO: 1326478 - RNA, 18 nt, Mycobacterium tuberculosis H37Rv
ucgcacaacugcgccagc

SEQ ID NO: 1326479 - RNA, 14 nt, Mycobacterium tuberculosis H37Rv
ucgcacagcaccac

SEQ ID NO: 1326480 - RNA, 18 nt, Mycobacterium tuberculosis H37Rv
ucgcaccagaucagguga

SEQ ID NO: 1326481 - RNA, 11 nt, Mycobacterium tuberculosis H37Rv
ucgcaccagcg

SEQ ID NO: 1326482 - RNA, 18 nt, Mycobacterium tuberculosis H37Rv
ucgcacggaaggcccggc

SEQ ID NO: 1326483 - RNA, 16 nt, Mycobacterium tuberculosis H37Rv
ucgcaaccgccgccau

SEQ ID NO: 1326484 - RNA, 12 nt, Mycobacterium tuberculosis H37Rv
ucgcaaugaccu

SEQ ID NO: 1326485 - RNA, 14 nt, Mycobacterium tuberculosis H37Rv
ucgcaaucagcugg

SEQ ID NO: 1326486 - RNA, 15 nt, Mycobacterium tuberculosis H37Rv
ucgcagacggcugcc

SEQ ID NO: 1326487 - RNA, 11 nt, Mycobacterium tuberculosis H37Rv
ucgcagcaugu

SEQ ID NO: 1326488 - RNA, 14 nt, Mycobacterium tuberculosis H37Rv
ucgcagcagaccac

SEQ ID NO: 1326489 - RNA, 15 nt, Mycobacterium tuberculosis H37Rv
ucgcagccaggcacg

SEQ ID NO: 1326490 - RNA, 19 nt, Mycobacterium tuberculosis H37Rv
ucgcacucguugccgacca

SEQ ID NO: 1326491 - RNA, 21 nt, Mycobacterium tuberculosis H37Rv
ucgcaguggagggcccggccg

SEQ ID NO: 1326492 - RNA, 18 nt, Mycobacterium tuberculosis H37Rv
ucgcaguacuugguugcg

SEQ ID NO: 1326493 - RNA, 22 nt, Mycobacterium tuberculosis H37Rv
ucgcagcgccauuccaagacgu

SEQ ID NO: 1326494 - RNA, 14 nt, Mycobacterium tuberculosis H37Rv
ucgcaggauuccca

SEQ ID NO: 1326495 - RNA, 18 nt, Mycobacterium tuberculosis H37Rv
ucgcaggauucccagucc

SEQ ID NO: 1326496 - RNA, 21 nt, Mycobacterium tuberculosis H37Rv
uccugaaucgguucggccaga

SEQ ID NO: 1326497 - RNA, 22 nt, Mycobacterium tuberculosis H37Rv
uccucuugcaccagggccucga

SEQ ID NO: 1326498 - RNA, 18 nt, Mycobacterium tuberculosis H37Rv
uccucugaaccugcugag

SEQ ID NO: 1326499 - RNA, 20 nt, Mycobacterium tuberculosis H37Rv
uccucgacguaggccagguc

SEQ ID NO: 1326500 - RNA, 18 nt, Mycobacterium tuberculosis H37Rv
uccucgacguggccgacg

SEQ ID NO: 1326501 - RNA, 17 nt, Mycobacterium tuberculosis H37Rv
uccucgaugcgggcgcc

SEQ ID NO: 1326502 - RNA, 20 nt, Mycobacterium tuberculosis H37Rv
uccucgaugcgggcgcccca

SEQ ID NO: 1326503 - RNA, 14 nt, Mycobacterium tuberculosis H37Rv
uccucgauggaccg

SEQ ID NO: 1326504 - RNA, 21 nt, Mycobacterium tuberculosis H37Rv
uccucgauggaccgccagggc

SEQ ID NO: 1326505 - RNA, 18 nt, Mycobacterium tuberculosis H37Rv
uccucgcccgcaccagcu

SEQ ID NO: 1326506 - RNA, 20 nt, Mycobacterium tuberculosis H37Rv
uccucggacugaagagcaau

SEQ ID NO: 1326507 - RNA, 15 nt, Mycobacterium tuberculosis H37Rv
uccucgcgagcuccc

SEQ ID NO: 1326508 - RNA, 20 nt, Mycobacterium tuberculosis H37Rv
uccucgggcaggcggccagc

SEQ ID NO: 1326509 - RNA, 20 nt, Mycobacterium tuberculosis H37Rv
uccucggguucgucagucaa

SEQ ID NO: 1326510 - RNA, 13 nt, Mycobacterium tuberculosis H37Rv
uccucggucacga

SEQ ID NO: 1326511 - RNA, 22 nt, Mycobacterium tuberculosis H37Rv
uccucggugugcucgccgacca

SEQ ID NO: 1326512 - RNA, 15 nt, Mycobacterium tuberculosis H37Rv
uccucggccacccgc

SEQ ID NO: 1326513 - RNA, 21 nt, Mycobacterium tuberculosis H37Rv
uccucgucgaggucagcuccc

SEQ ID NO: 1326514 - RNA, 18 nt, Mycobacterium tuberculosis H37Rv
uccucccauucccaacac

SEQ ID NO: 1326515 - RNA, 23 nt, Mycobacterium tuberculosis H37Rv
uccuccuggaugaaguguuuggc

SEQ ID NO: 1326516 - RNA, 15 nt, Mycobacterium tuberculosis H37Rv
uccucagcggcccgc

SEQ ID NO: 1326517 - RNA, 16 nt, Mycobacterium tuberculosis H37Rv
uccuggucgagcacgc

SEQ ID NO: 1326518 - RNA, 21 nt, Mycobacterium tuberculosis H37Rv
uccuggguguagcaagucgcc

SEQ ID NO: 1326519 - RNA, 15 nt, Mycobacterium tuberculosis H37Rv
uccuggucaccagcc

SEQ ID NO: 1326520 - RNA, 14 nt, Mycobacterium tuberculosis H37Rv
uccugguggcagac

SEQ ID NO: 1326521 - RNA, 22 nt, Mycobacterium tuberculosis H37Rv
uccuggggugucaaucacccag

SEQ ID NO: 1326522 - RNA, 16 nt, Mycobacterium tuberculosis H37Rv
uccugggccgccgccc

SEQ ID NO: 1326523 - RNA, 21 nt, Mycobacterium tuberculosis H37Rv
uccugggccgccgcccugguc

SEQ ID NO: 1326524 - RNA, 15 nt, Mycobacterium tuberculosis H37Rv
uccuucagccagucc

SEQ ID NO: 1326525 - RNA, 17 nt, Mycobacterium tuberculosis H37Rv
uccugcagugcggcguu

SEQ ID NO: 1326526 - RNA, 17 nt, Mycobacterium tuberculosis H37Rv
uccugcagcucgggcag

SEQ ID NO: 1326527 - RNA, 19 nt, Mycobacterium tuberculosis H37Rv
uccugcaggaucaaaaccu

SEQ ID NO: 1326528 - RNA, 16 nt, Mycobacterium tuberculosis H37Rv
uccugcaggaucaaaa

SEQ ID NO: 1326529 - RNA, 18 nt, Mycobacterium tuberculosis H37Rv
uccugcgucaaguccgag

SEQ ID NO: 1326530 - RNA, 14 nt, Mycobacterium tuberculosis H37Rv
uccugcgcugcacc

SEQ ID NO: 1326531 - RNA, 20 nt, Mycobacterium tuberculosis H37Rv
uccugcgccgguaacugucc

SEQ ID NO: 1326532 - RNA, 13 nt, Mycobacterium tuberculosis H37Rv
uccuggcggcugc

SEQ ID NO: 1326533 - RNA, 14 nt, Mycobacterium tuberculosis H37Rv
uccuggcgugagcc

SEQ ID NO: 1326534 - RNA, 18 nt, Mycobacterium tuberculosis H37Rv
uccuggccacucccagcc

SEQ ID NO: 1326535 - RNA, 19 nt, Mycobacterium tuberculosis H37Rv
uccuggccacucccagcca

SEQ ID NO: 1326536 - RNA, 20 nt, Mycobacterium tuberculosis H37Rv
uccuggcccgauaaaugccg

SEQ ID NO: 1326537 - RNA, 19 nt, Mycobacterium tuberculosis H37Rv
uccucaaggucggccaggc

SEQ ID NO: 1326538 - RNA, 20 nt, Mycobacterium tuberculosis H37Rv
uccucaaggucggccaggcu

SEQ ID NO: 1326539 - RNA, 14 nt, Mycobacterium tuberculosis H37Rv
uccuacggugcagu

SEQ ID NO: 1326540 - RNA, 15 nt, Mycobacterium tuberculosis H37Rv
uccgugccgaccacc

SEQ ID NO: 1326541 - RNA, 19 nt, Mycobacterium tuberculosis H37Rv
uccgugccgaccaccagca

SEQ ID NO: 1326542 - RNA, 15 nt, Mycobacterium tuberculosis H37Rv
uccgucggccaggcc

SEQ ID NO: 1326543 - RNA, 17 nt, Mycobacterium tuberculosis H37Rv
uccgucgagucgccgag

SEQ ID NO: 1326544 - RNA, 19 nt, Mycobacterium tuberculosis H37Rv
uccgucggggacauccgcu

SEQ ID NO: 1326545 - RNA, 19 nt, Mycobacterium tuberculosis H37Rv
uccgucggguagugcccac

SEQ ID NO: 1326546 - RNA, 23 nt, Mycobacterium tuberculosis H37Rv
uccgucgcucacggcccgagccg

SEQ ID NO: 1326547 - RNA, 17 nt, Mycobacterium tuberculosis H37Rv
uccgucugacccaccgc

SEQ ID NO: 1326548 - RNA, 12 nt, Mycobacterium tuberculosis H37Rv
uccgguguugag

SEQ ID NO: 1326549 - RNA, 16 nt, Mycobacterium tuberculosis H37Rv
uccgguuacuuuucca

SEQ ID NO: 1326550 - RNA, 16 nt, Mycobacterium tuberculosis H37Rv
uccgguucaucggcau

SEQ ID NO: 1326551 - RNA, 21 nt, Mycobacterium tuberculosis H37Rv
uccgguguaggccugcccccg

SEQ ID NO: 1326552 - RNA, 21 nt, Mycobacterium tuberculosis H37Rv
uccggugcgccgaucccgccc

SEQ ID NO: 1326553 - RNA, 20 nt, Mycobacterium tuberculosis H37Rv
uccgguggaauccaccagcc

SEQ ID NO: 1326554 - RNA, 20 nt, Mycobacterium tuberculosis H37Rv
uccgguggccaacaccgcca

SEQ ID NO: 1326555 - RNA, 17 nt, Mycobacterium tuberculosis H37Rv
uccguaggccacagccc

SEQ ID NO: 1326556 - RNA, 21 nt, Mycobacterium tuberculosis H37Rv
uccggcggacccucgccgaag

SEQ ID NO: 1326557 - RNA, 15 nt, Mycobacterium tuberculosis H37Rv
uccggcggaucuggg

SEQ ID NO: 1326558 - RNA, 22 nt, Mycobacterium tuberculosis H37Rv
uccggcggcagcggcgccgccu

SEQ ID NO: 1326559 - RNA, 12 nt, Mycobacterium tuberculosis H37Rv
uccggcgcaccu

SEQ ID NO: 1326560 - RNA, 15 nt, Mycobacterium tuberculosis H37Rv
uccggcgccaccgcc

SEQ ID NO: 1326561 - RNA, 22 nt, Mycobacterium tuberculosis H37Rv
uccggcgccaccgccgcugccg

SEQ ID NO: 1326562 - RNA, 14 nt, Mycobacterium tuberculosis H37Rv
uccggcgccagcag

SEQ ID NO: 1326563 - RNA, 23 nt, Mycobacterium tuberculosis H37Rv
uccggccaggggaucaccggcug

SEQ ID NO: 1326564 - RNA, 19 nt, Mycobacterium tuberculosis H37Rv
uccggcgugcagcaccccc

SEQ ID NO: 1326565 - RNA, 20 nt, Mycobacterium tuberculosis H37Rv
uccggcggaaacaugugggu

SEQ ID NO: 1326566 - RNA, 14 nt, Mycobacterium tuberculosis H37Rv
uccggcgugggcac

SEQ ID NO: 1326567 - RNA, 17 nt, Mycobacterium tuberculosis H37Rv
uccggcggccacgccgg

SEQ ID NO: 1326568 - RNA, 19 nt, Mycobacterium tuberculosis H37Rv
uccggcggccacgccggcg

SEQ ID NO: 1326569 - RNA, 12 nt, Mycobacterium tuberculosis H37Rv
uccggcggggau

SEQ ID NO: 1326570 - RNA, 14 nt, Mycobacterium tuberculosis H37Rv
uccggcuccacccc

SEQ ID NO: 1326571 - RNA, 12 nt, Mycobacterium tuberculosis H37Rv
uccgggugcaga

SEQ ID NO: 1326572 - RNA, 14 nt, Mycobacterium tuberculosis H37Rv
uccggguagcggcg

SEQ ID NO: 1326573 - RNA, 20 nt, Mycobacterium tuberculosis H37Rv
uccggguagcggcgccgccc

SEQ ID NO: 1326574 - RNA, 17 nt, Mycobacterium tuberculosis H37Rv
uccgguagcuguggugg

SEQ ID NO: 1326575 - RNA, 17 nt, Mycobacterium tuberculosis H37Rv
uccggucgccucaccgg

SEQ ID NO: 1326576 - RNA, 23 nt, Mycobacterium tuberculosis H37Rv
uccggucgacuccagcaccagca

SEQ ID NO: 1326577 - RNA, 15 nt, Mycobacterium tuberculosis H37Rv
uccggucggucucgg

SEQ ID NO: 1326578 - RNA, 21 nt, Mycobacterium tuberculosis H37Rv
uccggucgcucgauggaucca

SEQ ID NO: 1326579 - RNA, 15 nt, Mycobacterium tuberculosis H37Rv
uccggucggccaggc

SEQ ID NO: 1326580 - RNA, 16 nt, Mycobacterium tuberculosis H37Rv
uccggucagcgcggcg

SEQ ID NO: 1326581 - RNA, 22 nt, Mycobacterium tuberculosis H37Rv
uccgggccgccgccccggcgcu

SEQ ID NO: 1326582 - RNA, 17 nt, Mycobacterium tuberculosis H37Rv
uccggggggauccagca

SEQ ID NO: 1326583 - RNA, 20 nt, Mycobacterium tuberculosis H37Rv
uccggggggauccagcaggc

SEQ ID NO: 1326584 - RNA, 16 nt, Mycobacterium tuberculosis H37Rv
uccgggccccacggcg

SEQ ID NO: 1326585 - RNA, 18 nt, Mycobacterium tuberculosis H37Rv
uccgggccgagcgcacca

SEQ ID NO: 1326586 - RNA, 16 nt, Mycobacterium tuberculosis H37Rv
uccgggccaugugggg

SEQ ID NO: 1326587 - RNA, 14 nt, Mycobacterium tuberculosis H37Rv
uccgggcagaugau

SEQ ID NO: 1326588 - RNA, 19 nt, Mycobacterium tuberculosis H37Rv
uccgggaccaggccaacgg

SEQ ID NO: 1326589 - RNA, 20 nt, Mycobacterium tuberculosis H37Rv
uccgcugucgagccggugcc

SEQ ID NO: 1326590 - RNA, 21 nt, Mycobacterium tuberculosis H37Rv
uccgcugucgagccggugccg

SEQ ID NO: 1326591 - RNA, 19 nt, Mycobacterium tuberculosis H37Rv
uccggauaacccagcggcg

SEQ ID NO: 1326592 - RNA, 18 nt, Mycobacterium tuberculosis H37Rv
uccggaguuuaagacgcc

SEQ ID NO: 1326593 - RNA, 22 nt, Mycobacterium tuberculosis H37Rv
uccggacccacccgcaccgccg

SEQ ID NO: 1326594 - RNA, 13 nt, Mycobacterium tuberculosis H37Rv
uccggaagcggcg

SEQ ID NO: 1326595 - RNA, 15 nt, Mycobacterium tuberculosis H37Rv
uccggaucgccgaau

SEQ ID NO: 1326596 - RNA, 21 nt, Mycobacterium tuberculosis H37Rv
uccggauccucggccgccauc

SEQ ID NO: 1326597 - RNA, 15 nt, Mycobacterium tuberculosis H37Rv
uccggcaaccaccgg

SEQ ID NO: 1326598 - RNA, 18 nt, Mycobacterium tuberculosis H37Rv
uccggcaaccaccggccg

SEQ ID NO: 1326599 - RNA, 13 nt, Mycobacterium tuberculosis H37Rv
uccggccacacuc

SEQ ID NO: 1326600 - RNA, 15 nt, Mycobacterium tuberculosis H37Rv
uccggccaguccaag

SEQ ID NO: 1326601 - RNA, 15 nt, Mycobacterium tuberculosis H37Rv
uccggcccaccagcg

SEQ ID NO: 1326602 - RNA, 18 nt, Mycobacterium tuberculosis H37Rv
uccggcccaccagcgcag

SEQ ID NO: 1326603 - RNA, 17 nt, Mycobacterium tuberculosis H37Rv
uccggccgggcccucca

SEQ ID NO: 1326604 - RNA, 23 nt, Mycobacterium tuberculosis H37Rv
uccggcccuacgcagcgcggcug

SEQ ID NO: 1326605 - RNA, 23 nt, Mycobacterium tuberculosis H37Rv
uccggcaagcacaccgccagcgg

SEQ ID NO: 1326606 - RNA, 18 nt, Mycobacterium tuberculosis H37Rv
uccggcaagcacaccgcc

SEQ ID NO: 1326607 - RNA, 19 nt, Mycobacterium tuberculosis H37Rv
uccggcaagcacaccgcca

SEQ ID NO: 1326608 - RNA, 14 nt, Mycobacterium tuberculosis H37Rv
uccggcaccaacgc

SEQ ID NO: 1326609 - RNA, 21 nt, Mycobacterium tuberculosis H37Rv
uccggcaccaacgccaccguc

SEQ ID NO: 1326610 - RNA, 13 nt, Mycobacterium tuberculosis H37Rv
uccggcaccgccc

SEQ ID NO: 1326611 - RNA, 18 nt, Mycobacterium tuberculosis H37Rv
uccggcaccgcccuugcc

SEQ ID NO: 1326612 - RNA, 21 nt, Mycobacterium tuberculosis H37Rv
uccggcaccgcccuugccgcc

SEQ ID NO: 1326613 - RNA, 21 nt, Mycobacterium tuberculosis H37Rv
uccggcacugcggccagucag

SEQ ID NO: 1326614 - RNA, 22 nt, Mycobacterium tuberculosis H37Rv
uaguugaggccgucgaacggua

SEQ ID NO: 1326615 - RNA, 16 nt, Mycobacterium tuberculosis H37Rv
uagucgcgggccaagc

SEQ ID NO: 1326616 - RNA, 15 nt, Mycobacterium tuberculosis H37Rv
uagucgauuggcugc

SEQ ID NO: 1326617 - RNA, 17 nt, Mycobacterium tuberculosis H37Rv
uagucggccuccucguc

SEQ ID NO: 1326618 - RNA, 21 nt, Mycobacterium tuberculosis H37Rv
uagucggcggugcagaucggc

SEQ ID NO: 1326619 - RNA, 18 nt, Mycobacterium tuberculosis H37Rv
uagugacugguauuuccc

SEQ ID NO: 1326620 - RNA, 21 nt, Mycobacterium tuberculosis H37Rv
uagucuucuuucgccuccgga

SEQ ID NO: 1326621 - RNA, 20 nt, Mycobacterium tuberculosis H37Rv
uaguacgccgagcagacgca

SEQ ID NO: 1326622 - RNA, 21 nt, Mycobacterium tuberculosis H37Rv
uacuuucacgcucguuugcga

SEQ ID NO: 1326623 - RNA, 16 nt, Mycobacterium tuberculosis H37Rv
uaggugcaugucgaug

SEQ ID NO: 1326624 - RNA, 16 nt, Mycobacterium tuberculosis H37Rv
uagguugccaugccaa

SEQ ID NO: 1326625 - RNA, 13 nt, Mycobacterium tuberculosis H37Rv
uaucguacuggcu

SEQ ID NO: 1326626 - RNA, 18 nt, Mycobacterium tuberculosis H37Rv
uaucggcuucgucaucug

SEQ ID NO: 1326627 - RNA, 15 nt, Mycobacterium tuberculosis H37Rv
uauaggccgcaugcc

SEQ ID NO: 1326628 - RNA, 20 nt, Mycobacterium tuberculosis H37Rv
uaucucggugacgaugaacu

SEQ ID NO: 1326629 - RNA, 24 nt, Mycobacterium tuberculosis H37Rv
uaucuauggaugaccgaaccuggu

SEQ ID NO: 1326630 - RNA, 19 nt, Mycobacterium tuberculosis H37Rv
uaucuguugacucugcguc

SEQ ID NO: 1326631 - RNA, 23 nt, Mycobacterium tuberculosis H37Rv
uaugcccacgaaccgugcugggc

SEQ ID NO: 1326632 - RNA, 14 nt, Mycobacterium tuberculosis H37Rv
uaugcgcacucuag

SEQ ID NO: 1326633 - RNA, 13 nt, Mycobacterium tuberculosis H37Rv
uaugcuggcagcu

SEQ ID NO: 1326634 - RNA, 17 nt, Mycobacterium tuberculosis H37Rv
uaugccacaggcugcca

SEQ ID NO: 1326635 - RNA, 14 nt, Mycobacterium tuberculosis H37Rv
uauucguuggcgaa

SEQ ID NO: 1326636 - RNA, 14 nt, Mycobacterium tuberculosis H37Rv
uauugccaaagccc

SEQ ID NO: 1326637 - RNA, 15 nt, Mycobacterium tuberculosis H37Rv
ucagcggcagcaccg

SEQ ID NO: 1326638 - RNA, 16 nt, Mycobacterium tuberculosis H37Rv
ucagcgguggcguggu

SEQ ID NO: 1326639 - RNA, 20 nt, Mycobacterium tuberculosis H37Rv
ucagcguauuggacgcugcc

SEQ ID NO: 1326640 - RNA, 21 nt, Mycobacterium tuberculosis H37Rv
ucagcgucaggccuccaaaau

SEQ ID NO: 1326641 - RNA, 15 nt, Mycobacterium tuberculosis H37Rv
ucagcucgcuugcau

SEQ ID NO: 1326642 - RNA, 22 nt, Mycobacterium tuberculosis H37Rv
ucagcucgaccccggugcccau

SEQ ID NO: 1326643 - RNA, 15 nt, Mycobacterium tuberculosis H37Rv
ucagcucggcagcau

SEQ ID NO: 1326644 - RNA, 22 nt, Mycobacterium tuberculosis H37Rv
ucagccaccgcaugugggaacu

SEQ ID NO: 1326645 - RNA, 16 nt, Mycobacterium tuberculosis H37Rv
ucagccccaugaucug

SEQ ID NO: 1326646 - RNA, 14 nt, Mycobacterium tuberculosis H37Rv
ucagccccagugug

SEQ ID NO: 1326647 - RNA, 14 nt, Mycobacterium tuberculosis H37Rv
ucagccaccgguga

SEQ ID NO: 1326648 - RNA, 16 nt, Mycobacterium tuberculosis H37Rv
ucagcccgccggaccc

SEQ ID NO: 1326649 - RNA, 21 nt, Mycobacterium tuberculosis H37Rv
ucagcgcacuggccgcuaucc

SEQ ID NO: 1326650 - RNA, 14 nt, Mycobacterium tuberculosis H37Rv
ucagcgcagcaucg

SEQ ID NO: 1326651 - RNA, 16 nt, Mycobacterium tuberculosis H37Rv
ucagccgaccgaccug

SEQ ID NO: 1326652 - RNA, 18 nt, Mycobacterium tuberculosis H37Rv
ucagcaugguccacagcc

SEQ ID NO: 1326653 - RNA, 12 nt, Mycobacterium tuberculosis H37Rv
ucagcagcgccg

SEQ ID NO: 1326654 - RNA, 12 nt, Mycobacterium tuberculosis H37Rv
ucagcagcuguu

SEQ ID NO: 1326655 - RNA, 14 nt, Mycobacterium tuberculosis H37Rv
ucagcagcgccagc

SEQ ID NO: 1326656 - RNA, 21 nt, Mycobacterium tuberculosis H37Rv
ucagcaggcccuucaguucga

SEQ ID NO: 1326657 - RNA, 23 nt, Mycobacterium tuberculosis H37Rv
ucagcagugggaugaagaacgcg

SEQ ID NO: 1326658 - RNA, 16 nt, Mycobacterium tuberculosis H37Rv
ucagcaccaccagcag

SEQ ID NO: 1326659 - RNA, 22 nt, Mycobacterium tuberculosis H37Rv
ucagcaauacggcggcgccgcc

SEQ ID NO: 1326660 - RNA, 22 nt, Mycobacterium tuberculosis H37Rv
ucagcaccgcuacgaccaauag

SEQ ID NO: 1326661 - RNA, 20 nt, Mycobacterium tuberculosis H37Rv
ucagcagaauccugcgcugc

SEQ ID NO: 1326662 - RNA, 17 nt, Mycobacterium tuberculosis H37Rv
ucagcacggugggcgcu

SEQ ID NO: 1326663 - RNA, 20 nt, Mycobacterium tuberculosis H37Rv
ucagcacguuguucagcccg

SEQ ID NO: 1326664 - RNA, 22 nt, Mycobacterium tuberculosis H37Rv
ucagcacguuguucagcccgcc

SEQ ID NO: 1326665 - RNA, 17 nt, Mycobacterium tuberculosis H37Rv
ucagcacgccgggugcc

SEQ ID NO: 1326666 - RNA, 15 nt, Mycobacterium tuberculosis H37Rv
ucagcacgcugacca

SEQ ID NO: 1326667 - RNA, 14 nt, Mycobacterium tuberculosis H37Rv
ucaggccccgggaa

SEQ ID NO: 1326668 - RNA, 15 nt, Mycobacterium tuberculosis H37Rv
ucaggcccuuuuccc

SEQ ID NO: 1326669 - RNA, 22 nt, Mycobacterium tuberculosis H37Rv
ucaggcccuuuucccugccuuc

SEQ ID NO: 1326670 - RNA, 18 nt, Mycobacterium tuberculosis H37Rv
ucaggcccauggcagccc

SEQ ID NO: 1326671 - RNA, 20 nt, Mycobacterium tuberculosis H37Rv
ucagugcguuggcgccggcc

SEQ ID NO: 1326672 - RNA, 20 nt, Mycobacterium tuberculosis H37Rv
ucaguauucguaguccgguc

SEQ ID NO: 1326673 - RNA, 18 nt, Mycobacterium tuberculosis H37Rv
ucagugaagacaccaggc

SEQ ID NO: 1326674 - RNA, 23 nt, Mycobacterium tuberculosis H37Rv
ucaggcggcagguucgaggguga

SEQ ID NO: 1326675 - RNA, 17 nt, Mycobacterium tuberculosis H37Rv
ucaggucgucacgcccc

SEQ ID NO: 1326676 - RNA, 20 nt, Mycobacterium tuberculosis H37Rv
ucaggucgccgagaccggcc

SEQ ID NO: 1326677 - RNA, 19 nt, Mycobacterium tuberculosis H37Rv
ucagaggucgccggcacac

SEQ ID NO: 1326678 - RNA, 18 nt, Mycobacterium tuberculosis H37Rv
ucagacggcgaguaggcg

SEQ ID NO: 1326679 - RNA, 23 nt, Mycobacterium tuberculosis H37Rv
ucagacgccggcccaguucugca

SEQ ID NO: 1326680 - RNA, 13 nt, Mycobacterium tuberculosis H37Rv
ucagaaucugccu

SEQ ID NO: 1326681 - RNA, 14 nt, Mycobacterium tuberculosis H37Rv
ucagacaacaacac

SEQ ID NO: 1326682 - RNA, 18 nt, Mycobacterium tuberculosis H37Rv
ucagaauugugugcagca

SEQ ID NO: 1326683 - RNA, 17 nt, Mycobacterium tuberculosis H37Rv
ucagaacgugacggucc

SEQ ID NO: 1326684 - RNA, 13 nt, Mycobacterium tuberculosis H37Rv
ucagaacggcggc

SEQ ID NO: 1326685 - RNA, 21 nt, Mycobacterium tuberculosis H37Rv
ucagaacggcggcagcggcgu

SEQ ID NO: 1326686 - RNA, 22 nt, Mycobacterium tuberculosis H37Rv
ucagaaggaucagcgcacuggc

SEQ ID NO: 1326687 - RNA, 14 nt, Mycobacterium tuberculosis H37Rv
ucagaacgcggccu

SEQ ID NO: 1326688 - RNA, 13 nt, Mycobacterium tuberculosis H37Rv
ucagauagucgcc

SEQ ID NO: 1326689 - RNA, 12 nt, Mycobacterium tuberculosis H37Rv
ucagauccggcc

SEQ ID NO: 1326690 - RNA, 17 nt, Mycobacterium tuberculosis H37Rv
ucagcaacucggccacg

SEQ ID NO: 1326691 - RNA, 19 nt, Mycobacterium tuberculosis H37Rv
ucagcaacucggccacggc

SEQ ID NO: 1326692 - RNA, 21 nt, Mycobacterium tuberculosis H37Rv
ucagcaacaacgucugcagcc

SEQ ID NO: 1326693 - RNA, 18 nt, Mycobacterium tuberculosis H37Rv
ucagcaacaacgucugca

SEQ ID NO: 1326694 - RNA, 18 nt, Mycobacterium tuberculosis H37Rv
ucagaacaccggccaggc

SEQ ID NO: 1326695 - RNA, 20 nt, Mycobacterium tuberculosis H37Rv
ucacugguccaacgaucagu

SEQ ID NO: 1326696 - RNA, 15 nt, Mycobacterium tuberculosis H37Rv
ucacuggugacccug

SEQ ID NO: 1326697 - RNA, 13 nt, Mycobacterium tuberculosis H37Rv
ucacugcagcgcc

SEQ ID NO: 1326698 - RNA, 21 nt, Mycobacterium tuberculosis H37Rv
ucacuugcgccaccguggccg

SEQ ID NO: 1326699 - RNA, 13 nt, Mycobacterium tuberculosis H37Rv
ucacccucccgca

SEQ ID NO: 1326700 - RNA, 18 nt, Mycobacterium tuberculosis H37Rv
ucacccugucgcgcaccg

SEQ ID NO: 1326701 - RNA, 18 nt, Mycobacterium tuberculosis H37Rv
ucacccgggcagccugcu

SEQ ID NO: 1326702 - RNA, 22 nt, Mycobacterium tuberculosis H37Rv
ucacccguagguaguuguccag

SEQ ID NO: 1326703 - RNA, 21 nt, Mycobacterium tuberculosis H37Rv
ucacccgguguccagugcauu

SEQ ID NO: 1326704 - RNA, 21 nt, Mycobacterium tuberculosis H37Rv
ucacccguguucgccacaccc

SEQ ID NO: 1326705 - RNA, 21 nt, Mycobacterium tuberculosis H37Rv
ucacguugugagccacgcgca

SEQ ID NO: 1326706 - RNA, 19 nt, Mycobacterium tuberculosis H37Rv
ucacggcggccccggcauu

SEQ ID NO: 1326707 - RNA, 16 nt, Mycobacterium tuberculosis H37Rv
ucacggcgcgagccug

SEQ ID NO: 1326708 - RNA, 19 nt, Mycobacterium tuberculosis H37Rv
ucaaacuaccgaacagugg

SEQ ID NO: 1326709 - RNA, 22 nt, Mycobacterium tuberculosis H37Rv
ucaaacccagcgacgcggccag

SEQ ID NO: 1326710 - RNA, 12 nt, Mycobacterium tuberculosis H37Rv
ucaaagcggccu

SEQ ID NO: 1326711 - RNA, 23 nt, Mycobacterium tuberculosis H37Rv
ucaaagcggugccauuguaaaau

SEQ ID NO: 1326712 - RNA, 16 nt, Mycobacterium tuberculosis H37Rv
ucaaccugcgcaucac

SEQ ID NO: 1326713 - RNA, 22 nt, Mycobacterium tuberculosis H37Rv
ucaacgacgacgacaagugccc

SEQ ID NO: 1326714 - RNA, 16 nt, Mycobacterium tuberculosis H37Rv
ucaaccugcugcagaa

SEQ ID NO: 1326715 - RNA, 14 nt, Mycobacterium tuberculosis H37Rv
ucaacgacaccaga

SEQ ID NO: 1326716 - RNA, 15 nt, Mycobacterium tuberculosis H37Rv
ucaacgacaccagau

SEQ ID NO: 1326717 - RNA, 19 nt, Mycobacterium tuberculosis H37Rv
ucaacgcaucgguggcacg

SEQ ID NO: 1326718 - RNA, 18 nt, Mycobacterium tuberculosis H37Rv
ucaacgccucugcucagc

SEQ ID NO: 1326719 - RNA, 21 nt, Mycobacterium tuberculosis H37Rv
ucaacgccgcggucaggaugg

SEQ ID NO: 1326720 - RNA, 21 nt, Mycobacterium tuberculosis H37Rv
ucaacggaagaagcaguagcu

SEQ ID NO: 1326721 - RNA, 19 nt, Mycobacterium tuberculosis H37Rv
ucaacgcguugcacagcag

SEQ ID NO: 1326722 - RNA, 20 nt, Mycobacterium tuberculosis H37Rv
ucaacaccgccgaccuaguc

SEQ ID NO: 1326723 - RNA, 16 nt, Mycobacterium tuberculosis H37Rv
ucaacaccagcaagug

SEQ ID NO: 1326724 - RNA, 13 nt, Mycobacterium tuberculosis H37Rv
ucaacauuucuga

SEQ ID NO: 1326725 - RNA, 17 nt, Mycobacterium tuberculosis H37Rv
ucaacauugugcucgcc

SEQ ID NO: 1326726 - RNA, 14 nt, Mycobacterium tuberculosis H37Rv
ucaacagggccagg

SEQ ID NO: 1326727 - RNA, 16 nt, Mycobacterium tuberculosis H37Rv
ucacagcacagcgcag

SEQ ID NO: 1326728 - RNA, 13 nt, Mycobacterium tuberculosis H37Rv
ucacaaacccagc

SEQ ID NO: 1326729 - RNA, 17 nt, Mycobacterium tuberculosis H37Rv
ucacaaacccagcaucg

SEQ ID NO: 1326730 - RNA, 15 nt, Mycobacterium tuberculosis H37Rv
ucacaguucugccuu

SEQ ID NO: 1326731 - RNA, 20 nt, Mycobacterium tuberculosis H37Rv
aaaucggcggcguccagcag

SEQ ID NO: 1326732 - RNA, 21 nt, Mycobacterium tuberculosis H37Rv
aaaucggcggcguccagcagc

SEQ ID NO: 1326733 - RNA, 11 nt, Mycobacterium tuberculosis H37Rv
ucaccaccgga

SEQ ID NO: 1326734 - RNA, 21 nt, Mycobacterium tuberculosis H37Rv
ucaccaccgccgccaccaccg

SEQ ID NO: 1326735 - RNA, 13 nt, Mycobacterium tuberculosis H37Rv
ucaccaccgaccc

SEQ ID NO: 1326736 - RNA, 22 nt, Mycobacterium tuberculosis H37Rv
ucaccacgccggucgaggugac

SEQ ID NO: 1326737 - RNA, 12 nt, Mycobacterium tuberculosis H37Rv
ucaccagcggcu

SEQ ID NO: 1326738 - RNA, 16 nt, Mycobacterium tuberculosis H37Rv
ucaccagcggucagcc

SEQ ID NO: 1326739 - RNA, 19 nt, Mycobacterium tuberculosis H37Rv
ucaauuccaugcaguuguc

SEQ ID NO: 1326740 - RNA, 16 nt, Mycobacterium tuberculosis H37Rv
ucaauuggaagacacg

SEQ ID NO: 1326741 - RNA, 15 nt, Mycobacterium tuberculosis H37Rv
uaaagcucaccacau

SEQ ID NO: 1326742 - RNA, 22 nt, Mycobacterium tuberculosis H37Rv
uaaagaucguugccucgucgcc

SEQ ID NO: 1326743 - RNA, 14 nt, Mycobacterium tuberculosis H37Rv
guuuuggaagcccg

SEQ ID NO: 1326744 - RNA, 19 nt, Mycobacterium tuberculosis H37Rv
uaaaccagccaccaccagg

SEQ ID NO: 1326745 - RNA, 13 nt, Mycobacterium tuberculosis H37Rv
uaaacgcggcgcg

SEQ ID NO: 1326746 - RNA, 17 nt, Mycobacterium tuberculosis H37Rv
uaaaccucgccggugac

SEQ ID NO: 1326747 - RNA, 22 nt, Mycobacterium tuberculosis H37Rv
uaaacggcacacgaguacagau

SEQ ID NO: 1326748 - RNA, 16 nt, Mycobacterium tuberculosis H37Rv
uaaccacgacgacgac

SEQ ID NO: 1326749 - RNA, 14 nt, Mycobacterium tuberculosis H37Rv
uaacgcaggcagug

SEQ ID NO: 1326750 - RNA, 21 nt, Mycobacterium tuberculosis H37Rv
uaacgccaagcucggcccagc

SEQ ID NO: 1326751 - RNA, 17 nt, Mycobacterium tuberculosis H37Rv
uaaccggcaugccgcca

SEQ ID NO: 1326752 - RNA, 20 nt, Mycobacterium tuberculosis H37Rv
uaaaugccugcccaccuucg

SEQ ID NO: 1326753 - RNA, 21 nt, Mycobacterium tuberculosis H37Rv
uaagcagccagcaacaccaga

SEQ ID NO: 1326754 - RNA, 22 nt, Mycobacterium tuberculosis H37Rv
uaagcagcucgguggcaucggc

SEQ ID NO: 1326755 - RNA, 19 nt, Mycobacterium tuberculosis H37Rv
uaagcccggucgcugaucc

SEQ ID NO: 1326756 - RNA, 17 nt, Mycobacterium tuberculosis H37Rv
uaagcauucagcgcgcc

SEQ ID NO: 1326757 - RNA, 23 nt, Mycobacterium tuberculosis H37Rv
uaaggagccgggccguccgggua

SEQ ID NO: 1326758 - RNA, 21 nt, Mycobacterium tuberculosis H37Rv
uaaggaucagaacgcggccuc

SEQ ID NO: 1326759 - RNA, 20 nt, Mycobacterium tuberculosis H37Rv
uaaggcacguucagccaggc

SEQ ID NO: 1326760 - RNA, 15 nt, Mycobacterium tuberculosis H37Rv
uaagucuggagugag

SEQ ID NO: 1326761 - RNA, 14 nt, Mycobacterium tuberculosis H37Rv
uaagggcacuccac

SEQ ID NO: 1326762 - RNA, 17 nt, Mycobacterium tuberculosis H37Rv
uaagacggauuguccgg

SEQ ID NO: 1326763 - RNA, 14 nt, Mycobacterium tuberculosis H37Rv
uaacuggcccggac

SEQ ID NO: 1326764 - RNA, 20 nt, Mycobacterium tuberculosis H37Rv
aaauccccucgcaaccggcg

SEQ ID NO: 1326765 - RNA, 23 nt, Mycobacterium tuberculosis H37Rv
aaauccgcaccagccgccaugcg

SEQ ID NO: 1326766 - RNA, 19 nt, Mycobacterium tuberculosis H37Rv
uaaugaucucggcaaggac

SEQ ID NO: 1326767 - RNA, 14 nt, Mycobacterium tuberculosis H37Rv
uaaugaugauguca

SEQ ID NO: 1326768 - RNA, 21 nt, Mycobacterium tuberculosis H37Rv
uacaacacagaacucaccgac

SEQ ID NO: 1326769 - RNA, 15 nt, Mycobacterium tuberculosis H37Rv
uacaucgccuugccc

SEQ ID NO: 1326770 - RNA, 19 nt, Mycobacterium tuberculosis H37Rv
uacauagccggucauuuca

SEQ ID NO: 1326771 - RNA, 22 nt, Mycobacterium tuberculosis H37Rv
uacagucgaccggacacuccug

SEQ ID NO: 1326772 - RNA, 20 nt, Mycobacterium tuberculosis H37Rv
uaccaacaggauggugcggc

SEQ ID NO: 1326773 - RNA, 22 nt, Mycobacterium tuberculosis H37Rv
uaccacuuugcguucccauccc

SEQ ID NO: 1326774 - RNA, 15 nt, Mycobacterium tuberculosis H37Rv
uaccaccacguggcc

SEQ ID NO: 1326775 - RNA, 15 nt, Mycobacterium tuberculosis H37Rv
uaccacauaccccga

SEQ ID NO: 1326776 - RNA, 19 nt, Mycobacterium tuberculosis H37Rv
uaccagccgaagaaccggu

SEQ ID NO: 1326777 - RNA, 18 nt, Mycobacterium tuberculosis H37Rv
uaccagccgccccggcuu

SEQ ID NO: 1326778 - RNA, 15 nt, Mycobacterium tuberculosis H37Rv
uaccagcugggcgac

SEQ ID NO: 1326779 - RNA, 14 nt, Mycobacterium tuberculosis H37Rv
uaccagcggcaccg

SEQ ID NO: 1326780 - RNA, 14 nt, Mycobacterium tuberculosis H37Rv
uacccccagcaccc

SEQ ID NO: 1326781 - RNA, 17 nt, Mycobacterium tuberculosis H37Rv
uaccccagccggcagca

SEQ ID NO: 1326782 - RNA, 20 nt, Mycobacterium tuberculosis H37Rv
uaccccagccggcagcagcg

SEQ ID NO: 1326783 - RNA, 13 nt, Mycobacterium tuberculosis H37Rv
uaccccagcacaa

SEQ ID NO: 1326784 - RNA, 20 nt, Mycobacterium tuberculosis H37Rv
uaccccagaccgccacacgg

SEQ ID NO: 1326785 - RNA, 17 nt, Mycobacterium tuberculosis H37Rv
uacccaucgccacaccc

SEQ ID NO: 1326786 - RNA, 15 nt, Mycobacterium tuberculosis H37Rv
uacccagcgcggcca

SEQ ID NO: 1326787 - RNA, 23 nt, Mycobacterium tuberculosis H37Rv
uacccagcgcggccaccaccgag

SEQ ID NO: 1326788 - RNA, 17 nt, Mycobacterium tuberculosis H37Rv
uacccagcgcagcagcg

SEQ ID NO: 1326789 - RNA, 15 nt, Mycobacterium tuberculosis H37Rv
uaccaggcgcggccc

SEQ ID NO: 1326790 - RNA, 12 nt, Mycobacterium tuberculosis H37Rv
uacccgcuggcc

SEQ ID NO: 1326791 - RNA, 16 nt, Mycobacterium tuberculosis H37Rv
uacccgggccaggcug

SEQ ID NO: 1326792 - RNA, 21 nt, Mycobacterium tuberculosis H37Rv
uacccgaccagcaccagaacc

SEQ ID NO: 1326793 - RNA, 15 nt, Mycobacterium tuberculosis H37Rv
uacccguagcaccac

SEQ ID NO: 1326794 - RNA, 11 nt, Mycobacterium tuberculosis H37Rv
uacccuuugca

SEQ ID NO: 1326795 - RNA, 15 nt, Mycobacterium tuberculosis H37Rv
uaccgaacagcaccu

SEQ ID NO: 1326796 - RNA, 17 nt, Mycobacterium tuberculosis H37Rv
uaccgcucagggugcgc

SEQ ID NO: 1326797 - RNA, 23 nt, Mycobacterium tuberculosis H37Rv
uaccgagcacaucgccacaacgc

SEQ ID NO: 1326798 - RNA, 17 nt, Mycobacterium tuberculosis H37Rv
uaccgaaccgguguagc

SEQ ID NO: 1326799 - RNA, 10 nt, Mycobacterium tuberculosis H37Rv
uacuugaccg

SEQ ID NO: 1326800 - RNA, 22 nt, Mycobacterium tuberculosis H37Rv
uacugucgucgcccugacacaa

SEQ ID NO: 1326801 - RNA, 13 nt, Mycobacterium tuberculosis H37Rv
uacugagcuucca

SEQ ID NO: 1326802 - RNA, 14 nt, Mycobacterium tuberculosis H37Rv
uacucgugaugaau

SEQ ID NO: 1326803 - RNA, 20 nt, Mycobacterium tuberculosis H37Rv
uacgcgcgcucgcucaccgg

SEQ ID NO: 1326804 - RNA, 22 nt, Mycobacterium tuberculosis H37Rv
uacgcgaucagcgcgcacacgg

SEQ ID NO: 1326805 - RNA, 15 nt, Mycobacterium tuberculosis H37Rv
uacgcggcugcgucg

SEQ ID NO: 1326806 - RNA, 12 nt, Mycobacterium tuberculosis H37Rv
uacgggcaggcc

SEQ ID NO: 1326807 - RNA, 20 nt, Mycobacterium tuberculosis H37Rv
uacgggcaggccgcugggcc

SEQ ID NO: 1326808 - RNA, 12 nt, Mycobacterium tuberculosis H37Rv
uacgggcaguga

SEQ ID NO: 1326809 - RNA, 15 nt, Mycobacterium tuberculosis H37Rv
uacgggcagugaaca

SEQ ID NO: 1326810 - RNA, 16 nt, Mycobacterium tuberculosis H37Rv
uacgucguccagcacc

SEQ ID NO: 1326811 - RNA, 20 nt, Mycobacterium tuberculosis H37Rv
uacgucgaucaggucgucac

SEQ ID NO: 1326812 - RNA, 19 nt, Mycobacterium tuberculosis H37Rv
uaccguguaugcauccacu

SEQ ID NO: 1326813 - RNA, 23 nt, Mycobacterium tuberculosis H37Rv
uaccgucaguagccacgcccaca

SEQ ID NO: 1326814 - RNA, 16 nt, Mycobacterium tuberculosis H37Rv
uacgacuuggugcagc

SEQ ID NO: 1326815 - RNA, 16 nt, Mycobacterium tuberculosis H37Rv
uacgcaccgaggccgc

SEQ ID NO: 1326816 - RNA, 20 nt, Mycobacterium tuberculosis H37Rv
uacgcaccgaggccgccgag

SEQ ID NO: 1326817 - RNA, 20 nt, Mycobacterium tuberculosis H37Rv
uacgccggccgcgcugguga

SEQ ID NO: 1326818 - RNA, 17 nt, Mycobacterium tuberculosis H37Rv
uacgcccacuccagcag

SEQ ID NO: 1326819 - RNA, 21 nt, Mycobacterium tuberculosis H37Rv
guccaggaucgcguggcgcac

SEQ ID NO: 1326820 - RNA, 15 nt, Mycobacterium tuberculosis H37Rv
guccaggagugcggg

SEQ ID NO: 1326821 - RNA, 16 nt, Mycobacterium tuberculosis H37Rv
guccagcgccgcggcc

SEQ ID NO: 1326822 - RNA, 13 nt, Mycobacterium tuberculosis H37Rv
guccaggccggca

SEQ ID NO: 1326823 - RNA, 19 nt, Mycobacterium tuberculosis H37Rv
guccaggcacuccagcggc

SEQ ID NO: 1326824 - RNA, 20 nt, Mycobacterium tuberculosis H37Rv
guccaggcacuccagcggcg

SEQ ID NO: 1326825 - RNA, 22 nt, Mycobacterium tuberculosis H37Rv
guccaggcagcguaagaccuga

SEQ ID NO: 1326826 - RNA, 15 nt, Mycobacterium tuberculosis H37Rv
guccauaccugaaug

SEQ ID NO: 1326827 - RNA, 22 nt, Mycobacterium tuberculosis H37Rv
guccaugcggguaaaccaggug

SEQ ID NO: 1326828 - RNA, 19 nt, Mycobacterium tuberculosis H37Rv
guccaucgcgcggcugugc

SEQ ID NO: 1326829 - RNA, 19 nt, Mycobacterium tuberculosis H37Rv
guccauauagaucacugcu

SEQ ID NO: 1326830 - RNA, 17 nt, Mycobacterium tuberculosis H37Rv
guccaucaccggcggcc

SEQ ID NO: 1326831 - RNA, 22 nt, Mycobacterium tuberculosis H37Rv
guccaucaccggcggccccagg

SEQ ID NO: 1326832 - RNA, 20 nt, Mycobacterium tuberculosis H37Rv
gucccagcgguagccgagcu

SEQ ID NO: 1326833 - RNA, 18 nt, Mycobacterium tuberculosis H37Rv
gucccagccgaucacggg

SEQ ID NO: 1326834 - RNA, 15 nt, Mycobacterium tuberculosis H37Rv
gucccagcugaccag

SEQ ID NO: 1326835 - RNA, 18 nt, Mycobacterium tuberculosis H37Rv
gucccagcugaccagcgu

SEQ ID NO: 1326836 - RNA, 17 nt, Mycobacterium tuberculosis H37Rv
gucccagcgccgcagug

SEQ ID NO: 1326837 - RNA, 18 nt, Mycobacterium tuberculosis H37Rv
gucccacugccggugcug

SEQ ID NO: 1326838 - RNA, 20 nt, Mycobacterium tuberculosis H37Rv
gucccacugcgcgucgagcg

SEQ ID NO: 1326839 - RNA, 15 nt, Mycobacterium tuberculosis H37Rv
gucccacugggccgg

SEQ ID NO: 1326840 - RNA, 20 nt, Mycobacterium tuberculosis H37Rv
guccaccgccgacauggcgg

SEQ ID NO: 1326841 - RNA, 16 nt, Mycobacterium tuberculosis H37Rv
guccaccgcugccggc

SEQ ID NO: 1326842 - RNA, 14 nt, Mycobacterium tuberculosis H37Rv
guccagcccagcgc

SEQ ID NO: 1326843 - RNA, 13 nt, Mycobacterium tuberculosis H37Rv
guccagccaggcg

SEQ ID NO: 1326844 - RNA, 15 nt, Mycobacterium tuberculosis H37Rv
guccagccacgcugu

SEQ ID NO: 1326845 - RNA, 20 nt, Mycobacterium tuberculosis H37Rv
guccagccguggcggcgggc

SEQ ID NO: 1326846 - RNA, 17 nt, Mycobacterium tuberculosis H37Rv
guccagccgggugccgg

SEQ ID NO: 1326847 - RNA, 20 nt, Mycobacterium tuberculosis H37Rv
guccagcgaggagcagggcu

SEQ ID NO: 1326848 - RNA, 20 nt, Mycobacterium tuberculosis H37Rv
guccagcgcgacguccacca

SEQ ID NO: 1326849 - RNA, 21 nt, Mycobacterium tuberculosis H37Rv
guccagcgcgacguccaccag

SEQ ID NO: 1326850 - RNA, 16 nt, Mycobacterium tuberculosis H37Rv
guccagcgaucccggu

SEQ ID NO: 1326851 - RNA, 23 nt, Mycobacterium tuberculosis H37Rv
guccagcgcaucguugccgcaga

SEQ ID NO: 1326852 - RNA, 14 nt, Mycobacterium tuberculosis H37Rv
guccagcggccgcc

SEQ ID NO: 1326853 - RNA, 15 nt, Mycobacterium tuberculosis H37Rv
guccagcggccgccg

SEQ ID NO: 1326854 - RNA, 20 nt, Mycobacterium tuberculosis H37Rv
guccagcgcgccacccagca

SEQ ID NO: 1326855 - RNA, 14 nt, Mycobacterium tuberculosis H37Rv
guccaccgccacca

SEQ ID NO: 1326856 - RNA, 18 nt, Mycobacterium tuberculosis H37Rv
guccaccagccgguuggc

SEQ ID NO: 1326857 - RNA, 17 nt, Mycobacterium tuberculosis H37Rv
guccaauacucgccauc

SEQ ID NO: 1326858 - RNA, 20 nt, Mycobacterium tuberculosis H37Rv
guccaagccguagaccaggc

SEQ ID NO: 1326859 - RNA, 22 nt, Mycobacterium tuberculosis H37Rv
guccaagccguagaccaggccc

SEQ ID NO: 1326860 - RNA, 16 nt, Mycobacterium tuberculosis H37Rv
guccaagccggccacg

SEQ ID NO: 1326861 - RNA, 23 nt, Mycobacterium tuberculosis H37Rv
guccaagccggccacgcauucca

SEQ ID NO: 1326862 - RNA, 13 nt, Mycobacterium tuberculosis H37Rv
guccacagccggc

SEQ ID NO: 1326863 - RNA, 14 nt, Mycobacterium tuberculosis H37Rv
guccacagccggcg

SEQ ID NO: 1326864 - RNA, 14 nt, Mycobacterium tuberculosis H37Rv
guccacacgcugcc

SEQ ID NO: 1326865 - RNA, 19 nt, Mycobacterium tuberculosis H37Rv
guccaauuccgcagagacc

SEQ ID NO: 1326866 - RNA, 16 nt, Mycobacterium tuberculosis H37Rv
gucaucagcgugcaug

SEQ ID NO: 1326867 - RNA, 16 nt, Mycobacterium tuberculosis H37Rv
gucagguugucggcga

SEQ ID NO: 1326868 - RNA, 20 nt, Mycobacterium tuberculosis H37Rv
gucagguugucggcgaucaa

SEQ ID NO: 1326869 - RNA, 20 nt, Mycobacterium tuberculosis H37Rv
gucaggucugacagaccggg

SEQ ID NO: 1326870 - RNA, 14 nt, Mycobacterium tuberculosis H37Rv
gucaucgagcugac

SEQ ID NO: 1326871 - RNA, 13 nt, Mycobacterium tuberculosis H37Rv
gucauguccgucc

SEQ ID NO: 1326872 - RNA, 17 nt, Mycobacterium tuberculosis H37Rv
gucaucggaucaaagcc

SEQ ID NO: 1326873 - RNA, 15 nt, Mycobacterium tuberculosis H37Rv
gucaucuggcgcugc

SEQ ID NO: 1326874 - RNA, 17 nt, Mycobacterium tuberculosis H37Rv
gucaggcuggaggugaa

SEQ ID NO: 1326875 - RNA, 22 nt, Mycobacterium tuberculosis H37Rv
gucaggcucacacucggccggg

SEQ ID NO: 1326876 - RNA, 16 nt, Mycobacterium tuberculosis H37Rv
gucaggcguagguccu

SEQ ID NO: 1326877 - RNA, 18 nt, Mycobacterium tuberculosis H37Rv
gucagguaauucguccac

SEQ ID NO: 1326878 - RNA, 16 nt, Mycobacterium tuberculosis H37Rv
gucagggucaccugcg

SEQ ID NO: 1326879 - RNA, 13 nt, Mycobacterium tuberculosis H37Rv
gucagcgccgcgc

SEQ ID NO: 1326880 - RNA, 16 nt, Mycobacterium tuberculosis H37Rv
gucagcgcggcgcaca

SEQ ID NO: 1326881 - RNA, 23 nt, Mycobacterium tuberculosis H37Rv
gucaggcacaacgcgacgccgcu

SEQ ID NO: 1326882 - RNA, 17 nt, Mycobacterium tuberculosis H37Rv
gucagccugccagguac

SEQ ID NO: 1326883 - RNA, 15 nt, Mycobacterium tuberculosis H37Rv
gucagccgcggcggc

SEQ ID NO: 1326884 - RNA, 21 nt, Mycobacterium tuberculosis H37Rv
gucagcccgauacgggugugg

SEQ ID NO: 1326885 - RNA, 20 nt, Mycobacterium tuberculosis H37Rv
gucagccgugccguggugaa

SEQ ID NO: 1326886 - RNA, 17 nt, Mycobacterium tuberculosis H37Rv
gucagccccgacugcgc

SEQ ID NO: 1326887 - RNA, 21 nt, Mycobacterium tuberculosis H37Rv
gucagcaugggaauccgcugu

SEQ ID NO: 1326888 - RNA, 19 nt, Mycobacterium tuberculosis H37Rv
gucagccaccaucuggaug

SEQ ID NO: 1326889 - RNA, 13 nt, Mycobacterium tuberculosis H37Rv
gucagcccagcca

SEQ ID NO: 1326890 - RNA, 21 nt, Mycobacterium tuberculosis H37Rv
gucagccaccaucuggauggc

SEQ ID NO: 1326891 - RNA, 17 nt, Mycobacterium tuberculosis H37Rv
gucagcagcuccacugg

SEQ ID NO: 1326892 - RNA, 23 nt, Mycobacterium tuberculosis H37Rv
gucacugcccugauugaagcccc

SEQ ID NO: 1326893 - RNA, 22 nt, Mycobacterium tuberculosis H37Rv
gucagcacccaacccggcggca

SEQ ID NO: 1326894 - RNA, 13 nt, Mycobacterium tuberculosis H37Rv
gucacgguggugu

SEQ ID NO: 1326895 - RNA, 17 nt, Mycobacterium tuberculosis H37Rv
gucacguaacgccgcgg

SEQ ID NO: 1326896 - RNA, 19 nt, Mycobacterium tuberculosis H37Rv
gucacguaauuccccaggu

SEQ ID NO: 1326897 - RNA, 12 nt, Mycobacterium tuberculosis H37Rv
gucacggugcgu

SEQ ID NO: 1326898 - RNA, 14 nt, Mycobacterium tuberculosis H37Rv
gucacgggguccga

SEQ ID NO: 1326899 - RNA, 15 nt, Mycobacterium tuberculosis H37Rv
gucacggaugcggcc

SEQ ID NO: 1326900 - RNA, 17 nt, Mycobacterium tuberculosis H37Rv
gucaccgcgcuggucag

SEQ ID NO: 1326901 - RNA, 14 nt, Mycobacterium tuberculosis H37Rv
gucaccgcgggcau

SEQ ID NO: 1326902 - RNA, 18 nt, Mycobacterium tuberculosis H37Rv
gucaccggaggccgccgc

SEQ ID NO: 1326903 - RNA, 18 nt, Mycobacterium tuberculosis H37Rv
gucaccgccgaccaggcc

SEQ ID NO: 1326904 - RNA, 13 nt, Mycobacterium tuberculosis H37Rv
gucacgcaccgcg

SEQ ID NO: 1326905 - RNA, 16 nt, Mycobacterium tuberculosis H37Rv
gucacgcagcacccug

SEQ ID NO: 1326906 - RNA, 15 nt, Mycobacterium tuberculosis H37Rv
gucacgcgaccaccg

SEQ ID NO: 1326907 - RNA, 15 nt, Mycobacterium tuberculosis H37Rv
gucacgccaccgcaa

SEQ ID NO: 1326908 - RNA, 13 nt, Mycobacterium tuberculosis H37Rv
gucacgcccgcga

SEQ ID NO: 1326909 - RNA, 14 nt, Mycobacterium tuberculosis H37Rv
gucacggaccugga

SEQ ID NO: 1326910 - RNA, 17 nt, Mycobacterium tuberculosis H37Rv
gucaaugcgcuggcgcc

SEQ ID NO: 1326911 - RNA, 20 nt, Mycobacterium tuberculosis H37Rv
gucaccccuucgccagcgcc

SEQ ID NO: 1326912 - RNA, 22 nt, Mycobacterium tuberculosis H37Rv
gucaccccuucgccagcgccac

SEQ ID NO: 1326913 - RNA, 17 nt, Mycobacterium tuberculosis H37Rv
gucaccccuucgccagc

SEQ ID NO: 1326914 - RNA, 19 nt, Mycobacterium tuberculosis H37Rv
gucaccccgauucgugucg

SEQ ID NO: 1326915 - RNA, 22 nt, Mycobacterium tuberculosis H37Rv
gucacccggccguugggccacc

SEQ ID NO: 1326916 - RNA, 22 nt, Mycobacterium tuberculosis H37Rv
ggugaacgucacguggucggcc

SEQ ID NO: 1326917 - RNA, 15 nt, Mycobacterium tuberculosis H37Rv
ggugaacgccugcgg

SEQ ID NO: 1326918 - RNA, 15 nt, Mycobacterium tuberculosis H37Rv
ggugaacggcagcac

SEQ ID NO: 1326919 - RNA, 16 nt, Mycobacterium tuberculosis H37Rv
ggugaagccgagcgcc

SEQ ID NO: 1326920 - RNA, 15 nt, Mycobacterium tuberculosis H37Rv
ggugaaccccgccgg

SEQ ID NO: 1326921 - RNA, 16 nt, Mycobacterium tuberculosis H37Rv
ggugaagaacaugcuc

SEQ ID NO: 1326922 - RNA, 19 nt, Mycobacterium tuberculosis H37Rv
ggugaacuucuccaccagc

SEQ ID NO: 1326923 - RNA, 22 nt, Mycobacterium tuberculosis H37Rv
ggugaaguugccggucaggcag

SEQ ID NO: 1326924 - RNA, 13 nt, Mycobacterium tuberculosis H37Rv
ggugaaggcaaac

SEQ ID NO: 1326925 - RNA, 17 nt, Mycobacterium tuberculosis H37Rv
gucaagccgggcacggg

SEQ ID NO: 1326926 - RNA, 23 nt, Mycobacterium tuberculosis H37Rv
gucaaucgcaaugaccugcagcg

SEQ ID NO: 1326927 - RNA, 19 nt, Mycobacterium tuberculosis H37Rv
gucaaucgcaaugaccugc

SEQ ID NO: 1326928 - RNA, 19 nt, Mycobacterium tuberculosis H37Rv
guccggaaauuccggcgcg

SEQ ID NO: 1326929 - RNA, 21 nt, Mycobacterium tuberculosis H37Rv
guccggaaauuccggcgcggc

SEQ ID NO: 1326930 - RNA, 17 nt, Mycobacterium tuberculosis H37Rv
guccggaugcgcaaccg

SEQ ID NO: 1326931 - RNA, 23 nt, Mycobacterium tuberculosis H37Rv
guccggaugcgcaaccgcggccc

SEQ ID NO: 1326932 - RNA, 13 nt, Mycobacterium tuberculosis H37Rv
guccggccccccg

SEQ ID NO: 1326933 - RNA, 22 nt, Mycobacterium tuberculosis H37Rv
guccggccccccgacuccggca

SEQ ID NO: 1326934 - RNA, 20 nt, Mycobacterium tuberculosis H37Rv
guccggcccaccagcgcagc

SEQ ID NO: 1326935 - RNA, 17 nt, Mycobacterium tuberculosis H37Rv
guccgcggaugcauguc

SEQ ID NO: 1326936 - RNA, 22 nt, Mycobacterium tuberculosis H37Rv
guccgcggucgcagcagaccac

SEQ ID NO: 1326937 - RNA, 16 nt, Mycobacterium tuberculosis H37Rv
gucccaucgcgucggc

SEQ ID NO: 1326938 - RNA, 21 nt, Mycobacterium tuberculosis H37Rv
guccccguugagauaccccga

SEQ ID NO: 1326939 - RNA, 15 nt, Mycobacterium tuberculosis H37Rv
guccccucggugcca

SEQ ID NO: 1326940 - RNA, 19 nt, Mycobacterium tuberculosis H37Rv
guccccucggugccacugc

SEQ ID NO: 1326941 - RNA, 18 nt, Mycobacterium tuberculosis H37Rv
gucccgauacggccggcc

SEQ ID NO: 1326942 - RNA, 20 nt, Mycobacterium tuberculosis H37Rv
guccuccaaggcggucacca

SEQ ID NO: 1326943 - RNA, 11 nt, Mycobacterium tuberculosis H37Rv
guccuccucgg

SEQ ID NO: 1326944 - RNA, 12 nt, Mycobacterium tuberculosis H37Rv
guccuccgggcu

SEQ ID NO: 1326945 - RNA, 19 nt, Mycobacterium tuberculosis H37Rv
guccugccaguccgcagcg

SEQ ID NO: 1326946 - RNA, 19 nt, Mycobacterium tuberculosis H37Rv
guccugccaaugcugcagg

SEQ ID NO: 1326947 - RNA, 21 nt, Mycobacterium tuberculosis H37Rv
guccugccagaagaccuggcg

SEQ ID NO: 1326948 - RNA, 19 nt, Mycobacterium tuberculosis H37Rv
guccucacaugcccggacg

SEQ ID NO: 1326949 - RNA, 18 nt, Mycobacterium tuberculosis H37Rv
guccggguagcggcgccg

SEQ ID NO: 1326950 - RNA, 16 nt, Mycobacterium tuberculosis H37Rv
guccggcuuggcggcg

SEQ ID NO: 1326951 - RNA, 23 nt, Mycobacterium tuberculosis H37Rv
guccggcuuguccucacaugccc

SEQ ID NO: 1326952 - RNA, 20 nt, Mycobacterium tuberculosis H37Rv
guccggccgggggaacggga

SEQ ID NO: 1326953 - RNA, 15 nt, Mycobacterium tuberculosis H37Rv
guccggcgccugcug

SEQ ID NO: 1326954 - RNA, 13 nt, Mycobacterium tuberculosis H37Rv
gucgagcagccgc

SEQ ID NO: 1326955 - RNA, 14 nt, Mycobacterium tuberculosis H37Rv
gucgagcagcgcca

SEQ ID NO: 1326956 - RNA, 13 nt, Mycobacterium tuberculosis H37Rv
gucgagcaggccc

SEQ ID NO: 1326957 - RNA, 16 nt, Mycobacterium tuberculosis H37Rv
gucgagcgcccacugg

SEQ ID NO: 1326958 - RNA, 14 nt, Mycobacterium tuberculosis H37Rv
gucgagcgccgcgg

SEQ ID NO: 1326959 - RNA, 14 nt, Mycobacterium tuberculosis H37Rv
gucgagcagcacca

SEQ ID NO: 1326960 - RNA, 18 nt, Mycobacterium tuberculosis H37Rv
gucgacgaucucgccggc

SEQ ID NO: 1326961 - RNA, 16 nt, Mycobacterium tuberculosis H37Rv
gucgacgccggccagc

SEQ ID NO: 1326962 - RNA, 13 nt, Mycobacterium tuberculosis H37Rv
gucgacggcggcc

SEQ ID NO: 1326963 - RNA, 17 nt, Mycobacterium tuberculosis H37Rv
gucgacgggcacgcggc

SEQ ID NO: 1326964 - RNA, 21 nt, Mycobacterium tuberculosis H37Rv
gucgacggucuggcccgcgac

SEQ ID NO: 1326965 - RNA, 21 nt, Mycobacterium tuberculosis H37Rv
gucgacgguuugcaccgcggc

SEQ ID NO: 1326966 - RNA, 19 nt, Mycobacterium tuberculosis H37Rv
gucgacgggcacgcggcga

SEQ ID NO: 1326967 - RNA, 17 nt, Mycobacterium tuberculosis H37Rv
gucgagcacggugagcc

SEQ ID NO: 1326968 - RNA, 16 nt, Mycobacterium tuberculosis H37Rv
gucgaucauggcggca

SEQ ID NO: 1326969 - RNA, 23 nt, Mycobacterium tuberculosis H37Rv
gucgaucuccgucggugagcugc

SEQ ID NO: 1326970 - RNA, 12 nt, Mycobacterium tuberculosis H37Rv
gucgaucaacaa

SEQ ID NO: 1326971 - RNA, 22 nt, Mycobacterium tuberculosis H37Rv
gucgaucaacaacagccgcagc

SEQ ID NO: 1326972 - RNA, 14 nt, Mycobacterium tuberculosis H37Rv
gucgaucaccugca

SEQ ID NO: 1326973 - RNA, 21 nt, Mycobacterium tuberculosis H37Rv
gucgaucacgucgucagccac

SEQ ID NO: 1326974 - RNA, 17 nt, Mycobacterium tuberculosis H37Rv
gucgaguuuugcggcca

SEQ ID NO: 1326975 - RNA, 16 nt, Mycobacterium tuberculosis H37Rv
gucgagcugaccacgg

SEQ ID NO: 1326976 - RNA, 14 nt, Mycobacterium tuberculosis H37Rv
gucgacgagcgccu

SEQ ID NO: 1326977 - RNA, 14 nt, Mycobacterium tuberculosis H37Rv
gucgacgacgucgc

SEQ ID NO: 1326978 - RNA, 16 nt, Mycobacterium tuberculosis H37Rv
gucgacgacgucgcgc

SEQ ID NO: 1326979 - RNA, 22 nt, Mycobacterium tuberculosis H37Rv
gucgacgacauacgagcaguga

SEQ ID NO: 1326980 - RNA, 21 nt, Mycobacterium tuberculosis H37Rv
gucgaccucggcaaccaccuc

SEQ ID NO: 1326981 - RNA, 17 nt, Mycobacterium tuberculosis H37Rv
gucgacgaacucgccca

SEQ ID NO: 1326982 - RNA, 23 nt, Mycobacterium tuberculosis H37Rv
gucgacccccugccacagcgaca

SEQ ID NO: 1326983 - RNA, 15 nt, Mycobacterium tuberculosis H37Rv
gucgacccagcgcgc

SEQ ID NO: 1326984 - RNA, 16 nt, Mycobacterium tuberculosis H37Rv
gucgacccagcgcgcg

SEQ ID NO: 1326985 - RNA, 22 nt, Mycobacterium tuberculosis H37Rv
gucgaccaugagccggcgccgc

SEQ ID NO: 1326986 - RNA, 22 nt, Mycobacterium tuberculosis H37Rv
gucgacagucaacagggccagg

SEQ ID NO: 1326987 - RNA, 18 nt, Mycobacterium tuberculosis H37Rv
gucgacagcgucucgccg

SEQ ID NO: 1326988 - RNA, 15 nt, Mycobacterium tuberculosis H37Rv
gucgacagcgaaggc

SEQ ID NO: 1326989 - RNA, 18 nt, Mycobacterium tuberculosis H37Rv
guccuuuuccgccgggcu

SEQ ID NO: 1326990 - RNA, 16 nt, Mycobacterium tuberculosis H37Rv
guccuuguuguggugg

SEQ ID NO: 1326991 - RNA, 14 nt, Mycobacterium tuberculosis H37Rv
guccuugcgcagca

SEQ ID NO: 1326992 - RNA, 16 nt, Mycobacterium tuberculosis H37Rv
guccugcucgcacagc

SEQ ID NO: 1326993 - RNA, 17 nt, Mycobacterium tuberculosis H37Rv
guccugcgggaggcagc

SEQ ID NO: 1326994 - RNA, 14 nt, Mycobacterium tuberculosis H37Rv
gucgccgggcggcg

SEQ ID NO: 1326995 - RNA, 19 nt, Mycobacterium tuberculosis H37Rv
gucgccgucggugccgccg

SEQ ID NO: 1326996 - RNA, 18 nt, Mycobacterium tuberculosis H37Rv
gucgccgucgugccaccg

SEQ ID NO: 1326997 - RNA, 18 nt, Mycobacterium tuberculosis H37Rv
gucgccggauagcgcagc

SEQ ID NO: 1326998 - RNA, 20 nt, Mycobacterium tuberculosis H37Rv
gucgccuucuuggcaggugc

SEQ ID NO: 1326999 - RNA, 16 nt, Mycobacterium tuberculosis H37Rv
gucgcgauagccgccg

SEQ ID NO: 1327000 - RNA, 15 nt, Mycobacterium tuberculosis H37Rv
gucgcgaugcuuccc

SEQ ID NO: 1327001 - RNA, 20 nt, Mycobacterium tuberculosis H37Rv
gucgcggaguagccgcagcu

SEQ ID NO: 1327002 - RNA, 19 nt, Mycobacterium tuberculosis H37Rv
gucgcggaucagcccgcgc

SEQ ID NO: 1327003 - RNA, 19 nt, Mycobacterium tuberculosis H37Rv
gucgcgagcccgccacagc

SEQ ID NO: 1327004 - RNA, 15 nt, Mycobacterium tuberculosis H37Rv
gucgcggccagcagg

SEQ ID NO: 1327005 - RNA, 16 nt, Mycobacterium tuberculosis H37Rv
gucgcggccggcggcc

SEQ ID NO: 1327006 - RNA, 21 nt, Mycobacterium tuberculosis H37Rv
gucgcggcuauggcgccgcgg

SEQ ID NO: 1327007 - RNA, 12 nt, Mycobacterium tuberculosis H37Rv
gucgcggccucg

SEQ ID NO: 1327008 - RNA, 13 nt, Mycobacterium tuberculosis H37Rv
gucgcugaugagc

SEQ ID NO: 1327009 - RNA, 19 nt, Mycobacterium tuberculosis H37Rv
gucgcugacgcccuccugg

SEQ ID NO: 1327010 - RNA, 15 nt, Mycobacterium tuberculosis H37Rv
gucgcgggccaccgc

SEQ ID NO: 1327011 - RNA, 12 nt, Mycobacterium tuberculosis H37Rv
gucgcaccagcg

SEQ ID NO: 1327012 - RNA, 16 nt, Mycobacterium tuberculosis H37Rv
gucgauuucggcggcg

SEQ ID NO: 1327013 - RNA, 18 nt, Mycobacterium tuberculosis H37Rv
gucgauuggcugcgccga

SEQ ID NO: 1327014 - RNA, 17 nt, Mycobacterium tuberculosis H37Rv
gucgauuggcucgccga

SEQ ID NO: 1327015 - RNA, 14 nt, Mycobacterium tuberculosis H37Rv
gucgaucgccgcga

SEQ ID NO: 1327016 - RNA, 21 nt, Mycobacterium tuberculosis H37Rv
gucgcaauauccggccgagcc

SEQ ID NO: 1327017 - RNA, 22 nt, Mycobacterium tuberculosis H37Rv
gucgccgccuuccuggcgggcg

SEQ ID NO: 1327018 - RNA, 14 nt, Mycobacterium tuberculosis H37Rv
gucgccgccuucuu

SEQ ID NO: 1327019 - RNA, 16 nt, Mycobacterium tuberculosis H37Rv
gucgccgcgggcagcg

SEQ ID NO: 1327020 - RNA, 21 nt, Mycobacterium tuberculosis H37Rv
gucgccggacgacaacaggcc

SEQ ID NO: 1327021 - RNA, 15 nt, Mycobacterium tuberculosis H37Rv
gucgccgcuuucuug

SEQ ID NO: 1327022 - RNA, 22 nt, Mycobacterium tuberculosis H37Rv
gucgccgcuuucuuggcgggcg

SEQ ID NO: 1327023 - RNA, 18 nt, Mycobacterium tuberculosis H37Rv
gucgccgacccgggggcg

SEQ ID NO: 1327024 - RNA, 18 nt, Mycobacterium tuberculosis H37Rv
gucgccgaacaccgagug

SEQ ID NO: 1327025 - RNA, 19 nt, Mycobacterium tuberculosis H37Rv
gucgccgaacagcagcccg

SEQ ID NO: 1327026 - RNA, 19 nt, Mycobacterium tuberculosis H37Rv
gucgccgaccacucgagcg

SEQ ID NO: 1327027 - RNA, 12 nt, Mycobacterium tuberculosis H37Rv
gucgccgcccgu

SEQ ID NO: 1327028 - RNA, 18 nt, Mycobacterium tuberculosis H37Rv
gucgccgcaucggcggug

SEQ ID NO: 1327029 - RNA, 14 nt, Mycobacterium tuberculosis H37Rv
gucgccgccaaagc

SEQ ID NO: 1327030 - RNA, 18 nt, Mycobacterium tuberculosis H37Rv
gucgccgccaccagcgca

SEQ ID NO: 1327031 - RNA, 22 nt, Mycobacterium tuberculosis H37Rv
gucggccagcagcagugccacc

SEQ ID NO: 1327032 - RNA, 22 nt, Mycobacterium tuberculosis H37Rv
gucggccagcagaucagguccu

SEQ ID NO: 1327033 - RNA, 15 nt, Mycobacterium tuberculosis H37Rv
gucggcggggcgccg

SEQ ID NO: 1327034 - RNA, 20 nt, Mycobacterium tuberculosis H37Rv
gucggcgucgagcucguccu

SEQ ID NO: 1327035 - RNA, 13 nt, Mycobacterium tuberculosis H37Rv
gucggcuccaggu

SEQ ID NO: 1327036 - RNA, 14 nt, Mycobacterium tuberculosis H37Rv
gucggcgugcaggg

SEQ ID NO: 1327037 - RNA, 13 nt, Mycobacterium tuberculosis H37Rv
gucggcgugcagg

SEQ ID NO: 1327038 - RNA, 15 nt, Mycobacterium tuberculosis H37Rv
gucggcugguccucc

SEQ ID NO: 1327039 - RNA, 18 nt, Mycobacterium tuberculosis H37Rv
gucggcuggucgcugcug

SEQ ID NO: 1327040 - RNA, 22 nt, Mycobacterium tuberculosis H37Rv
gucggcugucgugccucucggg

SEQ ID NO: 1327041 - RNA, 19 nt, Mycobacterium tuberculosis H37Rv
gucggcuuccggugccggg

SEQ ID NO: 1327042 - RNA, 14 nt, Mycobacterium tuberculosis H37Rv
gucggcugccgcaa

SEQ ID NO: 1327043 - RNA, 14 nt, Mycobacterium tuberculosis H37Rv
gucggcuuccuccu

SEQ ID NO: 1327044 - RNA, 15 nt, Mycobacterium tuberculosis H37Rv
gucggcaccagcagc

SEQ ID NO: 1327045 - RNA, 22 nt, Mycobacterium tuberculosis H37Rv
gucggcaaugacguacgggguc

SEQ ID NO: 1327046 - RNA, 15 nt, Mycobacterium tuberculosis H37Rv
gucgcugcggcgcug

SEQ ID NO: 1327047 - RNA, 14 nt, Mycobacterium tuberculosis H37Rv
gucgcugccgccgc

SEQ ID NO: 1327048 - RNA, 14 nt, Mycobacterium tuberculosis H37Rv
gucgucgugcaggc

SEQ ID NO: 1327049 - RNA, 14 nt, Mycobacterium tuberculosis H37Rv
gucgugaucagcag

SEQ ID NO: 1327050 - RNA, 15 nt, Mycobacterium tuberculosis H37Rv
gucgugaucagcagg

SEQ ID NO: 1327051 - RNA, 16 nt, Mycobacterium tuberculosis H37Rv
gucgugaucagcagga

SEQ ID NO: 1327052 - RNA, 21 nt, Mycobacterium tuberculosis H37Rv
gucgucguuucgccagccggc

SEQ ID NO: 1327053 - RNA, 12 nt, Mycobacterium tuberculosis H37Rv
gucgucguccuc

SEQ ID NO: 1327054 - RNA, 23 nt, Mycobacterium tuberculosis H37Rv
gucgucguugggauccgguggug

SEQ ID NO: 1327055 - RNA, 15 nt, Mycobacterium tuberculosis H37Rv
gucgguggcggggaa

SEQ ID NO: 1327056 - RNA, 17 nt, Mycobacterium tuberculosis H37Rv
gucggugcgcgcagacu

SEQ ID NO: 1327057 - RNA, 20 nt, Mycobacterium tuberculosis H37Rv
gucgguguucggugguccug

SEQ ID NO: 1327058 - RNA, 20 nt, Mycobacterium tuberculosis H37Rv
gucgguuuccuccggcagca

SEQ ID NO: 1327059 - RNA, 14 nt, Mycobacterium tuberculosis H37Rv
gucgggacgccgcc

SEQ ID NO: 1327060 - RNA, 17 nt, Mycobacterium tuberculosis H37Rv
gucgggacgccgccccc

SEQ ID NO: 1327061 - RNA, 14 nt, Mycobacterium tuberculosis H37Rv
gucgggcaccgcgc

SEQ ID NO: 1327062 - RNA, 17 nt, Mycobacterium tuberculosis H37Rv
gucgggcaugcucuggc

SEQ ID NO: 1327063 - RNA, 22 nt, Mycobacterium tuberculosis H37Rv
gucgggguacagacacgcgcgc

SEQ ID NO: 1327064 - RNA, 12 nt, Mycobacterium tuberculosis H37Rv
gucggugaccug

SEQ ID NO: 1327065 - RNA, 23 nt, Mycobacterium tuberculosis H37Rv
gucggugagccgugccgccagca

SEQ ID NO: 1327066 - RNA, 20 nt, Mycobacterium tuberculosis H37Rv
gucggggagcugcggcggcc

SEQ ID NO: 1327067 - RNA, 20 nt, Mycobacterium tuberculosis H37Rv
gucggggccgcaggccaggg

SEQ ID NO: 1327068 - RNA, 19 nt, Mycobacterium tuberculosis H37Rv
gucugcucggcgcgguggg

SEQ ID NO: 1327069 - RNA, 19 nt, Mycobacterium tuberculosis H37Rv
gucugcucgccgggcagcu

SEQ ID NO: 1327070 - RNA, 17 nt, Mycobacterium tuberculosis H37Rv
gucugcucgcgcagccg

SEQ ID NO: 1327071 - RNA, 13 nt, Mycobacterium tuberculosis H37Rv
gucugcucaccag

SEQ ID NO: 1327072 - RNA, 15 nt, Mycobacterium tuberculosis H37Rv
gucugcucgccaggc

SEQ ID NO: 1327073 - RNA, 16 nt, Mycobacterium tuberculosis H37Rv
gucugcucgccaggca

SEQ ID NO: 1327074 - RNA, 23 nt, Mycobacterium tuberculosis H37Rv
gucugcgccuucgccagcggcgc

SEQ ID NO: 1327075 - RNA, 17 nt, Mycobacterium tuberculosis H37Rv
gucugcggaccggcgcg

SEQ ID NO: 1327076 - RNA, 16 nt, Mycobacterium tuberculosis H37Rv
gucugcggggugagug

SEQ ID NO: 1327077 - RNA, 15 nt, Mycobacterium tuberculosis H37Rv
gucuggcgaugacga

SEQ ID NO: 1327078 - RNA, 15 nt, Mycobacterium tuberculosis H37Rv
gucuggcaggccagc

SEQ ID NO: 1327079 - RNA, 14 nt, Mycobacterium tuberculosis H37Rv
gucuggcaggccag

SEQ ID NO: 1327080 - RNA, 17 nt, Mycobacterium tuberculosis H37Rv
gucuggggacgaaacua

SEQ ID NO: 1327081 - RNA, 17 nt, Mycobacterium tuberculosis H37Rv
gucugggugcagguucu

SEQ ID NO: 1327082 - RNA, 23 nt, Mycobacterium tuberculosis H37Rv
gucuggucggcuacggccagugc

SEQ ID NO: 1327083 - RNA, 18 nt, Mycobacterium tuberculosis H37Rv
gucugggugagcaccugg

SEQ ID NO: 1327084 - RNA, 19 nt, Mycobacterium tuberculosis H37Rv
gucugaccgguucccgggc

SEQ ID NO: 1327085 - RNA, 15 nt, Mycobacterium tuberculosis H37Rv
gucugacccaccgcc

SEQ ID NO: 1327086 - RNA, 15 nt, Mycobacterium tuberculosis H37Rv
gucugagcgccggca

SEQ ID NO: 1327087 - RNA, 17 nt, Mycobacterium tuberculosis H37Rv
gucugaaccgccccggu

SEQ ID NO: 1327088 - RNA, 19 nt, Mycobacterium tuberculosis H37Rv
gucugcccgauacccggug

SEQ ID NO: 1327089 - RNA, 14 nt, Mycobacterium tuberculosis H37Rv
gucugcccgcccag

SEQ ID NO: 1327090 - RNA, 14 nt, Mycobacterium tuberculosis H37Rv
gucugccagcaccc

SEQ ID NO: 1327091 - RNA, 14 nt, Mycobacterium tuberculosis H37Rv
gucugcccgcgcuc

SEQ ID NO: 1327092 - RNA, 15 nt, Mycobacterium tuberculosis H37Rv
gucugcagugcagcg

SEQ ID NO: 1327093 - RNA, 20 nt, Mycobacterium tuberculosis H37Rv
gucucccuugccgccauucc

SEQ ID NO: 1327094 - RNA, 19 nt, Mycobacterium tuberculosis H37Rv
gucuccgcugaugagccgc

SEQ ID NO: 1327095 - RNA, 15 nt, Mycobacterium tuberculosis H37Rv
gucucgccgaccuug

SEQ ID NO: 1327096 - RNA, 12 nt, Mycobacterium tuberculosis H37Rv
gucucggcaugc

SEQ ID NO: 1327097 - RNA, 21 nt, Mycobacterium tuberculosis H37Rv
gucucggaaacggaccuccuc

SEQ ID NO: 1327098 - RNA, 14 nt, Mycobacterium tuberculosis H37Rv
gucucgcggugcgg

SEQ ID NO: 1327099 - RNA, 15 nt, Mycobacterium tuberculosis H37Rv
gucucgucaaccugc

SEQ ID NO: 1327100 - RNA, 15 nt, Mycobacterium tuberculosis H37Rv
gucucggucagcccc

SEQ ID NO: 1327101 - RNA, 13 nt, Mycobacterium tuberculosis H37Rv
gucucugacgaau

SEQ ID NO: 1327102 - RNA, 19 nt, Mycobacterium tuberculosis H37Rv
gucucccagaggucgagcg

SEQ ID NO: 1327103 - RNA, 21 nt, Mycobacterium tuberculosis H37Rv
gucucccagaggucgagcgcc

SEQ ID NO: 1327104 - RNA, 22 nt, Mycobacterium tuberculosis H37Rv
gucuccagcaccaaaaggauca

SEQ ID NO: 1327105 - RNA, 20 nt, Mycobacterium tuberculosis H37Rv
gucguuggaaaucccuggcc

SEQ ID NO: 1327106 - RNA, 15 nt, Mycobacterium tuberculosis H37Rv
gucguugccguccac

SEQ ID NO: 1327107 - RNA, 17 nt, Mycobacterium tuberculosis H37Rv
gucgugagccagcuugc

SEQ ID NO: 1327108 - RNA, 16 nt, Mycobacterium tuberculosis H37Rv
gucgugcacggcggcc

SEQ ID NO: 1327109 - RNA, 20 nt, Mycobacterium tuberculosis H37Rv
gucgugucgccacaccgggg

SEQ ID NO: 1327110 - RNA, 21 nt, Mycobacterium tuberculosis H37Rv
gucguggugcaacacgccggc

SEQ ID NO: 1327111 - RNA, 16 nt, Mycobacterium tuberculosis H37Rv
gucgugguggccacgg

SEQ ID NO: 1327112 - RNA, 17 nt, Mycobacterium tuberculosis H37Rv
gucguggggacuggcag

SEQ ID NO: 1327113 - RNA, 17 nt, Mycobacterium tuberculosis H37Rv
gucguucccgccggcac

SEQ ID NO: 1327114 - RNA, 22 nt, Mycobacterium tuberculosis H37Rv
gucguugccgggucaaccggug

SEQ ID NO: 1327115 - RNA, 16 nt, Mycobacterium tuberculosis H37Rv
gucuugccggccagga

SEQ ID NO: 1327116 - RNA, 22 nt, Mycobacterium tuberculosis H37Rv
gucuuggcggcggugcagcagg

SEQ ID NO: 1327117 - RNA, 18 nt, Mycobacterium tuberculosis H37Rv
gucuuggcggcggugcag

SEQ ID NO: 1327118 - RNA, 21 nt, Mycobacterium tuberculosis H37Rv
gucuuggcccgguccgccauu

SEQ ID NO: 1327119 - RNA, 17 nt, Mycobacterium tuberculosis H37Rv
gucuuggcggcggugca

SEQ ID NO: 1327120 - RNA, 14 nt, Mycobacterium tuberculosis H37Rv
gucuuggcccggcg

SEQ ID NO: 1327121 - RNA, 19 nt, Mycobacterium tuberculosis H37Rv
gucuugacggcgccaggca

SEQ ID NO: 1327122 - RNA, 13 nt, Mycobacterium tuberculosis H37Rv
gucuugauguaau

SEQ ID NO: 1327123 - RNA, 19 nt, Mycobacterium tuberculosis H37Rv
gucuucgucauggccggcc

SEQ ID NO: 1327124 - RNA, 14 nt, Mycobacterium tuberculosis H37Rv
gucuuccggugcgc

SEQ ID NO: 1327125 - RNA, 18 nt, Mycobacterium tuberculosis H37Rv
gucuucaggccgcgcaug

SEQ ID NO: 1327126 - RNA, 20 nt, Mycobacterium tuberculosis H37Rv
gucuucaggccgcgcauggu

SEQ ID NO: 1327127 - RNA, 19 nt, Mycobacterium tuberculosis H37Rv
gucugguugggccagcucc

SEQ ID NO: 1327128 - RNA, 22 nt, Mycobacterium tuberculosis H37Rv
gugaacagcagguuggcgagcu

SEQ ID NO: 1327129 - RNA, 12 nt, Mycobacterium tuberculosis H37Rv
gugaaaguucau

SEQ ID NO: 1327130 - RNA, 14 nt, Mycobacterium tuberculosis H37Rv
gugaaaaucgccau

SEQ ID NO: 1327131 - RNA, 20 nt, Mycobacterium tuberculosis H37Rv
gucuuucccggggcuggggg

SEQ ID NO: 1327132 - RNA, 22 nt, Mycobacterium tuberculosis H37Rv
gucuuuaggcguggcccagucc

SEQ ID NO: 1327133 - RNA, 12 nt, Mycobacterium tuberculosis H37Rv
gucuuguggugg

SEQ ID NO: 1327134 - RNA, 23 nt, Mycobacterium tuberculosis H37Rv
gucuuugguacccagcgcggcca

SEQ ID NO: 1327135 - RNA, 15 nt, Mycobacterium tuberculosis H37Rv
gugagccgggcggcc

SEQ ID NO: 1327136 - RNA, 13 nt, Mycobacterium tuberculosis H37Rv
gugagccuuucgu

SEQ ID NO: 1327137 - RNA, 20 nt, Mycobacterium tuberculosis H37Rv
gugagccgguggcccgccgg

SEQ ID NO: 1327138 - RNA, 16 nt, Mycobacterium tuberculosis H37Rv
gugagccaugccgcuc

SEQ ID NO: 1327139 - RNA, 19 nt, Mycobacterium tuberculosis H37Rv
gugagcgcagcuugauccc

SEQ ID NO: 1327140 - RNA, 13 nt, Mycobacterium tuberculosis H37Rv
gugagcgccgcgg

SEQ ID NO: 1327141 - RNA, 11 nt, Mycobacterium tuberculosis H37Rv
gugagcgggca

SEQ ID NO: 1327142 - RNA, 15 nt, Mycobacterium tuberculosis H37Rv
gugagcauggcuagg

SEQ ID NO: 1327143 - RNA, 17 nt, Mycobacterium tuberculosis H37Rv
gugagcaccagcagcac

SEQ ID NO: 1327144 - RNA, 16 nt, Mycobacterium tuberculosis H37Rv
gugagcaccugggcgc

SEQ ID NO: 1327145 - RNA, 18 nt, Mycobacterium tuberculosis H37Rv
gugagcaauggcgcgacc

SEQ ID NO: 1327146 - RNA, 19 nt, Mycobacterium tuberculosis H37Rv
gugacguuggcaggcaggu

SEQ ID NO: 1327147 - RNA, 15 nt, Mycobacterium tuberculosis H37Rv
gugacguugugccuu

SEQ ID NO: 1327148 - RNA, 17 nt, Mycobacterium tuberculosis H37Rv
gugacuccggcuggaag

SEQ ID NO: 1327149 - RNA, 19 nt, Mycobacterium tuberculosis H37Rv
gugacuccgcgcgcggaca

SEQ ID NO: 1327150 - RNA, 23 nt, Mycobacterium tuberculosis H37Rv
gugacuccgcgcgcggacagcau

SEQ ID NO: 1327151 - RNA, 19 nt, Mycobacterium tuberculosis H37Rv
gugacugcgcgcguugcgg

SEQ ID NO: 1327152 - RNA, 14 nt, Mycobacterium tuberculosis H37Rv
gugagaccagguuc

SEQ ID NO: 1327153 - RNA, 20 nt, Mycobacterium tuberculosis H37Rv
gugagaccuagcagggugcc

SEQ ID NO: 1327154 - RNA, 24 nt, Mycobacterium tuberculosis H37Rv
gugagaucaugaggugagcugcgg

SEQ ID NO: 1327155 - RNA, 18 nt, Mycobacterium tuberculosis H37Rv
gugacuuauccggccagu

SEQ ID NO: 1327156 - RNA, 12 nt, Mycobacterium tuberculosis H37Rv
gugaggcccccc

SEQ ID NO: 1327157 - RNA, 16 nt, Mycobacterium tuberculosis H37Rv
gugaggccccccgcgc

SEQ ID NO: 1327158 - RNA, 14 nt, Mycobacterium tuberculosis H37Rv
gugaggcgaccgga

SEQ ID NO: 1327159 - RNA, 15 nt, Mycobacterium tuberculosis H37Rv
gugagcucggcugcu

SEQ ID NO: 1327160 - RNA, 18 nt, Mycobacterium tuberculosis H37Rv
gugagcuaugcuggcagc

SEQ ID NO: 1327161 - RNA, 15 nt, Mycobacterium tuberculosis H37Rv
gugagcgccgcggcg

SEQ ID NO: 1327162 - RNA, 16 nt, Mycobacterium tuberculosis H37Rv
gugagcucggcugcuc

SEQ ID NO: 1327163 - RNA, 21 nt, Mycobacterium tuberculosis H37Rv
gugagcuuagcgcaugggccu

SEQ ID NO: 1327164 - RNA, 18 nt, Mycobacterium tuberculosis H37Rv
gugaggaaccccggucgg

SEQ ID NO: 1327165 - RNA, 14 nt, Mycobacterium tuberculosis H37Rv
gugagucccacgcc

SEQ ID NO: 1327166 - RNA, 15 nt, Mycobacterium tuberculosis H37Rv
gugagucacccggcc

SEQ ID NO: 1327167 - RNA, 14 nt, Mycobacterium tuberculosis H37Rv
gugagguggucagc

SEQ ID NO: 1327168 - RNA, 17 nt, Mycobacterium tuberculosis H37Rv
gugcagacaggcggcgg

SEQ ID NO: 1327169 - RNA, 21 nt, Mycobacterium tuberculosis H37Rv
gugcagacaggcggcggccug

SEQ ID NO: 1327170 - RNA, 22 nt, Mycobacterium tuberculosis H37Rv
gugcagacaggcggcggccugg

SEQ ID NO: 1327171 - RNA, 19 nt, Mycobacterium tuberculosis H37Rv
gugcacggcuucggcgagc

SEQ ID NO: 1327172 - RNA, 22 nt, Mycobacterium tuberculosis H37Rv
gugcacuacaggguuggcagca

SEQ ID NO: 1327173 - RNA, 20 nt, Mycobacterium tuberculosis H37Rv
gugcaaugcuuccagcauca

SEQ ID NO: 1327174 - RNA, 14 nt, Mycobacterium tuberculosis H37Rv
gugcacaacgccca

SEQ ID NO: 1327175 - RNA, 23 nt, Mycobacterium tuberculosis H37Rv
gugcaggcggccgccaguucggc

SEQ ID NO: 1327176 - RNA, 19 nt, Mycobacterium tuberculosis H37Rv
gugcaggccgcggagaagg

SEQ ID NO: 1327177 - RNA, 14 nt, Mycobacterium tuberculosis H37Rv
gugcaggaccagaa

SEQ ID NO: 1327178 - RNA, 15 nt, Mycobacterium tuberculosis H37Rv
gugcaggaccagcac

SEQ ID NO: 1327179 - RNA, 19 nt, Mycobacterium tuberculosis H37Rv
gugcagcucgauacccagg

SEQ ID NO: 1327180 - RNA, 17 nt, Mycobacterium tuberculosis H37Rv
gugcagcgugcagcggc

SEQ ID NO: 1327181 - RNA, 22 nt, Mycobacterium tuberculosis H37Rv
gugcagaagacaagugguggua

SEQ ID NO: 1327182 - RNA, 18 nt, Mycobacterium tuberculosis H37Rv
gugaucgcggucgacagc

SEQ ID NO: 1327183 - RNA, 18 nt, Mycobacterium tuberculosis H37Rv
gugaucgcauuggcggcg

SEQ ID NO: 1327184 - RNA, 16 nt, Mycobacterium tuberculosis H37Rv
gugaucgaggcggcgg

SEQ ID NO: 1327185 - RNA, 17 nt, Mycobacterium tuberculosis H37Rv
gugaucccgauggucac

SEQ ID NO: 1327186 - RNA, 14 nt, Mycobacterium tuberculosis H37Rv
gugaucccgcccaa

SEQ ID NO: 1327187 - RNA, 17 nt, Mycobacterium tuberculosis H37Rv
gugauccgagaccaugc

SEQ ID NO: 1327188 - RNA, 23 nt, Mycobacterium tuberculosis H37Rv
gugaucggguacccaucugcuca

SEQ ID NO: 1327189 - RNA, 17 nt, Mycobacterium tuberculosis H37Rv
gugaucggcgucaggca

SEQ ID NO: 1327190 - RNA, 15 nt, Mycobacterium tuberculosis H37Rv
gugauucgcgcagcg

SEQ ID NO: 1327191 - RNA, 16 nt, Mycobacterium tuberculosis H37Rv
gugauugagcucaggu

SEQ ID NO: 1327192 - RNA, 15 nt, Mycobacterium tuberculosis H37Rv
gugacgagcacaugc

SEQ ID NO: 1327193 - RNA, 15 nt, Mycobacterium tuberculosis H37Rv
gugaccugggcgccc

SEQ ID NO: 1327194 - RNA, 18 nt, Mycobacterium tuberculosis H37Rv
gugacgcccgcuccgcgg

SEQ ID NO: 1327195 - RNA, 14 nt, Mycobacterium tuberculosis H37Rv
gugacggcggcugu

SEQ ID NO: 1327196 - RNA, 19 nt, Mycobacterium tuberculosis H37Rv
gugacggugaauucacgau

SEQ ID NO: 1327197 - RNA, 21 nt, Mycobacterium tuberculosis H37Rv
gugacguagggcagcgccagg

SEQ ID NO: 1327198 - RNA, 15 nt, Mycobacterium tuberculosis H37Rv
gugacgguguuggug

SEQ ID NO: 1327199 - RNA, 17 nt, Mycobacterium tuberculosis H37Rv
gugacguggugggcuug

SEQ ID NO: 1327200 - RNA, 13 nt, Mycobacterium tuberculosis H37Rv
gugacgugguggg

SEQ ID NO: 1327201 - RNA, 14 nt, Mycobacterium tuberculosis H37Rv
gugacgucgccggg

SEQ ID NO: 1327202 - RNA, 16 nt, Mycobacterium tuberculosis H37Rv
gugacgucgccgggcg

SEQ ID NO: 1327203 - RNA, 16 nt, Mycobacterium tuberculosis H37Rv
gugaccuaccuccucg

SEQ ID NO: 1327204 - RNA, 17 nt, Mycobacterium tuberculosis H37Rv
gugaccgcagucccagc

SEQ ID NO: 1327205 - RNA, 16 nt, Mycobacterium tuberculosis H37Rv
gugaccgccgcgccgg

SEQ ID NO: 1327206 - RNA, 23 nt, Mycobacterium tuberculosis H37Rv
gugacccugggguugcaucaugc

SEQ ID NO: 1327207 - RNA, 17 nt, Mycobacterium tuberculosis H37Rv
gugaccgaacaacagcg

SEQ ID NO: 1327208 - RNA, 14 nt, Mycobacterium tuberculosis H37Rv
gugacccgcugggc

SEQ ID NO: 1327209 - RNA, 17 nt, Mycobacterium tuberculosis H37Rv
gugacccacucggggac

SEQ ID NO: 1327210 - RNA, 21 nt, Mycobacterium tuberculosis H37Rv
gugacccccagcagggugugc

SEQ ID NO: 1327211 - RNA, 13 nt, Mycobacterium tuberculosis H37Rv
gugacauucugca

SEQ ID NO: 1327212 - RNA, 22 nt, Mycobacterium tuberculosis H37Rv
gugaccaacaccccccccaccc

SEQ ID NO: 1327213 - RNA, 17 nt, Mycobacterium tuberculosis H37Rv
gugaccaggaucgacag

SEQ ID NO: 1327214 - RNA, 18 nt, Mycobacterium tuberculosis H37Rv
gugaccagcaggccgggc

SEQ ID NO: 1327215 - RNA, 22 nt, Mycobacterium tuberculosis H37Rv
gugacauaaaccucgccgguga

SEQ ID NO: 1327216 - RNA, 21 nt, Mycobacterium tuberculosis H37Rv
gugacaaaucggccaucauga

SEQ ID NO: 1327217 - RNA, 16 nt, Mycobacterium tuberculosis H37Rv
aaauaggccgggcagu

SEQ ID NO: 1327218 - RNA, 18 nt, Mycobacterium tuberculosis H37Rv
gugaacuucuccaccagc

SEQ ID NO: 1327219 - RNA, 14 nt, Mycobacterium tuberculosis H37Rv
gugaacuguccggg

SEQ ID NO: 1327220 - RNA, 15 nt, Mycobacterium tuberculosis H37Rv
gugaacggcagcacg

SEQ ID NO: 1327221 - RNA, 15 nt, Mycobacterium tuberculosis H37Rv
gugaacgccggugcg

SEQ ID NO: 1327222 - RNA, 23 nt, Mycobacterium tuberculosis H37Rv
gugaagaaguucggguagccggg

SEQ ID NO: 1327223 - RNA, 17 nt, Mycobacterium tuberculosis H37Rv
gugaaccgggcaccacu

SEQ ID NO: 1327224 - RNA, 13 nt, Mycobacterium tuberculosis H37Rv
aaauagcugcgga

SEQ ID NO: 1327225 - RNA, 20 nt, Mycobacterium tuberculosis H37Rv
gugaaguggcgcaccaccuc

SEQ ID NO: 1327226 - RNA, 19 nt, Mycobacterium tuberculosis H37Rv
gugaaguugccggucaggc

SEQ ID NO: 1327227 - RNA, 16 nt, Mycobacterium tuberculosis H37Rv
gugaagccgagcgccc

SEQ ID NO: 1327228 - RNA, 16 nt, Mycobacterium tuberculosis H37Rv
gugaagggauccggaa

SEQ ID NO: 1327229 - RNA, 18 nt, Mycobacterium tuberculosis H37Rv
gugaaggcaaacaccagc

SEQ ID NO: 1327230 - RNA, 16 nt, Mycobacterium tuberculosis H37Rv
gugacaaauggggugu

SEQ ID NO: 1327231 - RNA, 23 nt, Mycobacterium tuberculosis H37Rv
gugacaaccguuguaccccagca

SEQ ID NO: 1327232 - RNA, 19 nt, Mycobacterium tuberculosis H37Rv
gugacaaggugcgcugggu

SEQ ID NO: 1327233 - RNA, 16 nt, Mycobacterium tuberculosis H37Rv
gugaauccgugcaggg

SEQ ID NO: 1327234 - RNA, 14 nt, Mycobacterium tuberculosis H37Rv
gugaauggcagcac

SEQ ID NO: 1327235 - RNA, 18 nt, Mycobacterium tuberculosis H37Rv
gugaaucgcggaugccag

SEQ ID NO: 1327236 - RNA, 16 nt, Mycobacterium tuberculosis H37Rv
guggcaucgccuccag

SEQ ID NO: 1327237 - RNA, 15 nt, Mycobacterium tuberculosis H37Rv
guggcaucggcggcc

SEQ ID NO: 1327238 - RNA, 12 nt, Mycobacterium tuberculosis H37Rv
guggccaccagc

SEQ ID NO: 1327239 - RNA, 20 nt, Mycobacterium tuberculosis H37Rv
guggccaccaaacgcugcug

SEQ ID NO: 1327240 - RNA, 22 nt, Mycobacterium tuberculosis H37Rv
guggccagaucgaacgcagcca

SEQ ID NO: 1327241 - RNA, 23 nt, Mycobacterium tuberculosis H37Rv
guggccagaucgaacgcagccag

SEQ ID NO: 1327242 - RNA, 20 nt, Mycobacterium tuberculosis H37Rv
guggccaacaccgccagcau

SEQ ID NO: 1327243 - RNA, 16 nt, Mycobacterium tuberculosis H37Rv
guggccaaccaaccgg

SEQ ID NO: 1327244 - RNA, 18 nt, Mycobacterium tuberculosis H37Rv
guggccaauccggcggcg

SEQ ID NO: 1327245 - RNA, 22 nt, Mycobacterium tuberculosis H37Rv
guggcaguacaccggcgugcug

SEQ ID NO: 1327246 - RNA, 15 nt, Mycobacterium tuberculosis H37Rv
guggcagccugcugc

SEQ ID NO: 1327247 - RNA, 16 nt, Mycobacterium tuberculosis H37Rv
guggcagcgcggccgg

SEQ ID NO: 1327248 - RNA, 19 nt, Mycobacterium tuberculosis H37Rv
guggcagcgguggcccgcc

SEQ ID NO: 1327249 - RNA, 13 nt, Mycobacterium tuberculosis H37Rv
guggccuucuggu

SEQ ID NO: 1327250 - RNA, 20 nt, Mycobacterium tuberculosis H37Rv
guggccugaaacggcugcag

SEQ ID NO: 1327251 - RNA, 18 nt, Mycobacterium tuberculosis H37Rv
guggcccgccggcaguga

SEQ ID NO: 1327252 - RNA, 19 nt, Mycobacterium tuberculosis H37Rv
guggcccgaccgggaacca

SEQ ID NO: 1327253 - RNA, 16 nt, Mycobacterium tuberculosis H37Rv
guggccagcgcuugug

SEQ ID NO: 1327254 - RNA, 18 nt, Mycobacterium tuberculosis H37Rv
guggccagcgcggcgagg

SEQ ID NO: 1327255 - RNA, 14 nt, Mycobacterium tuberculosis H37Rv
guggccagcaggcg

SEQ ID NO: 1327256 - RNA, 14 nt, Mycobacterium tuberculosis H37Rv
guggcgccacggca

SEQ ID NO: 1327257 - RNA, 14 nt, Mycobacterium tuberculosis H37Rv
guggcggcggcgga

SEQ ID NO: 1327258 - RNA, 13 nt, Mycobacterium tuberculosis H37Rv
guggcguguggcu

SEQ ID NO: 1327259 - RNA, 16 nt, Mycobacterium tuberculosis H37Rv
gugggcuuggugccca

SEQ ID NO: 1327260 - RNA, 14 nt, Mycobacterium tuberculosis H37Rv
gugggccccgccga

SEQ ID NO: 1327261 - RNA, 14 nt, Mycobacterium tuberculosis H37Rv
gugggccacgauga

SEQ ID NO: 1327262 - RNA, 11 nt, Mycobacterium tuberculosis H37Rv
gugggcagcag

SEQ ID NO: 1327263 - RNA, 21 nt, Mycobacterium tuberculosis H37Rv
gugggagcuacccgggccagg

SEQ ID NO: 1327264 - RNA, 13 nt, Mycobacterium tuberculosis H37Rv
gugggacaggucg

SEQ ID NO: 1327265 - RNA, 15 nt, Mycobacterium tuberculosis H37Rv
gugggacaggucggc

SEQ ID NO: 1327266 - RNA, 16 nt, Mycobacterium tuberculosis H37Rv
guggaugaacaccuca

SEQ ID NO: 1327267 - RNA, 13 nt, Mycobacterium tuberculosis H37Rv
guggaucugaaga

SEQ ID NO: 1327268 - RNA, 16 nt, Mycobacterium tuberculosis H37Rv
guggcaaucccgccau

SEQ ID NO: 1327269 - RNA, 15 nt, Mycobacterium tuberculosis H37Rv
guggaugugugaguc

SEQ ID NO: 1327270 - RNA, 19 nt, Mycobacterium tuberculosis H37Rv
guggaugccgacggcgggc

SEQ ID NO: 1327271 - RNA, 19 nt, Mycobacterium tuberculosis H37Rv
guggauggccgccaggcgc

SEQ ID NO: 1327272 - RNA, 18 nt, Mycobacterium tuberculosis H37Rv
guggauucgaucaggccu

SEQ ID NO: 1327273 - RNA, 23 nt, Mycobacterium tuberculosis H37Rv
guggagacguuuugcggcccggg

SEQ ID NO: 1327274 - RNA, 22 nt, Mycobacterium tuberculosis H37Rv
guggagauuggguccagcgagg

SEQ ID NO: 1327275 - RNA, 16 nt, Mycobacterium tuberculosis H37Rv
guggagcacagcacgg

SEQ ID NO: 1327276 - RNA, 21 nt, Mycobacterium tuberculosis H37Rv
guggaguuuccgaagcccggg

SEQ ID NO: 1327277 - RNA, 20 nt, Mycobacterium tuberculosis H37Rv
guggaguuuccgaagcccgg

SEQ ID NO: 1327278 - RNA, 14 nt, Mycobacterium tuberculosis H37Rv
guggaagccgacca

SEQ ID NO: 1327279 - RNA, 22 nt, Mycobacterium tuberculosis H37Rv
guggaagccgacgaccagcaga

SEQ ID NO: 1327280 - RNA, 21 nt, Mycobacterium tuberculosis H37Rv
guggacuucagcaggcccagc

SEQ ID NO: 1327281 - RNA, 18 nt, Mycobacterium tuberculosis H37Rv
gugcuggucgccgcggca

SEQ ID NO: 1327282 - RNA, 20 nt, Mycobacterium tuberculosis H37Rv
gugcuggggguaccucccgc

SEQ ID NO: 1327283 - RNA, 21 nt, Mycobacterium tuberculosis H37Rv
gugcuguggucggugccagca

SEQ ID NO: 1327284 - RNA, 13 nt, Mycobacterium tuberculosis H37Rv
guggaaagugcgu

SEQ ID NO: 1327285 - RNA, 11 nt, Mycobacterium tuberculosis H37Rv
gugcuggcagg

SEQ ID NO: 1327286 - RNA, 12 nt, Mycobacterium tuberculosis H37Rv
guguccagcaug

SEQ ID NO: 1327287 - RNA, 18 nt, Mycobacterium tuberculosis H37Rv
guguagcgaugccguuga

SEQ ID NO: 1327288 - RNA, 21 nt, Mycobacterium tuberculosis H37Rv
gugucacccaauggagccgcg

SEQ ID NO: 1327289 - RNA, 20 nt, Mycobacterium tuberculosis H37Rv
guguagcuucgaugggcauc

SEQ ID NO: 1327290 - RNA, 19 nt, Mycobacterium tuberculosis H37Rv
guguccccgcccggccagc

SEQ ID NO: 1327291 - RNA, 17 nt, Mycobacterium tuberculosis H37Rv
gugucguaacugcccgc

SEQ ID NO: 1327292 - RNA, 12 nt, Mycobacterium tuberculosis H37Rv
gugucggugcgc

SEQ ID NO: 1327293 - RNA, 16 nt, Mycobacterium tuberculosis H37Rv
gugucgggugugcagg

SEQ ID NO: 1327294 - RNA, 18 nt, Mycobacterium tuberculosis H37Rv
gugucgucggaccucgcc

SEQ ID NO: 1327295 - RNA, 18 nt, Mycobacterium tuberculosis H37Rv
gugucguggucgugggug

SEQ ID NO: 1327296 - RNA, 19 nt, Mycobacterium tuberculosis H37Rv
gugucggcgcggcugccgc

SEQ ID NO: 1327297 - RNA, 22 nt, Mycobacterium tuberculosis H37Rv
gugucugcccgagguccgcccu

SEQ ID NO: 1327298 - RNA, 14 nt, Mycobacterium tuberculosis H37Rv
gugggguggggagc

SEQ ID NO: 1327299 - RNA, 15 nt, Mycobacterium tuberculosis H37Rv
gugggguugcgcggu

SEQ ID NO: 1327300 - RNA, 21 nt, Mycobacterium tuberculosis H37Rv
guggggaucacgaucacacca

SEQ ID NO: 1327301 - RNA, 22 nt, Mycobacterium tuberculosis H37Rv
guggggccguguucuaccugca

SEQ ID NO: 1327302 - RNA, 15 nt, Mycobacterium tuberculosis H37Rv
guggggcgcgccggc

SEQ ID NO: 1327303 - RNA, 20 nt, Mycobacterium tuberculosis H37Rv
gugggugaaccggaccuggg

SEQ ID NO: 1327304 - RNA, 17 nt, Mycobacterium tuberculosis H37Rv
gugggugaagagaaguc

SEQ ID NO: 1327305 - RNA, 18 nt, Mycobacterium tuberculosis H37Rv
gugguuccggcugguggg

SEQ ID NO: 1327306 - RNA, 19 nt, Mycobacterium tuberculosis H37Rv
gugguucggcggcgccccg

SEQ ID NO: 1327307 - RNA, 18 nt, Mycobacterium tuberculosis H37Rv
gugguuguaccagccgaa

SEQ ID NO: 1327308 - RNA, 15 nt, Mycobacterium tuberculosis H37Rv
guguaccagcccagc

SEQ ID NO: 1327309 - RNA, 13 nt, Mycobacterium tuberculosis H37Rv
guguacuggucug

SEQ ID NO: 1327310 - RNA, 14 nt, Mycobacterium tuberculosis H37Rv
guguacggcggcua

SEQ ID NO: 1327311 - RNA, 16 nt, Mycobacterium tuberculosis H37Rv
gugugggccccgccga

SEQ ID NO: 1327312 - RNA, 17 nt, Mycobacterium tuberculosis H37Rv
guguggucauuggggug

SEQ ID NO: 1327313 - RNA, 15 nt, Mycobacterium tuberculosis H37Rv
gugugggggucaggg

SEQ ID NO: 1327314 - RNA, 16 nt, Mycobacterium tuberculosis H37Rv
gugugggggucagggg

SEQ ID NO: 1327315 - RNA, 14 nt, Mycobacterium tuberculosis H37Rv
guguuaaagaagcc

SEQ ID NO: 1327316 - RNA, 22 nt, Mycobacterium tuberculosis H37Rv
gugugugcaagccgaacaccgu

SEQ ID NO: 1327317 - RNA, 20 nt, Mycobacterium tuberculosis H37Rv
guguguacacacgaugacgu

SEQ ID NO: 1327318 - RNA, 16 nt, Mycobacterium tuberculosis H37Rv
guguggucgguggcgg

SEQ ID NO: 1327319 - RNA, 15 nt, Mycobacterium tuberculosis H37Rv
guguucggcccgcac

SEQ ID NO: 1327320 - RNA, 17 nt, Mycobacterium tuberculosis H37Rv
guguuccggucgcccga

SEQ ID NO: 1327321 - RNA, 17 nt, Mycobacterium tuberculosis H37Rv
guguuauugaugcccga

SEQ ID NO: 1327322 - RNA, 22 nt, Mycobacterium tuberculosis H37Rv
guguggagcucgcggcgcaggu

SEQ ID NO: 1327323 - RNA, 15 nt, Mycobacterium tuberculosis H37Rv
gugugcgucuccagc

SEQ ID NO: 1327324 - RNA, 15 nt, Mycobacterium tuberculosis H37Rv
gugugcugccgcaca

SEQ ID NO: 1327325 - RNA, 14 nt, Mycobacterium tuberculosis H37Rv
gugugcucacgcau

SEQ ID NO: 1327326 - RNA, 15 nt, Mycobacterium tuberculosis H37Rv
gugugcacgcgggcg

SEQ ID NO: 1327327 - RNA, 13 nt, Mycobacterium tuberculosis H37Rv
gugugcccgggug

SEQ ID NO: 1327328 - RNA, 23 nt, Mycobacterium tuberculosis H37Rv
gugugcccgggugacccgugcgg

SEQ ID NO: 1327329 - RNA, 14 nt, Mycobacterium tuberculosis H37Rv
gugugacggcggcc

SEQ ID NO: 1327330 - RNA, 13 nt, Mycobacterium tuberculosis H37Rv
guguugcgguggg

SEQ ID NO: 1327331 - RNA, 21 nt, Mycobacterium tuberculosis H37Rv
guguugcgcugcggccagcgc

SEQ ID NO: 1327332 - RNA, 16 nt, Mycobacterium tuberculosis H37Rv
guguugccgaagcccg

SEQ ID NO: 1327333 - RNA, 22 nt, Mycobacterium tuberculosis H37Rv
guguugauguugccggaguuga

SEQ ID NO: 1327334 - RNA, 14 nt, Mycobacterium tuberculosis H37Rv
guguugagggugcc

SEQ ID NO: 1327335 - RNA, 20 nt, Mycobacterium tuberculosis H37Rv
guguugaggcguaccagcug

SEQ ID NO: 1327336 - RNA, 22 nt, Mycobacterium tuberculosis H37Rv
guguugagaucgcccgaguuga

SEQ ID NO: 1327337 - RNA, 14 nt, Mycobacterium tuberculosis H37Rv
guguugcucccggc

SEQ ID NO: 1327338 - RNA, 22 nt, Mycobacterium tuberculosis H37Rv
guuaggcgauaucgcacaugga

SEQ ID NO: 1327339 - RNA, 21 nt, Mycobacterium tuberculosis H37Rv
guuaccgccggcgccggugcc

SEQ ID NO: 1327340 - RNA, 22 nt, Mycobacterium tuberculosis H37Rv
guuacccaucgccacacccaaa

SEQ ID NO: 1327341 - RNA, 18 nt, Mycobacterium tuberculosis H37Rv
guuacucaccaaccgcau

SEQ ID NO: 1327342 - RNA, 22 nt, Mycobacterium tuberculosis H37Rv
guuaugacgugaguuucaccac

SEQ ID NO: 1327343 - RNA, 13 nt, Mycobacterium tuberculosis H37Rv
guuccgcaaugac

SEQ ID NO: 1327344 - RNA, 20 nt, Mycobacterium tuberculosis H37Rv
guuccgcaaugaccuggccg

SEQ ID NO: 1327345 - RNA, 19 nt, Mycobacterium tuberculosis H37Rv
guuccgaucgcguuagcca

SEQ ID NO: 1327346 - RNA, 18 nt, Mycobacterium tuberculosis H37Rv
guuccgcacgaucaggga

SEQ ID NO: 1327347 - RNA, 19 nt, Mycobacterium tuberculosis H37Rv
guuccgcacgaucagggaa

SEQ ID NO: 1327348 - RNA, 19 nt, Mycobacterium tuberculosis H37Rv
guuccaucacggaccaggc

SEQ ID NO: 1327349 - RNA, 11 nt, Mycobacterium tuberculosis H37Rv
guuccgccauu

SEQ ID NO: 1327350 - RNA, 21 nt, Mycobacterium tuberculosis H37Rv
guuccgccaggccgaccgcgc

SEQ ID NO: 1327351 - RNA, 14 nt, Mycobacterium tuberculosis H37Rv
guuccgcgcggcag

SEQ ID NO: 1327352 - RNA, 12 nt, Mycobacterium tuberculosis H37Rv
guucgggacgcg

SEQ ID NO: 1327353 - RNA, 15 nt, Mycobacterium tuberculosis H37Rv
guucggcgugucggg

SEQ ID NO: 1327354 - RNA, 21 nt, Mycobacterium tuberculosis H37Rv
guucggcugccgcgcgcugcc

SEQ ID NO: 1327355 - RNA, 11 nt, Mycobacterium tuberculosis H37Rv
guucggcuggc

SEQ ID NO: 1327356 - RNA, 19 nt, Mycobacterium tuberculosis H37Rv
guucggcgucguugccggg

SEQ ID NO: 1327357 - RNA, 16 nt, Mycobacterium tuberculosis H37Rv
guucggcggcugccag

SEQ ID NO: 1327358 - RNA, 20 nt, Mycobacterium tuberculosis H37Rv
guucggcgagcacaugcugc

SEQ ID NO: 1327359 - RNA, 14 nt, Mycobacterium tuberculosis H37Rv
guucgggguggugg

SEQ ID NO: 1327360 - RNA, 15 nt, Mycobacterium tuberculosis H37Rv
guucgggguggugga

SEQ ID NO: 1327361 - RNA, 23 nt, Mycobacterium tuberculosis H37Rv
guucgggugagcacccagcggcg

SEQ ID NO: 1327362 - RNA, 14 nt, Mycobacterium tuberculosis H37Rv
guucggucggggag

SEQ ID NO: 1327363 - RNA, 20 nt, Mycobacterium tuberculosis H37Rv
guucgccggaucgaaacuca

SEQ ID NO: 1327364 - RNA, 23 nt, Mycobacterium tuberculosis H37Rv
guucgcccgcccgucuuccagcc

SEQ ID NO: 1327365 - RNA, 14 nt, Mycobacterium tuberculosis H37Rv
guucgaaggccacc

SEQ ID NO: 1327366 - RNA, 23 nt, Mycobacterium tuberculosis H37Rv
guucgaaggccacccgcgaagcc

SEQ ID NO: 1327367 - RNA, 17 nt, Mycobacterium tuberculosis H37Rv
guucagcgaccaaugca

SEQ ID NO: 1327368 - RNA, 20 nt, Mycobacterium tuberculosis H37Rv
guucagcgcuggcaggccgg

SEQ ID NO: 1327369 - RNA, 21 nt, Mycobacterium tuberculosis H37Rv
guucagcgcuggcaggccggg

SEQ ID NO: 1327370 - RNA, 14 nt, Mycobacterium tuberculosis H37Rv
guucagcgcuggca

SEQ ID NO: 1327371 - RNA, 12 nt, Mycobacterium tuberculosis H37Rv
guucacgguuga

SEQ ID NO: 1327372 - RNA, 15 nt, Mycobacterium tuberculosis H37Rv
guucacccagcggcg

SEQ ID NO: 1327373 - RNA, 21 nt, Mycobacterium tuberculosis H37Rv
guucaccgaggugccgcgcag

SEQ ID NO: 1327374 - RNA, 18 nt, Mycobacterium tuberculosis H37Rv
guuccacggguggugcca

SEQ ID NO: 1327375 - RNA, 18 nt, Mycobacterium tuberculosis H37Rv
guuccaccgcgcaggugc

SEQ ID NO: 1327376 - RNA, 19 nt, Mycobacterium tuberculosis H37Rv
guuccaccgcgcaggugcc

SEQ ID NO: 1327377 - RNA, 15 nt, Mycobacterium tuberculosis H37Rv
guucaugcggcggcg

SEQ ID NO: 1327378 - RNA, 11 nt, Mycobacterium tuberculosis H37Rv
guucaugaucg

SEQ ID NO: 1327379 - RNA, 17 nt, Mycobacterium tuberculosis H37Rv
guuccaacuccugcagc

SEQ ID NO: 1327380 - RNA, 16 nt, Mycobacterium tuberculosis H37Rv
guuccaaaucgguggc

SEQ ID NO: 1327381 - RNA, 20 nt, Mycobacterium tuberculosis H37Rv
guuccacccggugccgcagc

SEQ ID NO: 1327382 - RNA, 15 nt, Mycobacterium tuberculosis H37Rv
guuccacccgguggc

SEQ ID NO: 1327383 - RNA, 21 nt, Mycobacterium tuberculosis H37Rv
guucaucgcagucauguccau

SEQ ID NO: 1327384 - RNA, 18 nt, Mycobacterium tuberculosis H37Rv
guucauccgcaguccggg

SEQ ID NO: 1327385 - RNA, 19 nt, Mycobacterium tuberculosis H37Rv
guucagcgcuggcaggccg

SEQ ID NO: 1327386 - RNA, 20 nt, Mycobacterium tuberculosis H37Rv
guugaggccgucgaacggua

SEQ ID NO: 1327387 - RNA, 23 nt, Mycobacterium tuberculosis H37Rv
guugaggacgagguucugccgcg

SEQ ID NO: 1327388 - RNA, 13 nt, Mycobacterium tuberculosis H37Rv
guucucggugcgc

SEQ ID NO: 1327389 - RNA, 18 nt, Mycobacterium tuberculosis H37Rv
guucuccauccgcacugc

SEQ ID NO: 1327390 - RNA, 14 nt, Mycobacterium tuberculosis H37Rv
guucucaucgccaa

SEQ ID NO: 1327391 - RNA, 19 nt, Mycobacterium tuberculosis H37Rv
guugcgaagaagaaggcga

SEQ ID NO: 1327392 - RNA, 18 nt, Mycobacterium tuberculosis H37Rv
guugccggacaaccuggg

SEQ ID NO: 1327393 - RNA, 20 nt, Mycobacterium tuberculosis H37Rv
guugccgcugaauuggcgcc

SEQ ID NO: 1327394 - RNA, 21 nt, Mycobacterium tuberculosis H37Rv
guugccgcgccacuguagggc

SEQ ID NO: 1327395 - RNA, 18 nt, Mycobacterium tuberculosis H37Rv
guugcacguucggcgugu

SEQ ID NO: 1327396 - RNA, 15 nt, Mycobacterium tuberculosis H37Rv
guugcacggccggga

SEQ ID NO: 1327397 - RNA, 15 nt, Mycobacterium tuberculosis H37Rv
guugcaggcgcagcu

SEQ ID NO: 1327398 - RNA, 17 nt, Mycobacterium tuberculosis H37Rv
guugcuggcuggguggc

SEQ ID NO: 1327399 - RNA, 17 nt, Mycobacterium tuberculosis H37Rv
guugcuaaacuccgugc

SEQ ID NO: 1327400 - RNA, 19 nt, Mycobacterium tuberculosis H37Rv
guugcucccacggcaccca

SEQ ID NO: 1327401 - RNA, 15 nt, Mycobacterium tuberculosis H37Rv
guugcggcuggcgcc

SEQ ID NO: 1327402 - RNA, 17 nt, Mycobacterium tuberculosis H37Rv
guugcgcgaugggagcc

SEQ ID NO: 1327403 - RNA, 13 nt, Mycobacterium tuberculosis H37Rv
guugcgcggauga

SEQ ID NO: 1327404 - RNA, 23 nt, Mycobacterium tuberculosis H37Rv
guugcgcuccaacaacuccagca

SEQ ID NO: 1327405 - RNA, 20 nt, Mycobacterium tuberculosis H37Rv
guugguggucggcccuccac

SEQ ID NO: 1327406 - RNA, 21 nt, Mycobacterium tuberculosis H37Rv
guugguucagcucgaggacca

SEQ ID NO: 1327407 - RNA, 19 nt, Mycobacterium tuberculosis H37Rv
guuggugcagaccaccgcc

SEQ ID NO: 1327408 - RNA, 18 nt, Mycobacterium tuberculosis H37Rv
guuggucaccaccuggug

SEQ ID NO: 1327409 - RNA, 19 nt, Mycobacterium tuberculosis H37Rv
guuggucgucgcgugcauc

SEQ ID NO: 1327410 - RNA, 18 nt, Mycobacterium tuberculosis H37Rv
guugguauuagggccggc

SEQ ID NO: 1327411 - RNA, 16 nt, Mycobacterium tuberculosis H37Rv
guuggcgugcaccgca

SEQ ID NO: 1327412 - RNA, 22 nt, Mycobacterium tuberculosis H37Rv
guuggcggccucgggcucaaac

SEQ ID NO: 1327413 - RNA, 14 nt, Mycobacterium tuberculosis H37Rv
guuggcgaagcccg

SEQ ID NO: 1327414 - RNA, 16 nt, Mycobacterium tuberculosis H37Rv
guuggcgaucaucagg

SEQ ID NO: 1327415 - RNA, 14 nt, Mycobacterium tuberculosis H37Rv
guuggccugcaacg

SEQ ID NO: 1327416 - RNA, 18 nt, Mycobacterium tuberculosis H37Rv
guuggccgagcagggccg

SEQ ID NO: 1327417 - RNA, 17 nt, Mycobacterium tuberculosis H37Rv
guuggaagucccgccgu

SEQ ID NO: 1327418 - RNA, 14 nt, Mycobacterium tuberculosis H37Rv
guuuacggcccggc

SEQ ID NO: 1327419 - RNA, 22 nt, Mycobacterium tuberculosis H37Rv
guugucagcgaacggccaggac

SEQ ID NO: 1327420 - RNA, 23 nt, Mycobacterium tuberculosis H37Rv
guuguccaggaauuccccaccgu

SEQ ID NO: 1327421 - RNA, 23 nt, Mycobacterium tuberculosis H37Rv
guuguccgcggccaacguacauc

SEQ ID NO: 1327422 - RNA, 21 nt, Mycobacterium tuberculosis H37Rv
guugucgacgaagguggcgaa

SEQ ID NO: 1327423 - RNA, 16 nt, Mycobacterium tuberculosis H37Rv
guuucauuccugguua

SEQ ID NO: 1327424 - RNA, 20 nt, Mycobacterium tuberculosis H37Rv
aaauauuaugcgcacucuag

SEQ ID NO: 1327425 - RNA, 22 nt, Mycobacterium tuberculosis H37Rv
aaauauuggcccgucacgcccg

SEQ ID NO: 1327426 - RNA, 14 nt, Mycobacterium tuberculosis H37Rv
guuuccgaagcccg

SEQ ID NO: 1327427 - RNA, 16 nt, Mycobacterium tuberculosis H37Rv
guuuccucagcugcuc

SEQ ID NO: 1327428 - RNA, 15 nt, Mycobacterium tuberculosis H37Rv
guuuccucagcugcu

SEQ ID NO: 1327429 - RNA, 19 nt, Mycobacterium tuberculosis H37Rv
guuuccuccggcagcagca

SEQ ID NO: 1327430 - RNA, 20 nt, Mycobacterium tuberculosis H37Rv
guuucggcgcaugugaaaga

SEQ ID NO: 1327431 - RNA, 12 nt, Mycobacterium tuberculosis H37Rv
aaaucaagcaca

SEQ ID NO: 1327432 - RNA, 21 nt, Mycobacterium tuberculosis H37Rv
aaaucaagcacagcccggcga

SEQ ID NO: 1327433 - RNA, 20 nt, Mycobacterium tuberculosis H37Rv
guuugaucaccgugguggcg

SEQ ID NO: 1327434 - RNA, 21 nt, Mycobacterium tuberculosis H37Rv
guuugacugcgaccgguucgg

SEQ ID NO: 1327435 - RNA, 15 nt, Mycobacterium tuberculosis H37Rv
guuugacgccgauga

SEQ ID NO: 1327436 - RNA, 20 nt, Mycobacterium tuberculosis H37Rv
guuucugagcgcgcuggcca

SEQ ID NO: 1327437 - RNA, 15 nt, Mycobacterium tuberculosis H37Rv
guuuguuccgugcgg

SEQ ID NO: 1327438 - RNA, 12 nt, Mycobacterium tuberculosis H37Rv
guuuguuuuguc

SEQ ID NO: 1327439 - RNA, 14 nt, Mycobacterium tuberculosis H37Rv
guuugcgaugccca

SEQ ID NO: 1327440 - RNA, 12 nt, Mycobacterium tuberculosis H37Rv
guuugcgggcgg

SEQ ID NO: 1327441 - RNA, 14 nt, Mycobacterium tuberculosis H37Rv
guuugcgaagccca

SEQ ID NO: 1327442 - RNA, 15 nt, Mycobacterium tuberculosis H37Rv
guuugcgaagcccac

SEQ ID NO: 1327443 - RNA, 14 nt, Mycobacterium tuberculosis H37Rv
guuuugccgugcca

SEQ ID NO: 1327444 - RNA, 17 nt, Mycobacterium tuberculosis H37Rv
gcggucaccgacgcaga

SEQ ID NO: 1327445 - RNA, 17 nt, Mycobacterium tuberculosis H37Rv
gcggucagacgccggcc

SEQ ID NO: 1327446 - RNA, 22 nt, Mycobacterium tuberculosis H37Rv
gcggucagacgccggccgccga

SEQ ID NO: 1327447 - RNA, 19 nt, Mycobacterium tuberculosis H37Rv
gcggucaccggagagccgg

SEQ ID NO: 1327448 - RNA, 19 nt, Mycobacterium tuberculosis H37Rv
gcggucaaauccagcagcc

SEQ ID NO: 1327449 - RNA, 17 nt, Mycobacterium tuberculosis H37Rv
gcgguaaugccagcggc

SEQ ID NO: 1327450 - RNA, 16 nt, Mycobacterium tuberculosis H37Rv
gcgguaagggcgggcu

SEQ ID NO: 1327451 - RNA, 23 nt, Mycobacterium tuberculosis H37Rv
gcgguaccaucaccgcgccagcc

SEQ ID NO: 1327452 - RNA, 19 nt, Mycobacterium tuberculosis H37Rv
gcgguaguugucccgccgc

SEQ ID NO: 1327453 - RNA, 19 nt, Mycobacterium tuberculosis H37Rv
gcgguaucccccagccgcg

SEQ ID NO: 1327454 - RNA, 18 nt, Mycobacterium tuberculosis H37Rv
gcucauccagcgcgugga

SEQ ID NO: 1327455 - RNA, 20 nt, Mycobacterium tuberculosis H37Rv
gcucaucgaccgcggccggg

SEQ ID NO: 1327456 - RNA, 22 nt, Mycobacterium tuberculosis H37Rv
gcucaucccgacccuucgggcu

SEQ ID NO: 1327457 - RNA, 21 nt, Mycobacterium tuberculosis H37Rv
gcucauccgccgggccaggcc

SEQ ID NO: 1327458 - RNA, 17 nt, Mycobacterium tuberculosis H37Rv
gcucaucgaccgcggcc

SEQ ID NO: 1327459 - RNA, 17 nt, Mycobacterium tuberculosis H37Rv
gcuccaaaagccucagc

SEQ ID NO: 1327460 - RNA, 14 nt, Mycobacterium tuberculosis H37Rv
gcucaucgaucccg

SEQ ID NO: 1327461 - RNA, 21 nt, Mycobacterium tuberculosis H37Rv
gcucaucgaccggggcuuggg

SEQ ID NO: 1327462 - RNA, 20 nt, Mycobacterium tuberculosis H37Rv
gcucaucgcggcgaacauca

SEQ ID NO: 1327463 - RNA, 20 nt, Mycobacterium tuberculosis H37Rv
gcucaucuguaaccuccucg

SEQ ID NO: 1327464 - RNA, 21 nt, Mycobacterium tuberculosis H37Rv
gcucaucuguaaccuccucga

SEQ ID NO: 1327465 - RNA, 22 nt, Mycobacterium tuberculosis H37Rv
gcuccaauccuuugccagccac

SEQ ID NO: 1327466 - RNA, 18 nt, Mycobacterium tuberculosis H37Rv
gcuccaacgcacacaccg

SEQ ID NO: 1327467 - RNA, 20 nt, Mycobacterium tuberculosis H37Rv
gcuccaacaaugccagcugu

SEQ ID NO: 1327468 - RNA, 12 nt, Mycobacterium tuberculosis H37Rv
gcuccagcagcg

SEQ ID NO: 1327469 - RNA, 15 nt, Mycobacterium tuberculosis H37Rv
gcuccagcagcgcca

SEQ ID NO: 1327470 - RNA, 12 nt, Mycobacterium tuberculosis H37Rv
gcucccacggca

SEQ ID NO: 1327471 - RNA, 23 nt, Mycobacterium tuberculosis H37Rv
gcucccggcgucuuaccugaagc

SEQ ID NO: 1327472 - RNA, 19 nt, Mycobacterium tuberculosis H37Rv
gcuccaugacaaaccugca

SEQ ID NO: 1327473 - RNA, 15 nt, Mycobacterium tuberculosis H37Rv
gcuccgauuccgaac

SEQ ID NO: 1327474 - RNA, 17 nt, Mycobacterium tuberculosis H37Rv
gcuccgcccauucccag

SEQ ID NO: 1327475 - RNA, 18 nt, Mycobacterium tuberculosis H37Rv
gcuccgaacauggccagc

SEQ ID NO: 1327476 - RNA, 21 nt, Mycobacterium tuberculosis H37Rv
gcuccgaacauggccagcauc

SEQ ID NO: 1327477 - RNA, 16 nt, Mycobacterium tuberculosis H37Rv
gcucccguacgccggc

SEQ ID NO: 1327478 - RNA, 14 nt, Mycobacterium tuberculosis H37Rv
gcucccgugcuggc

SEQ ID NO: 1327479 - RNA, 17 nt, Mycobacterium tuberculosis H37Rv
gcucccuauugcugcgg

SEQ ID NO: 1327480 - RNA, 22 nt, Mycobacterium tuberculosis H37Rv
gcucccuacgagcccacgcgcc

SEQ ID NO: 1327481 - RNA, 17 nt, Mycobacterium tuberculosis H37Rv
gcuccggccgcacgccu

SEQ ID NO: 1327482 - RNA, 13 nt, Mycobacterium tuberculosis H37Rv
gcuccggucgggu

SEQ ID NO: 1327483 - RNA, 14 nt, Mycobacterium tuberculosis H37Rv
gcuccggauugcug

SEQ ID NO: 1327484 - RNA, 21 nt, Mycobacterium tuberculosis H37Rv
gcuccggacaccccgcacgga

SEQ ID NO: 1327485 - RNA, 16 nt, Mycobacterium tuberculosis H37Rv
gcuccgccgucgccgc

SEQ ID NO: 1327486 - RNA, 12 nt, Mycobacterium tuberculosis H37Rv
gcuccgccgccg

SEQ ID NO: 1327487 - RNA, 23 nt, Mycobacterium tuberculosis H37Rv
gcuccgcggcgagcuccgaugcc

SEQ ID NO: 1327488 - RNA, 20 nt, Mycobacterium tuberculosis H37Rv
gcuccgcggcgcagcacggc

SEQ ID NO: 1327489 - RNA, 13 nt, Mycobacterium tuberculosis H37Rv
gcuccgccgccga

SEQ ID NO: 1327490 - RNA, 19 nt, Mycobacterium tuberculosis H37Rv
gcuccgcgccgccccgcuc

SEQ ID NO: 1327491 - RNA, 14 nt, Mycobacterium tuberculosis H37Rv
gcuccgucgcggcc

SEQ ID NO: 1327492 - RNA, 13 nt, Mycobacterium tuberculosis H37Rv
gcuccucagccac

SEQ ID NO: 1327493 - RNA, 20 nt, Mycobacterium tuberculosis H37Rv
gcuccucauagagcggcacc

SEQ ID NO: 1327494 - RNA, 19 nt, Mycobacterium tuberculosis H37Rv
gcuccucggucagcggggu

SEQ ID NO: 1327495 - RNA, 24 nt, Mycobacterium tuberculosis H37Rv
gcuccugcucgucgagccgaccgc

SEQ ID NO: 1327496 - RNA, 13 nt, Mycobacterium tuberculosis H37Rv
gcucgacaacugc

SEQ ID NO: 1327497 - RNA, 16 nt, Mycobacterium tuberculosis H37Rv
gcucgaccgcccggcu

SEQ ID NO: 1327498 - RNA, 13 nt, Mycobacterium tuberculosis H37Rv
gcucgaccaggaa

SEQ ID NO: 1327499 - RNA, 24 nt, Mycobacterium tuberculosis H37Rv
gcuccuuggcuaacaccgcaggca

SEQ ID NO: 1327500 - RNA, 16 nt, Mycobacterium tuberculosis H37Rv
gcuccuuggcccagcg

SEQ ID NO: 1327501 - RNA, 24 nt, Mycobacterium tuberculosis H37Rv
gcucgaaauccugguggcagacau

SEQ ID NO: 1327502 - RNA, 17 nt, Mycobacterium tuberculosis H37Rv
gcucgaaacgcccuugu

SEQ ID NO: 1327503 - RNA, 22 nt, Mycobacterium tuberculosis H37Rv
gcucgaacuccccggucgccgc

SEQ ID NO: 1327504 - RNA, 17 nt, Mycobacterium tuberculosis H37Rv
gcucgaacucggcggcc

SEQ ID NO: 1327505 - RNA, 19 nt, Mycobacterium tuberculosis H37Rv
gcucgaacucggcggccag

SEQ ID NO: 1327506 - RNA, 16 nt, Mycobacterium tuberculosis H37Rv
gcucgacgcccgccac

SEQ ID NO: 1327507 - RNA, 17 nt, Mycobacterium tuberculosis H37Rv
gcucgacggcccgccgu

SEQ ID NO: 1327508 - RNA, 19 nt, Mycobacterium tuberculosis H37Rv
gcucgaggcccgggugcua

SEQ ID NO: 1327509 - RNA, 15 nt, Mycobacterium tuberculosis H37Rv
gcucgaucagccggg

SEQ ID NO: 1327510 - RNA, 14 nt, Mycobacterium tuberculosis H37Rv
gcucgauacccagg

SEQ ID NO: 1327511 - RNA, 22 nt, Mycobacterium tuberculosis H37Rv
gcucgaucgcguucugcaccag

SEQ ID NO: 1327512 - RNA, 20 nt, Mycobacterium tuberculosis H37Rv
gcucgaucugucgcgccggu

SEQ ID NO: 1327513 - RNA, 15 nt, Mycobacterium tuberculosis H37Rv
gcucgauacggcccu

SEQ ID NO: 1327514 - RNA, 18 nt, Mycobacterium tuberculosis H37Rv
gcucgaugucagcggccg

SEQ ID NO: 1327515 - RNA, 13 nt, Mycobacterium tuberculosis H37Rv
gcucgccagcacg

SEQ ID NO: 1327516 - RNA, 14 nt, Mycobacterium tuberculosis H37Rv
gcucgcagcgggcg

SEQ ID NO: 1327517 - RNA, 17 nt, Mycobacterium tuberculosis H37Rv
gcucgcaaucguuggcc

SEQ ID NO: 1327518 - RNA, 22 nt, Mycobacterium tuberculosis H37Rv
gcucgccaggcaagccagcacu

SEQ ID NO: 1327519 - RNA, 17 nt, Mycobacterium tuberculosis H37Rv
gcucgccaggccuaggc

SEQ ID NO: 1327520 - RNA, 15 nt, Mycobacterium tuberculosis H37Rv
gcucgccccauguca

SEQ ID NO: 1327521 - RNA, 21 nt, Mycobacterium tuberculosis H37Rv
gcucgcccgcuacggcagccc

SEQ ID NO: 1327522 - RNA, 16 nt, Mycobacterium tuberculosis H37Rv
gcucgcccgccgccac

SEQ ID NO: 1327523 - RNA, 21 nt, Mycobacterium tuberculosis H37Rv
gcucgccguaagcaccagcca

SEQ ID NO: 1327524 - RNA, 18 nt, Mycobacterium tuberculosis H37Rv
gcucgccgguaggcggcc

SEQ ID NO: 1327525 - RNA, 21 nt, Mycobacterium tuberculosis H37Rv
gcucgccgguaggcggccagc

SEQ ID NO: 1327526 - RNA, 15 nt, Mycobacterium tuberculosis H37Rv
gcucgccguggugga

SEQ ID NO: 1327527 - RNA, 14 nt, Mycobacterium tuberculosis H37Rv
gcucgccgugacca

SEQ ID NO: 1327528 - RNA, 21 nt, Mycobacterium tuberculosis H37Rv
gcucgccgugaccaggugcca

SEQ ID NO: 1327529 - RNA, 19 nt, Mycobacterium tuberculosis H37Rv
gcucgccuaucgacucagu

SEQ ID NO: 1327530 - RNA, 18 nt, Mycobacterium tuberculosis H37Rv
gcucgccggccaacuggg

SEQ ID NO: 1327531 - RNA, 12 nt, Mycobacterium tuberculosis H37Rv
gcucgccggcca

SEQ ID NO: 1327532 - RNA, 23 nt, Mycobacterium tuberculosis H37Rv
gcucgccgggcuuaggccgcggc

SEQ ID NO: 1327533 - RNA, 15 nt, Mycobacterium tuberculosis H37Rv
gcucgccgagcugug

SEQ ID NO: 1327534 - RNA, 16 nt, Mycobacterium tuberculosis H37Rv
gcucgccgaccagcuu

SEQ ID NO: 1327535 - RNA, 22 nt, Mycobacterium tuberculosis H37Rv
gcucggggcgaugagccugcag

SEQ ID NO: 1327536 - RNA, 21 nt, Mycobacterium tuberculosis H37Rv
gcucgggggauccggcgcagc

SEQ ID NO: 1327537 - RNA, 13 nt, Mycobacterium tuberculosis H37Rv
gcucgggggccga

SEQ ID NO: 1327538 - RNA, 23 nt, Mycobacterium tuberculosis H37Rv
gcucgggugguuugcgaacgaau

SEQ ID NO: 1327539 - RNA, 18 nt, Mycobacterium tuberculosis H37Rv
gcucgguccccgcagcuc

SEQ ID NO: 1327540 - RNA, 13 nt, Mycobacterium tuberculosis H37Rv
gcucgcugcacca

SEQ ID NO: 1327541 - RNA, 23 nt, Mycobacterium tuberculosis H37Rv
gcucgcugcgcgcccaccgggcg

SEQ ID NO: 1327542 - RNA, 21 nt, Mycobacterium tuberculosis H37Rv
gcucgcugaucuggggcacca

SEQ ID NO: 1327543 - RNA, 13 nt, Mycobacterium tuberculosis H37Rv
gcucgcugaaccg

SEQ ID NO: 1327544 - RNA, 15 nt, Mycobacterium tuberculosis H37Rv
gcucgcucacgccgu

SEQ ID NO: 1327545 - RNA, 17 nt, Mycobacterium tuberculosis H37Rv
gcucguggucgacguga

SEQ ID NO: 1327546 - RNA, 18 nt, Mycobacterium tuberculosis H37Rv
gcucguggguaccgagca

SEQ ID NO: 1327547 - RNA, 21 nt, Mycobacterium tuberculosis H37Rv
gcucggugcuguugcgcgguc

SEQ ID NO: 1327548 - RNA, 19 nt, Mycobacterium tuberculosis H37Rv
gcucgguggcaucggcggc

SEQ ID NO: 1327549 - RNA, 16 nt, Mycobacterium tuberculosis H37Rv
gcucgucgaucuccuc

SEQ ID NO: 1327550 - RNA, 22 nt, Mycobacterium tuberculosis H37Rv
gcucgucgagcgcgucggucac

SEQ ID NO: 1327551 - RNA, 15 nt, Mycobacterium tuberculosis H37Rv
gcucgucgagcgcgu

SEQ ID NO: 1327552 - RNA, 16 nt, Mycobacterium tuberculosis H37Rv
gcucgucgaacauggc

SEQ ID NO: 1327553 - RNA, 18 nt, Mycobacterium tuberculosis H37Rv
gcucgucgaacauggcac

SEQ ID NO: 1327554 - RNA, 17 nt, Mycobacterium tuberculosis H37Rv
gcucggucuccaccacc

SEQ ID NO: 1327555 - RNA, 19 nt, Mycobacterium tuberculosis H37Rv
gcucgguccuugccguaga

SEQ ID NO: 1327556 - RNA, 20 nt, Mycobacterium tuberculosis H37Rv
gcucggugaugcccagcgcc

SEQ ID NO: 1327557 - RNA, 18 nt, Mycobacterium tuberculosis H37Rv
gcucggugacccccgaga

SEQ ID NO: 1327558 - RNA, 21 nt, Mycobacterium tuberculosis H37Rv
gcucggugaucaccaugauca

SEQ ID NO: 1327559 - RNA, 22 nt, Mycobacterium tuberculosis H37Rv
gcucgucuaccccgagccuuga

SEQ ID NO: 1327560 - RNA, 13 nt, Mycobacterium tuberculosis H37Rv
gcucgucgcggcc

SEQ ID NO: 1327561 - RNA, 14 nt, Mycobacterium tuberculosis H37Rv
gcucgucgcggccc

SEQ ID NO: 1327562 - RNA, 20 nt, Mycobacterium tuberculosis H37Rv
gcucgugagccccagcgacg

SEQ ID NO: 1327563 - RNA, 18 nt, Mycobacterium tuberculosis H37Rv
gcucgucuuggcggcggu

SEQ ID NO: 1327564 - RNA, 15 nt, Mycobacterium tuberculosis H37Rv
gcucgucuugggccg

SEQ ID NO: 1327565 - RNA, 20 nt, Mycobacterium tuberculosis H37Rv
gcugagccccccgagcccgc

SEQ ID NO: 1327566 - RNA, 16 nt, Mycobacterium tuberculosis H37Rv
gcugagcccgccgcga

SEQ ID NO: 1327567 - RNA, 16 nt, Mycobacterium tuberculosis H37Rv
gcugagcaaguccugc

SEQ ID NO: 1327568 - RNA, 17 nt, Mycobacterium tuberculosis H37Rv
gcugagcaaguccugca

SEQ ID NO: 1327569 - RNA, 19 nt, Mycobacterium tuberculosis H37Rv
gcugagaugggccacccgc

SEQ ID NO: 1327570 - RNA, 14 nt, Mycobacterium tuberculosis H37Rv
gcugauccaaguac

SEQ ID NO: 1327571 - RNA, 17 nt, Mycobacterium tuberculosis H37Rv
gcugagccgucggcgcc

SEQ ID NO: 1327572 - RNA, 21 nt, Mycobacterium tuberculosis H37Rv
gcugauagcggucggucacca

SEQ ID NO: 1327573 - RNA, 14 nt, Mycobacterium tuberculosis H37Rv
gcugagcgccaggc

SEQ ID NO: 1327574 - RNA, 15 nt, Mycobacterium tuberculosis H37Rv
gcugaucgcgcgcac

SEQ ID NO: 1327575 - RNA, 17 nt, Mycobacterium tuberculosis H37Rv
gcugaucccggccaggc

SEQ ID NO: 1327576 - RNA, 16 nt, Mycobacterium tuberculosis H37Rv
gcugauccgggcgccg

SEQ ID NO: 1327577 - RNA, 20 nt, Mycobacterium tuberculosis H37Rv
gcugauccggucggccagca

SEQ ID NO: 1327578 - RNA, 15 nt, Mycobacterium tuberculosis H37Rv
gcugaucuugccgcc

SEQ ID NO: 1327579 - RNA, 19 nt, Mycobacterium tuberculosis H37Rv
gcugaucuugccgccgcgc

SEQ ID NO: 1327580 - RNA, 23 nt, Mycobacterium tuberculosis H37Rv
gcugauugcgaccgcgccaacag

SEQ ID NO: 1327581 - RNA, 14 nt, Mycobacterium tuberculosis H37Rv
gcugaugucgccgg

SEQ ID NO: 1327582 - RNA, 20 nt, Mycobacterium tuberculosis H37Rv
gcugccaaacuaacggcagc

SEQ ID NO: 1327583 - RNA, 22 nt, Mycobacterium tuberculosis H37Rv
gcugccaacgcccguguugaag

SEQ ID NO: 1327584 - RNA, 15 nt, Mycobacterium tuberculosis H37Rv
gcugccacccaucgc

SEQ ID NO: 1327585 - RNA, 15 nt, Mycobacterium tuberculosis H37Rv
gcugcagaaaggcca

SEQ ID NO: 1327586 - RNA, 15 nt, Mycobacterium tuberculosis H37Rv
gcugcacguggccac

SEQ ID NO: 1327587 - RNA, 15 nt, Mycobacterium tuberculosis H37Rv
gcugcaaugacugga

SEQ ID NO: 1327588 - RNA, 12 nt, Mycobacterium tuberculosis H37Rv
gcugcagcgaga

SEQ ID NO: 1327589 - RNA, 20 nt, Mycobacterium tuberculosis H37Rv
gcugcagcagacccgguggc

SEQ ID NO: 1327590 - RNA, 17 nt, Mycobacterium tuberculosis H37Rv
gcugcaacggagcgagc

SEQ ID NO: 1327591 - RNA, 19 nt, Mycobacterium tuberculosis H37Rv
gcugaacgggaugaauuca

SEQ ID NO: 1327592 - RNA, 17 nt, Mycobacterium tuberculosis H37Rv
gcugaagaucaacaggc

SEQ ID NO: 1327593 - RNA, 21 nt, Mycobacterium tuberculosis H37Rv
gcugaaguggcacaagcuggg

SEQ ID NO: 1327594 - RNA, 22 nt, Mycobacterium tuberculosis H37Rv
gcugaaggccgguagcgcgggu

SEQ ID NO: 1327595 - RNA, 14 nt, Mycobacterium tuberculosis H37Rv
gcucucgaguccag

SEQ ID NO: 1327596 - RNA, 18 nt, Mycobacterium tuberculosis H37Rv
gcucucgaguccaggcag

SEQ ID NO: 1327597 - RNA, 18 nt, Mycobacterium tuberculosis H37Rv
gcucucggucaguuccuc

SEQ ID NO: 1327598 - RNA, 22 nt, Mycobacterium tuberculosis H37Rv
gcucucguggauggccgccagg

SEQ ID NO: 1327599 - RNA, 21 nt, Mycobacterium tuberculosis H37Rv
gcucucggucaguuccucuac

SEQ ID NO: 1327600 - RNA, 18 nt, Mycobacterium tuberculosis H37Rv
gcucucggucugcaugcg

SEQ ID NO: 1327601 - RNA, 19 nt, Mycobacterium tuberculosis H37Rv
gcugaacaccgugggcgga

SEQ ID NO: 1327602 - RNA, 23 nt, Mycobacterium tuberculosis H37Rv
gcugaacagacggcucagcgugc

SEQ ID NO: 1327603 - RNA, 13 nt, Mycobacterium tuberculosis H37Rv
gcugaaucguucu

SEQ ID NO: 1327604 - RNA, 20 nt, Mycobacterium tuberculosis H37Rv
gcugaaucaccccggcggcc

SEQ ID NO: 1327605 - RNA, 21 nt, Mycobacterium tuberculosis H37Rv
gcugaccggggucggccugcg

SEQ ID NO: 1327606 - RNA, 14 nt, Mycobacterium tuberculosis H37Rv
gcugaccucccacc

SEQ ID NO: 1327607 - RNA, 16 nt, Mycobacterium tuberculosis H37Rv
gcugaccugaaaaucc

SEQ ID NO: 1327608 - RNA, 16 nt, Mycobacterium tuberculosis H37Rv
gcugaccggggucggc

SEQ ID NO: 1327609 - RNA, 16 nt, Mycobacterium tuberculosis H37Rv
gcugaccguggcgccg

SEQ ID NO: 1327610 - RNA, 16 nt, Mycobacterium tuberculosis H37Rv
gcugaccuucaggccc

SEQ ID NO: 1327611 - RNA, 15 nt, Mycobacterium tuberculosis H37Rv
gcugacgauggccag

SEQ ID NO: 1327612 - RNA, 16 nt, Mycobacterium tuberculosis H37Rv
gcugacgcccuccugg

SEQ ID NO: 1327613 - RNA, 16 nt, Mycobacterium tuberculosis H37Rv
gcugacgauggccagg

SEQ ID NO: 1327614 - RNA, 23 nt, Mycobacterium tuberculosis H37Rv
gcugccgggagggguucacccag

SEQ ID NO: 1327615 - RNA, 20 nt, Mycobacterium tuberculosis H37Rv
gcugccgguagcacagcagc

SEQ ID NO: 1327616 - RNA, 13 nt, Mycobacterium tuberculosis H37Rv
gcugccguaucca

SEQ ID NO: 1327617 - RNA, 14 nt, Mycobacterium tuberculosis H37Rv
gcugccgucggugc

SEQ ID NO: 1327618 - RNA, 12 nt, Mycobacterium tuberculosis H37Rv
gcugccuucuuu

SEQ ID NO: 1327619 - RNA, 19 nt, Mycobacterium tuberculosis H37Rv
gcugcgcaacaccaucagc

SEQ ID NO: 1327620 - RNA, 22 nt, Mycobacterium tuberculosis H37Rv
gcugcgagaucuugaugccuuu

SEQ ID NO: 1327621 - RNA, 16 nt, Mycobacterium tuberculosis H37Rv
gcugcgcaacaccauc

SEQ ID NO: 1327622 - RNA, 17 nt, Mycobacterium tuberculosis H37Rv
gcugcgcaccaaggccg

SEQ ID NO: 1327623 - RNA, 20 nt, Mycobacterium tuberculosis H37Rv
gcugcgcagcggcauccaca

SEQ ID NO: 1327624 - RNA, 18 nt, Mycobacterium tuberculosis H37Rv
gcugccgaagcggccacc

SEQ ID NO: 1327625 - RNA, 21 nt, Mycobacterium tuberculosis H37Rv
gcugccacccaucgcacggau

SEQ ID NO: 1327626 - RNA, 16 nt, Mycobacterium tuberculosis H37Rv
gcugccagccauggcc

SEQ ID NO: 1327627 - RNA, 18 nt, Mycobacterium tuberculosis H37Rv
gcugccagccuggagaug

SEQ ID NO: 1327628 - RNA, 16 nt, Mycobacterium tuberculosis H37Rv
gcugccggcccaccag

SEQ ID NO: 1327629 - RNA, 19 nt, Mycobacterium tuberculosis H37Rv
gcugccggagacacccgcc

SEQ ID NO: 1327630 - RNA, 15 nt, Mycobacterium tuberculosis H37Rv
gcugccggcccacca

SEQ ID NO: 1327631 - RNA, 22 nt, Mycobacterium tuberculosis H37Rv
gcugccggccagacggugcagc

SEQ ID NO: 1327632 - RNA, 19 nt, Mycobacterium tuberculosis H37Rv
gcugccggcaacagcucgc

SEQ ID NO: 1327633 - RNA, 22 nt, Mycobacterium tuberculosis H37Rv
gcugccgcugcgccgucgcagc

SEQ ID NO: 1327634 - RNA, 14 nt, Mycobacterium tuberculosis H37Rv
gcugccgcgcgcug

SEQ ID NO: 1327635 - RNA, 24 nt, Mycobacterium tuberculosis H37Rv
gcugccgccuuggucgcgucggcu

SEQ ID NO: 1327636 - RNA, 16 nt, Mycobacterium tuberculosis H37Rv
gcugccgcggcugcca

SEQ ID NO: 1327637 - RNA, 12 nt, Mycobacterium tuberculosis H37Rv
gcugccgcggug

SEQ ID NO: 1327638 - RNA, 13 nt, Mycobacterium tuberculosis H37Rv
gcugccgcggcug

SEQ ID NO: 1327639 - RNA, 15 nt, Mycobacterium tuberculosis H37Rv
gcugccgccgccggc

SEQ ID NO: 1327640 - RNA, 20 nt, Mycobacterium tuberculosis H37Rv
gcugccgcaugcgcuccggc

SEQ ID NO: 1327641 - RNA, 15 nt, Mycobacterium tuberculosis H37Rv
gcugcuggcagacca

SEQ ID NO: 1327642 - RNA, 18 nt, Mycobacterium tuberculosis H37Rv
gcugcugccguggcggca

SEQ ID NO: 1327643 - RNA, 19 nt, Mycobacterium tuberculosis H37Rv
gcugcugccgcaccggugc

SEQ ID NO: 1327644 - RNA, 17 nt, Mycobacterium tuberculosis H37Rv
gcugcuggcaugcaggu

SEQ ID NO: 1327645 - RNA, 22 nt, Mycobacterium tuberculosis H37Rv
gcuggaaaccucuucgggugca

SEQ ID NO: 1327646 - RNA, 18 nt, Mycobacterium tuberculosis H37Rv
gcuggaaaaucgggucac

SEQ ID NO: 1327647 - RNA, 22 nt, Mycobacterium tuberculosis H37Rv
gcuggaacaaaauucgcuggcg

SEQ ID NO: 1327648 - RNA, 23 nt, Mycobacterium tuberculosis H37Rv
gcuggaaucgaaaaggugcacca

SEQ ID NO: 1327649 - RNA, 17 nt, Mycobacterium tuberculosis H37Rv
gcugcuagcccggcggc

SEQ ID NO: 1327650 - RNA, 14 nt, Mycobacterium tuberculosis H37Rv
gcugcuaugggucg

SEQ ID NO: 1327651 - RNA, 18 nt, Mycobacterium tuberculosis H37Rv
gcugcucaucgcgcccgc

SEQ ID NO: 1327652 - RNA, 12 nt, Mycobacterium tuberculosis H37Rv
gcugcuccugga

SEQ ID NO: 1327653 - RNA, 14 nt, Mycobacterium tuberculosis H37Rv
gcugcgcgaagggg

SEQ ID NO: 1327654 - RNA, 13 nt, Mycobacterium tuberculosis H37Rv
gcugcgccgggcu

SEQ ID NO: 1327655 - RNA, 23 nt, Mycobacterium tuberculosis H37Rv
gcugcgccgauacccagcggguc

SEQ ID NO: 1327656 - RNA, 18 nt, Mycobacterium tuberculosis H37Rv
gcugcgccgaacaccaca

SEQ ID NO: 1327657 - RNA, 16 nt, Mycobacterium tuberculosis H37Rv
gcugcgcgaucccaac

SEQ ID NO: 1327658 - RNA, 15 nt, Mycobacterium tuberculosis H37Rv
gcugcgcgcucggcc

SEQ ID NO: 1327659 - RNA, 13 nt, Mycobacterium tuberculosis H37Rv
gcugcgcgcggcg

SEQ ID NO: 1327660 - RNA, 19 nt, Mycobacterium tuberculosis H37Rv
gcugcgcggugccggccgu

SEQ ID NO: 1327661 - RNA, 13 nt, Mycobacterium tuberculosis H37Rv
gcuggcacacucc

SEQ ID NO: 1327662 - RNA, 22 nt, Mycobacterium tuberculosis H37Rv
gcuggcaacgccgcgccguucc

SEQ ID NO: 1327663 - RNA, 17 nt, Mycobacterium tuberculosis H37Rv
gcuggaucucguuggug

SEQ ID NO: 1327664 - RNA, 21 nt, Mycobacterium tuberculosis H37Rv
gcugguccuccuucgguggug

SEQ ID NO: 1327665 - RNA, 15 nt, Mycobacterium tuberculosis H37Rv
gcuggucagcggcgc

SEQ ID NO: 1327666 - RNA, 22 nt, Mycobacterium tuberculosis H37Rv
gcugguccuccuucgguggugg

SEQ ID NO: 1327667 - RNA, 22 nt, Mycobacterium tuberculosis H37Rv
gcuggucagccgugccguggug

SEQ ID NO: 1327668 - RNA, 13 nt, Mycobacterium tuberculosis H37Rv
gcuggucagccgu

SEQ ID NO: 1327669 - RNA, 14 nt, Mycobacterium tuberculosis H37Rv
gcuggucggcggcu

SEQ ID NO: 1327670 - RNA, 15 nt, Mycobacterium tuberculosis H37Rv
gcuggucguggcggu

SEQ ID NO: 1327671 - RNA, 15 nt, Mycobacterium tuberculosis H37Rv
gcuggugccaacugc

SEQ ID NO: 1327672 - RNA, 20 nt, Mycobacterium tuberculosis H37Rv
gcuggugaucagcucaguga

SEQ ID NO: 1327673 - RNA, 24 nt, Mycobacterium tuberculosis H37Rv
gcuguacuugggauugcgggccug

SEQ ID NO: 1327674 - RNA, 15 nt, Mycobacterium tuberculosis H37Rv
aaaggacgucgaccu

SEQ ID NO: 1327675 - RNA, 16 nt, Mycobacterium tuberculosis H37Rv
gcugucacgccugcca

SEQ ID NO: 1327676 - RNA, 16 nt, Mycobacterium tuberculosis H37Rv
gcugucacaagccugc

SEQ ID NO: 1327677 - RNA, 16 nt, Mycobacterium tuberculosis H37Rv
gcugucaagcgggcug

SEQ ID NO: 1327678 - RNA, 18 nt, Mycobacterium tuberculosis H37Rv
gcuguaggucagcgcguc

SEQ ID NO: 1327679 - RNA, 21 nt, Mycobacterium tuberculosis H37Rv
gcugucccgcgggccagcacc

SEQ ID NO: 1327680 - RNA, 14 nt, Mycobacterium tuberculosis H37Rv
gcugucccagcccg

SEQ ID NO: 1327681 - RNA, 18 nt, Mycobacterium tuberculosis H37Rv
gcuguccgacuucuccag

SEQ ID NO: 1327682 - RNA, 14 nt, Mycobacterium tuberculosis H37Rv
gcuguggucggugc

SEQ ID NO: 1327683 - RNA, 16 nt, Mycobacterium tuberculosis H37Rv
gcuguggucggugcca

SEQ ID NO: 1327684 - RNA, 13 nt, Mycobacterium tuberculosis H37Rv
gcuguggugguga

SEQ ID NO: 1327685 - RNA, 23 nt, Mycobacterium tuberculosis H37Rv
gcuguuggcguggaucuuggcca

SEQ ID NO: 1327686 - RNA, 19 nt, Mycobacterium tuberculosis H37Rv
gcuguuguacugcggauga

SEQ ID NO: 1327687 - RNA, 18 nt, Mycobacterium tuberculosis H37Rv
gcuguugcggggugcuca

SEQ ID NO: 1327688 - RNA, 20 nt, Mycobacterium tuberculosis H37Rv
gcuguuugguugcgccagga

SEQ ID NO: 1327689 - RNA, 17 nt, Mycobacterium tuberculosis H37Rv
gcuuagaacgugcuggu

SEQ ID NO: 1327690 - RNA, 15 nt, Mycobacterium tuberculosis H37Rv
gcuuacaugcccugc

SEQ ID NO: 1327691 - RNA, 17 nt, Mycobacterium tuberculosis H37Rv
gcuuacaugcccugcgc

SEQ ID NO: 1327692 - RNA, 15 nt, Mycobacterium tuberculosis H37Rv
gcuuagcgcaugggc

SEQ ID NO: 1327693 - RNA, 21 nt, Mycobacterium tuberculosis H37Rv
gcuuaucgaacgucucggcca

SEQ ID NO: 1327694 - RNA, 18 nt, Mycobacterium tuberculosis H37Rv
gcuuagggcgcccgcccc

SEQ ID NO: 1327695 - RNA, 15 nt, Mycobacterium tuberculosis H37Rv
gcuucacagccacca

SEQ ID NO: 1327696 - RNA, 22 nt, Mycobacterium tuberculosis H37Rv
gcuucaagauuaccgaagcccg

SEQ ID NO: 1327697 - RNA, 18 nt, Mycobacterium tuberculosis H37Rv
gcuuccucgcgagcuccc

SEQ ID NO: 1327698 - RNA, 20 nt, Mycobacterium tuberculosis H37Rv
gcuuccuggguuggcaucca

SEQ ID NO: 1327699 - RNA, 15 nt, Mycobacterium tuberculosis H37Rv
gcuucgacggcggcc

SEQ ID NO: 1327700 - RNA, 12 nt, Mycobacterium tuberculosis H37Rv
gcuuccguggcc

SEQ ID NO: 1327701 - RNA, 23 nt, Mycobacterium tuberculosis H37Rv
gcuuccgcgacgcucgcugcagc

SEQ ID NO: 1327702 - RNA, 23 nt, Mycobacterium tuberculosis H37Rv
gcuucccuccagauaccaccgcc

SEQ ID NO: 1327703 - RNA, 17 nt, Mycobacterium tuberculosis H37Rv
gcuuccaucgccacugu

SEQ ID NO: 1327704 - RNA, 14 nt, Mycobacterium tuberculosis H37Rv
gcuuccagggcggc

SEQ ID NO: 1327705 - RNA, 12 nt, Mycobacterium tuberculosis H37Rv
gcuuccagcauc

SEQ ID NO: 1327706 - RNA, 16 nt, Mycobacterium tuberculosis H37Rv
gcuuccagccacagcc

SEQ ID NO: 1327707 - RNA, 20 nt, Mycobacterium tuberculosis H37Rv
gcuuccagccacagcccggc

SEQ ID NO: 1327708 - RNA, 14 nt, Mycobacterium tuberculosis H37Rv
gcuucccccggucc

SEQ ID NO: 1327709 - RNA, 14 nt, Mycobacterium tuberculosis H37Rv
gcuuccccaccaca

SEQ ID NO: 1327710 - RNA, 16 nt, Mycobacterium tuberculosis H37Rv
gcuucccggaagcgcc

SEQ ID NO: 1327711 - RNA, 21 nt, Mycobacterium tuberculosis H37Rv
gcuucccggaagcgccggccc

SEQ ID NO: 1327712 - RNA, 18 nt, Mycobacterium tuberculosis H37Rv
gcuucaggcgccacugcu

SEQ ID NO: 1327713 - RNA, 16 nt, Mycobacterium tuberculosis H37Rv
gcuucuccuccagaga

SEQ ID NO: 1327714 - RNA, 21 nt, Mycobacterium tuberculosis H37Rv
gcuucgucggccggcacccca

SEQ ID NO: 1327715 - RNA, 16 nt, Mycobacterium tuberculosis H37Rv
gcuucugcgucugcuc

SEQ ID NO: 1327716 - RNA, 21 nt, Mycobacterium tuberculosis H37Rv
gcuucugggcuuucugcaccc

SEQ ID NO: 1327717 - RNA, 22 nt, Mycobacterium tuberculosis H37Rv
gcuucugggguuggcucggcgc

SEQ ID NO: 1327718 - RNA, 21 nt, Mycobacterium tuberculosis H37Rv
gcuucgguucuguuccagaag

SEQ ID NO: 1327719 - RNA, 19 nt, Mycobacterium tuberculosis H37Rv
gcuucggguccagcggccg

SEQ ID NO: 1327720 - RNA, 20 nt, Mycobacterium tuberculosis H37Rv
gcuucgucggccagcagcaa

SEQ ID NO: 1327721 - RNA, 18 nt, Mycobacterium tuberculosis H37Rv
gcuucgucggccagcagc

SEQ ID NO: 1327722 - RNA, 15 nt, Mycobacterium tuberculosis H37Rv
gcuucggccagauca

SEQ ID NO: 1327723 - RNA, 20 nt, Mycobacterium tuberculosis H37Rv
gcuucggcggccgagcgcac

SEQ ID NO: 1327724 - RNA, 14 nt, Mycobacterium tuberculosis H37Rv
gcuucggcggucag

SEQ ID NO: 1327725 - RNA, 20 nt, Mycobacterium tuberculosis H37Rv
gcuucggcgaacccuccgca

SEQ ID NO: 1327726 - RNA, 21 nt, Mycobacterium tuberculosis H37Rv
gcuucgccgcgcagccuucuc

SEQ ID NO: 1327727 - RNA, 14 nt, Mycobacterium tuberculosis H37Rv
gcuucgcgguuggc

SEQ ID NO: 1327728 - RNA, 13 nt, Mycobacterium tuberculosis H37Rv
gcuucgauagaag

SEQ ID NO: 1327729 - RNA, 17 nt, Mycobacterium tuberculosis H37Rv
gcuucgccaacugcggc

SEQ ID NO: 1327730 - RNA, 19 nt, Mycobacterium tuberculosis H37Rv
gcuucgccacaccaugauu

SEQ ID NO: 1327731 - RNA, 14 nt, Mycobacterium tuberculosis H37Rv
gcuugccccgccuu

SEQ ID NO: 1327732 - RNA, 19 nt, Mycobacterium tuberculosis H37Rv
gcuugccccaucguucguu

SEQ ID NO: 1327733 - RNA, 14 nt, Mycobacterium tuberculosis H37Rv
gcuugccccgccgu

SEQ ID NO: 1327734 - RNA, 13 nt, Mycobacterium tuberculosis H37Rv
gcuugccccgccu

SEQ ID NO: 1327735 - RNA, 22 nt, Mycobacterium tuberculosis H37Rv
gcuugcgcucguugguucagcu

SEQ ID NO: 1327736 - RNA, 15 nt, Mycobacterium tuberculosis H37Rv
gcuugcgccgcagcg

SEQ ID NO: 1327737 - RNA, 23 nt, Mycobacterium tuberculosis H37Rv
gcuugcgggggaguagugguggg

SEQ ID NO: 1327738 - RNA, 20 nt, Mycobacterium tuberculosis H37Rv
gcuugcggccgaauuccuca

SEQ ID NO: 1327739 - RNA, 14 nt, Mycobacterium tuberculosis H37Rv
gcuugcggccgcgc

SEQ ID NO: 1327740 - RNA, 13 nt, Mycobacterium tuberculosis H37Rv
gcuugcggcacaa

SEQ ID NO: 1327741 - RNA, 17 nt, Mycobacterium tuberculosis H37Rv
gcuugcgcagccgcagc

SEQ ID NO: 1327742 - RNA, 18 nt, Mycobacterium tuberculosis H37Rv
gcuugcgaccccggcugc

SEQ ID NO: 1327743 - RNA, 20 nt, Mycobacterium tuberculosis H37Rv
gcuugacccacgagagcgcu

SEQ ID NO: 1327744 - RNA, 18 nt, Mycobacterium tuberculosis H37Rv
gcuucuuaccgcgggccg

SEQ ID NO: 1327745 - RNA, 22 nt, Mycobacterium tuberculosis H37Rv
gcuucuucggucaccucgaugc

SEQ ID NO: 1327746 - RNA, 17 nt, Mycobacterium tuberculosis H37Rv
gcuugacugcacaccac

SEQ ID NO: 1327747 - RNA, 22 nt, Mycobacterium tuberculosis H37Rv
gcuugaggucccgugcgcgcgc

SEQ ID NO: 1327748 - RNA, 14 nt, Mycobacterium tuberculosis H37Rv
gcuuggccuaugcu

SEQ ID NO: 1327749 - RNA, 17 nt, Mycobacterium tuberculosis H37Rv
gcuuggccucagccacc

SEQ ID NO: 1327750 - RNA, 19 nt, Mycobacterium tuberculosis H37Rv
gcuuggccagccacuccuc

SEQ ID NO: 1327751 - RNA, 21 nt, Mycobacterium tuberculosis H37Rv
gcuuggcaaucaucucccgac

SEQ ID NO: 1327752 - RNA, 14 nt, Mycobacterium tuberculosis H37Rv
gcuuggcggggcua

SEQ ID NO: 1327753 - RNA, 23 nt, Mycobacterium tuberculosis H37Rv
gcuuggcggucugcgccaaaauc

SEQ ID NO: 1327754 - RNA, 16 nt, Mycobacterium tuberculosis H37Rv
gcuuggcgugaccuac

SEQ ID NO: 1327755 - RNA, 22 nt, Mycobacterium tuberculosis H37Rv
gcuuggcggcgaucaacucggg

SEQ ID NO: 1327756 - RNA, 21 nt, Mycobacterium tuberculosis H37Rv
gcuuggcaaccuguuccagcg

SEQ ID NO: 1327757 - RNA, 16 nt, Mycobacterium tuberculosis H37Rv
gcuuggaccagcgugg

SEQ ID NO: 1327758 - RNA, 15 nt, Mycobacterium tuberculosis H37Rv
gcuugggccggugca

SEQ ID NO: 1327759 - RNA, 13 nt, Mycobacterium tuberculosis H37Rv
gcuugggccuggg

SEQ ID NO: 1327760 - RNA, 21 nt, Mycobacterium tuberculosis H37Rv
gcuuggcgugaccuaccuccu

SEQ ID NO: 1327761 - RNA, 15 nt, Mycobacterium tuberculosis H37Rv
gcuugggccaggccc

SEQ ID NO: 1327762 - RNA, 14 nt, Mycobacterium tuberculosis H37Rv
gcuugggccccuug

SEQ ID NO: 1327763 - RNA, 14 nt, Mycobacterium tuberculosis H37Rv
gcuugucgagcagg

SEQ ID NO: 1327764 - RNA, 15 nt, Mycobacterium tuberculosis H37Rv
gcuugucagccgcga

SEQ ID NO: 1327765 - RNA, 23 nt, Mycobacterium tuberculosis H37Rv
gcuugggugccucgccaaccuuu

SEQ ID NO: 1327766 - RNA, 16 nt, Mycobacterium tuberculosis H37Rv
gcuuggucgccgggca

SEQ ID NO: 1327767 - RNA, 19 nt, Mycobacterium tuberculosis H37Rv
gcuuggugcccaaggcaga

SEQ ID NO: 1327768 - RNA, 23 nt, Mycobacterium tuberculosis H37Rv
gcuuggugcccagcguggcuggc

SEQ ID NO: 1327769 - RNA, 21 nt, Mycobacterium tuberculosis H37Rv
gcuuguuuuccaccagcgagc

SEQ ID NO: 1327770 - RNA, 20 nt, Mycobacterium tuberculosis H37Rv
gcuuuaaccgcgucaucacc

SEQ ID NO: 1327771 - RNA, 19 nt, Mycobacterium tuberculosis H37Rv
ggaacaaguagccgucguc

SEQ ID NO: 1327772 - RNA, 15 nt, Mycobacterium tuberculosis H37Rv
ggaacaccaccaggc

SEQ ID NO: 1327773 - RNA, 19 nt, Mycobacterium tuberculosis H37Rv
gcuuucgauauagccgccg

SEQ ID NO: 1327774 - RNA, 22 nt, Mycobacterium tuberculosis H37Rv
gcuuucgauauagccgccggug

SEQ ID NO: 1327775 - RNA, 14 nt, Mycobacterium tuberculosis H37Rv
gcuuucgaagaacg

SEQ ID NO: 1327776 - RNA, 19 nt, Mycobacterium tuberculosis H37Rv
gcuuuccucaccagccguc

SEQ ID NO: 1327777 - RNA, 17 nt, Mycobacterium tuberculosis H37Rv
ggaaccagcggucggcg

SEQ ID NO: 1327778 - RNA, 17 nt, Mycobacterium tuberculosis H37Rv
ggaagccgcaccgcugu

SEQ ID NO: 1327779 - RNA, 17 nt, Mycobacterium tuberculosis H37Rv
ggaacugcaugguggcg

SEQ ID NO: 1327780 - RNA, 21 nt, Mycobacterium tuberculosis H37Rv
ggaacuccggguggcggcggc

SEQ ID NO: 1327781 - RNA, 20 nt, Mycobacterium tuberculosis H37Rv
ggaacggugcacagcaguga

SEQ ID NO: 1327782 - RNA, 17 nt, Mycobacterium tuberculosis H37Rv
ggaacggugcacagcag

SEQ ID NO: 1327783 - RNA, 14 nt, Mycobacterium tuberculosis H37Rv
ggaacccagcacug

SEQ ID NO: 1327784 - RNA, 16 nt, Mycobacterium tuberculosis H37Rv
ggaacccagcacuggg

SEQ ID NO: 1327785 - RNA, 13 nt, Mycobacterium tuberculosis H37Rv
ggaacggccagga

SEQ ID NO: 1327786 - RNA, 19 nt, Mycobacterium tuberculosis H37Rv
ggaacguccagccguggcg

SEQ ID NO: 1327787 - RNA, 18 nt, Mycobacterium tuberculosis H37Rv
ggaacguccagccguggc

SEQ ID NO: 1327788 - RNA, 15 nt, Mycobacterium tuberculosis H37Rv
ggaaggucagcgccc

SEQ ID NO: 1327789 - RNA, 22 nt, Mycobacterium tuberculosis H37Rv
ggaaggugugcgucuccagcug

SEQ ID NO: 1327790 - RNA, 19 nt, Mycobacterium tuberculosis H37Rv
ggaaggucgacaugggucg

SEQ ID NO: 1327791 - RNA, 14 nt, Mycobacterium tuberculosis H37Rv
ggaagcgguggccu

SEQ ID NO: 1327792 - RNA, 17 nt, Mycobacterium tuberculosis H37Rv
ggaagcgguugacccac

SEQ ID NO: 1327793 - RNA, 13 nt, Mycobacterium tuberculosis H37Rv
ggaagcggcggcc

SEQ ID NO: 1327794 - RNA, 23 nt, Mycobacterium tuberculosis H37Rv
ggaagcgccaacccggcgggccc

SEQ ID NO: 1327795 - RNA, 17 nt, Mycobacterium tuberculosis H37Rv
ggaagccugcgggccgg

SEQ ID NO: 1327796 - RNA, 13 nt, Mycobacterium tuberculosis H37Rv
ggacacuccugca

SEQ ID NO: 1327797 - RNA, 16 nt, Mycobacterium tuberculosis H37Rv
ggacaccggcaccacg

SEQ ID NO: 1327798 - RNA, 13 nt, Mycobacterium tuberculosis H37Rv
ggacaagcuccuc

SEQ ID NO: 1327799 - RNA, 14 nt, Mycobacterium tuberculosis H37Rv
ggacaagugccggc

SEQ ID NO: 1327800 - RNA, 18 nt, Mycobacterium tuberculosis H37Rv
ggacaagugccggcgcgg

SEQ ID NO: 1327801 - RNA, 18 nt, Mycobacterium tuberculosis H37Rv
ggacaauggacaccaacc

SEQ ID NO: 1327802 - RNA, 17 nt, Mycobacterium tuberculosis H37Rv
ggacacauugaccaggu

SEQ ID NO: 1327803 - RNA, 20 nt, Mycobacterium tuberculosis H37Rv
ggacaccaacccacccccca

SEQ ID NO: 1327804 - RNA, 13 nt, Mycobacterium tuberculosis H37Rv
ggacaccagccag

SEQ ID NO: 1327805 - RNA, 23 nt, Mycobacterium tuberculosis H37Rv
ggaauuccgcuaccgcacaggca

SEQ ID NO: 1327806 - RNA, 18 nt, Mycobacterium tuberculosis H37Rv
ggacaaaccgggcggcca

SEQ ID NO: 1327807 - RNA, 15 nt, Mycobacterium tuberculosis H37Rv
ggacaagccgcugau

SEQ ID NO: 1327808 - RNA, 22 nt, Mycobacterium tuberculosis H37Rv
ggacaacaagaugccugacacg

SEQ ID NO: 1327809 - RNA, 16 nt, Mycobacterium tuberculosis H37Rv
ggacaaagcugcucgu

SEQ ID NO: 1327810 - RNA, 17 nt, Mycobacterium tuberculosis H37Rv
ggaauacaacagcuggg

SEQ ID NO: 1327811 - RNA, 14 nt, Mycobacterium tuberculosis H37Rv
ggaauacagcuuga

SEQ ID NO: 1327812 - RNA, 23 nt, Mycobacterium tuberculosis H37Rv
ggaaguugaucuugccgcccuug

SEQ ID NO: 1327813 - RNA, 14 nt, Mycobacterium tuberculosis H37Rv
ggaagucccgccgu

SEQ ID NO: 1327814 - RNA, 17 nt, Mycobacterium tuberculosis H37Rv
ggaaugggcgccacagc

SEQ ID NO: 1327815 - RNA, 14 nt, Mycobacterium tuberculosis H37Rv
ggaauggucccggg

SEQ ID NO: 1327816 - RNA, 22 nt, Mycobacterium tuberculosis H37Rv
ggaauguugcgagugagcucag

SEQ ID NO: 1327817 - RNA, 23 nt, Mycobacterium tuberculosis H37Rv
ggaauacgcugcuggucuugccg

SEQ ID NO: 1327818 - RNA, 19 nt, Mycobacterium tuberculosis H37Rv
ggacccuaacucccccgcu

SEQ ID NO: 1327819 - RNA, 20 nt, Mycobacterium tuberculosis H37Rv
ggacccggugacccgcuggg

SEQ ID NO: 1327820 - RNA, 12 nt, Mycobacterium tuberculosis H37Rv
ggacagggugcg

SEQ ID NO: 1327821 - RNA, 19 nt, Mycobacterium tuberculosis H37Rv
ggaccgccccggccaggac

SEQ ID NO: 1327822 - RNA, 19 nt, Mycobacterium tuberculosis H37Rv
ggacccugcgccgccacag

SEQ ID NO: 1327823 - RNA, 21 nt, Mycobacterium tuberculosis H37Rv
ggaccgaucuuggccaccgcc

SEQ ID NO: 1327824 - RNA, 17 nt, Mycobacterium tuberculosis H37Rv
ggaccgauuucgccugc

SEQ ID NO: 1327825 - RNA, 14 nt, Mycobacterium tuberculosis H37Rv
ggaccgcagcguga

SEQ ID NO: 1327826 - RNA, 13 nt, Mycobacterium tuberculosis H37Rv
ggaccgcucugcg

SEQ ID NO: 1327827 - RNA, 19 nt, Mycobacterium tuberculosis H37Rv
ggaccgugacguaucgccg

SEQ ID NO: 1327828 - RNA, 14 nt, Mycobacterium tuberculosis H37Rv
ggaccgcggccacc

SEQ ID NO: 1327829 - RNA, 14 nt, Mycobacterium tuberculosis H37Rv
ggaccggugccagc

SEQ ID NO: 1327830 - RNA, 19 nt, Mycobacterium tuberculosis H37Rv
ggacagcguaucucccaac

SEQ ID NO: 1327831 - RNA, 11 nt, Mycobacterium tuberculosis H37Rv
ggacagcagcc

SEQ ID NO: 1327832 - RNA, 15 nt, Mycobacterium tuberculosis H37Rv
ggacagauggcggcc

SEQ ID NO: 1327833 - RNA, 18 nt, Mycobacterium tuberculosis H37Rv
ggacaggcuugacugcac

SEQ ID NO: 1327834 - RNA, 15 nt, Mycobacterium tuberculosis H37Rv
ggacagcuguugauu

SEQ ID NO: 1327835 - RNA, 20 nt, Mycobacterium tuberculosis H37Rv
ggaccuucugucccugcagu

SEQ ID NO: 1327836 - RNA, 17 nt, Mycobacterium tuberculosis H37Rv
ggacgcuuggguagccu

SEQ ID NO: 1327837 - RNA, 22 nt, Mycobacterium tuberculosis H37Rv
ggacgcugauugcgaccgcgcc

SEQ ID NO: 1327838 - RNA, 17 nt, Mycobacterium tuberculosis H37Rv
ggacgacgaucaagccu

SEQ ID NO: 1327839 - RNA, 18 nt, Mycobacterium tuberculosis H37Rv
ggagacguuuugcggccc

SEQ ID NO: 1327840 - RNA, 19 nt, Mycobacterium tuberculosis H37Rv
ggagacgaucgccaggccg

SEQ ID NO: 1327841 - RNA, 18 nt, Mycobacterium tuberculosis H37Rv
ggagacgaucgccaggcc

SEQ ID NO: 1327842 - RNA, 14 nt, Mycobacterium tuberculosis H37Rv
ggagacccgggugc

SEQ ID NO: 1327843 - RNA, 23 nt, Mycobacterium tuberculosis H37Rv
ggacuucggugagcagggcggcg

SEQ ID NO: 1327844 - RNA, 22 nt, Mycobacterium tuberculosis H37Rv
ggacuucguuccgugccgagcu

SEQ ID NO: 1327845 - RNA, 14 nt, Mycobacterium tuberculosis H37Rv
ggacuucgggggcc

SEQ ID NO: 1327846 - RNA, 16 nt, Mycobacterium tuberculosis H37Rv
ggacuugcgagccgua

SEQ ID NO: 1327847 - RNA, 12 nt, Mycobacterium tuberculosis H37Rv
ggagcagggcuc

SEQ ID NO: 1327848 - RNA, 21 nt, Mycobacterium tuberculosis H37Rv
ggagcaccucgaagugcaggu

SEQ ID NO: 1327849 - RNA, 16 nt, Mycobacterium tuberculosis H37Rv
ggacugaucgucugaa

SEQ ID NO: 1327850 - RNA, 18 nt, Mycobacterium tuberculosis H37Rv
ggacugaacaguugcaca

SEQ ID NO: 1327851 - RNA, 15 nt, Mycobacterium tuberculosis H37Rv
ggacugaccucguca

SEQ ID NO: 1327852 - RNA, 14 nt, Mycobacterium tuberculosis H37Rv
ggacugcagcgcgg

SEQ ID NO: 1327853 - RNA, 11 nt, Mycobacterium tuberculosis H37Rv
ggacugcagcg

SEQ ID NO: 1327854 - RNA, 14 nt, Mycobacterium tuberculosis H37Rv
ggacugcgccgggu

SEQ ID NO: 1327855 - RNA, 16 nt, Mycobacterium tuberculosis H37Rv
ggacugucccaccagg

SEQ ID NO: 1327856 - RNA, 18 nt, Mycobacterium tuberculosis H37Rv
ggacugucccaccaggua

SEQ ID NO: 1327857 - RNA, 19 nt, Mycobacterium tuberculosis H37Rv
ggacuucagcaggcccagc

SEQ ID NO: 1327858 - RNA, 13 nt, Mycobacterium tuberculosis H37Rv
ggauaccggucag

SEQ ID NO: 1327859 - RNA, 20 nt, Mycobacterium tuberculosis H37Rv
ggauaccgucaugggcggcu

SEQ ID NO: 1327860 - RNA, 20 nt, Mycobacterium tuberculosis H37Rv
ggauaccgcugggucgccgu

SEQ ID NO: 1327861 - RNA, 22 nt, Mycobacterium tuberculosis H37Rv
ggauacccagcgcccggccacu

SEQ ID NO: 1327862 - RNA, 12 nt, Mycobacterium tuberculosis H37Rv
ggauaacccagc

SEQ ID NO: 1327863 - RNA, 22 nt, Mycobacterium tuberculosis H37Rv
ggagccggccaccucggugcgg

SEQ ID NO: 1327864 - RNA, 18 nt, Mycobacterium tuberculosis H37Rv
ggagcccguccaggcccg

SEQ ID NO: 1327865 - RNA, 16 nt, Mycobacterium tuberculosis H37Rv
ggagcccugaccgggg

SEQ ID NO: 1327866 - RNA, 22 nt, Mycobacterium tuberculosis H37Rv
ggagccccugucaacgccgcgg

SEQ ID NO: 1327867 - RNA, 16 nt, Mycobacterium tuberculosis H37Rv
ggagccgaucacgcug

SEQ ID NO: 1327868 - RNA, 17 nt, Mycobacterium tuberculosis H37Rv
ggagccgaggugcugca

SEQ ID NO: 1327869 - RNA, 14 nt, Mycobacterium tuberculosis H37Rv
ggagccgccggacg

SEQ ID NO: 1327870 - RNA, 18 nt, Mycobacterium tuberculosis H37Rv
ggagccgccggccccgcc

SEQ ID NO: 1327871 - RNA, 19 nt, Mycobacterium tuberculosis H37Rv
ggagccgcccaagccgccg

SEQ ID NO: 1327872 - RNA, 13 nt, Mycobacterium tuberculosis H37Rv
ggagccggccacc

SEQ ID NO: 1327873 - RNA, 14 nt, Mycobacterium tuberculosis H37Rv
ggagcccggcggcc

SEQ ID NO: 1327874 - RNA, 16 nt, Mycobacterium tuberculosis H37Rv
ggagcccguccaggcc

SEQ ID NO: 1327875 - RNA, 16 nt, Mycobacterium tuberculosis H37Rv
ggagccaggacgacgc

SEQ ID NO: 1327876 - RNA, 16 nt, Mycobacterium tuberculosis H37Rv
ggaguucuuguagccg

SEQ ID NO: 1327877 - RNA, 13 nt, Mycobacterium tuberculosis H37Rv
ggaguugaagaag

SEQ ID NO: 1327878 - RNA, 15 nt, Mycobacterium tuberculosis H37Rv
ggaguucgcgcagca

SEQ ID NO: 1327879 - RNA, 18 nt, Mycobacterium tuberculosis H37Rv
ggaguugaagaagcccga

SEQ ID NO: 1327880 - RNA, 19 nt, Mycobacterium tuberculosis H37Rv
ggaguuuuucgggguggcg

SEQ ID NO: 1327881 - RNA, 20 nt, Mycobacterium tuberculosis H37Rv
ggaguuugauuccaggucau

SEQ ID NO: 1327882 - RNA, 18 nt, Mycobacterium tuberculosis H37Rv
ggaucgguuucugcggcc

SEQ ID NO: 1327883 - RNA, 17 nt, Mycobacterium tuberculosis H37Rv
ggaucguccggccgggg

SEQ ID NO: 1327884 - RNA, 21 nt, Mycobacterium tuberculosis H37Rv
ggaucgucgugcacggcggcc

SEQ ID NO: 1327885 - RNA, 23 nt, Mycobacterium tuberculosis H37Rv
ggaucguggcgcccgucuccagc

SEQ ID NO: 1327886 - RNA, 13 nt, Mycobacterium tuberculosis H37Rv
ggaucgugccggc

SEQ ID NO: 1327887 - RNA, 14 nt, Mycobacterium tuberculosis H37Rv
ggaucgugccggcg

SEQ ID NO: 1327888 - RNA, 21 nt, Mycobacterium tuberculosis H37Rv
ggaucgucgggagcacacaag

SEQ ID NO: 1327889 - RNA, 15 nt, Mycobacterium tuberculosis H37Rv
ggaucgucgugcacg

SEQ ID NO: 1327890 - RNA, 19 nt, Mycobacterium tuberculosis H37Rv
ggaucggcggaccgcagcg

SEQ ID NO: 1327891 - RNA, 13 nt, Mycobacterium tuberculosis H37Rv
ggaucggccggcg

SEQ ID NO: 1327892 - RNA, 18 nt, Mycobacterium tuberculosis H37Rv
ggaucggcaccccacgcc

SEQ ID NO: 1327893 - RNA, 24 nt, Mycobacterium tuberculosis H37Rv
ggaucggcugcgcgcucggccagc

SEQ ID NO: 1327894 - RNA, 15 nt, Mycobacterium tuberculosis H37Rv
ggaucggcagcagag

SEQ ID NO: 1327895 - RNA, 14 nt, Mycobacterium tuberculosis H37Rv
ggaucgcugccagc

SEQ ID NO: 1327896 - RNA, 16 nt, Mycobacterium tuberculosis H37Rv
ggaucggauggcggcc

SEQ ID NO: 1327897 - RNA, 16 nt, Mycobacterium tuberculosis H37Rv
ggauccacccagugcc

SEQ ID NO: 1327898 - RNA, 20 nt, Mycobacterium tuberculosis H37Rv
ggauccaggcccagccgagc

SEQ ID NO: 1327899 - RNA, 16 nt, Mycobacterium tuberculosis H37Rv
ggauccaggcccagcc

SEQ ID NO: 1327900 - RNA, 14 nt, Mycobacterium tuberculosis H37Rv
ggaucagcgcacug

SEQ ID NO: 1327901 - RNA, 13 nt, Mycobacterium tuberculosis H37Rv
ggaucaucgccgc

SEQ ID NO: 1327902 - RNA, 17 nt, Mycobacterium tuberculosis H37Rv
ggaucaucgccgcggcc

SEQ ID NO: 1327903 - RNA, 21 nt, Mycobacterium tuberculosis H37Rv
ggaucauccuucgccggcgcc

SEQ ID NO: 1327904 - RNA, 18 nt, Mycobacterium tuberculosis H37Rv
ggaucucggcguaggcga

SEQ ID NO: 1327905 - RNA, 22 nt, Mycobacterium tuberculosis H37Rv
ggaucguucgcgugccagcgcc

SEQ ID NO: 1327906 - RNA, 17 nt, Mycobacterium tuberculosis H37Rv
ggaucuauuggaugcga

SEQ ID NO: 1327907 - RNA, 16 nt, Mycobacterium tuberculosis H37Rv
ggaucucauccauguu

SEQ ID NO: 1327908 - RNA, 20 nt, Mycobacterium tuberculosis H37Rv
ggaucuugccgcugguggug

SEQ ID NO: 1327909 - RNA, 18 nt, Mycobacterium tuberculosis H37Rv
ggaucugguugaaccggu

SEQ ID NO: 1327910 - RNA, 15 nt, Mycobacterium tuberculosis H37Rv
ggaucugguccagug

SEQ ID NO: 1327911 - RNA, 20 nt, Mycobacterium tuberculosis H37Rv
ggaugaauuuggugaaguga

SEQ ID NO: 1327912 - RNA, 15 nt, Mycobacterium tuberculosis H37Rv
ggaugacgacgguga

SEQ ID NO: 1327913 - RNA, 21 nt, Mycobacterium tuberculosis H37Rv
ggaugaguucgucguggagcu

SEQ ID NO: 1327914 - RNA, 14 nt, Mycobacterium tuberculosis H37Rv
ggaugacgcccagg

SEQ ID NO: 1327915 - RNA, 19 nt, Mycobacterium tuberculosis H37Rv
ggaugacgguuccggucgg

SEQ ID NO: 1327916 - RNA, 13 nt, Mycobacterium tuberculosis H37Rv
ggauggcucgccg

SEQ ID NO: 1327917 - RNA, 22 nt, Mycobacterium tuberculosis H37Rv
ggaugggaccuugaucgagcag

SEQ ID NO: 1327918 - RNA, 15 nt, Mycobacterium tuberculosis H37Rv
ggaugucgucgacca

SEQ ID NO: 1327919 - RNA, 22 nt, Mycobacterium tuberculosis H37Rv
ggaugucgacgagcaccgcgcc

SEQ ID NO: 1327920 - RNA, 19 nt, Mycobacterium tuberculosis H37Rv
ggaugcggccccaugcgcc

SEQ ID NO: 1327921 - RNA, 20 nt, Mycobacterium tuberculosis H37Rv
ggaugcggacucagcggcgu

SEQ ID NO: 1327922 - RNA, 15 nt, Mycobacterium tuberculosis H37Rv
ggaugccgaaccgcu

SEQ ID NO: 1327923 - RNA, 23 nt, Mycobacterium tuberculosis H37Rv
ggaugcgauggccgacgcugcug

SEQ ID NO: 1327924 - RNA, 17 nt, Mycobacterium tuberculosis H37Rv
ggaugcgacagcgcugg

SEQ ID NO: 1327925 - RNA, 13 nt, Mycobacterium tuberculosis H37Rv
ggaugccggucgg

SEQ ID NO: 1327926 - RNA, 22 nt, Mycobacterium tuberculosis H37Rv
ggaugcccguagacgccgagca

SEQ ID NO: 1327927 - RNA, 22 nt, Mycobacterium tuberculosis H37Rv
ggaugccccuucaaagcggccu

SEQ ID NO: 1327928 - RNA, 19 nt, Mycobacterium tuberculosis H37Rv
ggaugcugagcgccaggcc

SEQ ID NO: 1327929 - RNA, 17 nt, Mycobacterium tuberculosis H37Rv
ggaugcugucagcagcc

SEQ ID NO: 1327930 - RNA, 14 nt, Mycobacterium tuberculosis H37Rv
ggaugcucgaucca

SEQ ID NO: 1327931 - RNA, 17 nt, Mycobacterium tuberculosis H37Rv
ggauuccagcagccugc

SEQ ID NO: 1327932 - RNA, 15 nt, Mycobacterium tuberculosis H37Rv
ggauuccagcagccu

SEQ ID NO: 1327933 - RNA, 20 nt, Mycobacterium tuberculosis H37Rv
ggauuaccaguggauuggcg

SEQ ID NO: 1327934 - RNA, 16 nt, Mycobacterium tuberculosis H37Rv
ggauucacgcaccggc

SEQ ID NO: 1327935 - RNA, 14 nt, Mycobacterium tuberculosis H37Rv
ggcaaccugccggg

SEQ ID NO: 1327936 - RNA, 22 nt, Mycobacterium tuberculosis H37Rv
ggcaaccgcgcgcgacacgaga

SEQ ID NO: 1327937 - RNA, 22 nt, Mycobacterium tuberculosis H37Rv
ggcaaccccgagcggagccgcc

SEQ ID NO: 1327938 - RNA, 14 nt, Mycobacterium tuberculosis H37Rv
ggcaaccagcgagc

SEQ ID NO: 1327939 - RNA, 18 nt, Mycobacterium tuberculosis H37Rv
ggcaagaccgaacagcgg

SEQ ID NO: 1327940 - RNA, 18 nt, Mycobacterium tuberculosis H37Rv
ggcaagcaaccggugcgc

SEQ ID NO: 1327941 - RNA, 19 nt, Mycobacterium tuberculosis H37Rv
ggcaacagcaccagugugg

SEQ ID NO: 1327942 - RNA, 14 nt, Mycobacterium tuberculosis H37Rv
ggcaaccaccggcc

SEQ ID NO: 1327943 - RNA, 18 nt, Mycobacterium tuberculosis H37Rv
ggcaacaucgagcgccag

SEQ ID NO: 1327944 - RNA, 12 nt, Mycobacterium tuberculosis H37Rv
ggcaacagggga

SEQ ID NO: 1327945 - RNA, 17 nt, Mycobacterium tuberculosis H37Rv
ggccgaacgccucgccg

SEQ ID NO: 1327946 - RNA, 18 nt, Mycobacterium tuberculosis H37Rv
ggccgaacugccgcgccg

SEQ ID NO: 1327947 - RNA, 20 nt, Mycobacterium tuberculosis H37Rv
ggccgaaccgguagucgccg

SEQ ID NO: 1327948 - RNA, 23 nt, Mycobacterium tuberculosis H37Rv
ggccgaacgacggguccgggcca

SEQ ID NO: 1327949 - RNA, 15 nt, Mycobacterium tuberculosis H37Rv
ggccgaacagcaggc

SEQ ID NO: 1327950 - RNA, 15 nt, Mycobacterium tuberculosis H37Rv
ggccgaaagccaggc

SEQ ID NO: 1327951 - RNA, 19 nt, Mycobacterium tuberculosis H37Rv
ggccgaaagagccagcggc

SEQ ID NO: 1327952 - RNA, 22 nt, Mycobacterium tuberculosis H37Rv
ggccgaaacuucgcccgggccg

SEQ ID NO: 1327953 - RNA, 17 nt, Mycobacterium tuberculosis H37Rv
ggcccuugcucguccag

SEQ ID NO: 1327954 - RNA, 21 nt, Mycobacterium tuberculosis H37Rv
ggcccuuguuggccugcaacg

SEQ ID NO: 1327955 - RNA, 14 nt, Mycobacterium tuberculosis H37Rv
ggcccuggccagcc

SEQ ID NO: 1327956 - RNA, 16 nt, Mycobacterium tuberculosis H37Rv
ggcccugcuggcccaa

SEQ ID NO: 1327957 - RNA, 21 nt, Mycobacterium tuberculosis H37Rv
ggcccugcggccacgguggcg

SEQ ID NO: 1327958 - RNA, 22 nt, Mycobacterium tuberculosis H37Rv
ggcccugcuccucgcgggcggc

SEQ ID NO: 1327959 - RNA, 15 nt, Mycobacterium tuberculosis H37Rv
ggcccgguccagccc

SEQ ID NO: 1327960 - RNA, 22 nt, Mycobacterium tuberculosis H37Rv
ggcccggguugagguaggggca

SEQ ID NO: 1327961 - RNA, 16 nt, Mycobacterium tuberculosis H37Rv
ggcccgggucuccggc

SEQ ID NO: 1327962 - RNA, 19 nt, Mycobacterium tuberculosis H37Rv
ggcccgggucuccggcgca

SEQ ID NO: 1327963 - RNA, 16 nt, Mycobacterium tuberculosis H37Rv
ggcccgggcggccagc

SEQ ID NO: 1327964 - RNA, 17 nt, Mycobacterium tuberculosis H37Rv
ggcccgggcggccagcu

SEQ ID NO: 1327965 - RNA, 20 nt, Mycobacterium tuberculosis H37Rv
ggcccggggacgcccucggg

SEQ ID NO: 1327966 - RNA, 17 nt, Mycobacterium tuberculosis H37Rv
ggcccgggccgaagcgc

SEQ ID NO: 1327967 - RNA, 12 nt, Mycobacterium tuberculosis H37Rv
ggcccgggcccg

SEQ ID NO: 1327968 - RNA, 14 nt, Mycobacterium tuberculosis H37Rv
ggcccggcgcggcc

SEQ ID NO: 1327969 - RNA, 16 nt, Mycobacterium tuberculosis H37Rv
ggcccguagccgagcu

SEQ ID NO: 1327970 - RNA, 14 nt, Mycobacterium tuberculosis H37Rv
ggcccgguucgagg

SEQ ID NO: 1327971 - RNA, 16 nt, Mycobacterium tuberculosis H37Rv
ggcccgucggcgugcg

SEQ ID NO: 1327972 - RNA, 22 nt, Mycobacterium tuberculosis H37Rv
ggcccgucggcgugcggacuga

SEQ ID NO: 1327973 - RNA, 18 nt, Mycobacterium tuberculosis H37Rv
ggcccggucuugggcgcg

SEQ ID NO: 1327974 - RNA, 19 nt, Mycobacterium tuberculosis H37Rv
ggcccggucuugggcgcgg

SEQ ID NO: 1327975 - RNA, 21 nt, Mycobacterium tuberculosis H37Rv
ggcccguuggcagcacaggcu

SEQ ID NO: 1327976 - RNA, 21 nt, Mycobacterium tuberculosis H37Rv
ggcccgugccacagcucgccg

SEQ ID NO: 1327977 - RNA, 19 nt, Mycobacterium tuberculosis H37Rv
ggcccuagccggcgcgccc

SEQ ID NO: 1327978 - RNA, 18 nt, Mycobacterium tuberculosis H37Rv
ggcccuagccggcgcgcc

SEQ ID NO: 1327979 - RNA, 18 nt, Mycobacterium tuberculosis H37Rv
ggcccuccacugcgagcg

SEQ ID NO: 1327980 - RNA, 13 nt, Mycobacterium tuberculosis H37Rv
ggcccuccucggu

SEQ ID NO: 1327981 - RNA, 13 nt, Mycobacterium tuberculosis H37Rv
ggcccucgccaga

SEQ ID NO: 1327982 - RNA, 13 nt, Mycobacterium tuberculosis H37Rv
ggcccucgcgcgc

SEQ ID NO: 1327983 - RNA, 22 nt, Mycobacterium tuberculosis H37Rv
ggcccgacggguaucccguccc

SEQ ID NO: 1327984 - RNA, 23 nt, Mycobacterium tuberculosis H37Rv
ggcccgaggugccggggccccau

SEQ ID NO: 1327985 - RNA, 22 nt, Mycobacterium tuberculosis H37Rv
ggcccgaguuggcgaagcccga

SEQ ID NO: 1327986 - RNA, 19 nt, Mycobacterium tuberculosis H37Rv
ggcccgaccgggaaccacg

SEQ ID NO: 1327987 - RNA, 21 nt, Mycobacterium tuberculosis H37Rv
ggcccgaaaugccgggcccga

SEQ ID NO: 1327988 - RNA, 20 nt, Mycobacterium tuberculosis H37Rv
ggcccgaagaucuccuccug

SEQ ID NO: 1327989 - RNA, 20 nt, Mycobacterium tuberculosis H37Rv
ggcccgacggcgcccagcgc

SEQ ID NO: 1327990 - RNA, 23 nt, Mycobacterium tuberculosis H37Rv
ggcccgauaaaugccgcgugggc

SEQ ID NO: 1327991 - RNA, 12 nt, Mycobacterium tuberculosis H37Rv
ggcccgauccag

SEQ ID NO: 1327992 - RNA, 15 nt, Mycobacterium tuberculosis H37Rv
ggcccgaugaccggu

SEQ ID NO: 1327993 - RNA, 13 nt, Mycobacterium tuberculosis H37Rv
ggcccgcagcagc

SEQ ID NO: 1327994 - RNA, 20 nt, Mycobacterium tuberculosis H37Rv
ggcccgcacggccgcagccg

SEQ ID NO: 1327995 - RNA, 15 nt, Mycobacterium tuberculosis H37Rv
ggcccgcauccgcac

SEQ ID NO: 1327996 - RNA, 22 nt, Mycobacterium tuberculosis H37Rv
ggcccgauugaguucggcggcc

SEQ ID NO: 1327997 - RNA, 14 nt, Mycobacterium tuberculosis H37Rv
ggcccgcaacgcgu

SEQ ID NO: 1327998 - RNA, 21 nt, Mycobacterium tuberculosis H37Rv
ggcccgcucccugcacccagc

SEQ ID NO: 1327999 - RNA, 22 nt, Mycobacterium tuberculosis H37Rv
ggcccgcucgggguugcucgcg

SEQ ID NO: 1328000 - RNA, 23 nt, Mycobacterium tuberculosis H37Rv
ggcccggacaugcgggcagcacu

SEQ ID NO: 1328001 - RNA, 19 nt, Mycobacterium tuberculosis H37Rv
ggcccggacgucggcggcc

SEQ ID NO: 1328002 - RNA, 18 nt, Mycobacterium tuberculosis H37Rv
ggcccggacgucggcggc

SEQ ID NO: 1328003 - RNA, 14 nt, Mycobacterium tuberculosis H37Rv
ggcccggcacccgg

SEQ ID NO: 1328004 - RNA, 15 nt, Mycobacterium tuberculosis H37Rv
ggcccggcaccgcgu

SEQ ID NO: 1328005 - RNA, 14 nt, Mycobacterium tuberculosis H37Rv
ggcccgcucagccg

SEQ ID NO: 1328006 - RNA, 13 nt, Mycobacterium tuberculosis H37Rv
ggcccgcucccug

SEQ ID NO: 1328007 - RNA, 18 nt, Mycobacterium tuberculosis H37Rv
ggcccgccagcagggcca

SEQ ID NO: 1328008 - RNA, 12 nt, Mycobacterium tuberculosis H37Rv
ggcccgcgguga

SEQ ID NO: 1328009 - RNA, 12 nt, Mycobacterium tuberculosis H37Rv
ggcccgcgcgua

SEQ ID NO: 1328010 - RNA, 12 nt, Mycobacterium tuberculosis H37Rv
ggcccgcgcggc

SEQ ID NO: 1328011 - RNA, 14 nt, Mycobacterium tuberculosis H37Rv
ggcccgccggcccc

SEQ ID NO: 1328012 - RNA, 15 nt, Mycobacterium tuberculosis H37Rv
ggcccgccggccccg

SEQ ID NO: 1328013 - RNA, 21 nt, Mycobacterium tuberculosis H37Rv
ggcccgccggccccgccggcc

SEQ ID NO: 1328014 - RNA, 14 nt, Mycobacterium tuberculosis H37Rv
ggcccgccgucacc

SEQ ID NO: 1328015 - RNA, 14 nt, Mycobacterium tuberculosis H37Rv
ggcccgccgucccc

SEQ ID NO: 1328016 - RNA, 19 nt, Mycobacterium tuberculosis H37Rv
ggcccgccgaguucugcug

SEQ ID NO: 1328017 - RNA, 19 nt, Mycobacterium tuberculosis H37Rv
ggcccgcccguagacccac

SEQ ID NO: 1328018 - RNA, 21 nt, Mycobacterium tuberculosis H37Rv
ggcccgccaucauggcggccc

SEQ ID NO: 1328019 - RNA, 21 nt, Mycobacterium tuberculosis H37Rv
ggcccgcccguagacccacag

SEQ ID NO: 1328020 - RNA, 20 nt, Mycobacterium tuberculosis H37Rv
ggcccgccaucauggcggcc

SEQ ID NO: 1328021 - RNA, 20 nt, Mycobacterium tuberculosis H37Rv
ggcccgccacaacggcggcg

SEQ ID NO: 1328022 - RNA, 16 nt, Mycobacterium tuberculosis H37Rv
ggccagggcgguggcc

SEQ ID NO: 1328023 - RNA, 23 nt, Mycobacterium tuberculosis H37Rv
ggccaggcgguacgggucgccgg

SEQ ID NO: 1328024 - RNA, 22 nt, Mycobacterium tuberculosis H37Rv
ggccagcuugcggagccgccgc

SEQ ID NO: 1328025 - RNA, 21 nt, Mycobacterium tuberculosis H37Rv
ggccagcuugcggagccgccg

SEQ ID NO: 1328026 - RNA, 15 nt, Mycobacterium tuberculosis H37Rv
ggccagcugcggcuc

SEQ ID NO: 1328027 - RNA, 14 nt, Mycobacterium tuberculosis H37Rv
ggccagcaagugcg

SEQ ID NO: 1328028 - RNA, 20 nt, Mycobacterium tuberculosis H37Rv
ggccagcaccacggccagcg

SEQ ID NO: 1328029 - RNA, 23 nt, Mycobacterium tuberculosis H37Rv
ggccagcaccacggccagcgggu

SEQ ID NO: 1328030 - RNA, 22 nt, Mycobacterium tuberculosis H37Rv
ggccagcacccgcuccagcucg

SEQ ID NO: 1328031 - RNA, 20 nt, Mycobacterium tuberculosis H37Rv
ggccagcaccucgaccgcca

SEQ ID NO: 1328032 - RNA, 15 nt, Mycobacterium tuberculosis H37Rv
ggccagcaccacggc

SEQ ID NO: 1328033 - RNA, 20 nt, Mycobacterium tuberculosis H37Rv
ggccagcacaccgucgacga

SEQ ID NO: 1328034 - RNA, 14 nt, Mycobacterium tuberculosis H37Rv
ggccagcucggcca

SEQ ID NO: 1328035 - RNA, 17 nt, Mycobacterium tuberculosis H37Rv
ggccagcuccucagcca

SEQ ID NO: 1328036 - RNA, 12 nt, Mycobacterium tuberculosis H37Rv
ggccagcucgcg

SEQ ID NO: 1328037 - RNA, 21 nt, Mycobacterium tuberculosis H37Rv
ggccagcucgcgggccgcguc

SEQ ID NO: 1328038 - RNA, 16 nt, Mycobacterium tuberculosis H37Rv
ggccagcagaucaggu

SEQ ID NO: 1328039 - RNA, 11 nt, Mycobacterium tuberculosis H37Rv
ggccagcagca

SEQ ID NO: 1328040 - RNA, 13 nt, Mycobacterium tuberculosis H37Rv
ggccagcacgccg

SEQ ID NO: 1328041 - RNA, 19 nt, Mycobacterium tuberculosis H37Rv
ggccagcacgccgccggcc

SEQ ID NO: 1328042 - RNA, 24 nt, Mycobacterium tuberculosis H37Rv
ggccagcacgccgccggccgccag

SEQ ID NO: 1328043 - RNA, 19 nt, Mycobacterium tuberculosis H37Rv
ggccaucaccgcgcucucg

SEQ ID NO: 1328044 - RNA, 17 nt, Mycobacterium tuberculosis H37Rv
ggccaucacggucagcu

SEQ ID NO: 1328045 - RNA, 23 nt, Mycobacterium tuberculosis H37Rv
ggccauagugaggccgaccagca

SEQ ID NO: 1328046 - RNA, 15 nt, Mycobacterium tuberculosis H37Rv
ggccauaccgcucgc

SEQ ID NO: 1328047 - RNA, 20 nt, Mycobacterium tuberculosis H37Rv
ggccaguugguagccgcccu

SEQ ID NO: 1328048 - RNA, 23 nt, Mycobacterium tuberculosis H37Rv
ggccaggucgagcaccggcugcg

SEQ ID NO: 1328049 - RNA, 20 nt, Mycobacterium tuberculosis H37Rv
ggccagguaauugccgaccg

SEQ ID NO: 1328050 - RNA, 21 nt, Mycobacterium tuberculosis H37Rv
ggccagguaauugccgaccgc

SEQ ID NO: 1328051 - RNA, 16 nt, Mycobacterium tuberculosis H37Rv
ggccaguucgucggcg

SEQ ID NO: 1328052 - RNA, 16 nt, Mycobacterium tuberculosis H37Rv
ggccaguucggcggcc

SEQ ID NO: 1328053 - RNA, 21 nt, Mycobacterium tuberculosis H37Rv
ggccaguucggcggccgccgc

SEQ ID NO: 1328054 - RNA, 13 nt, Mycobacterium tuberculosis H37Rv
ggccaggucgcca

SEQ ID NO: 1328055 - RNA, 21 nt, Mycobacterium tuberculosis H37Rv
ggccaucgugcggcacucccu

SEQ ID NO: 1328056 - RNA, 13 nt, Mycobacterium tuberculosis H37Rv
ggccaucguccag

SEQ ID NO: 1328057 - RNA, 17 nt, Mycobacterium tuberculosis H37Rv
ggccaucguccagcagg

SEQ ID NO: 1328058 - RNA, 20 nt, Mycobacterium tuberculosis H37Rv
ggccaucgucguggugaugu

SEQ ID NO: 1328059 - RNA, 14 nt, Mycobacterium tuberculosis H37Rv
ggccaucugcucgu

SEQ ID NO: 1328060 - RNA, 21 nt, Mycobacterium tuberculosis H37Rv
ggccauggacgccauggugaa

SEQ ID NO: 1328061 - RNA, 13 nt, Mycobacterium tuberculosis H37Rv
ggcccaccagcgc

SEQ ID NO: 1328062 - RNA, 20 nt, Mycobacterium tuberculosis H37Rv
ggcccacacggucgucgcga

SEQ ID NO: 1328063 - RNA, 15 nt, Mycobacterium tuberculosis H37Rv
ggccccgcggcgccg

SEQ ID NO: 1328064 - RNA, 14 nt, Mycobacterium tuberculosis H37Rv
ggccccgcggcgcc

SEQ ID NO: 1328065 - RNA, 13 nt, Mycobacterium tuberculosis H37Rv
ggccccgcggagc

SEQ ID NO: 1328066 - RNA, 23 nt, Mycobacterium tuberculosis H37Rv
ggccccgccguuuccgccgccgc

SEQ ID NO: 1328067 - RNA, 15 nt, Mycobacterium tuberculosis H37Rv
ggccccgccgucacc

SEQ ID NO: 1328068 - RNA, 15 nt, Mycobacterium tuberculosis H37Rv
ggccccgccggcgcc

SEQ ID NO: 1328069 - RNA, 22 nt, Mycobacterium tuberculosis H37Rv
ggccccgccgaugccgccggcc

SEQ ID NO: 1328070 - RNA, 20 nt, Mycobacterium tuberculosis H37Rv
ggccccgccgaugccgccgg

SEQ ID NO: 1328071 - RNA, 17 nt, Mycobacterium tuberculosis H37Rv
ggccccggggugccccc

SEQ ID NO: 1328072 - RNA, 15 nt, Mycobacterium tuberculosis H37Rv
ggccccgggcgguga

SEQ ID NO: 1328073 - RNA, 19 nt, Mycobacterium tuberculosis H37Rv
ggccccgguggugcugccg

SEQ ID NO: 1328074 - RNA, 17 nt, Mycobacterium tuberculosis H37Rv
ggcccauggcgccuguc

SEQ ID NO: 1328075 - RNA, 19 nt, Mycobacterium tuberculosis H37Rv
ggccccgccagcggcagcg

SEQ ID NO: 1328076 - RNA, 12 nt, Mycobacterium tuberculosis H37Rv
ggccccgccagc

SEQ ID NO: 1328077 - RNA, 23 nt, Mycobacterium tuberculosis H37Rv
ggccccgacauacgucggggccg

SEQ ID NO: 1328078 - RNA, 13 nt, Mycobacterium tuberculosis H37Rv
ggccccaggggca

SEQ ID NO: 1328079 - RNA, 18 nt, Mycobacterium tuberculosis H37Rv
ggcccccacacaggcaga

SEQ ID NO: 1328080 - RNA, 19 nt, Mycobacterium tuberculosis H37Rv
ggcccccacacaggcagau

SEQ ID NO: 1328081 - RNA, 17 nt, Mycobacterium tuberculosis H37Rv
ggccccccggggccgca

SEQ ID NO: 1328082 - RNA, 13 nt, Mycobacterium tuberculosis H37Rv
ggccccccgcgcc

SEQ ID NO: 1328083 - RNA, 18 nt, Mycobacterium tuberculosis H37Rv
ggcccauacgugccgccg

SEQ ID NO: 1328084 - RNA, 18 nt, Mycobacterium tuberculosis H37Rv
ggcccaguuccgcugcgg

SEQ ID NO: 1328085 - RNA, 17 nt, Mycobacterium tuberculosis H37Rv
ggcccauaacagcuggc

SEQ ID NO: 1328086 - RNA, 20 nt, Mycobacterium tuberculosis H37Rv
ggcccagugggacuggcgug

SEQ ID NO: 1328087 - RNA, 22 nt, Mycobacterium tuberculosis H37Rv
ggcccagguccgcgugcugccg

SEQ ID NO: 1328088 - RNA, 16 nt, Mycobacterium tuberculosis H37Rv
ggcccagguugccuug

SEQ ID NO: 1328089 - RNA, 22 nt, Mycobacterium tuberculosis H37Rv
ggcccagguugccuuggcggcc

SEQ ID NO: 1328090 - RNA, 14 nt, Mycobacterium tuberculosis H37Rv
ggcccagcggccgc

SEQ ID NO: 1328091 - RNA, 15 nt, Mycobacterium tuberculosis H37Rv
ggcccagcggccgcg

SEQ ID NO: 1328092 - RNA, 17 nt, Mycobacterium tuberculosis H37Rv
ggcccagcgcgccagcu

SEQ ID NO: 1328093 - RNA, 18 nt, Mycobacterium tuberculosis H37Rv
ggcccagcgcgccagcuu

SEQ ID NO: 1328094 - RNA, 14 nt, Mycobacterium tuberculosis H37Rv
ggcccagccgagcg

SEQ ID NO: 1328095 - RNA, 19 nt, Mycobacterium tuberculosis H37Rv
ggcccagauaucguacugg

SEQ ID NO: 1328096 - RNA, 20 nt, Mycobacterium tuberculosis H37Rv
ggcccagcaggucgucggcg

SEQ ID NO: 1328097 - RNA, 18 nt, Mycobacterium tuberculosis H37Rv
ggcccacggcgaccagga

SEQ ID NO: 1328098 - RNA, 19 nt, Mycobacterium tuberculosis H37Rv
ggcccacauguccagcguc

SEQ ID NO: 1328099 - RNA, 20 nt, Mycobacterium tuberculosis H37Rv
ggcccaccgccguugggccg

SEQ ID NO: 1328100 - RNA, 12 nt, Mycobacterium tuberculosis H37Rv
ggcccacggcag

SEQ ID NO: 1328101 - RNA, 21 nt, Mycobacterium tuberculosis H37Rv
ggcccacggugcgauccccaa

SEQ ID NO: 1328102 - RNA, 19 nt, Mycobacterium tuberculosis H37Rv
ggcccacuugugacccggc

SEQ ID NO: 1328103 - RNA, 18 nt, Mycobacterium tuberculosis H37Rv
ggcagccgcgccgcggcc

SEQ ID NO: 1328104 - RNA, 19 nt, Mycobacterium tuberculosis H37Rv
ggcagccgaagcgcccguu

SEQ ID NO: 1328105 - RNA, 13 nt, Mycobacterium tuberculosis H37Rv
ggcagccgcccgc

SEQ ID NO: 1328106 - RNA, 13 nt, Mycobacterium tuberculosis H37Rv
ggcagcccgucgg

SEQ ID NO: 1328107 - RNA, 18 nt, Mycobacterium tuberculosis H37Rv
ggcagcccggcggccgcu

SEQ ID NO: 1328108 - RNA, 13 nt, Mycobacterium tuberculosis H37Rv
ggcagcccggcgg

SEQ ID NO: 1328109 - RNA, 22 nt, Mycobacterium tuberculosis H37Rv
ggcagcccaaagcgccagcagc

SEQ ID NO: 1328110 - RNA, 19 nt, Mycobacterium tuberculosis H37Rv
ggcagcgaccgucguccag

SEQ ID NO: 1328111 - RNA, 16 nt, Mycobacterium tuberculosis H37Rv
ggcagcgacgccggcc

SEQ ID NO: 1328112 - RNA, 12 nt, Mycobacterium tuberculosis H37Rv
ggcagccugcug

SEQ ID NO: 1328113 - RNA, 13 nt, Mycobacterium tuberculosis H37Rv
ggcagccugcugc

SEQ ID NO: 1328114 - RNA, 23 nt, Mycobacterium tuberculosis H37Rv
ggcagccucucgcuuaggucgcu

SEQ ID NO: 1328115 - RNA, 19 nt, Mycobacterium tuberculosis H37Rv
ggcagccggcggagagggc

SEQ ID NO: 1328116 - RNA, 14 nt, Mycobacterium tuberculosis H37Rv
ggcagccgggcguc

SEQ ID NO: 1328117 - RNA, 13 nt, Mycobacterium tuberculosis H37Rv
ggcagcaacaggc

SEQ ID NO: 1328118 - RNA, 12 nt, Mycobacterium tuberculosis H37Rv
ggcagcaaaaac

SEQ ID NO: 1328119 - RNA, 19 nt, Mycobacterium tuberculosis H37Rv
ggcagcaaaaacgcugccg

SEQ ID NO: 1328120 - RNA, 18 nt, Mycobacterium tuberculosis H37Rv
ggcagauucuucacccaa

SEQ ID NO: 1328121 - RNA, 13 nt, Mycobacterium tuberculosis H37Rv
ggcagccagcggc

SEQ ID NO: 1328122 - RNA, 12 nt, Mycobacterium tuberculosis H37Rv
ggcagccagggc

SEQ ID NO: 1328123 - RNA, 20 nt, Mycobacterium tuberculosis H37Rv
ggcagaccgaucggcaggcc

SEQ ID NO: 1328124 - RNA, 13 nt, Mycobacterium tuberculosis H37Rv
ggcagagccgacu

SEQ ID NO: 1328125 - RNA, 12 nt, Mycobacterium tuberculosis H37Rv
ggcagagccgcc

SEQ ID NO: 1328126 - RNA, 19 nt, Mycobacterium tuberculosis H37Rv
ggcagaccgaucggcaggc

SEQ ID NO: 1328127 - RNA, 19 nt, Mycobacterium tuberculosis H37Rv
ggcagacauggcaagucaa

SEQ ID NO: 1328128 - RNA, 21 nt, Mycobacterium tuberculosis H37Rv
ggcagaacuggacaagcuccu

SEQ ID NO: 1328129 - RNA, 20 nt, Mycobacterium tuberculosis H37Rv
ggcaagucaacaccgcggcc

SEQ ID NO: 1328130 - RNA, 22 nt, Mycobacterium tuberculosis H37Rv
ggcaagccauucacgagccgcu

SEQ ID NO: 1328131 - RNA, 18 nt, Mycobacterium tuberculosis H37Rv
ggcaagccgauugcuucu

SEQ ID NO: 1328132 - RNA, 21 nt, Mycobacterium tuberculosis H37Rv
ggcaaggccuugcguguacca

SEQ ID NO: 1328133 - RNA, 22 nt, Mycobacterium tuberculosis H37Rv
ggcaagcgcaucgcacagcgcc

SEQ ID NO: 1328134 - RNA, 15 nt, Mycobacterium tuberculosis H37Rv
ggcaaggucgcggcc

SEQ ID NO: 1328135 - RNA, 14 nt, Mycobacterium tuberculosis H37Rv
ggcaagggccgacg

SEQ ID NO: 1328136 - RNA, 14 nt, Mycobacterium tuberculosis H37Rv
ggcaaggcggcggc

SEQ ID NO: 1328137 - RNA, 22 nt, Mycobacterium tuberculosis H37Rv
ggcagcucccgccacgucgccg

SEQ ID NO: 1328138 - RNA, 14 nt, Mycobacterium tuberculosis H37Rv
ggcagcuccgccgc

SEQ ID NO: 1328139 - RNA, 13 nt, Mycobacterium tuberculosis H37Rv
ggcagcuccacca

SEQ ID NO: 1328140 - RNA, 15 nt, Mycobacterium tuberculosis H37Rv
ggcagcuacggggcg

SEQ ID NO: 1328141 - RNA, 14 nt, Mycobacterium tuberculosis H37Rv
ggcagcucguccag

SEQ ID NO: 1328142 - RNA, 18 nt, Mycobacterium tuberculosis H37Rv
ggcagcuucucgccgacg

SEQ ID NO: 1328143 - RNA, 14 nt, Mycobacterium tuberculosis H37Rv
ggcagcugggcagg

SEQ ID NO: 1328144 - RNA, 21 nt, Mycobacterium tuberculosis H37Rv
ggcagcugguaaccggcggca

SEQ ID NO: 1328145 - RNA, 22 nt, Mycobacterium tuberculosis H37Rv
ggcagcuggucggugggcuugc

SEQ ID NO: 1328146 - RNA, 16 nt, Mycobacterium tuberculosis H37Rv
ggcagcuuggacucau

SEQ ID NO: 1328147 - RNA, 14 nt, Mycobacterium tuberculosis H37Rv
ggcagcgcccccgg

SEQ ID NO: 1328148 - RNA, 21 nt, Mycobacterium tuberculosis H37Rv
ggcagcgcacccggucggcgg

SEQ ID NO: 1328149 - RNA, 20 nt, Mycobacterium tuberculosis H37Rv
ggcagcgaugcggugucggg

SEQ ID NO: 1328150 - RNA, 19 nt, Mycobacterium tuberculosis H37Rv
ggcagcgcccagaucgccg

SEQ ID NO: 1328151 - RNA, 16 nt, Mycobacterium tuberculosis H37Rv
ggcaggagcagcacgu

SEQ ID NO: 1328152 - RNA, 16 nt, Mycobacterium tuberculosis H37Rv
ggcaggagaacacauc

SEQ ID NO: 1328153 - RNA, 20 nt, Mycobacterium tuberculosis H37Rv
ggcaggagaacacauccgcu

SEQ ID NO: 1328154 - RNA, 12 nt, Mycobacterium tuberculosis H37Rv
ggcaggacuugg

SEQ ID NO: 1328155 - RNA, 14 nt, Mycobacterium tuberculosis H37Rv
ggcaggcagggcag

SEQ ID NO: 1328156 - RNA, 14 nt, Mycobacterium tuberculosis H37Rv
ggcaggcagguugg

SEQ ID NO: 1328157 - RNA, 20 nt, Mycobacterium tuberculosis H37Rv
ggcaggaucgccugagcgcc

SEQ ID NO: 1328158 - RNA, 21 nt, Mycobacterium tuberculosis H37Rv
ggcaggccgcugggccgaccg

SEQ ID NO: 1328159 - RNA, 14 nt, Mycobacterium tuberculosis H37Rv
ggcaggcccgacgg

SEQ ID NO: 1328160 - RNA, 13 nt, Mycobacterium tuberculosis H37Rv
ggcaggccgggca

SEQ ID NO: 1328161 - RNA, 14 nt, Mycobacterium tuberculosis H37Rv
ggcaggccagcaug

SEQ ID NO: 1328162 - RNA, 17 nt, Mycobacterium tuberculosis H37Rv
ggcaggccauccgggcu

SEQ ID NO: 1328163 - RNA, 21 nt, Mycobacterium tuberculosis H37Rv
ggcaggcagcucggcaacgug

SEQ ID NO: 1328164 - RNA, 22 nt, Mycobacterium tuberculosis H37Rv
ggcaggcuuagcuuccggguuc

SEQ ID NO: 1328165 - RNA, 15 nt, Mycobacterium tuberculosis H37Rv
ggcaggcuggcgagg

SEQ ID NO: 1328166 - RNA, 17 nt, Mycobacterium tuberculosis H37Rv
ggcaggcuggcgagggc

SEQ ID NO: 1328167 - RNA, 19 nt, Mycobacterium tuberculosis H37Rv
ggcaggcuggcgagggcug

SEQ ID NO: 1328168 - RNA, 14 nt, Mycobacterium tuberculosis H37Rv
ggcagggcagcccg

SEQ ID NO: 1328169 - RNA, 15 nt, Mycobacterium tuberculosis H37Rv
ggcagggccagcggc

SEQ ID NO: 1328170 - RNA, 14 nt, Mycobacterium tuberculosis H37Rv
ggcagggccuggaa

SEQ ID NO: 1328171 - RNA, 23 nt, Mycobacterium tuberculosis H37Rv
ggcaggccucggcgccgcccagc

SEQ ID NO: 1328172 - RNA, 20 nt, Mycobacterium tuberculosis H37Rv
ggcaggccucggcgccgccc

SEQ ID NO: 1328173 - RNA, 15 nt, Mycobacterium tuberculosis H37Rv
ggcaggccucggcgc

SEQ ID NO: 1328174 - RNA, 15 nt, Mycobacterium tuberculosis H37Rv
ggcaggcggccgccg

SEQ ID NO: 1328175 - RNA, 20 nt, Mycobacterium tuberculosis H37Rv
ggcaggcuaaucagccaggc

SEQ ID NO: 1328176 - RNA, 14 nt, Mycobacterium tuberculosis H37Rv
ggcaggcggccagc

SEQ ID NO: 1328177 - RNA, 15 nt, Mycobacterium tuberculosis H37Rv
ggcaggcggccagcg

SEQ ID NO: 1328178 - RNA, 21 nt, Mycobacterium tuberculosis H37Rv
ggcaucaccgccgcggccgcc

SEQ ID NO: 1328179 - RNA, 13 nt, Mycobacterium tuberculosis H37Rv
ggcaucaccuggc

SEQ ID NO: 1328180 - RNA, 19 nt, Mycobacterium tuberculosis H37Rv
ggcaucaccuggcgugucg

SEQ ID NO: 1328181 - RNA, 22 nt, Mycobacterium tuberculosis H37Rv
ggcaucaccgacgcgucggcga

SEQ ID NO: 1328182 - RNA, 18 nt, Mycobacterium tuberculosis H37Rv
ggcaucagcagagccccg

SEQ ID NO: 1328183 - RNA, 17 nt, Mycobacterium tuberculosis H37Rv
ggcauccagcagcgccu

SEQ ID NO: 1328184 - RNA, 14 nt, Mycobacterium tuberculosis H37Rv
ggcaucagcagagc

SEQ ID NO: 1328185 - RNA, 19 nt, Mycobacterium tuberculosis H37Rv
ggcaucgcgagccagcugc

SEQ ID NO: 1328186 - RNA, 23 nt, Mycobacterium tuberculosis H37Rv
ggcaucgcgaauauagcggcguu

SEQ ID NO: 1328187 - RNA, 17 nt, Mycobacterium tuberculosis H37Rv
ggcaucgcgagccagcu

SEQ ID NO: 1328188 - RNA, 21 nt, Mycobacterium tuberculosis H37Rv
ggcaucgcgagccagcugcuc

SEQ ID NO: 1328189 - RNA, 18 nt, Mycobacterium tuberculosis H37Rv
ggcaggguggccagcagg

SEQ ID NO: 1328190 - RNA, 19 nt, Mycobacterium tuberculosis H37Rv
ggcaggguggccagcaggc

SEQ ID NO: 1328191 - RNA, 13 nt, Mycobacterium tuberculosis H37Rv
ggcaggguggggc

SEQ ID NO: 1328192 - RNA, 20 nt, Mycobacterium tuberculosis H37Rv
ggcagguuggccaccgccca

SEQ ID NO: 1328193 - RNA, 15 nt, Mycobacterium tuberculosis H37Rv
ggcaggugaucccga

SEQ ID NO: 1328194 - RNA, 20 nt, Mycobacterium tuberculosis H37Rv
ggcaucggcggcgucuucgu

SEQ ID NO: 1328195 - RNA, 23 nt, Mycobacterium tuberculosis H37Rv
ggcaucggaggaaccccgcgcgg

SEQ ID NO: 1328196 - RNA, 14 nt, Mycobacterium tuberculosis H37Rv
ggcaucgucgccga

SEQ ID NO: 1328197 - RNA, 13 nt, Mycobacterium tuberculosis H37Rv
ggcaucggugcgg

SEQ ID NO: 1328198 - RNA, 23 nt, Mycobacterium tuberculosis H37Rv
ggcaucuccaccgucgccgccgg

SEQ ID NO: 1328199 - RNA, 20 nt, Mycobacterium tuberculosis H37Rv
ggcaugcgacagaugccggg

SEQ ID NO: 1328200 - RNA, 22 nt, Mycobacterium tuberculosis H37Rv
ggcaugcucgacaaccgcccgc

SEQ ID NO: 1328201 - RNA, 20 nt, Mycobacterium tuberculosis H37Rv
ggcaucuccaccgucgccgc

SEQ ID NO: 1328202 - RNA, 18 nt, Mycobacterium tuberculosis H37Rv
ggccaccgccgccgccga

SEQ ID NO: 1328203 - RNA, 18 nt, Mycobacterium tuberculosis H37Rv
ggccaccgccgccugccc

SEQ ID NO: 1328204 - RNA, 14 nt, Mycobacterium tuberculosis H37Rv
ggccaccggcgacc

SEQ ID NO: 1328205 - RNA, 13 nt, Mycobacterium tuberculosis H37Rv
ggccaccggcggu

SEQ ID NO: 1328206 - RNA, 16 nt, Mycobacterium tuberculosis H37Rv
ggccaccggcggucug

SEQ ID NO: 1328207 - RNA, 21 nt, Mycobacterium tuberculosis H37Rv
ggccaccggcgucugcccgcc

SEQ ID NO: 1328208 - RNA, 23 nt, Mycobacterium tuberculosis H37Rv
ggccaccggcugcaaccagcggc

SEQ ID NO: 1328209 - RNA, 18 nt, Mycobacterium tuberculosis H37Rv
ggccaccgucgcggcggc

SEQ ID NO: 1328210 - RNA, 17 nt, Mycobacterium tuberculosis H37Rv
ggccaccguagccagca

SEQ ID NO: 1328211 - RNA, 20 nt, Mycobacterium tuberculosis H37Rv
ggccaccguaaacagcgcgc

SEQ ID NO: 1328212 - RNA, 16 nt, Mycobacterium tuberculosis H37Rv
ggccaccucuucucgg

SEQ ID NO: 1328213 - RNA, 19 nt, Mycobacterium tuberculosis H37Rv
ggccaccguagccagcagg

SEQ ID NO: 1328214 - RNA, 12 nt, Mycobacterium tuberculosis H37Rv
ggccaccguccc

SEQ ID NO: 1328215 - RNA, 20 nt, Mycobacterium tuberculosis H37Rv
ggccaccuuagcgcuugccg

SEQ ID NO: 1328216 - RNA, 16 nt, Mycobacterium tuberculosis H37Rv
ggccacgaacccucag

SEQ ID NO: 1328217 - RNA, 15 nt, Mycobacterium tuberculosis H37Rv
ggccacgaccucggg

SEQ ID NO: 1328218 - RNA, 18 nt, Mycobacterium tuberculosis H37Rv
ggccacgaugaucccaag

SEQ ID NO: 1328219 - RNA, 18 nt, Mycobacterium tuberculosis H37Rv
ggccacgccagcucgccg

SEQ ID NO: 1328220 - RNA, 14 nt, Mycobacterium tuberculosis H37Rv
ggccacgcccaggc

SEQ ID NO: 1328221 - RNA, 19 nt, Mycobacterium tuberculosis H37Rv
ggccacuugaugcucgaug

SEQ ID NO: 1328222 - RNA, 23 nt, Mycobacterium tuberculosis H37Rv
ggccacgcuucuuccgcgcgccg

SEQ ID NO: 1328223 - RNA, 15 nt, Mycobacterium tuberculosis H37Rv
ggccagacccaccac

SEQ ID NO: 1328224 - RNA, 15 nt, Mycobacterium tuberculosis H37Rv
ggccagaccgcgcgc

SEQ ID NO: 1328225 - RNA, 18 nt, Mycobacterium tuberculosis H37Rv
ggccagagccgcgcgccg

SEQ ID NO: 1328226 - RNA, 15 nt, Mycobacterium tuberculosis H37Rv
ggccagagccgcgcg

SEQ ID NO: 1328227 - RNA, 14 nt, Mycobacterium tuberculosis H37Rv
ggccagagccgccc

SEQ ID NO: 1328228 - RNA, 18 nt, Mycobacterium tuberculosis H37Rv
ggccaauggccugcagcg

SEQ ID NO: 1328229 - RNA, 22 nt, Mycobacterium tuberculosis H37Rv
ggccaaugacgucggaccagcu

SEQ ID NO: 1328230 - RNA, 14 nt, Mycobacterium tuberculosis H37Rv
ggccaagccgcggc

SEQ ID NO: 1328231 - RNA, 14 nt, Mycobacterium tuberculosis H37Rv
ggccaccgccgccg

SEQ ID NO: 1328232 - RNA, 17 nt, Mycobacterium tuberculosis H37Rv
ggccaaucagcccgccg

SEQ ID NO: 1328233 - RNA, 13 nt, Mycobacterium tuberculosis H37Rv
ggccaagggugcu

SEQ ID NO: 1328234 - RNA, 21 nt, Mycobacterium tuberculosis H37Rv
ggccaagggugcuugucgccg

SEQ ID NO: 1328235 - RNA, 15 nt, Mycobacterium tuberculosis H37Rv
ggccaagguggccac

SEQ ID NO: 1328236 - RNA, 21 nt, Mycobacterium tuberculosis H37Rv
ggcauuccuugauaacgaccc

SEQ ID NO: 1328237 - RNA, 13 nt, Mycobacterium tuberculosis H37Rv
ggcauugcggccc

SEQ ID NO: 1328238 - RNA, 21 nt, Mycobacterium tuberculosis H37Rv
ggcauuaccacuucggcgucc

SEQ ID NO: 1328239 - RNA, 19 nt, Mycobacterium tuberculosis H37Rv
ggcgccuuggucgccgccu

SEQ ID NO: 1328240 - RNA, 22 nt, Mycobacterium tuberculosis H37Rv
ggcgccuugguccguagcgcgg

SEQ ID NO: 1328241 - RNA, 17 nt, Mycobacterium tuberculosis H37Rv
ggcgccgucgcccagcg

SEQ ID NO: 1328242 - RNA, 13 nt, Mycobacterium tuberculosis H37Rv
ggcgccgucgccg

SEQ ID NO: 1328243 - RNA, 11 nt, Mycobacterium tuberculosis H37Rv
ggcgccuuggu

SEQ ID NO: 1328244 - RNA, 17 nt, Mycobacterium tuberculosis H37Rv
ggcgccggugcggcggg

SEQ ID NO: 1328245 - RNA, 14 nt, Mycobacterium tuberculosis H37Rv
ggcgccggugggcg

SEQ ID NO: 1328246 - RNA, 16 nt, Mycobacterium tuberculosis H37Rv
ggcgccggugccgccu

SEQ ID NO: 1328247 - RNA, 15 nt, Mycobacterium tuberculosis H37Rv
ggcgccggggccgcc

SEQ ID NO: 1328248 - RNA, 22 nt, Mycobacterium tuberculosis H37Rv
ggcgccggcgucggcgcccagc

SEQ ID NO: 1328249 - RNA, 16 nt, Mycobacterium tuberculosis H37Rv
ggcgcgacagccgugg

SEQ ID NO: 1328250 - RNA, 19 nt, Mycobacterium tuberculosis H37Rv
ggcgcgaauauucgcuggg

SEQ ID NO: 1328251 - RNA, 18 nt, Mycobacterium tuberculosis H37Rv
ggcgcgcagguagcgcuc

SEQ ID NO: 1328252 - RNA, 17 nt, Mycobacterium tuberculosis H37Rv
ggcgccgccggcaccgg

SEQ ID NO: 1328253 - RNA, 13 nt, Mycobacterium tuberculosis H37Rv
ggcgccgccggcg

SEQ ID NO: 1328254 - RNA, 15 nt, Mycobacterium tuberculosis H37Rv
ggcgccgccggcgcc

SEQ ID NO: 1328255 - RNA, 16 nt, Mycobacterium tuberculosis H37Rv
ggcgccgccggugcca

SEQ ID NO: 1328256 - RNA, 22 nt, Mycobacterium tuberculosis H37Rv
ggcgccgcgccgauuccaccgc

SEQ ID NO: 1328257 - RNA, 22 nt, Mycobacterium tuberculosis H37Rv
ggcgccgccguuaccgccggcg

SEQ ID NO: 1328258 - RNA, 23 nt, Mycobacterium tuberculosis H37Rv
ggcgccgccguccagcgccgcgg

SEQ ID NO: 1328259 - RNA, 12 nt, Mycobacterium tuberculosis H37Rv
ggcgccgcgcgc

SEQ ID NO: 1328260 - RNA, 16 nt, Mycobacterium tuberculosis H37Rv
ggcgccgcgcucgacg

SEQ ID NO: 1328261 - RNA, 23 nt, Mycobacterium tuberculosis H37Rv
ggcgccaguucggcgggagcugc

SEQ ID NO: 1328262 - RNA, 15 nt, Mycobacterium tuberculosis H37Rv
ggcgccaggucggcg

SEQ ID NO: 1328263 - RNA, 17 nt, Mycobacterium tuberculosis H37Rv
ggcgccaggucggcggg

SEQ ID NO: 1328264 - RNA, 14 nt, Mycobacterium tuberculosis H37Rv
ggcgccagccccgc

SEQ ID NO: 1328265 - RNA, 12 nt, Mycobacterium tuberculosis H37Rv
ggcgccagcgcc

SEQ ID NO: 1328266 - RNA, 20 nt, Mycobacterium tuberculosis H37Rv
ggcgcggucgaccugagccc

SEQ ID NO: 1328267 - RNA, 13 nt, Mycobacterium tuberculosis H37Rv
ggcgcggugccgg

SEQ ID NO: 1328268 - RNA, 23 nt, Mycobacterium tuberculosis H37Rv
ggcgcgguuucggcgucaccgug

SEQ ID NO: 1328269 - RNA, 21 nt, Mycobacterium tuberculosis H37Rv
ggcgcugaucgcgcgcaccgg

SEQ ID NO: 1328270 - RNA, 22 nt, Mycobacterium tuberculosis H37Rv
ggcgcgucggcguuggggcucg

SEQ ID NO: 1328271 - RNA, 19 nt, Mycobacterium tuberculosis H37Rv
ggcgcugauccggucggcc

SEQ ID NO: 1328272 - RNA, 23 nt, Mycobacterium tuberculosis H37Rv
ggcgcguccucgccgcacgccgg

SEQ ID NO: 1328273 - RNA, 18 nt, Mycobacterium tuberculosis H37Rv
ggcgcgucauggcgagua

SEQ ID NO: 1328274 - RNA, 18 nt, Mycobacterium tuberculosis H37Rv
ggcgcguccgggcucgcg

SEQ ID NO: 1328275 - RNA, 15 nt, Mycobacterium tuberculosis H37Rv
ggcggacaccucggg

SEQ ID NO: 1328276 - RNA, 20 nt, Mycobacterium tuberculosis H37Rv
ggcgcugcggcgugccgggu

SEQ ID NO: 1328277 - RNA, 22 nt, Mycobacterium tuberculosis H37Rv
ggcggacaccucgggcgcccgc

SEQ ID NO: 1328278 - RNA, 14 nt, Mycobacterium tuberculosis H37Rv
ggcggaccgcagcg

SEQ ID NO: 1328279 - RNA, 23 nt, Mycobacterium tuberculosis H37Rv
ggcggacccggugacccgcuggg

SEQ ID NO: 1328280 - RNA, 15 nt, Mycobacterium tuberculosis H37Rv
ggcggacccucgccg

SEQ ID NO: 1328281 - RNA, 19 nt, Mycobacterium tuberculosis H37Rv
ggcggaccaggccgcgcgc

SEQ ID NO: 1328282 - RNA, 22 nt, Mycobacterium tuberculosis H37Rv
ggcggaccaggccgcgcgcacc

SEQ ID NO: 1328283 - RNA, 20 nt, Mycobacterium tuberculosis H37Rv
ggcggacccggugacccgcu

SEQ ID NO: 1328284 - RNA, 14 nt, Mycobacterium tuberculosis H37Rv
ggcgcugcccgccg

SEQ ID NO: 1328285 - RNA, 19 nt, Mycobacterium tuberculosis H37Rv
ggcgcugcccgggcugccg

SEQ ID NO: 1328286 - RNA, 11 nt, Mycobacterium tuberculosis H37Rv
ggcgcugccaa

SEQ ID NO: 1328287 - RNA, 16 nt, Mycobacterium tuberculosis H37Rv
ggcgcgccgcacccgg

SEQ ID NO: 1328288 - RNA, 19 nt, Mycobacterium tuberculosis H37Rv
ggcgcggccgcagccagca

SEQ ID NO: 1328289 - RNA, 14 nt, Mycobacterium tuberculosis H37Rv
ggcgcggccgugaa

SEQ ID NO: 1328290 - RNA, 21 nt, Mycobacterium tuberculosis H37Rv
ggcgcggccgugaacggcgcg

SEQ ID NO: 1328291 - RNA, 22 nt, Mycobacterium tuberculosis H37Rv
ggcgcgcggguugucggcgacc

SEQ ID NO: 1328292 - RNA, 19 nt, Mycobacterium tuberculosis H37Rv
ggcgcggaacgcgucgccg

SEQ ID NO: 1328293 - RNA, 13 nt, Mycobacterium tuberculosis H37Rv
ggcggccagcgcg

SEQ ID NO: 1328294 - RNA, 14 nt, Mycobacterium tuberculosis H37Rv
ggcggccagcucgg

SEQ ID NO: 1328295 - RNA, 20 nt, Mycobacterium tuberculosis H37Rv
ggcggccagcgcgucgccgu

SEQ ID NO: 1328296 - RNA, 21 nt, Mycobacterium tuberculosis H37Rv
ggcggccagcuccagcgccgc

SEQ ID NO: 1328297 - RNA, 23 nt, Mycobacterium tuberculosis H37Rv
ggcggccaugucagcggccugcu

SEQ ID NO: 1328298 - RNA, 14 nt, Mycobacterium tuberculosis H37Rv
ggcggccgggcucc

SEQ ID NO: 1328299 - RNA, 20 nt, Mycobacterium tuberculosis H37Rv
ggcggccuggucggccaggu

SEQ ID NO: 1328300 - RNA, 13 nt, Mycobacterium tuberculosis H37Rv
ggcggccuccucc

SEQ ID NO: 1328301 - RNA, 11 nt, Mycobacterium tuberculosis H37Rv
ggcggccuccg

SEQ ID NO: 1328302 - RNA, 15 nt, Mycobacterium tuberculosis H37Rv
ggcggccggguagca

SEQ ID NO: 1328303 - RNA, 22 nt, Mycobacterium tuberculosis H37Rv
ggcggccguggcuggacccgca

SEQ ID NO: 1328304 - RNA, 22 nt, Mycobacterium tuberculosis H37Rv
ggcggcaggaaucgggucagca

SEQ ID NO: 1328305 - RNA, 22 nt, Mycobacterium tuberculosis H37Rv
ggcggcagguagaucagcaugc

SEQ ID NO: 1328306 - RNA, 19 nt, Mycobacterium tuberculosis H37Rv
ggcggcaucgggguuggug

SEQ ID NO: 1328307 - RNA, 20 nt, Mycobacterium tuberculosis H37Rv
ggcggcaucggugguaacac

SEQ ID NO: 1328308 - RNA, 23 nt, Mycobacterium tuberculosis H37Rv
ggcggcauccugcacgacccgcu

SEQ ID NO: 1328309 - RNA, 16 nt, Mycobacterium tuberculosis H37Rv
ggcggcaucgaggcca

SEQ ID NO: 1328310 - RNA, 20 nt, Mycobacterium tuberculosis H37Rv
ggcggcaucgaggccagcag

SEQ ID NO: 1328311 - RNA, 11 nt, Mycobacterium tuberculosis H37Rv
ggcggccagcg

SEQ ID NO: 1328312 - RNA, 10 nt, Mycobacterium tuberculosis H37Rv
ggcggccagc

SEQ ID NO: 1328313 - RNA, 11 nt, Mycobacterium tuberculosis H37Rv
ggcggccagca

SEQ ID NO: 1328314 - RNA, 18 nt, Mycobacterium tuberculosis H37Rv
ggcggagcgaugcgggca

SEQ ID NO: 1328315 - RNA, 17 nt, Mycobacterium tuberculosis H37Rv
ggcggacugagagaugg

SEQ ID NO: 1328316 - RNA, 16 nt, Mycobacterium tuberculosis H37Rv
ggcggagacggcggcc

SEQ ID NO: 1328317 - RNA, 18 nt, Mycobacterium tuberculosis H37Rv
ggcggaucccgaggcgcc

SEQ ID NO: 1328318 - RNA, 17 nt, Mycobacterium tuberculosis H37Rv
ggcggaucccgaggcgc

SEQ ID NO: 1328319 - RNA, 18 nt, Mycobacterium tuberculosis H37Rv
ggcggaucgccggggacg

SEQ ID NO: 1328320 - RNA, 15 nt, Mycobacterium tuberculosis H37Rv
ggcggaucgcgagcg

SEQ ID NO: 1328321 - RNA, 17 nt, Mycobacterium tuberculosis H37Rv
ggcggauaguucaccac

SEQ ID NO: 1328322 - RNA, 22 nt, Mycobacterium tuberculosis H37Rv
ggcggcaaccucaugcacgccg

SEQ ID NO: 1328323 - RNA, 18 nt, Mycobacterium tuberculosis H37Rv
ggcggaugaugcaacgcc

SEQ ID NO: 1328324 - RNA, 16 nt, Mycobacterium tuberculosis H37Rv
ggcggcaaagagcagc

SEQ ID NO: 1328325 - RNA, 20 nt, Mycobacterium tuberculosis H37Rv
ggcggaugcuguugacccgu

SEQ ID NO: 1328326 - RNA, 12 nt, Mycobacterium tuberculosis H37Rv
ggcggcagcggc

SEQ ID NO: 1328327 - RNA, 16 nt, Mycobacterium tuberculosis H37Rv
ggcggcacuacgcagc

SEQ ID NO: 1328328 - RNA, 17 nt, Mycobacterium tuberculosis H37Rv
ggcggugggcagcagcu

SEQ ID NO: 1328329 - RNA, 14 nt, Mycobacterium tuberculosis H37Rv
ggcggugggcagca

SEQ ID NO: 1328330 - RNA, 13 nt, Mycobacterium tuberculosis H37Rv
ggcgguggggcug

SEQ ID NO: 1328331 - RNA, 14 nt, Mycobacterium tuberculosis H37Rv
ggcgguguccagaa

SEQ ID NO: 1328332 - RNA, 23 nt, Mycobacterium tuberculosis H37Rv
ggcgguaguacucgcgcagguag

SEQ ID NO: 1328333 - RNA, 22 nt, Mycobacterium tuberculosis H37Rv
ggcggucaccaccguggcgccc

SEQ ID NO: 1328334 - RNA, 15 nt, Mycobacterium tuberculosis H37Rv
ggcgguggcggugcu

SEQ ID NO: 1328335 - RNA, 16 nt, Mycobacterium tuberculosis H37Rv
ggcgguggcggugcug

SEQ ID NO: 1328336 - RNA, 21 nt, Mycobacterium tuberculosis H37Rv
ggcgguuccauacagccgccg

SEQ ID NO: 1328337 - RNA, 23 nt, Mycobacterium tuberculosis H37Rv
ggcggugucgucaucggggccug

SEQ ID NO: 1328338 - RNA, 16 nt, Mycobacterium tuberculosis H37Rv
ggcggugucggcgccg

SEQ ID NO: 1328339 - RNA, 14 nt, Mycobacterium tuberculosis H37Rv
ggcggugucggcgc

SEQ ID NO: 1328340 - RNA, 14 nt, Mycobacterium tuberculosis H37Rv
ggcggugucgaccu

SEQ ID NO: 1328341 - RNA, 16 nt, Mycobacterium tuberculosis H37Rv
ggcggguggugcggcc

SEQ ID NO: 1328342 - RNA, 17 nt, Mycobacterium tuberculosis H37Rv
ggcgguagacaccccac

SEQ ID NO: 1328343 - RNA, 14 nt, Mycobacterium tuberculosis H37Rv
ggcgguagccgacg

SEQ ID NO: 1328344 - RNA, 14 nt, Mycobacterium tuberculosis H37Rv
ggcggggugcgccc

SEQ ID NO: 1328345 - RNA, 17 nt, Mycobacterium tuberculosis H37Rv
ggcggguaagcgaccga

SEQ ID NO: 1328346 - RNA, 15 nt, Mycobacterium tuberculosis H37Rv
ggcgggugcgacauc

SEQ ID NO: 1328347 - RNA, 14 nt, Mycobacterium tuberculosis H37Rv
ggcggguggcuccu

SEQ ID NO: 1328348 - RNA, 13 nt, Mycobacterium tuberculosis H37Rv
ggcgggcucgccc

SEQ ID NO: 1328349 - RNA, 14 nt, Mycobacterium tuberculosis H37Rv
ggcgggcugguguc

SEQ ID NO: 1328350 - RNA, 24 nt, Mycobacterium tuberculosis H37Rv
ggcgggcucuacucgcggccggcg

SEQ ID NO: 1328351 - RNA, 23 nt, Mycobacterium tuberculosis H37Rv
ggcgggggcgucgccgccgggca

SEQ ID NO: 1328352 - RNA, 13 nt, Mycobacterium tuberculosis H37Rv
ggcggggccggcg

SEQ ID NO: 1328353 - RNA, 12 nt, Mycobacterium tuberculosis H37Rv
ggcggggauccg

SEQ ID NO: 1328354 - RNA, 19 nt, Mycobacterium tuberculosis H37Rv
ggcgggacaaccgggcggg

SEQ ID NO: 1328355 - RNA, 16 nt, Mycobacterium tuberculosis H37Rv
ggcgggagcgugggcg

SEQ ID NO: 1328356 - RNA, 23 nt, Mycobacterium tuberculosis H37Rv
ggcgggauauagccggugucugg

SEQ ID NO: 1328357 - RNA, 16 nt, Mycobacterium tuberculosis H37Rv
ggcgggaugcgcgccc

SEQ ID NO: 1328358 - RNA, 16 nt, Mycobacterium tuberculosis H37Rv
ggcgggauggccgccg

SEQ ID NO: 1328359 - RNA, 14 nt, Mycobacterium tuberculosis H37Rv
ggcgggcacgcaca

SEQ ID NO: 1328360 - RNA, 15 nt, Mycobacterium tuberculosis H37Rv
ggcgggaugcagcug

SEQ ID NO: 1328361 - RNA, 18 nt, Mycobacterium tuberculosis H37Rv
ggcgggcacucagcaggg

SEQ ID NO: 1328362 - RNA, 18 nt, Mycobacterium tuberculosis H37Rv
ggcgggcgagugucagca

SEQ ID NO: 1328363 - RNA, 22 nt, Mycobacterium tuberculosis H37Rv
ggcgggccguacacaccgagca

SEQ ID NO: 1328364 - RNA, 12 nt, Mycobacterium tuberculosis H37Rv
ggcgggcgcggg

SEQ ID NO: 1328365 - RNA, 11 nt, Mycobacterium tuberculosis H37Rv
ggcgggcggca

SEQ ID NO: 1328366 - RNA, 11 nt, Mycobacterium tuberculosis H37Rv
ggcgggcgccu

SEQ ID NO: 1328367 - RNA, 13 nt, Mycobacterium tuberculosis H37Rv
ggcgggccgcgcg

SEQ ID NO: 1328368 - RNA, 13 nt, Mycobacterium tuberculosis H37Rv
ggcgggcccgccg

SEQ ID NO: 1328369 - RNA, 21 nt, Mycobacterium tuberculosis H37Rv
ggcgggcccgaugaggacauc

SEQ ID NO: 1328370 - RNA, 19 nt, Mycobacterium tuberculosis H37Rv
ggcgggccaccguaaacag

SEQ ID NO: 1328371 - RNA, 14 nt, Mycobacterium tuberculosis H37Rv
ggcggcggaggcug

SEQ ID NO: 1328372 - RNA, 19 nt, Mycobacterium tuberculosis H37Rv
ggcggcggccgcagcggcc

SEQ ID NO: 1328373 - RNA, 19 nt, Mycobacterium tuberculosis H37Rv
ggcggcgcugcagcugcuc

SEQ ID NO: 1328374 - RNA, 20 nt, Mycobacterium tuberculosis H37Rv
ggcgggaacggugccgaucg

SEQ ID NO: 1328375 - RNA, 17 nt, Mycobacterium tuberculosis H37Rv
ggcggcuuuggccgccg

SEQ ID NO: 1328376 - RNA, 12 nt, Mycobacterium tuberculosis H37Rv
ggcggcggccug

SEQ ID NO: 1328377 - RNA, 22 nt, Mycobacterium tuberculosis H37Rv
ggcggcggcuguugcggcggcg

SEQ ID NO: 1328378 - RNA, 16 nt, Mycobacterium tuberculosis H37Rv
ggcggcggcggagcga

SEQ ID NO: 1328379 - RNA, 14 nt, Mycobacterium tuberculosis H37Rv
ggcggcgcucgucg

SEQ ID NO: 1328380 - RNA, 16 nt, Mycobacterium tuberculosis H37Rv
ggcggcgcugcagcug

SEQ ID NO: 1328381 - RNA, 14 nt, Mycobacterium tuberculosis H37Rv
ggcgaugcgcgccc

SEQ ID NO: 1328382 - RNA, 13 nt, Mycobacterium tuberculosis H37Rv
ggcgaugcgcggg

SEQ ID NO: 1328383 - RNA, 14 nt, Mycobacterium tuberculosis H37Rv
ggcgaugcagccgg

SEQ ID NO: 1328384 - RNA, 19 nt, Mycobacterium tuberculosis H37Rv
ggcgaugaugacggcggcc

SEQ ID NO: 1328385 - RNA, 14 nt, Mycobacterium tuberculosis H37Rv
ggcgaugagcgcga

SEQ ID NO: 1328386 - RNA, 21 nt, Mycobacterium tuberculosis H37Rv
ggcgaugacaaucaccuggua

SEQ ID NO: 1328387 - RNA, 21 nt, Mycobacterium tuberculosis H37Rv
ggcgauucgcaaucagcuggu

SEQ ID NO: 1328388 - RNA, 16 nt, Mycobacterium tuberculosis H37Rv
ggcgauuacggccagu

SEQ ID NO: 1328389 - RNA, 16 nt, Mycobacterium tuberculosis H37Rv
ggcgauuggcugugau

SEQ ID NO: 1328390 - RNA, 19 nt, Mycobacterium tuberculosis H37Rv
ggcgauuucggcgccggcg

SEQ ID NO: 1328391 - RNA, 23 nt, Mycobacterium tuberculosis H37Rv
ggcgcaccaucgcggccgcuggg

SEQ ID NO: 1328392 - RNA, 19 nt, Mycobacterium tuberculosis H37Rv
ggcgcacgguccacggugg

SEQ ID NO: 1328393 - RNA, 19 nt, Mycobacterium tuberculosis H37Rv
ggcgcacgaaaccgcagcg

SEQ ID NO: 1328394 - RNA, 16 nt, Mycobacterium tuberculosis H37Rv
ggcgcaccgucgcggg

SEQ ID NO: 1328395 - RNA, 23 nt, Mycobacterium tuberculosis H37Rv
ggcgauuuugcgucugcucggcg

SEQ ID NO: 1328396 - RNA, 20 nt, Mycobacterium tuberculosis H37Rv
ggcgcaaaccacccgcaaca

SEQ ID NO: 1328397 - RNA, 18 nt, Mycobacterium tuberculosis H37Rv
ggcgauuuugcgucugcu

SEQ ID NO: 1328398 - RNA, 18 nt, Mycobacterium tuberculosis H37Rv
ggcgcaccaccgccccgc

SEQ ID NO: 1328399 - RNA, 16 nt, Mycobacterium tuberculosis H37Rv
ggcgccaccggcgccg

SEQ ID NO: 1328400 - RNA, 19 nt, Mycobacterium tuberculosis H37Rv
ggcgccaccgccgcugccg

SEQ ID NO: 1328401 - RNA, 14 nt, Mycobacterium tuberculosis H37Rv
ggcgccacggcagc

SEQ ID NO: 1328402 - RNA, 15 nt, Mycobacterium tuberculosis H37Rv
ggcgccacggcagcg

SEQ ID NO: 1328403 - RNA, 11 nt, Mycobacterium tuberculosis H37Rv
ggcgccagcag

SEQ ID NO: 1328404 - RNA, 20 nt, Mycobacterium tuberculosis H37Rv
ggcgcagggacugugggggc

SEQ ID NO: 1328405 - RNA, 21 nt, Mycobacterium tuberculosis H37Rv
ggcgcagggacugugggggcg

SEQ ID NO: 1328406 - RNA, 15 nt, Mycobacterium tuberculosis H37Rv
ggcgcacucccggau

SEQ ID NO: 1328407 - RNA, 17 nt, Mycobacterium tuberculosis H37Rv
ggcgcagcugccgagcg

SEQ ID NO: 1328408 - RNA, 16 nt, Mycobacterium tuberculosis H37Rv
ggcgcagcugggugcg

SEQ ID NO: 1328409 - RNA, 15 nt, Mycobacterium tuberculosis H37Rv
ggcgauagcggcgcu

SEQ ID NO: 1328410 - RNA, 19 nt, Mycobacterium tuberculosis H37Rv
ggcgaugaccacgccgacg

SEQ ID NO: 1328411 - RNA, 18 nt, Mycobacterium tuberculosis H37Rv
ggcgaucuugcgacgccc

SEQ ID NO: 1328412 - RNA, 19 nt, Mycobacterium tuberculosis H37Rv
ggcgaucagcagccgccga

SEQ ID NO: 1328413 - RNA, 19 nt, Mycobacterium tuberculosis H37Rv
ggcgaucaccgcgccggag

SEQ ID NO: 1328414 - RNA, 18 nt, Mycobacterium tuberculosis H37Rv
ggcgaucagcagccgccg

SEQ ID NO: 1328415 - RNA, 19 nt, Mycobacterium tuberculosis H37Rv
ggcgaccgagacggcgucg

SEQ ID NO: 1328416 - RNA, 22 nt, Mycobacterium tuberculosis H37Rv
ggcgaccggugccugcaacgcc

SEQ ID NO: 1328417 - RNA, 22 nt, Mycobacterium tuberculosis H37Rv
ggcgaccggccggccgcgggcg

SEQ ID NO: 1328418 - RNA, 22 nt, Mycobacterium tuberculosis H37Rv
ggcgaccccgaacauccgccgc

SEQ ID NO: 1328419 - RNA, 15 nt, Mycobacterium tuberculosis H37Rv
ggcgaccugcggacc

SEQ ID NO: 1328420 - RNA, 16 nt, Mycobacterium tuberculosis H37Rv
ggcgaccugcucgcug

SEQ ID NO: 1328421 - RNA, 19 nt, Mycobacterium tuberculosis H37Rv
ggcgaccagcucagcugcg

SEQ ID NO: 1328422 - RNA, 21 nt, Mycobacterium tuberculosis H37Rv
ggcgaccccgaacauccgccg

SEQ ID NO: 1328423 - RNA, 19 nt, Mycobacterium tuberculosis H37Rv
ggcgaccacgccgccggcg

SEQ ID NO: 1328424 - RNA, 22 nt, Mycobacterium tuberculosis H37Rv
ggcgaccaacacgucgagcagc

SEQ ID NO: 1328425 - RNA, 20 nt, Mycobacterium tuberculosis H37Rv
ggcgaccaccaccgccgccg

SEQ ID NO: 1328426 - RNA, 17 nt, Mycobacterium tuberculosis H37Rv
ggcgacagcgcggcggu

SEQ ID NO: 1328427 - RNA, 22 nt, Mycobacterium tuberculosis H37Rv
ggcgacaaucgagaacgcccgc

SEQ ID NO: 1328428 - RNA, 19 nt, Mycobacterium tuberculosis H37Rv
ggcgaaccgucagcgcgcc

SEQ ID NO: 1328429 - RNA, 13 nt, Mycobacterium tuberculosis H37Rv
ggcgacagcgcgg

SEQ ID NO: 1328430 - RNA, 12 nt, Mycobacterium tuberculosis H37Rv
ggcgacagcgcg

SEQ ID NO: 1328431 - RNA, 15 nt, Mycobacterium tuberculosis H37Rv
ggcgaacccuccgca

SEQ ID NO: 1328432 - RNA, 18 nt, Mycobacterium tuberculosis H37Rv
ggcgaacccuccgcagcu

SEQ ID NO: 1328433 - RNA, 19 nt, Mycobacterium tuberculosis H37Rv
ggcgaacccuccgcagcua

SEQ ID NO: 1328434 - RNA, 14 nt, Mycobacterium tuberculosis H37Rv
ggcgaaccagcgcg

SEQ ID NO: 1328435 - RNA, 22 nt, Mycobacterium tuberculosis H37Rv
ggcgaacccgccgaugccgccg

SEQ ID NO: 1328436 - RNA, 23 nt, Mycobacterium tuberculosis H37Rv
ggcgaacagcaugauccgcuggg

SEQ ID NO: 1328437 - RNA, 14 nt, Mycobacterium tuberculosis H37Rv
ggcgaacagcccca

SEQ ID NO: 1328438 - RNA, 15 nt, Mycobacterium tuberculosis H37Rv
ggcgaacagccccag

SEQ ID NO: 1328439 - RNA, 21 nt, Mycobacterium tuberculosis H37Rv
ggcgaaaagacugcgccgccg

SEQ ID NO: 1328440 - RNA, 17 nt, Mycobacterium tuberculosis H37Rv
ggccuuugagcgcggcc

SEQ ID NO: 1328441 - RNA, 20 nt, Mycobacterium tuberculosis H37Rv
ggccuuguucuuggccaccc

SEQ ID NO: 1328442 - RNA, 22 nt, Mycobacterium tuberculosis H37Rv
ggccuuguugccgcgccacugu

SEQ ID NO: 1328443 - RNA, 19 nt, Mycobacterium tuberculosis H37Rv
ggcgaacacgucggccagu

SEQ ID NO: 1328444 - RNA, 16 nt, Mycobacterium tuberculosis H37Rv
ggcgaaagauggccuc

SEQ ID NO: 1328445 - RNA, 23 nt, Mycobacterium tuberculosis H37Rv
ggccgacggcaaaccaguuggcg

SEQ ID NO: 1328446 - RNA, 22 nt, Mycobacterium tuberculosis H37Rv
ggccgaccgggcucuggccagu

SEQ ID NO: 1328447 - RNA, 18 nt, Mycobacterium tuberculosis H37Rv
ggccgacgauagcggccc

SEQ ID NO: 1328448 - RNA, 20 nt, Mycobacterium tuberculosis H37Rv
ggccgacagcacgccaggca

SEQ ID NO: 1328449 - RNA, 23 nt, Mycobacterium tuberculosis H37Rv
ggccgacacgccgaugccgaacu

SEQ ID NO: 1328450 - RNA, 17 nt, Mycobacterium tuberculosis H37Rv
ggccgacaccgccacca

SEQ ID NO: 1328451 - RNA, 22 nt, Mycobacterium tuberculosis H37Rv
ggcgacuacccagccagccgcg

SEQ ID NO: 1328452 - RNA, 15 nt, Mycobacterium tuberculosis H37Rv
ggcgacuacggccuc

SEQ ID NO: 1328453 - RNA, 19 nt, Mycobacterium tuberculosis H37Rv
ggcgacucgaggaccugcu

SEQ ID NO: 1328454 - RNA, 18 nt, Mycobacterium tuberculosis H37Rv
ggcgacugcagcgaagcc

SEQ ID NO: 1328455 - RNA, 18 nt, Mycobacterium tuberculosis H37Rv
ggcgacguuggcgggagc

SEQ ID NO: 1328456 - RNA, 16 nt, Mycobacterium tuberculosis H37Rv
ggcgacuacccagcca

SEQ ID NO: 1328457 - RNA, 12 nt, Mycobacterium tuberculosis H37Rv
ggcgagcagaga

SEQ ID NO: 1328458 - RNA, 18 nt, Mycobacterium tuberculosis H37Rv
ggcgagcaccgugcccug

SEQ ID NO: 1328459 - RNA, 22 nt, Mycobacterium tuberculosis H37Rv
ggcgagcagucgcaaaagcccc

SEQ ID NO: 1328460 - RNA, 14 nt, Mycobacterium tuberculosis H37Rv
ggcgagcagcaggu

SEQ ID NO: 1328461 - RNA, 12 nt, Mycobacterium tuberculosis H37Rv
ggcgagcgcgcc

SEQ ID NO: 1328462 - RNA, 13 nt, Mycobacterium tuberculosis H37Rv
ggcgagcgcggcc

SEQ ID NO: 1328463 - RNA, 16 nt, Mycobacterium tuberculosis H37Rv
ggcgagccgcucgcug

SEQ ID NO: 1328464 - RNA, 17 nt, Mycobacterium tuberculosis H37Rv
ggcgagcucgucgagcg

SEQ ID NO: 1328465 - RNA, 23 nt, Mycobacterium tuberculosis H37Rv
ggcgagcuccgaugccgacggcg

SEQ ID NO: 1328466 - RNA, 22 nt, Mycobacterium tuberculosis H37Rv
ggcgagcucgacgaaugugagc

SEQ ID NO: 1328467 - RNA, 16 nt, Mycobacterium tuberculosis H37Rv
ggcgagcgcggccugc

SEQ ID NO: 1328468 - RNA, 21 nt, Mycobacterium tuberculosis H37Rv
ggcgacgaaguccccguaguc

SEQ ID NO: 1328469 - RNA, 16 nt, Mycobacterium tuberculosis H37Rv
ggcgacgaccgucggc

SEQ ID NO: 1328470 - RNA, 19 nt, Mycobacterium tuberculosis H37Rv
ggcgacgaucucggcggcc

SEQ ID NO: 1328471 - RNA, 17 nt, Mycobacterium tuberculosis H37Rv
ggcgacgaugucgagcg

SEQ ID NO: 1328472 - RNA, 11 nt, Mycobacterium tuberculosis H37Rv
ggcgacgaggc

SEQ ID NO: 1328473 - RNA, 23 nt, Mycobacterium tuberculosis H37Rv
ggcgacgccaguguugcgcugcg

SEQ ID NO: 1328474 - RNA, 14 nt, Mycobacterium tuberculosis H37Rv
ggcgacggccagcg

SEQ ID NO: 1328475 - RNA, 17 nt, Mycobacterium tuberculosis H37Rv
ggcgacggccagcgcgu

SEQ ID NO: 1328476 - RNA, 13 nt, Mycobacterium tuberculosis H37Rv
ggcgacggacucc

SEQ ID NO: 1328477 - RNA, 19 nt, Mycobacterium tuberculosis H37Rv
ggcgacgccgucuagcaca

SEQ ID NO: 1328478 - RNA, 13 nt, Mycobacterium tuberculosis H37Rv
ggcugccagaaug

SEQ ID NO: 1328479 - RNA, 14 nt, Mycobacterium tuberculosis H37Rv
ggcugccaggagca

SEQ ID NO: 1328480 - RNA, 16 nt, Mycobacterium tuberculosis H37Rv
ggcugccaggagcacg

SEQ ID NO: 1328481 - RNA, 20 nt, Mycobacterium tuberculosis H37Rv
ggcugcaguaaaugggccuc

SEQ ID NO: 1328482 - RNA, 15 nt, Mycobacterium tuberculosis H37Rv
ggcugcauccuccuc

SEQ ID NO: 1328483 - RNA, 16 nt, Mycobacterium tuberculosis H37Rv
ggcugcauccuccucg

SEQ ID NO: 1328484 - RNA, 20 nt, Mycobacterium tuberculosis H37Rv
ggcugccgaaguugaagaag

SEQ ID NO: 1328485 - RNA, 16 nt, Mycobacterium tuberculosis H37Rv
ggcugcccgagaucgc

SEQ ID NO: 1328486 - RNA, 14 nt, Mycobacterium tuberculosis H37Rv
ggcugccccuccgg

SEQ ID NO: 1328487 - RNA, 22 nt, Mycobacterium tuberculosis H37Rv
ggcugcccguucugcccaggca

SEQ ID NO: 1328488 - RNA, 14 nt, Mycobacterium tuberculosis H37Rv
ggcugcgccgggcu

SEQ ID NO: 1328489 - RNA, 19 nt, Mycobacterium tuberculosis H37Rv
ggcugcgccgaacaccaca

SEQ ID NO: 1328490 - RNA, 14 nt, Mycobacterium tuberculosis H37Rv
ggcugcgcgcucgg

SEQ ID NO: 1328491 - RNA, 21 nt, Mycobacterium tuberculosis H37Rv
ggcugcgcuuugcacagcggc

SEQ ID NO: 1328492 - RNA, 20 nt, Mycobacterium tuberculosis H37Rv
ggcugccuccaucaacugca

SEQ ID NO: 1328493 - RNA, 17 nt, Mycobacterium tuberculosis H37Rv
ggcugccgucuccuggu

SEQ ID NO: 1328494 - RNA, 22 nt, Mycobacterium tuberculosis H37Rv
ggcugccggcaacagcucgccu

SEQ ID NO: 1328495 - RNA, 17 nt, Mycobacterium tuberculosis H37Rv
ggcugccgcggugccaa

SEQ ID NO: 1328496 - RNA, 19 nt, Mycobacterium tuberculosis H37Rv
ggcugccgguucaccaugu

SEQ ID NO: 1328497 - RNA, 19 nt, Mycobacterium tuberculosis H37Rv
ggcugagaugggccacccg

SEQ ID NO: 1328498 - RNA, 20 nt, Mycobacterium tuberculosis H37Rv
ggcugagaugggccacccgc

SEQ ID NO: 1328499 - RNA, 14 nt, Mycobacterium tuberculosis H37Rv
ggcugagcaggucu

SEQ ID NO: 1328500 - RNA, 15 nt, Mycobacterium tuberculosis H37Rv
ggcugagcaggucuc

SEQ ID NO: 1328501 - RNA, 14 nt, Mycobacterium tuberculosis H37Rv
ggcugagcccgccg

SEQ ID NO: 1328502 - RNA, 17 nt, Mycobacterium tuberculosis H37Rv
ggcugagcagcgcggcc

SEQ ID NO: 1328503 - RNA, 15 nt, Mycobacterium tuberculosis H37Rv
ggcugauucgagcca

SEQ ID NO: 1328504 - RNA, 14 nt, Mycobacterium tuberculosis H37Rv
ggcugauuggccca

SEQ ID NO: 1328505 - RNA, 23 nt, Mycobacterium tuberculosis H37Rv
ggcugaggcuuuuggagcggcuc

SEQ ID NO: 1328506 - RNA, 15 nt, Mycobacterium tuberculosis H37Rv
ggcugaacggcagcc

SEQ ID NO: 1328507 - RNA, 22 nt, Mycobacterium tuberculosis H37Rv
ggcugaaauaagggccggcggu

SEQ ID NO: 1328508 - RNA, 20 nt, Mycobacterium tuberculosis H37Rv
ggcugaccucccacccccgg

SEQ ID NO: 1328509 - RNA, 19 nt, Mycobacterium tuberculosis H37Rv
ggcugaccucccacccccg

SEQ ID NO: 1328510 - RNA, 21 nt, Mycobacterium tuberculosis H37Rv
ggcugaccggggucggccugc

SEQ ID NO: 1328511 - RNA, 19 nt, Mycobacterium tuberculosis H37Rv
ggcugaccgaagaagcccg

SEQ ID NO: 1328512 - RNA, 22 nt, Mycobacterium tuberculosis H37Rv
ggcguauugcaccgccaggucg

SEQ ID NO: 1328513 - RNA, 12 nt, Mycobacterium tuberculosis H37Rv
ggcucauggcau

SEQ ID NO: 1328514 - RNA, 23 nt, Mycobacterium tuberculosis H37Rv
ggcucaucgaagcuucggccuuc

SEQ ID NO: 1328515 - RNA, 14 nt, Mycobacterium tuberculosis H37Rv
ggcguagugcagcu

SEQ ID NO: 1328516 - RNA, 21 nt, Mycobacterium tuberculosis H37Rv
ggcguagaucaucuggcuggu

SEQ ID NO: 1328517 - RNA, 13 nt, Mycobacterium tuberculosis H37Rv
ggcguagcgagcg

SEQ ID NO: 1328518 - RNA, 15 nt, Mycobacterium tuberculosis H37Rv
ggcguagcgagcggg

SEQ ID NO: 1328519 - RNA, 14 nt, Mycobacterium tuberculosis H37Rv
ggcguagucggcgg

SEQ ID NO: 1328520 - RNA, 16 nt, Mycobacterium tuberculosis H37Rv
ggcguagugcucgccg

SEQ ID NO: 1328521 - RNA, 21 nt, Mycobacterium tuberculosis H37Rv
ggcuccucgugcacgcacagc

SEQ ID NO: 1328522 - RNA, 15 nt, Mycobacterium tuberculosis H37Rv
ggcucgagcucggcg

SEQ ID NO: 1328523 - RNA, 19 nt, Mycobacterium tuberculosis H37Rv
ggcucgagcaagaucaccu

SEQ ID NO: 1328524 - RNA, 16 nt, Mycobacterium tuberculosis H37Rv
ggcuccagcgcgcgcc

SEQ ID NO: 1328525 - RNA, 14 nt, Mycobacterium tuberculosis H37Rv
ggcuccagguccac

SEQ ID NO: 1328526 - RNA, 21 nt, Mycobacterium tuberculosis H37Rv
ggcuccaucgucugguggcag

SEQ ID NO: 1328527 - RNA, 15 nt, Mycobacterium tuberculosis H37Rv
ggcuccagcagcgcc

SEQ ID NO: 1328528 - RNA, 14 nt, Mycobacterium tuberculosis H37Rv
ggcuccaccgggcc

SEQ ID NO: 1328529 - RNA, 17 nt, Mycobacterium tuberculosis H37Rv
ggcuccaauugcggccg

SEQ ID NO: 1328530 - RNA, 23 nt, Mycobacterium tuberculosis H37Rv
ggcucgcgaucgucacggaggcc

SEQ ID NO: 1328531 - RNA, 21 nt, Mycobacterium tuberculosis H37Rv
ggcucgcgcucgauggcggcc

SEQ ID NO: 1328532 - RNA, 18 nt, Mycobacterium tuberculosis H37Rv
ggcucgcugcaccagcug

SEQ ID NO: 1328533 - RNA, 13 nt, Mycobacterium tuberculosis H37Rv
ggcucggccagcc

SEQ ID NO: 1328534 - RNA, 16 nt, Mycobacterium tuberculosis H37Rv
ggcucggcgucgccgc

SEQ ID NO: 1328535 - RNA, 12 nt, Mycobacterium tuberculosis H37Rv
ggcucggcggcc

SEQ ID NO: 1328536 - RNA, 12 nt, Mycobacterium tuberculosis H37Rv
ggcucggugcgc

SEQ ID NO: 1328537 - RNA, 22 nt, Mycobacterium tuberculosis H37Rv
ggcucugaggucaccggcgacc

SEQ ID NO: 1328538 - RNA, 21 nt, Mycobacterium tuberculosis H37Rv
ggcucucggugguccagcgcu

SEQ ID NO: 1328539 - RNA, 20 nt, Mycobacterium tuberculosis H37Rv
ggcucucguagcgcucagcu

SEQ ID NO: 1328540 - RNA, 14 nt, Mycobacterium tuberculosis H37Rv
ggcucuaucagacg

SEQ ID NO: 1328541 - RNA, 16 nt, Mycobacterium tuberculosis H37Rv
ggcucgugcgcuuggu

SEQ ID NO: 1328542 - RNA, 22 nt, Mycobacterium tuberculosis H37Rv
ggcuugcaaggucgcugcuugc

SEQ ID NO: 1328543 - RNA, 18 nt, Mycobacterium tuberculosis H37Rv
ggcuugacccuugggcac

SEQ ID NO: 1328544 - RNA, 15 nt, Mycobacterium tuberculosis H37Rv
ggcuucuagcccguu

SEQ ID NO: 1328545 - RNA, 15 nt, Mycobacterium tuberculosis H37Rv
ggcuucggcgagcgc

SEQ ID NO: 1328546 - RNA, 15 nt, Mycobacterium tuberculosis H37Rv
ggcuucggcagccgc

SEQ ID NO: 1328547 - RNA, 20 nt, Mycobacterium tuberculosis H37Rv
ggcuucggcggccgagcgca

SEQ ID NO: 1328548 - RNA, 18 nt, Mycobacterium tuberculosis H37Rv
ggcuugcgauuggcuggg

SEQ ID NO: 1328549 - RNA, 17 nt, Mycobacterium tuberculosis H37Rv
ggcuugcgauuggcugg

SEQ ID NO: 1328550 - RNA, 20 nt, Mycobacterium tuberculosis H37Rv
ggcuugcgcgcaggugcugg

SEQ ID NO: 1328551 - RNA, 14 nt, Mycobacterium tuberculosis H37Rv
ggcuuggccaucac

SEQ ID NO: 1328552 - RNA, 22 nt, Mycobacterium tuberculosis H37Rv
ggcuuggccgggaguguguccg

SEQ ID NO: 1328553 - RNA, 20 nt, Mycobacterium tuberculosis H37Rv
ggcuuggccguaggcggcga

SEQ ID NO: 1328554 - RNA, 23 nt, Mycobacterium tuberculosis H37Rv
ggcuuggguugauuggccccggc

SEQ ID NO: 1328555 - RNA, 15 nt, Mycobacterium tuberculosis H37Rv
ggcuugggccaggcc

SEQ ID NO: 1328556 - RNA, 15 nt, Mycobacterium tuberculosis H37Rv
ggcuuggcgucggcc

SEQ ID NO: 1328557 - RNA, 21 nt, Mycobacterium tuberculosis H37Rv
ggcuuggugaaccgcgcggcg

SEQ ID NO: 1328558 - RNA, 20 nt, Mycobacterium tuberculosis H37Rv
ggcuugguguauucgcggau

SEQ ID NO: 1328559 - RNA, 14 nt, Mycobacterium tuberculosis H37Rv
ggcuugucgccggc

SEQ ID NO: 1328560 - RNA, 21 nt, Mycobacterium tuberculosis H37Rv
ggcuuaugcgucugcucgccg

SEQ ID NO: 1328561 - RNA, 15 nt, Mycobacterium tuberculosis H37Rv
ggcuuaccggcgggc

SEQ ID NO: 1328562 - RNA, 16 nt, Mycobacterium tuberculosis H37Rv
ggcuguugcggcggcg

SEQ ID NO: 1328563 - RNA, 17 nt, Mycobacterium tuberculosis H37Rv
ggcugucgugauacagc

SEQ ID NO: 1328564 - RNA, 23 nt, Mycobacterium tuberculosis H37Rv
ggcuuccaacucggcggccagcg

SEQ ID NO: 1328565 - RNA, 19 nt, Mycobacterium tuberculosis H37Rv
ggcuuccagggcgacggcc

SEQ ID NO: 1328566 - RNA, 21 nt, Mycobacterium tuberculosis H37Rv
ggcuucacccaaccccgccgg

SEQ ID NO: 1328567 - RNA, 21 nt, Mycobacterium tuberculosis H37Rv
ggcuucaguccggccccccga

SEQ ID NO: 1328568 - RNA, 22 nt, Mycobacterium tuberculosis H37Rv
ggcuucaguccggccccccgac

SEQ ID NO: 1328569 - RNA, 19 nt, Mycobacterium tuberculosis H37Rv
ggcuuccggcgcgaccggu

SEQ ID NO: 1328570 - RNA, 19 nt, Mycobacterium tuberculosis H37Rv
ggcuucgacgcuuccuggg

SEQ ID NO: 1328571 - RNA, 15 nt, Mycobacterium tuberculosis H37Rv
ggcuucgacggcggc

SEQ ID NO: 1328572 - RNA, 14 nt, Mycobacterium tuberculosis H37Rv
ggcuggcugugccg

SEQ ID NO: 1328573 - RNA, 13 nt, Mycobacterium tuberculosis H37Rv
ggcugggaaagca

SEQ ID NO: 1328574 - RNA, 13 nt, Mycobacterium tuberculosis H37Rv
ggcuggcggccua

SEQ ID NO: 1328575 - RNA, 21 nt, Mycobacterium tuberculosis H37Rv
ggcuggcugaacauuccggca

SEQ ID NO: 1328576 - RNA, 21 nt, Mycobacterium tuberculosis H37Rv
ggcuggguaugcacccaggca

SEQ ID NO: 1328577 - RNA, 19 nt, Mycobacterium tuberculosis H37Rv
ggcuggggccccgcgccgg

SEQ ID NO: 1328578 - RNA, 20 nt, Mycobacterium tuberculosis H37Rv
ggcugguguccagccaggcg

SEQ ID NO: 1328579 - RNA, 19 nt, Mycobacterium tuberculosis H37Rv
ggcugguuacucaccaacc

SEQ ID NO: 1328580 - RNA, 13 nt, Mycobacterium tuberculosis H37Rv
ggcuggugcaggu

SEQ ID NO: 1328581 - RNA, 13 nt, Mycobacterium tuberculosis H37Rv
ggcuggugccaac

SEQ ID NO: 1328582 - RNA, 19 nt, Mycobacterium tuberculosis H37Rv
ggcuggucuacccgcggcg

SEQ ID NO: 1328583 - RNA, 15 nt, Mycobacterium tuberculosis H37Rv
ggcugguccgggugc

SEQ ID NO: 1328584 - RNA, 21 nt, Mycobacterium tuberculosis H37Rv
ggcugucgagucgguccugcc

SEQ ID NO: 1328585 - RNA, 15 nt, Mycobacterium tuberculosis H37Rv
ggcugucacgccugc

SEQ ID NO: 1328586 - RNA, 18 nt, Mycobacterium tuberculosis H37Rv
ggcuggugggacgcggcc

SEQ ID NO: 1328587 - RNA, 22 nt, Mycobacterium tuberculosis H37Rv
ggcuggccgccuccgcggcauu

SEQ ID NO: 1328588 - RNA, 17 nt, Mycobacterium tuberculosis H37Rv
ggcuggccgcgccucgg

SEQ ID NO: 1328589 - RNA, 16 nt, Mycobacterium tuberculosis H37Rv
ggcuggcgccccaggu

SEQ ID NO: 1328590 - RNA, 14 nt, Mycobacterium tuberculosis H37Rv
ggcuggacggcgcc

SEQ ID NO: 1328591 - RNA, 22 nt, Mycobacterium tuberculosis H37Rv
ggcuggcaucccgggcagucca

SEQ ID NO: 1328592 - RNA, 20 nt, Mycobacterium tuberculosis H37Rv
ggcuggcaugccggcgugcg

SEQ ID NO: 1328593 - RNA, 15 nt, Mycobacterium tuberculosis H37Rv
ggcuggacggcgccg

SEQ ID NO: 1328594 - RNA, 23 nt, Mycobacterium tuberculosis H37Rv
ggcuggaccacucgccggcggac

SEQ ID NO: 1328595 - RNA, 20 nt, Mycobacterium tuberculosis H37Rv
ggcuggaccacucgccggcg

SEQ ID NO: 1328596 - RNA, 18 nt, Mycobacterium tuberculosis H37Rv
ggcuggaccacucgccgg

SEQ ID NO: 1328597 - RNA, 12 nt, Mycobacterium tuberculosis H37Rv
ggcugcuccugg

SEQ ID NO: 1328598 - RNA, 14 nt, Mycobacterium tuberculosis H37Rv
ggcugcguggcggg

SEQ ID NO: 1328599 - RNA, 21 nt, Mycobacterium tuberculosis H37Rv
ggcugcgucgucugcagaccu

SEQ ID NO: 1328600 - RNA, 15 nt, Mycobacterium tuberculosis H37Rv
ggcugcguuggcugg

SEQ ID NO: 1328601 - RNA, 17 nt, Mycobacterium tuberculosis H37Rv
ggcugcgggcccggcgg

SEQ ID NO: 1328602 - RNA, 17 nt, Mycobacterium tuberculosis H37Rv
gggcaagcugaccgcca

SEQ ID NO: 1328603 - RNA, 16 nt, Mycobacterium tuberculosis H37Rv
gggcaaggcggcggcc

SEQ ID NO: 1328604 - RNA, 16 nt, Mycobacterium tuberculosis H37Rv
gggcaagaaaguucca

SEQ ID NO: 1328605 - RNA, 19 nt, Mycobacterium tuberculosis H37Rv
gggcaaggacaagccgcug

SEQ ID NO: 1328606 - RNA, 18 nt, Mycobacterium tuberculosis H37Rv
gggcacaccgacgccgcc

SEQ ID NO: 1328607 - RNA, 19 nt, Mycobacterium tuberculosis H37Rv
gggcacaccgacgccgcca

SEQ ID NO: 1328608 - RNA, 20 nt, Mycobacterium tuberculosis H37Rv
gggcacaccgguggcgcccu

SEQ ID NO: 1328609 - RNA, 20 nt, Mycobacterium tuberculosis H37Rv
gggcacaauaggcuccagcg

SEQ ID NO: 1328610 - RNA, 22 nt, Mycobacterium tuberculosis H37Rv
gggcaaucgcucugugucgccg

SEQ ID NO: 1328611 - RNA, 15 nt, Mycobacterium tuberculosis H37Rv
gggcacagccauggu

SEQ ID NO: 1328612 - RNA, 12 nt, Mycobacterium tuberculosis H37Rv
gggcacagccag

SEQ ID NO: 1328613 - RNA, 22 nt, Mycobacterium tuberculosis H37Rv
gggcaccagcgaauccagccgc

SEQ ID NO: 1328614 - RNA, 22 nt, Mycobacterium tuberculosis H37Rv
gggcaccacgcugugcucgacg

SEQ ID NO: 1328615 - RNA, 22 nt, Mycobacterium tuberculosis H37Rv
gggcacucggcccggcccgggu

SEQ ID NO: 1328616 - RNA, 14 nt, Mycobacterium tuberculosis H37Rv
gggcacucuugucc

SEQ ID NO: 1328617 - RNA, 14 nt, Mycobacterium tuberculosis H37Rv
gggcacgggcaacg

SEQ ID NO: 1328618 - RNA, 20 nt, Mycobacterium tuberculosis H37Rv
gggcagaaucggugggcggg

SEQ ID NO: 1328619 - RNA, 15 nt, Mycobacterium tuberculosis H37Rv
gggcagaagaguguc

SEQ ID NO: 1328620 - RNA, 19 nt, Mycobacterium tuberculosis H37Rv
gggcaccuuggccaggaag

SEQ ID NO: 1328621 - RNA, 14 nt, Mycobacterium tuberculosis H37Rv
gggcacgccaugga

SEQ ID NO: 1328622 - RNA, 19 nt, Mycobacterium tuberculosis H37Rv
gggcagcaggcccacccgg

SEQ ID NO: 1328623 - RNA, 16 nt, Mycobacterium tuberculosis H37Rv
gggcagauucuucacc

SEQ ID NO: 1328624 - RNA, 11 nt, Mycobacterium tuberculosis H37Rv
gggcagccgcg

SEQ ID NO: 1328625 - RNA, 16 nt, Mycobacterium tuberculosis H37Rv
gggcagccccuccgcg

SEQ ID NO: 1328626 - RNA, 15 nt, Mycobacterium tuberculosis H37Rv
gggcagcugguaggu

SEQ ID NO: 1328627 - RNA, 16 nt, Mycobacterium tuberculosis H37Rv
gggcagcgcggccagu

SEQ ID NO: 1328628 - RNA, 11 nt, Mycobacterium tuberculosis H37Rv
gggcagcuggc

SEQ ID NO: 1328629 - RNA, 12 nt, Mycobacterium tuberculosis H37Rv
gggcagcugggc

SEQ ID NO: 1328630 - RNA, 16 nt, Mycobacterium tuberculosis H37Rv
gggcagcugggcagga

SEQ ID NO: 1328631 - RNA, 19 nt, Mycobacterium tuberculosis H37Rv
gggcagcgaaacgagccgg

SEQ ID NO: 1328632 - RNA, 15 nt, Mycobacterium tuberculosis H37Rv
gggcagcgccaggcc

SEQ ID NO: 1328633 - RNA, 15 nt, Mycobacterium tuberculosis H37Rv
gggcagcgcggccag

SEQ ID NO: 1328634 - RNA, 18 nt, Mycobacterium tuberculosis H37Rv
gggcaguuuggcggcagg

SEQ ID NO: 1328635 - RNA, 13 nt, Mycobacterium tuberculosis H37Rv
gggcagugcgcgg

SEQ ID NO: 1328636 - RNA, 16 nt, Mycobacterium tuberculosis H37Rv
gggcaguggcagcccg

SEQ ID NO: 1328637 - RNA, 14 nt, Mycobacterium tuberculosis H37Rv
gggcaguccaggca

SEQ ID NO: 1328638 - RNA, 14 nt, Mycobacterium tuberculosis H37Rv
gggcagucaacucc

SEQ ID NO: 1328639 - RNA, 13 nt, Mycobacterium tuberculosis H37Rv
gggcaggccccac

SEQ ID NO: 1328640 - RNA, 17 nt, Mycobacterium tuberculosis H37Rv
gggcaggcggccagcga

SEQ ID NO: 1328641 - RNA, 14 nt, Mycobacterium tuberculosis H37Rv
gggcaggcggccag

SEQ ID NO: 1328642 - RNA, 16 nt, Mycobacterium tuberculosis H37Rv
gggaucuagaugcgga

SEQ ID NO: 1328643 - RNA, 17 nt, Mycobacterium tuberculosis H37Rv
gggaugcagcugcccgg

SEQ ID NO: 1328644 - RNA, 17 nt, Mycobacterium tuberculosis H37Rv
gggaugccggcccccac

SEQ ID NO: 1328645 - RNA, 21 nt, Mycobacterium tuberculosis H37Rv
gggauggacggcagccagcca

SEQ ID NO: 1328646 - RNA, 14 nt, Mycobacterium tuberculosis H37Rv
gggcaaaucaagca

SEQ ID NO: 1328647 - RNA, 17 nt, Mycobacterium tuberculosis H37Rv
gggcaaaucaagcacag

SEQ ID NO: 1328648 - RNA, 18 nt, Mycobacterium tuberculosis H37Rv
gggcaaaucaagcacagc

SEQ ID NO: 1328649 - RNA, 19 nt, Mycobacterium tuberculosis H37Rv
gggcaaaucaagcacagcc

SEQ ID NO: 1328650 - RNA, 18 nt, Mycobacterium tuberculosis H37Rv
gggcaacgaucagguugg

SEQ ID NO: 1328651 - RNA, 17 nt, Mycobacterium tuberculosis H37Rv
gggcaaacugggcaccg

SEQ ID NO: 1328652 - RNA, 14 nt, Mycobacterium tuberculosis H37Rv
gggauucggcagcg

SEQ ID NO: 1328653 - RNA, 16 nt, Mycobacterium tuberculosis H37Rv
gggauugcgggccugc

SEQ ID NO: 1328654 - RNA, 15 nt, Mycobacterium tuberculosis H37Rv
gggaucgggcccucc

SEQ ID NO: 1328655 - RNA, 14 nt, Mycobacterium tuberculosis H37Rv
gggaucgcccaggc

SEQ ID NO: 1328656 - RNA, 19 nt, Mycobacterium tuberculosis H37Rv
gggaucgacgucgcggcgc

SEQ ID NO: 1328657 - RNA, 17 nt, Mycobacterium tuberculosis H37Rv
gggaucgccguccagca

SEQ ID NO: 1328658 - RNA, 17 nt, Mycobacterium tuberculosis H37Rv
gggauccgcgcgcugga

SEQ ID NO: 1328659 - RNA, 21 nt, Mycobacterium tuberculosis H37Rv
gggauccgaagagccagcaac

SEQ ID NO: 1328660 - RNA, 13 nt, Mycobacterium tuberculosis H37Rv
gggaucaugacca

SEQ ID NO: 1328661 - RNA, 17 nt, Mycobacterium tuberculosis H37Rv
gggaucccagcgcagcg

SEQ ID NO: 1328662 - RNA, 16 nt, Mycobacterium tuberculosis H37Rv
gggauccggcgcagcg

SEQ ID NO: 1328663 - RNA, 14 nt, Mycobacterium tuberculosis H37Rv
gggauccgguggug

SEQ ID NO: 1328664 - RNA, 14 nt, Mycobacterium tuberculosis H37Rv
gggaucgacccgcc

SEQ ID NO: 1328665 - RNA, 21 nt, Mycobacterium tuberculosis H37Rv
gggaucacaccccaggcaccc

SEQ ID NO: 1328666 - RNA, 14 nt, Mycobacterium tuberculosis H37Rv
gggaucacgccacc

SEQ ID NO: 1328667 - RNA, 17 nt, Mycobacterium tuberculosis H37Rv
gggauccagcaggccgg

SEQ ID NO: 1328668 - RNA, 18 nt, Mycobacterium tuberculosis H37Rv
gggauccagcaggccggg

SEQ ID NO: 1328669 - RNA, 20 nt, Mycobacterium tuberculosis H37Rv
gggaggccaacccugcggcg

SEQ ID NO: 1328670 - RNA, 22 nt, Mycobacterium tuberculosis H37Rv
gggaggcggcgccgcacccaca

SEQ ID NO: 1328671 - RNA, 23 nt, Mycobacterium tuberculosis H37Rv
gggagucgucguguuggccgggu

SEQ ID NO: 1328672 - RNA, 20 nt, Mycobacterium tuberculosis H37Rv
gggaguccggccgacccgga

SEQ ID NO: 1328673 - RNA, 17 nt, Mycobacterium tuberculosis H37Rv
gggaguacgggagccgg

SEQ ID NO: 1328674 - RNA, 15 nt, Mycobacterium tuberculosis H37Rv
gggauaggccguggu

SEQ ID NO: 1328675 - RNA, 21 nt, Mycobacterium tuberculosis H37Rv
gggauacucgucgucggcagg

SEQ ID NO: 1328676 - RNA, 17 nt, Mycobacterium tuberculosis H37Rv
gggagugcgccggcugg

SEQ ID NO: 1328677 - RNA, 21 nt, Mycobacterium tuberculosis H37Rv
gggagugcgccggcuggcggc

SEQ ID NO: 1328678 - RNA, 20 nt, Mycobacterium tuberculosis H37Rv
gggaguugcuugcagggcca

SEQ ID NO: 1328679 - RNA, 20 nt, Mycobacterium tuberculosis H37Rv
gggaacgcggaagccgccua

SEQ ID NO: 1328680 - RNA, 21 nt, Mycobacterium tuberculosis H37Rv
gggaaaguuguaucgcagcau

SEQ ID NO: 1328681 - RNA, 21 nt, Mycobacterium tuberculosis H37Rv
gggaaggaaccgggcaaauca

SEQ ID NO: 1328682 - RNA, 18 nt, Mycobacterium tuberculosis H37Rv
gggaagcgcguccaacca

SEQ ID NO: 1328683 - RNA, 14 nt, Mycobacterium tuberculosis H37Rv
gggaaggaaccggg

SEQ ID NO: 1328684 - RNA, 20 nt, Mycobacterium tuberculosis H37Rv
gggaagacgaccgugcuggg

SEQ ID NO: 1328685 - RNA, 16 nt, Mycobacterium tuberculosis H37Rv
ggcuuugcucgccagc

SEQ ID NO: 1328686 - RNA, 15 nt, Mycobacterium tuberculosis H37Rv
ggcuuugagccgcuc

SEQ ID NO: 1328687 - RNA, 22 nt, Mycobacterium tuberculosis H37Rv
gggaaaacgggguggcacgcau

SEQ ID NO: 1328688 - RNA, 13 nt, Mycobacterium tuberculosis H37Rv
gggaccggggacg

SEQ ID NO: 1328689 - RNA, 12 nt, Mycobacterium tuberculosis H37Rv
gggaccgcccga

SEQ ID NO: 1328690 - RNA, 14 nt, Mycobacterium tuberculosis H37Rv
gggaccgcgccagg

SEQ ID NO: 1328691 - RNA, 17 nt, Mycobacterium tuberculosis H37Rv
gggaccgccccggccag

SEQ ID NO: 1328692 - RNA, 14 nt, Mycobacterium tuberculosis H37Rv
gggacccggggccg

SEQ ID NO: 1328693 - RNA, 21 nt, Mycobacterium tuberculosis H37Rv
gggaccagugcgguggcaggu

SEQ ID NO: 1328694 - RNA, 22 nt, Mycobacterium tuberculosis H37Rv
gggaccacccgguccugcucgc

SEQ ID NO: 1328695 - RNA, 14 nt, Mycobacterium tuberculosis H37Rv
gggacccgagauca

SEQ ID NO: 1328696 - RNA, 17 nt, Mycobacterium tuberculosis H37Rv
gggacccgcuccaagcg

SEQ ID NO: 1328697 - RNA, 19 nt, Mycobacterium tuberculosis H37Rv
gggaccgcaucgguggggc

SEQ ID NO: 1328698 - RNA, 14 nt, Mycobacterium tuberculosis H37Rv
gggaccgccccggc

SEQ ID NO: 1328699 - RNA, 22 nt, Mycobacterium tuberculosis H37Rv
gggacaaucguccacccgagcu

SEQ ID NO: 1328700 - RNA, 19 nt, Mycobacterium tuberculosis H37Rv
gggacaaucucggccgcau

SEQ ID NO: 1328701 - RNA, 20 nt, Mycobacterium tuberculosis H37Rv
gggacauccagugcgguggc

SEQ ID NO: 1328702 - RNA, 22 nt, Mycobacterium tuberculosis H37Rv
gggacgaaucccgcgcccggcc

SEQ ID NO: 1328703 - RNA, 12 nt, Mycobacterium tuberculosis H37Rv
gggacgggcgcg

SEQ ID NO: 1328704 - RNA, 16 nt, Mycobacterium tuberculosis H37Rv
gggacuucgugccucg

SEQ ID NO: 1328705 - RNA, 16 nt, Mycobacterium tuberculosis H37Rv
gggacuggcaggccgg

SEQ ID NO: 1328706 - RNA, 19 nt, Mycobacterium tuberculosis H37Rv
gggacuggcaggccggcgu

SEQ ID NO: 1328707 - RNA, 12 nt, Mycobacterium tuberculosis H37Rv
gggacugcagcg

SEQ ID NO: 1328708 - RNA, 23 nt, Mycobacterium tuberculosis H37Rv
gggacucugccacccagcacgcg

SEQ ID NO: 1328709 - RNA, 17 nt, Mycobacterium tuberculosis H37Rv
gggacguuguccaccgc

SEQ ID NO: 1328710 - RNA, 22 nt, Mycobacterium tuberculosis H37Rv
gggagacgcugcgcgccagaca

SEQ ID NO: 1328711 - RNA, 20 nt, Mycobacterium tuberculosis H37Rv
gggagcaccgaccagggccg

SEQ ID NO: 1328712 - RNA, 15 nt, Mycobacterium tuberculosis H37Rv
gggagcacuacccca

SEQ ID NO: 1328713 - RNA, 15 nt, Mycobacterium tuberculosis H37Rv
gggagcccggcggcc

SEQ ID NO: 1328714 - RNA, 18 nt, Mycobacterium tuberculosis H37Rv
gggagcccgagcucaccg

SEQ ID NO: 1328715 - RNA, 13 nt, Mycobacterium tuberculosis H37Rv
gggagcgaacggc

SEQ ID NO: 1328716 - RNA, 18 nt, Mycobacterium tuberculosis H37Rv
gggagcgcagcgccggca

SEQ ID NO: 1328717 - RNA, 21 nt, Mycobacterium tuberculosis H37Rv
gggagcgcagcgccggcagca

SEQ ID NO: 1328718 - RNA, 15 nt, Mycobacterium tuberculosis H37Rv
gggagcggcugcacg

SEQ ID NO: 1328719 - RNA, 14 nt, Mycobacterium tuberculosis H37Rv
gggagcggcugcgg

SEQ ID NO: 1328720 - RNA, 15 nt, Mycobacterium tuberculosis H37Rv
ggggccccgcgccgg

SEQ ID NO: 1328721 - RNA, 19 nt, Mycobacterium tuberculosis H37Rv
ggggccccgcggcgccgcc

SEQ ID NO: 1328722 - RNA, 22 nt, Mycobacterium tuberculosis H37Rv
ggggccgcgucucggugcagca

SEQ ID NO: 1328723 - RNA, 20 nt, Mycobacterium tuberculosis H37Rv
ggggccgccagcugcgcagc

SEQ ID NO: 1328724 - RNA, 15 nt, Mycobacterium tuberculosis H37Rv
ggggccacccgcaga

SEQ ID NO: 1328725 - RNA, 13 nt, Mycobacterium tuberculosis H37Rv
ggggcagcgcggc

SEQ ID NO: 1328726 - RNA, 12 nt, Mycobacterium tuberculosis H37Rv
ggggcagcgcga

SEQ ID NO: 1328727 - RNA, 12 nt, Mycobacterium tuberculosis H37Rv
ggggcagcgcgg

SEQ ID NO: 1328728 - RNA, 22 nt, Mycobacterium tuberculosis H37Rv
ggggcgccuucaccuggugugc

SEQ ID NO: 1328729 - RNA, 22 nt, Mycobacterium tuberculosis H37Rv
ggggcgcuuccguggcccaacc

SEQ ID NO: 1328730 - RNA, 15 nt, Mycobacterium tuberculosis H37Rv
ggggcgcccggccag

SEQ ID NO: 1328731 - RNA, 15 nt, Mycobacterium tuberculosis H37Rv
ggggcgccgccguug

SEQ ID NO: 1328732 - RNA, 15 nt, Mycobacterium tuberculosis H37Rv
ggggcgcagcgcggc

SEQ ID NO: 1328733 - RNA, 13 nt, Mycobacterium tuberculosis H37Rv
ggggcgcccggcc

SEQ ID NO: 1328734 - RNA, 14 nt, Mycobacterium tuberculosis H37Rv
ggggccggucgggc

SEQ ID NO: 1328735 - RNA, 11 nt, Mycobacterium tuberculosis H37Rv
ggggccgggcg

SEQ ID NO: 1328736 - RNA, 13 nt, Mycobacterium tuberculosis H37Rv
ggggccgggcucc

SEQ ID NO: 1328737 - RNA, 21 nt, Mycobacterium tuberculosis H37Rv
ggggccgcucacaagccgugc

SEQ ID NO: 1328738 - RNA, 20 nt, Mycobacterium tuberculosis H37Rv
ggggccggacugaagccgcg

SEQ ID NO: 1328739 - RNA, 18 nt, Mycobacterium tuberculosis H37Rv
ggggccgcaggccagggu

SEQ ID NO: 1328740 - RNA, 22 nt, Mycobacterium tuberculosis H37Rv
ggggcgucgcaacccggccugg

SEQ ID NO: 1328741 - RNA, 19 nt, Mycobacterium tuberculosis H37Rv
ggggcgugacagggcggca

SEQ ID NO: 1328742 - RNA, 22 nt, Mycobacterium tuberculosis H37Rv
ggggcgucguucgcgggugcgc

SEQ ID NO: 1328743 - RNA, 14 nt, Mycobacterium tuberculosis H37Rv
ggggcggcgguggg

SEQ ID NO: 1328744 - RNA, 19 nt, Mycobacterium tuberculosis H37Rv
ggggcuaguugagcgcugc

SEQ ID NO: 1328745 - RNA, 20 nt, Mycobacterium tuberculosis H37Rv
ggggcuacaacugccgagca

SEQ ID NO: 1328746 - RNA, 18 nt, Mycobacterium tuberculosis H37Rv
ggggcuacuaggcccagc

SEQ ID NO: 1328747 - RNA, 20 nt, Mycobacterium tuberculosis H37Rv
ggggcgugacagggcggcaa

SEQ ID NO: 1328748 - RNA, 22 nt, Mycobacterium tuberculosis H37Rv
ggggcgugccgccgcagauggg

SEQ ID NO: 1328749 - RNA, 19 nt, Mycobacterium tuberculosis H37Rv
ggggcuauggcgcagcugg

SEQ ID NO: 1328750 - RNA, 17 nt, Mycobacterium tuberculosis H37Rv
ggggcucaaccccgucc

SEQ ID NO: 1328751 - RNA, 16 nt, Mycobacterium tuberculosis H37Rv
ggggcucagcgguggc

SEQ ID NO: 1328752 - RNA, 20 nt, Mycobacterium tuberculosis H37Rv
ggggcucagcgguggcgugg

SEQ ID NO: 1328753 - RNA, 17 nt, Mycobacterium tuberculosis H37Rv
ggggcucguaggugggc

SEQ ID NO: 1328754 - RNA, 22 nt, Mycobacterium tuberculosis H37Rv
ggggcucucgaguccaggcagc

SEQ ID NO: 1328755 - RNA, 12 nt, Mycobacterium tuberculosis H37Rv
ggggcugugcag

SEQ ID NO: 1328756 - RNA, 18 nt, Mycobacterium tuberculosis H37Rv
ggggcuuuugcgucugcu

SEQ ID NO: 1328757 - RNA, 16 nt, Mycobacterium tuberculosis H37Rv
ggggcugugcaggcgg

SEQ ID NO: 1328758 - RNA, 13 nt, Mycobacterium tuberculosis H37Rv
ggggcuguacucg

SEQ ID NO: 1328759 - RNA, 18 nt, Mycobacterium tuberculosis H37Rv
ggggcuucaucuggcgcc

SEQ ID NO: 1328760 - RNA, 18 nt, Mycobacterium tuberculosis H37Rv
ggggcuucugcgucugcu

SEQ ID NO: 1328761 - RNA, 18 nt, Mycobacterium tuberculosis H37Rv
gggggccgagccgacauc

SEQ ID NO: 1328762 - RNA, 14 nt, Mycobacterium tuberculosis H37Rv
gggggccggcagcg

SEQ ID NO: 1328763 - RNA, 21 nt, Mycobacterium tuberculosis H37Rv
gggggccggcagcggcuggga

SEQ ID NO: 1328764 - RNA, 19 nt, Mycobacterium tuberculosis H37Rv
gggggauccggcgcagcga

SEQ ID NO: 1328765 - RNA, 15 nt, Mycobacterium tuberculosis H37Rv
gggggagcggccgcc

SEQ ID NO: 1328766 - RNA, 19 nt, Mycobacterium tuberculosis H37Rv
gggggauccagcaggccgg

SEQ ID NO: 1328767 - RNA, 21 nt, Mycobacterium tuberculosis H37Rv
ggggcaacgaucagguuggcg

SEQ ID NO: 1328768 - RNA, 18 nt, Mycobacterium tuberculosis H37Rv
ggggaucgcuggccgcga

SEQ ID NO: 1328769 - RNA, 17 nt, Mycobacterium tuberculosis H37Rv
ggggaucucgagccgcg

SEQ ID NO: 1328770 - RNA, 18 nt, Mycobacterium tuberculosis H37Rv
ggggaucguccggccggg

SEQ ID NO: 1328771 - RNA, 21 nt, Mycobacterium tuberculosis H37Rv
ggggaguucgcgcagcaccgg

SEQ ID NO: 1328772 - RNA, 17 nt, Mycobacterium tuberculosis H37Rv
ggggaucaccggcugcu

SEQ ID NO: 1328773 - RNA, 16 nt, Mycobacterium tuberculosis H37Rv
ggggaguugcuugcag

SEQ ID NO: 1328774 - RNA, 15 nt, Mycobacterium tuberculosis H37Rv
ggggagccggugacg

SEQ ID NO: 1328775 - RNA, 14 nt, Mycobacterium tuberculosis H37Rv
ggggagcggccgcc

SEQ ID NO: 1328776 - RNA, 15 nt, Mycobacterium tuberculosis H37Rv
ggggaguaguggugg

SEQ ID NO: 1328777 - RNA, 16 nt, Mycobacterium tuberculosis H37Rv
ggggaccgcggcgcgu

SEQ ID NO: 1328778 - RNA, 19 nt, Mycobacterium tuberculosis H37Rv
ggggacgccgcggcgccgg

SEQ ID NO: 1328779 - RNA, 13 nt, Mycobacterium tuberculosis H37Rv
ggggacgccgcgg

SEQ ID NO: 1328780 - RNA, 14 nt, Mycobacterium tuberculosis H37Rv
ggggacgggcggcc

SEQ ID NO: 1328781 - RNA, 14 nt, Mycobacterium tuberculosis H37Rv
ggggacgggucggc

SEQ ID NO: 1328782 - RNA, 16 nt, Mycobacterium tuberculosis H37Rv
ggggaccccgccagcc

SEQ ID NO: 1328783 - RNA, 12 nt, Mycobacterium tuberculosis H37Rv
ggggaccccgcc

SEQ ID NO: 1328784 - RNA, 22 nt, Mycobacterium tuberculosis H37Rv
ggggaccccgccagccggagcg

SEQ ID NO: 1328785 - RNA, 22 nt, Mycobacterium tuberculosis H37Rv
ggggacccgcuccaagcgcggu

SEQ ID NO: 1328786 - RNA, 16 nt, Mycobacterium tuberculosis H37Rv
ggggaacagcagcgca

SEQ ID NO: 1328787 - RNA, 19 nt, Mycobacterium tuberculosis H37Rv
ggggaagaucucggccagg

SEQ ID NO: 1328788 - RNA, 19 nt, Mycobacterium tuberculosis H37Rv
gggcuuccagggcggccau

SEQ ID NO: 1328789 - RNA, 17 nt, Mycobacterium tuberculosis H37Rv
gggcuucugcgucugcu

SEQ ID NO: 1328790 - RNA, 17 nt, Mycobacterium tuberculosis H37Rv
gggcuugccgcgcacca

SEQ ID NO: 1328791 - RNA, 13 nt, Mycobacterium tuberculosis H37Rv
gggcuugccgggu

SEQ ID NO: 1328792 - RNA, 13 nt, Mycobacterium tuberculosis H37Rv
gggcuuggcugug

SEQ ID NO: 1328793 - RNA, 14 nt, Mycobacterium tuberculosis H37Rv
gggcuugagcgccg

SEQ ID NO: 1328794 - RNA, 20 nt, Mycobacterium tuberculosis H37Rv
ggggaaaccggccagccgac

SEQ ID NO: 1328795 - RNA, 23 nt, Mycobacterium tuberculosis H37Rv
gggcuuucgcgugcggcugccag

SEQ ID NO: 1328796 - RNA, 22 nt, Mycobacterium tuberculosis H37Rv
gggcuuuugcgucugcucgcca

SEQ ID NO: 1328797 - RNA, 20 nt, Mycobacterium tuberculosis H37Rv
gggcuuucgcgugcggcugc

SEQ ID NO: 1328798 - RNA, 16 nt, Mycobacterium tuberculosis H37Rv
gggcuugucgccggca

SEQ ID NO: 1328799 - RNA, 13 nt, Mycobacterium tuberculosis H37Rv
gggcuggcgacga

SEQ ID NO: 1328800 - RNA, 19 nt, Mycobacterium tuberculosis H37Rv
gggcuggauaugagccaac

SEQ ID NO: 1328801 - RNA, 21 nt, Mycobacterium tuberculosis H37Rv
gggcugccacggccuucagcg

SEQ ID NO: 1328802 - RNA, 14 nt, Mycobacterium tuberculosis H37Rv
gggcugcggccgcg

SEQ ID NO: 1328803 - RNA, 22 nt, Mycobacterium tuberculosis H37Rv
gggcuguugacgccacgacgcc

SEQ ID NO: 1328804 - RNA, 19 nt, Mycobacterium tuberculosis H37Rv
gggcuguccgaccucgccg

SEQ ID NO: 1328805 - RNA, 17 nt, Mycobacterium tuberculosis H37Rv
gggcuggguggccaacc

SEQ ID NO: 1328806 - RNA, 18 nt, Mycobacterium tuberculosis H37Rv
gggugaccaacacccccc

SEQ ID NO: 1328807 - RNA, 19 nt, Mycobacterium tuberculosis H37Rv
gggugaccaacaccccccc

SEQ ID NO: 1328808 - RNA, 22 nt, Mycobacterium tuberculosis H37Rv
gggugaagagaagucucgcggc

SEQ ID NO: 1328809 - RNA, 21 nt, Mycobacterium tuberculosis H37Rv
gggucugacaucggccaaggu

SEQ ID NO: 1328810 - RNA, 16 nt, Mycobacterium tuberculosis H37Rv
gggucguuggcggcgg

SEQ ID NO: 1328811 - RNA, 16 nt, Mycobacterium tuberculosis H37Rv
gggucuggcaggccag

SEQ ID NO: 1328812 - RNA, 23 nt, Mycobacterium tuberculosis H37Rv
gggucggccggguugcccuggug

SEQ ID NO: 1328813 - RNA, 18 nt, Mycobacterium tuberculosis H37Rv
gggucggccugcggcacc

SEQ ID NO: 1328814 - RNA, 19 nt, Mycobacterium tuberculosis H37Rv
gggucgggucccagccugg

SEQ ID NO: 1328815 - RNA, 20 nt, Mycobacterium tuberculosis H37Rv
gggucgucauacagcgcccu

SEQ ID NO: 1328816 - RNA, 19 nt, Mycobacterium tuberculosis H37Rv
gggucguccgccugcaccg

SEQ ID NO: 1328817 - RNA, 16 nt, Mycobacterium tuberculosis H37Rv
ggguccuugcggccgg

SEQ ID NO: 1328818 - RNA, 22 nt, Mycobacterium tuberculosis H37Rv
gggucgaacaggccggccgcga

SEQ ID NO: 1328819 - RNA, 16 nt, Mycobacterium tuberculosis H37Rv
ggguccgccgggcccc

SEQ ID NO: 1328820 - RNA, 14 nt, Mycobacterium tuberculosis H37Rv
gggucgauuucgcc

SEQ ID NO: 1328821 - RNA, 23 nt, Mycobacterium tuberculosis H37Rv
gggucgcaauauccggccgagcc

SEQ ID NO: 1328822 - RNA, 17 nt, Mycobacterium tuberculosis H37Rv
gggucagcugggacccg

SEQ ID NO: 1328823 - RNA, 21 nt, Mycobacterium tuberculosis H37Rv
gggucagcugggacccgagca

SEQ ID NO: 1328824 - RNA, 15 nt, Mycobacterium tuberculosis H37Rv
gggucaggccagggu

SEQ ID NO: 1328825 - RNA, 14 nt, Mycobacterium tuberculosis H37Rv
gggucaucagccgc

SEQ ID NO: 1328826 - RNA, 23 nt, Mycobacterium tuberculosis H37Rv
ggguccgaaguacuggccgccgc

SEQ ID NO: 1328827 - RNA, 17 nt, Mycobacterium tuberculosis H37Rv
ggguccgacagccccgg

SEQ ID NO: 1328828 - RNA, 21 nt, Mycobacterium tuberculosis H37Rv
ggguccgacagccccggcagg

SEQ ID NO: 1328829 - RNA, 22 nt, Mycobacterium tuberculosis H37Rv
gggucccaaucgucggccagca

SEQ ID NO: 1328830 - RNA, 22 nt, Mycobacterium tuberculosis H37Rv
gggucccggccgggucuuccgg

SEQ ID NO: 1328831 - RNA, 12 nt, Mycobacterium tuberculosis H37Rv
gggucaaccggu

SEQ ID NO: 1328832 - RNA, 19 nt, Mycobacterium tuberculosis H37Rv
ggguaucgacccuccagca

SEQ ID NO: 1328833 - RNA, 21 nt, Mycobacterium tuberculosis H37Rv
gggucaaugcuggcagcggcc

SEQ ID NO: 1328834 - RNA, 15 nt, Mycobacterium tuberculosis H37Rv
gggucacaaaaccug

SEQ ID NO: 1328835 - RNA, 13 nt, Mycobacterium tuberculosis H37Rv
gggucagcccagc

SEQ ID NO: 1328836 - RNA, 17 nt, Mycobacterium tuberculosis H37Rv
gggguuggcucggcgca

SEQ ID NO: 1328837 - RNA, 15 nt, Mycobacterium tuberculosis H37Rv
gggguugcggcagcu

SEQ ID NO: 1328838 - RNA, 16 nt, Mycobacterium tuberculosis H37Rv
gggguugcggcagcug

SEQ ID NO: 1328839 - RNA, 17 nt, Mycobacterium tuberculosis H37Rv
gggguugaucaccgaca

SEQ ID NO: 1328840 - RNA, 17 nt, Mycobacterium tuberculosis H37Rv
gggguugacuggccgcc

SEQ ID NO: 1328841 - RNA, 16 nt, Mycobacterium tuberculosis H37Rv
ggguaaaguucuccaa

SEQ ID NO: 1328842 - RNA, 18 nt, Mycobacterium tuberculosis H37Rv
ggguagaccuucucgccg

SEQ ID NO: 1328843 - RNA, 14 nt, Mycobacterium tuberculosis H37Rv
ggguagauccgccg

SEQ ID NO: 1328844 - RNA, 17 nt, Mycobacterium tuberculosis H37Rv
ggguacccgggaaugga

SEQ ID NO: 1328845 - RNA, 18 nt, Mycobacterium tuberculosis H37Rv
ggguacagacacgcgcgc

SEQ ID NO: 1328846 - RNA, 18 nt, Mycobacterium tuberculosis H37Rv
ggguacgacaccgcagcg

SEQ ID NO: 1328847 - RNA, 23 nt, Mycobacterium tuberculosis H37Rv
ggguaccucccgcuugcggggga

SEQ ID NO: 1328848 - RNA, 21 nt, Mycobacterium tuberculosis H37Rv
ggguagauguucacgccgccg

SEQ ID NO: 1328849 - RNA, 15 nt, Mycobacterium tuberculosis H37Rv
ggguagccgcccagc

SEQ ID NO: 1328850 - RNA, 13 nt, Mycobacterium tuberculosis H37Rv
ggguaggccgccg

SEQ ID NO: 1328851 - RNA, 16 nt, Mycobacterium tuberculosis H37Rv
ggguagugcccacaac

SEQ ID NO: 1328852 - RNA, 22 nt, Mycobacterium tuberculosis H37Rv
gggguggucucgauaucaguga

SEQ ID NO: 1328853 - RNA, 16 nt, Mycobacterium tuberculosis H37Rv
ggggugugcgggcggu

SEQ ID NO: 1328854 - RNA, 13 nt, Mycobacterium tuberculosis H37Rv
gggguggcgcggg

SEQ ID NO: 1328855 - RNA, 12 nt, Mycobacterium tuberculosis H37Rv
gggguggcggca

SEQ ID NO: 1328856 - RNA, 15 nt, Mycobacterium tuberculosis H37Rv
gggguggcggcaggu

SEQ ID NO: 1328857 - RNA, 14 nt, Mycobacterium tuberculosis H37Rv
ggggugugcggggu

SEQ ID NO: 1328858 - RNA, 21 nt, Mycobacterium tuberculosis H37Rv
gggguuaggaguggccgggcg

SEQ ID NO: 1328859 - RNA, 20 nt, Mycobacterium tuberculosis H37Rv
ggggugcccggccgccagcg

SEQ ID NO: 1328860 - RNA, 14 nt, Mycobacterium tuberculosis H37Rv
ggggugcgcccacc

SEQ ID NO: 1328861 - RNA, 21 nt, Mycobacterium tuberculosis H37Rv
ggggucggccugcggcaccgg

SEQ ID NO: 1328862 - RNA, 16 nt, Mycobacterium tuberculosis H37Rv
ggggucggcccgccaa

SEQ ID NO: 1328863 - RNA, 16 nt, Mycobacterium tuberculosis H37Rv
ggggucgccggcaccg

SEQ ID NO: 1328864 - RNA, 16 nt, Mycobacterium tuberculosis H37Rv
ggggucccgccgggug

SEQ ID NO: 1328865 - RNA, 17 nt, Mycobacterium tuberculosis H37Rv
gggguccgaugcgugcc

SEQ ID NO: 1328866 - RNA, 14 nt, Mycobacterium tuberculosis H37Rv
ggggucagcucgcc

SEQ ID NO: 1328867 - RNA, 19 nt, Mycobacterium tuberculosis H37Rv
ggggucagcucgccagccu

SEQ ID NO: 1328868 - RNA, 24 nt, Mycobacterium tuberculosis H37Rv
gggguaucgacccuccagcacgcc

SEQ ID NO: 1328869 - RNA, 23 nt, Mycobacterium tuberculosis H37Rv
gggguaauacgcggggccggccg

SEQ ID NO: 1328870 - RNA, 20 nt, Mycobacterium tuberculosis H37Rv
gggggucgcacccugcgcgg

SEQ ID NO: 1328871 - RNA, 22 nt, Mycobacterium tuberculosis H37Rv
gggggucgcacccugcgcggcg

SEQ ID NO: 1328872 - RNA, 17 nt, Mycobacterium tuberculosis H37Rv
gggggcguacugugagu

SEQ ID NO: 1328873 - RNA, 18 nt, Mycobacterium tuberculosis H37Rv
ggggguccggcggccgcc

SEQ ID NO: 1328874 - RNA, 15 nt, Mycobacterium tuberculosis H37Rv
ggggguccggcggcc

SEQ ID NO: 1328875 - RNA, 15 nt, Mycobacterium tuberculosis H37Rv
gggccucgaccgcca

SEQ ID NO: 1328876 - RNA, 21 nt, Mycobacterium tuberculosis H37Rv
gggccguccucccacagguag

SEQ ID NO: 1328877 - RNA, 15 nt, Mycobacterium tuberculosis H37Rv
gggccgucucgccgu

SEQ ID NO: 1328878 - RNA, 21 nt, Mycobacterium tuberculosis H37Rv
gggccguuggugaggcccccc

SEQ ID NO: 1328879 - RNA, 20 nt, Mycobacterium tuberculosis H37Rv
gggccgucuugccggccagg

SEQ ID NO: 1328880 - RNA, 21 nt, Mycobacterium tuberculosis H37Rv
gggccgucuugccggccagga

SEQ ID NO: 1328881 - RNA, 21 nt, Mycobacterium tuberculosis H37Rv
gggccucgaccgccagccgcg

SEQ ID NO: 1328882 - RNA, 20 nt, Mycobacterium tuberculosis H37Rv
gggccugcacgccggcgcug

SEQ ID NO: 1328883 - RNA, 13 nt, Mycobacterium tuberculosis H37Rv
gggccugcgcaga

SEQ ID NO: 1328884 - RNA, 20 nt, Mycobacterium tuberculosis H37Rv
gggccuggccugcccagcac

SEQ ID NO: 1328885 - RNA, 21 nt, Mycobacterium tuberculosis H37Rv
gggccguacaacagcgcgcgc

SEQ ID NO: 1328886 - RNA, 21 nt, Mycobacterium tuberculosis H37Rv
gggccguagaucccgaagcga

SEQ ID NO: 1328887 - RNA, 20 nt, Mycobacterium tuberculosis H37Rv
gggccgucaguuaaaggugg

SEQ ID NO: 1328888 - RNA, 19 nt, Mycobacterium tuberculosis H37Rv
gggccguccggcgccugcu

SEQ ID NO: 1328889 - RNA, 22 nt, Mycobacterium tuberculosis H37Rv
gggccguccggcgccugcugcg

SEQ ID NO: 1328890 - RNA, 23 nt, Mycobacterium tuberculosis H37Rv
gggccguccggcuuggcggcgau

SEQ ID NO: 1328891 - RNA, 13 nt, Mycobacterium tuberculosis H37Rv
gggccguccuccc

SEQ ID NO: 1328892 - RNA, 20 nt, Mycobacterium tuberculosis H37Rv
gggccgggcuccucugguug

SEQ ID NO: 1328893 - RNA, 19 nt, Mycobacterium tuberculosis H37Rv
gggccggucgugccggggc

SEQ ID NO: 1328894 - RNA, 12 nt, Mycobacterium tuberculosis H37Rv
gggccggugcga

SEQ ID NO: 1328895 - RNA, 16 nt, Mycobacterium tuberculosis H37Rv
gggccggcaccgcagc

SEQ ID NO: 1328896 - RNA, 23 nt, Mycobacterium tuberculosis H37Rv
gggccggaugucgacgagcaccg

SEQ ID NO: 1328897 - RNA, 23 nt, Mycobacterium tuberculosis H37Rv
gggccgcucacaagccgugcagc

SEQ ID NO: 1328898 - RNA, 16 nt, Mycobacterium tuberculosis H37Rv
gggccggccgagcgca

SEQ ID NO: 1328899 - RNA, 13 nt, Mycobacterium tuberculosis H37Rv
gggccggcgcggu

SEQ ID NO: 1328900 - RNA, 15 nt, Mycobacterium tuberculosis H37Rv
gggccggcggcucgg

SEQ ID NO: 1328901 - RNA, 14 nt, Mycobacterium tuberculosis H37Rv
gggccggcuagggc

SEQ ID NO: 1328902 - RNA, 23 nt, Mycobacterium tuberculosis H37Rv
gggccggcuagggcagcagcccg

SEQ ID NO: 1328903 - RNA, 20 nt, Mycobacterium tuberculosis H37Rv
gggccgaagcgcgcgcguga

SEQ ID NO: 1328904 - RNA, 21 nt, Mycobacterium tuberculosis H37Rv
gggccgaauccgauagcccgg

SEQ ID NO: 1328905 - RNA, 18 nt, Mycobacterium tuberculosis H37Rv
gggcccgccguccccgcc

SEQ ID NO: 1328906 - RNA, 19 nt, Mycobacterium tuberculosis H37Rv
gggcccgccguccccgccg

SEQ ID NO: 1328907 - RNA, 17 nt, Mycobacterium tuberculosis H37Rv
gggcccguagccgagcu

SEQ ID NO: 1328908 - RNA, 22 nt, Mycobacterium tuberculosis H37Rv
gggcccggccggacgggugcgg

SEQ ID NO: 1328909 - RNA, 22 nt, Mycobacterium tuberculosis H37Rv
gggcccgcguucucggcacccu

SEQ ID NO: 1328910 - RNA, 16 nt, Mycobacterium tuberculosis H37Rv
gggccgacugggcgcg

SEQ ID NO: 1328911 - RNA, 19 nt, Mycobacterium tuberculosis H37Rv
gggccgacgggacaacccg

SEQ ID NO: 1328912 - RNA, 22 nt, Mycobacterium tuberculosis H37Rv
gggccgaacacaccgggcgggc

SEQ ID NO: 1328913 - RNA, 12 nt, Mycobacterium tuberculosis H37Rv
gggccgccagcu

SEQ ID NO: 1328914 - RNA, 17 nt, Mycobacterium tuberculosis H37Rv
gggccgcaggccagggu

SEQ ID NO: 1328915 - RNA, 13 nt, Mycobacterium tuberculosis H37Rv
gggccgccagggc

SEQ ID NO: 1328916 - RNA, 13 nt, Mycobacterium tuberculosis H37Rv
gggccgccaggcg

SEQ ID NO: 1328917 - RNA, 13 nt, Mycobacterium tuberculosis H37Rv
gggccgccgagcu

SEQ ID NO: 1328918 - RNA, 14 nt, Mycobacterium tuberculosis H37Rv
gggccgccgaagcu

SEQ ID NO: 1328919 - RNA, 12 nt, Mycobacterium tuberculosis H37Rv
gggccgccgccc

SEQ ID NO: 1328920 - RNA, 15 nt, Mycobacterium tuberculosis H37Rv
gggccgcgcccuggc

SEQ ID NO: 1328921 - RNA, 17 nt, Mycobacterium tuberculosis H37Rv
gggccgccuggagcugu

SEQ ID NO: 1328922 - RNA, 13 nt, Mycobacterium tuberculosis H37Rv
gggccaggucggc

SEQ ID NO: 1328923 - RNA, 23 nt, Mycobacterium tuberculosis H37Rv
gggccaggucagccgcgcggguc

SEQ ID NO: 1328924 - RNA, 13 nt, Mycobacterium tuberculosis H37Rv
gggccaggcugcg

SEQ ID NO: 1328925 - RNA, 16 nt, Mycobacterium tuberculosis H37Rv
gggccaggcgcccagc

SEQ ID NO: 1328926 - RNA, 21 nt, Mycobacterium tuberculosis H37Rv
gggccagccgcucacccgguc

SEQ ID NO: 1328927 - RNA, 17 nt, Mycobacterium tuberculosis H37Rv
gggccagcggcagccug

SEQ ID NO: 1328928 - RNA, 22 nt, Mycobacterium tuberculosis H37Rv
gggccauggguagccgcccagc

SEQ ID NO: 1328929 - RNA, 17 nt, Mycobacterium tuberculosis H37Rv
gggcccacacggugcga

SEQ ID NO: 1328930 - RNA, 13 nt, Mycobacterium tuberculosis H37Rv
gggcccagcagcg

SEQ ID NO: 1328931 - RNA, 14 nt, Mycobacterium tuberculosis H37Rv
gggcccagcggccg

SEQ ID NO: 1328932 - RNA, 13 nt, Mycobacterium tuberculosis H37Rv
gggccccacggcg

SEQ ID NO: 1328933 - RNA, 21 nt, Mycobacterium tuberculosis H37Rv
gggccccacaucgccccccag

SEQ ID NO: 1328934 - RNA, 16 nt, Mycobacterium tuberculosis H37Rv
gggccccgccgaugcg

SEQ ID NO: 1328935 - RNA, 23 nt, Mycobacterium tuberculosis H37Rv
gggcccgacguugccgaagccgg

SEQ ID NO: 1328936 - RNA, 13 nt, Mycobacterium tuberculosis H37Rv
gggcccgaugagg

SEQ ID NO: 1328937 - RNA, 17 nt, Mycobacterium tuberculosis H37Rv
gggcccgccagcccagc

SEQ ID NO: 1328938 - RNA, 13 nt, Mycobacterium tuberculosis H37Rv
gggcccgccagcc

SEQ ID NO: 1328939 - RNA, 18 nt, Mycobacterium tuberculosis H37Rv
gggcccgccggccccgcc

SEQ ID NO: 1328940 - RNA, 14 nt, Mycobacterium tuberculosis H37Rv
gggccacggcugcg

SEQ ID NO: 1328941 - RNA, 19 nt, Mycobacterium tuberculosis H37Rv
gggccacgaugaucccaag

SEQ ID NO: 1328942 - RNA, 16 nt, Mycobacterium tuberculosis H37Rv
gggcauugcggcgcgg

SEQ ID NO: 1328943 - RNA, 21 nt, Mycobacterium tuberculosis H37Rv
gggccaccgcugucagccgac

SEQ ID NO: 1328944 - RNA, 16 nt, Mycobacterium tuberculosis H37Rv
gggccaccgccgccug

SEQ ID NO: 1328945 - RNA, 17 nt, Mycobacterium tuberculosis H37Rv
gggcaucgggccuagcc

SEQ ID NO: 1328946 - RNA, 14 nt, Mycobacterium tuberculosis H37Rv
gggcaucgucgccg

SEQ ID NO: 1328947 - RNA, 18 nt, Mycobacterium tuberculosis H37Rv
gggcaguggcagcccguc

SEQ ID NO: 1328948 - RNA, 22 nt, Mycobacterium tuberculosis H37Rv
gggcaucgucgucgcugccgcc

SEQ ID NO: 1328949 - RNA, 23 nt, Mycobacterium tuberculosis H37Rv
gggcaugucgccgaacgccacca

SEQ ID NO: 1328950 - RNA, 18 nt, Mycobacterium tuberculosis H37Rv
gggcauucccgcucgcag

SEQ ID NO: 1328951 - RNA, 21 nt, Mycobacterium tuberculosis H37Rv
gggcgacacccgaugugcccg

SEQ ID NO: 1328952 - RNA, 23 nt, Mycobacterium tuberculosis H37Rv
gggcgacacccgaugugcccggc

SEQ ID NO: 1328953 - RNA, 16 nt, Mycobacterium tuberculosis H37Rv
gggcgacuaccggcuc

SEQ ID NO: 1328954 - RNA, 16 nt, Mycobacterium tuberculosis H37Rv
gggcgacuggaccgau

SEQ ID NO: 1328955 - RNA, 14 nt, Mycobacterium tuberculosis H37Rv
gggcgagaccgcga

SEQ ID NO: 1328956 - RNA, 13 nt, Mycobacterium tuberculosis H37Rv
gggcgacgcggcg

SEQ ID NO: 1328957 - RNA, 12 nt, Mycobacterium tuberculosis H37Rv
gggcgacggcga

SEQ ID NO: 1328958 - RNA, 15 nt, Mycobacterium tuberculosis H37Rv
gggcgacagcggcga

SEQ ID NO: 1328959 - RNA, 18 nt, Mycobacterium tuberculosis H37Rv
gggcgcaccaagacgcca

SEQ ID NO: 1328960 - RNA, 19 nt, Mycobacterium tuberculosis H37Rv
gggcgcaacgagagcggcu

SEQ ID NO: 1328961 - RNA, 16 nt, Mycobacterium tuberculosis H37Rv
gggcgcaagcagcccg

SEQ ID NO: 1328962 - RNA, 22 nt, Mycobacterium tuberculosis H37Rv
gggcgauucugugucugcucgc

SEQ ID NO: 1328963 - RNA, 16 nt, Mycobacterium tuberculosis H37Rv
gggcgaugucggcugg

SEQ ID NO: 1328964 - RNA, 15 nt, Mycobacterium tuberculosis H37Rv
gggcgaugcugggcg

SEQ ID NO: 1328965 - RNA, 19 nt, Mycobacterium tuberculosis H37Rv
gggcgauauuggacgcgca

SEQ ID NO: 1328966 - RNA, 17 nt, Mycobacterium tuberculosis H37Rv
gggcgagucgggggccg

SEQ ID NO: 1328967 - RNA, 20 nt, Mycobacterium tuberculosis H37Rv
gggcgagucgggggccgcgu

SEQ ID NO: 1328968 - RNA, 17 nt, Mycobacterium tuberculosis H37Rv
gggcgagucccggcggu

SEQ ID NO: 1328969 - RNA, 20 nt, Mycobacterium tuberculosis H37Rv
gggcggacaaaagaacgcca

SEQ ID NO: 1328970 - RNA, 22 nt, Mycobacterium tuberculosis H37Rv
gggcgcuuaugcgucugcucgc

SEQ ID NO: 1328971 - RNA, 14 nt, Mycobacterium tuberculosis H37Rv
gggcggcaucccca

SEQ ID NO: 1328972 - RNA, 23 nt, Mycobacterium tuberculosis H37Rv
gggcgcgugggcgugcaggcugg

SEQ ID NO: 1328973 - RNA, 15 nt, Mycobacterium tuberculosis H37Rv
gggcgcggcccauga

SEQ ID NO: 1328974 - RNA, 12 nt, Mycobacterium tuberculosis H37Rv
gggcgcggggcg

SEQ ID NO: 1328975 - RNA, 20 nt, Mycobacterium tuberculosis H37Rv
gggcgcgggugaccaggcgg

SEQ ID NO: 1328976 - RNA, 19 nt, Mycobacterium tuberculosis H37Rv
gggcgcggguggcgccagg

SEQ ID NO: 1328977 - RNA, 13 nt, Mycobacterium tuberculosis H37Rv
gggcgcggaucug

SEQ ID NO: 1328978 - RNA, 18 nt, Mycobacterium tuberculosis H37Rv
gggcgcggaucugcagca

SEQ ID NO: 1328979 - RNA, 18 nt, Mycobacterium tuberculosis H37Rv
gggcgcgccggcuagggc

SEQ ID NO: 1328980 - RNA, 17 nt, Mycobacterium tuberculosis H37Rv
gggcgccuuccaggcgg

SEQ ID NO: 1328981 - RNA, 21 nt, Mycobacterium tuberculosis H37Rv
gggcgccgaauuggcccgggu

SEQ ID NO: 1328982 - RNA, 18 nt, Mycobacterium tuberculosis H37Rv
gggcgccaucccgccgcc

SEQ ID NO: 1328983 - RNA, 17 nt, Mycobacterium tuberculosis H37Rv
gggcgcaccgcggaccg

SEQ ID NO: 1328984 - RNA, 16 nt, Mycobacterium tuberculosis H37Rv
gggcgcagagucaacg

SEQ ID NO: 1328985 - RNA, 13 nt, Mycobacterium tuberculosis H37Rv
gggcggccgggcu

SEQ ID NO: 1328986 - RNA, 15 nt, Mycobacterium tuberculosis H37Rv
gggcggccgggcucc

SEQ ID NO: 1328987 - RNA, 21 nt, Mycobacterium tuberculosis H37Rv
gggcggccaccgcacgcuggc

SEQ ID NO: 1328988 - RNA, 14 nt, Mycobacterium tuberculosis H37Rv
gggcggcaucgccg

SEQ ID NO: 1328989 - RNA, 18 nt, Mycobacterium tuberculosis H37Rv
gggcggcauuaccaacgc

SEQ ID NO: 1328990 - RNA, 14 nt, Mycobacterium tuberculosis H37Rv
gggcggccaggauc

SEQ ID NO: 1328991 - RNA, 19 nt, Mycobacterium tuberculosis H37Rv
gggcggcgucgcggaucug

SEQ ID NO: 1328992 - RNA, 17 nt, Mycobacterium tuberculosis H37Rv
gggcgggauccacccag

SEQ ID NO: 1328993 - RNA, 21 nt, Mycobacterium tuberculosis H37Rv
gggcggcggugggcgcggacc

SEQ ID NO: 1328994 - RNA, 16 nt, Mycobacterium tuberculosis H37Rv
gggcguacucggcgcg

SEQ ID NO: 1328995 - RNA, 20 nt, Mycobacterium tuberculosis H37Rv
gggcggugggcagcagcugg

SEQ ID NO: 1328996 - RNA, 16 nt, Mycobacterium tuberculosis H37Rv
gggcggucggccggcu

SEQ ID NO: 1328997 - RNA, 14 nt, Mycobacterium tuberculosis H37Rv
gggcgugcugccga

SEQ ID NO: 1328998 - RNA, 12 nt, Mycobacterium tuberculosis H37Rv
gggcgugcucgc

SEQ ID NO: 1328999 - RNA, 13 nt, Mycobacterium tuberculosis H37Rv
gggcgugcugccg

SEQ ID NO: 1329000 - RNA, 18 nt, Mycobacterium tuberculosis H37Rv
gggcgugacgggcaggag

SEQ ID NO: 1329001 - RNA, 18 nt, Mycobacterium tuberculosis H37Rv
gggcgucgccgccgggca

SEQ ID NO: 1329002 - RNA, 14 nt, Mycobacterium tuberculosis H37Rv
gggcgucugcagcg

SEQ ID NO: 1329003 - RNA, 14 nt, Mycobacterium tuberculosis H37Rv
gggcgucgucggug

SEQ ID NO: 1329004 - RNA, 17 nt, Mycobacterium tuberculosis H37Rv
gggcuaccggcagcugc

SEQ ID NO: 1329005 - RNA, 14 nt, Mycobacterium tuberculosis H37Rv
gggcguuggcgacg

SEQ ID NO: 1329006 - RNA, 17 nt, Mycobacterium tuberculosis H37Rv
gggcuaauccagcagca

SEQ ID NO: 1329007 - RNA, 13 nt, Mycobacterium tuberculosis H37Rv
gggcgugugcagu

SEQ ID NO: 1329008 - RNA, 16 nt, Mycobacterium tuberculosis H37Rv
gggcguuggcgggcug

SEQ ID NO: 1329009 - RNA, 23 nt, Mycobacterium tuberculosis H37Rv
gggcgugguaaccagggcagccg

SEQ ID NO: 1329010 - RNA, 17 nt, Mycobacterium tuberculosis H37Rv
gggcucugcugccagcc

SEQ ID NO: 1329011 - RNA, 16 nt, Mycobacterium tuberculosis H37Rv
gggcucguccagcaac

SEQ ID NO: 1329012 - RNA, 18 nt, Mycobacterium tuberculosis H37Rv
gggcugaccgaagaagcc

SEQ ID NO: 1329013 - RNA, 20 nt, Mycobacterium tuberculosis H37Rv
gggcucuucgcagcgguggu

SEQ ID NO: 1329014 - RNA, 13 nt, Mycobacterium tuberculosis H37Rv
gggcugcccgcgg

SEQ ID NO: 1329015 - RNA, 14 nt, Mycobacterium tuberculosis H37Rv
ggguuggccggcgc

SEQ ID NO: 1329016 - RNA, 17 nt, Mycobacterium tuberculosis H37Rv
gguaacgcgacaagguc

SEQ ID NO: 1329017 - RNA, 13 nt, Mycobacterium tuberculosis H37Rv
gguaaagccgcgg

SEQ ID NO: 1329018 - RNA, 11 nt, Mycobacterium tuberculosis H37Rv
gguaacugucc

SEQ ID NO: 1329019 - RNA, 15 nt, Mycobacterium tuberculosis H37Rv
gguaauacgucccga

SEQ ID NO: 1329020 - RNA, 18 nt, Mycobacterium tuberculosis H37Rv
gguaaucaccuggcuggu

SEQ ID NO: 1329021 - RNA, 16 nt, Mycobacterium tuberculosis H37Rv
gguaaugguggcgucc

SEQ ID NO: 1329022 - RNA, 13 nt, Mycobacterium tuberculosis H37Rv
gguaauccgggca

SEQ ID NO: 1329023 - RNA, 17 nt, Mycobacterium tuberculosis H37Rv
ggguguuugucgcggug

SEQ ID NO: 1329024 - RNA, 19 nt, Mycobacterium tuberculosis H37Rv
ggguguuugucgcgguggu

SEQ ID NO: 1329025 - RNA, 13 nt, Mycobacterium tuberculosis H37Rv
ggguggugccagg

SEQ ID NO: 1329026 - RNA, 21 nt, Mycobacterium tuberculosis H37Rv
gggugguucaccucggcgacg

SEQ ID NO: 1329027 - RNA, 23 nt, Mycobacterium tuberculosis H37Rv
ggguggugaaguagucggcgccg

SEQ ID NO: 1329028 - RNA, 21 nt, Mycobacterium tuberculosis H37Rv
ggguggcgucgaucucgauca

SEQ ID NO: 1329029 - RNA, 14 nt, Mycobacterium tuberculosis H37Rv
ggguggcggcggcg

SEQ ID NO: 1329030 - RNA, 11 nt, Mycobacterium tuberculosis H37Rv
gggugggugca

SEQ ID NO: 1329031 - RNA, 23 nt, Mycobacterium tuberculosis H37Rv
gggugguagcugacgcugcucug

SEQ ID NO: 1329032 - RNA, 18 nt, Mycobacterium tuberculosis H37Rv
ggguucacguucggugga

SEQ ID NO: 1329033 - RNA, 23 nt, Mycobacterium tuberculosis H37Rv
ggguugaucggcaacggcggcgu

SEQ ID NO: 1329034 - RNA, 14 nt, Mycobacterium tuberculosis H37Rv
ggguugcggucacc

SEQ ID NO: 1329035 - RNA, 20 nt, Mycobacterium tuberculosis H37Rv
ggguuggcucggcgcagcac

SEQ ID NO: 1329036 - RNA, 17 nt, Mycobacterium tuberculosis H37Rv
gggugagcgaccugggu

SEQ ID NO: 1329037 - RNA, 19 nt, Mycobacterium tuberculosis H37Rv
gggugagcauggcuagggc

SEQ ID NO: 1329038 - RNA, 20 nt, Mycobacterium tuberculosis H37Rv
gggugagcacccagcggcgu

SEQ ID NO: 1329039 - RNA, 22 nt, Mycobacterium tuberculosis H37Rv
gggugaucgaaaacgggggcgc

SEQ ID NO: 1329040 - RNA, 17 nt, Mycobacterium tuberculosis H37Rv
gggugcagaucgcccca

SEQ ID NO: 1329041 - RNA, 14 nt, Mycobacterium tuberculosis H37Rv
gggugcccucggcc

SEQ ID NO: 1329042 - RNA, 19 nt, Mycobacterium tuberculosis H37Rv
gggugccgacucggccaca

SEQ ID NO: 1329043 - RNA, 12 nt, Mycobacterium tuberculosis H37Rv
gggugccgcagc

SEQ ID NO: 1329044 - RNA, 23 nt, Mycobacterium tuberculosis H37Rv
gggugccagcccguugcaggacg

SEQ ID NO: 1329045 - RNA, 12 nt, Mycobacterium tuberculosis H37Rv
ggguggcggcgc

SEQ ID NO: 1329046 - RNA, 22 nt, Mycobacterium tuberculosis H37Rv
ggguggcgccggugcggcgggc

SEQ ID NO: 1329047 - RNA, 16 nt, Mycobacterium tuberculosis H37Rv
ggguggcgaggcagca

SEQ ID NO: 1329048 - RNA, 19 nt, Mycobacterium tuberculosis H37Rv
ggguggaguuggcugccgg

SEQ ID NO: 1329049 - RNA, 15 nt, Mycobacterium tuberculosis H37Rv
ggguggaucuucacc

SEQ ID NO: 1329050 - RNA, 20 nt, Mycobacterium tuberculosis H37Rv
gggugcugcgcgcggcggcc

SEQ ID NO: 1329051 - RNA, 13 nt, Mycobacterium tuberculosis H37Rv
ggguggacaccug

SEQ ID NO: 1329052 - RNA, 12 nt, Mycobacterium tuberculosis H37Rv
ggguggccagca

SEQ ID NO: 1329053 - RNA, 19 nt, Mycobacterium tuberculosis H37Rv
gggugcugaugggucaggc

SEQ ID NO: 1329054 - RNA, 17 nt, Mycobacterium tuberculosis H37Rv
gggugcucucguggaug

SEQ ID NO: 1329055 - RNA, 14 nt, Mycobacterium tuberculosis H37Rv
gggugcgagcgaca

SEQ ID NO: 1329056 - RNA, 18 nt, Mycobacterium tuberculosis H37Rv
gggugccggcagcggcgc

SEQ ID NO: 1329057 - RNA, 15 nt, Mycobacterium tuberculosis H37Rv
gggugcgcugcagcg

SEQ ID NO: 1329058 - RNA, 20 nt, Mycobacterium tuberculosis H37Rv
gggugcgccauucgcccggc

SEQ ID NO: 1329059 - RNA, 15 nt, Mycobacterium tuberculosis H37Rv
gggugcgccgcagca

SEQ ID NO: 1329060 - RNA, 16 nt, Mycobacterium tuberculosis H37Rv
gguagcggcgccgccc

SEQ ID NO: 1329061 - RNA, 21 nt, Mycobacterium tuberculosis H37Rv
gguagcguccaggucaugccg

SEQ ID NO: 1329062 - RNA, 12 nt, Mycobacterium tuberculosis H37Rv
gguagcggcgcc

SEQ ID NO: 1329063 - RNA, 15 nt, Mycobacterium tuberculosis H37Rv
gguagcgcggguggc

SEQ ID NO: 1329064 - RNA, 21 nt, Mycobacterium tuberculosis H37Rv
gguagcgcucgaucagguugg

SEQ ID NO: 1329065 - RNA, 14 nt, Mycobacterium tuberculosis H37Rv
gguagccgaccagc

SEQ ID NO: 1329066 - RNA, 16 nt, Mycobacterium tuberculosis H37Rv
gguagcgaucgugcug

SEQ ID NO: 1329067 - RNA, 23 nt, Mycobacterium tuberculosis H37Rv
gguagccccgucgaccuccacca

SEQ ID NO: 1329068 - RNA, 18 nt, Mycobacterium tuberculosis H37Rv
gguagccauucggugugg

SEQ ID NO: 1329069 - RNA, 16 nt, Mycobacterium tuberculosis H37Rv
gguagccaucggugcg

SEQ ID NO: 1329070 - RNA, 12 nt, Mycobacterium tuberculosis H37Rv
gguagagguugu

SEQ ID NO: 1329071 - RNA, 17 nt, Mycobacterium tuberculosis H37Rv
gguagcacugucgaggu

SEQ ID NO: 1329072 - RNA, 16 nt, Mycobacterium tuberculosis H37Rv
gguagaccaugaagaa

SEQ ID NO: 1329073 - RNA, 13 nt, Mycobacterium tuberculosis H37Rv
gguagacacccca

SEQ ID NO: 1329074 - RNA, 12 nt, Mycobacterium tuberculosis H37Rv
gguaccgcccgc

SEQ ID NO: 1329075 - RNA, 21 nt, Mycobacterium tuberculosis H37Rv
gguaccucgucgagcgugcgc

SEQ ID NO: 1329076 - RNA, 13 nt, Mycobacterium tuberculosis H37Rv
gguaccggcggcg

SEQ ID NO: 1329077 - RNA, 17 nt, Mycobacterium tuberculosis H37Rv
gguaccggcggcgccgg

SEQ ID NO: 1329078 - RNA, 18 nt, Mycobacterium tuberculosis H37Rv
gguacgccaggugcagca

SEQ ID NO: 1329079 - RNA, 19 nt, Mycobacterium tuberculosis H37Rv
gguacgccggucggugcgg

SEQ ID NO: 1329080 - RNA, 14 nt, Mycobacterium tuberculosis H37Rv
gguacugcgcagcg

SEQ ID NO: 1329081 - RNA, 22 nt, Mycobacterium tuberculosis H37Rv
gguacggacagcgggagcagca

SEQ ID NO: 1329082 - RNA, 19 nt, Mycobacterium tuberculosis H37Rv
gguaccacgcuggcgcgua

SEQ ID NO: 1329083 - RNA, 13 nt, Mycobacterium tuberculosis H37Rv
gguaccccagcgc

SEQ ID NO: 1329084 - RNA, 16 nt, Mycobacterium tuberculosis H37Rv
gguaccaaccugcgcg

SEQ ID NO: 1329085 - RNA, 21 nt, Mycobacterium tuberculosis H37Rv
gguacaucgaggccacgccag

SEQ ID NO: 1329086 - RNA, 17 nt, Mycobacterium tuberculosis H37Rv
gguacacccgcucgccc

SEQ ID NO: 1329087 - RNA, 14 nt, Mycobacterium tuberculosis H37Rv
gguaguugaggccg

SEQ ID NO: 1329088 - RNA, 18 nt, Mycobacterium tuberculosis H37Rv
gguaucgacccuccagca

SEQ ID NO: 1329089 - RNA, 17 nt, Mycobacterium tuberculosis H37Rv
gguauccacgccgggca

SEQ ID NO: 1329090 - RNA, 21 nt, Mycobacterium tuberculosis H37Rv
gguagucgggcaaggcggcgg

SEQ ID NO: 1329091 - RNA, 15 nt, Mycobacterium tuberculosis H37Rv
gguaguggggugcgg

SEQ ID NO: 1329092 - RNA, 17 nt, Mycobacterium tuberculosis H37Rv
gguaggccaucugcucg

SEQ ID NO: 1329093 - RNA, 20 nt, Mycobacterium tuberculosis H37Rv
gguagguucgacggacaccc

SEQ ID NO: 1329094 - RNA, 12 nt, Mycobacterium tuberculosis H37Rv
gguaggcggcca

SEQ ID NO: 1329095 - RNA, 20 nt, Mycobacterium tuberculosis H37Rv
gguauucguggucggccucg

SEQ ID NO: 1329096 - RNA, 21 nt, Mycobacterium tuberculosis H37Rv
ggucaaccccggaccgcggcc

SEQ ID NO: 1329097 - RNA, 16 nt, Mycobacterium tuberculosis H37Rv
ggucaaacgcgcgcgc

SEQ ID NO: 1329098 - RNA, 15 nt, Mycobacterium tuberculosis H37Rv
gguaucggcgugcug

SEQ ID NO: 1329099 - RNA, 19 nt, Mycobacterium tuberculosis H37Rv
gguaugagcuuccgcgcgc

SEQ ID NO: 1329100 - RNA, 13 nt, Mycobacterium tuberculosis H37Rv
gguauggcggcga

SEQ ID NO: 1329101 - RNA, 20 nt, Mycobacterium tuberculosis H37Rv
ggucacacucccauccgccu

SEQ ID NO: 1329102 - RNA, 21 nt, Mycobacterium tuberculosis H37Rv
ggucaccccuucgccagcgcc

SEQ ID NO: 1329103 - RNA, 20 nt, Mycobacterium tuberculosis H37Rv
ggucaccauggcgccgcgcc

SEQ ID NO: 1329104 - RNA, 20 nt, Mycobacterium tuberculosis H37Rv
ggucacccccggccagcguc

SEQ ID NO: 1329105 - RNA, 20 nt, Mycobacterium tuberculosis H37Rv
ggucaaugcuggcagcggcc

SEQ ID NO: 1329106 - RNA, 17 nt, Mycobacterium tuberculosis H37Rv
ggucaauugugcggccc

SEQ ID NO: 1329107 - RNA, 15 nt, Mycobacterium tuberculosis H37Rv
ggucaagccggcgcc

SEQ ID NO: 1329108 - RNA, 18 nt, Mycobacterium tuberculosis H37Rv
ggucaagacccgcaucca

SEQ ID NO: 1329109 - RNA, 18 nt, Mycobacterium tuberculosis H37Rv
ggucacgugggccaugcu

SEQ ID NO: 1329110 - RNA, 14 nt, Mycobacterium tuberculosis H37Rv
ggucacguccgcgg

SEQ ID NO: 1329111 - RNA, 15 nt, Mycobacterium tuberculosis H37Rv
ggucagacgccggcc

SEQ ID NO: 1329112 - RNA, 20 nt, Mycobacterium tuberculosis H37Rv
ggucagacgccggccgccga

SEQ ID NO: 1329113 - RNA, 17 nt, Mycobacterium tuberculosis H37Rv
ggucaccucgucgccua

SEQ ID NO: 1329114 - RNA, 22 nt, Mycobacterium tuberculosis H37Rv
ggucaccggcuucuccuccaga

SEQ ID NO: 1329115 - RNA, 20 nt, Mycobacterium tuberculosis H37Rv
ggucaccggcgaccggugcc

SEQ ID NO: 1329116 - RNA, 13 nt, Mycobacterium tuberculosis H37Rv
ggucaccugcugc

SEQ ID NO: 1329117 - RNA, 12 nt, Mycobacterium tuberculosis H37Rv
ggucaccuucuu

SEQ ID NO: 1329118 - RNA, 14 nt, Mycobacterium tuberculosis H37Rv
ggucacgcagcacc

SEQ ID NO: 1329119 - RNA, 22 nt, Mycobacterium tuberculosis H37Rv
ggucacgcagucgggcagcgcu

SEQ ID NO: 1329120 - RNA, 17 nt, Mycobacterium tuberculosis H37Rv
ggucacgguagcguucg

SEQ ID NO: 1329121 - RNA, 23 nt, Mycobacterium tuberculosis H37Rv
ggucacgccgugugugcggcggu

SEQ ID NO: 1329122 - RNA, 19 nt, Mycobacterium tuberculosis H37Rv
ggucagcaauacggcggcg

SEQ ID NO: 1329123 - RNA, 23 nt, Mycobacterium tuberculosis H37Rv
ggucagcacccaacccggcggca

SEQ ID NO: 1329124 - RNA, 16 nt, Mycobacterium tuberculosis H37Rv
ggucagcaccaccagc

SEQ ID NO: 1329125 - RNA, 11 nt, Mycobacterium tuberculosis H37Rv
ggucagcagcg

SEQ ID NO: 1329126 - RNA, 12 nt, Mycobacterium tuberculosis H37Rv
ggucagccgcgg

SEQ ID NO: 1329127 - RNA, 22 nt, Mycobacterium tuberculosis H37Rv
ggucagcacccaacccggcggc

SEQ ID NO: 1329128 - RNA, 19 nt, Mycobacterium tuberculosis H37Rv
ggucagcgaccucacugcg

SEQ ID NO: 1329129 - RNA, 13 nt, Mycobacterium tuberculosis H37Rv
ggucaggcggccg

SEQ ID NO: 1329130 - RNA, 13 nt, Mycobacterium tuberculosis H37Rv
ggucaggccgccg

SEQ ID NO: 1329131 - RNA, 16 nt, Mycobacterium tuberculosis H37Rv
ggucaggccaggguga

SEQ ID NO: 1329132 - RNA, 21 nt, Mycobacterium tuberculosis H37Rv
ggucagcugacgggccgcugu

SEQ ID NO: 1329133 - RNA, 13 nt, Mycobacterium tuberculosis H37Rv
ggucagcucgcca

SEQ ID NO: 1329134 - RNA, 14 nt, Mycobacterium tuberculosis H37Rv
ggucagcgugcagg

SEQ ID NO: 1329135 - RNA, 16 nt, Mycobacterium tuberculosis H37Rv
ggucagcgcggcgacc

SEQ ID NO: 1329136 - RNA, 17 nt, Mycobacterium tuberculosis H37Rv
ggucagguugucggcga

SEQ ID NO: 1329137 - RNA, 17 nt, Mycobacterium tuberculosis H37Rv
ggucagguccugggugu

SEQ ID NO: 1329138 - RNA, 13 nt, Mycobacterium tuberculosis H37Rv
ggucagggugggc

SEQ ID NO: 1329139 - RNA, 13 nt, Mycobacterium tuberculosis H37Rv
ggucaucggcgcc

SEQ ID NO: 1329140 - RNA, 23 nt, Mycobacterium tuberculosis H37Rv
ggucaucagcgugcauggcggug

SEQ ID NO: 1329141 - RNA, 15 nt, Mycobacterium tuberculosis H37Rv
ggucauccagccagc

SEQ ID NO: 1329142 - RNA, 16 nt, Mycobacterium tuberculosis H37Rv
ggucauccagccagca

SEQ ID NO: 1329143 - RNA, 19 nt, Mycobacterium tuberculosis H37Rv
ggucaguccgucggccugg

SEQ ID NO: 1329144 - RNA, 20 nt, Mycobacterium tuberculosis H37Rv
ggucaggucugacagaccgg

SEQ ID NO: 1329145 - RNA, 23 nt, Mycobacterium tuberculosis H37Rv
gguccagacaucagugcgccggc

SEQ ID NO: 1329146 - RNA, 18 nt, Mycobacterium tuberculosis H37Rv
gguccaccuuggucgcca

SEQ ID NO: 1329147 - RNA, 22 nt, Mycobacterium tuberculosis H37Rv
gguccagcagcucggccgaggc

SEQ ID NO: 1329148 - RNA, 13 nt, Mycobacterium tuberculosis H37Rv
gguccagccaacg

SEQ ID NO: 1329149 - RNA, 15 nt, Mycobacterium tuberculosis H37Rv
gguccagccaccgcc

SEQ ID NO: 1329150 - RNA, 19 nt, Mycobacterium tuberculosis H37Rv
gguccacaaaccgugcacg

SEQ ID NO: 1329151 - RNA, 14 nt, Mycobacterium tuberculosis H37Rv
gguccaacagcgcc

SEQ ID NO: 1329152 - RNA, 14 nt, Mycobacterium tuberculosis H37Rv
gguccacacgcugc

SEQ ID NO: 1329153 - RNA, 17 nt, Mycobacterium tuberculosis H37Rv
gguccacagccggcggc

SEQ ID NO: 1329154 - RNA, 14 nt, Mycobacterium tuberculosis H37Rv
gguccaccggccag

SEQ ID NO: 1329155 - RNA, 15 nt, Mycobacterium tuberculosis H37Rv
gguccaaccagcacc

SEQ ID NO: 1329156 - RNA, 17 nt, Mycobacterium tuberculosis H37Rv
gguccaaagcacguccu

SEQ ID NO: 1329157 - RNA, 14 nt, Mycobacterium tuberculosis H37Rv
ggucaugggcgcgu

SEQ ID NO: 1329158 - RNA, 15 nt, Mycobacterium tuberculosis H37Rv
ggucaucgggcagcg

SEQ ID NO: 1329159 - RNA, 17 nt, Mycobacterium tuberculosis H37Rv
gguccgccacggcgggc

SEQ ID NO: 1329160 - RNA, 17 nt, Mycobacterium tuberculosis H37Rv
gguccgaugcgugccga

SEQ ID NO: 1329161 - RNA, 14 nt, Mycobacterium tuberculosis H37Rv
gguccgccacggcg

SEQ ID NO: 1329162 - RNA, 15 nt, Mycobacterium tuberculosis H37Rv
gguccggcccgggga

SEQ ID NO: 1329163 - RNA, 14 nt, Mycobacterium tuberculosis H37Rv
gguccgccggugcc

SEQ ID NO: 1329164 - RNA, 18 nt, Mycobacterium tuberculosis H37Rv
gguccgcggcccucgccu

SEQ ID NO: 1329165 - RNA, 16 nt, Mycobacterium tuberculosis H37Rv
gguccgccgggccccg

SEQ ID NO: 1329166 - RNA, 17 nt, Mycobacterium tuberculosis H37Rv
gguccgucaccaccgcc

SEQ ID NO: 1329167 - RNA, 12 nt, Mycobacterium tuberculosis H37Rv
gguccggcggcc

SEQ ID NO: 1329168 - RNA, 14 nt, Mycobacterium tuberculosis H37Rv
gguccggcggccgg

SEQ ID NO: 1329169 - RNA, 15 nt, Mycobacterium tuberculosis H37Rv
gguccucgagcggca

SEQ ID NO: 1329170 - RNA, 15 nt, Mycobacterium tuberculosis H37Rv
gguccucgucggcgu

SEQ ID NO: 1329171 - RNA, 19 nt, Mycobacterium tuberculosis H37Rv
ggucccggccgggucuucc

SEQ ID NO: 1329172 - RNA, 12 nt, Mycobacterium tuberculosis H37Rv
ggucccgugcgc

SEQ ID NO: 1329173 - RNA, 15 nt, Mycobacterium tuberculosis H37Rv
gguccaggcguugga

SEQ ID NO: 1329174 - RNA, 16 nt, Mycobacterium tuberculosis H37Rv
ggucccgaugaccuug

SEQ ID NO: 1329175 - RNA, 14 nt, Mycobacterium tuberculosis H37Rv
ggucccagccuggc

SEQ ID NO: 1329176 - RNA, 13 nt, Mycobacterium tuberculosis H37Rv
gguccaggucggg

SEQ ID NO: 1329177 - RNA, 11 nt, Mycobacterium tuberculosis H37Rv
gguccaguuca

SEQ ID NO: 1329178 - RNA, 20 nt, Mycobacterium tuberculosis H37Rv
gguccaucaaccccagcgca

SEQ ID NO: 1329179 - RNA, 18 nt, Mycobacterium tuberculosis H37Rv
gguccaucgcgcugcggc

SEQ ID NO: 1329180 - RNA, 18 nt, Mycobacterium tuberculosis H37Rv
gguccauggacggccagg

SEQ ID NO: 1329181 - RNA, 13 nt, Mycobacterium tuberculosis H37Rv
gguccagcccagc

SEQ ID NO: 1329182 - RNA, 18 nt, Mycobacterium tuberculosis H37Rv
gguccagcgaggagcagg

SEQ ID NO: 1329183 - RNA, 23 nt, Mycobacterium tuberculosis H37Rv
gguccagcgggaucugacccagc

SEQ ID NO: 1329184 - RNA, 12 nt, Mycobacterium tuberculosis H37Rv
ggucgaagcugg

SEQ ID NO: 1329185 - RNA, 19 nt, Mycobacterium tuberculosis H37Rv
ggucgacaggugccagacc

SEQ ID NO: 1329186 - RNA, 21 nt, Mycobacterium tuberculosis H37Rv
ggucgaagaccaagagcgcgc

SEQ ID NO: 1329187 - RNA, 20 nt, Mycobacterium tuberculosis H37Rv
ggucgaaucgcugccgccga

SEQ ID NO: 1329188 - RNA, 16 nt, Mycobacterium tuberculosis H37Rv
ggucgacgggucggcg

SEQ ID NO: 1329189 - RNA, 18 nt, Mycobacterium tuberculosis H37Rv
ggucgacugggacgacgc

SEQ ID NO: 1329190 - RNA, 20 nt, Mycobacterium tuberculosis H37Rv
ggucgacgaucucuccugga

SEQ ID NO: 1329191 - RNA, 22 nt, Mycobacterium tuberculosis H37Rv
gguccuucuccagauccacgcc

SEQ ID NO: 1329192 - RNA, 19 nt, Mycobacterium tuberculosis H37Rv
gguccuugucggccccggc

SEQ ID NO: 1329193 - RNA, 20 nt, Mycobacterium tuberculosis H37Rv
gguccuugucggccccggcc

SEQ ID NO: 1329194 - RNA, 18 nt, Mycobacterium tuberculosis H37Rv
gguccgucgagucgccga

SEQ ID NO: 1329195 - RNA, 23 nt, Mycobacterium tuberculosis H37Rv
gguccgucggguagugcccacaa

SEQ ID NO: 1329196 - RNA, 21 nt, Mycobacterium tuberculosis H37Rv
gguccugcucgcacagcacca

SEQ ID NO: 1329197 - RNA, 22 nt, Mycobacterium tuberculosis H37Rv
ggucgcaauauccggccgagcc

SEQ ID NO: 1329198 - RNA, 12 nt, Mycobacterium tuberculosis H37Rv
ggucgaugcugc

SEQ ID NO: 1329199 - RNA, 15 nt, Mycobacterium tuberculosis H37Rv
ggucgaugucggcga

SEQ ID NO: 1329200 - RNA, 15 nt, Mycobacterium tuberculosis H37Rv
ggucgcacccugcgc

SEQ ID NO: 1329201 - RNA, 17 nt, Mycobacterium tuberculosis H37Rv
ggucgcauggucgacga

SEQ ID NO: 1329202 - RNA, 16 nt, Mycobacterium tuberculosis H37Rv
ggucgcauucugcugc

SEQ ID NO: 1329203 - RNA, 23 nt, Mycobacterium tuberculosis H37Rv
ggucgaucaugacgagccgagcc

SEQ ID NO: 1329204 - RNA, 16 nt, Mycobacterium tuberculosis H37Rv
ggucgaguugaagaau

SEQ ID NO: 1329205 - RNA, 13 nt, Mycobacterium tuberculosis H37Rv
ggucgaggugacu

SEQ ID NO: 1329206 - RNA, 22 nt, Mycobacterium tuberculosis H37Rv
ggucgagcacgcugcugcgggu

SEQ ID NO: 1329207 - RNA, 13 nt, Mycobacterium tuberculosis H37Rv
ggucgagcgccuu

SEQ ID NO: 1329208 - RNA, 14 nt, Mycobacterium tuberculosis H37Rv
ggucgagggcggcg

SEQ ID NO: 1329209 - RNA, 13 nt, Mycobacterium tuberculosis H37Rv
ggucgcccaggcc

SEQ ID NO: 1329210 - RNA, 18 nt, Mycobacterium tuberculosis H37Rv
ggucgccggacugcggcc

SEQ ID NO: 1329211 - RNA, 13 nt, Mycobacterium tuberculosis H37Rv
ggucgccggggcc

SEQ ID NO: 1329212 - RNA, 17 nt, Mycobacterium tuberculosis H37Rv
ggucgccaagugcaggg

SEQ ID NO: 1329213 - RNA, 18 nt, Mycobacterium tuberculosis H37Rv
ggucgccaacgccagcac

SEQ ID NO: 1329214 - RNA, 22 nt, Mycobacterium tuberculosis H37Rv
ggucgccauguugaagcgaagc

SEQ ID NO: 1329215 - RNA, 20 nt, Mycobacterium tuberculosis H37Rv
ggucgccaugucggccaggu

SEQ ID NO: 1329216 - RNA, 15 nt, Mycobacterium tuberculosis H37Rv
ggucgcgcgauggac

SEQ ID NO: 1329217 - RNA, 18 nt, Mycobacterium tuberculosis H37Rv
ggucgcgcagcuccaccg

SEQ ID NO: 1329218 - RNA, 21 nt, Mycobacterium tuberculosis H37Rv
ggucgcugauccgggcgccga

SEQ ID NO: 1329219 - RNA, 20 nt, Mycobacterium tuberculosis H37Rv
ggucgcugauccgggcgccg

SEQ ID NO: 1329220 - RNA, 18 nt, Mycobacterium tuberculosis H37Rv
ggucgcgguggcggcggu

SEQ ID NO: 1329221 - RNA, 15 nt, Mycobacterium tuberculosis H37Rv
ggucgcuucagcgcc

SEQ ID NO: 1329222 - RNA, 17 nt, Mycobacterium tuberculosis H37Rv
ggucgcugugcagcggg

SEQ ID NO: 1329223 - RNA, 23 nt, Mycobacterium tuberculosis H37Rv
ggucggacagcgucucggaggcg

SEQ ID NO: 1329224 - RNA, 19 nt, Mycobacterium tuberculosis H37Rv
ggucggaccacccggcgcg

SEQ ID NO: 1329225 - RNA, 19 nt, Mycobacterium tuberculosis H37Rv
ggucggagacgucuucggg

SEQ ID NO: 1329226 - RNA, 13 nt, Mycobacterium tuberculosis H37Rv
ggucggcagcugg

SEQ ID NO: 1329227 - RNA, 14 nt, Mycobacterium tuberculosis H37Rv
ggucggcagcuggg

SEQ ID NO: 1329228 - RNA, 23 nt, Mycobacterium tuberculosis H37Rv
ggucuacgccaccgagaucggac

SEQ ID NO: 1329229 - RNA, 13 nt, Mycobacterium tuberculosis H37Rv
ggucuagcugggu

SEQ ID NO: 1329230 - RNA, 14 nt, Mycobacterium tuberculosis H37Rv
ggucguugucgggg

SEQ ID NO: 1329231 - RNA, 17 nt, Mycobacterium tuberculosis H37Rv
ggucguuggcggcgguc

SEQ ID NO: 1329232 - RNA, 15 nt, Mycobacterium tuberculosis H37Rv
ggucguuggucgggg

SEQ ID NO: 1329233 - RNA, 15 nt, Mycobacterium tuberculosis H37Rv
ggucguugaggccgg

SEQ ID NO: 1329234 - RNA, 14 nt, Mycobacterium tuberculosis H37Rv
ggucguggcugugc

SEQ ID NO: 1329235 - RNA, 15 nt, Mycobacterium tuberculosis H37Rv
ggucgugccagcagc

SEQ ID NO: 1329236 - RNA, 14 nt, Mycobacterium tuberculosis H37Rv
ggucgugccagcag

SEQ ID NO: 1329237 - RNA, 20 nt, Mycobacterium tuberculosis H37Rv
ggucgugcaggcgacggcuc

SEQ ID NO: 1329238 - RNA, 18 nt, Mycobacterium tuberculosis H37Rv
ggucgguuuccuccggca

SEQ ID NO: 1329239 - RNA, 22 nt, Mycobacterium tuberculosis H37Rv
ggucggcugucgugccucucgg

SEQ ID NO: 1329240 - RNA, 15 nt, Mycobacterium tuberculosis H37Rv
ggucggcgaccgcgc

SEQ ID NO: 1329241 - RNA, 17 nt, Mycobacterium tuberculosis H37Rv
ggucggcgaacgcggcg

SEQ ID NO: 1329242 - RNA, 18 nt, Mycobacterium tuberculosis H37Rv
ggucgguaccgguaccug

SEQ ID NO: 1329243 - RNA, 15 nt, Mycobacterium tuberculosis H37Rv
ggucggugggcggcg

SEQ ID NO: 1329244 - RNA, 20 nt, Mycobacterium tuberculosis H37Rv
ggucgguggucucgacggcg

SEQ ID NO: 1329245 - RNA, 22 nt, Mycobacterium tuberculosis H37Rv
ggucggugaugguuucggcggg

SEQ ID NO: 1329246 - RNA, 20 nt, Mycobacterium tuberculosis H37Rv
ggucggggagcugcggcggc

SEQ ID NO: 1329247 - RNA, 12 nt, Mycobacterium tuberculosis H37Rv
ggucgggcggcg

SEQ ID NO: 1329248 - RNA, 13 nt, Mycobacterium tuberculosis H37Rv
ggucgggcggcga

SEQ ID NO: 1329249 - RNA, 15 nt, Mycobacterium tuberculosis H37Rv
ggucgggcggcgacc

SEQ ID NO: 1329250 - RNA, 17 nt, Mycobacterium tuberculosis H37Rv
ggucggcugauuggccc

SEQ ID NO: 1329251 - RNA, 22 nt, Mycobacterium tuberculosis H37Rv
ggucugacagaccgggcaccag

SEQ ID NO: 1329252 - RNA, 20 nt, Mycobacterium tuberculosis H37Rv
ggucugcgccgccggcggcg

SEQ ID NO: 1329253 - RNA, 21 nt, Mycobacterium tuberculosis H37Rv
ggucugcgccgccggcggcgg

SEQ ID NO: 1329254 - RNA, 16 nt, Mycobacterium tuberculosis H37Rv
ggucugcgccgccggc

SEQ ID NO: 1329255 - RNA, 16 nt, Mycobacterium tuberculosis H37Rv
ggucugcgccaaaauc

SEQ ID NO: 1329256 - RNA, 20 nt, Mycobacterium tuberculosis H37Rv
ggucugccaaaagggcggca

SEQ ID NO: 1329257 - RNA, 16 nt, Mycobacterium tuberculosis H37Rv
ggucuccggaucgccg

SEQ ID NO: 1329258 - RNA, 22 nt, Mycobacterium tuberculosis H37Rv
ggucucaacgcaucgguggcac

SEQ ID NO: 1329259 - RNA, 19 nt, Mycobacterium tuberculosis H37Rv
ggucucacguugugagcca

SEQ ID NO: 1329260 - RNA, 20 nt, Mycobacterium tuberculosis H37Rv
ggucucggaaacggaccucc

SEQ ID NO: 1329261 - RNA, 13 nt, Mycobacterium tuberculosis H37Rv
ggucucggugcgg

SEQ ID NO: 1329262 - RNA, 16 nt, Mycobacterium tuberculosis H37Rv
ggucuuggcgauccag

SEQ ID NO: 1329263 - RNA, 18 nt, Mycobacterium tuberculosis H37Rv
ggucuuugcucucggucu

SEQ ID NO: 1329264 - RNA, 15 nt, Mycobacterium tuberculosis H37Rv
ggucuggacugcagc

SEQ ID NO: 1329265 - RNA, 10 nt, Mycobacterium tuberculosis H37Rv
ggucugcucc

SEQ ID NO: 1329266 - RNA, 17 nt, Mycobacterium tuberculosis H37Rv
ggucugcuccaggcgcg

SEQ ID NO: 1329267 - RNA, 11 nt, Mycobacterium tuberculosis H37Rv
ggucugcucau

SEQ ID NO: 1329268 - RNA, 15 nt, Mycobacterium tuberculosis H37Rv
ggucuguuggugaca

SEQ ID NO: 1329269 - RNA, 20 nt, Mycobacterium tuberculosis H37Rv
gccguaugccgccaaccgcg

SEQ ID NO: 1329270 - RNA, 17 nt, Mycobacterium tuberculosis H37Rv
gccguaucggggcacca

SEQ ID NO: 1329271 - RNA, 16 nt, Mycobacterium tuberculosis H37Rv
gccguauccaggcgug

SEQ ID NO: 1329272 - RNA, 17 nt, Mycobacterium tuberculosis H37Rv
gccgcuugccccgccuu

SEQ ID NO: 1329273 - RNA, 14 nt, Mycobacterium tuberculosis H37Rv
gccgcuugggccug

SEQ ID NO: 1329274 - RNA, 16 nt, Mycobacterium tuberculosis H37Rv
gccgcuuggcgcggcc

SEQ ID NO: 1329275 - RNA, 21 nt, Mycobacterium tuberculosis H37Rv
gccgucugcggggugagugac

SEQ ID NO: 1329276 - RNA, 18 nt, Mycobacterium tuberculosis H37Rv
gccgucuucgccgccacc

SEQ ID NO: 1329277 - RNA, 21 nt, Mycobacterium tuberculosis H37Rv
gccgucuucgccgccaccggc

SEQ ID NO: 1329278 - RNA, 16 nt, Mycobacterium tuberculosis H37Rv
gccgucuuggcccggu

SEQ ID NO: 1329279 - RNA, 16 nt, Mycobacterium tuberculosis H37Rv
gccgucuugccggcca

SEQ ID NO: 1329280 - RNA, 22 nt, Mycobacterium tuberculosis H37Rv
gccgucggggaguucgcgcagc

SEQ ID NO: 1329281 - RNA, 23 nt, Mycobacterium tuberculosis H37Rv
gccgucggggaguucgcgcagca

SEQ ID NO: 1329282 - RNA, 21 nt, Mycobacterium tuberculosis H37Rv
gccgucugacagcauccuucg

SEQ ID NO: 1329283 - RNA, 17 nt, Mycobacterium tuberculosis H37Rv
gccgucgcugguguaga

SEQ ID NO: 1329284 - RNA, 20 nt, Mycobacterium tuberculosis H37Rv
gccgucggccucggcggucg

SEQ ID NO: 1329285 - RNA, 22 nt, Mycobacterium tuberculosis H37Rv
gccgucggcgagcagacgccgc

SEQ ID NO: 1329286 - RNA, 16 nt, Mycobacterium tuberculosis H37Rv
gccgucggcgaugaag

SEQ ID NO: 1329287 - RNA, 17 nt, Mycobacterium tuberculosis H37Rv
gccgucgccguuggguu

SEQ ID NO: 1329288 - RNA, 21 nt, Mycobacterium tuberculosis H37Rv
gccgucgcugacgcccuccug

SEQ ID NO: 1329289 - RNA, 19 nt, Mycobacterium tuberculosis H37Rv
gccguccgguguggcgcug

SEQ ID NO: 1329290 - RNA, 15 nt, Mycobacterium tuberculosis H37Rv
gccgucgccgccggc

SEQ ID NO: 1329291 - RNA, 23 nt, Mycobacterium tuberculosis H37Rv
gccguccggguagacauggguga

SEQ ID NO: 1329292 - RNA, 16 nt, Mycobacterium tuberculosis H37Rv
gccguccggcgcccac

SEQ ID NO: 1329293 - RNA, 19 nt, Mycobacterium tuberculosis H37Rv
gccguccggcgcccacauc

SEQ ID NO: 1329294 - RNA, 15 nt, Mycobacterium tuberculosis H37Rv
gccguccggcgccug

SEQ ID NO: 1329295 - RNA, 17 nt, Mycobacterium tuberculosis H37Rv
gccguccggcgccugcu

SEQ ID NO: 1329296 - RNA, 20 nt, Mycobacterium tuberculosis H37Rv
gccguccgguggaccgccga

SEQ ID NO: 1329297 - RNA, 16 nt, Mycobacterium tuberculosis H37Rv
gccgucaacgauggug

SEQ ID NO: 1329298 - RNA, 15 nt, Mycobacterium tuberculosis H37Rv
gccgucaccgccauu

SEQ ID NO: 1329299 - RNA, 19 nt, Mycobacterium tuberculosis H37Rv
gccgucaccgccauugcca

SEQ ID NO: 1329300 - RNA, 21 nt, Mycobacterium tuberculosis H37Rv
gccgucaccgccgaccaggcc

SEQ ID NO: 1329301 - RNA, 23 nt, Mycobacterium tuberculosis H37Rv
gccgucagaacaccggccaggcc

SEQ ID NO: 1329302 - RNA, 15 nt, Mycobacterium tuberculosis H37Rv
gccgucagaacaccg

SEQ ID NO: 1329303 - RNA, 17 nt, Mycobacterium tuberculosis H37Rv
gccgucaccgcgcggcu

SEQ ID NO: 1329304 - RNA, 20 nt, Mycobacterium tuberculosis H37Rv
gccgucccgauacggccggc

SEQ ID NO: 1329305 - RNA, 15 nt, Mycobacterium tuberculosis H37Rv
gccgucccgcgagca

SEQ ID NO: 1329306 - RNA, 22 nt, Mycobacterium tuberculosis H37Rv
gccgucccgcgagcagcccggc

SEQ ID NO: 1329307 - RNA, 18 nt, Mycobacterium tuberculosis H37Rv
gccguccgcaccggcggc

SEQ ID NO: 1329308 - RNA, 21 nt, Mycobacterium tuberculosis H37Rv
gccguuuccgccgccgccauc

SEQ ID NO: 1329309 - RNA, 20 nt, Mycobacterium tuberculosis H37Rv
gccguuggugaggccccccg

SEQ ID NO: 1329310 - RNA, 23 nt, Mycobacterium tuberculosis H37Rv
gccguuggugaggccccccgcgc

SEQ ID NO: 1329311 - RNA, 17 nt, Mycobacterium tuberculosis H37Rv
gccguuggugccgccug

SEQ ID NO: 1329312 - RNA, 19 nt, Mycobacterium tuberculosis H37Rv
gccguuguagacggcggca

SEQ ID NO: 1329313 - RNA, 19 nt, Mycobacterium tuberculosis H37Rv
gccguuguaguacaccuug

SEQ ID NO: 1329314 - RNA, 22 nt, Mycobacterium tuberculosis H37Rv
gccguugggcaccguguagcug

SEQ ID NO: 1329315 - RNA, 17 nt, Mycobacterium tuberculosis H37Rv
gccguugggccaccggc

SEQ ID NO: 1329316 - RNA, 22 nt, Mycobacterium tuberculosis H37Rv
gccguugggccgcgcccuggcc

SEQ ID NO: 1329317 - RNA, 13 nt, Mycobacterium tuberculosis H37Rv
gccguuggcggcg

SEQ ID NO: 1329318 - RNA, 17 nt, Mycobacterium tuberculosis H37Rv
gccguuggcaccgggug

SEQ ID NO: 1329319 - RNA, 14 nt, Mycobacterium tuberculosis H37Rv
gccguuggagacgu

SEQ ID NO: 1329320 - RNA, 20 nt, Mycobacterium tuberculosis H37Rv
gccuagccgcagccccgaca

SEQ ID NO: 1329321 - RNA, 14 nt, Mycobacterium tuberculosis H37Rv
gccuagccgcggca

SEQ ID NO: 1329322 - RNA, 13 nt, Mycobacterium tuberculosis H37Rv
gccuagccgcagc

SEQ ID NO: 1329323 - RNA, 17 nt, Mycobacterium tuberculosis H37Rv
gccuaggccgaggccgc

SEQ ID NO: 1329324 - RNA, 14 nt, Mycobacterium tuberculosis H37Rv
gccuaggacaccgg

SEQ ID NO: 1329325 - RNA, 16 nt, Mycobacterium tuberculosis H37Rv
gccguucacccuggug

SEQ ID NO: 1329326 - RNA, 16 nt, Mycobacterium tuberculosis H37Rv
gccguucccaccacca

SEQ ID NO: 1329327 - RNA, 14 nt, Mycobacterium tuberculosis H37Rv
gccguucccgccgg

SEQ ID NO: 1329328 - RNA, 14 nt, Mycobacterium tuberculosis H37Rv
gccguucgcagcug

SEQ ID NO: 1329329 - RNA, 21 nt, Mycobacterium tuberculosis H37Rv
gccguuaccgccguugccgcc

SEQ ID NO: 1329330 - RNA, 17 nt, Mycobacterium tuberculosis H37Rv
gccguggauacgcacgg

SEQ ID NO: 1329331 - RNA, 18 nt, Mycobacterium tuberculosis H37Rv
gccguggauacgcacggc

SEQ ID NO: 1329332 - RNA, 19 nt, Mycobacterium tuberculosis H37Rv
gccguggcagucgcacggu

SEQ ID NO: 1329333 - RNA, 17 nt, Mycobacterium tuberculosis H37Rv
gccguguuccagguaca

SEQ ID NO: 1329334 - RNA, 18 nt, Mycobacterium tuberculosis H37Rv
gccgugaucggcgcccgg

SEQ ID NO: 1329335 - RNA, 23 nt, Mycobacterium tuberculosis H37Rv
gccgugaucagcucgcgcacguc

SEQ ID NO: 1329336 - RNA, 19 nt, Mycobacterium tuberculosis H37Rv
gccgugacgauucgagcaa

SEQ ID NO: 1329337 - RNA, 23 nt, Mycobacterium tuberculosis H37Rv
gccgugacgauucgagcaacugc

SEQ ID NO: 1329338 - RNA, 16 nt, Mycobacterium tuberculosis H37Rv
gccgugacccucagca

SEQ ID NO: 1329339 - RNA, 18 nt, Mycobacterium tuberculosis H37Rv
gccgugcgugcgggggcu

SEQ ID NO: 1329340 - RNA, 18 nt, Mycobacterium tuberculosis H37Rv
gccgugcugaacuccgcc

SEQ ID NO: 1329341 - RNA, 14 nt, Mycobacterium tuberculosis H37Rv
gccgugcgugcggg

SEQ ID NO: 1329342 - RNA, 13 nt, Mycobacterium tuberculosis H37Rv
gccgugcggcggc

SEQ ID NO: 1329343 - RNA, 14 nt, Mycobacterium tuberculosis H37Rv
gccgugcggcggcu

SEQ ID NO: 1329344 - RNA, 22 nt, Mycobacterium tuberculosis H37Rv
gccucgucgauguucgccgcgc

SEQ ID NO: 1329345 - RNA, 17 nt, Mycobacterium tuberculosis H37Rv
gccucguagucccacug

SEQ ID NO: 1329346 - RNA, 18 nt, Mycobacterium tuberculosis H37Rv
gccucgggcucaaacgga

SEQ ID NO: 1329347 - RNA, 18 nt, Mycobacterium tuberculosis H37Rv
gccucgggccggcguagc

SEQ ID NO: 1329348 - RNA, 23 nt, Mycobacterium tuberculosis H37Rv
gccucguuagaguaggccaccac

SEQ ID NO: 1329349 - RNA, 12 nt, Mycobacterium tuberculosis H37Rv
gccucggcaugc

SEQ ID NO: 1329350 - RNA, 15 nt, Mycobacterium tuberculosis H37Rv
gccucggcaugcagc

SEQ ID NO: 1329351 - RNA, 18 nt, Mycobacterium tuberculosis H37Rv
gccucggcaugcagcccc

SEQ ID NO: 1329352 - RNA, 21 nt, Mycobacterium tuberculosis H37Rv
gccucggagaucgagaucacc

SEQ ID NO: 1329353 - RNA, 21 nt, Mycobacterium tuberculosis H37Rv
gccucggaccagacccacgau

SEQ ID NO: 1329354 - RNA, 16 nt, Mycobacterium tuberculosis H37Rv
gccucggaccagaccc

SEQ ID NO: 1329355 - RNA, 18 nt, Mycobacterium tuberculosis H37Rv
gccucgggacucccgcgc

SEQ ID NO: 1329356 - RNA, 14 nt, Mycobacterium tuberculosis H37Rv
gccucgggcaccug

SEQ ID NO: 1329357 - RNA, 23 nt, Mycobacterium tuberculosis H37Rv
gccucggcgcugcgcaccgccgc

SEQ ID NO: 1329358 - RNA, 15 nt, Mycobacterium tuberculosis H37Rv
gccucggcgcugcgc

SEQ ID NO: 1329359 - RNA, 21 nt, Mycobacterium tuberculosis H37Rv
gccucggcgaugggccggucc

SEQ ID NO: 1329360 - RNA, 18 nt, Mycobacterium tuberculosis H37Rv
gccucggcgccgcccagc

SEQ ID NO: 1329361 - RNA, 13 nt, Mycobacterium tuberculosis H37Rv
gccucggcgcugc

SEQ ID NO: 1329362 - RNA, 15 nt, Mycobacterium tuberculosis H37Rv
gccucggcgagccgc

SEQ ID NO: 1329363 - RNA, 17 nt, Mycobacterium tuberculosis H37Rv
gccucgcuaacucccca

SEQ ID NO: 1329364 - RNA, 23 nt, Mycobacterium tuberculosis H37Rv
gccucgcgggaagucccgagugg

SEQ ID NO: 1329365 - RNA, 21 nt, Mycobacterium tuberculosis H37Rv
gccucgccguagagcuggugc

SEQ ID NO: 1329366 - RNA, 15 nt, Mycobacterium tuberculosis H37Rv
gccucgccggccacc

SEQ ID NO: 1329367 - RNA, 19 nt, Mycobacterium tuberculosis H37Rv
gccucgcccagcaaggccc

SEQ ID NO: 1329368 - RNA, 19 nt, Mycobacterium tuberculosis H37Rv
gccucgacgcggcaggccg

SEQ ID NO: 1329369 - RNA, 22 nt, Mycobacterium tuberculosis H37Rv
gccucgaccgccagccgcgagc

SEQ ID NO: 1329370 - RNA, 14 nt, Mycobacterium tuberculosis H37Rv
gccucgaccgccag

SEQ ID NO: 1329371 - RNA, 14 nt, Mycobacterium tuberculosis H37Rv
gccucgacagcggc

SEQ ID NO: 1329372 - RNA, 18 nt, Mycobacterium tuberculosis H37Rv
gccucgacacccagccgc

SEQ ID NO: 1329373 - RNA, 21 nt, Mycobacterium tuberculosis H37Rv
gccucgacacccagccgcagc

SEQ ID NO: 1329374 - RNA, 15 nt, Mycobacterium tuberculosis H37Rv
gccucgacacccagc

SEQ ID NO: 1329375 - RNA, 22 nt, Mycobacterium tuberculosis H37Rv
gccucgauuguggccagcgcuu

SEQ ID NO: 1329376 - RNA, 18 nt, Mycobacterium tuberculosis H37Rv
gccucgauuguggccagc

SEQ ID NO: 1329377 - RNA, 19 nt, Mycobacterium tuberculosis H37Rv
gccucgauuguggccagcg

SEQ ID NO: 1329378 - RNA, 21 nt, Mycobacterium tuberculosis H37Rv
gccucgagguauucgcgcagc

SEQ ID NO: 1329379 - RNA, 20 nt, Mycobacterium tuberculosis H37Rv
gccucgaguucgaccggcgg

SEQ ID NO: 1329380 - RNA, 18 nt, Mycobacterium tuberculosis H37Rv
gccuccucgugcaggacc

SEQ ID NO: 1329381 - RNA, 20 nt, Mycobacterium tuberculosis H37Rv
gccuccugccgccgcuccau

SEQ ID NO: 1329382 - RNA, 17 nt, Mycobacterium tuberculosis H37Rv
gccuccugcuggcccug

SEQ ID NO: 1329383 - RNA, 12 nt, Mycobacterium tuberculosis H37Rv
gccuccugcugg

SEQ ID NO: 1329384 - RNA, 22 nt, Mycobacterium tuberculosis H37Rv
gccuccuggaaggaggccggga

SEQ ID NO: 1329385 - RNA, 21 nt, Mycobacterium tuberculosis H37Rv
gccuccugcuggcccugcucc

SEQ ID NO: 1329386 - RNA, 14 nt, Mycobacterium tuberculosis H37Rv
gccucgacacccag

SEQ ID NO: 1329387 - RNA, 16 nt, Mycobacterium tuberculosis H37Rv
gccucgaacgccgccc

SEQ ID NO: 1329388 - RNA, 18 nt, Mycobacterium tuberculosis H37Rv
gccucgaacgccgcccgc

SEQ ID NO: 1329389 - RNA, 16 nt, Mycobacterium tuberculosis H37Rv
gccuccggcgccgccc

SEQ ID NO: 1329390 - RNA, 16 nt, Mycobacterium tuberculosis H37Rv
gccuccggagaauccg

SEQ ID NO: 1329391 - RNA, 18 nt, Mycobacterium tuberculosis H37Rv
gccuccggauccucggcc

SEQ ID NO: 1329392 - RNA, 23 nt, Mycobacterium tuberculosis H37Rv
gccuccggugcauauuggaucgu

SEQ ID NO: 1329393 - RNA, 15 nt, Mycobacterium tuberculosis H37Rv
gccuccguugccccc

SEQ ID NO: 1329394 - RNA, 21 nt, Mycobacterium tuberculosis H37Rv
gccuccuccccgaccgccacc

SEQ ID NO: 1329395 - RNA, 21 nt, Mycobacterium tuberculosis H37Rv
gccuccucgacgucggcgagc

SEQ ID NO: 1329396 - RNA, 15 nt, Mycobacterium tuberculosis H37Rv
gccucccgcgccggc

SEQ ID NO: 1329397 - RNA, 13 nt, Mycobacterium tuberculosis H37Rv
gccucccgggccg

SEQ ID NO: 1329398 - RNA, 13 nt, Mycobacterium tuberculosis H37Rv
gccuccgccugcc

SEQ ID NO: 1329399 - RNA, 17 nt, Mycobacterium tuberculosis H37Rv
gccuccgccgaggccgc

SEQ ID NO: 1329400 - RNA, 13 nt, Mycobacterium tuberculosis H37Rv
gccuccaucgcga

SEQ ID NO: 1329401 - RNA, 18 nt, Mycobacterium tuberculosis H37Rv
gccuccagcuuggcgagc

SEQ ID NO: 1329402 - RNA, 20 nt, Mycobacterium tuberculosis H37Rv
gccuccagauucgccgccca

SEQ ID NO: 1329403 - RNA, 15 nt, Mycobacterium tuberculosis H37Rv
gccuccagcaggucc

SEQ ID NO: 1329404 - RNA, 13 nt, Mycobacterium tuberculosis H37Rv
gccuccagcaccc

SEQ ID NO: 1329405 - RNA, 16 nt, Mycobacterium tuberculosis H37Rv
gccuccaccgcgucca

SEQ ID NO: 1329406 - RNA, 18 nt, Mycobacterium tuberculosis H37Rv
gccuccaccgcguccagg

SEQ ID NO: 1329407 - RNA, 15 nt, Mycobacterium tuberculosis H37Rv
gccuccacccgccac

SEQ ID NO: 1329408 - RNA, 18 nt, Mycobacterium tuberculosis H37Rv
gccuccaagcccgccgga

SEQ ID NO: 1329409 - RNA, 21 nt, Mycobacterium tuberculosis H37Rv
gccucaugcuaggccaccggc

SEQ ID NO: 1329410 - RNA, 17 nt, Mycobacterium tuberculosis H37Rv
gccucaugcuaggccac

SEQ ID NO: 1329411 - RNA, 19 nt, Mycobacterium tuberculosis H37Rv
gccuccaaaaucgcggcca

SEQ ID NO: 1329412 - RNA, 22 nt, Mycobacterium tuberculosis H37Rv
gccucauccaccgauggcgcgc

SEQ ID NO: 1329413 - RNA, 17 nt, Mycobacterium tuberculosis H37Rv
gccucagcccggccagc

SEQ ID NO: 1329414 - RNA, 13 nt, Mycobacterium tuberculosis H37Rv
gccucagcccggc

SEQ ID NO: 1329415 - RNA, 23 nt, Mycobacterium tuberculosis H37Rv
gccucaccgccgcuaccgcccgc

SEQ ID NO: 1329416 - RNA, 17 nt, Mycobacterium tuberculosis H37Rv
gccucaccggcgcgagc

SEQ ID NO: 1329417 - RNA, 12 nt, Mycobacterium tuberculosis H37Rv
gccucagccgcu

SEQ ID NO: 1329418 - RNA, 18 nt, Mycobacterium tuberculosis H37Rv
gccuagguucgcccagcc

SEQ ID NO: 1329419 - RNA, 23 nt, Mycobacterium tuberculosis H37Rv
gccuaggucgacgccgaccaccc

SEQ ID NO: 1329420 - RNA, 15 nt, Mycobacterium tuberculosis H37Rv
gccuagggcggcggc

SEQ ID NO: 1329421 - RNA, 16 nt, Mycobacterium tuberculosis H37Rv
gccuagggcggcggcg

SEQ ID NO: 1329422 - RNA, 19 nt, Mycobacterium tuberculosis H37Rv
gcgaaaguccugcagugcg

SEQ ID NO: 1329423 - RNA, 15 nt, Mycobacterium tuberculosis H37Rv
gcgaacagccccagg

SEQ ID NO: 1329424 - RNA, 12 nt, Mycobacterium tuberculosis H37Rv
gcgaacagcggc

SEQ ID NO: 1329425 - RNA, 15 nt, Mycobacterium tuberculosis H37Rv
gcgaacagcgggggc

SEQ ID NO: 1329426 - RNA, 22 nt, Mycobacterium tuberculosis H37Rv
gcgaacaucaccgucgcccggg

SEQ ID NO: 1329427 - RNA, 18 nt, Mycobacterium tuberculosis H37Rv
gcgaacaaguggccagcg

SEQ ID NO: 1329428 - RNA, 20 nt, Mycobacterium tuberculosis H37Rv
gcgaacacccgaagccggcg

SEQ ID NO: 1329429 - RNA, 17 nt, Mycobacterium tuberculosis H37Rv
gcgaaaucgacagcagc

SEQ ID NO: 1329430 - RNA, 20 nt, Mycobacterium tuberculosis H37Rv
gcgaaauuacuucggccaca

SEQ ID NO: 1329431 - RNA, 16 nt, Mycobacterium tuberculosis H37Rv
gcgaaaucgacagcag

SEQ ID NO: 1329432 - RNA, 22 nt, Mycobacterium tuberculosis H37Rv
gcgaaauccccugcgcugcagc

SEQ ID NO: 1329433 - RNA, 16 nt, Mycobacterium tuberculosis H37Rv
gcgaaauagcgagcgu

SEQ ID NO: 1329434 - RNA, 22 nt, Mycobacterium tuberculosis H37Rv
gcgaaauagcugcggaggguuc

SEQ ID NO: 1329435 - RNA, 16 nt, Mycobacterium tuberculosis H37Rv
gcgaacuuggccgagu

SEQ ID NO: 1329436 - RNA, 19 nt, Mycobacterium tuberculosis H37Rv
gcgaagacuagcugcuagc

SEQ ID NO: 1329437 - RNA, 19 nt, Mycobacterium tuberculosis H37Rv
gcgaagaacaacaucgcca

SEQ ID NO: 1329438 - RNA, 15 nt, Mycobacterium tuberculosis H37Rv
gcgaacuccagcagc

SEQ ID NO: 1329439 - RNA, 17 nt, Mycobacterium tuberculosis H37Rv
gcgaagccgagcaucag

SEQ ID NO: 1329440 - RNA, 18 nt, Mycobacterium tuberculosis H37Rv
gcgaagccgggucucggu

SEQ ID NO: 1329441 - RNA, 23 nt, Mycobacterium tuberculosis H37Rv
gcgaagccgguucgcccagcagg

SEQ ID NO: 1329442 - RNA, 13 nt, Mycobacterium tuberculosis H37Rv
gcgaagccgagca

SEQ ID NO: 1329443 - RNA, 20 nt, Mycobacterium tuberculosis H37Rv
gcgaagcauucaggccgagg

SEQ ID NO: 1329444 - RNA, 13 nt, Mycobacterium tuberculosis H37Rv
gcgaagcacaccg

SEQ ID NO: 1329445 - RNA, 21 nt, Mycobacterium tuberculosis H37Rv
gcgaagcaagugaauacccca

SEQ ID NO: 1329446 - RNA, 17 nt, Mycobacterium tuberculosis H37Rv
gcgaagagcgcacugaa

SEQ ID NO: 1329447 - RNA, 15 nt, Mycobacterium tuberculosis H37Rv
gcgaacgccacggca

SEQ ID NO: 1329448 - RNA, 22 nt, Mycobacterium tuberculosis H37Rv
gcgaacgauuucggcccacucc

SEQ ID NO: 1329449 - RNA, 19 nt, Mycobacterium tuberculosis H37Rv
gcgaaccgucagcgcgccg

SEQ ID NO: 1329450 - RNA, 14 nt, Mycobacterium tuberculosis H37Rv
gcgaacggccagga

SEQ ID NO: 1329451 - RNA, 18 nt, Mycobacterium tuberculosis H37Rv
gcgaacgucaaccgggcg

SEQ ID NO: 1329452 - RNA, 14 nt, Mycobacterium tuberculosis H37Rv
gcgaacccuccgca

SEQ ID NO: 1329453 - RNA, 12 nt, Mycobacterium tuberculosis H37Rv
gcgaacccgguc

SEQ ID NO: 1329454 - RNA, 17 nt, Mycobacterium tuberculosis H37Rv
gcgaacccccgccgcgc

SEQ ID NO: 1329455 - RNA, 19 nt, Mycobacterium tuberculosis H37Rv
gcgaaccagaguucggcca

SEQ ID NO: 1329456 - RNA, 18 nt, Mycobacterium tuberculosis H37Rv
gcgaaccacgccaucgag

SEQ ID NO: 1329457 - RNA, 14 nt, Mycobacterium tuberculosis H37Rv
gcgaacaucgccag

SEQ ID NO: 1329458 - RNA, 18 nt, Mycobacterium tuberculosis H37Rv
gccuucguagaaggaccg

SEQ ID NO: 1329459 - RNA, 17 nt, Mycobacterium tuberculosis H37Rv
gccuucguagcggccgc

SEQ ID NO: 1329460 - RNA, 17 nt, Mycobacterium tuberculosis H37Rv
gccuucguagaaggacc

SEQ ID NO: 1329461 - RNA, 17 nt, Mycobacterium tuberculosis H37Rv
gccuugacagcuuucuu

SEQ ID NO: 1329462 - RNA, 18 nt, Mycobacterium tuberculosis H37Rv
gccuugcagcgcccccgc

SEQ ID NO: 1329463 - RNA, 16 nt, Mycobacterium tuberculosis H37Rv
gccuugaucgugcugg

SEQ ID NO: 1329464 - RNA, 18 nt, Mycobacterium tuberculosis H37Rv
gccuugaucugagcgcgg

SEQ ID NO: 1329465 - RNA, 18 nt, Mycobacterium tuberculosis H37Rv
gccuugaggcccugcggc

SEQ ID NO: 1329466 - RNA, 24 nt, Mycobacterium tuberculosis H37Rv
gccuugacccauggcuccgcccag

SEQ ID NO: 1329467 - RNA, 19 nt, Mycobacterium tuberculosis H37Rv
gccuugacugaacucaaca

SEQ ID NO: 1329468 - RNA, 16 nt, Mycobacterium tuberculosis H37Rv
gccuucacgcuggccu

SEQ ID NO: 1329469 - RNA, 15 nt, Mycobacterium tuberculosis H37Rv
gccuucgccagcggc

SEQ ID NO: 1329470 - RNA, 16 nt, Mycobacterium tuberculosis H37Rv
gccuucggguucggug

SEQ ID NO: 1329471 - RNA, 14 nt, Mycobacterium tuberculosis H37Rv
gccuuggcgcccgc

SEQ ID NO: 1329472 - RNA, 15 nt, Mycobacterium tuberculosis H37Rv
gccuuggcggcggca

SEQ ID NO: 1329473 - RNA, 16 nt, Mycobacterium tuberculosis H37Rv
gccuuggucgccgccu

SEQ ID NO: 1329474 - RNA, 15 nt, Mycobacterium tuberculosis H37Rv
gccuuggucgccgcc

SEQ ID NO: 1329475 - RNA, 17 nt, Mycobacterium tuberculosis H37Rv
gccuugguagccggccg

SEQ ID NO: 1329476 - RNA, 14 nt, Mycobacterium tuberculosis H37Rv
gccuuggucgccgc

SEQ ID NO: 1329477 - RNA, 20 nt, Mycobacterium tuberculosis H37Rv
gccuuggucgccgcuuucuu

SEQ ID NO: 1329478 - RNA, 22 nt, Mycobacterium tuberculosis H37Rv
gccuuggacgugcgcgccaagu

SEQ ID NO: 1329479 - RNA, 16 nt, Mycobacterium tuberculosis H37Rv
gccuuggcagcccagu

SEQ ID NO: 1329480 - RNA, 16 nt, Mycobacterium tuberculosis H37Rv
gccuuggcaguccagc

SEQ ID NO: 1329481 - RNA, 16 nt, Mycobacterium tuberculosis H37Rv
gccuuggccaccaucg

SEQ ID NO: 1329482 - RNA, 21 nt, Mycobacterium tuberculosis H37Rv
gccuuggccaccaucgccgcc

SEQ ID NO: 1329483 - RNA, 12 nt, Mycobacterium tuberculosis H37Rv
gccuuggccagc

SEQ ID NO: 1329484 - RNA, 14 nt, Mycobacterium tuberculosis H37Rv
gccuuggcgcggca

SEQ ID NO: 1329485 - RNA, 21 nt, Mycobacterium tuberculosis H37Rv
gccuuggcgaacgccacggca

SEQ ID NO: 1329486 - RNA, 14 nt, Mycobacterium tuberculosis H37Rv
gccuuugcccccgg

SEQ ID NO: 1329487 - RNA, 17 nt, Mycobacterium tuberculosis H37Rv
gccuuugcccgccgcgu

SEQ ID NO: 1329488 - RNA, 23 nt, Mycobacterium tuberculosis H37Rv
gccuuuccagcaccccgaucugg

SEQ ID NO: 1329489 - RNA, 22 nt, Mycobacterium tuberculosis H37Rv
gccuggccggaauacccgcugg

SEQ ID NO: 1329490 - RNA, 14 nt, Mycobacterium tuberculosis H37Rv
gccuggccaccugg

SEQ ID NO: 1329491 - RNA, 14 nt, Mycobacterium tuberculosis H37Rv
gccuggcccgucgg

SEQ ID NO: 1329492 - RNA, 13 nt, Mycobacterium tuberculosis H37Rv
gccugcuggagca

SEQ ID NO: 1329493 - RNA, 15 nt, Mycobacterium tuberculosis H37Rv
gccugcugcggccag

SEQ ID NO: 1329494 - RNA, 22 nt, Mycobacterium tuberculosis H37Rv
gccugcugcacaucgcauccac

SEQ ID NO: 1329495 - RNA, 19 nt, Mycobacterium tuberculosis H37Rv
gccugcgcgaccgaccagc

SEQ ID NO: 1329496 - RNA, 12 nt, Mycobacterium tuberculosis H37Rv
gccugcggcggu

SEQ ID NO: 1329497 - RNA, 13 nt, Mycobacterium tuberculosis H37Rv
gccugcggcagca

SEQ ID NO: 1329498 - RNA, 14 nt, Mycobacterium tuberculosis H37Rv
gccugcggcagcac

SEQ ID NO: 1329499 - RNA, 22 nt, Mycobacterium tuberculosis H37Rv
gccucucuucccaaccgcccgu

SEQ ID NO: 1329500 - RNA, 18 nt, Mycobacterium tuberculosis H37Rv
gccucucgaccucagaca

SEQ ID NO: 1329501 - RNA, 21 nt, Mycobacterium tuberculosis H37Rv
gccucucgggggccgagccga

SEQ ID NO: 1329502 - RNA, 12 nt, Mycobacterium tuberculosis H37Rv
gccucugucuuc

SEQ ID NO: 1329503 - RNA, 21 nt, Mycobacterium tuberculosis H37Rv
gccugccgaaacgccgaccgc

SEQ ID NO: 1329504 - RNA, 18 nt, Mycobacterium tuberculosis H37Rv
gccuggcggcgccgcaga

SEQ ID NO: 1329505 - RNA, 15 nt, Mycobacterium tuberculosis H37Rv
gccuggcggcgccgc

SEQ ID NO: 1329506 - RNA, 18 nt, Mycobacterium tuberculosis H37Rv
gccugggcacggccgucg

SEQ ID NO: 1329507 - RNA, 17 nt, Mycobacterium tuberculosis H37Rv
gccugggccagccgcuc

SEQ ID NO: 1329508 - RNA, 23 nt, Mycobacterium tuberculosis H37Rv
gccuggcuguccgcgggccgcgc

SEQ ID NO: 1329509 - RNA, 23 nt, Mycobacterium tuberculosis H37Rv
gccuggcuaguugggugggugca

SEQ ID NO: 1329510 - RNA, 23 nt, Mycobacterium tuberculosis H37Rv
gccuguagucccucaucaccucu

SEQ ID NO: 1329511 - RNA, 14 nt, Mycobacterium tuberculosis H37Rv
gccugggccgcaca

SEQ ID NO: 1329512 - RNA, 22 nt, Mycobacterium tuberculosis H37Rv
gccuucaacgcgaguccgcugc

SEQ ID NO: 1329513 - RNA, 15 nt, Mycobacterium tuberculosis H37Rv
gccuucaaaaggaag

SEQ ID NO: 1329514 - RNA, 19 nt, Mycobacterium tuberculosis H37Rv
gccuguccacguccagccc

SEQ ID NO: 1329515 - RNA, 16 nt, Mycobacterium tuberculosis H37Rv
gccuguccugcgggag

SEQ ID NO: 1329516 - RNA, 16 nt, Mycobacterium tuberculosis H37Rv
gcgacuaccaucgccg

SEQ ID NO: 1329517 - RNA, 14 nt, Mycobacterium tuberculosis H37Rv
gcgacucgccggcg

SEQ ID NO: 1329518 - RNA, 21 nt, Mycobacterium tuberculosis H37Rv
gcgacucgccggcgaauccgc

SEQ ID NO: 1329519 - RNA, 14 nt, Mycobacterium tuberculosis H37Rv
gcgacuacggccuc

SEQ ID NO: 1329520 - RNA, 22 nt, Mycobacterium tuberculosis H37Rv
gcgacuagacgccgccgcugcc

SEQ ID NO: 1329521 - RNA, 15 nt, Mycobacterium tuberculosis H37Rv
gcgagaacccgagcg

SEQ ID NO: 1329522 - RNA, 15 nt, Mycobacterium tuberculosis H37Rv
gcgacucggccagga

SEQ ID NO: 1329523 - RNA, 16 nt, Mycobacterium tuberculosis H37Rv
gcgagagccggcggcg

SEQ ID NO: 1329524 - RNA, 15 nt, Mycobacterium tuberculosis H37Rv
gcgagagccucggcc

SEQ ID NO: 1329525 - RNA, 15 nt, Mycobacterium tuberculosis H37Rv
gcgagagcgcggaga

SEQ ID NO: 1329526 - RNA, 13 nt, Mycobacterium tuberculosis H37Rv
gcgagacgcucca

SEQ ID NO: 1329527 - RNA, 20 nt, Mycobacterium tuberculosis H37Rv
gcgagaaggugcugcgcggg

SEQ ID NO: 1329528 - RNA, 19 nt, Mycobacterium tuberculosis H37Rv
gcgagaagucgcagcgagg

SEQ ID NO: 1329529 - RNA, 23 nt, Mycobacterium tuberculosis H37Rv
gcgagaccucucugcgccaggcg

SEQ ID NO: 1329530 - RNA, 14 nt, Mycobacterium tuberculosis H37Rv
gcgagcaggggagu

SEQ ID NO: 1329531 - RNA, 14 nt, Mycobacterium tuberculosis H37Rv
gcgagcaggucgga

SEQ ID NO: 1329532 - RNA, 18 nt, Mycobacterium tuberculosis H37Rv
gcgagauagcaccaguuu

SEQ ID NO: 1329533 - RNA, 13 nt, Mycobacterium tuberculosis H37Rv
gcgagccacggca

SEQ ID NO: 1329534 - RNA, 13 nt, Mycobacterium tuberculosis H37Rv
gcgagcccagcug

SEQ ID NO: 1329535 - RNA, 20 nt, Mycobacterium tuberculosis H37Rv
gcgagcaucugggguccggu

SEQ ID NO: 1329536 - RNA, 22 nt, Mycobacterium tuberculosis H37Rv
gcgagcccagcugcgccgaacg

SEQ ID NO: 1329537 - RNA, 14 nt, Mycobacterium tuberculosis H37Rv
gcgagcccagcugc

SEQ ID NO: 1329538 - RNA, 18 nt, Mycobacterium tuberculosis H37Rv
gcgagcccagcugcgccg

SEQ ID NO: 1329539 - RNA, 13 nt, Mycobacterium tuberculosis H37Rv
gcgaagggcaccg

SEQ ID NO: 1329540 - RNA, 19 nt, Mycobacterium tuberculosis H37Rv
gcgaagcgucuggucagcc

SEQ ID NO: 1329541 - RNA, 17 nt, Mycobacterium tuberculosis H37Rv
gcgaagcuagcgcccgc

SEQ ID NO: 1329542 - RNA, 23 nt, Mycobacterium tuberculosis H37Rv
gcgaagcuagcgcccgcgagaga

SEQ ID NO: 1329543 - RNA, 16 nt, Mycobacterium tuberculosis H37Rv
gcgaagugcgcgcugg

SEQ ID NO: 1329544 - RNA, 19 nt, Mycobacterium tuberculosis H37Rv
gcgaagucguccagaauga

SEQ ID NO: 1329545 - RNA, 16 nt, Mycobacterium tuberculosis H37Rv
gcgaaguugcggguga

SEQ ID NO: 1329546 - RNA, 22 nt, Mycobacterium tuberculosis H37Rv
gcgacggccaagaucggcgccc

SEQ ID NO: 1329547 - RNA, 13 nt, Mycobacterium tuberculosis H37Rv
gcgacggccggga

SEQ ID NO: 1329548 - RNA, 17 nt, Mycobacterium tuberculosis H37Rv
gcgacguuggcgggagc

SEQ ID NO: 1329549 - RNA, 20 nt, Mycobacterium tuberculosis H37Rv
gcgacgggcacccgagccgc

SEQ ID NO: 1329550 - RNA, 19 nt, Mycobacterium tuberculosis H37Rv
gcgacggcgcucggcgagc

SEQ ID NO: 1329551 - RNA, 12 nt, Mycobacterium tuberculosis H37Rv
gcgacggcgccc

SEQ ID NO: 1329552 - RNA, 20 nt, Mycobacterium tuberculosis H37Rv
gcgacggcucuaccgguccg

SEQ ID NO: 1329553 - RNA, 14 nt, Mycobacterium tuberculosis H37Rv
gcgauaggcccggu

SEQ ID NO: 1329554 - RNA, 21 nt, Mycobacterium tuberculosis H37Rv
gcgaguuaggccgccagccgg

SEQ ID NO: 1329555 - RNA, 22 nt, Mycobacterium tuberculosis H37Rv
gcgaggaacuggaccggugcca

SEQ ID NO: 1329556 - RNA, 15 nt, Mycobacterium tuberculosis H37Rv
gcgaggagcagggcu

SEQ ID NO: 1329557 - RNA, 18 nt, Mycobacterium tuberculosis H37Rv
gcgaggacggcggccagg

SEQ ID NO: 1329558 - RNA, 14 nt, Mycobacterium tuberculosis H37Rv
gcgagcuuggcuug

SEQ ID NO: 1329559 - RNA, 16 nt, Mycobacterium tuberculosis H37Rv
gcgagccucgcgcgcc

SEQ ID NO: 1329560 - RNA, 13 nt, Mycobacterium tuberculosis H37Rv
gcgagccgcgccc

SEQ ID NO: 1329561 - RNA, 16 nt, Mycobacterium tuberculosis H37Rv
gcgagcguuuggacgg

SEQ ID NO: 1329562 - RNA, 14 nt, Mycobacterium tuberculosis H37Rv
gcgagccggcgcgc

SEQ ID NO: 1329563 - RNA, 19 nt, Mycobacterium tuberculosis H37Rv
gcgagcguuuggacgggcg

SEQ ID NO: 1329564 - RNA, 15 nt, Mycobacterium tuberculosis H37Rv
gcgagcucccgggcg

SEQ ID NO: 1329565 - RNA, 13 nt, Mycobacterium tuberculosis H37Rv
gcgaucugcagcg

SEQ ID NO: 1329566 - RNA, 22 nt, Mycobacterium tuberculosis H37Rv
gcgaucuuggcgacaugcagcg

SEQ ID NO: 1329567 - RNA, 23 nt, Mycobacterium tuberculosis H37Rv
gcgaucuuguccaggguggucag

SEQ ID NO: 1329568 - RNA, 14 nt, Mycobacterium tuberculosis H37Rv
gcgaugaccgggcg

SEQ ID NO: 1329569 - RNA, 22 nt, Mycobacterium tuberculosis H37Rv
gcgaugacgaucgcguccgcgc

SEQ ID NO: 1329570 - RNA, 16 nt, Mycobacterium tuberculosis H37Rv
gcgaucucaccuggag

SEQ ID NO: 1329571 - RNA, 22 nt, Mycobacterium tuberculosis H37Rv
gcgaucucuugguagugacugc

SEQ ID NO: 1329572 - RNA, 16 nt, Mycobacterium tuberculosis H37Rv
gcgaucugcggcgccc

SEQ ID NO: 1329573 - RNA, 14 nt, Mycobacterium tuberculosis H37Rv
gcgaucuccuuggc

SEQ ID NO: 1329574 - RNA, 15 nt, Mycobacterium tuberculosis H37Rv
gcgaucucgacggcc

SEQ ID NO: 1329575 - RNA, 21 nt, Mycobacterium tuberculosis H37Rv
gcgaucucggcgagcaccacc

SEQ ID NO: 1329576 - RNA, 18 nt, Mycobacterium tuberculosis H37Rv
gcgaucgcguccuccucg

SEQ ID NO: 1329577 - RNA, 20 nt, Mycobacterium tuberculosis H37Rv
gcgaucggcacuuagcccga

SEQ ID NO: 1329578 - RNA, 20 nt, Mycobacterium tuberculosis H37Rv
gcgaucgcgcccgcugagcc

SEQ ID NO: 1329579 - RNA, 16 nt, Mycobacterium tuberculosis H37Rv
gcgaucgcgagcgagc

SEQ ID NO: 1329580 - RNA, 18 nt, Mycobacterium tuberculosis H37Rv
gcgaucgggcccagcagc

SEQ ID NO: 1329581 - RNA, 14 nt, Mycobacterium tuberculosis H37Rv
gcgaucgucaagcc

SEQ ID NO: 1329582 - RNA, 18 nt, Mycobacterium tuberculosis H37Rv
gcgaucaccaugugcucc

SEQ ID NO: 1329583 - RNA, 22 nt, Mycobacterium tuberculosis H37Rv
gcgaucaccgcgccggagaucg

SEQ ID NO: 1329584 - RNA, 19 nt, Mycobacterium tuberculosis H37Rv
gcgaucacccacaugguga

SEQ ID NO: 1329585 - RNA, 21 nt, Mycobacterium tuberculosis H37Rv
gcgaucaccgagucgacggcc

SEQ ID NO: 1329586 - RNA, 19 nt, Mycobacterium tuberculosis H37Rv
gcgaugggcccagcggccg

SEQ ID NO: 1329587 - RNA, 21 nt, Mycobacterium tuberculosis H37Rv
gcgaugggauaccgcguccuu

SEQ ID NO: 1329588 - RNA, 17 nt, Mycobacterium tuberculosis H37Rv
gcgauggugcgccgggc

SEQ ID NO: 1329589 - RNA, 15 nt, Mycobacterium tuberculosis H37Rv
gcgaugguaucgccg

SEQ ID NO: 1329590 - RNA, 19 nt, Mycobacterium tuberculosis H37Rv
gcgaugcguccgcccagcc

SEQ ID NO: 1329591 - RNA, 18 nt, Mycobacterium tuberculosis H37Rv
gcgaugcggucggccaca

SEQ ID NO: 1329592 - RNA, 12 nt, Mycobacterium tuberculosis H37Rv
gcgauggccagc

SEQ ID NO: 1329593 - RNA, 18 nt, Mycobacterium tuberculosis H37Rv
gcgaugcccacgcacagc

SEQ ID NO: 1329594 - RNA, 13 nt, Mycobacterium tuberculosis H37Rv
gcgaugccguuca

SEQ ID NO: 1329595 - RNA, 21 nt, Mycobacterium tuberculosis H37Rv
gcgaugucggcugguggggga

SEQ ID NO: 1329596 - RNA, 20 nt, Mycobacterium tuberculosis H37Rv
gcgaugugaaccgggcacca

SEQ ID NO: 1329597 - RNA, 20 nt, Mycobacterium tuberculosis H37Rv
gcgauuccacggcagcaccg

SEQ ID NO: 1329598 - RNA, 23 nt, Mycobacterium tuberculosis H37Rv
gcgauucugggcuucaucggcga

SEQ ID NO: 1329599 - RNA, 18 nt, Mycobacterium tuberculosis H37Rv
gcgauucugugucugcuc

SEQ ID NO: 1329600 - RNA, 21 nt, Mycobacterium tuberculosis H37Rv
gcgauucacgggugcgccaca

SEQ ID NO: 1329601 - RNA, 19 nt, Mycobacterium tuberculosis H37Rv
gcgauugauccgguggcac

SEQ ID NO: 1329602 - RNA, 13 nt, Mycobacterium tuberculosis H37Rv
gcgauuggcuggg

SEQ ID NO: 1329603 - RNA, 23 nt, Mycobacterium tuberculosis H37Rv
gcgauugcgcacacccugcagcu

SEQ ID NO: 1329604 - RNA, 19 nt, Mycobacterium tuberculosis H37Rv
gcgauuuugugucugcucg

SEQ ID NO: 1329605 - RNA, 20 nt, Mycobacterium tuberculosis H37Rv
gcgcaaagacaccgaaagcc

SEQ ID NO: 1329606 - RNA, 18 nt, Mycobacterium tuberculosis H37Rv
gcgcaagaaugccgccga

SEQ ID NO: 1329607 - RNA, 21 nt, Mycobacterium tuberculosis H37Rv
gcgcaaugcaucgcggcggcg

SEQ ID NO: 1329608 - RNA, 18 nt, Mycobacterium tuberculosis H37Rv
gcgcaauagcgacagcag

SEQ ID NO: 1329609 - RNA, 22 nt, Mycobacterium tuberculosis H37Rv
gcgcaacucgccacggucgccg

SEQ ID NO: 1329610 - RNA, 16 nt, Mycobacterium tuberculosis H37Rv
gcgcaacucccagcac

SEQ ID NO: 1329611 - RNA, 14 nt, Mycobacterium tuberculosis H37Rv
gcgcaacggccagc

SEQ ID NO: 1329612 - RNA, 16 nt, Mycobacterium tuberculosis H37Rv
gcgcaacguagccagc

SEQ ID NO: 1329613 - RNA, 20 nt, Mycobacterium tuberculosis H37Rv
gcgcaacaaccgguuggcga

SEQ ID NO: 1329614 - RNA, 18 nt, Mycobacterium tuberculosis H37Rv
gcgcaaaugccugcuggu

SEQ ID NO: 1329615 - RNA, 21 nt, Mycobacterium tuberculosis H37Rv
gcgcaaccagcaaugccgacu

SEQ ID NO: 1329616 - RNA, 22 nt, Mycobacterium tuberculosis H37Rv
gcgcaaccuaaauugccgggcc

SEQ ID NO: 1329617 - RNA, 22 nt, Mycobacterium tuberculosis H37Rv
gcgcaaccgguggaugaacacc

SEQ ID NO: 1329618 - RNA, 13 nt, Mycobacterium tuberculosis H37Rv
gcgcacagcgagc

SEQ ID NO: 1329619 - RNA, 15 nt, Mycobacterium tuberculosis H37Rv
gcgcacagcgagcac

SEQ ID NO: 1329620 - RNA, 16 nt, Mycobacterium tuberculosis H37Rv
gcgcacagcgagcaca

SEQ ID NO: 1329621 - RNA, 13 nt, Mycobacterium tuberculosis H37Rv
gcgcaccagcggc

SEQ ID NO: 1329622 - RNA, 21 nt, Mycobacterium tuberculosis H37Rv
gcgcaccaccgccccgcgccc

SEQ ID NO: 1329623 - RNA, 21 nt, Mycobacterium tuberculosis H37Rv
gcgcacaugguuuucaguagg

SEQ ID NO: 1329624 - RNA, 20 nt, Mycobacterium tuberculosis H37Rv
gcgcacaaacauacgccacc

SEQ ID NO: 1329625 - RNA, 16 nt, Mycobacterium tuberculosis H37Rv
gcgcacacccugcagc

SEQ ID NO: 1329626 - RNA, 17 nt, Mycobacterium tuberculosis H37Rv
gcgcaaugcgcgacggu

SEQ ID NO: 1329627 - RNA, 14 nt, Mycobacterium tuberculosis H37Rv
gcgcaaugcggccc

SEQ ID NO: 1329628 - RNA, 16 nt, Mycobacterium tuberculosis H37Rv
gcgcacccagcccagc

SEQ ID NO: 1329629 - RNA, 17 nt, Mycobacterium tuberculosis H37Rv
gcgcacccagcccagcc

SEQ ID NO: 1329630 - RNA, 16 nt, Mycobacterium tuberculosis H37Rv
gcgcaccaucgcggcc

SEQ ID NO: 1329631 - RNA, 13 nt, Mycobacterium tuberculosis H37Rv
gcgcacccgcggg

SEQ ID NO: 1329632 - RNA, 22 nt, Mycobacterium tuberculosis H37Rv
gcgcaccgccgauguggucggc

SEQ ID NO: 1329633 - RNA, 18 nt, Mycobacterium tuberculosis H37Rv
gcgcacccguccgccgca

SEQ ID NO: 1329634 - RNA, 15 nt, Mycobacterium tuberculosis H37Rv
gcgcacccggucggc

SEQ ID NO: 1329635 - RNA, 13 nt, Mycobacterium tuberculosis H37Rv
gcgcaggggcggc

SEQ ID NO: 1329636 - RNA, 14 nt, Mycobacterium tuberculosis H37Rv
gcgcaggucgccuu

SEQ ID NO: 1329637 - RNA, 22 nt, Mycobacterium tuberculosis H37Rv
gcgcaguacuugaccguccacc

SEQ ID NO: 1329638 - RNA, 16 nt, Mycobacterium tuberculosis H37Rv
gcgcaguagccgacca

SEQ ID NO: 1329639 - RNA, 21 nt, Mycobacterium tuberculosis H37Rv
gcgcaggcuuccagccacagc

SEQ ID NO: 1329640 - RNA, 19 nt, Mycobacterium tuberculosis H37Rv
gcgcagcguguugagggcu

SEQ ID NO: 1329641 - RNA, 14 nt, Mycobacterium tuberculosis H37Rv
gcgcagcgugagug

SEQ ID NO: 1329642 - RNA, 14 nt, Mycobacterium tuberculosis H37Rv
gcgcagcugggugc

SEQ ID NO: 1329643 - RNA, 16 nt, Mycobacterium tuberculosis H37Rv
gcgcagcugggugcgc

SEQ ID NO: 1329644 - RNA, 18 nt, Mycobacterium tuberculosis H37Rv
gcgcagcugccgcacccc

SEQ ID NO: 1329645 - RNA, 21 nt, Mycobacterium tuberculosis H37Rv
gcgcagcugccgcacccccuc

SEQ ID NO: 1329646 - RNA, 19 nt, Mycobacterium tuberculosis H37Rv
gcgcagcugcgggucgugc

SEQ ID NO: 1329647 - RNA, 12 nt, Mycobacterium tuberculosis H37Rv
gcgcagcugccg

SEQ ID NO: 1329648 - RNA, 21 nt, Mycobacterium tuberculosis H37Rv
gcgcaggauguucaaucccuc

SEQ ID NO: 1329649 - RNA, 18 nt, Mycobacterium tuberculosis H37Rv
gcgcagcgccggcagcag

SEQ ID NO: 1329650 - RNA, 15 nt, Mycobacterium tuberculosis H37Rv
gcgcagcgcaaacau

SEQ ID NO: 1329651 - RNA, 17 nt, Mycobacterium tuberculosis H37Rv
gcgcagccugccgauga

SEQ ID NO: 1329652 - RNA, 21 nt, Mycobacterium tuberculosis H37Rv
gcgcagccgggucuacagcgu

SEQ ID NO: 1329653 - RNA, 12 nt, Mycobacterium tuberculosis H37Rv
gcgcagcgcggc

SEQ ID NO: 1329654 - RNA, 14 nt, Mycobacterium tuberculosis H37Rv
gcgcagcggcaucc

SEQ ID NO: 1329655 - RNA, 19 nt, Mycobacterium tuberculosis H37Rv
gcgcacggaccaucgccag

SEQ ID NO: 1329656 - RNA, 22 nt, Mycobacterium tuberculosis H37Rv
gcgcacggcgucggccaccgcc

SEQ ID NO: 1329657 - RNA, 14 nt, Mycobacterium tuberculosis H37Rv
gcgcacggcgccga

SEQ ID NO: 1329658 - RNA, 22 nt, Mycobacterium tuberculosis H37Rv
gcgcacucccggcucggccagc

SEQ ID NO: 1329659 - RNA, 13 nt, Mycobacterium tuberculosis H37Rv
gcgcacggcuggc

SEQ ID NO: 1329660 - RNA, 14 nt, Mycobacterium tuberculosis H37Rv
gcgcacgguuggcg

SEQ ID NO: 1329661 - RNA, 12 nt, Mycobacterium tuberculosis H37Rv
gcgcacucuagc

SEQ ID NO: 1329662 - RNA, 16 nt, Mycobacterium tuberculosis H37Rv
gcgcacucuagccggg

SEQ ID NO: 1329663 - RNA, 17 nt, Mycobacterium tuberculosis H37Rv
gcgcacucuagccgggu

SEQ ID NO: 1329664 - RNA, 21 nt, Mycobacterium tuberculosis H37Rv
gcgcacgaaaccgcagcgcga

SEQ ID NO: 1329665 - RNA, 13 nt, Mycobacterium tuberculosis H37Rv
gcgcacgacagga

SEQ ID NO: 1329666 - RNA, 23 nt, Mycobacterium tuberculosis H37Rv
gcgcacgcucaguuuggccuggu

SEQ ID NO: 1329667 - RNA, 12 nt, Mycobacterium tuberculosis H37Rv
gcgcaccggagu

SEQ ID NO: 1329668 - RNA, 23 nt, Mycobacterium tuberculosis H37Rv
gcgcaccgguauguucggcaaug

SEQ ID NO: 1329669 - RNA, 20 nt, Mycobacterium tuberculosis H37Rv
gcgcaccggcuggcccagcg

SEQ ID NO: 1329670 - RNA, 22 nt, Mycobacterium tuberculosis H37Rv
gcgcaccggcuggcccagcgac

SEQ ID NO: 1329671 - RNA, 20 nt, Mycobacterium tuberculosis H37Rv
gcgcaccggcguucaccugc

SEQ ID NO: 1329672 - RNA, 16 nt, Mycobacterium tuberculosis H37Rv
gcgcaccggcgucggc

SEQ ID NO: 1329673 - RNA, 19 nt, Mycobacterium tuberculosis H37Rv
gcgcaccugggcugccggc

SEQ ID NO: 1329674 - RNA, 17 nt, Mycobacterium tuberculosis H37Rv
gcgcaccugggcugccg

SEQ ID NO: 1329675 - RNA, 13 nt, Mycobacterium tuberculosis H37Rv
gcgcagcagcggc

SEQ ID NO: 1329676 - RNA, 22 nt, Mycobacterium tuberculosis H37Rv
gcgcagcaguuggucgcggucc

SEQ ID NO: 1329677 - RNA, 14 nt, Mycobacterium tuberculosis H37Rv
gcgcagcaucggcg

SEQ ID NO: 1329678 - RNA, 19 nt, Mycobacterium tuberculosis H37Rv
gcgcagccgcucgacggcc

SEQ ID NO: 1329679 - RNA, 14 nt, Mycobacterium tuberculosis H37Rv
gcgcagccaggcug

SEQ ID NO: 1329680 - RNA, 16 nt, Mycobacterium tuberculosis H37Rv
gcgcagccaggcugcg

SEQ ID NO: 1329681 - RNA, 18 nt, Mycobacterium tuberculosis H37Rv
gcgcagcaacugggcggc

SEQ ID NO: 1329682 - RNA, 21 nt, Mycobacterium tuberculosis H37Rv
gcgcagcaacugggcggccug

SEQ ID NO: 1329683 - RNA, 19 nt, Mycobacterium tuberculosis H37Rv
gcgcagcacauccugcagc

SEQ ID NO: 1329684 - RNA, 19 nt, Mycobacterium tuberculosis H37Rv
gcgcagauuugcuccagcg

SEQ ID NO: 1329685 - RNA, 20 nt, Mycobacterium tuberculosis H37Rv
gcgcagcacugcggcagcga

SEQ ID NO: 1329686 - RNA, 17 nt, Mycobacterium tuberculosis H37Rv
gcgcagcaccggucagu

SEQ ID NO: 1329687 - RNA, 23 nt, Mycobacterium tuberculosis H37Rv
gcgcagcacauccugcagcucgg

SEQ ID NO: 1329688 - RNA, 17 nt, Mycobacterium tuberculosis H37Rv
gcgcagcaccagggugg

SEQ ID NO: 1329689 - RNA, 14 nt, Mycobacterium tuberculosis H37Rv
gcgcagacucgcca

SEQ ID NO: 1329690 - RNA, 16 nt, Mycobacterium tuberculosis H37Rv
gcgcagacucgccacc

SEQ ID NO: 1329691 - RNA, 19 nt, Mycobacterium tuberculosis H37Rv
gcgcagaucguccaccgcc

SEQ ID NO: 1329692 - RNA, 16 nt, Mycobacterium tuberculosis H37Rv
gcgcagaucguccacc

SEQ ID NO: 1329693 - RNA, 19 nt, Mycobacterium tuberculosis H37Rv
gcgcagaugagcgcggcga

SEQ ID NO: 1329694 - RNA, 20 nt, Mycobacterium tuberculosis H37Rv
gcgccacuggaagccaagcu

SEQ ID NO: 1329695 - RNA, 20 nt, Mycobacterium tuberculosis H37Rv
gcgccagaucaccgucgaca

SEQ ID NO: 1329696 - RNA, 18 nt, Mycobacterium tuberculosis H37Rv
gcgccagacacaaccgcu

SEQ ID NO: 1329697 - RNA, 18 nt, Mycobacterium tuberculosis H37Rv
gcgccacuagcccugagc

SEQ ID NO: 1329698 - RNA, 21 nt, Mycobacterium tuberculosis H37Rv
gcgccacgucgacggucuggc

SEQ ID NO: 1329699 - RNA, 20 nt, Mycobacterium tuberculosis H37Rv
gcgccacguggucgagcagg

SEQ ID NO: 1329700 - RNA, 20 nt, Mycobacterium tuberculosis H37Rv
gcgccacggcagcgcccaga

SEQ ID NO: 1329701 - RNA, 19 nt, Mycobacterium tuberculosis H37Rv
gcgccacgaccgcggcggc

SEQ ID NO: 1329702 - RNA, 19 nt, Mycobacterium tuberculosis H37Rv
gcgccaccgugguggacga

SEQ ID NO: 1329703 - RNA, 18 nt, Mycobacterium tuberculosis H37Rv
gcgccaccggcgccgccc

SEQ ID NO: 1329704 - RNA, 21 nt, Mycobacterium tuberculosis H37Rv
gcgccacccgguccggcccgg

SEQ ID NO: 1329705 - RNA, 15 nt, Mycobacterium tuberculosis H37Rv
gcgccaccggcgccg

SEQ ID NO: 1329706 - RNA, 16 nt, Mycobacterium tuberculosis H37Rv
gcgccacccgcgccgc

SEQ ID NO: 1329707 - RNA, 20 nt, Mycobacterium tuberculosis H37Rv
gcgccacccgcgucaguccu

SEQ ID NO: 1329708 - RNA, 17 nt, Mycobacterium tuberculosis H37Rv
gcgccacccgguccggc

SEQ ID NO: 1329709 - RNA, 14 nt, Mycobacterium tuberculosis H37Rv
gcgccacagcagcg

SEQ ID NO: 1329710 - RNA, 13 nt, Mycobacterium tuberculosis H37Rv
gcgccacagcagc

SEQ ID NO: 1329711 - RNA, 16 nt, Mycobacterium tuberculosis H37Rv
gcgccaccagcaccgc

SEQ ID NO: 1329712 - RNA, 15 nt, Mycobacterium tuberculosis H37Rv
gcgccagcgccgcca

SEQ ID NO: 1329713 - RNA, 16 nt, Mycobacterium tuberculosis H37Rv
gcgccagccccgccgg

SEQ ID NO: 1329714 - RNA, 20 nt, Mycobacterium tuberculosis H37Rv
gcgccagcgauaucggcggc

SEQ ID NO: 1329715 - RNA, 12 nt, Mycobacterium tuberculosis H37Rv
gcgccagccggu

SEQ ID NO: 1329716 - RNA, 22 nt, Mycobacterium tuberculosis H37Rv
gcgccagccuccaccaggucgu

SEQ ID NO: 1329717 - RNA, 16 nt, Mycobacterium tuberculosis H37Rv
gcgccagcagccaccc

SEQ ID NO: 1329718 - RNA, 11 nt, Mycobacterium tuberculosis H37Rv
gcgccagcaga

SEQ ID NO: 1329719 - RNA, 23 nt, Mycobacterium tuberculosis H37Rv
gcgccaaggucugccgggcgcgc

SEQ ID NO: 1329720 - RNA, 17 nt, Mycobacterium tuberculosis H37Rv
gcgccaauucagcggca

SEQ ID NO: 1329721 - RNA, 22 nt, Mycobacterium tuberculosis H37Rv
gcgccaaacaccccggccuugc

SEQ ID NO: 1329722 - RNA, 22 nt, Mycobacterium tuberculosis H37Rv
gcgccaaaaaggaucccgccgc

SEQ ID NO: 1329723 - RNA, 20 nt, Mycobacterium tuberculosis H37Rv
gcgccaacccggcgggcccg

SEQ ID NO: 1329724 - RNA, 21 nt, Mycobacterium tuberculosis H37Rv
gcgcauugccgacgcgcggcc

SEQ ID NO: 1329725 - RNA, 21 nt, Mycobacterium tuberculosis H37Rv
gcgcauuuguugcugcugccg

SEQ ID NO: 1329726 - RNA, 19 nt, Mycobacterium tuberculosis H37Rv
gcgcauguuaugagcgcuc

SEQ ID NO: 1329727 - RNA, 18 nt, Mycobacterium tuberculosis H37Rv
gcgcaucgccgacagcgc

SEQ ID NO: 1329728 - RNA, 16 nt, Mycobacterium tuberculosis H37Rv
gcgcaucgccuccucg

SEQ ID NO: 1329729 - RNA, 17 nt, Mycobacterium tuberculosis H37Rv
gcgcaucgccgcuggcc

SEQ ID NO: 1329730 - RNA, 17 nt, Mycobacterium tuberculosis H37Rv
gcgcaucggccagcagc

SEQ ID NO: 1329731 - RNA, 17 nt, Mycobacterium tuberculosis H37Rv
gcgcaucgagcaccucc

SEQ ID NO: 1329732 - RNA, 13 nt, Mycobacterium tuberculosis H37Rv
gcgcaucaccacu

SEQ ID NO: 1329733 - RNA, 14 nt, Mycobacterium tuberculosis H37Rv
gcgcauauccgcag

SEQ ID NO: 1329734 - RNA, 17 nt, Mycobacterium tuberculosis H37Rv
gcgcugaucgcgcgcac

SEQ ID NO: 1329735 - RNA, 14 nt, Mycobacterium tuberculosis H37Rv
gcgcugaucggcag

SEQ ID NO: 1329736 - RNA, 17 nt, Mycobacterium tuberculosis H37Rv
gcgcugaucggcagggu

SEQ ID NO: 1329737 - RNA, 22 nt, Mycobacterium tuberculosis H37Rv
gcgcugauccggucggccagca

SEQ ID NO: 1329738 - RNA, 18 nt, Mycobacterium tuberculosis H37Rv
gcgcucucauagcgacgg

SEQ ID NO: 1329739 - RNA, 19 nt, Mycobacterium tuberculosis H37Rv
gcgcucucauagcgacggc

SEQ ID NO: 1329740 - RNA, 18 nt, Mycobacterium tuberculosis H37Rv
gcgcucguagaaucggcu

SEQ ID NO: 1329741 - RNA, 17 nt, Mycobacterium tuberculosis H37Rv
gcgcucgggcccagcgc

SEQ ID NO: 1329742 - RNA, 14 nt, Mycobacterium tuberculosis H37Rv
gcgcucggccgggg

SEQ ID NO: 1329743 - RNA, 20 nt, Mycobacterium tuberculosis H37Rv
gcgcucggccauagcgccgc

SEQ ID NO: 1329744 - RNA, 15 nt, Mycobacterium tuberculosis H37Rv
gcgcucgacgagcac

SEQ ID NO: 1329745 - RNA, 23 nt, Mycobacterium tuberculosis H37Rv
gcgcucgaacuccccggucgccg

SEQ ID NO: 1329746 - RNA, 18 nt, Mycobacterium tuberculosis H37Rv
gcgcugcucugagcuugg

SEQ ID NO: 1329747 - RNA, 13 nt, Mycobacterium tuberculosis H37Rv
gcgcuggaccuga

SEQ ID NO: 1329748 - RNA, 21 nt, Mycobacterium tuberculosis H37Rv
gcgcuggcaggcuuagcuucc

SEQ ID NO: 1329749 - RNA, 15 nt, Mycobacterium tuberculosis H37Rv
gcgcuggccagcagg

SEQ ID NO: 1329750 - RNA, 16 nt, Mycobacterium tuberculosis H37Rv
gcgcugcggcccacac

SEQ ID NO: 1329751 - RNA, 20 nt, Mycobacterium tuberculosis H37Rv
gcgcugcggcgugccgggug

SEQ ID NO: 1329752 - RNA, 19 nt, Mycobacterium tuberculosis H37Rv
gcgcugcucacgcagcagu

SEQ ID NO: 1329753 - RNA, 13 nt, Mycobacterium tuberculosis H37Rv
gcgcugcggccag

SEQ ID NO: 1329754 - RNA, 20 nt, Mycobacterium tuberculosis H37Rv
gcgcugcggaucguggcgcc

SEQ ID NO: 1329755 - RNA, 17 nt, Mycobacterium tuberculosis H37Rv
gcgcugcagcauggcuc

SEQ ID NO: 1329756 - RNA, 11 nt, Mycobacterium tuberculosis H37Rv
gcgcugcagca

SEQ ID NO: 1329757 - RNA, 15 nt, Mycobacterium tuberculosis H37Rv
gcgcugcgcaccgcc

SEQ ID NO: 1329758 - RNA, 11 nt, Mycobacterium tuberculosis H37Rv
gcgcugcgcag

SEQ ID NO: 1329759 - RNA, 14 nt, Mycobacterium tuberculosis H37Rv
gcgcugcccacgga

SEQ ID NO: 1329760 - RNA, 13 nt, Mycobacterium tuberculosis H37Rv
gcgcugccggccg

SEQ ID NO: 1329761 - RNA, 15 nt, Mycobacterium tuberculosis H37Rv
gcgcugccggccgcg

SEQ ID NO: 1329762 - RNA, 22 nt, Mycobacterium tuberculosis H37Rv
gcggaagcgguugacccacagc

SEQ ID NO: 1329763 - RNA, 14 nt, Mycobacterium tuberculosis H37Rv
gcggaagcggcggc

SEQ ID NO: 1329764 - RNA, 16 nt, Mycobacterium tuberculosis H37Rv
gcggaagcggcggccc

SEQ ID NO: 1329765 - RNA, 15 nt, Mycobacterium tuberculosis H37Rv
gcggaacgccgagca

SEQ ID NO: 1329766 - RNA, 16 nt, Mycobacterium tuberculosis H37Rv
gcggaaccugcucggc

SEQ ID NO: 1329767 - RNA, 19 nt, Mycobacterium tuberculosis H37Rv
gcggaacacgaugcgcggu

SEQ ID NO: 1329768 - RNA, 12 nt, Mycobacterium tuberculosis H37Rv
gcggaacaccgc

SEQ ID NO: 1329769 - RNA, 17 nt, Mycobacterium tuberculosis H37Rv
gcggaacaccagcaggc

SEQ ID NO: 1329770 - RNA, 20 nt, Mycobacterium tuberculosis H37Rv
gcggaacaccagcaggcggc

SEQ ID NO: 1329771 - RNA, 22 nt, Mycobacterium tuberculosis H37Rv
gcgcugucguaccgcggaucgg

SEQ ID NO: 1329772 - RNA, 23 nt, Mycobacterium tuberculosis H37Rv
gcgcuucacagccaccagccggg

SEQ ID NO: 1329773 - RNA, 14 nt, Mycobacterium tuberculosis H37Rv
gcgcuguuguuguc

SEQ ID NO: 1329774 - RNA, 23 nt, Mycobacterium tuberculosis H37Rv
gcggaaacccggccgccgagacg

SEQ ID NO: 1329775 - RNA, 16 nt, Mycobacterium tuberculosis H37Rv
gcgcuggccauggugg

SEQ ID NO: 1329776 - RNA, 16 nt, Mycobacterium tuberculosis H37Rv
gcgcuggcggcgcagc

SEQ ID NO: 1329777 - RNA, 17 nt, Mycobacterium tuberculosis H37Rv
gcgcuggcgggcggcgu

SEQ ID NO: 1329778 - RNA, 21 nt, Mycobacterium tuberculosis H37Rv
gcgcugggacggucgcucggc

SEQ ID NO: 1329779 - RNA, 24 nt, Mycobacterium tuberculosis H37Rv
gcgcugggaggcggcgccagugcg

SEQ ID NO: 1329780 - RNA, 21 nt, Mycobacterium tuberculosis H37Rv
gcgcuggcuacccaccggccg

SEQ ID NO: 1329781 - RNA, 19 nt, Mycobacterium tuberculosis H37Rv
gcgcuggucagccgugccg

SEQ ID NO: 1329782 - RNA, 21 nt, Mycobacterium tuberculosis H37Rv
gcgcuggucagccgugccgug

SEQ ID NO: 1329783 - RNA, 21 nt, Mycobacterium tuberculosis H37Rv
gcgcuggucgcgguggcggcg

SEQ ID NO: 1329784 - RNA, 13 nt, Mycobacterium tuberculosis H37Rv
gcgcugguggcgg

SEQ ID NO: 1329785 - RNA, 22 nt, Mycobacterium tuberculosis H37Rv
gcgcugguugaacauguccagu

SEQ ID NO: 1329786 - RNA, 20 nt, Mycobacterium tuberculosis H37Rv
gcgcuguacugccccagcac

SEQ ID NO: 1329787 - RNA, 22 nt, Mycobacterium tuberculosis H37Rv
gcgcugggcccgagcgcgcgcu

SEQ ID NO: 1329788 - RNA, 17 nt, Mycobacterium tuberculosis H37Rv
gcggauuucucgcccug

SEQ ID NO: 1329789 - RNA, 16 nt, Mycobacterium tuberculosis H37Rv
gcggcaaagccgggug

SEQ ID NO: 1329790 - RNA, 18 nt, Mycobacterium tuberculosis H37Rv
gcggcaaagagcagccgg

SEQ ID NO: 1329791 - RNA, 19 nt, Mycobacterium tuberculosis H37Rv
gcggcaaacacugcggccu

SEQ ID NO: 1329792 - RNA, 17 nt, Mycobacterium tuberculosis H37Rv
gcggcacccaggugucg

SEQ ID NO: 1329793 - RNA, 22 nt, Mycobacterium tuberculosis H37Rv
gcggcacccagucggcgccgcc

SEQ ID NO: 1329794 - RNA, 17 nt, Mycobacterium tuberculosis H37Rv
gcggcaccgccgcccaa

SEQ ID NO: 1329795 - RNA, 20 nt, Mycobacterium tuberculosis H37Rv
gcggcaccgcuucaggcgcc

SEQ ID NO: 1329796 - RNA, 14 nt, Mycobacterium tuberculosis H37Rv
gcggcacccaacca

SEQ ID NO: 1329797 - RNA, 15 nt, Mycobacterium tuberculosis H37Rv
gcggcaaccccgagc

SEQ ID NO: 1329798 - RNA, 22 nt, Mycobacterium tuberculosis H37Rv
gcggcacgcugaccggaucuga

SEQ ID NO: 1329799 - RNA, 18 nt, Mycobacterium tuberculosis H37Rv
gcggcagcggugcuggug

SEQ ID NO: 1329800 - RNA, 16 nt, Mycobacterium tuberculosis H37Rv
gcggcacgcccacagc

SEQ ID NO: 1329801 - RNA, 16 nt, Mycobacterium tuberculosis H37Rv
gcggcacgaucggcag

SEQ ID NO: 1329802 - RNA, 16 nt, Mycobacterium tuberculosis H37Rv
gcggcacgaucgccaa

SEQ ID NO: 1329803 - RNA, 21 nt, Mycobacterium tuberculosis H37Rv
gcggcagcgguuuuaggcagc

SEQ ID NO: 1329804 - RNA, 16 nt, Mycobacterium tuberculosis H37Rv
gcggaccggcgcgcuc

SEQ ID NO: 1329805 - RNA, 15 nt, Mycobacterium tuberculosis H37Rv
gcggaccggcgcgcu

SEQ ID NO: 1329806 - RNA, 17 nt, Mycobacterium tuberculosis H37Rv
gcggaccugcgccggug

SEQ ID NO: 1329807 - RNA, 17 nt, Mycobacterium tuberculosis H37Rv
gcggaccucggcgaccu

SEQ ID NO: 1329808 - RNA, 21 nt, Mycobacterium tuberculosis H37Rv
gcggacgaacccguuuugggu

SEQ ID NO: 1329809 - RNA, 22 nt, Mycobacterium tuberculosis H37Rv
gcggaaguagcgcaaugcggcc

SEQ ID NO: 1329810 - RNA, 22 nt, Mycobacterium tuberculosis H37Rv
gcggacccggugacccgcuggg

SEQ ID NO: 1329811 - RNA, 20 nt, Mycobacterium tuberculosis H37Rv
gcggaccaggccgcgcgcac

SEQ ID NO: 1329812 - RNA, 16 nt, Mycobacterium tuberculosis H37Rv
gcggaucugggcggcc

SEQ ID NO: 1329813 - RNA, 20 nt, Mycobacterium tuberculosis H37Rv
gcggaucugcugcgagaucu

SEQ ID NO: 1329814 - RNA, 12 nt, Mycobacterium tuberculosis H37Rv
gcggaucuggcc

SEQ ID NO: 1329815 - RNA, 22 nt, Mycobacterium tuberculosis H37Rv
gcggaucucaucgggccacagc

SEQ ID NO: 1329816 - RNA, 23 nt, Mycobacterium tuberculosis H37Rv
gcggaucggcggccgcgaccagc

SEQ ID NO: 1329817 - RNA, 14 nt, Mycobacterium tuberculosis H37Rv
gcggaucccgccgg

SEQ ID NO: 1329818 - RNA, 18 nt, Mycobacterium tuberculosis H37Rv
gcggaucgaccgccagcg

SEQ ID NO: 1329819 - RNA, 16 nt, Mycobacterium tuberculosis H37Rv
gcggaucccgaggcgc

SEQ ID NO: 1329820 - RNA, 14 nt, Mycobacterium tuberculosis H37Rv
gcggacucagcggc

SEQ ID NO: 1329821 - RNA, 21 nt, Mycobacterium tuberculosis H37Rv
gcggauccagaaacugcucgg

SEQ ID NO: 1329822 - RNA, 23 nt, Mycobacterium tuberculosis H37Rv
gcggacggcguugagcaggugcc

SEQ ID NO: 1329823 - RNA, 19 nt, Mycobacterium tuberculosis H37Rv
gcggccccgacugccgcgg

SEQ ID NO: 1329824 - RNA, 18 nt, Mycobacterium tuberculosis H37Rv
gcggcccgaggcucgggc

SEQ ID NO: 1329825 - RNA, 22 nt, Mycobacterium tuberculosis H37Rv
gcggcccgauagaucgcgugga

SEQ ID NO: 1329826 - RNA, 14 nt, Mycobacterium tuberculosis H37Rv
gcggcccgcagccc

SEQ ID NO: 1329827 - RNA, 15 nt, Mycobacterium tuberculosis H37Rv
gcggcccgcagcccg

SEQ ID NO: 1329828 - RNA, 19 nt, Mycobacterium tuberculosis H37Rv
gcggcccgcagcccgccgg

SEQ ID NO: 1329829 - RNA, 23 nt, Mycobacterium tuberculosis H37Rv
gcggcccgccgaguucugcugga

SEQ ID NO: 1329830 - RNA, 21 nt, Mycobacterium tuberculosis H37Rv
gcggcccgcacggccgcagcc

SEQ ID NO: 1329831 - RNA, 18 nt, Mycobacterium tuberculosis H37Rv
gcggcccgcgaauacgag

SEQ ID NO: 1329832 - RNA, 17 nt, Mycobacterium tuberculosis H37Rv
gcggcccgcgaucgggc

SEQ ID NO: 1329833 - RNA, 19 nt, Mycobacterium tuberculosis H37Rv
gcggcccuaaacaccgcga

SEQ ID NO: 1329834 - RNA, 21 nt, Mycobacterium tuberculosis H37Rv
gcggcccuaucuggcggccgg

SEQ ID NO: 1329835 - RNA, 18 nt, Mycobacterium tuberculosis H37Rv
gcggcccggguuggccga

SEQ ID NO: 1329836 - RNA, 16 nt, Mycobacterium tuberculosis H37Rv
gcggcccgguggacag

SEQ ID NO: 1329837 - RNA, 17 nt, Mycobacterium tuberculosis H37Rv
gcggcccgucaccgcgg

SEQ ID NO: 1329838 - RNA, 18 nt, Mycobacterium tuberculosis H37Rv
gcggcccgcugcgcggcc

SEQ ID NO: 1329839 - RNA, 13 nt, Mycobacterium tuberculosis H37Rv
gcggcccgcugug

SEQ ID NO: 1329840 - RNA, 22 nt, Mycobacterium tuberculosis H37Rv
gcggcccgcuccacggucaggc

SEQ ID NO: 1329841 - RNA, 20 nt, Mycobacterium tuberculosis H37Rv
gcggccagcaucgcgguggu

SEQ ID NO: 1329842 - RNA, 16 nt, Mycobacterium tuberculosis H37Rv
gcggccagcagugcgg

SEQ ID NO: 1329843 - RNA, 18 nt, Mycobacterium tuberculosis H37Rv
gcggccagcaucgcggug

SEQ ID NO: 1329844 - RNA, 21 nt, Mycobacterium tuberculosis H37Rv
gcggcccacaccagcgcagca

SEQ ID NO: 1329845 - RNA, 14 nt, Mycobacterium tuberculosis H37Rv
gcggccacgguggc

SEQ ID NO: 1329846 - RNA, 19 nt, Mycobacterium tuberculosis H37Rv
gcggccacgguggcgcaag

SEQ ID NO: 1329847 - RNA, 14 nt, Mycobacterium tuberculosis H37Rv
gcggccagagccgc

SEQ ID NO: 1329848 - RNA, 21 nt, Mycobacterium tuberculosis H37Rv
gcggccacuuggaugcgaccc

SEQ ID NO: 1329849 - RNA, 21 nt, Mycobacterium tuberculosis H37Rv
gcggccaccgccgccgccacc

SEQ ID NO: 1329850 - RNA, 20 nt, Mycobacterium tuberculosis H37Rv
gcggcauuaccaacgcggug

SEQ ID NO: 1329851 - RNA, 15 nt, Mycobacterium tuberculosis H37Rv
gcggcauucucgagc

SEQ ID NO: 1329852 - RNA, 14 nt, Mycobacterium tuberculosis H37Rv
gcggcauugccagc

SEQ ID NO: 1329853 - RNA, 15 nt, Mycobacterium tuberculosis H37Rv
gcggcauugccagcc

SEQ ID NO: 1329854 - RNA, 17 nt, Mycobacterium tuberculosis H37Rv
gcggcauucucgagcac

SEQ ID NO: 1329855 - RNA, 23 nt, Mycobacterium tuberculosis H37Rv
gcggcauucucgagcacccgcaa

SEQ ID NO: 1329856 - RNA, 22 nt, Mycobacterium tuberculosis H37Rv
gcggccaaccccgaugaggcgc

SEQ ID NO: 1329857 - RNA, 18 nt, Mycobacterium tuberculosis H37Rv
gcggccaauggccgcggc

SEQ ID NO: 1329858 - RNA, 17 nt, Mycobacterium tuberculosis H37Rv
gcggccaauggccgcgg

SEQ ID NO: 1329859 - RNA, 24 nt, Mycobacterium tuberculosis H37Rv
gcggccaauggugggcgagcugcu

SEQ ID NO: 1329860 - RNA, 24 nt, Mycobacterium tuberculosis H37Rv
gcggccaacggcuccgggcgcucg

SEQ ID NO: 1329861 - RNA, 21 nt, Mycobacterium tuberculosis H37Rv
gcggccaaucagcccgccgga

SEQ ID NO: 1329862 - RNA, 15 nt, Mycobacterium tuberculosis H37Rv
gcggccaccaccgcc

SEQ ID NO: 1329863 - RNA, 21 nt, Mycobacterium tuberculosis H37Rv
gcggccacaucgccagcagca

SEQ ID NO: 1329864 - RNA, 21 nt, Mycobacterium tuberculosis H37Rv
gcggccaccacaacgccagga

SEQ ID NO: 1329865 - RNA, 15 nt, Mycobacterium tuberculosis H37Rv
gcggccaccagcgcc

SEQ ID NO: 1329866 - RNA, 20 nt, Mycobacterium tuberculosis H37Rv
gcggccaaucagcccgccgg

SEQ ID NO: 1329867 - RNA, 18 nt, Mycobacterium tuberculosis H37Rv
gcggcaucgcgggcggcg

SEQ ID NO: 1329868 - RNA, 21 nt, Mycobacterium tuberculosis H37Rv
gcggcaugcaaugcuggcggc

SEQ ID NO: 1329869 - RNA, 21 nt, Mycobacterium tuberculosis H37Rv
gcggcaugggcccugcacagc

SEQ ID NO: 1329870 - RNA, 22 nt, Mycobacterium tuberculosis H37Rv
gcggcaucgaauuccagccagc

SEQ ID NO: 1329871 - RNA, 16 nt, Mycobacterium tuberculosis H37Rv
gcggcaucgcgggcgg

SEQ ID NO: 1329872 - RNA, 15 nt, Mycobacterium tuberculosis H37Rv
gcggcaucgcgggcg

SEQ ID NO: 1329873 - RNA, 14 nt, Mycobacterium tuberculosis H37Rv
gcggcaucgcgggc

SEQ ID NO: 1329874 - RNA, 16 nt, Mycobacterium tuberculosis H37Rv
gcgggacaaccgggcg

SEQ ID NO: 1329875 - RNA, 21 nt, Mycobacterium tuberculosis H37Rv
gcgggacaccaccgcccgcac

SEQ ID NO: 1329876 - RNA, 20 nt, Mycobacterium tuberculosis H37Rv
gcgggaacgaugccgccggc

SEQ ID NO: 1329877 - RNA, 22 nt, Mycobacterium tuberculosis H37Rv
gcgggacagauggcggccgagg

SEQ ID NO: 1329878 - RNA, 20 nt, Mycobacterium tuberculosis H37Rv
gcgggacauccagugcggug

SEQ ID NO: 1329879 - RNA, 22 nt, Mycobacterium tuberculosis H37Rv
gcgggacacgucgcgccaggcg

SEQ ID NO: 1329880 - RNA, 19 nt, Mycobacterium tuberculosis H37Rv
gcgggaaggguggaccggg

SEQ ID NO: 1329881 - RNA, 16 nt, Mycobacterium tuberculosis H37Rv
gcgggacuugucgggg

SEQ ID NO: 1329882 - RNA, 15 nt, Mycobacterium tuberculosis H37Rv
gcgggcaugccggcg

SEQ ID NO: 1329883 - RNA, 20 nt, Mycobacterium tuberculosis H37Rv
gcgggagguacccccagcac

SEQ ID NO: 1329884 - RNA, 21 nt, Mycobacterium tuberculosis H37Rv
gcgggcgauuucggcgccggc

SEQ ID NO: 1329885 - RNA, 22 nt, Mycobacterium tuberculosis H37Rv
gcgggcgauuucggcgccggcg

SEQ ID NO: 1329886 - RNA, 21 nt, Mycobacterium tuberculosis H37Rv
gcgggcgaucucggcgagcac

SEQ ID NO: 1329887 - RNA, 16 nt, Mycobacterium tuberculosis H37Rv
gcgggcgaugagcgcg

SEQ ID NO: 1329888 - RNA, 22 nt, Mycobacterium tuberculosis H37Rv
gcgggcgacccguucucgguga

SEQ ID NO: 1329889 - RNA, 19 nt, Mycobacterium tuberculosis H37Rv
gcgggcccgccggccccgc

SEQ ID NO: 1329890 - RNA, 20 nt, Mycobacterium tuberculosis H37Rv
gcgggcccgccggccccgcc

SEQ ID NO: 1329891 - RNA, 17 nt, Mycobacterium tuberculosis H37Rv
gcgggcccgaugaggac

SEQ ID NO: 1329892 - RNA, 13 nt, Mycobacterium tuberculosis H37Rv
gcgggccagcacc

SEQ ID NO: 1329893 - RNA, 16 nt, Mycobacterium tuberculosis H37Rv
gcgggccagcacccgc

SEQ ID NO: 1329894 - RNA, 20 nt, Mycobacterium tuberculosis H37Rv
gcgggccacgaucggcuggu

SEQ ID NO: 1329895 - RNA, 19 nt, Mycobacterium tuberculosis H37Rv
gcgggccaccacgcgccgc

SEQ ID NO: 1329896 - RNA, 19 nt, Mycobacterium tuberculosis H37Rv
gcggcuccgaucucuggug

SEQ ID NO: 1329897 - RNA, 12 nt, Mycobacterium tuberculosis H37Rv
gcggcucgcgcg

SEQ ID NO: 1329898 - RNA, 18 nt, Mycobacterium tuberculosis H37Rv
gcggcucguuggcaaaga

SEQ ID NO: 1329899 - RNA, 21 nt, Mycobacterium tuberculosis H37Rv
gcggcucuagaucgccgagcg

SEQ ID NO: 1329900 - RNA, 20 nt, Mycobacterium tuberculosis H37Rv
gcggcucuauccggcgcagg

SEQ ID NO: 1329901 - RNA, 15 nt, Mycobacterium tuberculosis H37Rv
gcggcugccagaaug

SEQ ID NO: 1329902 - RNA, 17 nt, Mycobacterium tuberculosis H37Rv
gcggcugcccgagaucg

SEQ ID NO: 1329903 - RNA, 23 nt, Mycobacterium tuberculosis H37Rv
gcggcugccaucccgaucccggc

SEQ ID NO: 1329904 - RNA, 22 nt, Mycobacterium tuberculosis H37Rv
gcggcuucguggcggcgcgcgc

SEQ ID NO: 1329905 - RNA, 20 nt, Mycobacterium tuberculosis H37Rv
gcggcuggcccgcaugccgg

SEQ ID NO: 1329906 - RNA, 22 nt, Mycobacterium tuberculosis H37Rv
gcggcuuggccuagccgcggca

SEQ ID NO: 1329907 - RNA, 16 nt, Mycobacterium tuberculosis H37Rv
gcgggaacacaccgca

SEQ ID NO: 1329908 - RNA, 21 nt, Mycobacterium tuberculosis H37Rv
gcgggaacgaugccgccggcg

SEQ ID NO: 1329909 - RNA, 23 nt, Mycobacterium tuberculosis H37Rv
gcgggcugcagugacucgaucac

SEQ ID NO: 1329910 - RNA, 16 nt, Mycobacterium tuberculosis H37Rv
gcgggcugaccaacuc

SEQ ID NO: 1329911 - RNA, 22 nt, Mycobacterium tuberculosis H37Rv
gcggguagauguucacgccgcc

SEQ ID NO: 1329912 - RNA, 20 nt, Mycobacterium tuberculosis H37Rv
gcggggaucgcuggccgcga

SEQ ID NO: 1329913 - RNA, 14 nt, Mycobacterium tuberculosis H37Rv
gcggggaugucgac

SEQ ID NO: 1329914 - RNA, 19 nt, Mycobacterium tuberculosis H37Rv
gcgggcgccuuccaggcgg

SEQ ID NO: 1329915 - RNA, 17 nt, Mycobacterium tuberculosis H37Rv
gcgggcgccgcuaggug

SEQ ID NO: 1329916 - RNA, 19 nt, Mycobacterium tuberculosis H37Rv
gcgggcggugggcagcagc

SEQ ID NO: 1329917 - RNA, 12 nt, Mycobacterium tuberculosis H37Rv
gcgggcgguggg

SEQ ID NO: 1329918 - RNA, 14 nt, Mycobacterium tuberculosis H37Rv
gcgggcggugggca

SEQ ID NO: 1329919 - RNA, 18 nt, Mycobacterium tuberculosis H37Rv
gcgggcggugcacaccgu

SEQ ID NO: 1329920 - RNA, 23 nt, Mycobacterium tuberculosis H37Rv
gcgggcucaacaccagccggucg

SEQ ID NO: 1329921 - RNA, 14 nt, Mycobacterium tuberculosis H37Rv
gcgggcucgcccgc

SEQ ID NO: 1329922 - RNA, 16 nt, Mycobacterium tuberculosis H37Rv
gcgggcuccccgcaca

SEQ ID NO: 1329923 - RNA, 16 nt, Mycobacterium tuberculosis H37Rv
gcgggcgugugcaguc

SEQ ID NO: 1329924 - RNA, 17 nt, Mycobacterium tuberculosis H37Rv
gcgggcguugaccugca

SEQ ID NO: 1329925 - RNA, 13 nt, Mycobacterium tuberculosis H37Rv
gcgggcgugugca

SEQ ID NO: 1329926 - RNA, 16 nt, Mycobacterium tuberculosis H37Rv
gcgggcggugggcagc

SEQ ID NO: 1329927 - RNA, 14 nt, Mycobacterium tuberculosis H37Rv
gcgguaaagccccg

SEQ ID NO: 1329928 - RNA, 19 nt, Mycobacterium tuberculosis H37Rv
gcgguaaccacgcggauca

SEQ ID NO: 1329929 - RNA, 15 nt, Mycobacterium tuberculosis H37Rv
gcgguaacucuggug

SEQ ID NO: 1329930 - RNA, 20 nt, Mycobacterium tuberculosis H37Rv
gcgguaacucuggugugggc

SEQ ID NO: 1329931 - RNA, 15 nt, Mycobacterium tuberculosis H37Rv
gcgguaagggcgggc

SEQ ID NO: 1329932 - RNA, 22 nt, Mycobacterium tuberculosis H37Rv
gcgggugccagcccguugcagg

SEQ ID NO: 1329933 - RNA, 17 nt, Mycobacterium tuberculosis H37Rv
gcgggugccgagcuggc

SEQ ID NO: 1329934 - RNA, 12 nt, Mycobacterium tuberculosis H37Rv
gcgggugccagc

SEQ ID NO: 1329935 - RNA, 15 nt, Mycobacterium tuberculosis H37Rv
gcgggugccagcccg

SEQ ID NO: 1329936 - RNA, 14 nt, Mycobacterium tuberculosis H37Rv
gcgggugcgccggc

SEQ ID NO: 1329937 - RNA, 16 nt, Mycobacterium tuberculosis H37Rv
gcgggugaugcaguga

SEQ ID NO: 1329938 - RNA, 14 nt, Mycobacterium tuberculosis H37Rv
gcgggugccgggca

SEQ ID NO: 1329939 - RNA, 19 nt, Mycobacterium tuberculosis H37Rv
gcgggugcgcgaggucggc

SEQ ID NO: 1329940 - RNA, 15 nt, Mycobacterium tuberculosis H37Rv
gcgggugcgccggcg

SEQ ID NO: 1329941 - RNA, 12 nt, Mycobacterium tuberculosis H37Rv
gcgggugcuggu

SEQ ID NO: 1329942 - RNA, 22 nt, Mycobacterium tuberculosis H37Rv
gcgggugcuggucaacagcggc

SEQ ID NO: 1329943 - RNA, 20 nt, Mycobacterium tuberculosis H37Rv
gcggguuugccgggcgcugg

SEQ ID NO: 1329944 - RNA, 15 nt, Mycobacterium tuberculosis H37Rv
gcggguggcagcggc

SEQ ID NO: 1329945 - RNA, 20 nt, Mycobacterium tuberculosis H37Rv
gcggguggccaucaccgcgc

SEQ ID NO: 1329946 - RNA, 22 nt, Mycobacterium tuberculosis H37Rv
gcgggucacaaaaccugggaug

SEQ ID NO: 1329947 - RNA, 16 nt, Mycobacterium tuberculosis H37Rv
gcgggucggcgaccgc

SEQ ID NO: 1329948 - RNA, 15 nt, Mycobacterium tuberculosis H37Rv
gcgggucaggccagg

SEQ ID NO: 1329949 - RNA, 23 nt, Mycobacterium tuberculosis H37Rv
gcgggucgugccccggcgcgguc

SEQ ID NO: 1329950 - RNA, 19 nt, Mycobacterium tuberculosis H37Rv
gcgggucgugccagcagca

SEQ ID NO: 1329951 - RNA, 20 nt, Mycobacterium tuberculosis H37Rv
gcgggucgugccccggcgcg

SEQ ID NO: 1329952 - RNA, 14 nt, Mycobacterium tuberculosis H37Rv
gcgggucggcggug

SEQ ID NO: 1329953 - RNA, 16 nt, Mycobacterium tuberculosis H37Rv
gcgggugaccaggcgg

SEQ ID NO: 1329954 - RNA, 22 nt, Mycobacterium tuberculosis H37Rv
gcgggugaccaggcggcgcggg

SEQ ID NO: 1329955 - RNA, 22 nt, Mycobacterium tuberculosis H37Rv
gcggccgaauuccucaaggucg

SEQ ID NO: 1329956 - RNA, 17 nt, Mycobacterium tuberculosis H37Rv
gcggccgcagcggccag

SEQ ID NO: 1329957 - RNA, 18 nt, Mycobacterium tuberculosis H37Rv
gcggccgccguccccgcc

SEQ ID NO: 1329958 - RNA, 12 nt, Mycobacterium tuberculosis H37Rv
gcggccgccauc

SEQ ID NO: 1329959 - RNA, 20 nt, Mycobacterium tuberculosis H37Rv
gcggccgccaucagccgcug

SEQ ID NO: 1329960 - RNA, 22 nt, Mycobacterium tuberculosis H37Rv
gcggccgcccggacccaaagca

SEQ ID NO: 1329961 - RNA, 15 nt, Mycobacterium tuberculosis H37Rv
gcggccgccgcggcu

SEQ ID NO: 1329962 - RNA, 13 nt, Mycobacterium tuberculosis H37Rv
gcggcgcccagga

SEQ ID NO: 1329963 - RNA, 16 nt, Mycobacterium tuberculosis H37Rv
gcggcgcgcggggccu

SEQ ID NO: 1329964 - RNA, 13 nt, Mycobacterium tuberculosis H37Rv
gcggcgcccggcg

SEQ ID NO: 1329965 - RNA, 11 nt, Mycobacterium tuberculosis H37Rv
gcggcgcccgg

SEQ ID NO: 1329966 - RNA, 21 nt, Mycobacterium tuberculosis H37Rv
gcggcgcgcaacacauccagu

SEQ ID NO: 1329967 - RNA, 17 nt, Mycobacterium tuberculosis H37Rv
gcggcgcgcaacacauc

SEQ ID NO: 1329968 - RNA, 14 nt, Mycobacterium tuberculosis H37Rv
gcggcgcccaggaa

SEQ ID NO: 1329969 - RNA, 16 nt, Mycobacterium tuberculosis H37Rv
gcggcgcccaggaacu

SEQ ID NO: 1329970 - RNA, 12 nt, Mycobacterium tuberculosis H37Rv
gcggcgcugcag

SEQ ID NO: 1329971 - RNA, 20 nt, Mycobacterium tuberculosis H37Rv
gcggcgcucuugcucaccag

SEQ ID NO: 1329972 - RNA, 20 nt, Mycobacterium tuberculosis H37Rv
gcggcgcuggucgcgguggc

SEQ ID NO: 1329973 - RNA, 13 nt, Mycobacterium tuberculosis H37Rv
gcggcgcugguug

SEQ ID NO: 1329974 - RNA, 12 nt, Mycobacterium tuberculosis H37Rv
gcggcgcugguu

SEQ ID NO: 1329975 - RNA, 17 nt, Mycobacterium tuberculosis H37Rv
gcggcgcggccgcagcc

SEQ ID NO: 1329976 - RNA, 13 nt, Mycobacterium tuberculosis H37Rv
gcggcgcggcggg

SEQ ID NO: 1329977 - RNA, 19 nt, Mycobacterium tuberculosis H37Rv
gcggcgcgggucacgccgu

SEQ ID NO: 1329978 - RNA, 17 nt, Mycobacterium tuberculosis H37Rv
gcggcgcgggggugggc

SEQ ID NO: 1329979 - RNA, 15 nt, Mycobacterium tuberculosis H37Rv
gcggcgcgggucggc

SEQ ID NO: 1329980 - RNA, 15 nt, Mycobacterium tuberculosis H37Rv
gcggcggcccgcagc

SEQ ID NO: 1329981 - RNA, 23 nt, Mycobacterium tuberculosis H37Rv
gcggcggcaucgaggccagcagc

SEQ ID NO: 1329982 - RNA, 20 nt, Mycobacterium tuberculosis H37Rv
gcggcggcccgcagcccgcc

SEQ ID NO: 1329983 - RNA, 13 nt, Mycobacterium tuberculosis H37Rv
gcggcggccgcag

SEQ ID NO: 1329984 - RNA, 13 nt, Mycobacterium tuberculosis H37Rv
gcggcggccuggg

SEQ ID NO: 1329985 - RNA, 18 nt, Mycobacterium tuberculosis H37Rv
gcggcggccugggccagc

SEQ ID NO: 1329986 - RNA, 14 nt, Mycobacterium tuberculosis H37Rv
gcggcggcgcccgg

SEQ ID NO: 1329987 - RNA, 20 nt, Mycobacterium tuberculosis H37Rv
gcggcggcacuacgcagccg

SEQ ID NO: 1329988 - RNA, 14 nt, Mycobacterium tuberculosis H37Rv
gcggcggcacgcuc

SEQ ID NO: 1329989 - RNA, 14 nt, Mycobacterium tuberculosis H37Rv
gcggcggccagcgc

SEQ ID NO: 1329990 - RNA, 13 nt, Mycobacterium tuberculosis H37Rv
gcggcggcagcgg

SEQ ID NO: 1329991 - RNA, 16 nt, Mycobacterium tuberculosis H37Rv
gcggcggcagcggcga

SEQ ID NO: 1329992 - RNA, 17 nt, Mycobacterium tuberculosis H37Rv
gcggcggcaaccccgag

SEQ ID NO: 1329993 - RNA, 13 nt, Mycobacterium tuberculosis H37Rv
gcggcggcggcca

SEQ ID NO: 1329994 - RNA, 13 nt, Mycobacterium tuberculosis H37Rv
gcggcggcgcugg

SEQ ID NO: 1329995 - RNA, 12 nt, Mycobacterium tuberculosis H37Rv
gcggcggcgcug

SEQ ID NO: 1329996 - RNA, 15 nt, Mycobacterium tuberculosis H37Rv
gcggcggcgcucggc

SEQ ID NO: 1329997 - RNA, 12 nt, Mycobacterium tuberculosis H37Rv
gcggcggcgccu

SEQ ID NO: 1329998 - RNA, 14 nt, Mycobacterium tuberculosis H37Rv
gcggcggcgcgauc

SEQ ID NO: 1329999 - RNA, 14 nt, Mycobacterium tuberculosis H37Rv
gcggcggcgccggc

SEQ ID NO: 1330000 - RNA, 13 nt, Mycobacterium tuberculosis H37Rv
gcggcggcgccgg

SEQ ID NO: 1330001 - RNA, 19 nt, Mycobacterium tuberculosis H37Rv
gcggcgggggcggcggcug

SEQ ID NO: 1330002 - RNA, 14 nt, Mycobacterium tuberculosis H37Rv
gcggcgggcagcgg

SEQ ID NO: 1330003 - RNA, 20 nt, Mycobacterium tuberculosis H37Rv
gcggcggcuuuggccgccgu

SEQ ID NO: 1330004 - RNA, 24 nt, Mycobacterium tuberculosis H37Rv
gcggcggcuuuggccgccguggcg

SEQ ID NO: 1330005 - RNA, 22 nt, Mycobacterium tuberculosis H37Rv
gcggcgguaugccacaggcugc

SEQ ID NO: 1330006 - RNA, 12 nt, Mycobacterium tuberculosis H37Rv
gcggcgggggcg

SEQ ID NO: 1330007 - RNA, 20 nt, Mycobacterium tuberculosis H37Rv
gcggcggucucgucaaccug

SEQ ID NO: 1330008 - RNA, 19 nt, Mycobacterium tuberculosis H37Rv
gcggcggugcagcagggcg

SEQ ID NO: 1330009 - RNA, 14 nt, Mycobacterium tuberculosis H37Rv
gcggcggugcgccc

SEQ ID NO: 1330010 - RNA, 18 nt, Mycobacterium tuberculosis H37Rv
gcggcggucugggugagc

SEQ ID NO: 1330011 - RNA, 13 nt, Mycobacterium tuberculosis H37Rv
gcggcggucgagc

SEQ ID NO: 1330012 - RNA, 15 nt, Mycobacterium tuberculosis H37Rv
gcggcggucgagcuc

SEQ ID NO: 1330013 - RNA, 16 nt, Mycobacterium tuberculosis H37Rv
gcggcguaacugugga

SEQ ID NO: 1330014 - RNA, 15 nt, Mycobacterium tuberculosis H37Rv
gcggcgguggccagc

SEQ ID NO: 1330015 - RNA, 22 nt, Mycobacterium tuberculosis H37Rv
gcggcgugucguugccagggcg

SEQ ID NO: 1330016 - RNA, 17 nt, Mycobacterium tuberculosis H37Rv
gcggcguuaccaccguc

SEQ ID NO: 1330017 - RNA, 19 nt, Mycobacterium tuberculosis H37Rv
gcggcguucgaugccacau

SEQ ID NO: 1330018 - RNA, 21 nt, Mycobacterium tuberculosis H37Rv
gcggcguuggugcagucggug

SEQ ID NO: 1330019 - RNA, 20 nt, Mycobacterium tuberculosis H37Rv
gcggcguuucccggguccug

SEQ ID NO: 1330020 - RNA, 18 nt, Mycobacterium tuberculosis H37Rv
gcggcuacaucggcggcg

SEQ ID NO: 1330021 - RNA, 17 nt, Mycobacterium tuberculosis H37Rv
gcggcucaaucuccucc

SEQ ID NO: 1330022 - RNA, 18 nt, Mycobacterium tuberculosis H37Rv
gcggcucaaucuccuccg

SEQ ID NO: 1330023 - RNA, 19 nt, Mycobacterium tuberculosis H37Rv
gcggcuauggcgccgcggc

SEQ ID NO: 1330024 - RNA, 16 nt, Mycobacterium tuberculosis H37Rv
gcggcuaggcaccagc

SEQ ID NO: 1330025 - RNA, 16 nt, Mycobacterium tuberculosis H37Rv
gcggcuaggccagcac

SEQ ID NO: 1330026 - RNA, 22 nt, Mycobacterium tuberculosis H37Rv
gcggcucaaccucuggcggcgg

SEQ ID NO: 1330027 - RNA, 18 nt, Mycobacterium tuberculosis H37Rv
gcggcuccaccgggcccg

SEQ ID NO: 1330028 - RNA, 20 nt, Mycobacterium tuberculosis H37Rv
gcggcuccaccgggcccgcc

SEQ ID NO: 1330029 - RNA, 18 nt, Mycobacterium tuberculosis H37Rv
gcggcguauugcggccug

SEQ ID NO: 1330030 - RNA, 17 nt, Mycobacterium tuberculosis H37Rv
gcggcguauugcggccu

SEQ ID NO: 1330031 - RNA, 19 nt, Mycobacterium tuberculosis H37Rv
gcggcgucgaugucauccg

SEQ ID NO: 1330032 - RNA, 13 nt, Mycobacterium tuberculosis H37Rv
gcggcgucgccgu

SEQ ID NO: 1330033 - RNA, 14 nt, Mycobacterium tuberculosis H37Rv
gcggcguccagcag

SEQ ID NO: 1330034 - RNA, 15 nt, Mycobacterium tuberculosis H37Rv
gcggcguccagcagc

SEQ ID NO: 1330035 - RNA, 13 nt, Mycobacterium tuberculosis H37Rv
gcggcguccagca

SEQ ID NO: 1330036 - RNA, 16 nt, Mycobacterium tuberculosis H37Rv
gcggcguggcgccggc

SEQ ID NO: 1330037 - RNA, 22 nt, Mycobacterium tuberculosis H37Rv
gcggcgugguauccgccguucu

SEQ ID NO: 1330038 - RNA, 14 nt, Mycobacterium tuberculosis H37Rv
gcggcgugcgcggu

SEQ ID NO: 1330039 - RNA, 20 nt, Mycobacterium tuberculosis H37Rv
gcggcgugacgucgucggug

SEQ ID NO: 1330040 - RNA, 13 nt, Mycobacterium tuberculosis H37Rv
gcggcgucguucg

SEQ ID NO: 1330041 - RNA, 17 nt, Mycobacterium tuberculosis H37Rv
gcggcgucguucgagac

SEQ ID NO: 1330042 - RNA, 17 nt, Mycobacterium tuberculosis H37Rv
gcggcgucuagcccgcc

SEQ ID NO: 1330043 - RNA, 21 nt, Mycobacterium tuberculosis H37Rv
gcggcgucgugagaggccaag

SEQ ID NO: 1330044 - RNA, 20 nt, Mycobacterium tuberculosis H37Rv
gcggcgucggugagcgcguc

SEQ ID NO: 1330045 - RNA, 19 nt, Mycobacterium tuberculosis H37Rv
gcggcgucggugccgcuga

SEQ ID NO: 1330046 - RNA, 14 nt, Mycobacterium tuberculosis H37Rv
gcgcgaucgcgccc

SEQ ID NO: 1330047 - RNA, 19 nt, Mycobacterium tuberculosis H37Rv
gcgcgaucgggccggcgcg

SEQ ID NO: 1330048 - RNA, 21 nt, Mycobacterium tuberculosis H37Rv
gcgcgaucgggccggcgcggu

SEQ ID NO: 1330049 - RNA, 17 nt, Mycobacterium tuberculosis H37Rv
gcgcgaucugcucgccc

SEQ ID NO: 1330050 - RNA, 23 nt, Mycobacterium tuberculosis H37Rv
gcgcgauggccuggcccuuguug

SEQ ID NO: 1330051 - RNA, 21 nt, Mycobacterium tuberculosis H37Rv
gcgcgauggcgauagcggcgc

SEQ ID NO: 1330052 - RNA, 18 nt, Mycobacterium tuberculosis H37Rv
gcgcgaccucgcuggccg

SEQ ID NO: 1330053 - RNA, 13 nt, Mycobacterium tuberculosis H37Rv
gcgcgacggcgcu

SEQ ID NO: 1330054 - RNA, 20 nt, Mycobacterium tuberculosis H37Rv
gcgcgacguaguugccggcu

SEQ ID NO: 1330055 - RNA, 22 nt, Mycobacterium tuberculosis H37Rv
gcgcgacggucccuucgucacc

SEQ ID NO: 1330056 - RNA, 19 nt, Mycobacterium tuberculosis H37Rv
gcgcgcaacguacgcacgc

SEQ ID NO: 1330057 - RNA, 22 nt, Mycobacterium tuberculosis H37Rv
gcgcgcaacguagccagcagcg

SEQ ID NO: 1330058 - RNA, 22 nt, Mycobacterium tuberculosis H37Rv
gcgcgcaagugcuggccgaaga

SEQ ID NO: 1330059 - RNA, 15 nt, Mycobacterium tuberculosis H37Rv
gcgcgcaacccugcc

SEQ ID NO: 1330060 - RNA, 19 nt, Mycobacterium tuberculosis H37Rv
gcgcgcaacccugccgcga

SEQ ID NO: 1330061 - RNA, 22 nt, Mycobacterium tuberculosis H37Rv
gcgcgaugggagcccggcggcc

SEQ ID NO: 1330062 - RNA, 15 nt, Mycobacterium tuberculosis H37Rv
gcgcgccacccagca

SEQ ID NO: 1330063 - RNA, 20 nt, Mycobacterium tuberculosis H37Rv
gcgcgcauauccgcaggccc

SEQ ID NO: 1330064 - RNA, 17 nt, Mycobacterium tuberculosis H37Rv
gcgccuuggcacccucc

SEQ ID NO: 1330065 - RNA, 15 nt, Mycobacterium tuberculosis H37Rv
gcgccuuggccagcg

SEQ ID NO: 1330066 - RNA, 16 nt, Mycobacterium tuberculosis H37Rv
gcgccuuggccagcgc

SEQ ID NO: 1330067 - RNA, 14 nt, Mycobacterium tuberculosis H37Rv
gcgccuugcgggcc

SEQ ID NO: 1330068 - RNA, 18 nt, Mycobacterium tuberculosis H37Rv
gcgccuugcgggccuggu

SEQ ID NO: 1330069 - RNA, 20 nt, Mycobacterium tuberculosis H37Rv
gcgccuuccaggcgggcggc

SEQ ID NO: 1330070 - RNA, 17 nt, Mycobacterium tuberculosis H37Rv
gcgccuucgccagcggc

SEQ ID NO: 1330071 - RNA, 16 nt, Mycobacterium tuberculosis H37Rv
gcgccuugaccacagc

SEQ ID NO: 1330072 - RNA, 18 nt, Mycobacterium tuberculosis H37Rv
gcgccuuugccccgugga

SEQ ID NO: 1330073 - RNA, 21 nt, Mycobacterium tuberculosis H37Rv
gcgcggcgaccauaagcucgu

SEQ ID NO: 1330074 - RNA, 12 nt, Mycobacterium tuberculosis H37Rv
gcgcggccuugg

SEQ ID NO: 1330075 - RNA, 19 nt, Mycobacterium tuberculosis H37Rv
gcgcggcgagcacgcgggc

SEQ ID NO: 1330076 - RNA, 18 nt, Mycobacterium tuberculosis H37Rv
gcgcggcaagcucguccg

SEQ ID NO: 1330077 - RNA, 21 nt, Mycobacterium tuberculosis H37Rv
gcgcgcugggaagcucggucc

SEQ ID NO: 1330078 - RNA, 15 nt, Mycobacterium tuberculosis H37Rv
gcgcgcuggcgggcg

SEQ ID NO: 1330079 - RNA, 14 nt, Mycobacterium tuberculosis H37Rv
gcgcgcugggcgcg

SEQ ID NO: 1330080 - RNA, 14 nt, Mycobacterium tuberculosis H37Rv
gcgcgcugggcccg

SEQ ID NO: 1330081 - RNA, 21 nt, Mycobacterium tuberculosis H37Rv
gcgcgcugggcccgagcgcgc

SEQ ID NO: 1330082 - RNA, 15 nt, Mycobacterium tuberculosis H37Rv
gcgcgcugauuucuu

SEQ ID NO: 1330083 - RNA, 13 nt, Mycobacterium tuberculosis H37Rv
gcgcgcugagccg

SEQ ID NO: 1330084 - RNA, 20 nt, Mycobacterium tuberculosis H37Rv
gcgcgccggauacaccggca

SEQ ID NO: 1330085 - RNA, 19 nt, Mycobacterium tuberculosis H37Rv
gcgcgcugaaaugccgucg

SEQ ID NO: 1330086 - RNA, 15 nt, Mycobacterium tuberculosis H37Rv
gcgcgcgcucgggcc

SEQ ID NO: 1330087 - RNA, 14 nt, Mycobacterium tuberculosis H37Rv
gcgcgccggcgucg

SEQ ID NO: 1330088 - RNA, 18 nt, Mycobacterium tuberculosis H37Rv
gcgcgccgaucggcaccg

SEQ ID NO: 1330089 - RNA, 21 nt, Mycobacterium tuberculosis H37Rv
gcgcgccgcauccagccgugc

SEQ ID NO: 1330090 - RNA, 23 nt, Mycobacterium tuberculosis H37Rv
gcgcgccagcuugucgggcaccg

SEQ ID NO: 1330091 - RNA, 20 nt, Mycobacterium tuberculosis H37Rv
gcgcgccgaucacggugggc

SEQ ID NO: 1330092 - RNA, 16 nt, Mycobacterium tuberculosis H37Rv
gcgcgccgaucggcac

SEQ ID NO: 1330093 - RNA, 17 nt, Mycobacterium tuberculosis H37Rv
gcgccucaagcucgccg

SEQ ID NO: 1330094 - RNA, 19 nt, Mycobacterium tuberculosis H37Rv
gcgccuccagcaccacggc

SEQ ID NO: 1330095 - RNA, 17 nt, Mycobacterium tuberculosis H37Rv
gcgccucgcccagcaag

SEQ ID NO: 1330096 - RNA, 14 nt, Mycobacterium tuberculosis H37Rv
gcgccuccgggacg

SEQ ID NO: 1330097 - RNA, 15 nt, Mycobacterium tuberculosis H37Rv
gcgccuccgggacgg

SEQ ID NO: 1330098 - RNA, 22 nt, Mycobacterium tuberculosis H37Rv
gcgccucgaccugacuggucag

SEQ ID NO: 1330099 - RNA, 13 nt, Mycobacterium tuberculosis H37Rv
gcgccucgccggc

SEQ ID NO: 1330100 - RNA, 14 nt, Mycobacterium tuberculosis H37Rv
gcgccucgccggcc

SEQ ID NO: 1330101 - RNA, 16 nt, Mycobacterium tuberculosis H37Rv
gcgccguugcccccgu

SEQ ID NO: 1330102 - RNA, 15 nt, Mycobacterium tuberculosis H37Rv
gcgccguugccgccg

SEQ ID NO: 1330103 - RNA, 16 nt, Mycobacterium tuberculosis H37Rv
gcgccguugccgccgu

SEQ ID NO: 1330104 - RNA, 14 nt, Mycobacterium tuberculosis H37Rv
gcgccuaccagcac

SEQ ID NO: 1330105 - RNA, 21 nt, Mycobacterium tuberculosis H37Rv
gcgccguggaucaucccgacc

SEQ ID NO: 1330106 - RNA, 20 nt, Mycobacterium tuberculosis H37Rv
gcgccgugucaccgggugca

SEQ ID NO: 1330107 - RNA, 17 nt, Mycobacterium tuberculosis H37Rv
gcgccguggcaucgccu

SEQ ID NO: 1330108 - RNA, 15 nt, Mycobacterium tuberculosis H37Rv
gcgccguucgcuccc

SEQ ID NO: 1330109 - RNA, 14 nt, Mycobacterium tuberculosis H37Rv
gcgccugcggcagc

SEQ ID NO: 1330110 - RNA, 12 nt, Mycobacterium tuberculosis H37Rv
gcgccucggugg

SEQ ID NO: 1330111 - RNA, 16 nt, Mycobacterium tuberculosis H37Rv
gcgccugagcggccuc

SEQ ID NO: 1330112 - RNA, 22 nt, Mycobacterium tuberculosis H37Rv
gcgccugaacauguccgcacgc

SEQ ID NO: 1330113 - RNA, 15 nt, Mycobacterium tuberculosis H37Rv
gcgccugaggugcug

SEQ ID NO: 1330114 - RNA, 21 nt, Mycobacterium tuberculosis H37Rv
gcgccuggcuggccagcugcg

SEQ ID NO: 1330115 - RNA, 20 nt, Mycobacterium tuberculosis H37Rv
gcgccuggcggcgccgcaga

SEQ ID NO: 1330116 - RNA, 15 nt, Mycobacterium tuberculosis H37Rv
gcgccugcggcagca

SEQ ID NO: 1330117 - RNA, 12 nt, Mycobacterium tuberculosis H37Rv
gcgccugcugcg

SEQ ID NO: 1330118 - RNA, 16 nt, Mycobacterium tuberculosis H37Rv
gcgccugcugcggcca

SEQ ID NO: 1330119 - RNA, 12 nt, Mycobacterium tuberculosis H37Rv
gcgccggcuggc

SEQ ID NO: 1330120 - RNA, 15 nt, Mycobacterium tuberculosis H37Rv
gcgccggcuggcggc

SEQ ID NO: 1330121 - RNA, 19 nt, Mycobacterium tuberculosis H37Rv
gcgccgggcguccgccggc

SEQ ID NO: 1330122 - RNA, 17 nt, Mycobacterium tuberculosis H37Rv
gcgccggcugccacaca

SEQ ID NO: 1330123 - RNA, 20 nt, Mycobacterium tuberculosis H37Rv
gcgccggcuagggcccuggc

SEQ ID NO: 1330124 - RNA, 14 nt, Mycobacterium tuberculosis H37Rv
gcgccggcgucggc

SEQ ID NO: 1330125 - RNA, 18 nt, Mycobacterium tuberculosis H37Rv
gcgccggcuagggcccug

SEQ ID NO: 1330126 - RNA, 16 nt, Mycobacterium tuberculosis H37Rv
gcgccggcgggcgcgg

SEQ ID NO: 1330127 - RNA, 12 nt, Mycobacterium tuberculosis H37Rv
gcgccggcgggc

SEQ ID NO: 1330128 - RNA, 13 nt, Mycobacterium tuberculosis H37Rv
gcgccggcggccg

SEQ ID NO: 1330129 - RNA, 14 nt, Mycobacterium tuberculosis H37Rv
gcgccggcggccgc

SEQ ID NO: 1330130 - RNA, 17 nt, Mycobacterium tuberculosis H37Rv
gcgccggcgcugcugcc

SEQ ID NO: 1330131 - RNA, 13 nt, Mycobacterium tuberculosis H37Rv
gcgccggcgccuc

SEQ ID NO: 1330132 - RNA, 17 nt, Mycobacterium tuberculosis H37Rv
gcgccggccgcugccuu

SEQ ID NO: 1330133 - RNA, 14 nt, Mycobacterium tuberculosis H37Rv
gcgccggccgcugc

SEQ ID NO: 1330134 - RNA, 20 nt, Mycobacterium tuberculosis H37Rv
gcgccggcagacccgggcca

SEQ ID NO: 1330135 - RNA, 23 nt, Mycobacterium tuberculosis H37Rv
gcgccggcaucuccaccgucgcc

SEQ ID NO: 1330136 - RNA, 15 nt, Mycobacterium tuberculosis H37Rv
gcgccgucaucgcag

SEQ ID NO: 1330137 - RNA, 16 nt, Mycobacterium tuberculosis H37Rv
gcgccgucagcccagg

SEQ ID NO: 1330138 - RNA, 18 nt, Mycobacterium tuberculosis H37Rv
gcgccguagaccagcagg

SEQ ID NO: 1330139 - RNA, 20 nt, Mycobacterium tuberculosis H37Rv
gcgccguagagccgcucggc

SEQ ID NO: 1330140 - RNA, 19 nt, Mycobacterium tuberculosis H37Rv
gcgccguaacagccggccg

SEQ ID NO: 1330141 - RNA, 16 nt, Mycobacterium tuberculosis H37Rv
gcgccguacagcggcg

SEQ ID NO: 1330142 - RNA, 17 nt, Mycobacterium tuberculosis H37Rv
gcgccguacagcggcgg

SEQ ID NO: 1330143 - RNA, 15 nt, Mycobacterium tuberculosis H37Rv
gcgccgucgcccagc

SEQ ID NO: 1330144 - RNA, 15 nt, Mycobacterium tuberculosis H37Rv
gcgccgucgggccug

SEQ ID NO: 1330145 - RNA, 21 nt, Mycobacterium tuberculosis H37Rv
gcgccgucguugugccggucg

SEQ ID NO: 1330146 - RNA, 16 nt, Mycobacterium tuberculosis H37Rv
gcgccgucggugggug

SEQ ID NO: 1330147 - RNA, 16 nt, Mycobacterium tuberculosis H37Rv
gcgccgucgcagccag

SEQ ID NO: 1330148 - RNA, 22 nt, Mycobacterium tuberculosis H37Rv
gcgccguccuagcgugccgccc

SEQ ID NO: 1330149 - RNA, 14 nt, Mycobacterium tuberculosis H37Rv
gcgccgggcucgcg

SEQ ID NO: 1330150 - RNA, 19 nt, Mycobacterium tuberculosis H37Rv
gcgccggugccgccgggug

SEQ ID NO: 1330151 - RNA, 15 nt, Mycobacterium tuberculosis H37Rv
gcgccggugccgccu

SEQ ID NO: 1330152 - RNA, 18 nt, Mycobacterium tuberculosis H37Rv
gcgccggugccgccuccg

SEQ ID NO: 1330153 - RNA, 19 nt, Mycobacterium tuberculosis H37Rv
gcgccgguuacccggaccg

SEQ ID NO: 1330154 - RNA, 19 nt, Mycobacterium tuberculosis H37Rv
gcgccgggggcgccgccgu

SEQ ID NO: 1330155 - RNA, 16 nt, Mycobacterium tuberculosis H37Rv
gcgccggggccgccga

SEQ ID NO: 1330156 - RNA, 14 nt, Mycobacterium tuberculosis H37Rv
gcgccggggcgcag

SEQ ID NO: 1330157 - RNA, 15 nt, Mycobacterium tuberculosis H37Rv
gcgccggggcgcagg

SEQ ID NO: 1330158 - RNA, 20 nt, Mycobacterium tuberculosis H37Rv
gcgccgccguuaccgccggc

SEQ ID NO: 1330159 - RNA, 17 nt, Mycobacterium tuberculosis H37Rv
gcgccgccggcggcggu

SEQ ID NO: 1330160 - RNA, 17 nt, Mycobacterium tuberculosis H37Rv
gcgccgccgcgagcgcc

SEQ ID NO: 1330161 - RNA, 14 nt, Mycobacterium tuberculosis H37Rv
gcgccgccggugcc

SEQ ID NO: 1330162 - RNA, 17 nt, Mycobacterium tuberculosis H37Rv
gcgccgccggugccacc

SEQ ID NO: 1330163 - RNA, 18 nt, Mycobacterium tuberculosis H37Rv
gcgccgccguccagcgcc

SEQ ID NO: 1330164 - RNA, 17 nt, Mycobacterium tuberculosis H37Rv
gcgccgcgccgauucca

SEQ ID NO: 1330165 - RNA, 17 nt, Mycobacterium tuberculosis H37Rv
gcgccgcgcagcgagga

SEQ ID NO: 1330166 - RNA, 20 nt, Mycobacterium tuberculosis H37Rv
gcgccgcccuugccgccggc

SEQ ID NO: 1330167 - RNA, 17 nt, Mycobacterium tuberculosis H37Rv
gcgccgccggcaccgcc

SEQ ID NO: 1330168 - RNA, 15 nt, Mycobacterium tuberculosis H37Rv
gcgccgccggcgccg

SEQ ID NO: 1330169 - RNA, 18 nt, Mycobacterium tuberculosis H37Rv
gcgccgccggcgccgccc

SEQ ID NO: 1330170 - RNA, 22 nt, Mycobacterium tuberculosis H37Rv
gcgccgccgcgagcgccggccg

SEQ ID NO: 1330171 - RNA, 17 nt, Mycobacterium tuberculosis H37Rv
gcgccgccggcgccggc

SEQ ID NO: 1330172 - RNA, 14 nt, Mycobacterium tuberculosis H37Rv
gcgccgccggcgcg

SEQ ID NO: 1330173 - RNA, 16 nt, Mycobacterium tuberculosis H37Rv
gcgccgcccgcgccac

SEQ ID NO: 1330174 - RNA, 15 nt, Mycobacterium tuberculosis H37Rv
gcgccgcccaacgcg

SEQ ID NO: 1330175 - RNA, 17 nt, Mycobacterium tuberculosis H37Rv
gcgccgcuggucguggc

SEQ ID NO: 1330176 - RNA, 15 nt, Mycobacterium tuberculosis H37Rv
gcgccgcugaagcca

SEQ ID NO: 1330177 - RNA, 18 nt, Mycobacterium tuberculosis H37Rv
gcgccggaguuuccccua

SEQ ID NO: 1330178 - RNA, 20 nt, Mycobacterium tuberculosis H37Rv
gcgccggaguuuccccuacc

SEQ ID NO: 1330179 - RNA, 21 nt, Mycobacterium tuberculosis H37Rv
gcgccggacaaaccgggcggc

SEQ ID NO: 1330180 - RNA, 15 nt, Mycobacterium tuberculosis H37Rv
gcgccggcacgggcg

SEQ ID NO: 1330181 - RNA, 14 nt, Mycobacterium tuberculosis H37Rv
gcgccgcggcgacg

SEQ ID NO: 1330182 - RNA, 20 nt, Mycobacterium tuberculosis H37Rv
gcgccgcggcuacaucggcg

SEQ ID NO: 1330183 - RNA, 13 nt, Mycobacterium tuberculosis H37Rv
gcgccgcggcgac

SEQ ID NO: 1330184 - RNA, 16 nt, Mycobacterium tuberculosis H37Rv
gcgccgcggcccgcuc

SEQ ID NO: 1330185 - RNA, 15 nt, Mycobacterium tuberculosis H37Rv
gcgccgcggcccgcu

SEQ ID NO: 1330186 - RNA, 17 nt, Mycobacterium tuberculosis H37Rv
gcgccgaaaacaacccg

SEQ ID NO: 1330187 - RNA, 16 nt, Mycobacterium tuberculosis H37Rv
gcgccgaacaccacac

SEQ ID NO: 1330188 - RNA, 22 nt, Mycobacterium tuberculosis H37Rv
gcgccgaacaccacaccgagca

SEQ ID NO: 1330189 - RNA, 18 nt, Mycobacterium tuberculosis H37Rv
gcgccgaacgccagcagc

SEQ ID NO: 1330190 - RNA, 19 nt, Mycobacterium tuberculosis H37Rv
gcgccgaacgcuccaggcc

SEQ ID NO: 1330191 - RNA, 18 nt, Mycobacterium tuberculosis H37Rv
gcgccgaaguagccgacc

SEQ ID NO: 1330192 - RNA, 23 nt, Mycobacterium tuberculosis H37Rv
gcgccgaaguagccgaccggcag

SEQ ID NO: 1330193 - RNA, 17 nt, Mycobacterium tuberculosis H37Rv
gcgccgaaucgcgggcu

SEQ ID NO: 1330194 - RNA, 18 nt, Mycobacterium tuberculosis H37Rv
gcgccgaaucgcgggcug

SEQ ID NO: 1330195 - RNA, 24 nt, Mycobacterium tuberculosis H37Rv
gcgccgaaugccaccucgacgcac

SEQ ID NO: 1330196 - RNA, 23 nt, Mycobacterium tuberculosis H37Rv
gcgcccuggcgugugugcgccuc

SEQ ID NO: 1330197 - RNA, 21 nt, Mycobacterium tuberculosis H37Rv
gcgcccuuaagccggcgcggc

SEQ ID NO: 1330198 - RNA, 12 nt, Mycobacterium tuberculosis H37Rv
gcgcccuccucg

SEQ ID NO: 1330199 - RNA, 16 nt, Mycobacterium tuberculosis H37Rv
gcgcccugagccaccc

SEQ ID NO: 1330200 - RNA, 18 nt, Mycobacterium tuberculosis H37Rv
gcgccgacggccagcagg

SEQ ID NO: 1330201 - RNA, 23 nt, Mycobacterium tuberculosis H37Rv
gcgccgagauccacgccagagcg

SEQ ID NO: 1330202 - RNA, 20 nt, Mycobacterium tuberculosis H37Rv
gcgccgacccgcgcgccggc

SEQ ID NO: 1330203 - RNA, 19 nt, Mycobacterium tuberculosis H37Rv
gcgccgaccucaucggcac

SEQ ID NO: 1330204 - RNA, 17 nt, Mycobacterium tuberculosis H37Rv
gcgccgacccgcgcgcc

SEQ ID NO: 1330205 - RNA, 18 nt, Mycobacterium tuberculosis H37Rv
gcgccgacccgcgcgccg

SEQ ID NO: 1330206 - RNA, 19 nt, Mycobacterium tuberculosis H37Rv
gcgccgacccgcgcgccgg

SEQ ID NO: 1330207 - RNA, 15 nt, Mycobacterium tuberculosis H37Rv
gcgccgaauggcggu

SEQ ID NO: 1330208 - RNA, 19 nt, Mycobacterium tuberculosis H37Rv
gcgccgaauggcggugggc

SEQ ID NO: 1330209 - RNA, 16 nt, Mycobacterium tuberculosis H37Rv
gcgccgacaccggcug

SEQ ID NO: 1330210 - RNA, 17 nt, Mycobacterium tuberculosis H37Rv
gcgccgauguggccggc

SEQ ID NO: 1330211 - RNA, 18 nt, Mycobacterium tuberculosis H37Rv
gcgccgauacccagcggg

SEQ ID NO: 1330212 - RNA, 17 nt, Mycobacterium tuberculosis H37Rv
gcgccgauaccggcggc

SEQ ID NO: 1330213 - RNA, 21 nt, Mycobacterium tuberculosis H37Rv
gcgccgauaccggcggcgagc

SEQ ID NO: 1330214 - RNA, 19 nt, Mycobacterium tuberculosis H37Rv
gcgccgaucacggugggcg

SEQ ID NO: 1330215 - RNA, 18 nt, Mycobacterium tuberculosis H37Rv
gcgccgaucacggugggc

SEQ ID NO: 1330216 - RNA, 20 nt, Mycobacterium tuberculosis H37Rv
gcgccgaguugcccgggucg

SEQ ID NO: 1330217 - RNA, 17 nt, Mycobacterium tuberculosis H37Rv
gcgccgccacugccggc

SEQ ID NO: 1330218 - RNA, 14 nt, Mycobacterium tuberculosis H37Rv
gcgccgccagcacc

SEQ ID NO: 1330219 - RNA, 13 nt, Mycobacterium tuberculosis H37Rv
gcgccgccagcgc

SEQ ID NO: 1330220 - RNA, 14 nt, Mycobacterium tuberculosis H37Rv
gcgccgccagcgcc

SEQ ID NO: 1330221 - RNA, 19 nt, Mycobacterium tuberculosis H37Rv
gcgccgccagcgccgccgg

SEQ ID NO: 1330222 - RNA, 19 nt, Mycobacterium tuberculosis H37Rv
gcgccgccacagcacccac

SEQ ID NO: 1330223 - RNA, 17 nt, Mycobacterium tuberculosis H37Rv
gcgccgccaagggcccc

SEQ ID NO: 1330224 - RNA, 23 nt, Mycobacterium tuberculosis H37Rv
gcgccgccacgguacauccagag

SEQ ID NO: 1330225 - RNA, 21 nt, Mycobacterium tuberculosis H37Rv
gcgccgccaccgaagccgccg

SEQ ID NO: 1330226 - RNA, 23 nt, Mycobacterium tuberculosis H37Rv
gcgccgcaucauagacagggccg

SEQ ID NO: 1330227 - RNA, 12 nt, Mycobacterium tuberculosis H37Rv
gcgccgccacag

SEQ ID NO: 1330228 - RNA, 13 nt, Mycobacterium tuberculosis H37Rv
gcgccgccacagc

SEQ ID NO: 1330229 - RNA, 14 nt, Mycobacterium tuberculosis H37Rv
gcgccgccacagca

SEQ ID NO: 1330230 - RNA, 15 nt, Mycobacterium tuberculosis H37Rv
gcgccgcagggccgc

SEQ ID NO: 1330231 - RNA, 21 nt, Mycobacterium tuberculosis H37Rv
gcgccgcauccagccgugcgg

SEQ ID NO: 1330232 - RNA, 19 nt, Mycobacterium tuberculosis H37Rv
gcgccgcagagcaccgcga

SEQ ID NO: 1330233 - RNA, 12 nt, Mycobacterium tuberculosis H37Rv
gcgccgcacggc

SEQ ID NO: 1330234 - RNA, 15 nt, Mycobacterium tuberculosis H37Rv
gcgccaucgccucca

SEQ ID NO: 1330235 - RNA, 20 nt, Mycobacterium tuberculosis H37Rv
gcgccaucgggucacccccg

SEQ ID NO: 1330236 - RNA, 21 nt, Mycobacterium tuberculosis H37Rv
gcgccaucgggucacccccgg

SEQ ID NO: 1330237 - RNA, 18 nt, Mycobacterium tuberculosis H37Rv
gcgccaucgaugcgguga

SEQ ID NO: 1330238 - RNA, 18 nt, Mycobacterium tuberculosis H37Rv
gcgccaugaagccgggcg

SEQ ID NO: 1330239 - RNA, 22 nt, Mycobacterium tuberculosis H37Rv
gcgccaugcugucguagcgcga

SEQ ID NO: 1330240 - RNA, 17 nt, Mycobacterium tuberculosis H37Rv
gcgcccaccgggcggcg

SEQ ID NO: 1330241 - RNA, 22 nt, Mycobacterium tuberculosis H37Rv
gcgcccacuggugaucuggucc

SEQ ID NO: 1330242 - RNA, 20 nt, Mycobacterium tuberculosis H37Rv
gcgcccaccggcuagcugug

SEQ ID NO: 1330243 - RNA, 18 nt, Mycobacterium tuberculosis H37Rv
gcgcccacagcccgggcg

SEQ ID NO: 1330244 - RNA, 21 nt, Mycobacterium tuberculosis H37Rv
gcgcccacaucgucggcgggc

SEQ ID NO: 1330245 - RNA, 20 nt, Mycobacterium tuberculosis H37Rv
gcgccaguguggugcggcgc

SEQ ID NO: 1330246 - RNA, 19 nt, Mycobacterium tuberculosis H37Rv
gcgccaguauggccgccac

SEQ ID NO: 1330247 - RNA, 23 nt, Mycobacterium tuberculosis H37Rv
gcgccauaauauugccgccuccg

SEQ ID NO: 1330248 - RNA, 17 nt, Mycobacterium tuberculosis H37Rv
gcgccaguucggcgggc

SEQ ID NO: 1330249 - RNA, 18 nt, Mycobacterium tuberculosis H37Rv
gcgccaggucggcggacg

SEQ ID NO: 1330250 - RNA, 17 nt, Mycobacterium tuberculosis H37Rv
gcgccaggucggcgggc

SEQ ID NO: 1330251 - RNA, 20 nt, Mycobacterium tuberculosis H37Rv
gcgccaggucggcgggcgcg

SEQ ID NO: 1330252 - RNA, 13 nt, Mycobacterium tuberculosis H37Rv
gcgccaggucggu

SEQ ID NO: 1330253 - RNA, 15 nt, Mycobacterium tuberculosis H37Rv
gcgccaggggugugc

SEQ ID NO: 1330254 - RNA, 19 nt, Mycobacterium tuberculosis H37Rv
gcgccaggcgcgaucgcgc

SEQ ID NO: 1330255 - RNA, 20 nt, Mycobacterium tuberculosis H37Rv
gcgccagcguuaggucgccg

SEQ ID NO: 1330256 - RNA, 17 nt, Mycobacterium tuberculosis H37Rv
gcgcccggcccgccacc

SEQ ID NO: 1330257 - RNA, 19 nt, Mycobacterium tuberculosis H37Rv
gcgcccggccaagccggcg

SEQ ID NO: 1330258 - RNA, 20 nt, Mycobacterium tuberculosis H37Rv
gcgcccggcgcuagcgccgc

SEQ ID NO: 1330259 - RNA, 18 nt, Mycobacterium tuberculosis H37Rv
gcgcccucagccgcggcc

SEQ ID NO: 1330260 - RNA, 16 nt, Mycobacterium tuberculosis H37Rv
gcgcccucagccgcgg

SEQ ID NO: 1330261 - RNA, 17 nt, Mycobacterium tuberculosis H37Rv
gcgcccucagccgcggc

SEQ ID NO: 1330262 - RNA, 15 nt, Mycobacterium tuberculosis H37Rv
gcgcccgugccgccc

SEQ ID NO: 1330263 - RNA, 14 nt, Mycobacterium tuberculosis H37Rv
gcgcccgcgcgcuc

SEQ ID NO: 1330264 - RNA, 19 nt, Mycobacterium tuberculosis H37Rv
gcgcccgggucccggcagc

SEQ ID NO: 1330265 - RNA, 21 nt, Mycobacterium tuberculosis H37Rv
gcgcccgggcauccuucacca

SEQ ID NO: 1330266 - RNA, 14 nt, Mycobacterium tuberculosis H37Rv
gcgcccgcaccacc

SEQ ID NO: 1330267 - RNA, 16 nt, Mycobacterium tuberculosis H37Rv
gcgcccgccaucagcc

SEQ ID NO: 1330268 - RNA, 21 nt, Mycobacterium tuberculosis H37Rv
gcgcccgccaucagcccggcg

SEQ ID NO: 1330269 - RNA, 13 nt, Mycobacterium tuberculosis H37Rv
gcgcccgcgcggc

SEQ ID NO: 1330270 - RNA, 19 nt, Mycobacterium tuberculosis H37Rv
gcgcccgcguucagggcac

SEQ ID NO: 1330271 - RNA, 14 nt, Mycobacterium tuberculosis H37Rv
gcgcccgccgcggc

SEQ ID NO: 1330272 - RNA, 15 nt, Mycobacterium tuberculosis H37Rv
gcgcccgccgcggca

SEQ ID NO: 1330273 - RNA, 12 nt, Mycobacterium tuberculosis H37Rv
gcgcccgccggc

SEQ ID NO: 1330274 - RNA, 20 nt, Mycobacterium tuberculosis H37Rv
gcgcccauagcugccggccc

SEQ ID NO: 1330275 - RNA, 15 nt, Mycobacterium tuberculosis H37Rv
gcgcccauagcugcc

SEQ ID NO: 1330276 - RNA, 16 nt, Mycobacterium tuberculosis H37Rv
gcgcccauggccacca

SEQ ID NO: 1330277 - RNA, 17 nt, Mycobacterium tuberculosis H37Rv
gcgcccauggccaccag

SEQ ID NO: 1330278 - RNA, 23 nt, Mycobacterium tuberculosis H37Rv
gcgcccagcgcuagccgggcgcg

SEQ ID NO: 1330279 - RNA, 20 nt, Mycobacterium tuberculosis H37Rv
gcgcccagcacguaacccag

SEQ ID NO: 1330280 - RNA, 18 nt, Mycobacterium tuberculosis H37Rv
gcgcccccagcagcugcg

SEQ ID NO: 1330281 - RNA, 15 nt, Mycobacterium tuberculosis H37Rv
gcgccccaugaugaa

SEQ ID NO: 1330282 - RNA, 18 nt, Mycobacterium tuberculosis H37Rv
gcgcccgaaccccgggcg

SEQ ID NO: 1330283 - RNA, 20 nt, Mycobacterium tuberculosis H37Rv
gcgcccgaaccccgggcggc

SEQ ID NO: 1330284 - RNA, 17 nt, Mycobacterium tuberculosis H37Rv
gcgcccgaagccgggcc

SEQ ID NO: 1330285 - RNA, 21 nt, Mycobacterium tuberculosis H37Rv
gcgcccccgacgacggcaccg

SEQ ID NO: 1330286 - RNA, 13 nt, Mycobacterium tuberculosis H37Rv
gcccggcccgccc

SEQ ID NO: 1330287 - RNA, 12 nt, Mycobacterium tuberculosis H37Rv
gcccggccccgc

SEQ ID NO: 1330288 - RNA, 13 nt, Mycobacterium tuberculosis H37Rv
gcccggccgcggc

SEQ ID NO: 1330289 - RNA, 14 nt, Mycobacterium tuberculosis H37Rv
gcccggccgcggcc

SEQ ID NO: 1330290 - RNA, 15 nt, Mycobacterium tuberculosis H37Rv
gcccggccgcggccc

SEQ ID NO: 1330291 - RNA, 14 nt, Mycobacterium tuberculosis H37Rv
gcccggccgcagcg

SEQ ID NO: 1330292 - RNA, 14 nt, Mycobacterium tuberculosis H37Rv
gcccggccgccagc

SEQ ID NO: 1330293 - RNA, 22 nt, Mycobacterium tuberculosis H37Rv
gcccggcgcaagcgccgcgcuu

SEQ ID NO: 1330294 - RNA, 21 nt, Mycobacterium tuberculosis H37Rv
gcccggccuugccgccggcuc

SEQ ID NO: 1330295 - RNA, 16 nt, Mycobacterium tuberculosis H37Rv
gcccggccuugccgcc

SEQ ID NO: 1330296 - RNA, 19 nt, Mycobacterium tuberculosis H37Rv
gcccggccuugccgccggc

SEQ ID NO: 1330297 - RNA, 16 nt, Mycobacterium tuberculosis H37Rv
gcccggccaagccggc

SEQ ID NO: 1330298 - RNA, 14 nt, Mycobacterium tuberculosis H37Rv
gcccggcaggacuu

SEQ ID NO: 1330299 - RNA, 22 nt, Mycobacterium tuberculosis H37Rv
gcccggcgugucgccgccacca

SEQ ID NO: 1330300 - RNA, 19 nt, Mycobacterium tuberculosis H37Rv
gcccggcgugucgccgcca

SEQ ID NO: 1330301 - RNA, 20 nt, Mycobacterium tuberculosis H37Rv
gcccggcgugucgccgccac

SEQ ID NO: 1330302 - RNA, 22 nt, Mycobacterium tuberculosis H37Rv
gcccggcguuguugaccagcac

SEQ ID NO: 1330303 - RNA, 16 nt, Mycobacterium tuberculosis H37Rv
gcccggcguggugagc

SEQ ID NO: 1330304 - RNA, 15 nt, Mycobacterium tuberculosis H37Rv
gcccggcggccgcuu

SEQ ID NO: 1330305 - RNA, 17 nt, Mycobacterium tuberculosis H37Rv
gcccggcggccgcuucg

SEQ ID NO: 1330306 - RNA, 14 nt, Mycobacterium tuberculosis H37Rv
gcccggcggcccga

SEQ ID NO: 1330307 - RNA, 19 nt, Mycobacterium tuberculosis H37Rv
gcccggcggaucccgaggc

SEQ ID NO: 1330308 - RNA, 22 nt, Mycobacterium tuberculosis H37Rv
gcccggcgcuagcgccgcgcuu

SEQ ID NO: 1330309 - RNA, 16 nt, Mycobacterium tuberculosis H37Rv
gcccggcuacgacggc

SEQ ID NO: 1330310 - RNA, 20 nt, Mycobacterium tuberculosis H37Rv
gcccgggccgaagcgcgcgc

SEQ ID NO: 1330311 - RNA, 23 nt, Mycobacterium tuberculosis H37Rv
gcccgggcagccccuccgcgccg

SEQ ID NO: 1330312 - RNA, 12 nt, Mycobacterium tuberculosis H37Rv
gcccgggcaccg

SEQ ID NO: 1330313 - RNA, 22 nt, Mycobacterium tuberculosis H37Rv
gcccggcuuuugcgcccagcac

SEQ ID NO: 1330314 - RNA, 15 nt, Mycobacterium tuberculosis H37Rv
gcccgcugagccagc

SEQ ID NO: 1330315 - RNA, 13 nt, Mycobacterium tuberculosis H37Rv
gcccgcugcgcgg

SEQ ID NO: 1330316 - RNA, 16 nt, Mycobacterium tuberculosis H37Rv
gcccgcugcgcggccc

SEQ ID NO: 1330317 - RNA, 18 nt, Mycobacterium tuberculosis H37Rv
gcccgcuggccuccugga

SEQ ID NO: 1330318 - RNA, 16 nt, Mycobacterium tuberculosis H37Rv
gcccgcugggcucgcu

SEQ ID NO: 1330319 - RNA, 15 nt, Mycobacterium tuberculosis H37Rv
gcccgcucaccuugg

SEQ ID NO: 1330320 - RNA, 21 nt, Mycobacterium tuberculosis H37Rv
gcccgcucggccgcagccagc

SEQ ID NO: 1330321 - RNA, 19 nt, Mycobacterium tuberculosis H37Rv
gcccgcucggagaucgcca

SEQ ID NO: 1330322 - RNA, 14 nt, Mycobacterium tuberculosis H37Rv
gcccgcuccgcggc

SEQ ID NO: 1330323 - RNA, 14 nt, Mycobacterium tuberculosis H37Rv
gcccgcucccugca

SEQ ID NO: 1330324 - RNA, 22 nt, Mycobacterium tuberculosis H37Rv
gcccgcuccgccgucgccgccg

SEQ ID NO: 1330325 - RNA, 17 nt, Mycobacterium tuberculosis H37Rv
gcccgcuccgggaccca

SEQ ID NO: 1330326 - RNA, 17 nt, Mycobacterium tuberculosis H37Rv
gcccggacgauggcguc

SEQ ID NO: 1330327 - RNA, 18 nt, Mycobacterium tuberculosis H37Rv
gcccggacgcaacacccg

SEQ ID NO: 1330328 - RNA, 14 nt, Mycobacterium tuberculosis H37Rv
gcccggacaugcgg

SEQ ID NO: 1330329 - RNA, 18 nt, Mycobacterium tuberculosis H37Rv
gcccggaaccggcgugca

SEQ ID NO: 1330330 - RNA, 13 nt, Mycobacterium tuberculosis H37Rv
gcccggacaggcu

SEQ ID NO: 1330331 - RNA, 17 nt, Mycobacterium tuberculosis H37Rv
gcccggaaaggccgcgg

SEQ ID NO: 1330332 - RNA, 19 nt, Mycobacterium tuberculosis H37Rv
gcccgcugggcuuggggcc

SEQ ID NO: 1330333 - RNA, 18 nt, Mycobacterium tuberculosis H37Rv
gcccgcugggcucgcugc

SEQ ID NO: 1330334 - RNA, 11 nt, Mycobacterium tuberculosis H37Rv
gcccgcuggcc

SEQ ID NO: 1330335 - RNA, 18 nt, Mycobacterium tuberculosis H37Rv
gcccgcgccgccgcuacc

SEQ ID NO: 1330336 - RNA, 14 nt, Mycobacterium tuberculosis H37Rv
gcccgcgcggcggu

SEQ ID NO: 1330337 - RNA, 23 nt, Mycobacterium tuberculosis H37Rv
gcccgcgccaccagcaccgccgc

SEQ ID NO: 1330338 - RNA, 18 nt, Mycobacterium tuberculosis H37Rv
gcccgcgccgccgccacc

SEQ ID NO: 1330339 - RNA, 18 nt, Mycobacterium tuberculosis H37Rv
gcccgcgccaccagcacc

SEQ ID NO: 1330340 - RNA, 21 nt, Mycobacterium tuberculosis H37Rv
gcccgcgcagcgguccgccgc

SEQ ID NO: 1330341 - RNA, 15 nt, Mycobacterium tuberculosis H37Rv
gcccgcgaggacagc

SEQ ID NO: 1330342 - RNA, 16 nt, Mycobacterium tuberculosis H37Rv
gcccgcgaucgggccg

SEQ ID NO: 1330343 - RNA, 19 nt, Mycobacterium tuberculosis H37Rv
gcccgcguuugcgaagccc

SEQ ID NO: 1330344 - RNA, 21 nt, Mycobacterium tuberculosis H37Rv
gcccgcguuugcgaagcccac

SEQ ID NO: 1330345 - RNA, 21 nt, Mycobacterium tuberculosis H37Rv
gcccgcguugccaaagcccac

SEQ ID NO: 1330346 - RNA, 18 nt, Mycobacterium tuberculosis H37Rv
gcccgcguugccaaagcc

SEQ ID NO: 1330347 - RNA, 13 nt, Mycobacterium tuberculosis H37Rv
gcccgcguucucg

SEQ ID NO: 1330348 - RNA, 18 nt, Mycobacterium tuberculosis H37Rv
gcccgcguucagggcacg

SEQ ID NO: 1330349 - RNA, 20 nt, Mycobacterium tuberculosis H37Rv
gcccgcguucagggcacgcu

SEQ ID NO: 1330350 - RNA, 20 nt, Mycobacterium tuberculosis H37Rv
gcccgcgugacgcuuggcca

SEQ ID NO: 1330351 - RNA, 17 nt, Mycobacterium tuberculosis H37Rv
gcccgcgggcgguaauc

SEQ ID NO: 1330352 - RNA, 13 nt, Mycobacterium tuberculosis H37Rv
gcccgaggcgaga

SEQ ID NO: 1330353 - RNA, 17 nt, Mycobacterium tuberculosis H37Rv
gcccgaggcucgggccg

SEQ ID NO: 1330354 - RNA, 16 nt, Mycobacterium tuberculosis H37Rv
gcccgagcccagcgcc

SEQ ID NO: 1330355 - RNA, 17 nt, Mycobacterium tuberculosis H37Rv
gcccgagaucgcgugcg

SEQ ID NO: 1330356 - RNA, 16 nt, Mycobacterium tuberculosis H37Rv
gcccgacugccguuca

SEQ ID NO: 1330357 - RNA, 14 nt, Mycobacterium tuberculosis H37Rv
gcccgagcccagcc

SEQ ID NO: 1330358 - RNA, 16 nt, Mycobacterium tuberculosis H37Rv
gcccgaguuguuggug

SEQ ID NO: 1330359 - RNA, 16 nt, Mycobacterium tuberculosis H37Rv
gcccgaguugaagaag

SEQ ID NO: 1330360 - RNA, 22 nt, Mycobacterium tuberculosis H37Rv
gcccgaguuguucgugccggcg

SEQ ID NO: 1330361 - RNA, 19 nt, Mycobacterium tuberculosis H37Rv
gcccgaguuaaacgcagcg

SEQ ID NO: 1330362 - RNA, 12 nt, Mycobacterium tuberculosis H37Rv
gcccgaguugaa

SEQ ID NO: 1330363 - RNA, 17 nt, Mycobacterium tuberculosis H37Rv
gcccgaucaccagcccc

SEQ ID NO: 1330364 - RNA, 14 nt, Mycobacterium tuberculosis H37Rv
gcccgauagaucgc

SEQ ID NO: 1330365 - RNA, 24 nt, Mycobacterium tuberculosis H37Rv
gcccgaugaggacauccggcgccg

SEQ ID NO: 1330366 - RNA, 20 nt, Mycobacterium tuberculosis H37Rv
gcccgagcgcuugaccccgc

SEQ ID NO: 1330367 - RNA, 14 nt, Mycobacterium tuberculosis H37Rv
gcccgcccagcccg

SEQ ID NO: 1330368 - RNA, 14 nt, Mycobacterium tuberculosis H37Rv
gcccgaucgcuucc

SEQ ID NO: 1330369 - RNA, 14 nt, Mycobacterium tuberculosis H37Rv
gcccgccgccacca

SEQ ID NO: 1330370 - RNA, 19 nt, Mycobacterium tuberculosis H37Rv
gcccgccgaccugguaugc

SEQ ID NO: 1330371 - RNA, 16 nt, Mycobacterium tuberculosis H37Rv
gcccgccccgcgccuu

SEQ ID NO: 1330372 - RNA, 16 nt, Mycobacterium tuberculosis H37Rv
gcccgcccagcccggc

SEQ ID NO: 1330373 - RNA, 21 nt, Mycobacterium tuberculosis H37Rv
gcccgcgaacgaucccgccga

SEQ ID NO: 1330374 - RNA, 18 nt, Mycobacterium tuberculosis H37Rv
gcccgccgccaccagcug

SEQ ID NO: 1330375 - RNA, 18 nt, Mycobacterium tuberculosis H37Rv
gccccgggggaagcgcca

SEQ ID NO: 1330376 - RNA, 19 nt, Mycobacterium tuberculosis H37Rv
gccccuucaaagcggccuc

SEQ ID NO: 1330377 - RNA, 20 nt, Mycobacterium tuberculosis H37Rv
gccccguccgauuucccagc

SEQ ID NO: 1330378 - RNA, 16 nt, Mycobacterium tuberculosis H37Rv
gccccgguggcaggga

SEQ ID NO: 1330379 - RNA, 16 nt, Mycobacterium tuberculosis H37Rv
gcccgaagccgggccc

SEQ ID NO: 1330380 - RNA, 22 nt, Mycobacterium tuberculosis H37Rv
gcccgaagacggggugguggug

SEQ ID NO: 1330381 - RNA, 14 nt, Mycobacterium tuberculosis H37Rv
gcccgaacuucugg

SEQ ID NO: 1330382 - RNA, 14 nt, Mycobacterium tuberculosis H37Rv
gcccgacgagauug

SEQ ID NO: 1330383 - RNA, 22 nt, Mycobacterium tuberculosis H37Rv
gcccgacgagauugccgggccg

SEQ ID NO: 1330384 - RNA, 20 nt, Mycobacterium tuberculosis H37Rv
gcccgacgcguggcauccag

SEQ ID NO: 1330385 - RNA, 21 nt, Mycobacterium tuberculosis H37Rv
gcccgacugccguucagcggc

SEQ ID NO: 1330386 - RNA, 19 nt, Mycobacterium tuberculosis H37Rv
gcccgacggcgcccagcgc

SEQ ID NO: 1330387 - RNA, 18 nt, Mycobacterium tuberculosis H37Rv
gccccgccuuggccacca

SEQ ID NO: 1330388 - RNA, 16 nt, Mycobacterium tuberculosis H37Rv
gccccgccgucacccc

SEQ ID NO: 1330389 - RNA, 20 nt, Mycobacterium tuberculosis H37Rv
gccccggcauugcccgagcc

SEQ ID NO: 1330390 - RNA, 15 nt, Mycobacterium tuberculosis H37Rv
gccccggccaggaca

SEQ ID NO: 1330391 - RNA, 14 nt, Mycobacterium tuberculosis H37Rv
gccccggcgcuggu

SEQ ID NO: 1330392 - RNA, 18 nt, Mycobacterium tuberculosis H37Rv
gccccgggcggugaggca

SEQ ID NO: 1330393 - RNA, 15 nt, Mycobacterium tuberculosis H37Rv
gccccggcucucuuc

SEQ ID NO: 1330394 - RNA, 14 nt, Mycobacterium tuberculosis H37Rv
gccccgggccacca

SEQ ID NO: 1330395 - RNA, 19 nt, Mycobacterium tuberculosis H37Rv
gccccgggccaccaguugu

SEQ ID NO: 1330396 - RNA, 14 nt, Mycobacterium tuberculosis H37Rv
gccccggcggcggc

SEQ ID NO: 1330397 - RNA, 14 nt, Mycobacterium tuberculosis H37Rv
gccccggcgcggcc

SEQ ID NO: 1330398 - RNA, 15 nt, Mycobacterium tuberculosis H37Rv
gccccggcgcggcca

SEQ ID NO: 1330399 - RNA, 21 nt, Mycobacterium tuberculosis H37Rv
gccccggccuuuacccgggcg

SEQ ID NO: 1330400 - RNA, 14 nt, Mycobacterium tuberculosis H37Rv
gccccgccagcgcc

SEQ ID NO: 1330401 - RNA, 21 nt, Mycobacterium tuberculosis H37Rv
gcccccguucuggaaccccga

SEQ ID NO: 1330402 - RNA, 16 nt, Mycobacterium tuberculosis H37Rv
gcccccguugccgccc

SEQ ID NO: 1330403 - RNA, 23 nt, Mycobacterium tuberculosis H37Rv
gcccccuggauggcgcccugcgc

SEQ ID NO: 1330404 - RNA, 15 nt, Mycobacterium tuberculosis H37Rv
gccccgccggggccg

SEQ ID NO: 1330405 - RNA, 19 nt, Mycobacterium tuberculosis H37Rv
gccccgccggggccgccgu

SEQ ID NO: 1330406 - RNA, 13 nt, Mycobacterium tuberculosis H37Rv
gccccgccggccc

SEQ ID NO: 1330407 - RNA, 16 nt, Mycobacterium tuberculosis H37Rv
gccccgccggccccgc

SEQ ID NO: 1330408 - RNA, 14 nt, Mycobacterium tuberculosis H37Rv
gccccgccgcacgc

SEQ ID NO: 1330409 - RNA, 14 nt, Mycobacterium tuberculosis H37Rv
gccccgccgcccuc

SEQ ID NO: 1330410 - RNA, 11 nt, Mycobacterium tuberculosis H37Rv
gccccgcccgg

SEQ ID NO: 1330411 - RNA, 22 nt, Mycobacterium tuberculosis H37Rv
gcccauucauaggcccgcacga

SEQ ID NO: 1330412 - RNA, 22 nt, Mycobacterium tuberculosis H37Rv
gcccauucccagaggcccgcgg

SEQ ID NO: 1330413 - RNA, 17 nt, Mycobacterium tuberculosis H37Rv
gccccaucgcuggucga

SEQ ID NO: 1330414 - RNA, 15 nt, Mycobacterium tuberculosis H37Rv
gcccauuggccaggu

SEQ ID NO: 1330415 - RNA, 19 nt, Mycobacterium tuberculosis H37Rv
gcccauuggguaaccagcg

SEQ ID NO: 1330416 - RNA, 21 nt, Mycobacterium tuberculosis H37Rv
gcccauuggguaaccagcgcc

SEQ ID NO: 1330417 - RNA, 23 nt, Mycobacterium tuberculosis H37Rv
gcccauugucgaucaccugcagc

SEQ ID NO: 1330418 - RNA, 19 nt, Mycobacterium tuberculosis H37Rv
gcccaugguggcgaucugg

SEQ ID NO: 1330419 - RNA, 23 nt, Mycobacterium tuberculosis H37Rv
gcccccaacgcgguaaagccccg

SEQ ID NO: 1330420 - RNA, 22 nt, Mycobacterium tuberculosis H37Rv
gcccccaacgcgguaaagcccc

SEQ ID NO: 1330421 - RNA, 16 nt, Mycobacterium tuberculosis H37Rv
gccccauugcgggagc

SEQ ID NO: 1330422 - RNA, 17 nt, Mycobacterium tuberculosis H37Rv
gccccaugcaacacacc

SEQ ID NO: 1330423 - RNA, 23 nt, Mycobacterium tuberculosis H37Rv
gcccccgccggccgcgccggccc

SEQ ID NO: 1330424 - RNA, 14 nt, Mycobacterium tuberculosis H37Rv
gcccccgccggccg

SEQ ID NO: 1330425 - RNA, 15 nt, Mycobacterium tuberculosis H37Rv
gcccccgccggccgc

SEQ ID NO: 1330426 - RNA, 15 nt, Mycobacterium tuberculosis H37Rv
gcccccggcgcggcg

SEQ ID NO: 1330427 - RNA, 14 nt, Mycobacterium tuberculosis H37Rv
gcccccggcgcggc

SEQ ID NO: 1330428 - RNA, 15 nt, Mycobacterium tuberculosis H37Rv
gcccccguuaccgcc

SEQ ID NO: 1330429 - RNA, 21 nt, Mycobacterium tuberculosis H37Rv
gcccccguuaccgccgucgcc

SEQ ID NO: 1330430 - RNA, 18 nt, Mycobacterium tuberculosis H37Rv
gcccacguuuagggugcc

SEQ ID NO: 1330431 - RNA, 18 nt, Mycobacterium tuberculosis H37Rv
gcccacguggggccgggg

SEQ ID NO: 1330432 - RNA, 16 nt, Mycobacterium tuberculosis H37Rv
gcccacguuggccccg

SEQ ID NO: 1330433 - RNA, 20 nt, Mycobacterium tuberculosis H37Rv
gcccacggagggcaggagaa

SEQ ID NO: 1330434 - RNA, 16 nt, Mycobacterium tuberculosis H37Rv
gcccacggcaccacca

SEQ ID NO: 1330435 - RNA, 17 nt, Mycobacterium tuberculosis H37Rv
gcccagaaaaccgccgc

SEQ ID NO: 1330436 - RNA, 16 nt, Mycobacterium tuberculosis H37Rv
gcccacuccagcagcu

SEQ ID NO: 1330437 - RNA, 23 nt, Mycobacterium tuberculosis H37Rv
gcccacuagcagggggacccgga

SEQ ID NO: 1330438 - RNA, 17 nt, Mycobacterium tuberculosis H37Rv
gcccaccggugccgccc

SEQ ID NO: 1330439 - RNA, 18 nt, Mycobacterium tuberculosis H37Rv
gcccaccggucgccgcga

SEQ ID NO: 1330440 - RNA, 18 nt, Mycobacterium tuberculosis H37Rv
gcccaccgggcggcggcg

SEQ ID NO: 1330441 - RNA, 23 nt, Mycobacterium tuberculosis H37Rv
gcccaccucaccgaucucgacca

SEQ ID NO: 1330442 - RNA, 15 nt, Mycobacterium tuberculosis H37Rv
gcccaccgucugcug

SEQ ID NO: 1330443 - RNA, 17 nt, Mycobacterium tuberculosis H37Rv
gcccaccuccugguuga

SEQ ID NO: 1330444 - RNA, 19 nt, Mycobacterium tuberculosis H37Rv
gcccaccucgaucgcgccg

SEQ ID NO: 1330445 - RNA, 15 nt, Mycobacterium tuberculosis H37Rv
gcccaccuggggccg

SEQ ID NO: 1330446 - RNA, 22 nt, Mycobacterium tuberculosis H37Rv
gcccacgcgcacucgaccagga

SEQ ID NO: 1330447 - RNA, 13 nt, Mycobacterium tuberculosis H37Rv
gcccacgcugccc

SEQ ID NO: 1330448 - RNA, 12 nt, Mycobacterium tuberculosis H37Rv
gcccaccgcaac

SEQ ID NO: 1330449 - RNA, 15 nt, Mycobacterium tuberculosis H37Rv
gcccaccgacccaga

SEQ ID NO: 1330450 - RNA, 17 nt, Mycobacterium tuberculosis H37Rv
gcccaccggcuagcugu

SEQ ID NO: 1330451 - RNA, 13 nt, Mycobacterium tuberculosis H37Rv
gcccaccaugauc

SEQ ID NO: 1330452 - RNA, 16 nt, Mycobacterium tuberculosis H37Rv
gcccacccgggugggc

SEQ ID NO: 1330453 - RNA, 15 nt, Mycobacterium tuberculosis H37Rv
gcccaccagcgcagc

SEQ ID NO: 1330454 - RNA, 20 nt, Mycobacterium tuberculosis H37Rv
gcccacaggggcagcgcggc

SEQ ID NO: 1330455 - RNA, 21 nt, Mycobacterium tuberculosis H37Rv
gcccacaggggcagcgcggcc

SEQ ID NO: 1330456 - RNA, 19 nt, Mycobacterium tuberculosis H37Rv
gcccacaggggcagcgcgg

SEQ ID NO: 1330457 - RNA, 15 nt, Mycobacterium tuberculosis H37Rv
gcccacaggggcagc

SEQ ID NO: 1330458 - RNA, 23 nt, Mycobacterium tuberculosis H37Rv
gcccacaucgucggcgggcggca

SEQ ID NO: 1330459 - RNA, 23 nt, Mycobacterium tuberculosis H37Rv
gcccacaugaacgaccaccgcug

SEQ ID NO: 1330460 - RNA, 16 nt, Mycobacterium tuberculosis H37Rv
gcccacaggcggcgcu

SEQ ID NO: 1330461 - RNA, 15 nt, Mycobacterium tuberculosis H37Rv
gcccacacggucguc

SEQ ID NO: 1330462 - RNA, 21 nt, Mycobacterium tuberculosis H37Rv
gcccacacggucgucgcgagc

SEQ ID NO: 1330463 - RNA, 23 nt, Mycobacterium tuberculosis H37Rv
gcccaccacugugacacccgagg

SEQ ID NO: 1330464 - RNA, 20 nt, Mycobacterium tuberculosis H37Rv
gcccacaugcucagggcagu

SEQ ID NO: 1330465 - RNA, 21 nt, Mycobacterium tuberculosis H37Rv
gcccaccacgaacacguucgg

SEQ ID NO: 1330466 - RNA, 21 nt, Mycobacterium tuberculosis H37Rv
gcccaccaccacugcggccgc

SEQ ID NO: 1330467 - RNA, 15 nt, Mycobacterium tuberculosis H37Rv
gcccacaugcucagg

SEQ ID NO: 1330468 - RNA, 18 nt, Mycobacterium tuberculosis H37Rv
gcccagguguguggcggc

SEQ ID NO: 1330469 - RNA, 22 nt, Mycobacterium tuberculosis H37Rv
gcccagguugauccagugcugg

SEQ ID NO: 1330470 - RNA, 22 nt, Mycobacterium tuberculosis H37Rv
gcccauaccgaugguggugcca

SEQ ID NO: 1330471 - RNA, 22 nt, Mycobacterium tuberculosis H37Rv
gcccaggugggccgagagcagc

SEQ ID NO: 1330472 - RNA, 18 nt, Mycobacterium tuberculosis H37Rv
gcccauacgugccgccga

SEQ ID NO: 1330473 - RNA, 22 nt, Mycobacterium tuberculosis H37Rv
gcccagcagguuccacggccag

SEQ ID NO: 1330474 - RNA, 19 nt, Mycobacterium tuberculosis H37Rv
gcccagcagguuccacggc

SEQ ID NO: 1330475 - RNA, 20 nt, Mycobacterium tuberculosis H37Rv
gcccagacaauugcagcgac

SEQ ID NO: 1330476 - RNA, 21 nt, Mycobacterium tuberculosis H37Rv
gcccagccacugacggcuucc

SEQ ID NO: 1330477 - RNA, 23 nt, Mycobacterium tuberculosis H37Rv
gcccagcguugucggguggcugc

SEQ ID NO: 1330478 - RNA, 16 nt, Mycobacterium tuberculosis H37Rv
gcccagcguggcuggc

SEQ ID NO: 1330479 - RNA, 18 nt, Mycobacterium tuberculosis H37Rv
gcccagcucgucgagcug

SEQ ID NO: 1330480 - RNA, 22 nt, Mycobacterium tuberculosis H37Rv
gcccaggcguccaucagagaca

SEQ ID NO: 1330481 - RNA, 19 nt, Mycobacterium tuberculosis H37Rv
gccauguugcccugcaacc

SEQ ID NO: 1330482 - RNA, 20 nt, Mycobacterium tuberculosis H37Rv
gccaugcucgucuugggccg

SEQ ID NO: 1330483 - RNA, 15 nt, Mycobacterium tuberculosis H37Rv
gccaugcggaaagcc

SEQ ID NO: 1330484 - RNA, 16 nt, Mycobacterium tuberculosis H37Rv
gccauuagcagcaccc

SEQ ID NO: 1330485 - RNA, 17 nt, Mycobacterium tuberculosis H37Rv
gccaucugcuggcuggg

SEQ ID NO: 1330486 - RNA, 19 nt, Mycobacterium tuberculosis H37Rv
gccaugcgcaccaguccag

SEQ ID NO: 1330487 - RNA, 20 nt, Mycobacterium tuberculosis H37Rv
gccaugcgcaccaguccagc

SEQ ID NO: 1330488 - RNA, 20 nt, Mycobacterium tuberculosis H37Rv
gccaugcuaggaccaccagc

SEQ ID NO: 1330489 - RNA, 16 nt, Mycobacterium tuberculosis H37Rv
gcccaacucggccagc

SEQ ID NO: 1330490 - RNA, 17 nt, Mycobacterium tuberculosis H37Rv
gcccaacgucgccaggu

SEQ ID NO: 1330491 - RNA, 17 nt, Mycobacterium tuberculosis H37Rv
gcccaacucggccagcu

SEQ ID NO: 1330492 - RNA, 17 nt, Mycobacterium tuberculosis H37Rv
gcccaauugcgccgagc

SEQ ID NO: 1330493 - RNA, 15 nt, Mycobacterium tuberculosis H37Rv
gcccacaccagcgca

SEQ ID NO: 1330494 - RNA, 21 nt, Mycobacterium tuberculosis H37Rv
gcccacaccagcgcagcauug

SEQ ID NO: 1330495 - RNA, 19 nt, Mycobacterium tuberculosis H37Rv
gcccacacgcucacgggcu

SEQ ID NO: 1330496 - RNA, 19 nt, Mycobacterium tuberculosis H37Rv
gcccacaaugacucggccg

SEQ ID NO: 1330497 - RNA, 13 nt, Mycobacterium tuberculosis H37Rv
gcccaacgcgagc

SEQ ID NO: 1330498 - RNA, 23 nt, Mycobacterium tuberculosis H37Rv
gcccaacaggcgggacaaccggg

SEQ ID NO: 1330499 - RNA, 16 nt, Mycobacterium tuberculosis H37Rv
gcccaacaccgccaga

SEQ ID NO: 1330500 - RNA, 17 nt, Mycobacterium tuberculosis H37Rv
gccauuggcgccgccga

SEQ ID NO: 1330501 - RNA, 12 nt, Mycobacterium tuberculosis H37Rv
gccauugccgcc

SEQ ID NO: 1330502 - RNA, 19 nt, Mycobacterium tuberculosis H37Rv
gccaggcgauugcccgcgc

SEQ ID NO: 1330503 - RNA, 22 nt, Mycobacterium tuberculosis H37Rv
gccaggcggcaaggacggagcc

SEQ ID NO: 1330504 - RNA, 20 nt, Mycobacterium tuberculosis H37Rv
gccaggcggcaauucgggca

SEQ ID NO: 1330505 - RNA, 20 nt, Mycobacterium tuberculosis H37Rv
gccauauugauuccgacccc

SEQ ID NO: 1330506 - RNA, 14 nt, Mycobacterium tuberculosis H37Rv
gccaucgagcagca

SEQ ID NO: 1330507 - RNA, 15 nt, Mycobacterium tuberculosis H37Rv
gccaucgagcagcag

SEQ ID NO: 1330508 - RNA, 22 nt, Mycobacterium tuberculosis H37Rv
gccauccucgaguuuggccagu

SEQ ID NO: 1330509 - RNA, 22 nt, Mycobacterium tuberculosis H37Rv
gccaucgaccguccgggucacc

SEQ ID NO: 1330510 - RNA, 21 nt, Mycobacterium tuberculosis H37Rv
gccaucgccaugauggacagc

SEQ ID NO: 1330511 - RNA, 22 nt, Mycobacterium tuberculosis H37Rv
gccaucugauccggugucgcga

SEQ ID NO: 1330512 - RNA, 13 nt, Mycobacterium tuberculosis H37Rv
gccaucugccugc

SEQ ID NO: 1330513 - RNA, 17 nt, Mycobacterium tuberculosis H37Rv
gccaucagcccuucagc

SEQ ID NO: 1330514 - RNA, 19 nt, Mycobacterium tuberculosis H37Rv
gccaucagcccggcgcgcc

SEQ ID NO: 1330515 - RNA, 17 nt, Mycobacterium tuberculosis H37Rv
gccgagcuucagcgcgc

SEQ ID NO: 1330516 - RNA, 17 nt, Mycobacterium tuberculosis H37Rv
gccgagcugugcgcaga

SEQ ID NO: 1330517 - RNA, 13 nt, Mycobacterium tuberculosis H37Rv
gccgagcuugagc

SEQ ID NO: 1330518 - RNA, 18 nt, Mycobacterium tuberculosis H37Rv
gccgagcuugucgagcag

SEQ ID NO: 1330519 - RNA, 19 nt, Mycobacterium tuberculosis H37Rv
gccgagcuugucgagcagg

SEQ ID NO: 1330520 - RNA, 23 nt, Mycobacterium tuberculosis H37Rv
gccgaggacuggaaagcagcagc

SEQ ID NO: 1330521 - RNA, 15 nt, Mycobacterium tuberculosis H37Rv
gccgaggacgccggc

SEQ ID NO: 1330522 - RNA, 20 nt, Mycobacterium tuberculosis H37Rv
gccgaggcaaccgacacugg

SEQ ID NO: 1330523 - RNA, 11 nt, Mycobacterium tuberculosis H37Rv
gccgagcgcgc

SEQ ID NO: 1330524 - RNA, 13 nt, Mycobacterium tuberculosis H37Rv
gccgaggccgccg

SEQ ID NO: 1330525 - RNA, 18 nt, Mycobacterium tuberculosis H37Rv
gccgaggccgcugccagg

SEQ ID NO: 1330526 - RNA, 15 nt, Mycobacterium tuberculosis H37Rv
gccgaguugcccggg

SEQ ID NO: 1330527 - RNA, 15 nt, Mycobacterium tuberculosis H37Rv
gccgauagcgcggca

SEQ ID NO: 1330528 - RNA, 15 nt, Mycobacterium tuberculosis H37Rv
gccgauaccggcggc

SEQ ID NO: 1330529 - RNA, 15 nt, Mycobacterium tuberculosis H37Rv
gccgauaccgccggc

SEQ ID NO: 1330530 - RNA, 17 nt, Mycobacterium tuberculosis H37Rv
gccgaucggccugcagc

SEQ ID NO: 1330531 - RNA, 16 nt, Mycobacterium tuberculosis H37Rv
gccgaucggccacagu

SEQ ID NO: 1330532 - RNA, 13 nt, Mycobacterium tuberculosis H37Rv
gccgaucgcccgc

SEQ ID NO: 1330533 - RNA, 16 nt, Mycobacterium tuberculosis H37Rv
gccgauaucugccacg

SEQ ID NO: 1330534 - RNA, 15 nt, Mycobacterium tuberculosis H37Rv
gccgauaucugccac

SEQ ID NO: 1330535 - RNA, 17 nt, Mycobacterium tuberculosis H37Rv
gccgaucccgugguggc

SEQ ID NO: 1330536 - RNA, 19 nt, Mycobacterium tuberculosis H37Rv
gccgaucgaaccgcugcuc

SEQ ID NO: 1330537 - RNA, 21 nt, Mycobacterium tuberculosis H37Rv
gccgagauccacgccagagcg

SEQ ID NO: 1330538 - RNA, 18 nt, Mycobacterium tuberculosis H37Rv
gccgagaagugggcggua

SEQ ID NO: 1330539 - RNA, 17 nt, Mycobacterium tuberculosis H37Rv
gccgagaccgccgcugc

SEQ ID NO: 1330540 - RNA, 19 nt, Mycobacterium tuberculosis H37Rv
gccgagaccgccgcugccg

SEQ ID NO: 1330541 - RNA, 16 nt, Mycobacterium tuberculosis H37Rv
gccgagagcagccagc

SEQ ID NO: 1330542 - RNA, 16 nt, Mycobacterium tuberculosis H37Rv
gccgagcagacgcaga

SEQ ID NO: 1330543 - RNA, 16 nt, Mycobacterium tuberculosis H37Rv
gccgagcagacgcgga

SEQ ID NO: 1330544 - RNA, 13 nt, Mycobacterium tuberculosis H37Rv
gccgagcaggucg

SEQ ID NO: 1330545 - RNA, 16 nt, Mycobacterium tuberculosis H37Rv
gccgagcaggucggca

SEQ ID NO: 1330546 - RNA, 23 nt, Mycobacterium tuberculosis H37Rv
gccgagcaaacauccacccgcgg

SEQ ID NO: 1330547 - RNA, 22 nt, Mycobacterium tuberculosis H37Rv
gccgagcacgccgagcccgccg

SEQ ID NO: 1330548 - RNA, 22 nt, Mycobacterium tuberculosis H37Rv
gccgagccgauauaccagggca

SEQ ID NO: 1330549 - RNA, 17 nt, Mycobacterium tuberculosis H37Rv
gccgagcgaccguccca

SEQ ID NO: 1330550 - RNA, 22 nt, Mycobacterium tuberculosis H37Rv
gccgagcgcacuggggaggcca

SEQ ID NO: 1330551 - RNA, 13 nt, Mycobacterium tuberculosis H37Rv
gccgagcgcccgc

SEQ ID NO: 1330552 - RNA, 22 nt, Mycobacterium tuberculosis H37Rv
gccgagcagguuccgcacgauc

SEQ ID NO: 1330553 - RNA, 17 nt, Mycobacterium tuberculosis H37Rv
gccgagccagcacccgc

SEQ ID NO: 1330554 - RNA, 18 nt, Mycobacterium tuberculosis H37Rv
gccgagcuggcgcgcggg

SEQ ID NO: 1330555 - RNA, 16 nt, Mycobacterium tuberculosis H37Rv
gccgagcuccuccacc

SEQ ID NO: 1330556 - RNA, 14 nt, Mycobacterium tuberculosis H37Rv
gccgagcgugcgcu

SEQ ID NO: 1330557 - RNA, 11 nt, Mycobacterium tuberculosis H37Rv
gccgagcgcga

SEQ ID NO: 1330558 - RNA, 13 nt, Mycobacterium tuberculosis H37Rv
gccgcacgggcga

SEQ ID NO: 1330559 - RNA, 23 nt, Mycobacterium tuberculosis H37Rv
gccgcaccgcuguugcaucgccg

SEQ ID NO: 1330560 - RNA, 19 nt, Mycobacterium tuberculosis H37Rv
gccgcaccggugcucgucg

SEQ ID NO: 1330561 - RNA, 22 nt, Mycobacterium tuberculosis H37Rv
gccgcacgccggcaugccagcc

SEQ ID NO: 1330562 - RNA, 18 nt, Mycobacterium tuberculosis H37Rv
gccgcacggucagcgcgc

SEQ ID NO: 1330563 - RNA, 15 nt, Mycobacterium tuberculosis H37Rv
gccgcacuuucuucc

SEQ ID NO: 1330564 - RNA, 21 nt, Mycobacterium tuberculosis H37Rv
gccgcagaaucccaacuccuc

SEQ ID NO: 1330565 - RNA, 22 nt, Mycobacterium tuberculosis H37Rv
gccgcagaaucccaacuccucc

SEQ ID NO: 1330566 - RNA, 13 nt, Mycobacterium tuberculosis H37Rv
gccgcaaccaugu

SEQ ID NO: 1330567 - RNA, 11 nt, Mycobacterium tuberculosis H37Rv
gccgcaaccau

SEQ ID NO: 1330568 - RNA, 19 nt, Mycobacterium tuberculosis H37Rv
gccgcaacaugggugaugc

SEQ ID NO: 1330569 - RNA, 16 nt, Mycobacterium tuberculosis H37Rv
gccgaucugcucgccg

SEQ ID NO: 1330570 - RNA, 22 nt, Mycobacterium tuberculosis H37Rv
gccgccacggaucgcggcggcg

SEQ ID NO: 1330571 - RNA, 16 nt, Mycobacterium tuberculosis H37Rv
gccgccacgggcggcc

SEQ ID NO: 1330572 - RNA, 21 nt, Mycobacterium tuberculosis H37Rv
gccgccacgguacauccagag

SEQ ID NO: 1330573 - RNA, 19 nt, Mycobacterium tuberculosis H37Rv
gccgccacggaucgcggcg

SEQ ID NO: 1330574 - RNA, 21 nt, Mycobacterium tuberculosis H37Rv
gccgccaccuuggcugggccc

SEQ ID NO: 1330575 - RNA, 19 nt, Mycobacterium tuberculosis H37Rv
gccgccaccggcgccgccg

SEQ ID NO: 1330576 - RNA, 15 nt, Mycobacterium tuberculosis H37Rv
gccgcaucgucgccg

SEQ ID NO: 1330577 - RNA, 14 nt, Mycobacterium tuberculosis H37Rv
gccgcaugcucagc

SEQ ID NO: 1330578 - RNA, 14 nt, Mycobacterium tuberculosis H37Rv
gccgcagccagcaa

SEQ ID NO: 1330579 - RNA, 12 nt, Mycobacterium tuberculosis H37Rv
gccgcagccugc

SEQ ID NO: 1330580 - RNA, 13 nt, Mycobacterium tuberculosis H37Rv
gccgcauaccagu

SEQ ID NO: 1330581 - RNA, 19 nt, Mycobacterium tuberculosis H37Rv
gccgcauaggccccgccag

SEQ ID NO: 1330582 - RNA, 24 nt, Mycobacterium tuberculosis H37Rv
gccgcagcgaaaacccggucggcg

SEQ ID NO: 1330583 - RNA, 14 nt, Mycobacterium tuberculosis H37Rv
gccgcagcggcggc

SEQ ID NO: 1330584 - RNA, 18 nt, Mycobacterium tuberculosis H37Rv
gccgaacagcgaaccgcc

SEQ ID NO: 1330585 - RNA, 18 nt, Mycobacterium tuberculosis H37Rv
gccgaacacgcacacgau

SEQ ID NO: 1330586 - RNA, 13 nt, Mycobacterium tuberculosis H37Rv
gccgaaauccaga

SEQ ID NO: 1330587 - RNA, 18 nt, Mycobacterium tuberculosis H37Rv
gccgaaagagccagcggc

SEQ ID NO: 1330588 - RNA, 17 nt, Mycobacterium tuberculosis H37Rv
gccgaaaucggccagcu

SEQ ID NO: 1330589 - RNA, 15 nt, Mycobacterium tuberculosis H37Rv
gccgaaagccaggcg

SEQ ID NO: 1330590 - RNA, 20 nt, Mycobacterium tuberculosis H37Rv
gcccuugccuccggcgccgc

SEQ ID NO: 1330591 - RNA, 15 nt, Mycobacterium tuberculosis H37Rv
gcccuugccgccuug

SEQ ID NO: 1330592 - RNA, 18 nt, Mycobacterium tuberculosis H37Rv
gcccuugccgccuuggcc

SEQ ID NO: 1330593 - RNA, 12 nt, Mycobacterium tuberculosis H37Rv
gcccuugccuug

SEQ ID NO: 1330594 - RNA, 15 nt, Mycobacterium tuberculosis H37Rv
gccgaaacauugccc

SEQ ID NO: 1330595 - RNA, 22 nt, Mycobacterium tuberculosis H37Rv
gccgaaacucaccagcaccccg

SEQ ID NO: 1330596 - RNA, 19 nt, Mycobacterium tuberculosis H37Rv
gccgaaacuucgcccgggc

SEQ ID NO: 1330597 - RNA, 14 nt, Mycobacterium tuberculosis H37Rv
gccgaaagccuugc

SEQ ID NO: 1330598 - RNA, 19 nt, Mycobacterium tuberculosis H37Rv
gcccuguccggcgccgagg

SEQ ID NO: 1330599 - RNA, 19 nt, Mycobacterium tuberculosis H37Rv
gcccugguccaggcccugg

SEQ ID NO: 1330600 - RNA, 17 nt, Mycobacterium tuberculosis H37Rv
gcccugguccaggcccu

SEQ ID NO: 1330601 - RNA, 18 nt, Mycobacterium tuberculosis H37Rv
gcccugguccaggcccug

SEQ ID NO: 1330602 - RNA, 17 nt, Mycobacterium tuberculosis H37Rv
gcccuggugugccgcgu

SEQ ID NO: 1330603 - RNA, 23 nt, Mycobacterium tuberculosis H37Rv
gcccuugccgccggccccgccgu

SEQ ID NO: 1330604 - RNA, 23 nt, Mycobacterium tuberculosis H37Rv
gcccuugccgccguugccgccgg

SEQ ID NO: 1330605 - RNA, 15 nt, Mycobacterium tuberculosis H37Rv
gcccuugccgccggc

SEQ ID NO: 1330606 - RNA, 20 nt, Mycobacterium tuberculosis H37Rv
gcccuugccgccagccccag

SEQ ID NO: 1330607 - RNA, 16 nt, Mycobacterium tuberculosis H37Rv
gcccuugccgccgagg

SEQ ID NO: 1330608 - RNA, 12 nt, Mycobacterium tuberculosis H37Rv
gcccuugccgcc

SEQ ID NO: 1330609 - RNA, 13 nt, Mycobacterium tuberculosis H37Rv
gcccuugaagaaa

SEQ ID NO: 1330610 - RNA, 21 nt, Mycobacterium tuberculosis H37Rv
gcccugcggccacgguggcgc

SEQ ID NO: 1330611 - RNA, 14 nt, Mycobacterium tuberculosis H37Rv
gcccugcggccacg

SEQ ID NO: 1330612 - RNA, 19 nt, Mycobacterium tuberculosis H37Rv
gcccugcgccucggcggcc

SEQ ID NO: 1330613 - RNA, 15 nt, Mycobacterium tuberculosis H37Rv
gcccugcgcagccgc

SEQ ID NO: 1330614 - RNA, 14 nt, Mycobacterium tuberculosis H37Rv
gcccugcgcagccg

SEQ ID NO: 1330615 - RNA, 19 nt, Mycobacterium tuberculosis H37Rv
gcccugcgccacacccggc

SEQ ID NO: 1330616 - RNA, 21 nt, Mycobacterium tuberculosis H37Rv
gcccugccgccggccccgccg

SEQ ID NO: 1330617 - RNA, 20 nt, Mycobacterium tuberculosis H37Rv
gcccugccgacgcuccaggg

SEQ ID NO: 1330618 - RNA, 16 nt, Mycobacterium tuberculosis H37Rv
gcccgggcugccgccc

SEQ ID NO: 1330619 - RNA, 18 nt, Mycobacterium tuberculosis H37Rv
gcccuggaauccaggagc

SEQ ID NO: 1330620 - RNA, 22 nt, Mycobacterium tuberculosis H37Rv
gcccuggggguggcagcgcggc

SEQ ID NO: 1330621 - RNA, 14 nt, Mycobacterium tuberculosis H37Rv
gcccugggugguuc

SEQ ID NO: 1330622 - RNA, 14 nt, Mycobacterium tuberculosis H37Rv
gcccugcuggccca

SEQ ID NO: 1330623 - RNA, 23 nt, Mycobacterium tuberculosis H37Rv
gcccugcuccucgcgggcggcgu

SEQ ID NO: 1330624 - RNA, 21 nt, Mycobacterium tuberculosis H37Rv
gccgaccggcccgcauccgca

SEQ ID NO: 1330625 - RNA, 23 nt, Mycobacterium tuberculosis H37Rv
gccgaccggcccgcauccgcacc

SEQ ID NO: 1330626 - RNA, 18 nt, Mycobacterium tuberculosis H37Rv
gccgaccgcgggucgugc

SEQ ID NO: 1330627 - RNA, 14 nt, Mycobacterium tuberculosis H37Rv
gccgaccagcgcgg

SEQ ID NO: 1330628 - RNA, 20 nt, Mycobacterium tuberculosis H37Rv
gccgaccaucucaccgggcc

SEQ ID NO: 1330629 - RNA, 23 nt, Mycobacterium tuberculosis H37Rv
gccgaccaucucaccgggcccga

SEQ ID NO: 1330630 - RNA, 12 nt, Mycobacterium tuberculosis H37Rv
gccgacccgcgc

SEQ ID NO: 1330631 - RNA, 19 nt, Mycobacterium tuberculosis H37Rv
gccgacccgccgcgcccgg

SEQ ID NO: 1330632 - RNA, 21 nt, Mycobacterium tuberculosis H37Rv
gccgacccgcccgaagaugcc

SEQ ID NO: 1330633 - RNA, 13 nt, Mycobacterium tuberculosis H37Rv
gccgacccgccgc

SEQ ID NO: 1330634 - RNA, 16 nt, Mycobacterium tuberculosis H37Rv
gccgaccaggaccacc

SEQ ID NO: 1330635 - RNA, 22 nt, Mycobacterium tuberculosis H37Rv
gccgaccaggccagagccgccc

SEQ ID NO: 1330636 - RNA, 17 nt, Mycobacterium tuberculosis H37Rv
gccgacuaucggccgcc

SEQ ID NO: 1330637 - RNA, 20 nt, Mycobacterium tuberculosis H37Rv
gccgacgugguugccccgca

SEQ ID NO: 1330638 - RNA, 16 nt, Mycobacterium tuberculosis H37Rv
gccgacuccccgccgg

SEQ ID NO: 1330639 - RNA, 20 nt, Mycobacterium tuberculosis H37Rv
gccgacucggcaccgcggcc

SEQ ID NO: 1330640 - RNA, 21 nt, Mycobacterium tuberculosis H37Rv
gccgacuuccgcgucgccggc

SEQ ID NO: 1330641 - RNA, 23 nt, Mycobacterium tuberculosis H37Rv
gccgacuuugagucguuggacgg

SEQ ID NO: 1330642 - RNA, 15 nt, Mycobacterium tuberculosis H37Rv
gccgacggugauggg

SEQ ID NO: 1330643 - RNA, 18 nt, Mycobacterium tuberculosis H37Rv
gccgacguauagaccagg

SEQ ID NO: 1330644 - RNA, 19 nt, Mycobacterium tuberculosis H37Rv
gccgacguauagaccaggu

SEQ ID NO: 1330645 - RNA, 17 nt, Mycobacterium tuberculosis H37Rv
gccgacgugacaacugc

SEQ ID NO: 1330646 - RNA, 20 nt, Mycobacterium tuberculosis H37Rv
gccgacgucgaccacugccc

SEQ ID NO: 1330647 - RNA, 22 nt, Mycobacterium tuberculosis H37Rv
gccgacgucgacgccggccagc

SEQ ID NO: 1330648 - RNA, 14 nt, Mycobacterium tuberculosis H37Rv
gccgacgucgccgg

SEQ ID NO: 1330649 - RNA, 21 nt, Mycobacterium tuberculosis H37Rv
gccgaccgggcucuggccagu

SEQ ID NO: 1330650 - RNA, 13 nt, Mycobacterium tuberculosis H37Rv
gccgaccggcggc

SEQ ID NO: 1330651 - RNA, 18 nt, Mycobacterium tuberculosis H37Rv
gccgaccgggcucuggcc

SEQ ID NO: 1330652 - RNA, 22 nt, Mycobacterium tuberculosis H37Rv
gccgaccguuucuccgccgccc

SEQ ID NO: 1330653 - RNA, 19 nt, Mycobacterium tuberculosis H37Rv
gccgaacaguucggcgagc

SEQ ID NO: 1330654 - RNA, 18 nt, Mycobacterium tuberculosis H37Rv
gccgaaccacgcgcccgc

SEQ ID NO: 1330655 - RNA, 16 nt, Mycobacterium tuberculosis H37Rv
gccgaaccggcaccag

SEQ ID NO: 1330656 - RNA, 17 nt, Mycobacterium tuberculosis H37Rv
gccgaaccugccgcagu

SEQ ID NO: 1330657 - RNA, 14 nt, Mycobacterium tuberculosis H37Rv
gccgaacccgccgu

SEQ ID NO: 1330658 - RNA, 18 nt, Mycobacterium tuberculosis H37Rv
gccgaacccgguguugag

SEQ ID NO: 1330659 - RNA, 15 nt, Mycobacterium tuberculosis H37Rv
gccgaacgguugcuc

SEQ ID NO: 1330660 - RNA, 16 nt, Mycobacterium tuberculosis H37Rv
gccgaacgugcaacca

SEQ ID NO: 1330661 - RNA, 16 nt, Mycobacterium tuberculosis H37Rv
gccgacaccgccacca

SEQ ID NO: 1330662 - RNA, 16 nt, Mycobacterium tuberculosis H37Rv
gccgaccaccagcauc

SEQ ID NO: 1330663 - RNA, 18 nt, Mycobacterium tuberculosis H37Rv
gccgacaaucaccaacgc

SEQ ID NO: 1330664 - RNA, 15 nt, Mycobacterium tuberculosis H37Rv
gccgacaccaccggc

SEQ ID NO: 1330665 - RNA, 19 nt, Mycobacterium tuberculosis H37Rv
gccgacaauggcagcgaga

SEQ ID NO: 1330666 - RNA, 19 nt, Mycobacterium tuberculosis H37Rv
gccgaccaccccgagcggc

SEQ ID NO: 1330667 - RNA, 15 nt, Mycobacterium tuberculosis H37Rv
gccgaccaccgccgg

SEQ ID NO: 1330668 - RNA, 23 nt, Mycobacterium tuberculosis H37Rv
gccgacaacgacgucgccgaccc

SEQ ID NO: 1330669 - RNA, 15 nt, Mycobacterium tuberculosis H37Rv
gccgacaagucaaga

SEQ ID NO: 1330670 - RNA, 12 nt, Mycobacterium tuberculosis H37Rv
gccgacaacccc

SEQ ID NO: 1330671 - RNA, 16 nt, Mycobacterium tuberculosis H37Rv
gccgacaaccccgcca

SEQ ID NO: 1330672 - RNA, 21 nt, Mycobacterium tuberculosis H37Rv
gccgacaacccggccgggccu

SEQ ID NO: 1330673 - RNA, 17 nt, Mycobacterium tuberculosis H37Rv
gccgcgggacaccaccg

SEQ ID NO: 1330674 - RNA, 23 nt, Mycobacterium tuberculosis H37Rv
gccgcgggacagauggcggccga

SEQ ID NO: 1330675 - RNA, 14 nt, Mycobacterium tuberculosis H37Rv
gccgcgggcgcggc

SEQ ID NO: 1330676 - RNA, 13 nt, Mycobacterium tuberculosis H37Rv
gccgcgggcgccg

SEQ ID NO: 1330677 - RNA, 14 nt, Mycobacterium tuberculosis H37Rv
gccgcggcggucug

SEQ ID NO: 1330678 - RNA, 17 nt, Mycobacterium tuberculosis H37Rv
gccgcgggugcggcaug

SEQ ID NO: 1330679 - RNA, 19 nt, Mycobacterium tuberculosis H37Rv
gccgcgguagacgccgccg

SEQ ID NO: 1330680 - RNA, 17 nt, Mycobacterium tuberculosis H37Rv
gccgcgggucccggccg

SEQ ID NO: 1330681 - RNA, 15 nt, Mycobacterium tuberculosis H37Rv
gccgcgggugcggca

SEQ ID NO: 1330682 - RNA, 15 nt, Mycobacterium tuberculosis H37Rv
gccgcgggucccggc

SEQ ID NO: 1330683 - RNA, 14 nt, Mycobacterium tuberculosis H37Rv
gccgcggggcaucg

SEQ ID NO: 1330684 - RNA, 17 nt, Mycobacterium tuberculosis H37Rv
gccgcggcggcagcggc

SEQ ID NO: 1330685 - RNA, 11 nt, Mycobacterium tuberculosis H37Rv
gccgcggcgga

SEQ ID NO: 1330686 - RNA, 13 nt, Mycobacterium tuberculosis H37Rv
gccgcggcggccc

SEQ ID NO: 1330687 - RNA, 15 nt, Mycobacterium tuberculosis H37Rv
gccgcggcgcccggc

SEQ ID NO: 1330688 - RNA, 16 nt, Mycobacterium tuberculosis H37Rv
gccgcggcgcccggcg

SEQ ID NO: 1330689 - RNA, 12 nt, Mycobacterium tuberculosis H37Rv
gccgcggcgcca

SEQ ID NO: 1330690 - RNA, 14 nt, Mycobacterium tuberculosis H37Rv
gccgcggccgccgu

SEQ ID NO: 1330691 - RNA, 19 nt, Mycobacterium tuberculosis H37Rv
gccgcgcuugcgaucgccg

SEQ ID NO: 1330692 - RNA, 13 nt, Mycobacterium tuberculosis H37Rv
gccgcggccgccg

SEQ ID NO: 1330693 - RNA, 21 nt, Mycobacterium tuberculosis H37Rv
gccgcgucgaacugggcgccc

SEQ ID NO: 1330694 - RNA, 23 nt, Mycobacterium tuberculosis H37Rv
gccgcgucgaacugggcgcccgc

SEQ ID NO: 1330695 - RNA, 20 nt, Mycobacterium tuberculosis H37Rv
gccgcgucgcgaaaggccac

SEQ ID NO: 1330696 - RNA, 20 nt, Mycobacterium tuberculosis H37Rv
gccgcguaaaccggcugacc

SEQ ID NO: 1330697 - RNA, 21 nt, Mycobacterium tuberculosis H37Rv
gccgcguagugcuccguccga

SEQ ID NO: 1330698 - RNA, 21 nt, Mycobacterium tuberculosis H37Rv
gccgcguaccaauucccgcgc

SEQ ID NO: 1330699 - RNA, 18 nt, Mycobacterium tuberculosis H37Rv
gccgcguagguggccagc

SEQ ID NO: 1330700 - RNA, 18 nt, Mycobacterium tuberculosis H37Rv
gccgcgguugugcugggu

SEQ ID NO: 1330701 - RNA, 22 nt, Mycobacterium tuberculosis H37Rv
gccgcggugagugaaucgcgga

SEQ ID NO: 1330702 - RNA, 18 nt, Mycobacterium tuberculosis H37Rv
gccgcggugccaaccgcg

SEQ ID NO: 1330703 - RNA, 21 nt, Mycobacterium tuberculosis H37Rv
gccgcggucgugaucagcagg

SEQ ID NO: 1330704 - RNA, 18 nt, Mycobacterium tuberculosis H37Rv
gccgcggucccgucgcuu

SEQ ID NO: 1330705 - RNA, 15 nt, Mycobacterium tuberculosis H37Rv
gccgcggucggcgug

SEQ ID NO: 1330706 - RNA, 17 nt, Mycobacterium tuberculosis H37Rv
gccgcggucggcgugca

SEQ ID NO: 1330707 - RNA, 21 nt, Mycobacterium tuberculosis H37Rv
gccgcggucgauguccgcagc

SEQ ID NO: 1330708 - RNA, 15 nt, Mycobacterium tuberculosis H37Rv
gccgcggucggccac

SEQ ID NO: 1330709 - RNA, 20 nt, Mycobacterium tuberculosis H37Rv
gccgcuaccgcccgcgccac

SEQ ID NO: 1330710 - RNA, 21 nt, Mycobacterium tuberculosis H37Rv
gccgcuaccgcccgcgccacc

SEQ ID NO: 1330711 - RNA, 16 nt, Mycobacterium tuberculosis H37Rv
gccgcguugccggucg

SEQ ID NO: 1330712 - RNA, 22 nt, Mycobacterium tuberculosis H37Rv
gccgcguuucggucguuggugc

SEQ ID NO: 1330713 - RNA, 18 nt, Mycobacterium tuberculosis H37Rv
gccgcgucucggugcagc

SEQ ID NO: 1330714 - RNA, 21 nt, Mycobacterium tuberculosis H37Rv
gccgcgucucggugcagcagc

SEQ ID NO: 1330715 - RNA, 16 nt, Mycobacterium tuberculosis H37Rv
gccgcgucgcugagca

SEQ ID NO: 1330716 - RNA, 17 nt, Mycobacterium tuberculosis H37Rv
gccgcgucggccgcgcu

SEQ ID NO: 1330717 - RNA, 15 nt, Mycobacterium tuberculosis H37Rv
gccgcgugcucgccg

SEQ ID NO: 1330718 - RNA, 16 nt, Mycobacterium tuberculosis H37Rv
gccgcgugcugcggcu

SEQ ID NO: 1330719 - RNA, 14 nt, Mycobacterium tuberculosis H37Rv
gccgcguggcuggc

SEQ ID NO: 1330720 - RNA, 21 nt, Mycobacterium tuberculosis H37Rv
gccgcgugguuccggcgugca

SEQ ID NO: 1330721 - RNA, 16 nt, Mycobacterium tuberculosis H37Rv
gccgcugugagcuugg

SEQ ID NO: 1330722 - RNA, 15 nt, Mycobacterium tuberculosis H37Rv
gccgcuggggcgccc

SEQ ID NO: 1330723 - RNA, 18 nt, Mycobacterium tuberculosis H37Rv
gccgcugggugaccagga

SEQ ID NO: 1330724 - RNA, 13 nt, Mycobacterium tuberculosis H37Rv
gccgcuggccagc

SEQ ID NO: 1330725 - RNA, 15 nt, Mycobacterium tuberculosis H37Rv
gccgcugcauccgca

SEQ ID NO: 1330726 - RNA, 14 nt, Mycobacterium tuberculosis H37Rv
gccgcugccagccg

SEQ ID NO: 1330727 - RNA, 14 nt, Mycobacterium tuberculosis H37Rv
gccgcugcauccgc

SEQ ID NO: 1330728 - RNA, 22 nt, Mycobacterium tuberculosis H37Rv
gccgcugcauacaaccccgcgc

SEQ ID NO: 1330729 - RNA, 17 nt, Mycobacterium tuberculosis H37Rv
gccgcugccgcgcggcg

SEQ ID NO: 1330730 - RNA, 16 nt, Mycobacterium tuberculosis H37Rv
gccgcugccgcgcggc

SEQ ID NO: 1330731 - RNA, 14 nt, Mycobacterium tuberculosis H37Rv
gccgcugccgccug

SEQ ID NO: 1330732 - RNA, 12 nt, Mycobacterium tuberculosis H37Rv
gccgcuggcaau

SEQ ID NO: 1330733 - RNA, 20 nt, Mycobacterium tuberculosis H37Rv
gccgcuggcaaucccgcggu

SEQ ID NO: 1330734 - RNA, 13 nt, Mycobacterium tuberculosis H37Rv
gccgcugccuucu

SEQ ID NO: 1330735 - RNA, 23 nt, Mycobacterium tuberculosis H37Rv
gccgcugcgacaaaucggcggug

SEQ ID NO: 1330736 - RNA, 22 nt, Mycobacterium tuberculosis H37Rv
gccgcugaucugccgccgcggc

SEQ ID NO: 1330737 - RNA, 22 nt, Mycobacterium tuberculosis H37Rv
gccgcugacuccugcggcaccg

SEQ ID NO: 1330738 - RNA, 22 nt, Mycobacterium tuberculosis H37Rv
gccgcugacgguucggucgggg

SEQ ID NO: 1330739 - RNA, 15 nt, Mycobacterium tuberculosis H37Rv
gccgcugagcccugc

SEQ ID NO: 1330740 - RNA, 21 nt, Mycobacterium tuberculosis H37Rv
gccgcucguuacgccgagcac

SEQ ID NO: 1330741 - RNA, 18 nt, Mycobacterium tuberculosis H37Rv
gccgcuaggacggcgcga

SEQ ID NO: 1330742 - RNA, 19 nt, Mycobacterium tuberculosis H37Rv
gccgcuaccccagccggca

SEQ ID NO: 1330743 - RNA, 21 nt, Mycobacterium tuberculosis H37Rv
gccgcuaggacggcgcgagcc

SEQ ID NO: 1330744 - RNA, 20 nt, Mycobacterium tuberculosis H37Rv
gccgcuaggacggcgcgagc

SEQ ID NO: 1330745 - RNA, 13 nt, Mycobacterium tuberculosis H37Rv
gccgcuccaugac

SEQ ID NO: 1330746 - RNA, 18 nt, Mycobacterium tuberculosis H37Rv
gccgcucauccagcgcgu

SEQ ID NO: 1330747 - RNA, 13 nt, Mycobacterium tuberculosis H37Rv
gccgcucauccag

SEQ ID NO: 1330748 - RNA, 14 nt, Mycobacterium tuberculosis H37Rv
gccgcucauccagc

SEQ ID NO: 1330749 - RNA, 13 nt, Mycobacterium tuberculosis H37Rv
gccgcucaccccg

SEQ ID NO: 1330750 - RNA, 20 nt, Mycobacterium tuberculosis H37Rv
gccgcucacauacagcaggc

SEQ ID NO: 1330751 - RNA, 23 nt, Mycobacterium tuberculosis H37Rv
gccgcccggcgagcagggcgucg

SEQ ID NO: 1330752 - RNA, 13 nt, Mycobacterium tuberculosis H37Rv
aaagcucucggca

SEQ ID NO: 1330753 - RNA, 16 nt, Mycobacterium tuberculosis H37Rv
gccgccccggccgcug

SEQ ID NO: 1330754 - RNA, 13 nt, Mycobacterium tuberculosis H37Rv
gccgccccgcagc

SEQ ID NO: 1330755 - RNA, 18 nt, Mycobacterium tuberculosis H37Rv
gccgccagauuggcgcug

SEQ ID NO: 1330756 - RNA, 18 nt, Mycobacterium tuberculosis H37Rv
gccgccagcaccaccggc

SEQ ID NO: 1330757 - RNA, 21 nt, Mycobacterium tuberculosis H37Rv
gccgccagcaccucggccagc

SEQ ID NO: 1330758 - RNA, 14 nt, Mycobacterium tuberculosis H37Rv
gccgcccgcccgga

SEQ ID NO: 1330759 - RNA, 22 nt, Mycobacterium tuberculosis H37Rv
gccgcccgcccggacgcaacac

SEQ ID NO: 1330760 - RNA, 23 nt, Mycobacterium tuberculosis H37Rv
gccgcccgcgccgccgcuacccc

SEQ ID NO: 1330761 - RNA, 19 nt, Mycobacterium tuberculosis H37Rv
gccgcccgcagggccgccg

SEQ ID NO: 1330762 - RNA, 20 nt, Mycobacterium tuberculosis H37Rv
gccgcccgcagggccgccgc

SEQ ID NO: 1330763 - RNA, 19 nt, Mycobacterium tuberculosis H37Rv
gccgcccggacccaaagca

SEQ ID NO: 1330764 - RNA, 13 nt, Mycobacterium tuberculosis H37Rv
gccgcccgcgccu

SEQ ID NO: 1330765 - RNA, 20 nt, Mycobacterium tuberculosis H37Rv
gccgcccgcuccgccgucgc

SEQ ID NO: 1330766 - RNA, 15 nt, Mycobacterium tuberculosis H37Rv
gccgccggcgccggc

SEQ ID NO: 1330767 - RNA, 20 nt, Mycobacterium tuberculosis H37Rv
gccgccggcgccggcgcugc

SEQ ID NO: 1330768 - RNA, 17 nt, Mycobacterium tuberculosis H37Rv
gccgccggcgccgccgu

SEQ ID NO: 1330769 - RNA, 16 nt, Mycobacterium tuberculosis H37Rv
gccgccggcgccgccg

SEQ ID NO: 1330770 - RNA, 18 nt, Mycobacterium tuberculosis H37Rv
gccgccggcgcccaggcc

SEQ ID NO: 1330771 - RNA, 13 nt, Mycobacterium tuberculosis H37Rv
gccgccggcgcug

SEQ ID NO: 1330772 - RNA, 15 nt, Mycobacterium tuberculosis H37Rv
gccgccggcggcggu

SEQ ID NO: 1330773 - RNA, 17 nt, Mycobacterium tuberculosis H37Rv
gccgccggcgccacccg

SEQ ID NO: 1330774 - RNA, 15 nt, Mycobacterium tuberculosis H37Rv
gccgccggcgccacc

SEQ ID NO: 1330775 - RNA, 13 nt, Mycobacterium tuberculosis H37Rv
gccgccggcgccc

SEQ ID NO: 1330776 - RNA, 15 nt, Mycobacterium tuberculosis H37Rv
gccgccggcgccagc

SEQ ID NO: 1330777 - RNA, 14 nt, Mycobacterium tuberculosis H37Rv
gccgccggcgccgc

SEQ ID NO: 1330778 - RNA, 16 nt, Mycobacterium tuberculosis H37Rv
gccgccgcggcgaagc

SEQ ID NO: 1330779 - RNA, 12 nt, Mycobacterium tuberculosis H37Rv
gccgccgcggcg

SEQ ID NO: 1330780 - RNA, 16 nt, Mycobacterium tuberculosis H37Rv
gccgccgcgggcgccg

SEQ ID NO: 1330781 - RNA, 17 nt, Mycobacterium tuberculosis H37Rv
gccgccgcgggcgccgg

SEQ ID NO: 1330782 - RNA, 15 nt, Mycobacterium tuberculosis H37Rv
gccgccgcggcgccc

SEQ ID NO: 1330783 - RNA, 17 nt, Mycobacterium tuberculosis H37Rv
gccgccgcuacccccga

SEQ ID NO: 1330784 - RNA, 13 nt, Mycobacterium tuberculosis H37Rv
gccgccgcggccg

SEQ ID NO: 1330785 - RNA, 16 nt, Mycobacterium tuberculosis H37Rv
gccgccgcggccacca

SEQ ID NO: 1330786 - RNA, 13 nt, Mycobacterium tuberculosis H37Rv
gccgccgcggcca

SEQ ID NO: 1330787 - RNA, 14 nt, Mycobacterium tuberculosis H37Rv
gccgccgccugcuc

SEQ ID NO: 1330788 - RNA, 16 nt, Mycobacterium tuberculosis H37Rv
gccgccgcgagcgccg

SEQ ID NO: 1330789 - RNA, 12 nt, Mycobacterium tuberculosis H37Rv
gccgccgcccgu

SEQ ID NO: 1330790 - RNA, 16 nt, Mycobacterium tuberculosis H37Rv
gccgccgccgccggcg

SEQ ID NO: 1330791 - RNA, 15 nt, Mycobacterium tuberculosis H37Rv
gccgccgccgccggc

SEQ ID NO: 1330792 - RNA, 12 nt, Mycobacterium tuberculosis H37Rv
gccgccgccauc

SEQ ID NO: 1330793 - RNA, 14 nt, Mycobacterium tuberculosis H37Rv
gccgccgccccggc

SEQ ID NO: 1330794 - RNA, 12 nt, Mycobacterium tuberculosis H37Rv
gccgccgcagcu

SEQ ID NO: 1330795 - RNA, 23 nt, Mycobacterium tuberculosis H37Rv
gccgccgccaccggcgccgccgu

SEQ ID NO: 1330796 - RNA, 23 nt, Mycobacterium tuberculosis H37Rv
gccgcgcacccguccgccgcaga

SEQ ID NO: 1330797 - RNA, 16 nt, Mycobacterium tuberculosis H37Rv
gccgcgaucgugcagg

SEQ ID NO: 1330798 - RNA, 18 nt, Mycobacterium tuberculosis H37Rv
gccgcgaugagcggcgcg

SEQ ID NO: 1330799 - RNA, 23 nt, Mycobacterium tuberculosis H37Rv
gccgcgaucggugcgggcgccgc

SEQ ID NO: 1330800 - RNA, 18 nt, Mycobacterium tuberculosis H37Rv
gccgcgaucgggcccagc

SEQ ID NO: 1330801 - RNA, 22 nt, Mycobacterium tuberculosis H37Rv
gccgcgaucggugcgggcgccg

SEQ ID NO: 1330802 - RNA, 12 nt, Mycobacterium tuberculosis H37Rv
gccgcgcccggc

SEQ ID NO: 1330803 - RNA, 18 nt, Mycobacterium tuberculosis H37Rv
gccgcgcgggccgccgca

SEQ ID NO: 1330804 - RNA, 14 nt, Mycobacterium tuberculosis H37Rv
gccgcgccggcccc

SEQ ID NO: 1330805 - RNA, 12 nt, Mycobacterium tuberculosis H37Rv
gccgcgcggcga

SEQ ID NO: 1330806 - RNA, 13 nt, Mycobacterium tuberculosis H37Rv
gccgcgccgcggc

SEQ ID NO: 1330807 - RNA, 14 nt, Mycobacterium tuberculosis H37Rv
gccgcgccggcaga

SEQ ID NO: 1330808 - RNA, 15 nt, Mycobacterium tuberculosis H37Rv
gccgcgccgcggccc

SEQ ID NO: 1330809 - RNA, 16 nt, Mycobacterium tuberculosis H37Rv
gccgcgccgcggcccg

SEQ ID NO: 1330810 - RNA, 13 nt, Mycobacterium tuberculosis H37Rv
gccgcgccgaccu

SEQ ID NO: 1330811 - RNA, 16 nt, Mycobacterium tuberculosis H37Rv
gccgcgccgacgccgc

SEQ ID NO: 1330812 - RNA, 19 nt, Mycobacterium tuberculosis H37Rv
gccgcgccgacgccgcgga

SEQ ID NO: 1330813 - RNA, 17 nt, Mycobacterium tuberculosis H37Rv
gccgccgucgccgccgc

SEQ ID NO: 1330814 - RNA, 16 nt, Mycobacterium tuberculosis H37Rv
gccgccgucggcgagc

SEQ ID NO: 1330815 - RNA, 23 nt, Mycobacterium tuberculosis H37Rv
gccgccgggaaauaucucgguga

SEQ ID NO: 1330816 - RNA, 20 nt, Mycobacterium tuberculosis H37Rv
gccgccgggauaacccagca

SEQ ID NO: 1330817 - RNA, 15 nt, Mycobacterium tuberculosis H37Rv
gccgccguccccgcc

SEQ ID NO: 1330818 - RNA, 21 nt, Mycobacterium tuberculosis H37Rv
gccgccgucgccacgcccagc

SEQ ID NO: 1330819 - RNA, 16 nt, Mycobacterium tuberculosis H37Rv
gccgccgucgccgcca

SEQ ID NO: 1330820 - RNA, 16 nt, Mycobacterium tuberculosis H37Rv
gccgccgucgccgccg

SEQ ID NO: 1330821 - RNA, 17 nt, Mycobacterium tuberculosis H37Rv
gccgccguugccgccgu

SEQ ID NO: 1330822 - RNA, 23 nt, Mycobacterium tuberculosis H37Rv
gccgccguugccgccggcgccgc

SEQ ID NO: 1330823 - RNA, 22 nt, Mycobacterium tuberculosis H37Rv
gccgccguugccgccggcgccg

SEQ ID NO: 1330824 - RNA, 19 nt, Mycobacterium tuberculosis H37Rv
gccgccguugccgccggcg

SEQ ID NO: 1330825 - RNA, 16 nt, Mycobacterium tuberculosis H37Rv
gccgccguuuccugcg

SEQ ID NO: 1330826 - RNA, 18 nt, Mycobacterium tuberculosis H37Rv
gccgccguugccgccggc

SEQ ID NO: 1330827 - RNA, 17 nt, Mycobacterium tuberculosis H37Rv
gccgccguugccgccgg

SEQ ID NO: 1330828 - RNA, 20 nt, Mycobacterium tuberculosis H37Rv
gccgccguugccgccaucac

SEQ ID NO: 1330829 - RNA, 16 nt, Mycobacterium tuberculosis H37Rv
gccgccguugccaccg

SEQ ID NO: 1330830 - RNA, 17 nt, Mycobacterium tuberculosis H37Rv
gccgccguugccaccgu

SEQ ID NO: 1330831 - RNA, 15 nt, Mycobacterium tuberculosis H37Rv
gccgccguugccgcc

SEQ ID NO: 1330832 - RNA, 16 nt, Mycobacterium tuberculosis H37Rv
gccgccguugccgcca

SEQ ID NO: 1330833 - RNA, 17 nt, Mycobacterium tuberculosis H37Rv
gccgccguugccgccau

SEQ ID NO: 1330834 - RNA, 20 nt, Mycobacterium tuberculosis H37Rv
gccgccuucgccgccgccga

SEQ ID NO: 1330835 - RNA, 22 nt, Mycobacterium tuberculosis H37Rv
gccgcgaaacccugaaaagggc

SEQ ID NO: 1330836 - RNA, 19 nt, Mycobacterium tuberculosis H37Rv
gccgcgaccagcgccgcac

SEQ ID NO: 1330837 - RNA, 16 nt, Mycobacterium tuberculosis H37Rv
gccgcgaaugucgccg

SEQ ID NO: 1330838 - RNA, 19 nt, Mycobacterium tuberculosis H37Rv
gccgcgaaugucgccgccu

SEQ ID NO: 1330839 - RNA, 20 nt, Mycobacterium tuberculosis H37Rv
gccgcgaaugucgccgccug

SEQ ID NO: 1330840 - RNA, 21 nt, Mycobacterium tuberculosis H37Rv
gccgccguucccgccggcccc

SEQ ID NO: 1330841 - RNA, 17 nt, Mycobacterium tuberculosis H37Rv
gcagucggugcggugca

SEQ ID NO: 1330842 - RNA, 14 nt, Mycobacterium tuberculosis H37Rv
gcagucgggcagcg

SEQ ID NO: 1330843 - RNA, 21 nt, Mycobacterium tuberculosis H37Rv
gcagucaggccuagcgcggcg

SEQ ID NO: 1330844 - RNA, 17 nt, Mycobacterium tuberculosis H37Rv
gcagucauguccauagc

SEQ ID NO: 1330845 - RNA, 12 nt, Mycobacterium tuberculosis H37Rv
gcaguccaggca

SEQ ID NO: 1330846 - RNA, 19 nt, Mycobacterium tuberculosis H37Rv
gcaguccagccgggugccg

SEQ ID NO: 1330847 - RNA, 17 nt, Mycobacterium tuberculosis H37Rv
gcaguccaccgcgcggc

SEQ ID NO: 1330848 - RNA, 21 nt, Mycobacterium tuberculosis H37Rv
gcagucccagcacacccccgu

SEQ ID NO: 1330849 - RNA, 12 nt, Mycobacterium tuberculosis H37Rv
gcagucccagcg

SEQ ID NO: 1330850 - RNA, 14 nt, Mycobacterium tuberculosis H37Rv
gcaguccgggugua

SEQ ID NO: 1330851 - RNA, 19 nt, Mycobacterium tuberculosis H37Rv
gcagucgcaaaagccccca

SEQ ID NO: 1330852 - RNA, 16 nt, Mycobacterium tuberculosis H37Rv
gcagucgaugagugac

SEQ ID NO: 1330853 - RNA, 19 nt, Mycobacterium tuberculosis H37Rv
gcagucgauuucggcggcg

SEQ ID NO: 1330854 - RNA, 21 nt, Mycobacterium tuberculosis H37Rv
gcagucgcacggugccgccgu

SEQ ID NO: 1330855 - RNA, 19 nt, Mycobacterium tuberculosis H37Rv
gcagucgcuaaagcccccg

SEQ ID NO: 1330856 - RNA, 12 nt, Mycobacterium tuberculosis H37Rv
gcagucgcccac

SEQ ID NO: 1330857 - RNA, 13 nt, Mycobacterium tuberculosis H37Rv
gcagucgcccacu

SEQ ID NO: 1330858 - RNA, 15 nt, Mycobacterium tuberculosis H37Rv
gcagggccgccgcga

SEQ ID NO: 1330859 - RNA, 14 nt, Mycobacterium tuberculosis H37Rv
gcaggggacgggcg

SEQ ID NO: 1330860 - RNA, 22 nt, Mycobacterium tuberculosis H37Rv
gcagguuggccaccgcccagug

SEQ ID NO: 1330861 - RNA, 17 nt, Mycobacterium tuberculosis H37Rv
gcagucaacucccgaac

SEQ ID NO: 1330862 - RNA, 14 nt, Mycobacterium tuberculosis H37Rv
gcagucaacucccg

SEQ ID NO: 1330863 - RNA, 15 nt, Mycobacterium tuberculosis H37Rv
gcagugccgugcuga

SEQ ID NO: 1330864 - RNA, 17 nt, Mycobacterium tuberculosis H37Rv
gcagugccgcacccaga

SEQ ID NO: 1330865 - RNA, 13 nt, Mycobacterium tuberculosis H37Rv
gcaguggcagccc

SEQ ID NO: 1330866 - RNA, 17 nt, Mycobacterium tuberculosis H37Rv
gcaguggcagcccgucg

SEQ ID NO: 1330867 - RNA, 19 nt, Mycobacterium tuberculosis H37Rv
gcaguucaucgggcaccaa

SEQ ID NO: 1330868 - RNA, 21 nt, Mycobacterium tuberculosis H37Rv
gcaguucaucgggcaccaacc

SEQ ID NO: 1330869 - RNA, 16 nt, Mycobacterium tuberculosis H37Rv
gcaguuccagcucgcg

SEQ ID NO: 1330870 - RNA, 14 nt, Mycobacterium tuberculosis H37Rv
gcaguuuggcggca

SEQ ID NO: 1330871 - RNA, 14 nt, Mycobacterium tuberculosis H37Rv
gcaguugacccaug

SEQ ID NO: 1330872 - RNA, 17 nt, Mycobacterium tuberculosis H37Rv
gcagcuagcccggcagc

SEQ ID NO: 1330873 - RNA, 15 nt, Mycobacterium tuberculosis H37Rv
gcagcuccaccagga

SEQ ID NO: 1330874 - RNA, 19 nt, Mycobacterium tuberculosis H37Rv
gcagcugccgcacccccuc

SEQ ID NO: 1330875 - RNA, 22 nt, Mycobacterium tuberculosis H37Rv
gcagcugcgucccggaaaaagu

SEQ ID NO: 1330876 - RNA, 14 nt, Mycobacterium tuberculosis H37Rv
gcagcugcuccagu

SEQ ID NO: 1330877 - RNA, 14 nt, Mycobacterium tuberculosis H37Rv
gcagcugcucgguc

SEQ ID NO: 1330878 - RNA, 12 nt, Mycobacterium tuberculosis H37Rv
gcagcguccagc

SEQ ID NO: 1330879 - RNA, 15 nt, Mycobacterium tuberculosis H37Rv
gcagcguccagcgcc

SEQ ID NO: 1330880 - RNA, 15 nt, Mycobacterium tuberculosis H37Rv
gcagcgguccagaca

SEQ ID NO: 1330881 - RNA, 21 nt, Mycobacterium tuberculosis H37Rv
gcagcgguugaugcggccgcg

SEQ ID NO: 1330882 - RNA, 18 nt, Mycobacterium tuberculosis H37Rv
gcagcggugcagcccgcc

SEQ ID NO: 1330883 - RNA, 18 nt, Mycobacterium tuberculosis H37Rv
gcagcgguccgccgccuu

SEQ ID NO: 1330884 - RNA, 18 nt, Mycobacterium tuberculosis H37Rv
gcagcggguugcggucac

SEQ ID NO: 1330885 - RNA, 19 nt, Mycobacterium tuberculosis H37Rv
gcagcggguuugccgggcg

SEQ ID NO: 1330886 - RNA, 19 nt, Mycobacterium tuberculosis H37Rv
gcaaccgaugacgcguuca

SEQ ID NO: 1330887 - RNA, 18 nt, Mycobacterium tuberculosis H37Rv
gcagcgggucgccgggcc

SEQ ID NO: 1330888 - RNA, 16 nt, Mycobacterium tuberculosis H37Rv
gcagcuuggccagcca

SEQ ID NO: 1330889 - RNA, 17 nt, Mycobacterium tuberculosis H37Rv
gcagcuugcccgacggc

SEQ ID NO: 1330890 - RNA, 19 nt, Mycobacterium tuberculosis H37Rv
gcagcuuguuuuccaccag

SEQ ID NO: 1330891 - RNA, 20 nt, Mycobacterium tuberculosis H37Rv
gcagcuuuaaucguggcacu

SEQ ID NO: 1330892 - RNA, 21 nt, Mycobacterium tuberculosis H37Rv
gcaggaaaucguccuuggaca

SEQ ID NO: 1330893 - RNA, 14 nt, Mycobacterium tuberculosis H37Rv
gcaggaacacccau

SEQ ID NO: 1330894 - RNA, 19 nt, Mycobacterium tuberculosis H37Rv
gcaggaagccggcgugcuc

SEQ ID NO: 1330895 - RNA, 14 nt, Mycobacterium tuberculosis H37Rv
gcagcuggucggug

SEQ ID NO: 1330896 - RNA, 23 nt, Mycobacterium tuberculosis H37Rv
gcagcugguaggucaccggucac

SEQ ID NO: 1330897 - RNA, 17 nt, Mycobacterium tuberculosis H37Rv
gcagcuggggcccggcc

SEQ ID NO: 1330898 - RNA, 13 nt, Mycobacterium tuberculosis H37Rv
gcagcuggggcgg

SEQ ID NO: 1330899 - RNA, 19 nt, Mycobacterium tuberculosis H37Rv
gcagcuggcgcagccugcc

SEQ ID NO: 1330900 - RNA, 12 nt, Mycobacterium tuberculosis H37Rv
gcagcuucucgc

SEQ ID NO: 1330901 - RNA, 14 nt, Mycobacterium tuberculosis H37Rv
gcaggccgggcgca

SEQ ID NO: 1330902 - RNA, 21 nt, Mycobacterium tuberculosis H37Rv
gcaggccuccaagcccgccgg

SEQ ID NO: 1330903 - RNA, 12 nt, Mycobacterium tuberculosis H37Rv
gcaggccgggcg

SEQ ID NO: 1330904 - RNA, 13 nt, Mycobacterium tuberculosis H37Rv
gcaggccgccggc

SEQ ID NO: 1330905 - RNA, 14 nt, Mycobacterium tuberculosis H37Rv
gcaggccgcguucg

SEQ ID NO: 1330906 - RNA, 15 nt, Mycobacterium tuberculosis H37Rv
gcaggccuccaagcc

SEQ ID NO: 1330907 - RNA, 19 nt, Mycobacterium tuberculosis H37Rv
gcaggccucggcgccgccc

SEQ ID NO: 1330908 - RNA, 14 nt, Mycobacterium tuberculosis H37Rv
gcaggcgagcaguc

SEQ ID NO: 1330909 - RNA, 21 nt, Mycobacterium tuberculosis H37Rv
gcaggcgaguuaggccgccag

SEQ ID NO: 1330910 - RNA, 16 nt, Mycobacterium tuberculosis H37Rv
gcaggaaucgggucag

SEQ ID NO: 1330911 - RNA, 22 nt, Mycobacterium tuberculosis H37Rv
gcaggaucgccugagcgccgcg

SEQ ID NO: 1330912 - RNA, 19 nt, Mycobacterium tuberculosis H37Rv
gcaggaucgccugagcgcc

SEQ ID NO: 1330913 - RNA, 20 nt, Mycobacterium tuberculosis H37Rv
gcagggcauugcggcccgcg

SEQ ID NO: 1330914 - RNA, 13 nt, Mycobacterium tuberculosis H37Rv
gcagggccgcgcg

SEQ ID NO: 1330915 - RNA, 14 nt, Mycobacterium tuberculosis H37Rv
gcagggccagcggc

SEQ ID NO: 1330916 - RNA, 14 nt, Mycobacterium tuberculosis H37Rv
gcagggcagcccgg

SEQ ID NO: 1330917 - RNA, 19 nt, Mycobacterium tuberculosis H37Rv
gcaggcucagcugguggcg

SEQ ID NO: 1330918 - RNA, 21 nt, Mycobacterium tuberculosis H37Rv
gcaggcgucccagccgaucac

SEQ ID NO: 1330919 - RNA, 15 nt, Mycobacterium tuberculosis H37Rv
gcaggcgcaccaggc

SEQ ID NO: 1330920 - RNA, 16 nt, Mycobacterium tuberculosis H37Rv
gcaggcgcagcugggu

SEQ ID NO: 1330921 - RNA, 21 nt, Mycobacterium tuberculosis H37Rv
gcaggcgugcuugaccgccug

SEQ ID NO: 1330922 - RNA, 23 nt, Mycobacterium tuberculosis H37Rv
gcaggcgugcuugaccgccugga

SEQ ID NO: 1330923 - RNA, 21 nt, Mycobacterium tuberculosis H37Rv
gcauucgggauucgggcgccg

SEQ ID NO: 1330924 - RNA, 22 nt, Mycobacterium tuberculosis H37Rv
gcauucguggagccggccguga

SEQ ID NO: 1330925 - RNA, 12 nt, Mycobacterium tuberculosis H37Rv
gcauuggcggcg

SEQ ID NO: 1330926 - RNA, 14 nt, Mycobacterium tuberculosis H37Rv
gcauuggcggcggu

SEQ ID NO: 1330927 - RNA, 24 nt, Mycobacterium tuberculosis H37Rv
gcauuccguaggccacagcccggc

SEQ ID NO: 1330928 - RNA, 18 nt, Mycobacterium tuberculosis H37Rv
gccaaacuacccgcccac

SEQ ID NO: 1330929 - RNA, 12 nt, Mycobacterium tuberculosis H37Rv
gcauggccuggg

SEQ ID NO: 1330930 - RNA, 16 nt, Mycobacterium tuberculosis H37Rv
gcauggucaggcggcc

SEQ ID NO: 1330931 - RNA, 22 nt, Mycobacterium tuberculosis H37Rv
gcaugguccacagccggcggcu

SEQ ID NO: 1330932 - RNA, 17 nt, Mycobacterium tuberculosis H37Rv
gcaugguggugggugau

SEQ ID NO: 1330933 - RNA, 14 nt, Mycobacterium tuberculosis H37Rv
gcauggugguggcc

SEQ ID NO: 1330934 - RNA, 18 nt, Mycobacterium tuberculosis H37Rv
gcaugucgcggacccgcg

SEQ ID NO: 1330935 - RNA, 19 nt, Mycobacterium tuberculosis H37Rv
gcauguccauguuuugcug

SEQ ID NO: 1330936 - RNA, 19 nt, Mycobacterium tuberculosis H37Rv
gcaugcaaacggaugguuc

SEQ ID NO: 1330937 - RNA, 15 nt, Mycobacterium tuberculosis H37Rv
gcaucuuuggcggcc

SEQ ID NO: 1330938 - RNA, 18 nt, Mycobacterium tuberculosis H37Rv
gcaucuuuggcggccgca

SEQ ID NO: 1330939 - RNA, 21 nt, Mycobacterium tuberculosis H37Rv
gcaugauccgcugggccgggg

SEQ ID NO: 1330940 - RNA, 21 nt, Mycobacterium tuberculosis H37Rv
gcaugcccagcgcacggacca

SEQ ID NO: 1330941 - RNA, 12 nt, Mycobacterium tuberculosis H37Rv
gcaugcccagcg

SEQ ID NO: 1330942 - RNA, 20 nt, Mycobacterium tuberculosis H37Rv
gcaugcucgacaaccgcccg

SEQ ID NO: 1330943 - RNA, 20 nt, Mycobacterium tuberculosis H37Rv
gcaugcccagaaaaccgccg

SEQ ID NO: 1330944 - RNA, 16 nt, Mycobacterium tuberculosis H37Rv
gcaucugucgcgcggc

SEQ ID NO: 1330945 - RNA, 14 nt, Mycobacterium tuberculosis H37Rv
gcaucugcuucugc

SEQ ID NO: 1330946 - RNA, 18 nt, Mycobacterium tuberculosis H37Rv
gcauagcggcccaucggg

SEQ ID NO: 1330947 - RNA, 13 nt, Mycobacterium tuberculosis H37Rv
gcauaggcgcggu

SEQ ID NO: 1330948 - RNA, 19 nt, Mycobacterium tuberculosis H37Rv
gcauaggccccgccagcgc

SEQ ID NO: 1330949 - RNA, 21 nt, Mycobacterium tuberculosis H37Rv
gcaucaacgcgggcgcuugcc

SEQ ID NO: 1330950 - RNA, 22 nt, Mycobacterium tuberculosis H37Rv
gcaucaaccguccccggcgucc

SEQ ID NO: 1330951 - RNA, 12 nt, Mycobacterium tuberculosis H37Rv
gcaucagggucg

SEQ ID NO: 1330952 - RNA, 14 nt, Mycobacterium tuberculosis H37Rv
gcaucgccacaguc

SEQ ID NO: 1330953 - RNA, 21 nt, Mycobacterium tuberculosis H37Rv
gcaucgugugguuaacacccu

SEQ ID NO: 1330954 - RNA, 15 nt, Mycobacterium tuberculosis H37Rv
gcaucguggccgcac

SEQ ID NO: 1330955 - RNA, 17 nt, Mycobacterium tuberculosis H37Rv
gcaucgccgacagcgcc

SEQ ID NO: 1330956 - RNA, 18 nt, Mycobacterium tuberculosis H37Rv
gcaucucgggcgaagccg

SEQ ID NO: 1330957 - RNA, 19 nt, Mycobacterium tuberculosis H37Rv
gcaucuccgucggccaggc

SEQ ID NO: 1330958 - RNA, 23 nt, Mycobacterium tuberculosis H37Rv
gcaucuccgucggccaggccacg

SEQ ID NO: 1330959 - RNA, 19 nt, Mycobacterium tuberculosis H37Rv
gcauccagaaguaggcgac

SEQ ID NO: 1330960 - RNA, 21 nt, Mycobacterium tuberculosis H37Rv
gcauccaggcugucgcgggcc

SEQ ID NO: 1330961 - RNA, 20 nt, Mycobacterium tuberculosis H37Rv
gcauccagccgugcggcggc

SEQ ID NO: 1330962 - RNA, 22 nt, Mycobacterium tuberculosis H37Rv
gcaucaucgcugugcgcugguc

SEQ ID NO: 1330963 - RNA, 22 nt, Mycobacterium tuberculosis H37Rv
gcaucaugcccuuguaggccau

SEQ ID NO: 1330964 - RNA, 20 nt, Mycobacterium tuberculosis H37Rv
gcaucgaacgcccugacggu

SEQ ID NO: 1330965 - RNA, 16 nt, Mycobacterium tuberculosis H37Rv
gcaucgacgaacccca

SEQ ID NO: 1330966 - RNA, 22 nt, Mycobacterium tuberculosis H37Rv
gcaucgaauuccagccagccgc

SEQ ID NO: 1330967 - RNA, 23 nt, Mycobacterium tuberculosis H37Rv
gcaucgacugccagcgccgcggc

SEQ ID NO: 1330968 - RNA, 21 nt, Mycobacterium tuberculosis H37Rv
gcaucgagacgcacggccacc

SEQ ID NO: 1330969 - RNA, 14 nt, Mycobacterium tuberculosis H37Rv
gcaucgaggccagc

SEQ ID NO: 1330970 - RNA, 21 nt, Mycobacterium tuberculosis H37Rv
gcaucgagcgucgggcacauc

SEQ ID NO: 1330971 - RNA, 14 nt, Mycobacterium tuberculosis H37Rv
gccacggaucgcgg

SEQ ID NO: 1330972 - RNA, 21 nt, Mycobacterium tuberculosis H37Rv
gccacgcuucuuccgcgcgcc

SEQ ID NO: 1330973 - RNA, 17 nt, Mycobacterium tuberculosis H37Rv
gccacgcucggugcugc

SEQ ID NO: 1330974 - RNA, 19 nt, Mycobacterium tuberculosis H37Rv
gccacgcguuccuccagca

SEQ ID NO: 1330975 - RNA, 19 nt, Mycobacterium tuberculosis H37Rv
gccacgcucggcggccagc

SEQ ID NO: 1330976 - RNA, 14 nt, Mycobacterium tuberculosis H37Rv
gccagaaacccggc

SEQ ID NO: 1330977 - RNA, 15 nt, Mycobacterium tuberculosis H37Rv
gccagaacguggcca

SEQ ID NO: 1330978 - RNA, 16 nt, Mycobacterium tuberculosis H37Rv
gccagaaugggcggca

SEQ ID NO: 1330979 - RNA, 15 nt, Mycobacterium tuberculosis H37Rv
gccagaaugggcggc

SEQ ID NO: 1330980 - RNA, 16 nt, Mycobacterium tuberculosis H37Rv
gccagaaucccgcuuc

SEQ ID NO: 1330981 - RNA, 17 nt, Mycobacterium tuberculosis H37Rv
gccagacggugcagcuc

SEQ ID NO: 1330982 - RNA, 13 nt, Mycobacterium tuberculosis H37Rv
gccagagccgccc

SEQ ID NO: 1330983 - RNA, 20 nt, Mycobacterium tuberculosis H37Rv
gccagcaccaccggcucccg

SEQ ID NO: 1330984 - RNA, 13 nt, Mycobacterium tuberculosis H37Rv
gccagcaccacgg

SEQ ID NO: 1330985 - RNA, 15 nt, Mycobacterium tuberculosis H37Rv
gccagcaccacggcc

SEQ ID NO: 1330986 - RNA, 15 nt, Mycobacterium tuberculosis H37Rv
gccagcaccaccggc

SEQ ID NO: 1330987 - RNA, 21 nt, Mycobacterium tuberculosis H37Rv
gccagcaagacgaugacagac

SEQ ID NO: 1330988 - RNA, 14 nt, Mycobacterium tuberculosis H37Rv
gccagcaagugcgg

SEQ ID NO: 1330989 - RNA, 13 nt, Mycobacterium tuberculosis H37Rv
gccagcaccagcg

SEQ ID NO: 1330990 - RNA, 14 nt, Mycobacterium tuberculosis H37Rv
gccagcaccagcgu

SEQ ID NO: 1330991 - RNA, 21 nt, Mycobacterium tuberculosis H37Rv
gccagcaccagcgucgcggcc

SEQ ID NO: 1330992 - RNA, 17 nt, Mycobacterium tuberculosis H37Rv
gccagcacccugaugug

SEQ ID NO: 1330993 - RNA, 21 nt, Mycobacterium tuberculosis H37Rv
gccagcaccuagucgcggccg

SEQ ID NO: 1330994 - RNA, 13 nt, Mycobacterium tuberculosis H37Rv
gccagcacuccac

SEQ ID NO: 1330995 - RNA, 22 nt, Mycobacterium tuberculosis H37Rv
gccagcacgcccucgacgcgcu

SEQ ID NO: 1330996 - RNA, 14 nt, Mycobacterium tuberculosis H37Rv
gccagcacgccgcc

SEQ ID NO: 1330997 - RNA, 15 nt, Mycobacterium tuberculosis H37Rv
gccagcacgccgccg

SEQ ID NO: 1330998 - RNA, 14 nt, Mycobacterium tuberculosis H37Rv
gccagauaggcacc

SEQ ID NO: 1330999 - RNA, 23 nt, Mycobacterium tuberculosis H37Rv
gccagaucagcaccgacagcccg

SEQ ID NO: 1331000 - RNA, 20 nt, Mycobacterium tuberculosis H37Rv
gccagauagguuccaccggg

SEQ ID NO: 1331001 - RNA, 21 nt, Mycobacterium tuberculosis H37Rv
gccagaucgaacgcagccagc

SEQ ID NO: 1331002 - RNA, 20 nt, Mycobacterium tuberculosis H37Rv
gccagaucgaagcgcagcac

SEQ ID NO: 1331003 - RNA, 16 nt, Mycobacterium tuberculosis H37Rv
gccagaucucgcgcgc

SEQ ID NO: 1331004 - RNA, 22 nt, Mycobacterium tuberculosis H37Rv
gccagaucggcggguggcgcca

SEQ ID NO: 1331005 - RNA, 14 nt, Mycobacterium tuberculosis H37Rv
gccagauuggcgcu

SEQ ID NO: 1331006 - RNA, 17 nt, Mycobacterium tuberculosis H37Rv
gccaccagggccgcagu

SEQ ID NO: 1331007 - RNA, 13 nt, Mycobacterium tuberculosis H37Rv
gccaccagggcca

SEQ ID NO: 1331008 - RNA, 17 nt, Mycobacterium tuberculosis H37Rv
gccaccaucgccgccgu

SEQ ID NO: 1331009 - RNA, 16 nt, Mycobacterium tuberculosis H37Rv
gccaccaucgccgccg

SEQ ID NO: 1331010 - RNA, 21 nt, Mycobacterium tuberculosis H37Rv
gccaccaggggaccgcggcgc

SEQ ID NO: 1331011 - RNA, 22 nt, Mycobacterium tuberculosis H37Rv
gccaccagcgcccggcccgcca

SEQ ID NO: 1331012 - RNA, 22 nt, Mycobacterium tuberculosis H37Rv
gccaccagcaccgccgcugcca

SEQ ID NO: 1331013 - RNA, 16 nt, Mycobacterium tuberculosis H37Rv
gccaccguggccgcag

SEQ ID NO: 1331014 - RNA, 20 nt, Mycobacterium tuberculosis H37Rv
gccaccguggccgcagggcc

SEQ ID NO: 1331015 - RNA, 19 nt, Mycobacterium tuberculosis H37Rv
gccaccgucgcggcggcac

SEQ ID NO: 1331016 - RNA, 15 nt, Mycobacterium tuberculosis H37Rv
gccaccgucgcugcc

SEQ ID NO: 1331017 - RNA, 18 nt, Mycobacterium tuberculosis H37Rv
gccaccggaauccgggcc

SEQ ID NO: 1331018 - RNA, 14 nt, Mycobacterium tuberculosis H37Rv
gccaccgcggccug

SEQ ID NO: 1331019 - RNA, 16 nt, Mycobacterium tuberculosis H37Rv
gccaccgcgggcggca

SEQ ID NO: 1331020 - RNA, 13 nt, Mycobacterium tuberculosis H37Rv
gccaccgcgguca

SEQ ID NO: 1331021 - RNA, 16 nt, Mycobacterium tuberculosis H37Rv
gccaccgcggucagcu

SEQ ID NO: 1331022 - RNA, 23 nt, Mycobacterium tuberculosis H37Rv
gccaccgccggcagcaucggcac

SEQ ID NO: 1331023 - RNA, 17 nt, Mycobacterium tuberculosis H37Rv
gccaccgccgccgccac

SEQ ID NO: 1331024 - RNA, 13 nt, Mycobacterium tuberculosis H37Rv
gccaccgccgccg

SEQ ID NO: 1331025 - RNA, 14 nt, Mycobacterium tuberculosis H37Rv
gccaccgccgccgc

SEQ ID NO: 1331026 - RNA, 16 nt, Mycobacterium tuberculosis H37Rv
gccaccgccgccgcca

SEQ ID NO: 1331027 - RNA, 22 nt, Mycobacterium tuberculosis H37Rv
gccaccugacaaacggcuuggc

SEQ ID NO: 1331028 - RNA, 19 nt, Mycobacterium tuberculosis H37Rv
gccaccuccgaggccgcca

SEQ ID NO: 1331029 - RNA, 20 nt, Mycobacterium tuberculosis H37Rv
gccaccucccacgccgccgu

SEQ ID NO: 1331030 - RNA, 17 nt, Mycobacterium tuberculosis H37Rv
gccaccgucauggcggg

SEQ ID NO: 1331031 - RNA, 15 nt, Mycobacterium tuberculosis H37Rv
gccacgcaccgggug

SEQ ID NO: 1331032 - RNA, 16 nt, Mycobacterium tuberculosis H37Rv
gccacgaugaucccaa

SEQ ID NO: 1331033 - RNA, 17 nt, Mycobacterium tuberculosis H37Rv
gccacgccagcucgccg

SEQ ID NO: 1331034 - RNA, 19 nt, Mycobacterium tuberculosis H37Rv
gccacgccagcucgccggc

SEQ ID NO: 1331035 - RNA, 21 nt, Mycobacterium tuberculosis H37Rv
gccacgccaccgcggucaccg

SEQ ID NO: 1331036 - RNA, 17 nt, Mycobacterium tuberculosis H37Rv
gccacgcaugggccagg

SEQ ID NO: 1331037 - RNA, 15 nt, Mycobacterium tuberculosis H37Rv
gccacgccugagcca

SEQ ID NO: 1331038 - RNA, 18 nt, Mycobacterium tuberculosis H37Rv
gccacgccugagccacca

SEQ ID NO: 1331039 - RNA, 20 nt, Mycobacterium tuberculosis H37Rv
gccacgccugcucggagagc

SEQ ID NO: 1331040 - RNA, 13 nt, Mycobacterium tuberculosis H37Rv
gccacgccgccgg

SEQ ID NO: 1331041 - RNA, 17 nt, Mycobacterium tuberculosis H37Rv
gccacgccgaucaacau

SEQ ID NO: 1331042 - RNA, 17 nt, Mycobacterium tuberculosis H37Rv
gccacgccagccaggcg

SEQ ID NO: 1331043 - RNA, 20 nt, Mycobacterium tuberculosis H37Rv
gccacgcccacaggggcagc

SEQ ID NO: 1331044 - RNA, 16 nt, Mycobacterium tuberculosis H37Rv
gccacgcccaggcaag

SEQ ID NO: 1331045 - RNA, 22 nt, Mycobacterium tuberculosis H37Rv
gccacagucgucgagcgcuccc

SEQ ID NO: 1331046 - RNA, 22 nt, Mycobacterium tuberculosis H37Rv
gccaccaagaaguugacaccag

SEQ ID NO: 1331047 - RNA, 15 nt, Mycobacterium tuberculosis H37Rv
gccaccaacaccgcg

SEQ ID NO: 1331048 - RNA, 18 nt, Mycobacterium tuberculosis H37Rv
gccaccaccgcugccggc

SEQ ID NO: 1331049 - RNA, 17 nt, Mycobacterium tuberculosis H37Rv
gccaccaccuccgcguc

SEQ ID NO: 1331050 - RNA, 20 nt, Mycobacterium tuberculosis H37Rv
gccaccaccggcgccccugu

SEQ ID NO: 1331051 - RNA, 18 nt, Mycobacterium tuberculosis H37Rv
gccaccaccaggcugacg

SEQ ID NO: 1331052 - RNA, 14 nt, Mycobacterium tuberculosis H37Rv
gccaccaccagggc

SEQ ID NO: 1331053 - RNA, 16 nt, Mycobacterium tuberculosis H37Rv
gccaccaccagggcaa

SEQ ID NO: 1331054 - RNA, 14 nt, Mycobacterium tuberculosis H37Rv
gccaccaccagguc

SEQ ID NO: 1331055 - RNA, 21 nt, Mycobacterium tuberculosis H37Rv
gccaccacccaacagcccacc

SEQ ID NO: 1331056 - RNA, 14 nt, Mycobacterium tuberculosis H37Rv
gccaccaccgccgc

SEQ ID NO: 1331057 - RNA, 17 nt, Mycobacterium tuberculosis H37Rv
gccaccacggcgcgcuc

SEQ ID NO: 1331058 - RNA, 17 nt, Mycobacterium tuberculosis H37Rv
gccaccacgccgucgac

SEQ ID NO: 1331059 - RNA, 18 nt, Mycobacterium tuberculosis H37Rv
gccaccacgcuccccagc

SEQ ID NO: 1331060 - RNA, 16 nt, Mycobacterium tuberculosis H37Rv
gccaccagaaccagcg

SEQ ID NO: 1331061 - RNA, 15 nt, Mycobacterium tuberculosis H37Rv
gccaccagaaccacu

SEQ ID NO: 1331062 - RNA, 20 nt, Mycobacterium tuberculosis H37Rv
gccaccacugcgcccgccac

SEQ ID NO: 1331063 - RNA, 16 nt, Mycobacterium tuberculosis H37Rv
gccaaauccggcuugu

SEQ ID NO: 1331064 - RNA, 19 nt, Mycobacterium tuberculosis H37Rv
gccaaaugaugacgaucag

SEQ ID NO: 1331065 - RNA, 12 nt, Mycobacterium tuberculosis H37Rv
gccacacaggcg

SEQ ID NO: 1331066 - RNA, 22 nt, Mycobacterium tuberculosis H37Rv
gccacaccaugauugccaggac

SEQ ID NO: 1331067 - RNA, 14 nt, Mycobacterium tuberculosis H37Rv
gccacaacgcgcgg

SEQ ID NO: 1331068 - RNA, 19 nt, Mycobacterium tuberculosis H37Rv
gccagcgagaucagcaugc

SEQ ID NO: 1331069 - RNA, 19 nt, Mycobacterium tuberculosis H37Rv
gccagcgauaucggcggcu

SEQ ID NO: 1331070 - RNA, 23 nt, Mycobacterium tuberculosis H37Rv
gccagccuggccaucgagggcau

SEQ ID NO: 1331071 - RNA, 19 nt, Mycobacterium tuberculosis H37Rv
gccagcgaauggggcagcu

SEQ ID NO: 1331072 - RNA, 22 nt, Mycobacterium tuberculosis H37Rv
gccagcgacgcggucaucgagc

SEQ ID NO: 1331073 - RNA, 13 nt, Mycobacterium tuberculosis H37Rv
gccagcgccgcca

SEQ ID NO: 1331074 - RNA, 12 nt, Mycobacterium tuberculosis H37Rv
gccagcgccgcc

SEQ ID NO: 1331075 - RNA, 18 nt, Mycobacterium tuberculosis H37Rv
gccagcgccgccgcgagc

SEQ ID NO: 1331076 - RNA, 14 nt, Mycobacterium tuberculosis H37Rv
gccagcgccgccgg

SEQ ID NO: 1331077 - RNA, 16 nt, Mycobacterium tuberculosis H37Rv
gccagcgccgccggcg

SEQ ID NO: 1331078 - RNA, 16 nt, Mycobacterium tuberculosis H37Rv
gccagcgccgccgcga

SEQ ID NO: 1331079 - RNA, 18 nt, Mycobacterium tuberculosis H37Rv
gccagcgccggccaggcu

SEQ ID NO: 1331080 - RNA, 18 nt, Mycobacterium tuberculosis H37Rv
gccagcgccgcugaagcc

SEQ ID NO: 1331081 - RNA, 13 nt, Mycobacterium tuberculosis H37Rv
gccagcgccucgg

SEQ ID NO: 1331082 - RNA, 18 nt, Mycobacterium tuberculosis H37Rv
gccagcgccucggugagc

SEQ ID NO: 1331083 - RNA, 12 nt, Mycobacterium tuberculosis H37Rv
gccagcgccggc

SEQ ID NO: 1331084 - RNA, 14 nt, Mycobacterium tuberculosis H37Rv
gccagccuccacca

SEQ ID NO: 1331085 - RNA, 21 nt, Mycobacterium tuberculosis H37Rv
gccagccugcuggccgcggcc

SEQ ID NO: 1331086 - RNA, 17 nt, Mycobacterium tuberculosis H37Rv
gccagccgguggugggc

SEQ ID NO: 1331087 - RNA, 21 nt, Mycobacterium tuberculosis H37Rv
gccagccgguggugggcggga

SEQ ID NO: 1331088 - RNA, 23 nt, Mycobacterium tuberculosis H37Rv
gccagccgguccagcagcucggc

SEQ ID NO: 1331089 - RNA, 18 nt, Mycobacterium tuberculosis H37Rv
gccagccgcugccacagg

SEQ ID NO: 1331090 - RNA, 24 nt, Mycobacterium tuberculosis H37Rv
gccagccccagcguucccgccggc

SEQ ID NO: 1331091 - RNA, 23 nt, Mycobacterium tuberculosis H37Rv
gccagccccagcguucccgccgg

SEQ ID NO: 1331092 - RNA, 13 nt, Mycobacterium tuberculosis H37Rv
gccagccccgccg

SEQ ID NO: 1331093 - RNA, 13 nt, Mycobacterium tuberculosis H37Rv
gccagccccgcgc

SEQ ID NO: 1331094 - RNA, 15 nt, Mycobacterium tuberculosis H37Rv
gccagccccgcgccc

SEQ ID NO: 1331095 - RNA, 16 nt, Mycobacterium tuberculosis H37Rv
gccagcccggcgugca

SEQ ID NO: 1331096 - RNA, 14 nt, Mycobacterium tuberculosis H37Rv
gccagcccguccgg

SEQ ID NO: 1331097 - RNA, 17 nt, Mycobacterium tuberculosis H37Rv
gccagcagcggcgagcc

SEQ ID NO: 1331098 - RNA, 15 nt, Mycobacterium tuberculosis H37Rv
gccagcagcggcgag

SEQ ID NO: 1331099 - RNA, 17 nt, Mycobacterium tuberculosis H37Rv
gccagcaggaugaugac

SEQ ID NO: 1331100 - RNA, 15 nt, Mycobacterium tuberculosis H37Rv
gccagcagggccacc

SEQ ID NO: 1331101 - RNA, 15 nt, Mycobacterium tuberculosis H37Rv
gccagcagggccaga

SEQ ID NO: 1331102 - RNA, 21 nt, Mycobacterium tuberculosis H37Rv
gccagcaggggacgggcggcc

SEQ ID NO: 1331103 - RNA, 15 nt, Mycobacterium tuberculosis H37Rv
gccagcagguauuug

SEQ ID NO: 1331104 - RNA, 14 nt, Mycobacterium tuberculosis H37Rv
gccagcagggccac

SEQ ID NO: 1331105 - RNA, 21 nt, Mycobacterium tuberculosis H37Rv
gccagcagcaaucagccgccu

SEQ ID NO: 1331106 - RNA, 11 nt, Mycobacterium tuberculosis H37Rv
gccagcagcag

SEQ ID NO: 1331107 - RNA, 15 nt, Mycobacterium tuberculosis H37Rv
gccagcagagcggca

SEQ ID NO: 1331108 - RNA, 20 nt, Mycobacterium tuberculosis H37Rv
gccagcagauuaccgagcug

SEQ ID NO: 1331109 - RNA, 13 nt, Mycobacterium tuberculosis H37Rv
gccagcagauucu

SEQ ID NO: 1331110 - RNA, 19 nt, Mycobacterium tuberculosis H37Rv
gccagcagcagugccaccg

SEQ ID NO: 1331111 - RNA, 17 nt, Mycobacterium tuberculosis H37Rv
gccagcagcagaugcga

SEQ ID NO: 1331112 - RNA, 16 nt, Mycobacterium tuberculosis H37Rv
gccagcagcaggccag

SEQ ID NO: 1331113 - RNA, 23 nt, Mycobacterium tuberculosis H37Rv
gccagcagccacccgacaacgcu

SEQ ID NO: 1331114 - RNA, 11 nt, Mycobacterium tuberculosis H37Rv
gccagcagccg

SEQ ID NO: 1331115 - RNA, 15 nt, Mycobacterium tuberculosis H37Rv
gccagcagccguuca

SEQ ID NO: 1331116 - RNA, 17 nt, Mycobacterium tuberculosis H37Rv
gccagcagcgacuccag

SEQ ID NO: 1331117 - RNA, 14 nt, Mycobacterium tuberculosis H37Rv
gccagcagccgcga

SEQ ID NO: 1331118 - RNA, 21 nt, Mycobacterium tuberculosis H37Rv
gccagcagcgcgggaucugag

SEQ ID NO: 1331119 - RNA, 16 nt, Mycobacterium tuberculosis H37Rv
gccagccacuccucgg

SEQ ID NO: 1331120 - RNA, 15 nt, Mycobacterium tuberculosis H37Rv
gccagccagcgggcg

SEQ ID NO: 1331121 - RNA, 14 nt, Mycobacterium tuberculosis H37Rv
gccagccaggcgaa

SEQ ID NO: 1331122 - RNA, 13 nt, Mycobacterium tuberculosis H37Rv
gccagcccagccg

SEQ ID NO: 1331123 - RNA, 14 nt, Mycobacterium tuberculosis H37Rv
gccagcccagccgc

SEQ ID NO: 1331124 - RNA, 15 nt, Mycobacterium tuberculosis H37Rv
gccagcccagccggg

SEQ ID NO: 1331125 - RNA, 14 nt, Mycobacterium tuberculosis H37Rv
gccagcccagcacg

SEQ ID NO: 1331126 - RNA, 15 nt, Mycobacterium tuberculosis H37Rv
gccagcccagcaggu

SEQ ID NO: 1331127 - RNA, 12 nt, Mycobacterium tuberculosis H37Rv
gccagcccagca

SEQ ID NO: 1331128 - RNA, 13 nt, Mycobacterium tuberculosis H37Rv
gccagcccaggcc

SEQ ID NO: 1331129 - RNA, 16 nt, Mycobacterium tuberculosis H37Rv
gccagcccaggguguc

SEQ ID NO: 1331130 - RNA, 14 nt, Mycobacterium tuberculosis H37Rv
gccagcagugcggu

SEQ ID NO: 1331131 - RNA, 18 nt, Mycobacterium tuberculosis H37Rv
gccagcauugaagaagcc

SEQ ID NO: 1331132 - RNA, 12 nt, Mycobacterium tuberculosis H37Rv
gccagcaugaca

SEQ ID NO: 1331133 - RNA, 17 nt, Mycobacterium tuberculosis H37Rv
gccagcaugucgggccg

SEQ ID NO: 1331134 - RNA, 18 nt, Mycobacterium tuberculosis H37Rv
gccagcaucggcagcagc

SEQ ID NO: 1331135 - RNA, 14 nt, Mycobacterium tuberculosis H37Rv
gccagcaucgugug

SEQ ID NO: 1331136 - RNA, 23 nt, Mycobacterium tuberculosis H37Rv
gccagcgcggcgcgcggggccuc

SEQ ID NO: 1331137 - RNA, 13 nt, Mycobacterium tuberculosis H37Rv
gccagcgcggcga

SEQ ID NO: 1331138 - RNA, 12 nt, Mycobacterium tuberculosis H37Rv
gccagcgcgcgc

SEQ ID NO: 1331139 - RNA, 18 nt, Mycobacterium tuberculosis H37Rv
gccagcgcgccacgagca

SEQ ID NO: 1331140 - RNA, 15 nt, Mycobacterium tuberculosis H37Rv
gccagcggccgggcg

SEQ ID NO: 1331141 - RNA, 15 nt, Mycobacterium tuberculosis H37Rv
gccagcggcgcgacc

SEQ ID NO: 1331142 - RNA, 17 nt, Mycobacterium tuberculosis H37Rv
gccagcggcccgucacc

SEQ ID NO: 1331143 - RNA, 23 nt, Mycobacterium tuberculosis H37Rv
gccagcggcccuaucuggcggcc

SEQ ID NO: 1331144 - RNA, 19 nt, Mycobacterium tuberculosis H37Rv
gccagcggcaauggccagc

SEQ ID NO: 1331145 - RNA, 10 nt, Mycobacterium tuberculosis H37Rv
gccagcggca

SEQ ID NO: 1331146 - RNA, 21 nt, Mycobacterium tuberculosis H37Rv
gccagcggcacacccaucacc

SEQ ID NO: 1331147 - RNA, 23 nt, Mycobacterium tuberculosis H37Rv
gccagcggcaauggccagcacca

SEQ ID NO: 1331148 - RNA, 19 nt, Mycobacterium tuberculosis H37Rv
gccagcggcacugaucugc

SEQ ID NO: 1331149 - RNA, 17 nt, Mycobacterium tuberculosis H37Rv
gccagcggcagcggcgu

SEQ ID NO: 1331150 - RNA, 13 nt, Mycobacterium tuberculosis H37Rv
gccagcucaacca

SEQ ID NO: 1331151 - RNA, 18 nt, Mycobacterium tuberculosis H37Rv
gccagcguuaggucgccg

SEQ ID NO: 1331152 - RNA, 19 nt, Mycobacterium tuberculosis H37Rv
gccagcuccgccugccgcu

SEQ ID NO: 1331153 - RNA, 16 nt, Mycobacterium tuberculosis H37Rv
gccagcuccucagcca

SEQ ID NO: 1331154 - RNA, 18 nt, Mycobacterium tuberculosis H37Rv
gccagcuccucagccacc

SEQ ID NO: 1331155 - RNA, 14 nt, Mycobacterium tuberculosis H37Rv
gccagcucccgggc

SEQ ID NO: 1331156 - RNA, 22 nt, Mycobacterium tuberculosis H37Rv
gccagcguaaauagcgcccugc

SEQ ID NO: 1331157 - RNA, 16 nt, Mycobacterium tuberculosis H37Rv
gccagcgucaacagcg

SEQ ID NO: 1331158 - RNA, 21 nt, Mycobacterium tuberculosis H37Rv
gccagcgucaacagcguggag

SEQ ID NO: 1331159 - RNA, 13 nt, Mycobacterium tuberculosis H37Rv
gccagcgguggac

SEQ ID NO: 1331160 - RNA, 17 nt, Mycobacterium tuberculosis H37Rv
gccagcgucaccucacc

SEQ ID NO: 1331161 - RNA, 24 nt, Mycobacterium tuberculosis H37Rv
gccagcgucagcuguuugccggcu

SEQ ID NO: 1331162 - RNA, 22 nt, Mycobacterium tuberculosis H37Rv
gccagcgucgacacacccacug

SEQ ID NO: 1331163 - RNA, 22 nt, Mycobacterium tuberculosis H37Rv
gccaggaugaagacgcgggucu

SEQ ID NO: 1331164 - RNA, 20 nt, Mycobacterium tuberculosis H37Rv
gccaggaugaauuuggugaa

SEQ ID NO: 1331165 - RNA, 21 nt, Mycobacterium tuberculosis H37Rv
gccaggacuggcaccgccagc

SEQ ID NO: 1331166 - RNA, 17 nt, Mycobacterium tuberculosis H37Rv
gccaggauugccgccgu

SEQ ID NO: 1331167 - RNA, 16 nt, Mycobacterium tuberculosis H37Rv
gccaggcaugccgccc

SEQ ID NO: 1331168 - RNA, 13 nt, Mycobacterium tuberculosis H37Rv
gccaggccgagcc

SEQ ID NO: 1331169 - RNA, 22 nt, Mycobacterium tuberculosis H37Rv
gccagcuugcggagccgccgcu

SEQ ID NO: 1331170 - RNA, 16 nt, Mycobacterium tuberculosis H37Rv
gccaggaacucggccc

SEQ ID NO: 1331171 - RNA, 13 nt, Mycobacterium tuberculosis H37Rv
gccaggaauugcc

SEQ ID NO: 1331172 - RNA, 14 nt, Mycobacterium tuberculosis H37Rv
gccaggaccaacug

SEQ ID NO: 1331173 - RNA, 22 nt, Mycobacterium tuberculosis H37Rv
gccaggacgacgccgacgauga

SEQ ID NO: 1331174 - RNA, 12 nt, Mycobacterium tuberculosis H37Rv
gccagcugggca

SEQ ID NO: 1331175 - RNA, 20 nt, Mycobacterium tuberculosis H37Rv
gccagcugacacccgcagcu

SEQ ID NO: 1331176 - RNA, 19 nt, Mycobacterium tuberculosis H37Rv
gccagcucgggcgcgcggc

SEQ ID NO: 1331177 - RNA, 14 nt, Mycobacterium tuberculosis H37Rv
gccagcugcagcag

SEQ ID NO: 1331178 - RNA, 17 nt, Mycobacterium tuberculosis H37Rv
gccagcugcagcagacc

SEQ ID NO: 1331179 - RNA, 14 nt, Mycobacterium tuberculosis H37Rv
gccagcugcgcagc

SEQ ID NO: 1331180 - RNA, 16 nt, Mycobacterium tuberculosis H37Rv
gccagcugcgcagcgc

SEQ ID NO: 1331181 - RNA, 20 nt, Mycobacterium tuberculosis H37Rv
gccagcucuucggggaugac

SEQ ID NO: 1331182 - RNA, 13 nt, Mycobacterium tuberculosis H37Rv
gcaaaaucgccca

SEQ ID NO: 1331183 - RNA, 17 nt, Mycobacterium tuberculosis H37Rv
gauuuugugucugcucg

SEQ ID NO: 1331184 - RNA, 22 nt, Mycobacterium tuberculosis H37Rv
gcaaagccagcgcagccaggcu

SEQ ID NO: 1331185 - RNA, 15 nt, Mycobacterium tuberculosis H37Rv
gcaaagacagcgcgg

SEQ ID NO: 1331186 - RNA, 20 nt, Mycobacterium tuberculosis H37Rv
gcaaacaagaucagacccag

SEQ ID NO: 1331187 - RNA, 20 nt, Mycobacterium tuberculosis H37Rv
gcaaaccacccgcaacacau

SEQ ID NO: 1331188 - RNA, 21 nt, Mycobacterium tuberculosis H37Rv
gcaaacauccacccgcgguga

SEQ ID NO: 1331189 - RNA, 19 nt, Mycobacterium tuberculosis H37Rv
gcaaacauccacccgcggu

SEQ ID NO: 1331190 - RNA, 16 nt, Mycobacterium tuberculosis H37Rv
gcaaacauccacccgc

SEQ ID NO: 1331191 - RNA, 12 nt, Mycobacterium tuberculosis H37Rv
gcaacaccaccu

SEQ ID NO: 1331192 - RNA, 18 nt, Mycobacterium tuberculosis H37Rv
gcaacacccgggcgaccu

SEQ ID NO: 1331193 - RNA, 12 nt, Mycobacterium tuberculosis H37Rv
gcaacacagcug

SEQ ID NO: 1331194 - RNA, 22 nt, Mycobacterium tuberculosis H37Rv
gcaacacaccgcggaaggccag

SEQ ID NO: 1331195 - RNA, 23 nt, Mycobacterium tuberculosis H37Rv
gcaacacaccgcggaaggccagc

SEQ ID NO: 1331196 - RNA, 22 nt, Mycobacterium tuberculosis H37Rv
gcaacacauuucuuugggcggc

SEQ ID NO: 1331197 - RNA, 18 nt, Mycobacterium tuberculosis H37Rv
gcaacaacgucugcagcc

SEQ ID NO: 1331198 - RNA, 21 nt, Mycobacterium tuberculosis H37Rv
gcaacaccgucggcagcagcg

SEQ ID NO: 1331199 - RNA, 19 nt, Mycobacterium tuberculosis H37Rv
gcaacacgccggcccggug

SEQ ID NO: 1331200 - RNA, 17 nt, Mycobacterium tuberculosis H37Rv
gcaacacgggcgccgga

SEQ ID NO: 1331201 - RNA, 15 nt, Mycobacterium tuberculosis H37Rv
gcaacacucauuccc

SEQ ID NO: 1331202 - RNA, 16 nt, Mycobacterium tuberculosis H37Rv
gcaacaugucaccugc

SEQ ID NO: 1331203 - RNA, 14 nt, Mycobacterium tuberculosis H37Rv
gcaacaucagcagg

SEQ ID NO: 1331204 - RNA, 15 nt, Mycobacterium tuberculosis H37Rv
gcaacaucagcagga

SEQ ID NO: 1331205 - RNA, 20 nt, Mycobacterium tuberculosis H37Rv
gcaaccauuagcgccaagcc

SEQ ID NO: 1331206 - RNA, 17 nt, Mycobacterium tuberculosis H37Rv
gcaaccaccggccgcgc

SEQ ID NO: 1331207 - RNA, 19 nt, Mycobacterium tuberculosis H37Rv
gcaaccaccucgugggcca

SEQ ID NO: 1331208 - RNA, 21 nt, Mycobacterium tuberculosis H37Rv
gcaacccugcccggcccgccc

SEQ ID NO: 1331209 - RNA, 17 nt, Mycobacterium tuberculosis H37Rv
gcaacccugcggugcag

SEQ ID NO: 1331210 - RNA, 11 nt, Mycobacterium tuberculosis H37Rv
gcaacccgguc

SEQ ID NO: 1331211 - RNA, 13 nt, Mycobacterium tuberculosis H37Rv
gcaaaugcggcgc

SEQ ID NO: 1331212 - RNA, 13 nt, Mycobacterium tuberculosis H37Rv
gcaaaucaagcac

SEQ ID NO: 1331213 - RNA, 12 nt, Mycobacterium tuberculosis H37Rv
gcaaaucaagca

SEQ ID NO: 1331214 - RNA, 19 nt, Mycobacterium tuberculosis H37Rv
gauucugggcuucaucggc

SEQ ID NO: 1331215 - RNA, 17 nt, Mycobacterium tuberculosis H37Rv
gauugaagcuggccacc

SEQ ID NO: 1331216 - RNA, 16 nt, Mycobacterium tuberculosis H37Rv
gauugaagcuggccac

SEQ ID NO: 1331217 - RNA, 16 nt, Mycobacterium tuberculosis H37Rv
gauucuucgaugaugc

SEQ ID NO: 1331218 - RNA, 20 nt, Mycobacterium tuberculosis H37Rv
gauugaguucggcggccagg

SEQ ID NO: 1331219 - RNA, 18 nt, Mycobacterium tuberculosis H37Rv
gauugccaggaccgcgcc

SEQ ID NO: 1331220 - RNA, 20 nt, Mycobacterium tuberculosis H37Rv
gauuggccaaccccauggcc

SEQ ID NO: 1331221 - RNA, 23 nt, Mycobacterium tuberculosis H37Rv
gauugcugcggcuuucagcgcuu

SEQ ID NO: 1331222 - RNA, 18 nt, Mycobacterium tuberculosis H37Rv
gauugcguagcgggucag

SEQ ID NO: 1331223 - RNA, 14 nt, Mycobacterium tuberculosis H37Rv
gauugcggcacgga

SEQ ID NO: 1331224 - RNA, 22 nt, Mycobacterium tuberculosis H37Rv
gauucgaagccgagcuccucca

SEQ ID NO: 1331225 - RNA, 17 nt, Mycobacterium tuberculosis H37Rv
gauuccucuucaggccc

SEQ ID NO: 1331226 - RNA, 15 nt, Mycobacterium tuberculosis H37Rv
gauucgguaucaggg

SEQ ID NO: 1331227 - RNA, 18 nt, Mycobacterium tuberculosis H37Rv
gauucgggcgccgcagcg

SEQ ID NO: 1331228 - RNA, 14 nt, Mycobacterium tuberculosis H37Rv
gauucggcccaucu

SEQ ID NO: 1331229 - RNA, 15 nt, Mycobacterium tuberculosis H37Rv
gauucgcggcagccg

SEQ ID NO: 1331230 - RNA, 14 nt, Mycobacterium tuberculosis H37Rv
gauucgcgcugcuu

SEQ ID NO: 1331231 - RNA, 12 nt, Mycobacterium tuberculosis H37Rv
gauucauggcgg

SEQ ID NO: 1331232 - RNA, 19 nt, Mycobacterium tuberculosis H37Rv
gauuccaccuuggccagac

SEQ ID NO: 1331233 - RNA, 13 nt, Mycobacterium tuberculosis H37Rv
gauucccagucca

SEQ ID NO: 1331234 - RNA, 15 nt, Mycobacterium tuberculosis H37Rv
gauucccaguccagg

SEQ ID NO: 1331235 - RNA, 20 nt, Mycobacterium tuberculosis H37Rv
gauuuauugagucggcuggu

SEQ ID NO: 1331236 - RNA, 15 nt, Mycobacterium tuberculosis H37Rv
gauuugguggcuggu

SEQ ID NO: 1331237 - RNA, 20 nt, Mycobacterium tuberculosis H37Rv
gauuucgggcgccgaccaca

SEQ ID NO: 1331238 - RNA, 20 nt, Mycobacterium tuberculosis H37Rv
gauuucuuuaaaccccuggc

SEQ ID NO: 1331239 - RNA, 18 nt, Mycobacterium tuberculosis H37Rv
gauggcgaaccucaccug

SEQ ID NO: 1331240 - RNA, 18 nt, Mycobacterium tuberculosis H37Rv
gauggccccgggcgguga

SEQ ID NO: 1331241 - RNA, 13 nt, Mycobacterium tuberculosis H37Rv
gauggccagguug

SEQ ID NO: 1331242 - RNA, 13 nt, Mycobacterium tuberculosis H37Rv
gauggccaucagc

SEQ ID NO: 1331243 - RNA, 15 nt, Mycobacterium tuberculosis H37Rv
gauggcggcgcguuc

SEQ ID NO: 1331244 - RNA, 19 nt, Mycobacterium tuberculosis H37Rv
gauggcgauagcggcgcuc

SEQ ID NO: 1331245 - RNA, 15 nt, Mycobacterium tuberculosis H37Rv
gauggcgauggcagg

SEQ ID NO: 1331246 - RNA, 20 nt, Mycobacterium tuberculosis H37Rv
gauggcgauggcaggggcga

SEQ ID NO: 1331247 - RNA, 23 nt, Mycobacterium tuberculosis H37Rv
gaugcuggcaaaguaucgcagca

SEQ ID NO: 1331248 - RNA, 13 nt, Mycobacterium tuberculosis H37Rv
gaugcugcgggcg

SEQ ID NO: 1331249 - RNA, 13 nt, Mycobacterium tuberculosis H37Rv
gaugcuucccgga

SEQ ID NO: 1331250 - RNA, 12 nt, Mycobacterium tuberculosis H37Rv
gauggcaccacc

SEQ ID NO: 1331251 - RNA, 13 nt, Mycobacterium tuberculosis H37Rv
gauggacaccacc

SEQ ID NO: 1331252 - RNA, 14 nt, Mycobacterium tuberculosis H37Rv
gauggacaccagcc

SEQ ID NO: 1331253 - RNA, 17 nt, Mycobacterium tuberculosis H37Rv
gauggaccgcacugaca

SEQ ID NO: 1331254 - RNA, 21 nt, Mycobacterium tuberculosis H37Rv
gaugguggccgccaccuccca

SEQ ID NO: 1331255 - RNA, 17 nt, Mycobacterium tuberculosis H37Rv
gaugguggucaccacca

SEQ ID NO: 1331256 - RNA, 23 nt, Mycobacterium tuberculosis H37Rv
gaugguguacugcugcuugagcu

SEQ ID NO: 1331257 - RNA, 21 nt, Mycobacterium tuberculosis H37Rv
gauguccaggagugcgggcau

SEQ ID NO: 1331258 - RNA, 17 nt, Mycobacterium tuberculosis H37Rv
gauguccucgacaccca

SEQ ID NO: 1331259 - RNA, 14 nt, Mycobacterium tuberculosis H37Rv
gauguccucgaugc

SEQ ID NO: 1331260 - RNA, 19 nt, Mycobacterium tuberculosis H37Rv
gauguccucgaugcgggcg

SEQ ID NO: 1331261 - RNA, 19 nt, Mycobacterium tuberculosis H37Rv
gauguccgacgccaccgcc

SEQ ID NO: 1331262 - RNA, 13 nt, Mycobacterium tuberculosis H37Rv
gauguccgcagca

SEQ ID NO: 1331263 - RNA, 14 nt, Mycobacterium tuberculosis H37Rv
gauguccgcagcac

SEQ ID NO: 1331264 - RNA, 13 nt, Mycobacterium tuberculosis H37Rv
gauguccaggagu

SEQ ID NO: 1331265 - RNA, 17 nt, Mycobacterium tuberculosis H37Rv
gauguaguccucggugg

SEQ ID NO: 1331266 - RNA, 18 nt, Mycobacterium tuberculosis H37Rv
gaugggccgguuccucag

SEQ ID NO: 1331267 - RNA, 21 nt, Mycobacterium tuberculosis H37Rv
gaugggcgaauugcaggacgc

SEQ ID NO: 1331268 - RNA, 17 nt, Mycobacterium tuberculosis H37Rv
gaugggcaugguggugg

SEQ ID NO: 1331269 - RNA, 15 nt, Mycobacterium tuberculosis H37Rv
gaugggcaugguggu

SEQ ID NO: 1331270 - RNA, 13 nt, Mycobacterium tuberculosis H37Rv
gaugggccaggcg

SEQ ID NO: 1331271 - RNA, 21 nt, Mycobacterium tuberculosis H37Rv
gaugggccaggcgcccagcac

SEQ ID NO: 1331272 - RNA, 21 nt, Mycobacterium tuberculosis H37Rv
gaugggagcccggcggcccga

SEQ ID NO: 1331273 - RNA, 23 nt, Mycobacterium tuberculosis H37Rv
gaugggaccuugaucgagcaggg

SEQ ID NO: 1331274 - RNA, 19 nt, Mycobacterium tuberculosis H37Rv
gauggucaccgucugcacc

SEQ ID NO: 1331275 - RNA, 23 nt, Mycobacterium tuberculosis H37Rv
gauggucucccggcugaugccug

SEQ ID NO: 1331276 - RNA, 15 nt, Mycobacterium tuberculosis H37Rv
gauggugaccagcag

SEQ ID NO: 1331277 - RNA, 17 nt, Mycobacterium tuberculosis H37Rv
gauggugaccagcaggc

SEQ ID NO: 1331278 - RNA, 21 nt, Mycobacterium tuberculosis H37Rv
gauggucgugaucuucugccu

SEQ ID NO: 1331279 - RNA, 19 nt, Mycobacterium tuberculosis H37Rv
gauggucgagagcaccgca

SEQ ID NO: 1331280 - RNA, 14 nt, Mycobacterium tuberculosis H37Rv
gauggucauccagc

SEQ ID NO: 1331281 - RNA, 20 nt, Mycobacterium tuberculosis H37Rv
gauggucauccagccagcaa

SEQ ID NO: 1331282 - RNA, 17 nt, Mycobacterium tuberculosis H37Rv
gaugguaugcccgccgu

SEQ ID NO: 1331283 - RNA, 17 nt, Mycobacterium tuberculosis H37Rv
gaugugcacggugugca

SEQ ID NO: 1331284 - RNA, 16 nt, Mycobacterium tuberculosis H37Rv
gaugugcgccaccucg

SEQ ID NO: 1331285 - RNA, 14 nt, Mycobacterium tuberculosis H37Rv
gaugugcucgguac

SEQ ID NO: 1331286 - RNA, 19 nt, Mycobacterium tuberculosis H37Rv
gauguuacacuaaccgaau

SEQ ID NO: 1331287 - RNA, 16 nt, Mycobacterium tuberculosis H37Rv
gauguguucuccugcc

SEQ ID NO: 1331288 - RNA, 18 nt, Mycobacterium tuberculosis H37Rv
gaugucgucgaccaggcc

SEQ ID NO: 1331289 - RNA, 24 nt, Mycobacterium tuberculosis H37Rv
gaugucucggcaccacagugaaau

SEQ ID NO: 1331290 - RNA, 14 nt, Mycobacterium tuberculosis H37Rv
gaugucgacgacaa

SEQ ID NO: 1331291 - RNA, 17 nt, Mycobacterium tuberculosis H37Rv
gauguccgcggccacca

SEQ ID NO: 1331292 - RNA, 20 nt, Mycobacterium tuberculosis H37Rv
gauguccccggcggcagcau

SEQ ID NO: 1331293 - RNA, 19 nt, Mycobacterium tuberculosis H37Rv
gauguucagcgccacgucc

SEQ ID NO: 1331294 - RNA, 17 nt, Mycobacterium tuberculosis H37Rv
gauuacgccggaggcau

SEQ ID NO: 1331295 - RNA, 16 nt, Mycobacterium tuberculosis H37Rv
gauuaccagcggcacc

SEQ ID NO: 1331296 - RNA, 19 nt, Mycobacterium tuberculosis H37Rv
gaugaucgguucgggacgc

SEQ ID NO: 1331297 - RNA, 22 nt, Mycobacterium tuberculosis H37Rv
gaugaucgcgaacaucgccagc

SEQ ID NO: 1331298 - RNA, 14 nt, Mycobacterium tuberculosis H37Rv
gaugaucagcgagg

SEQ ID NO: 1331299 - RNA, 22 nt, Mycobacterium tuberculosis H37Rv
aaagccuaguacgccgagcaga

SEQ ID NO: 1331300 - RNA, 22 nt, Mycobacterium tuberculosis H37Rv
aaagccuaguccuggcucggca

SEQ ID NO: 1331301 - RNA, 14 nt, Mycobacterium tuberculosis H37Rv
aaagccgugccagc

SEQ ID NO: 1331302 - RNA, 22 nt, Mycobacterium tuberculosis H37Rv
gaugaugccggcguuguaguug

SEQ ID NO: 1331303 - RNA, 16 nt, Mycobacterium tuberculosis H37Rv
gaugaugacggcggcc

SEQ ID NO: 1331304 - RNA, 20 nt, Mycobacterium tuberculosis H37Rv
gaugauggcgcgaucggugc

SEQ ID NO: 1331305 - RNA, 17 nt, Mycobacterium tuberculosis H37Rv
gaugaugcaacgccaaa

SEQ ID NO: 1331306 - RNA, 14 nt, Mycobacterium tuberculosis H37Rv
gaugaugccggcgu

SEQ ID NO: 1331307 - RNA, 22 nt, Mycobacterium tuberculosis H37Rv
gaugaggcgccauuugggccca

SEQ ID NO: 1331308 - RNA, 14 nt, Mycobacterium tuberculosis H37Rv
gaugaggcccauca

SEQ ID NO: 1331309 - RNA, 14 nt, Mycobacterium tuberculosis H37Rv
gaugagcucguuca

SEQ ID NO: 1331310 - RNA, 17 nt, Mycobacterium tuberculosis H37Rv
gaugagcgcuucgaggu

SEQ ID NO: 1331311 - RNA, 20 nt, Mycobacterium tuberculosis H37Rv
gaugagcaugcccagcgcac

SEQ ID NO: 1331312 - RNA, 15 nt, Mycobacterium tuberculosis H37Rv
gaugagccgcagaug

SEQ ID NO: 1331313 - RNA, 19 nt, Mycobacterium tuberculosis H37Rv
gaugagcaugcccagcgca

SEQ ID NO: 1331314 - RNA, 20 nt, Mycobacterium tuberculosis H37Rv
gaugaccgcguagagcagca

SEQ ID NO: 1331315 - RNA, 21 nt, Mycobacterium tuberculosis H37Rv
gaugacgaacaagaaaagcag

SEQ ID NO: 1331316 - RNA, 16 nt, Mycobacterium tuberculosis H37Rv
gaugacgcagucgccc

SEQ ID NO: 1331317 - RNA, 17 nt, Mycobacterium tuberculosis H37Rv
gaugacggugccgaccg

SEQ ID NO: 1331318 - RNA, 15 nt, Mycobacterium tuberculosis H37Rv
gaugacuagccugcu

SEQ ID NO: 1331319 - RNA, 17 nt, Mycobacterium tuberculosis H37Rv
gaugacgccgucggcgc

SEQ ID NO: 1331320 - RNA, 13 nt, Mycobacterium tuberculosis H37Rv
gaugaccgcagca

SEQ ID NO: 1331321 - RNA, 13 nt, Mycobacterium tuberculosis H37Rv
gaugaccagugau

SEQ ID NO: 1331322 - RNA, 19 nt, Mycobacterium tuberculosis H37Rv
gaugaccagggucugcuca

SEQ ID NO: 1331323 - RNA, 17 nt, Mycobacterium tuberculosis H37Rv
gaugacccacugcaggc

SEQ ID NO: 1331324 - RNA, 19 nt, Mycobacterium tuberculosis H37Rv
gaugaccgaaccuggucuu

SEQ ID NO: 1331325 - RNA, 15 nt, Mycobacterium tuberculosis H37Rv
gaucuugguguuggu

SEQ ID NO: 1331326 - RNA, 17 nt, Mycobacterium tuberculosis H37Rv
gaucuugacgaaaucca

SEQ ID NO: 1331327 - RNA, 14 nt, Mycobacterium tuberculosis H37Rv
gaucuuaggcacuc

SEQ ID NO: 1331328 - RNA, 20 nt, Mycobacterium tuberculosis H37Rv
gaugaaggugacgacgaggg

SEQ ID NO: 1331329 - RNA, 21 nt, Mycobacterium tuberculosis H37Rv
gaugacaggcuuggcaugcgg

SEQ ID NO: 1331330 - RNA, 20 nt, Mycobacterium tuberculosis H37Rv
gaugaaccacggcaggcagg

SEQ ID NO: 1331331 - RNA, 12 nt, Mycobacterium tuberculosis H37Rv
gaugaaccaggc

SEQ ID NO: 1331332 - RNA, 23 nt, Mycobacterium tuberculosis H37Rv
gaugcgguaucggucgacuggga

SEQ ID NO: 1331333 - RNA, 18 nt, Mycobacterium tuberculosis H37Rv
gaugcggugcggaucaga

SEQ ID NO: 1331334 - RNA, 13 nt, Mycobacterium tuberculosis H37Rv
gaugcgggcggca

SEQ ID NO: 1331335 - RNA, 14 nt, Mycobacterium tuberculosis H37Rv
gaugcgggcuguga

SEQ ID NO: 1331336 - RNA, 11 nt, Mycobacterium tuberculosis H37Rv
gaugcgggcaa

SEQ ID NO: 1331337 - RNA, 22 nt, Mycobacterium tuberculosis H37Rv
gaugcgcugcucacgcagcagu

SEQ ID NO: 1331338 - RNA, 14 nt, Mycobacterium tuberculosis H37Rv
gaugcgcuaggugc

SEQ ID NO: 1331339 - RNA, 17 nt, Mycobacterium tuberculosis H37Rv
gaugcgcgggugguuca

SEQ ID NO: 1331340 - RNA, 18 nt, Mycobacterium tuberculosis H37Rv
gaugcggacucagcggcg

SEQ ID NO: 1331341 - RNA, 19 nt, Mycobacterium tuberculosis H37Rv
gaugcggacucagcggcgu

SEQ ID NO: 1331342 - RNA, 20 nt, Mycobacterium tuberculosis H37Rv
gaugcgcugcucacgcagca

SEQ ID NO: 1331343 - RNA, 15 nt, Mycobacterium tuberculosis H37Rv
gaugcgugguuggcc

SEQ ID NO: 1331344 - RNA, 15 nt, Mycobacterium tuberculosis H37Rv
gaugcgugccgaccc

SEQ ID NO: 1331345 - RNA, 18 nt, Mycobacterium tuberculosis H37Rv
gaugcgugccgacccgcu

SEQ ID NO: 1331346 - RNA, 24 nt, Mycobacterium tuberculosis H37Rv
gaugcguuccgcgacagcggcguc

SEQ ID NO: 1331347 - RNA, 23 nt, Mycobacterium tuberculosis H37Rv
gaugcguucgggcuccagcagcg

SEQ ID NO: 1331348 - RNA, 18 nt, Mycobacterium tuberculosis H37Rv
gaugcguuggccccagga

SEQ ID NO: 1331349 - RNA, 22 nt, Mycobacterium tuberculosis H37Rv
gaugcugagcgccaggccgcac

SEQ ID NO: 1331350 - RNA, 19 nt, Mycobacterium tuberculosis H37Rv
gaugccuucguagcggccg

SEQ ID NO: 1331351 - RNA, 12 nt, Mycobacterium tuberculosis H37Rv
gaugccguaggc

SEQ ID NO: 1331352 - RNA, 15 nt, Mycobacterium tuberculosis H37Rv
gaugccguaggcggc

SEQ ID NO: 1331353 - RNA, 17 nt, Mycobacterium tuberculosis H37Rv
gaugccgugcccggugc

SEQ ID NO: 1331354 - RNA, 15 nt, Mycobacterium tuberculosis H37Rv
gaugccggaaagcau

SEQ ID NO: 1331355 - RNA, 16 nt, Mycobacterium tuberculosis H37Rv
gaugcgaaacaucucg

SEQ ID NO: 1331356 - RNA, 22 nt, Mycobacterium tuberculosis H37Rv
gaugcgacgaaccucggcggga

SEQ ID NO: 1331357 - RNA, 16 nt, Mycobacterium tuberculosis H37Rv
gaugcgccaggcugaa

SEQ ID NO: 1331358 - RNA, 17 nt, Mycobacterium tuberculosis H37Rv
gaugcgccaggcugaag

SEQ ID NO: 1331359 - RNA, 22 nt, Mycobacterium tuberculosis H37Rv
gaugcgcacucccggcucggcc

SEQ ID NO: 1331360 - RNA, 12 nt, Mycobacterium tuberculosis H37Rv
gaugcgccgcac

SEQ ID NO: 1331361 - RNA, 21 nt, Mycobacterium tuberculosis H37Rv
gaugccgcccgugagauccuc

SEQ ID NO: 1331362 - RNA, 12 nt, Mycobacterium tuberculosis H37Rv
gaugccgcccgu

SEQ ID NO: 1331363 - RNA, 15 nt, Mycobacterium tuberculosis H37Rv
gaugccggacgccau

SEQ ID NO: 1331364 - RNA, 18 nt, Mycobacterium tuberculosis H37Rv
gaugccgccggcaccgcc

SEQ ID NO: 1331365 - RNA, 14 nt, Mycobacterium tuberculosis H37Rv
gaugccgccggccc

SEQ ID NO: 1331366 - RNA, 18 nt, Mycobacterium tuberculosis H37Rv
gaugccguaggcggccag

SEQ ID NO: 1331367 - RNA, 21 nt, Mycobacterium tuberculosis H37Rv
gaugccguaguaaggagccgg

SEQ ID NO: 1331368 - RNA, 20 nt, Mycobacterium tuberculosis H37Rv
gaugccgucuuugucacgca

SEQ ID NO: 1331369 - RNA, 14 nt, Mycobacterium tuberculosis H37Rv
gaugccgggugugu

SEQ ID NO: 1331370 - RNA, 17 nt, Mycobacterium tuberculosis H37Rv
gaugccggcgagggcca

SEQ ID NO: 1331371 - RNA, 16 nt, Mycobacterium tuberculosis H37Rv
gaugccggcgagggcc

SEQ ID NO: 1331372 - RNA, 20 nt, Mycobacterium tuberculosis H37Rv
gaugccggcgaaggccagca

SEQ ID NO: 1331373 - RNA, 22 nt, Mycobacterium tuberculosis H37Rv
gaugccggcuagauaacccaac

SEQ ID NO: 1331374 - RNA, 23 nt, Mycobacterium tuberculosis H37Rv
gaugccggcgccggcccgcagcc

SEQ ID NO: 1331375 - RNA, 15 nt, Mycobacterium tuberculosis H37Rv
gaugccccacggugc

SEQ ID NO: 1331376 - RNA, 14 nt, Mycobacterium tuberculosis H37Rv
gaugcccagcagga

SEQ ID NO: 1331377 - RNA, 20 nt, Mycobacterium tuberculosis H37Rv
gaugcccacggugccggcac

SEQ ID NO: 1331378 - RNA, 13 nt, Mycobacterium tuberculosis H37Rv
gaugcccagcgcc

SEQ ID NO: 1331379 - RNA, 19 nt, Mycobacterium tuberculosis H37Rv
gaugcccggcaucgcgauc

SEQ ID NO: 1331380 - RNA, 21 nt, Mycobacterium tuberculosis H37Rv
gaugcccguagacgccgagca

SEQ ID NO: 1331381 - RNA, 21 nt, Mycobacterium tuberculosis H37Rv
gaugcccucgauggccaggcu

SEQ ID NO: 1331382 - RNA, 16 nt, Mycobacterium tuberculosis H37Rv
gaugccgacggcgggc

SEQ ID NO: 1331383 - RNA, 15 nt, Mycobacterium tuberculosis H37Rv
gaugccgaagccccc

SEQ ID NO: 1331384 - RNA, 23 nt, Mycobacterium tuberculosis H37Rv
gaugccgaacuccgcggaaccca

SEQ ID NO: 1331385 - RNA, 21 nt, Mycobacterium tuberculosis H37Rv
gaugcaucccaacgagaugug

SEQ ID NO: 1331386 - RNA, 14 nt, Mycobacterium tuberculosis H37Rv
gaugauguggugug

SEQ ID NO: 1331387 - RNA, 15 nt, Mycobacterium tuberculosis H37Rv
aaagcgacgagcagc

SEQ ID NO: 1331388 - RNA, 14 nt, Mycobacterium tuberculosis H37Rv
aaagcgacagcgcg

SEQ ID NO: 1331389 - RNA, 17 nt, Mycobacterium tuberculosis H37Rv
gaugcagcgggucgccg

SEQ ID NO: 1331390 - RNA, 18 nt, Mycobacterium tuberculosis H37Rv
gaugcaacgccaaaaugg

SEQ ID NO: 1331391 - RNA, 21 nt, Mycobacterium tuberculosis H37Rv
gauacucgaguggcgaacggg

SEQ ID NO: 1331392 - RNA, 16 nt, Mycobacterium tuberculosis H37Rv
gauacucggcgacugc

SEQ ID NO: 1331393 - RNA, 22 nt, Mycobacterium tuberculosis H37Rv
gauacucgucgucggcaggcag

SEQ ID NO: 1331394 - RNA, 18 nt, Mycobacterium tuberculosis H37Rv
gauacggccaccaggugc

SEQ ID NO: 1331395 - RNA, 13 nt, Mycobacterium tuberculosis H37Rv
gauacgagcugua

SEQ ID NO: 1331396 - RNA, 14 nt, Mycobacterium tuberculosis H37Rv
gauaggccccgagg

SEQ ID NO: 1331397 - RNA, 22 nt, Mycobacterium tuberculosis H37Rv
gauagcaacggugcucuucgau

SEQ ID NO: 1331398 - RNA, 18 nt, Mycobacterium tuberculosis H37Rv
gauaggucgggcaugacg

SEQ ID NO: 1331399 - RNA, 14 nt, Mycobacterium tuberculosis H37Rv
gauagucgccgccg

SEQ ID NO: 1331400 - RNA, 21 nt, Mycobacterium tuberculosis H37Rv
gauagucgccgucgccccacc

SEQ ID NO: 1331401 - RNA, 22 nt, Mycobacterium tuberculosis H37Rv
gauagucgccgucgccccacca

SEQ ID NO: 1331402 - RNA, 17 nt, Mycobacterium tuberculosis H37Rv
gauauagggcuccucgu

SEQ ID NO: 1331403 - RNA, 20 nt, Mycobacterium tuberculosis H37Rv
gauaugacggcagaccaugg

SEQ ID NO: 1331404 - RNA, 14 nt, Mycobacterium tuberculosis H37Rv
gaucaaccccccgg

SEQ ID NO: 1331405 - RNA, 19 nt, Mycobacterium tuberculosis H37Rv
gaucaacucgugcgggcag

SEQ ID NO: 1331406 - RNA, 17 nt, Mycobacterium tuberculosis H37Rv
gaucaaccgggucagcc

SEQ ID NO: 1331407 - RNA, 17 nt, Mycobacterium tuberculosis H37Rv
gauauggucaccaagac

SEQ ID NO: 1331408 - RNA, 22 nt, Mycobacterium tuberculosis H37Rv
gaucaagcuggcccgcucauac

SEQ ID NO: 1331409 - RNA, 22 nt, Mycobacterium tuberculosis H37Rv
gaucaccgagucgacggccagu

SEQ ID NO: 1331410 - RNA, 15 nt, Mycobacterium tuberculosis H37Rv
gaucaccgccaccac

SEQ ID NO: 1331411 - RNA, 15 nt, Mycobacterium tuberculosis H37Rv
gaucaccccgccaug

SEQ ID NO: 1331412 - RNA, 22 nt, Mycobacterium tuberculosis H37Rv
gaucagcaacggcagcgaggcc

SEQ ID NO: 1331413 - RNA, 17 nt, Mycobacterium tuberculosis H37Rv
gaucagcagcggcgacc

SEQ ID NO: 1331414 - RNA, 14 nt, Mycobacterium tuberculosis H37Rv
gaucagcagccgcc

SEQ ID NO: 1331415 - RNA, 19 nt, Mycobacterium tuberculosis H37Rv
gaucagcaacucggccacg

SEQ ID NO: 1331416 - RNA, 16 nt, Mycobacterium tuberculosis H37Rv
gaucagaacgcggccu

SEQ ID NO: 1331417 - RNA, 23 nt, Mycobacterium tuberculosis H37Rv
gaucacggcgggaugcagcugcc

SEQ ID NO: 1331418 - RNA, 13 nt, Mycobacterium tuberculosis H37Rv
gaucacggcggcc

SEQ ID NO: 1331419 - RNA, 15 nt, Mycobacterium tuberculosis H37Rv
gaucacggagcucuu

SEQ ID NO: 1331420 - RNA, 23 nt, Mycobacterium tuberculosis H37Rv
gaucaccguugcguuggcgccac

SEQ ID NO: 1331421 - RNA, 20 nt, Mycobacterium tuberculosis H37Rv
gaucaccuuggcaagcacgc

SEQ ID NO: 1331422 - RNA, 18 nt, Mycobacterium tuberculosis H37Rv
gaucaccgcgcccgccgc

SEQ ID NO: 1331423 - RNA, 21 nt, Mycobacterium tuberculosis H37Rv
gaucaccgcguaguccaggcc

SEQ ID NO: 1331424 - RNA, 18 nt, Mycobacterium tuberculosis H37Rv
gaucaguucguggcuggc

SEQ ID NO: 1331425 - RNA, 19 nt, Mycobacterium tuberculosis H37Rv
gaucaggccuugggauagg

SEQ ID NO: 1331426 - RNA, 23 nt, Mycobacterium tuberculosis H37Rv
gaucaggcgggcaacgcagcacg

SEQ ID NO: 1331427 - RNA, 22 nt, Mycobacterium tuberculosis H37Rv
gaucagggugucgaagagcagg

SEQ ID NO: 1331428 - RNA, 16 nt, Mycobacterium tuberculosis H37Rv
gaucaggucgccgaga

SEQ ID NO: 1331429 - RNA, 20 nt, Mycobacterium tuberculosis H37Rv
gaucagccgggugcgcaccc

SEQ ID NO: 1331430 - RNA, 18 nt, Mycobacterium tuberculosis H37Rv
gaucagcgaguagccgcu

SEQ ID NO: 1331431 - RNA, 15 nt, Mycobacterium tuberculosis H37Rv
gaucagcgcggcgcc

SEQ ID NO: 1331432 - RNA, 16 nt, Mycobacterium tuberculosis H37Rv
gaucagcgcggcgccc

SEQ ID NO: 1331433 - RNA, 17 nt, Mycobacterium tuberculosis H37Rv
gaucagcgugucgccga

SEQ ID NO: 1331434 - RNA, 20 nt, Mycobacterium tuberculosis H37Rv
gaucagcgugaucugcaggg

SEQ ID NO: 1331435 - RNA, 21 nt, Mycobacterium tuberculosis H37Rv
gaucagcgucgguggcagcgg

SEQ ID NO: 1331436 - RNA, 19 nt, Mycobacterium tuberculosis H37Rv
gaucagcguauuggacgcu

SEQ ID NO: 1331437 - RNA, 15 nt, Mycobacterium tuberculosis H37Rv
gaucaggccccacac

SEQ ID NO: 1331438 - RNA, 17 nt, Mycobacterium tuberculosis H37Rv
gaucaggccgaugacga

SEQ ID NO: 1331439 - RNA, 16 nt, Mycobacterium tuberculosis H37Rv
gaucauggcggcagca

SEQ ID NO: 1331440 - RNA, 21 nt, Mycobacterium tuberculosis H37Rv
gaucauguccaucgcgcggcu

SEQ ID NO: 1331441 - RNA, 17 nt, Mycobacterium tuberculosis H37Rv
gaucaucauauccgccc

SEQ ID NO: 1331442 - RNA, 21 nt, Mycobacterium tuberculosis H37Rv
gaucaucgacgauuccaggua

SEQ ID NO: 1331443 - RNA, 17 nt, Mycobacterium tuberculosis H37Rv
gaucaucuggcugguga

SEQ ID NO: 1331444 - RNA, 17 nt, Mycobacterium tuberculosis H37Rv
gaucaucgggagccgca

SEQ ID NO: 1331445 - RNA, 20 nt, Mycobacterium tuberculosis H37Rv
gaucccggccgggucgagug

SEQ ID NO: 1331446 - RNA, 20 nt, Mycobacterium tuberculosis H37Rv
gaucccguucggggccccgc

SEQ ID NO: 1331447 - RNA, 18 nt, Mycobacterium tuberculosis H37Rv
gaucccgugguggcgcca

SEQ ID NO: 1331448 - RNA, 22 nt, Mycobacterium tuberculosis H37Rv
gaucccggucuagcuggguagc

SEQ ID NO: 1331449 - RNA, 21 nt, Mycobacterium tuberculosis H37Rv
gaucccggucuuuaauccagc

SEQ ID NO: 1331450 - RNA, 13 nt, Mycobacterium tuberculosis H37Rv
gaucccggccagc

SEQ ID NO: 1331451 - RNA, 16 nt, Mycobacterium tuberculosis H37Rv
gaucccgaucgcgcug

SEQ ID NO: 1331452 - RNA, 20 nt, Mycobacterium tuberculosis H37Rv
gauccgcacccggccgcgca

SEQ ID NO: 1331453 - RNA, 16 nt, Mycobacterium tuberculosis H37Rv
gauccgccugccgacg

SEQ ID NO: 1331454 - RNA, 16 nt, Mycobacterium tuberculosis H37Rv
gaucccugugccagca

SEQ ID NO: 1331455 - RNA, 14 nt, Mycobacterium tuberculosis H37Rv
gauccggccagagu

SEQ ID NO: 1331456 - RNA, 23 nt, Mycobacterium tuberculosis H37Rv
gauccggccgccaacuucaccac

SEQ ID NO: 1331457 - RNA, 16 nt, Mycobacterium tuberculosis H37Rv
gauccggcgccauucg

SEQ ID NO: 1331458 - RNA, 13 nt, Mycobacterium tuberculosis H37Rv
gauccggcggcag

SEQ ID NO: 1331459 - RNA, 18 nt, Mycobacterium tuberculosis H37Rv
gauccggcagcagccggc

SEQ ID NO: 1331460 - RNA, 19 nt, Mycobacterium tuberculosis H37Rv
gauccggcagcagccggcg

SEQ ID NO: 1331461 - RNA, 17 nt, Mycobacterium tuberculosis H37Rv
gauccggaucccaccac

SEQ ID NO: 1331462 - RNA, 16 nt, Mycobacterium tuberculosis H37Rv
gauccgcuagccccga

SEQ ID NO: 1331463 - RNA, 20 nt, Mycobacterium tuberculosis H37Rv
gauccgauuggcgaucuugc

SEQ ID NO: 1331464 - RNA, 20 nt, Mycobacterium tuberculosis H37Rv
gauccaggacuucugcugca

SEQ ID NO: 1331465 - RNA, 12 nt, Mycobacterium tuberculosis H37Rv
gauccagcugua

SEQ ID NO: 1331466 - RNA, 18 nt, Mycobacterium tuberculosis H37Rv
gauccagggagcggcugc

SEQ ID NO: 1331467 - RNA, 23 nt, Mycobacterium tuberculosis H37Rv
gauccagggccuucgggccagga

SEQ ID NO: 1331468 - RNA, 17 nt, Mycobacterium tuberculosis H37Rv
gaucauugcacccaccc

SEQ ID NO: 1331469 - RNA, 17 nt, Mycobacterium tuberculosis H37Rv
gauccagcccaugcgcc

SEQ ID NO: 1331470 - RNA, 16 nt, Mycobacterium tuberculosis H37Rv
gauccaccaagcucgc

SEQ ID NO: 1331471 - RNA, 18 nt, Mycobacterium tuberculosis H37Rv
gaucgaccaauucgaccg

SEQ ID NO: 1331472 - RNA, 15 nt, Mycobacterium tuberculosis H37Rv
gaucgacgccgccac

SEQ ID NO: 1331473 - RNA, 19 nt, Mycobacterium tuberculosis H37Rv
gaucgagcaguuccagcuc

SEQ ID NO: 1331474 - RNA, 13 nt, Mycobacterium tuberculosis H37Rv
gaucgagcagggu

SEQ ID NO: 1331475 - RNA, 20 nt, Mycobacterium tuberculosis H37Rv
gaucgagcagggugaccagg

SEQ ID NO: 1331476 - RNA, 23 nt, Mycobacterium tuberculosis H37Rv
gaucgauccggcuccacccccac

SEQ ID NO: 1331477 - RNA, 21 nt, Mycobacterium tuberculosis H37Rv
gaucgauuuggaucggcugcg

SEQ ID NO: 1331478 - RNA, 20 nt, Mycobacterium tuberculosis H37Rv
gaucgaucugcgggcggguc

SEQ ID NO: 1331479 - RNA, 19 nt, Mycobacterium tuberculosis H37Rv
gaucgcagggaucaccccg

SEQ ID NO: 1331480 - RNA, 14 nt, Mycobacterium tuberculosis H37Rv
gauccguggccaaa

SEQ ID NO: 1331481 - RNA, 15 nt, Mycobacterium tuberculosis H37Rv
gauccgugucgcaga

SEQ ID NO: 1331482 - RNA, 13 nt, Mycobacterium tuberculosis H37Rv
gauccgguggugg

SEQ ID NO: 1331483 - RNA, 13 nt, Mycobacterium tuberculosis H37Rv
gauccggguggcg

SEQ ID NO: 1331484 - RNA, 15 nt, Mycobacterium tuberculosis H37Rv
gauccucgcccgcac

SEQ ID NO: 1331485 - RNA, 14 nt, Mycobacterium tuberculosis H37Rv
aaagcccggcggca

SEQ ID NO: 1331486 - RNA, 16 nt, Mycobacterium tuberculosis H37Rv
aaagcccgacaugaau

SEQ ID NO: 1331487 - RNA, 19 nt, Mycobacterium tuberculosis H37Rv
aaagccagcgcagccaggc

SEQ ID NO: 1331488 - RNA, 17 nt, Mycobacterium tuberculosis H37Rv
gaucgcccugacaccca

SEQ ID NO: 1331489 - RNA, 18 nt, Mycobacterium tuberculosis H37Rv
gaucgccccagccaugcu

SEQ ID NO: 1331490 - RNA, 23 nt, Mycobacterium tuberculosis H37Rv
gaucgcccgaguugaagaagccg

SEQ ID NO: 1331491 - RNA, 12 nt, Mycobacterium tuberculosis H37Rv
gaucgccaccgg

SEQ ID NO: 1331492 - RNA, 16 nt, Mycobacterium tuberculosis H37Rv
gaucgccgccggcgcc

SEQ ID NO: 1331493 - RNA, 20 nt, Mycobacterium tuberculosis H37Rv
gaucgccgagcaggucggca

SEQ ID NO: 1331494 - RNA, 23 nt, Mycobacterium tuberculosis H37Rv
gaucgccggcuucgcccagagcc

SEQ ID NO: 1331495 - RNA, 18 nt, Mycobacterium tuberculosis H37Rv
gaucgccggugaacaggg

SEQ ID NO: 1331496 - RNA, 21 nt, Mycobacterium tuberculosis H37Rv
gaucgcgaacaucgccagcgc

SEQ ID NO: 1331497 - RNA, 15 nt, Mycobacterium tuberculosis H37Rv
gaucgcgaacuucca

SEQ ID NO: 1331498 - RNA, 14 nt, Mycobacterium tuberculosis H37Rv
gaucggaagaaacg

SEQ ID NO: 1331499 - RNA, 20 nt, Mycobacterium tuberculosis H37Rv
gaucggaacgaucauuccug

SEQ ID NO: 1331500 - RNA, 17 nt, Mycobacterium tuberculosis H37Rv
gaucgcgugccacagca

SEQ ID NO: 1331501 - RNA, 17 nt, Mycobacterium tuberculosis H37Rv
gaucggauggcggccac

SEQ ID NO: 1331502 - RNA, 11 nt, Mycobacterium tuberculosis H37Rv
gaucggcacua

SEQ ID NO: 1331503 - RNA, 17 nt, Mycobacterium tuberculosis H37Rv
gaucggcaacggcggcg

SEQ ID NO: 1331504 - RNA, 21 nt, Mycobacterium tuberculosis H37Rv
gaucgcggucuugacaccgcc

SEQ ID NO: 1331505 - RNA, 14 nt, Mycobacterium tuberculosis H37Rv
gaucgcgcgagcga

SEQ ID NO: 1331506 - RNA, 14 nt, Mycobacterium tuberculosis H37Rv
gaucgcgcccugcg

SEQ ID NO: 1331507 - RNA, 18 nt, Mycobacterium tuberculosis H37Rv
gaucgcggcgcccaggaa

SEQ ID NO: 1331508 - RNA, 17 nt, Mycobacterium tuberculosis H37Rv
gaucggugccagcacuc

SEQ ID NO: 1331509 - RNA, 15 nt, Mycobacterium tuberculosis H37Rv
gaucgucacucccga

SEQ ID NO: 1331510 - RNA, 14 nt, Mycobacterium tuberculosis H37Rv
gaucgucacggggu

SEQ ID NO: 1331511 - RNA, 19 nt, Mycobacterium tuberculosis H37Rv
gaucgucgacccaccaugu

SEQ ID NO: 1331512 - RNA, 14 nt, Mycobacterium tuberculosis H37Rv
gaucguccaaugca

SEQ ID NO: 1331513 - RNA, 15 nt, Mycobacterium tuberculosis H37Rv
gaucgugagacgccg

SEQ ID NO: 1331514 - RNA, 14 nt, Mycobacterium tuberculosis H37Rv
gaucgugccgggac

SEQ ID NO: 1331515 - RNA, 22 nt, Mycobacterium tuberculosis H37Rv
gaucggucuuggcgauccaggc

SEQ ID NO: 1331516 - RNA, 21 nt, Mycobacterium tuberculosis H37Rv
gaucgggucguuggcggcggu

SEQ ID NO: 1331517 - RNA, 19 nt, Mycobacterium tuberculosis H37Rv
gaucggugcgaucaggcug

SEQ ID NO: 1331518 - RNA, 22 nt, Mycobacterium tuberculosis H37Rv
gaucgggucguuggcggcgguc

SEQ ID NO: 1331519 - RNA, 14 nt, Mycobacterium tuberculosis H37Rv
gaucggccggcggu

SEQ ID NO: 1331520 - RNA, 17 nt, Mycobacterium tuberculosis H37Rv
gaucggcgcgccgaucg

SEQ ID NO: 1331521 - RNA, 15 nt, Mycobacterium tuberculosis H37Rv
gaucggcacuuagcc

SEQ ID NO: 1331522 - RNA, 20 nt, Mycobacterium tuberculosis H37Rv
gaucggccauucgggaugcg

SEQ ID NO: 1331523 - RNA, 14 nt, Mycobacterium tuberculosis H37Rv
gaucggccaccauc

SEQ ID NO: 1331524 - RNA, 18 nt, Mycobacterium tuberculosis H37Rv
gaucuggucggcggccuc

SEQ ID NO: 1331525 - RNA, 17 nt, Mycobacterium tuberculosis H37Rv
gaucugggcugcggccg

SEQ ID NO: 1331526 - RNA, 21 nt, Mycobacterium tuberculosis H37Rv
gaucuggcguucagcggccag

SEQ ID NO: 1331527 - RNA, 15 nt, Mycobacterium tuberculosis H37Rv
gaucugcuccucggu

SEQ ID NO: 1331528 - RNA, 16 nt, Mycobacterium tuberculosis H37Rv
gaucugcccccgccgg

SEQ ID NO: 1331529 - RNA, 24 nt, Mycobacterium tuberculosis H37Rv
gaucugccgccgcggccacaaccu

SEQ ID NO: 1331530 - RNA, 16 nt, Mycobacterium tuberculosis H37Rv
gaucucguagccgccg

SEQ ID NO: 1331531 - RNA, 19 nt, Mycobacterium tuberculosis H37Rv
gaucucgucccacugcgcg

SEQ ID NO: 1331532 - RNA, 17 nt, Mycobacterium tuberculosis H37Rv
gaucucggcggccgcgu

SEQ ID NO: 1331533 - RNA, 21 nt, Mycobacterium tuberculosis H37Rv
gaucucguggaucugccucuc

SEQ ID NO: 1331534 - RNA, 14 nt, Mycobacterium tuberculosis H37Rv
gaucugcccccgcc

SEQ ID NO: 1331535 - RNA, 15 nt, Mycobacterium tuberculosis H37Rv
gaucucgagcaggcg

SEQ ID NO: 1331536 - RNA, 18 nt, Mycobacterium tuberculosis H37Rv
gaucucgaucgacccggu

SEQ ID NO: 1331537 - RNA, 21 nt, Mycobacterium tuberculosis H37Rv
gaucucgaccguauugaccag

SEQ ID NO: 1331538 - RNA, 22 nt, Mycobacterium tuberculosis H37Rv
gaucucgaccggcuugcccucc

SEQ ID NO: 1331539 - RNA, 15 nt, Mycobacterium tuberculosis H37Rv
gaucucgaccagcgc

SEQ ID NO: 1331540 - RNA, 16 nt, Mycobacterium tuberculosis H37Rv
gaucucgaccagcgcc

SEQ ID NO: 1331541 - RNA, 16 nt, Mycobacterium tuberculosis H37Rv
gaucucgcccaccucc

SEQ ID NO: 1331542 - RNA, 19 nt, Mycobacterium tuberculosis H37Rv
gaucucggcgagcaccacc

SEQ ID NO: 1331543 - RNA, 21 nt, Mycobacterium tuberculosis H37Rv
gaucucggcgagcaccacccc

SEQ ID NO: 1331544 - RNA, 19 nt, Mycobacterium tuberculosis H37Rv
gaucucauccuccugcgcc

SEQ ID NO: 1331545 - RNA, 15 nt, Mycobacterium tuberculosis H37Rv
gaucucaccuggagc

SEQ ID NO: 1331546 - RNA, 19 nt, Mycobacterium tuberculosis H37Rv
gaucuccaccuucuggucc

SEQ ID NO: 1331547 - RNA, 19 nt, Mycobacterium tuberculosis H37Rv
gaucuccccguccugccag

SEQ ID NO: 1331548 - RNA, 12 nt, Mycobacterium tuberculosis H37Rv
gaucuccuccug

SEQ ID NO: 1331549 - RNA, 22 nt, Mycobacterium tuberculosis H37Rv
gaucucaccacccgucggcccg

SEQ ID NO: 1331550 - RNA, 17 nt, Mycobacterium tuberculosis H37Rv
gaggccuaccaggcgcg

SEQ ID NO: 1331551 - RNA, 13 nt, Mycobacterium tuberculosis H37Rv
gaggcgaaagaug

SEQ ID NO: 1331552 - RNA, 16 nt, Mycobacterium tuberculosis H37Rv
gaggcgcucacccgcc

SEQ ID NO: 1331553 - RNA, 19 nt, Mycobacterium tuberculosis H37Rv
gaggcggcgccgcacccac

SEQ ID NO: 1331554 - RNA, 12 nt, Mycobacterium tuberculosis H37Rv
gaggcgcccaac

SEQ ID NO: 1331555 - RNA, 20 nt, Mycobacterium tuberculosis H37Rv
gagggggguguugaggccgg

SEQ ID NO: 1331556 - RNA, 24 nt, Mycobacterium tuberculosis H37Rv
gagggggguguugaggccggugaa

SEQ ID NO: 1331557 - RNA, 16 nt, Mycobacterium tuberculosis H37Rv
gagggcuaccggcgcc

SEQ ID NO: 1331558 - RNA, 18 nt, Mycobacterium tuberculosis H37Rv
gagggcuaccggcgccgc

SEQ ID NO: 1331559 - RNA, 14 nt, Mycobacterium tuberculosis H37Rv
gaggguuuccaagu

SEQ ID NO: 1331560 - RNA, 21 nt, Mycobacterium tuberculosis H37Rv
gaggguucgccgaagccggac

SEQ ID NO: 1331561 - RNA, 23 nt, Mycobacterium tuberculosis H37Rv
gagguacccaucgucgagccgcc

SEQ ID NO: 1331562 - RNA, 16 nt, Mycobacterium tuberculosis H37Rv
gagguacccccagcac

SEQ ID NO: 1331563 - RNA, 19 nt, Mycobacterium tuberculosis H37Rv
gagguauucguggucggcc

SEQ ID NO: 1331564 - RNA, 13 nt, Mycobacterium tuberculosis H37Rv
gaguacaggcgca

SEQ ID NO: 1331565 - RNA, 17 nt, Mycobacterium tuberculosis H37Rv
gaguaacacguggguga

SEQ ID NO: 1331566 - RNA, 23 nt, Mycobacterium tuberculosis H37Rv
gaggcauugguguagccaaccgu

SEQ ID NO: 1331567 - RNA, 15 nt, Mycobacterium tuberculosis H37Rv
gaggccaacccugcg

SEQ ID NO: 1331568 - RNA, 14 nt, Mycobacterium tuberculosis H37Rv
gaggccccccgcgc

SEQ ID NO: 1331569 - RNA, 19 nt, Mycobacterium tuberculosis H37Rv
gaggccauguugccgugga

SEQ ID NO: 1331570 - RNA, 13 nt, Mycobacterium tuberculosis H37Rv
gaggccaucaucc

SEQ ID NO: 1331571 - RNA, 15 nt, Mycobacterium tuberculosis H37Rv
gaggcccgcggugga

SEQ ID NO: 1331572 - RNA, 14 nt, Mycobacterium tuberculosis H37Rv
gaggccacgccagc

SEQ ID NO: 1331573 - RNA, 19 nt, Mycobacterium tuberculosis H37Rv
gaggccacggggcuuggcg

SEQ ID NO: 1331574 - RNA, 17 nt, Mycobacterium tuberculosis H37Rv
gaggccgccaucgccgc

SEQ ID NO: 1331575 - RNA, 15 nt, Mycobacterium tuberculosis H37Rv
gaggccgcugccagc

SEQ ID NO: 1331576 - RNA, 17 nt, Mycobacterium tuberculosis H37Rv
gaggccgcugccagggu

SEQ ID NO: 1331577 - RNA, 13 nt, Mycobacterium tuberculosis H37Rv
gaggacggcggcc

SEQ ID NO: 1331578 - RNA, 14 nt, Mycobacterium tuberculosis H37Rv
gaggaagcggcggc

SEQ ID NO: 1331579 - RNA, 15 nt, Mycobacterium tuberculosis H37Rv
gaggacuggaaagca

SEQ ID NO: 1331580 - RNA, 22 nt, Mycobacterium tuberculosis H37Rv
gaggacuggaaagcagcagcgg

SEQ ID NO: 1331581 - RNA, 19 nt, Mycobacterium tuberculosis H37Rv
gaggaacucggacccaccc

SEQ ID NO: 1331582 - RNA, 13 nt, Mycobacterium tuberculosis H37Rv
gagcugcggcggc

SEQ ID NO: 1331583 - RNA, 14 nt, Mycobacterium tuberculosis H37Rv
gagcugcggcggcc

SEQ ID NO: 1331584 - RNA, 19 nt, Mycobacterium tuberculosis H37Rv
gagcugagcggccagcauc

SEQ ID NO: 1331585 - RNA, 14 nt, Mycobacterium tuberculosis H37Rv
gagcugauccaagu

SEQ ID NO: 1331586 - RNA, 14 nt, Mycobacterium tuberculosis H37Rv
gagcucggcugcuc

SEQ ID NO: 1331587 - RNA, 22 nt, Mycobacterium tuberculosis H37Rv
gagcucgaaguuggcuuucggu

SEQ ID NO: 1331588 - RNA, 16 nt, Mycobacterium tuberculosis H37Rv
gagcuccgucgcggcc

SEQ ID NO: 1331589 - RNA, 15 nt, Mycobacterium tuberculosis H37Rv
gagcuccucacggau

SEQ ID NO: 1331590 - RNA, 22 nt, Mycobacterium tuberculosis H37Rv
gagcucguugcuggcggccagc

SEQ ID NO: 1331591 - RNA, 16 nt, Mycobacterium tuberculosis H37Rv
gagcugacgccgagcu

SEQ ID NO: 1331592 - RNA, 16 nt, Mycobacterium tuberculosis H37Rv
gagucgacgugugccg

SEQ ID NO: 1331593 - RNA, 24 nt, Mycobacterium tuberculosis H37Rv
gagucgaugaccccgguggucugg

SEQ ID NO: 1331594 - RNA, 14 nt, Mycobacterium tuberculosis H37Rv
gagucgcacguggg

SEQ ID NO: 1331595 - RNA, 17 nt, Mycobacterium tuberculosis H37Rv
gagucgcgaacucaugc

SEQ ID NO: 1331596 - RNA, 19 nt, Mycobacterium tuberculosis H37Rv
gagucggcggggcggacuc

SEQ ID NO: 1331597 - RNA, 20 nt, Mycobacterium tuberculosis H37Rv
gaguccgguagcuguggugg

SEQ ID NO: 1331598 - RNA, 21 nt, Mycobacterium tuberculosis H37Rv
gaguccgguagcugugguggu

SEQ ID NO: 1331599 - RNA, 19 nt, Mycobacterium tuberculosis H37Rv
gaguccugguaccccagca

SEQ ID NO: 1331600 - RNA, 13 nt, Mycobacterium tuberculosis H37Rv
gagucgacaagcc

SEQ ID NO: 1331601 - RNA, 16 nt, Mycobacterium tuberculosis H37Rv
gaguacggcgaugcgg

SEQ ID NO: 1331602 - RNA, 16 nt, Mycobacterium tuberculosis H37Rv
gaguagaagauggcac

SEQ ID NO: 1331603 - RNA, 15 nt, Mycobacterium tuberculosis H37Rv
gaguauuggucggug

SEQ ID NO: 1331604 - RNA, 20 nt, Mycobacterium tuberculosis H37Rv
gaguauuggucgguggggua

SEQ ID NO: 1331605 - RNA, 20 nt, Mycobacterium tuberculosis H37Rv
gagugagcucagcaaguucg

SEQ ID NO: 1331606 - RNA, 16 nt, Mycobacterium tuberculosis H37Rv
gaguggaugcgccgca

SEQ ID NO: 1331607 - RNA, 17 nt, Mycobacterium tuberculosis H37Rv
gagugcagcacgaucca

SEQ ID NO: 1331608 - RNA, 16 nt, Mycobacterium tuberculosis H37Rv
gagucggggggccgga

SEQ ID NO: 1331609 - RNA, 16 nt, Mycobacterium tuberculosis H37Rv
gagugugacggcggcc

SEQ ID NO: 1331610 - RNA, 16 nt, Mycobacterium tuberculosis H37Rv
gaguucgcgcagcacc

SEQ ID NO: 1331611 - RNA, 16 nt, Mycobacterium tuberculosis H37Rv
gaguucgcaaugccug

SEQ ID NO: 1331612 - RNA, 22 nt, Mycobacterium tuberculosis H37Rv
gaguuccggucgacuccagcac

SEQ ID NO: 1331613 - RNA, 21 nt, Mycobacterium tuberculosis H37Rv
gaguggcgauuucggcgccug

SEQ ID NO: 1331614 - RNA, 20 nt, Mycobacterium tuberculosis H37Rv
gagugucuuagccagcagca

SEQ ID NO: 1331615 - RNA, 23 nt, Mycobacterium tuberculosis H37Rv
gagugucccgaugguggccgcgc

SEQ ID NO: 1331616 - RNA, 15 nt, Mycobacterium tuberculosis H37Rv
gagugucacugggcc

SEQ ID NO: 1331617 - RNA, 19 nt, Mycobacterium tuberculosis H37Rv
gaguuugauuucgcacgga

SEQ ID NO: 1331618 - RNA, 12 nt, Mycobacterium tuberculosis H37Rv
gaguuucugcuc

SEQ ID NO: 1331619 - RNA, 22 nt, Mycobacterium tuberculosis H37Rv
gaguucggcccgcaaacagucg

SEQ ID NO: 1331620 - RNA, 17 nt, Mycobacterium tuberculosis H37Rv
gaguucggccaccaacc

SEQ ID NO: 1331621 - RNA, 20 nt, Mycobacterium tuberculosis H37Rv
gaguugucgacggccacccc

SEQ ID NO: 1331622 - RNA, 22 nt, Mycobacterium tuberculosis H37Rv
gaguuggucguggcugugcggg

SEQ ID NO: 1331623 - RNA, 22 nt, Mycobacterium tuberculosis H37Rv
gauaacccaaccgcgccaccuc

SEQ ID NO: 1331624 - RNA, 13 nt, Mycobacterium tuberculosis H37Rv
gauaacccagcac

SEQ ID NO: 1331625 - RNA, 17 nt, Mycobacterium tuberculosis H37Rv
gauaacccagcaccaca

SEQ ID NO: 1331626 - RNA, 17 nt, Mycobacterium tuberculosis H37Rv
gagccgacggcggcggc

SEQ ID NO: 1331627 - RNA, 16 nt, Mycobacterium tuberculosis H37Rv
gagccgauccaggagu

SEQ ID NO: 1331628 - RNA, 18 nt, Mycobacterium tuberculosis H37Rv
gagccgauccaggaguga

SEQ ID NO: 1331629 - RNA, 11 nt, Mycobacterium tuberculosis H37Rv
gagccgcagcc

SEQ ID NO: 1331630 - RNA, 12 nt, Mycobacterium tuberculosis H37Rv
gagccgccagga

SEQ ID NO: 1331631 - RNA, 16 nt, Mycobacterium tuberculosis H37Rv
gagccagaaugcaagc

SEQ ID NO: 1331632 - RNA, 17 nt, Mycobacterium tuberculosis H37Rv
gagccagaaugcaagca

SEQ ID NO: 1331633 - RNA, 20 nt, Mycobacterium tuberculosis H37Rv
gagccgguggcccgccggca

SEQ ID NO: 1331634 - RNA, 20 nt, Mycobacterium tuberculosis H37Rv
gagccguccaauuccgcaga

SEQ ID NO: 1331635 - RNA, 22 nt, Mycobacterium tuberculosis H37Rv
gagccgccgacucggcaccgcg

SEQ ID NO: 1331636 - RNA, 24 nt, Mycobacterium tuberculosis H37Rv
gagccgcccuugccuccggcgccg

SEQ ID NO: 1331637 - RNA, 17 nt, Mycobacterium tuberculosis H37Rv
gagccgccggaucgcca

SEQ ID NO: 1331638 - RNA, 18 nt, Mycobacterium tuberculosis H37Rv
gagccgccggaucgccac

SEQ ID NO: 1331639 - RNA, 14 nt, Mycobacterium tuberculosis H37Rv
gagccgugccagca

SEQ ID NO: 1331640 - RNA, 13 nt, Mycobacterium tuberculosis H37Rv
gagccgugccucg

SEQ ID NO: 1331641 - RNA, 22 nt, Mycobacterium tuberculosis H37Rv
gagccgugccucgaggacggcg

SEQ ID NO: 1331642 - RNA, 21 nt, Mycobacterium tuberculosis H37Rv
gagccucgcgcgccacggugu

SEQ ID NO: 1331643 - RNA, 20 nt, Mycobacterium tuberculosis H37Rv
gagcgaccgcgagggccagc

SEQ ID NO: 1331644 - RNA, 23 nt, Mycobacterium tuberculosis H37Rv
gagcgcccgucguagguggccgg

SEQ ID NO: 1331645 - RNA, 15 nt, Mycobacterium tuberculosis H37Rv
gagcgcccuccucga

SEQ ID NO: 1331646 - RNA, 13 nt, Mycobacterium tuberculosis H37Rv
gagcgcaccgcga

SEQ ID NO: 1331647 - RNA, 14 nt, Mycobacterium tuberculosis H37Rv
gagcgcaucggcca

SEQ ID NO: 1331648 - RNA, 13 nt, Mycobacterium tuberculosis H37Rv
gagcgcaacuccc

SEQ ID NO: 1331649 - RNA, 18 nt, Mycobacterium tuberculosis H37Rv
gagcgcaagagccguccg

SEQ ID NO: 1331650 - RNA, 13 nt, Mycobacterium tuberculosis H37Rv
gagcgcaccugaa

SEQ ID NO: 1331651 - RNA, 14 nt, Mycobacterium tuberculosis H37Rv
gagcgcaccacggc

SEQ ID NO: 1331652 - RNA, 17 nt, Mycobacterium tuberculosis H37Rv
gagcgacgucggugaag

SEQ ID NO: 1331653 - RNA, 14 nt, Mycobacterium tuberculosis H37Rv
gagcggagccggcg

SEQ ID NO: 1331654 - RNA, 20 nt, Mycobacterium tuberculosis H37Rv
gagcggauagcggcaaagcc

SEQ ID NO: 1331655 - RNA, 19 nt, Mycobacterium tuberculosis H37Rv
gagcggaucgucgucgugu

SEQ ID NO: 1331656 - RNA, 16 nt, Mycobacterium tuberculosis H37Rv
gagcgcuaucaccgcc

SEQ ID NO: 1331657 - RNA, 14 nt, Mycobacterium tuberculosis H37Rv
gagcgcugcgccga

SEQ ID NO: 1331658 - RNA, 12 nt, Mycobacterium tuberculosis H37Rv
gagcgcggccug

SEQ ID NO: 1331659 - RNA, 21 nt, Mycobacterium tuberculosis H37Rv
gagcgcggcggagccggguga

SEQ ID NO: 1331660 - RNA, 18 nt, Mycobacterium tuberculosis H37Rv
gagcgcggcggcggaggc

SEQ ID NO: 1331661 - RNA, 15 nt, Mycobacterium tuberculosis H37Rv
gagcgcggcggcgga

SEQ ID NO: 1331662 - RNA, 18 nt, Mycobacterium tuberculosis H37Rv
gagcgcgcguagcggggg

SEQ ID NO: 1331663 - RNA, 20 nt, Mycobacterium tuberculosis H37Rv
gagcgcgccuaugggccugc

SEQ ID NO: 1331664 - RNA, 14 nt, Mycobacterium tuberculosis H37Rv
gagcgcgcagcagu

SEQ ID NO: 1331665 - RNA, 18 nt, Mycobacterium tuberculosis H37Rv
gagcgcgcucgagggugg

SEQ ID NO: 1331666 - RNA, 16 nt, Mycobacterium tuberculosis H37Rv
gagcgguacggacagc

SEQ ID NO: 1331667 - RNA, 14 nt, Mycobacterium tuberculosis H37Rv
gagcgguggugagu

SEQ ID NO: 1331668 - RNA, 20 nt, Mycobacterium tuberculosis H37Rv
gagcgguggcgucgucggcg

SEQ ID NO: 1331669 - RNA, 16 nt, Mycobacterium tuberculosis H37Rv
gagcggguggccggga

SEQ ID NO: 1331670 - RNA, 14 nt, Mycobacterium tuberculosis H37Rv
gagcgggugcgggc

SEQ ID NO: 1331671 - RNA, 21 nt, Mycobacterium tuberculosis H37Rv
gagcgggauucuggcgcagcu

SEQ ID NO: 1331672 - RNA, 19 nt, Mycobacterium tuberculosis H37Rv
gagcgggaucgggcccucc

SEQ ID NO: 1331673 - RNA, 16 nt, Mycobacterium tuberculosis H37Rv
gagcggcgcgggggug

SEQ ID NO: 1331674 - RNA, 14 nt, Mycobacterium tuberculosis H37Rv
gagcggcgcggggg

SEQ ID NO: 1331675 - RNA, 14 nt, Mycobacterium tuberculosis H37Rv
gagcggcggcacug

SEQ ID NO: 1331676 - RNA, 12 nt, Mycobacterium tuberculosis H37Rv
gagcggccucgg

SEQ ID NO: 1331677 - RNA, 19 nt, Mycobacterium tuberculosis H37Rv
gagcguucuucagccaggg

SEQ ID NO: 1331678 - RNA, 20 nt, Mycobacterium tuberculosis H37Rv
gagcguuuuggugcggaccu

SEQ ID NO: 1331679 - RNA, 14 nt, Mycobacterium tuberculosis H37Rv
gagcuagccguucg

SEQ ID NO: 1331680 - RNA, 17 nt, Mycobacterium tuberculosis H37Rv
gagcucaccgcacaccu

SEQ ID NO: 1331681 - RNA, 14 nt, Mycobacterium tuberculosis H37Rv
gagcuaugcuggca

SEQ ID NO: 1331682 - RNA, 20 nt, Mycobacterium tuberculosis H37Rv
gagcuauucggugucgccac

SEQ ID NO: 1331683 - RNA, 15 nt, Mycobacterium tuberculosis H37Rv
gagcguaggccagcg

SEQ ID NO: 1331684 - RNA, 18 nt, Mycobacterium tuberculosis H37Rv
gagcguaaugcugcugca

SEQ ID NO: 1331685 - RNA, 23 nt, Mycobacterium tuberculosis H37Rv
gagcguggccaauccggcggcga

SEQ ID NO: 1331686 - RNA, 15 nt, Mycobacterium tuberculosis H37Rv
gagcgugccgcagcg

SEQ ID NO: 1331687 - RNA, 23 nt, Mycobacterium tuberculosis H37Rv
gagcgugucgagcgccgcaguga

SEQ ID NO: 1331688 - RNA, 19 nt, Mycobacterium tuberculosis H37Rv
gagauugggcugggauagc

SEQ ID NO: 1331689 - RNA, 16 nt, Mycobacterium tuberculosis H37Rv
gagauuggguccagcg

SEQ ID NO: 1331690 - RNA, 15 nt, Mycobacterium tuberculosis H37Rv
gagauuggugcagac

SEQ ID NO: 1331691 - RNA, 20 nt, Mycobacterium tuberculosis H37Rv
gagaucgcggcgacccgguc

SEQ ID NO: 1331692 - RNA, 16 nt, Mycobacterium tuberculosis H37Rv
gagaucgccgccggcg

SEQ ID NO: 1331693 - RNA, 16 nt, Mycobacterium tuberculosis H37Rv
gagaucguagggacgc

SEQ ID NO: 1331694 - RNA, 18 nt, Mycobacterium tuberculosis H37Rv
gagaucgucgcguaguga

SEQ ID NO: 1331695 - RNA, 21 nt, Mycobacterium tuberculosis H37Rv
gacucaccgugaaccgcccgc

SEQ ID NO: 1331696 - RNA, 15 nt, Mycobacterium tuberculosis H37Rv
gacucacgcagcgcc

SEQ ID NO: 1331697 - RNA, 18 nt, Mycobacterium tuberculosis H37Rv
gacucaggucggugcggu

SEQ ID NO: 1331698 - RNA, 20 nt, Mycobacterium tuberculosis H37Rv
gacuccagcaaggccagcac

SEQ ID NO: 1331699 - RNA, 22 nt, Mycobacterium tuberculosis H37Rv
gacuccaaagccgugccagccc

SEQ ID NO: 1331700 - RNA, 23 nt, Mycobacterium tuberculosis H37Rv
gacuccagcaaggccagcacggc

SEQ ID NO: 1331701 - RNA, 13 nt, Mycobacterium tuberculosis H37Rv
gagagggcggggc

SEQ ID NO: 1331702 - RNA, 17 nt, Mycobacterium tuberculosis H37Rv
gagcaguuccagcucgc

SEQ ID NO: 1331703 - RNA, 16 nt, Mycobacterium tuberculosis H37Rv
gagcagcgcggccaga

SEQ ID NO: 1331704 - RNA, 22 nt, Mycobacterium tuberculosis H37Rv
gagcagccggaccguguacugg

SEQ ID NO: 1331705 - RNA, 18 nt, Mycobacterium tuberculosis H37Rv
gagcagcgcggccagagc

SEQ ID NO: 1331706 - RNA, 24 nt, Mycobacterium tuberculosis H37Rv
gagcagcuuagucagggccgaggu

SEQ ID NO: 1331707 - RNA, 17 nt, Mycobacterium tuberculosis H37Rv
gagccaacgcgcagagc

SEQ ID NO: 1331708 - RNA, 12 nt, Mycobacterium tuberculosis H37Rv
gagcagccagcc

SEQ ID NO: 1331709 - RNA, 18 nt, Mycobacterium tuberculosis H37Rv
gagcagccgaaccggcac

SEQ ID NO: 1331710 - RNA, 23 nt, Mycobacterium tuberculosis H37Rv
gagcagccgaaccggcaccagcg

SEQ ID NO: 1331711 - RNA, 16 nt, Mycobacterium tuberculosis H37Rv
gagcagcagcgggcug

SEQ ID NO: 1331712 - RNA, 17 nt, Mycobacterium tuberculosis H37Rv
gagcagagaacuccgcc

SEQ ID NO: 1331713 - RNA, 12 nt, Mycobacterium tuberculosis H37Rv
gagcagcaaucc

SEQ ID NO: 1331714 - RNA, 13 nt, Mycobacterium tuberculosis H37Rv
gagcagcacagca

SEQ ID NO: 1331715 - RNA, 15 nt, Mycobacterium tuberculosis H37Rv
gagcagcaagccgcc

SEQ ID NO: 1331716 - RNA, 14 nt, Mycobacterium tuberculosis H37Rv
gagcaaguccugca

SEQ ID NO: 1331717 - RNA, 22 nt, Mycobacterium tuberculosis H37Rv
gagcaaaccagauugccgagcc

SEQ ID NO: 1331718 - RNA, 21 nt, Mycobacterium tuberculosis H37Rv
gagcaaaccagauugccgagc

SEQ ID NO: 1331719 - RNA, 20 nt, Mycobacterium tuberculosis H37Rv
gagcaacaccccuggguuga

SEQ ID NO: 1331720 - RNA, 23 nt, Mycobacterium tuberculosis H37Rv
gagcaacaccgucggcagcagcg

SEQ ID NO: 1331721 - RNA, 17 nt, Mycobacterium tuberculosis H37Rv
cuuugaauugcgcgccc

SEQ ID NO: 1331722 - RNA, 17 nt, Mycobacterium tuberculosis H37Rv
cuuucccggggcugggg

SEQ ID NO: 1331723 - RNA, 22 nt, Mycobacterium tuberculosis H37Rv
cuuucguugguuaucccagacu

SEQ ID NO: 1331724 - RNA, 17 nt, Mycobacterium tuberculosis H37Rv
cuuugucacgcaccgcg

SEQ ID NO: 1331725 - RNA, 18 nt, Mycobacterium tuberculosis H37Rv
cuuugucgccuucuuggc

SEQ ID NO: 1331726 - RNA, 20 nt, Mycobacterium tuberculosis H37Rv
cuuugacgcccggcaccccu

SEQ ID NO: 1331727 - RNA, 16 nt, Mycobacterium tuberculosis H37Rv
cuuugacgcccggcac

SEQ ID NO: 1331728 - RNA, 21 nt, Mycobacterium tuberculosis H37Rv
cuuugcucucggucugcaugc

SEQ ID NO: 1331729 - RNA, 19 nt, Mycobacterium tuberculosis H37Rv
cuuugcucucggucugcau

SEQ ID NO: 1331730 - RNA, 15 nt, Mycobacterium tuberculosis H37Rv
cuuugcucgccagca

SEQ ID NO: 1331731 - RNA, 18 nt, Mycobacterium tuberculosis H37Rv
cuucgcucgggucaucuu

SEQ ID NO: 1331732 - RNA, 18 nt, Mycobacterium tuberculosis H37Rv
cuucgcugcggugggcca

SEQ ID NO: 1331733 - RNA, 14 nt, Mycobacterium tuberculosis H37Rv
cuucgcuggaaacc

SEQ ID NO: 1331734 - RNA, 18 nt, Mycobacterium tuberculosis H37Rv
cuucggcggugccaccag

SEQ ID NO: 1331735 - RNA, 16 nt, Mycobacterium tuberculosis H37Rv
cuucggcggucgccgc

SEQ ID NO: 1331736 - RNA, 21 nt, Mycobacterium tuberculosis H37Rv
cuucggccugugcgggcaggu

SEQ ID NO: 1331737 - RNA, 15 nt, Mycobacterium tuberculosis H37Rv
cuucggccuucuuga

SEQ ID NO: 1331738 - RNA, 19 nt, Mycobacterium tuberculosis H37Rv
cuucggccuucuugaggua

SEQ ID NO: 1331739 - RNA, 12 nt, Mycobacterium tuberculosis H37Rv
cuucggccggcg

SEQ ID NO: 1331740 - RNA, 15 nt, Mycobacterium tuberculosis H37Rv
cuucggccagcuccc

SEQ ID NO: 1331741 - RNA, 16 nt, Mycobacterium tuberculosis H37Rv
cuucggccagaucacg

SEQ ID NO: 1331742 - RNA, 19 nt, Mycobacterium tuberculosis H37Rv
cuuuagcgcgugcugcaga

SEQ ID NO: 1331743 - RNA, 12 nt, Mycobacterium tuberculosis H37Rv
aaagacucgacc

SEQ ID NO: 1331744 - RNA, 16 nt, Mycobacterium tuberculosis H37Rv
cuuuugcgcccagcac

SEQ ID NO: 1331745 - RNA, 15 nt, Mycobacterium tuberculosis H37Rv
cuuuuacgucugcuc

SEQ ID NO: 1331746 - RNA, 16 nt, Mycobacterium tuberculosis H37Rv
cuuuuccgccgggcuc

SEQ ID NO: 1331747 - RNA, 17 nt, Mycobacterium tuberculosis H37Rv
gaaaaccccggccacca

SEQ ID NO: 1331748 - RNA, 23 nt, Mycobacterium tuberculosis H37Rv
gaaaacccggucggcgaaaggcc

SEQ ID NO: 1331749 - RNA, 20 nt, Mycobacterium tuberculosis H37Rv
gaaaaccucggacugcagcg

SEQ ID NO: 1331750 - RNA, 21 nt, Mycobacterium tuberculosis H37Rv
gaaaaccgucgcagaaaccau

SEQ ID NO: 1331751 - RNA, 14 nt, Mycobacterium tuberculosis H37Rv
gaaaacgcccggca

SEQ ID NO: 1331752 - RNA, 14 nt, Mycobacterium tuberculosis H37Rv
gaaaagaacccggg

SEQ ID NO: 1331753 - RNA, 14 nt, Mycobacterium tuberculosis H37Rv
gaaaagacugcgcc

SEQ ID NO: 1331754 - RNA, 20 nt, Mycobacterium tuberculosis H37Rv
gaaauacccagcgcagcagc

SEQ ID NO: 1331755 - RNA, 15 nt, Mycobacterium tuberculosis H37Rv
gaaauagcgagcguu

SEQ ID NO: 1331756 - RNA, 16 nt, Mycobacterium tuberculosis H37Rv
gaaaucaccucaccag

SEQ ID NO: 1331757 - RNA, 17 nt, Mycobacterium tuberculosis H37Rv
gaaaguagcgugcgaca

SEQ ID NO: 1331758 - RNA, 17 nt, Mycobacterium tuberculosis H37Rv
gaaagcgucgagcugau

SEQ ID NO: 1331759 - RNA, 23 nt, Mycobacterium tuberculosis H37Rv
gaaaaucugcuagcuuggcggcc

SEQ ID NO: 1331760 - RNA, 17 nt, Mycobacterium tuberculosis H37Rv
gaaacucaccagcaccc

SEQ ID NO: 1331761 - RNA, 15 nt, Mycobacterium tuberculosis H37Rv
gaaaaugccgcccag

SEQ ID NO: 1331762 - RNA, 17 nt, Mycobacterium tuberculosis H37Rv
gaaagcgccgaaacagc

SEQ ID NO: 1331763 - RNA, 22 nt, Mycobacterium tuberculosis H37Rv
gaaacugcucggauccggccag

SEQ ID NO: 1331764 - RNA, 21 nt, Mycobacterium tuberculosis H37Rv
gaaauuccggcgcggccggcc

SEQ ID NO: 1331765 - RNA, 15 nt, Mycobacterium tuberculosis H37Rv
gaaauucgcggcggu

SEQ ID NO: 1331766 - RNA, 14 nt, Mycobacterium tuberculosis H37Rv
gaaauugccgccgc

SEQ ID NO: 1331767 - RNA, 21 nt, Mycobacterium tuberculosis H37Rv
gaaauugcuuggccgcgcagg

SEQ ID NO: 1331768 - RNA, 22 nt, Mycobacterium tuberculosis H37Rv
gaaauugcuuggccgcgcaggc

SEQ ID NO: 1331769 - RNA, 18 nt, Mycobacterium tuberculosis H37Rv
gaaauugaugaucugcag

SEQ ID NO: 1331770 - RNA, 14 nt, Mycobacterium tuberculosis H37Rv
gaaauugagccggc

SEQ ID NO: 1331771 - RNA, 19 nt, Mycobacterium tuberculosis H37Rv
gaaauccugguggcagaca

SEQ ID NO: 1331772 - RNA, 16 nt, Mycobacterium tuberculosis H37Rv
gaaaucgcacagcgca

SEQ ID NO: 1331773 - RNA, 17 nt, Mycobacterium tuberculosis H37Rv
gaaaucgcccugacccg

SEQ ID NO: 1331774 - RNA, 20 nt, Mycobacterium tuberculosis H37Rv
gaaaucgcccugacccggag

SEQ ID NO: 1331775 - RNA, 14 nt, Mycobacterium tuberculosis H37Rv
gaaaugaagugcac

SEQ ID NO: 1331776 - RNA, 17 nt, Mycobacterium tuberculosis H37Rv
gaacagcugaucccaga

SEQ ID NO: 1331777 - RNA, 20 nt, Mycobacterium tuberculosis H37Rv
gaacaggcaaaguacgcccu

SEQ ID NO: 1331778 - RNA, 22 nt, Mycobacterium tuberculosis H37Rv
gaacacguucggguacccggga

SEQ ID NO: 1331779 - RNA, 21 nt, Mycobacterium tuberculosis H37Rv
gaacagcaccgaacccgccac

SEQ ID NO: 1331780 - RNA, 14 nt, Mycobacterium tuberculosis H37Rv
gaacagcaccuccg

SEQ ID NO: 1331781 - RNA, 13 nt, Mycobacterium tuberculosis H37Rv
gaacagcacgacu

SEQ ID NO: 1331782 - RNA, 13 nt, Mycobacterium tuberculosis H37Rv
gaacagcaccgcc

SEQ ID NO: 1331783 - RNA, 16 nt, Mycobacterium tuberculosis H37Rv
gaacagcagcccgccc

SEQ ID NO: 1331784 - RNA, 15 nt, Mycobacterium tuberculosis H37Rv
gaacagcaggccucc

SEQ ID NO: 1331785 - RNA, 19 nt, Mycobacterium tuberculosis H37Rv
gaacagcgguccagccacc

SEQ ID NO: 1331786 - RNA, 20 nt, Mycobacterium tuberculosis H37Rv
gaacagcgggggcagcgcga

SEQ ID NO: 1331787 - RNA, 16 nt, Mycobacterium tuberculosis H37Rv
gaacaauaaggccgca

SEQ ID NO: 1331788 - RNA, 23 nt, Mycobacterium tuberculosis H37Rv
gaacaccggccaacagucgcagc

SEQ ID NO: 1331789 - RNA, 17 nt, Mycobacterium tuberculosis H37Rv
gaacaccuugggcagcu

SEQ ID NO: 1331790 - RNA, 16 nt, Mycobacterium tuberculosis H37Rv
gaacaauucacgcacc

SEQ ID NO: 1331791 - RNA, 18 nt, Mycobacterium tuberculosis H37Rv
gaacgugcaaccacggcg

SEQ ID NO: 1331792 - RNA, 19 nt, Mycobacterium tuberculosis H37Rv
gaacgugcaaccacggcgg

SEQ ID NO: 1331793 - RNA, 23 nt, Mycobacterium tuberculosis H37Rv
gaacgugcaaccacggcggcauc

SEQ ID NO: 1331794 - RNA, 22 nt, Mycobacterium tuberculosis H37Rv
gaacguccagccguggcggcgg

SEQ ID NO: 1331795 - RNA, 23 nt, Mycobacterium tuberculosis H37Rv
gaacguccagccguggcggcggg

SEQ ID NO: 1331796 - RNA, 19 nt, Mycobacterium tuberculosis H37Rv
gaacggugcacagcaguga

SEQ ID NO: 1331797 - RNA, 24 nt, Mycobacterium tuberculosis H37Rv
gaacguucuuaaacgggcucuucg

SEQ ID NO: 1331798 - RNA, 22 nt, Mycobacterium tuberculosis H37Rv
gaacgugccuuccucgccggaa

SEQ ID NO: 1331799 - RNA, 15 nt, Mycobacterium tuberculosis H37Rv
gaacggcgguguggu

SEQ ID NO: 1331800 - RNA, 22 nt, Mycobacterium tuberculosis H37Rv
gaacggauucccgcccagcagc

SEQ ID NO: 1331801 - RNA, 15 nt, Mycobacterium tuberculosis H37Rv
gaacggggugagcca

SEQ ID NO: 1331802 - RNA, 12 nt, Mycobacterium tuberculosis H37Rv
gaacggcagcac

SEQ ID NO: 1331803 - RNA, 15 nt, Mycobacterium tuberculosis H37Rv
gaacgaugccgccgg

SEQ ID NO: 1331804 - RNA, 16 nt, Mycobacterium tuberculosis H37Rv
gaacgcagccagcgcc

SEQ ID NO: 1331805 - RNA, 18 nt, Mycobacterium tuberculosis H37Rv
gaacgcccgcugcagacg

SEQ ID NO: 1331806 - RNA, 12 nt, Mycobacterium tuberculosis H37Rv
gaacgccgaaca

SEQ ID NO: 1331807 - RNA, 23 nt, Mycobacterium tuberculosis H37Rv
gaacgccagaccgacugcgggcc

SEQ ID NO: 1331808 - RNA, 14 nt, Mycobacterium tuberculosis H37Rv
gaacgccagcagcg

SEQ ID NO: 1331809 - RNA, 16 nt, Mycobacterium tuberculosis H37Rv
gaacgccucaggggcg

SEQ ID NO: 1331810 - RNA, 16 nt, Mycobacterium tuberculosis H37Rv
gaacgccucgccggcc

SEQ ID NO: 1331811 - RNA, 20 nt, Mycobacterium tuberculosis H37Rv
gaacgccucgccggccgcca

SEQ ID NO: 1331812 - RNA, 13 nt, Mycobacterium tuberculosis H37Rv
gaacgccugcugg

SEQ ID NO: 1331813 - RNA, 22 nt, Mycobacterium tuberculosis H37Rv
gaacgcgcgcguggucgccccg

SEQ ID NO: 1331814 - RNA, 23 nt, Mycobacterium tuberculosis H37Rv
gaacgcuagcgccaaauccggcu

SEQ ID NO: 1331815 - RNA, 22 nt, Mycobacterium tuberculosis H37Rv
gaacgcugaggaagcggcggca

SEQ ID NO: 1331816 - RNA, 17 nt, Mycobacterium tuberculosis H37Rv
gaacgcggacaccgcgg

SEQ ID NO: 1331817 - RNA, 16 nt, Mycobacterium tuberculosis H37Rv
gaacgcguccagcgcg

SEQ ID NO: 1331818 - RNA, 20 nt, Mycobacterium tuberculosis H37Rv
gaacugcaucauggccguga

SEQ ID NO: 1331819 - RNA, 21 nt, Mycobacterium tuberculosis H37Rv
gaacugaggauuucauacgcg

SEQ ID NO: 1331820 - RNA, 19 nt, Mycobacterium tuberculosis H37Rv
gaacugaugaaccacggca

SEQ ID NO: 1331821 - RNA, 23 nt, Mycobacterium tuberculosis H37Rv
gaacugaugaaccacggcaggca

SEQ ID NO: 1331822 - RNA, 22 nt, Mycobacterium tuberculosis H37Rv
gaacuggacggggaagcccggc

SEQ ID NO: 1331823 - RNA, 14 nt, Mycobacterium tuberculosis H37Rv
gaacucguccugac

SEQ ID NO: 1331824 - RNA, 20 nt, Mycobacterium tuberculosis H37Rv
gaacucuggauucuucagcg

SEQ ID NO: 1331825 - RNA, 17 nt, Mycobacterium tuberculosis H37Rv
gaacucggugcccccac

SEQ ID NO: 1331826 - RNA, 19 nt, Mycobacterium tuberculosis H37Rv
gaacucggcgucguggugg

SEQ ID NO: 1331827 - RNA, 18 nt, Mycobacterium tuberculosis H37Rv
gaacucgcgccgagccag

SEQ ID NO: 1331828 - RNA, 16 nt, Mycobacterium tuberculosis H37Rv
gaacucgcgggcgacc

SEQ ID NO: 1331829 - RNA, 16 nt, Mycobacterium tuberculosis H37Rv
gaacucggacccaccc

SEQ ID NO: 1331830 - RNA, 17 nt, Mycobacterium tuberculosis H37Rv
gaacucgcguaucccgu

SEQ ID NO: 1331831 - RNA, 15 nt, Mycobacterium tuberculosis H37Rv
gaacucgucgcugcc

SEQ ID NO: 1331832 - RNA, 19 nt, Mycobacterium tuberculosis H37Rv
gaacucguugaagaauccg

SEQ ID NO: 1331833 - RNA, 20 nt, Mycobacterium tuberculosis H37Rv
gaacucguugagcagcugga

SEQ ID NO: 1331834 - RNA, 18 nt, Mycobacterium tuberculosis H37Rv
gaacucaacaccagcaag

SEQ ID NO: 1331835 - RNA, 17 nt, Mycobacterium tuberculosis H37Rv
gaacuacccgccagcaa

SEQ ID NO: 1331836 - RNA, 17 nt, Mycobacterium tuberculosis H37Rv
gaacuccagcagcccgg

SEQ ID NO: 1331837 - RNA, 14 nt, Mycobacterium tuberculosis H37Rv
gaacucccacugcc

SEQ ID NO: 1331838 - RNA, 15 nt, Mycobacterium tuberculosis H37Rv
gaacucaccgccaug

SEQ ID NO: 1331839 - RNA, 13 nt, Mycobacterium tuberculosis H37Rv
gaacuccgccacc

SEQ ID NO: 1331840 - RNA, 17 nt, Mycobacterium tuberculosis H37Rv
gaacuccaucaccacac

SEQ ID NO: 1331841 - RNA, 15 nt, Mycobacterium tuberculosis H37Rv
gaacuccggguggcg

SEQ ID NO: 1331842 - RNA, 20 nt, Mycobacterium tuberculosis H37Rv
gaacuccggguggcggcggc

SEQ ID NO: 1331843 - RNA, 18 nt, Mycobacterium tuberculosis H37Rv
gaacuccgggaccaggcc

SEQ ID NO: 1331844 - RNA, 21 nt, Mycobacterium tuberculosis H37Rv
gaacauccgccgcccccgccc

SEQ ID NO: 1331845 - RNA, 17 nt, Mycobacterium tuberculosis H37Rv
gaacauugcgcccagcg

SEQ ID NO: 1331846 - RNA, 19 nt, Mycobacterium tuberculosis H37Rv
gaacauuccggcaccuccg

SEQ ID NO: 1331847 - RNA, 22 nt, Mycobacterium tuberculosis H37Rv
gaaccacgcgcccgcaccaccg

SEQ ID NO: 1331848 - RNA, 23 nt, Mycobacterium tuberculosis H37Rv
gaaccacgacguugcgaggccgc

SEQ ID NO: 1331849 - RNA, 16 nt, Mycobacterium tuberculosis H37Rv
gaaccaccaccggcaa

SEQ ID NO: 1331850 - RNA, 14 nt, Mycobacterium tuberculosis H37Rv
gaaccaccagcacg

SEQ ID NO: 1331851 - RNA, 21 nt, Mycobacterium tuberculosis H37Rv
gaaccaccggcgccgccggca

SEQ ID NO: 1331852 - RNA, 23 nt, Mycobacterium tuberculosis H37Rv
gaaccaaccucggaucgccaggc

SEQ ID NO: 1331853 - RNA, 15 nt, Mycobacterium tuberculosis H37Rv
gaacccccagcugca

SEQ ID NO: 1331854 - RNA, 17 nt, Mycobacterium tuberculosis H37Rv
gaacccccagcugcagg

SEQ ID NO: 1331855 - RNA, 18 nt, Mycobacterium tuberculosis H37Rv
gaacccccagcugcaggg

SEQ ID NO: 1331856 - RNA, 24 nt, Mycobacterium tuberculosis H37Rv
gaacccacugcccgccgacgccag

SEQ ID NO: 1331857 - RNA, 17 nt, Mycobacterium tuberculosis H37Rv
gaaccacggcaggcagg

SEQ ID NO: 1331858 - RNA, 18 nt, Mycobacterium tuberculosis H37Rv
gaaccacggcagccaacc

SEQ ID NO: 1331859 - RNA, 15 nt, Mycobacterium tuberculosis H37Rv
gaaccacggcaggca

SEQ ID NO: 1331860 - RNA, 20 nt, Mycobacterium tuberculosis H37Rv
gaaccaccgcguuggccaca

SEQ ID NO: 1331861 - RNA, 14 nt, Mycobacterium tuberculosis H37Rv
gaaccacggcagcc

SEQ ID NO: 1331862 - RNA, 21 nt, Mycobacterium tuberculosis H37Rv
gaaccacucggugauguaggg

SEQ ID NO: 1331863 - RNA, 11 nt, Mycobacterium tuberculosis H37Rv
gaaccacggcg

SEQ ID NO: 1331864 - RNA, 14 nt, Mycobacterium tuberculosis H37Rv
gaaccagcgcgugg

SEQ ID NO: 1331865 - RNA, 23 nt, Mycobacterium tuberculosis H37Rv
gaaccagaggucacgcagcaccc

SEQ ID NO: 1331866 - RNA, 21 nt, Mycobacterium tuberculosis H37Rv
gaaccagcuugcgccgcagcg

SEQ ID NO: 1331867 - RNA, 20 nt, Mycobacterium tuberculosis H37Rv
gaaccagcuugcgccgcagc

SEQ ID NO: 1331868 - RNA, 21 nt, Mycobacterium tuberculosis H37Rv
gaaccagucgaagaagacccg

SEQ ID NO: 1331869 - RNA, 15 nt, Mycobacterium tuberculosis H37Rv
gaaccagucgaccca

SEQ ID NO: 1331870 - RNA, 17 nt, Mycobacterium tuberculosis H37Rv
gaaccagucgacccagc

SEQ ID NO: 1331871 - RNA, 20 nt, Mycobacterium tuberculosis H37Rv
gaaccagucgacccagcgcg

SEQ ID NO: 1331872 - RNA, 14 nt, Mycobacterium tuberculosis H37Rv
gaaccggaccuggg

SEQ ID NO: 1331873 - RNA, 20 nt, Mycobacterium tuberculosis H37Rv
gaaccgcguuaugccaggcg

SEQ ID NO: 1331874 - RNA, 13 nt, Mycobacterium tuberculosis H37Rv
gaaccgcgcggcg

SEQ ID NO: 1331875 - RNA, 17 nt, Mycobacterium tuberculosis H37Rv
gaaccgccggcaccgcc

SEQ ID NO: 1331876 - RNA, 11 nt, Mycobacterium tuberculosis H37Rv
gaaccgcccgc

SEQ ID NO: 1331877 - RNA, 18 nt, Mycobacterium tuberculosis H37Rv
gaaccgcucagcgcagca

SEQ ID NO: 1331878 - RNA, 14 nt, Mycobacterium tuberculosis H37Rv
gaaccgggacacca

SEQ ID NO: 1331879 - RNA, 15 nt, Mycobacterium tuberculosis H37Rv
gaaccgggcaaauca

SEQ ID NO: 1331880 - RNA, 17 nt, Mycobacterium tuberculosis H37Rv
gaaccgguacaaccccc

SEQ ID NO: 1331881 - RNA, 22 nt, Mycobacterium tuberculosis H37Rv
gaaccggucagccggaccacca

SEQ ID NO: 1331882 - RNA, 15 nt, Mycobacterium tuberculosis H37Rv
gaaccgguccacugu

SEQ ID NO: 1331883 - RNA, 21 nt, Mycobacterium tuberculosis H37Rv
gaaccgacgcguccggugcac

SEQ ID NO: 1331884 - RNA, 19 nt, Mycobacterium tuberculosis H37Rv
gaaccccgcgcggugcccu

SEQ ID NO: 1331885 - RNA, 12 nt, Mycobacterium tuberculosis H37Rv
gaacccccgccg

SEQ ID NO: 1331886 - RNA, 16 nt, Mycobacterium tuberculosis H37Rv
gaaccccgggcggcgc

SEQ ID NO: 1331887 - RNA, 16 nt, Mycobacterium tuberculosis H37Rv
gaacccgagccgccgu

SEQ ID NO: 1331888 - RNA, 22 nt, Mycobacterium tuberculosis H37Rv
gaacccgcgagguugaccacca

SEQ ID NO: 1331889 - RNA, 19 nt, Mycobacterium tuberculosis H37Rv
gaaccugcucggccgugca

SEQ ID NO: 1331890 - RNA, 11 nt, Mycobacterium tuberculosis H37Rv
gaaccugcuga

SEQ ID NO: 1331891 - RNA, 15 nt, Mycobacterium tuberculosis H37Rv
gaaccgugucgccgc

SEQ ID NO: 1331892 - RNA, 18 nt, Mycobacterium tuberculosis H37Rv
gaaccguucgacccagcg

SEQ ID NO: 1331893 - RNA, 17 nt, Mycobacterium tuberculosis H37Rv
gaaccguucgacccagc

SEQ ID NO: 1331894 - RNA, 21 nt, Mycobacterium tuberculosis H37Rv
gaaccguucggcgacagcgcg

SEQ ID NO: 1331895 - RNA, 18 nt, Mycobacterium tuberculosis H37Rv
gaaccgucucgcccccuc

SEQ ID NO: 1331896 - RNA, 12 nt, Mycobacterium tuberculosis H37Rv
gaacgacgccac

SEQ ID NO: 1331897 - RNA, 15 nt, Mycobacterium tuberculosis H37Rv
gaacgacauccggcc

SEQ ID NO: 1331898 - RNA, 15 nt, Mycobacterium tuberculosis H37Rv
gaccgcggcccgcac

SEQ ID NO: 1331899 - RNA, 22 nt, Mycobacterium tuberculosis H37Rv
gaccgcggcugucacgccugcc

SEQ ID NO: 1331900 - RNA, 23 nt, Mycobacterium tuberculosis H37Rv
gaccgcggcugucacgccugcca

SEQ ID NO: 1331901 - RNA, 18 nt, Mycobacterium tuberculosis H37Rv
gaccgcgggcgccuucca

SEQ ID NO: 1331902 - RNA, 22 nt, Mycobacterium tuberculosis H37Rv
gaccgcggcguuaagguacccg

SEQ ID NO: 1331903 - RNA, 19 nt, Mycobacterium tuberculosis H37Rv
gaccgcgcacggcuggcgu

SEQ ID NO: 1331904 - RNA, 15 nt, Mycobacterium tuberculosis H37Rv
gaccgcgccgcauca

SEQ ID NO: 1331905 - RNA, 16 nt, Mycobacterium tuberculosis H37Rv
gaccgcucugcggcca

SEQ ID NO: 1331906 - RNA, 19 nt, Mycobacterium tuberculosis H37Rv
gaccgcguaaaggccuugg

SEQ ID NO: 1331907 - RNA, 19 nt, Mycobacterium tuberculosis H37Rv
gaccgcuaccagcugggcg

SEQ ID NO: 1331908 - RNA, 19 nt, Mycobacterium tuberculosis H37Rv
gaccgcucgaugucccgag

SEQ ID NO: 1331909 - RNA, 15 nt, Mycobacterium tuberculosis H37Rv
gaccgcugccugccg

SEQ ID NO: 1331910 - RNA, 23 nt, Mycobacterium tuberculosis H37Rv
gaccgcggugacucggccuccgc

SEQ ID NO: 1331911 - RNA, 20 nt, Mycobacterium tuberculosis H37Rv
gaccgcggucuucuucaccg

SEQ ID NO: 1331912 - RNA, 20 nt, Mycobacterium tuberculosis H37Rv
gaccgcgggcuccccgcaca

SEQ ID NO: 1331913 - RNA, 23 nt, Mycobacterium tuberculosis H37Rv
gaccgcgggcuccccgcacaucc

SEQ ID NO: 1331914 - RNA, 15 nt, Mycobacterium tuberculosis H37Rv
gaccgcgggucgugc

SEQ ID NO: 1331915 - RNA, 15 nt, Mycobacterium tuberculosis H37Rv
gaccgcuaccagcug

SEQ ID NO: 1331916 - RNA, 16 nt, Mycobacterium tuberculosis H37Rv
gaccgcgucggcggcc

SEQ ID NO: 1331917 - RNA, 17 nt, Mycobacterium tuberculosis H37Rv
gaccgcgucgucccagu

SEQ ID NO: 1331918 - RNA, 14 nt, Mycobacterium tuberculosis H37Rv
gaccgccuccucga

SEQ ID NO: 1331919 - RNA, 22 nt, Mycobacterium tuberculosis H37Rv
gaccgccuccucgauagcggcg

SEQ ID NO: 1331920 - RNA, 17 nt, Mycobacterium tuberculosis H37Rv
gaccgccugcgcggcug

SEQ ID NO: 1331921 - RNA, 14 nt, Mycobacterium tuberculosis H37Rv
gaccgccugcaaca

SEQ ID NO: 1331922 - RNA, 21 nt, Mycobacterium tuberculosis H37Rv
gaccgccgcgagcagaaacaa

SEQ ID NO: 1331923 - RNA, 15 nt, Mycobacterium tuberculosis H37Rv
gaccgccgcgccggc

SEQ ID NO: 1331924 - RNA, 14 nt, Mycobacterium tuberculosis H37Rv
gaccgccgcgagca

SEQ ID NO: 1331925 - RNA, 18 nt, Mycobacterium tuberculosis H37Rv
gaccgccauuucgcccga

SEQ ID NO: 1331926 - RNA, 20 nt, Mycobacterium tuberculosis H37Rv
gaccgccccggccaggacau

SEQ ID NO: 1331927 - RNA, 18 nt, Mycobacterium tuberculosis H37Rv
gaccgcccgcacccccga

SEQ ID NO: 1331928 - RNA, 17 nt, Mycobacterium tuberculosis H37Rv
gaccgccgacgccguug

SEQ ID NO: 1331929 - RNA, 16 nt, Mycobacterium tuberculosis H37Rv
gaccgccgacaccacg

SEQ ID NO: 1331930 - RNA, 18 nt, Mycobacterium tuberculosis H37Rv
gaccgccgaagaagguga

SEQ ID NO: 1331931 - RNA, 13 nt, Mycobacterium tuberculosis H37Rv
gaccgccagggcu

SEQ ID NO: 1331932 - RNA, 18 nt, Mycobacterium tuberculosis H37Rv
gaccgccagcggccgcuc

SEQ ID NO: 1331933 - RNA, 21 nt, Mycobacterium tuberculosis H37Rv
gacccauucucggccggcggc

SEQ ID NO: 1331934 - RNA, 14 nt, Mycobacterium tuberculosis H37Rv
gacccccagcaggg

SEQ ID NO: 1331935 - RNA, 19 nt, Mycobacterium tuberculosis H37Rv
gacccccugccacagcgac

SEQ ID NO: 1331936 - RNA, 16 nt, Mycobacterium tuberculosis H37Rv
gaccccgccagccgga

SEQ ID NO: 1331937 - RNA, 16 nt, Mycobacterium tuberculosis H37Rv
gaccccggcagcgccc

SEQ ID NO: 1331938 - RNA, 21 nt, Mycobacterium tuberculosis H37Rv
gaccccggcagcgcccuugga

SEQ ID NO: 1331939 - RNA, 23 nt, Mycobacterium tuberculosis H37Rv
gaccccgcuuuuucccggcggcg

SEQ ID NO: 1331940 - RNA, 20 nt, Mycobacterium tuberculosis H37Rv
gaccccggaaugcccgagca

SEQ ID NO: 1331941 - RNA, 19 nt, Mycobacterium tuberculosis H37Rv
gaccccggcguugccgccg

SEQ ID NO: 1331942 - RNA, 16 nt, Mycobacterium tuberculosis H37Rv
gaccccgucagcgggc

SEQ ID NO: 1331943 - RNA, 23 nt, Mycobacterium tuberculosis H37Rv
gaccccgucagcgggcagcaggc

SEQ ID NO: 1331944 - RNA, 16 nt, Mycobacterium tuberculosis H37Rv
gaccccucacccagcu

SEQ ID NO: 1331945 - RNA, 17 nt, Mycobacterium tuberculosis H37Rv
gaccccuggccgccggc

SEQ ID NO: 1331946 - RNA, 20 nt, Mycobacterium tuberculosis H37Rv
gaccccuggccgccggcgcc

SEQ ID NO: 1331947 - RNA, 22 nt, Mycobacterium tuberculosis H37Rv
gacccgacaugguccgaccagc

SEQ ID NO: 1331948 - RNA, 21 nt, Mycobacterium tuberculosis H37Rv
gaccgccacacggggccgcca

SEQ ID NO: 1331949 - RNA, 14 nt, Mycobacterium tuberculosis H37Rv
gaccgagacuugcu

SEQ ID NO: 1331950 - RNA, 16 nt, Mycobacterium tuberculosis H37Rv
gaccgccaccggcuga

SEQ ID NO: 1331951 - RNA, 12 nt, Mycobacterium tuberculosis H37Rv
gaccgccacccc

SEQ ID NO: 1331952 - RNA, 22 nt, Mycobacterium tuberculosis H37Rv
gacccgacgaugccggcccgca

SEQ ID NO: 1331953 - RNA, 13 nt, Mycobacterium tuberculosis H37Rv
gaccgaagaagcc

SEQ ID NO: 1331954 - RNA, 15 nt, Mycobacterium tuberculosis H37Rv
gaccgaagaagcccg

SEQ ID NO: 1331955 - RNA, 21 nt, Mycobacterium tuberculosis H37Rv
gaccgaauggccgccgcagcu

SEQ ID NO: 1331956 - RNA, 19 nt, Mycobacterium tuberculosis H37Rv
gaccgacccggaccugggc

SEQ ID NO: 1331957 - RNA, 17 nt, Mycobacterium tuberculosis H37Rv
gaccgaauggccgccgc

SEQ ID NO: 1331958 - RNA, 14 nt, Mycobacterium tuberculosis H37Rv
gaccgacaccacca

SEQ ID NO: 1331959 - RNA, 20 nt, Mycobacterium tuberculosis H37Rv
gaccacgccgccggcgcuga

SEQ ID NO: 1331960 - RNA, 11 nt, Mycobacterium tuberculosis H37Rv
gaccagcggcg

SEQ ID NO: 1331961 - RNA, 13 nt, Mycobacterium tuberculosis H37Rv
gaccagcgcggca

SEQ ID NO: 1331962 - RNA, 22 nt, Mycobacterium tuberculosis H37Rv
gaccagcguggggccgccacca

SEQ ID NO: 1331963 - RNA, 17 nt, Mycobacterium tuberculosis H37Rv
gaccagcgggcggcccu

SEQ ID NO: 1331964 - RNA, 15 nt, Mycobacterium tuberculosis H37Rv
gaccagcguccagcc

SEQ ID NO: 1331965 - RNA, 18 nt, Mycobacterium tuberculosis H37Rv
gaccagcguccagccgcc

SEQ ID NO: 1331966 - RNA, 17 nt, Mycobacterium tuberculosis H37Rv
gaccacgaauggggcca

SEQ ID NO: 1331967 - RNA, 21 nt, Mycobacterium tuberculosis H37Rv
gaccacgcaagggaauccgaa

SEQ ID NO: 1331968 - RNA, 20 nt, Mycobacterium tuberculosis H37Rv
gaccaccucagcugcggacu

SEQ ID NO: 1331969 - RNA, 14 nt, Mycobacterium tuberculosis H37Rv
gaccaccugcugca

SEQ ID NO: 1331970 - RNA, 19 nt, Mycobacterium tuberculosis H37Rv
gaccaccucgaugccgccc

SEQ ID NO: 1331971 - RNA, 18 nt, Mycobacterium tuberculosis H37Rv
gaccaccugagccggggu

SEQ ID NO: 1331972 - RNA, 21 nt, Mycobacterium tuberculosis H37Rv
gaccaccuucugacgcggccg

SEQ ID NO: 1331973 - RNA, 18 nt, Mycobacterium tuberculosis H37Rv
gaccaccgcgaaagcacc

SEQ ID NO: 1331974 - RNA, 19 nt, Mycobacterium tuberculosis H37Rv
gaccaccgggccgacagca

SEQ ID NO: 1331975 - RNA, 12 nt, Mycobacterium tuberculosis H37Rv
gaccaccgggua

SEQ ID NO: 1331976 - RNA, 20 nt, Mycobacterium tuberculosis H37Rv
gaccaccgcggcaugugaca

SEQ ID NO: 1331977 - RNA, 20 nt, Mycobacterium tuberculosis H37Rv
gaccaccgcgucgggccgca

SEQ ID NO: 1331978 - RNA, 13 nt, Mycobacterium tuberculosis H37Rv
gaccacccggcgc

SEQ ID NO: 1331979 - RNA, 12 nt, Mycobacterium tuberculosis H37Rv
gaccaccagcau

SEQ ID NO: 1331980 - RNA, 22 nt, Mycobacterium tuberculosis H37Rv
gaccaugagcuugguggccacc

SEQ ID NO: 1331981 - RNA, 23 nt, Mycobacterium tuberculosis H37Rv
gaccaugagcuugguggccacca

SEQ ID NO: 1331982 - RNA, 22 nt, Mycobacterium tuberculosis H37Rv
gacccagccagcagcggcgagc

SEQ ID NO: 1331983 - RNA, 23 nt, Mycobacterium tuberculosis H37Rv
gacccaugagcccgugacauucu

SEQ ID NO: 1331984 - RNA, 19 nt, Mycobacterium tuberculosis H37Rv
gaccauagucgccgucgug

SEQ ID NO: 1331985 - RNA, 22 nt, Mycobacterium tuberculosis H37Rv
gaccaucguguacuggucugga

SEQ ID NO: 1331986 - RNA, 15 nt, Mycobacterium tuberculosis H37Rv
gaccaucgccaggcc

SEQ ID NO: 1331987 - RNA, 16 nt, Mycobacterium tuberculosis H37Rv
gaccaucaccacggcc

SEQ ID NO: 1331988 - RNA, 16 nt, Mycobacterium tuberculosis H37Rv
gaccaucacgcccugu

SEQ ID NO: 1331989 - RNA, 20 nt, Mycobacterium tuberculosis H37Rv
gaccacagccgcgccgaccu

SEQ ID NO: 1331990 - RNA, 13 nt, Mycobacterium tuberculosis H37Rv
gaccaccagugag

SEQ ID NO: 1331991 - RNA, 22 nt, Mycobacterium tuberculosis H37Rv
gaccaaugucagugccccgccc

SEQ ID NO: 1331992 - RNA, 21 nt, Mycobacterium tuberculosis H37Rv
gacagucaacagggccaggac

SEQ ID NO: 1331993 - RNA, 17 nt, Mycobacterium tuberculosis H37Rv
gacagucaacagggcca

SEQ ID NO: 1331994 - RNA, 21 nt, Mycobacterium tuberculosis H37Rv
gacauccagaugcccagcagg

SEQ ID NO: 1331995 - RNA, 22 nt, Mycobacterium tuberculosis H37Rv
gacauccacaccgcggcggcgc

SEQ ID NO: 1331996 - RNA, 18 nt, Mycobacterium tuberculosis H37Rv
gacauccgggccgagcgc

SEQ ID NO: 1331997 - RNA, 23 nt, Mycobacterium tuberculosis H37Rv
gacaugccauaugggggaaagcu

SEQ ID NO: 1331998 - RNA, 20 nt, Mycobacterium tuberculosis H37Rv
gacaugccauaugggggaaa

SEQ ID NO: 1331999 - RNA, 16 nt, Mycobacterium tuberculosis H37Rv
gacaugcgggcagcac

SEQ ID NO: 1332000 - RNA, 21 nt, Mycobacterium tuberculosis H37Rv
gacaugucgaacgccccccac

SEQ ID NO: 1332001 - RNA, 20 nt, Mycobacterium tuberculosis H37Rv
gacaugguccgaccagcggc

SEQ ID NO: 1332002 - RNA, 22 nt, Mycobacterium tuberculosis H37Rv
gacaggugccagaccagggcag

SEQ ID NO: 1332003 - RNA, 22 nt, Mycobacterium tuberculosis H37Rv
gacagggugggggcaucagggu

SEQ ID NO: 1332004 - RNA, 22 nt, Mycobacterium tuberculosis H37Rv
gacagggcggcaaccucaugca

SEQ ID NO: 1332005 - RNA, 22 nt, Mycobacterium tuberculosis H37Rv
gacaggucgcccaacaccgcgc

SEQ ID NO: 1332006 - RNA, 13 nt, Mycobacterium tuberculosis H37Rv
gacagggcggcga

SEQ ID NO: 1332007 - RNA, 16 nt, Mycobacterium tuberculosis H37Rv
gacagcccacgagugc

SEQ ID NO: 1332008 - RNA, 14 nt, Mycobacterium tuberculosis H37Rv
gacagccccgcggc

SEQ ID NO: 1332009 - RNA, 15 nt, Mycobacterium tuberculosis H37Rv
gacagccccgcggcc

SEQ ID NO: 1332010 - RNA, 19 nt, Mycobacterium tuberculosis H37Rv
gacagccccgccgcccucc

SEQ ID NO: 1332011 - RNA, 19 nt, Mycobacterium tuberculosis H37Rv
gacagccccaucaccaccg

SEQ ID NO: 1332012 - RNA, 13 nt, Mycobacterium tuberculosis H37Rv
gacaggccgagca

SEQ ID NO: 1332013 - RNA, 20 nt, Mycobacterium tuberculosis H37Rv
gacaggccggccaccagucc

SEQ ID NO: 1332014 - RNA, 13 nt, Mycobacterium tuberculosis H37Rv
gacagaugcaucc

SEQ ID NO: 1332015 - RNA, 15 nt, Mycobacterium tuberculosis H37Rv
gacagaugcauccag

SEQ ID NO: 1332016 - RNA, 19 nt, Mycobacterium tuberculosis H37Rv
gacagaugugguaccagcc

SEQ ID NO: 1332017 - RNA, 23 nt, Mycobacterium tuberculosis H37Rv
gacagauagacuagccgauccag

SEQ ID NO: 1332018 - RNA, 19 nt, Mycobacterium tuberculosis H37Rv
gacagcaucacgaucacgu

SEQ ID NO: 1332019 - RNA, 19 nt, Mycobacterium tuberculosis H37Rv
gacagccaguguugcagug

SEQ ID NO: 1332020 - RNA, 21 nt, Mycobacterium tuberculosis H37Rv
gacaccgcggcgaucugcgac

SEQ ID NO: 1332021 - RNA, 17 nt, Mycobacterium tuberculosis H37Rv
gacaccggucggcagcu

SEQ ID NO: 1332022 - RNA, 14 nt, Mycobacterium tuberculosis H37Rv
gacaccggcugacc

SEQ ID NO: 1332023 - RNA, 11 nt, Mycobacterium tuberculosis H37Rv
gacaccgcgca

SEQ ID NO: 1332024 - RNA, 22 nt, Mycobacterium tuberculosis H37Rv
gacaccggcuauaucccgcccc

SEQ ID NO: 1332025 - RNA, 13 nt, Mycobacterium tuberculosis H37Rv
gacagacaggauu

SEQ ID NO: 1332026 - RNA, 16 nt, Mycobacterium tuberculosis H37Rv
gacaccguccagcagc

SEQ ID NO: 1332027 - RNA, 12 nt, Mycobacterium tuberculosis H37Rv
gacagacacagc

SEQ ID NO: 1332028 - RNA, 16 nt, Mycobacterium tuberculosis H37Rv
gacacccgcagcugug

SEQ ID NO: 1332029 - RNA, 16 nt, Mycobacterium tuberculosis H37Rv
gacacccugggugccg

SEQ ID NO: 1332030 - RNA, 15 nt, Mycobacterium tuberculosis H37Rv
gacacccgccaggcc

SEQ ID NO: 1332031 - RNA, 16 nt, Mycobacterium tuberculosis H37Rv
gacacccgagggccug

SEQ ID NO: 1332032 - RNA, 12 nt, Mycobacterium tuberculosis H37Rv
gacacccgggcc

SEQ ID NO: 1332033 - RNA, 16 nt, Mycobacterium tuberculosis H37Rv
gacaccgaaccgccgc

SEQ ID NO: 1332034 - RNA, 15 nt, Mycobacterium tuberculosis H37Rv
gacaccgaccggguc

SEQ ID NO: 1332035 - RNA, 18 nt, Mycobacterium tuberculosis H37Rv
gacaccgaggaccucguc

SEQ ID NO: 1332036 - RNA, 13 nt, Mycobacterium tuberculosis H37Rv
gacgccgccguug

SEQ ID NO: 1332037 - RNA, 21 nt, Mycobacterium tuberculosis H37Rv
gacgccgccacccggcgggcg

SEQ ID NO: 1332038 - RNA, 15 nt, Mycobacterium tuberculosis H37Rv
gacgcccggcgcacc

SEQ ID NO: 1332039 - RNA, 12 nt, Mycobacterium tuberculosis H37Rv
gacgccagaacg

SEQ ID NO: 1332040 - RNA, 16 nt, Mycobacterium tuberculosis H37Rv
gacgccaccgccacca

SEQ ID NO: 1332041 - RNA, 21 nt, Mycobacterium tuberculosis H37Rv
gacgccaccgccaccacccag

SEQ ID NO: 1332042 - RNA, 23 nt, Mycobacterium tuberculosis H37Rv
gacgccaccgccaccacccaggc

SEQ ID NO: 1332043 - RNA, 22 nt, Mycobacterium tuberculosis H37Rv
gacgcccacaugcucagggcag

SEQ ID NO: 1332044 - RNA, 18 nt, Mycobacterium tuberculosis H37Rv
gacgcccaggcauggccu

SEQ ID NO: 1332045 - RNA, 16 nt, Mycobacterium tuberculosis H37Rv
gacgcccagggcgucg

SEQ ID NO: 1332046 - RNA, 13 nt, Mycobacterium tuberculosis H37Rv
gacgccagcugcc

SEQ ID NO: 1332047 - RNA, 23 nt, Mycobacterium tuberculosis H37Rv
gacgccaguugcguuguccacca

SEQ ID NO: 1332048 - RNA, 19 nt, Mycobacterium tuberculosis H37Rv
gacgccaucugcuggcugg

SEQ ID NO: 1332049 - RNA, 20 nt, Mycobacterium tuberculosis H37Rv
gacgccaucugcuggcuggg

SEQ ID NO: 1332050 - RNA, 21 nt, Mycobacterium tuberculosis H37Rv
gacgccaucugcuggcuggga

SEQ ID NO: 1332051 - RNA, 15 nt, Mycobacterium tuberculosis H37Rv
gacgacugggcgccc

SEQ ID NO: 1332052 - RNA, 22 nt, Mycobacterium tuberculosis H37Rv
gacgaggucauaucgacgggcc

SEQ ID NO: 1332053 - RNA, 24 nt, Mycobacterium tuberculosis H37Rv
gacgagugguccggcggccgguag

SEQ ID NO: 1332054 - RNA, 19 nt, Mycobacterium tuberculosis H37Rv
gacgacgucgccgccgcgg

SEQ ID NO: 1332055 - RNA, 22 nt, Mycobacterium tuberculosis H37Rv
gacgacguagaugguggucacc

SEQ ID NO: 1332056 - RNA, 15 nt, Mycobacterium tuberculosis H37Rv
gacgacgggguuggg

SEQ ID NO: 1332057 - RNA, 11 nt, Mycobacterium tuberculosis H37Rv
gacgacgccaa

SEQ ID NO: 1332058 - RNA, 16 nt, Mycobacterium tuberculosis H37Rv
gacgacgacaccgcgc

SEQ ID NO: 1332059 - RNA, 22 nt, Mycobacterium tuberculosis H37Rv
gacgacggcauuucagcgcgcc

SEQ ID NO: 1332060 - RNA, 20 nt, Mycobacterium tuberculosis H37Rv
gacgacgccgacgaugacgc

SEQ ID NO: 1332061 - RNA, 21 nt, Mycobacterium tuberculosis H37Rv
gacgcaggaucacacuggccu

SEQ ID NO: 1332062 - RNA, 21 nt, Mycobacterium tuberculosis H37Rv
gacgcagcuugcccgacggcg

SEQ ID NO: 1332063 - RNA, 20 nt, Mycobacterium tuberculosis H37Rv
gacgauccagucugggacac

SEQ ID NO: 1332064 - RNA, 21 nt, Mycobacterium tuberculosis H37Rv
gacgauccccauugcgcccca

SEQ ID NO: 1332065 - RNA, 14 nt, Mycobacterium tuberculosis H37Rv
gacgaucaagcugg

SEQ ID NO: 1332066 - RNA, 16 nt, Mycobacterium tuberculosis H37Rv
gacgaucaagccuucg

SEQ ID NO: 1332067 - RNA, 18 nt, Mycobacterium tuberculosis H37Rv
gaccggcgaccggcgagc

SEQ ID NO: 1332068 - RNA, 19 nt, Mycobacterium tuberculosis H37Rv
gaccggaaaccacagcgcc

SEQ ID NO: 1332069 - RNA, 14 nt, Mycobacterium tuberculosis H37Rv
gaccggcaauuccg

SEQ ID NO: 1332070 - RNA, 23 nt, Mycobacterium tuberculosis H37Rv
gaccggaguucagugcgcgugcc

SEQ ID NO: 1332071 - RNA, 20 nt, Mycobacterium tuberculosis H37Rv
gaccggaucugacggcgccg

SEQ ID NO: 1332072 - RNA, 11 nt, Mycobacterium tuberculosis H37Rv
gaccuggccac

SEQ ID NO: 1332073 - RNA, 20 nt, Mycobacterium tuberculosis H37Rv
gaccuggaacugcauggugg

SEQ ID NO: 1332074 - RNA, 21 nt, Mycobacterium tuberculosis H37Rv
gaccugaggcaccucggccuu

SEQ ID NO: 1332075 - RNA, 20 nt, Mycobacterium tuberculosis H37Rv
gaccugcaugggcagcuggu

SEQ ID NO: 1332076 - RNA, 19 nt, Mycobacterium tuberculosis H37Rv
gaccuugaucgagcagggu

SEQ ID NO: 1332077 - RNA, 16 nt, Mycobacterium tuberculosis H37Rv
gaccugguugaccucg

SEQ ID NO: 1332078 - RNA, 18 nt, Mycobacterium tuberculosis H37Rv
gaccuuguugaccaccac

SEQ ID NO: 1332079 - RNA, 21 nt, Mycobacterium tuberculosis H37Rv
gaccuuuugcggcaagcgcac

SEQ ID NO: 1332080 - RNA, 21 nt, Mycobacterium tuberculosis H37Rv
gaccuugguguggggcggcuu

SEQ ID NO: 1332081 - RNA, 14 nt, Mycobacterium tuberculosis H37Rv
gacgaacugcagcc

SEQ ID NO: 1332082 - RNA, 23 nt, Mycobacterium tuberculosis H37Rv
gacgaagaucgcgugccacagca

SEQ ID NO: 1332083 - RNA, 17 nt, Mycobacterium tuberculosis H37Rv
gacgaacgaccaggcgc

SEQ ID NO: 1332084 - RNA, 14 nt, Mycobacterium tuberculosis H37Rv
gacgaacgccgucg

SEQ ID NO: 1332085 - RNA, 16 nt, Mycobacterium tuberculosis H37Rv
gacgacgagggcggga

SEQ ID NO: 1332086 - RNA, 16 nt, Mycobacterium tuberculosis H37Rv
gacgaaccgccagaau

SEQ ID NO: 1332087 - RNA, 19 nt, Mycobacterium tuberculosis H37Rv
gacgaaccggaucaucgcc

SEQ ID NO: 1332088 - RNA, 20 nt, Mycobacterium tuberculosis H37Rv
gacgaaauccgccgggcgcc

SEQ ID NO: 1332089 - RNA, 20 nt, Mycobacterium tuberculosis H37Rv
gacguggugggcuuggcugu

SEQ ID NO: 1332090 - RNA, 23 nt, Mycobacterium tuberculosis H37Rv
gacguggugggcuuggcuguggu

SEQ ID NO: 1332091 - RNA, 23 nt, Mycobacterium tuberculosis H37Rv
gacgucaaacgcaaagacagcgc

SEQ ID NO: 1332092 - RNA, 16 nt, Mycobacterium tuberculosis H37Rv
gacguauagaccaggu

SEQ ID NO: 1332093 - RNA, 20 nt, Mycobacterium tuberculosis H37Rv
gacguaggcgcugaagauca

SEQ ID NO: 1332094 - RNA, 16 nt, Mycobacterium tuberculosis H37Rv
gacguagggcagcgcc

SEQ ID NO: 1332095 - RNA, 14 nt, Mycobacterium tuberculosis H37Rv
gacguggcuugagu

SEQ ID NO: 1332096 - RNA, 18 nt, Mycobacterium tuberculosis H37Rv
gacgucaggcagcuccgc

SEQ ID NO: 1332097 - RNA, 17 nt, Mycobacterium tuberculosis H37Rv
gacuaccaucgccgccc

SEQ ID NO: 1332098 - RNA, 20 nt, Mycobacterium tuberculosis H37Rv
gacuaccgccggcggcggcc

SEQ ID NO: 1332099 - RNA, 18 nt, Mycobacterium tuberculosis H37Rv
gacuaccgccggcggcgg

SEQ ID NO: 1332100 - RNA, 22 nt, Mycobacterium tuberculosis H37Rv
gacuagcugcuagcccggcggc

SEQ ID NO: 1332101 - RNA, 18 nt, Mycobacterium tuberculosis H37Rv
gacuagcuggggucaaag

SEQ ID NO: 1332102 - RNA, 15 nt, Mycobacterium tuberculosis H37Rv
gacggccggcaagca

SEQ ID NO: 1332103 - RNA, 21 nt, Mycobacterium tuberculosis H37Rv
gacggccuggggcagccgggc

SEQ ID NO: 1332104 - RNA, 17 nt, Mycobacterium tuberculosis H37Rv
gacggcgaacccgccga

SEQ ID NO: 1332105 - RNA, 23 nt, Mycobacterium tuberculosis H37Rv
gacggcgccgcucacggggcgug

SEQ ID NO: 1332106 - RNA, 14 nt, Mycobacterium tuberculosis H37Rv
gacggcgccaggca

SEQ ID NO: 1332107 - RNA, 19 nt, Mycobacterium tuberculosis H37Rv
gacggucaaaugaauggug

SEQ ID NO: 1332108 - RNA, 22 nt, Mycobacterium tuberculosis H37Rv
gacggcugccgucagccguucg

SEQ ID NO: 1332109 - RNA, 18 nt, Mycobacterium tuberculosis H37Rv
gacggcgucugcgguggc

SEQ ID NO: 1332110 - RNA, 16 nt, Mycobacterium tuberculosis H37Rv
gacggcgcuguggcgg

SEQ ID NO: 1332111 - RNA, 20 nt, Mycobacterium tuberculosis H37Rv
gacggcggccgcgauggcgu

SEQ ID NO: 1332112 - RNA, 14 nt, Mycobacterium tuberculosis H37Rv
gacggcgggcccgg

SEQ ID NO: 1332113 - RNA, 14 nt, Mycobacterium tuberculosis H37Rv
gacggucgucgauc

SEQ ID NO: 1332114 - RNA, 21 nt, Mycobacterium tuberculosis H37Rv
gacgguccguucgaugccagu

SEQ ID NO: 1332115 - RNA, 20 nt, Mycobacterium tuberculosis H37Rv
gacggucaaggugcgccgcc

SEQ ID NO: 1332116 - RNA, 14 nt, Mycobacterium tuberculosis H37Rv
gacggucacggugg

SEQ ID NO: 1332117 - RNA, 14 nt, Mycobacterium tuberculosis H37Rv
gacggucagccgcg

SEQ ID NO: 1332118 - RNA, 20 nt, Mycobacterium tuberculosis H37Rv
gacggugcaggaccagaacu

SEQ ID NO: 1332119 - RNA, 17 nt, Mycobacterium tuberculosis H37Rv
gacggugaagccguuug

SEQ ID NO: 1332120 - RNA, 17 nt, Mycobacterium tuberculosis H37Rv
gacggugaagccgagcg

SEQ ID NO: 1332121 - RNA, 15 nt, Mycobacterium tuberculosis H37Rv
gacggugaccgggag

SEQ ID NO: 1332122 - RNA, 14 nt, Mycobacterium tuberculosis H37Rv
gacguaccacggcg

SEQ ID NO: 1332123 - RNA, 11 nt, Mycobacterium tuberculosis H37Rv
gacguagacga

SEQ ID NO: 1332124 - RNA, 20 nt, Mycobacterium tuberculosis H37Rv
gacguagaagucgaucgccg

SEQ ID NO: 1332125 - RNA, 15 nt, Mycobacterium tuberculosis H37Rv
gacguaggccagguc

SEQ ID NO: 1332126 - RNA, 14 nt, Mycobacterium tuberculosis H37Rv
gacggugcggucag

SEQ ID NO: 1332127 - RNA, 15 nt, Mycobacterium tuberculosis H37Rv
gacggugcgcuggau

SEQ ID NO: 1332128 - RNA, 13 nt, Mycobacterium tuberculosis H37Rv
gacggugccgucg

SEQ ID NO: 1332129 - RNA, 22 nt, Mycobacterium tuberculosis H37Rv
gacggagguccuacgugcugcg

SEQ ID NO: 1332130 - RNA, 17 nt, Mycobacterium tuberculosis H37Rv
gacggcagugcugcaga

SEQ ID NO: 1332131 - RNA, 20 nt, Mycobacterium tuberculosis H37Rv
gacggaggucggagcgggcu

SEQ ID NO: 1332132 - RNA, 22 nt, Mycobacterium tuberculosis H37Rv
gacggcauguaccgaccgcguu

SEQ ID NO: 1332133 - RNA, 14 nt, Mycobacterium tuberculosis H37Rv
gacggacucccucg

SEQ ID NO: 1332134 - RNA, 16 nt, Mycobacterium tuberculosis H37Rv
gacggacuucccgcgc

SEQ ID NO: 1332135 - RNA, 14 nt, Mycobacterium tuberculosis H37Rv
gacggccacaugga

SEQ ID NO: 1332136 - RNA, 19 nt, Mycobacterium tuberculosis H37Rv
gacggcaucaacgcgggcg

SEQ ID NO: 1332137 - RNA, 15 nt, Mycobacterium tuberculosis H37Rv
gacggccauauccaa

SEQ ID NO: 1332138 - RNA, 13 nt, Mycobacterium tuberculosis H37Rv
gacggccagccca

SEQ ID NO: 1332139 - RNA, 14 nt, Mycobacterium tuberculosis H37Rv
gacggccagcagga

SEQ ID NO: 1332140 - RNA, 14 nt, Mycobacterium tuberculosis H37Rv
gacgccggccgccg

SEQ ID NO: 1332141 - RNA, 14 nt, Mycobacterium tuberculosis H37Rv
gacgccggccuggc

SEQ ID NO: 1332142 - RNA, 24 nt, Mycobacterium tuberculosis H37Rv
gacgccgucaugcccaucuccaac

SEQ ID NO: 1332143 - RNA, 21 nt, Mycobacterium tuberculosis H37Rv
gacgccguagccggccggccc

SEQ ID NO: 1332144 - RNA, 23 nt, Mycobacterium tuberculosis H37Rv
gacgccgguggcagagccgccgu

SEQ ID NO: 1332145 - RNA, 22 nt, Mycobacterium tuberculosis H37Rv
gacgccggguccaucaacccca

SEQ ID NO: 1332146 - RNA, 17 nt, Mycobacterium tuberculosis H37Rv
gacgccguugccgccgu

SEQ ID NO: 1332147 - RNA, 17 nt, Mycobacterium tuberculosis H37Rv
gacgcuguggcucgacg

SEQ ID NO: 1332148 - RNA, 16 nt, Mycobacterium tuberculosis H37Rv
gacgccguugccgccg

SEQ ID NO: 1332149 - RNA, 23 nt, Mycobacterium tuberculosis H37Rv
gaacuugcggaccuggcggcggu

SEQ ID NO: 1332150 - RNA, 16 nt, Mycobacterium tuberculosis H37Rv
gaacuucagcggcggg

SEQ ID NO: 1332151 - RNA, 21 nt, Mycobacterium tuberculosis H37Rv
gaacuggucucggcugagacg

SEQ ID NO: 1332152 - RNA, 22 nt, Mycobacterium tuberculosis H37Rv
gaagacuuagcgggugccagcc

SEQ ID NO: 1332153 - RNA, 15 nt, Mycobacterium tuberculosis H37Rv
gaagacuagcugcua

SEQ ID NO: 1332154 - RNA, 23 nt, Mycobacterium tuberculosis H37Rv
gaagacggccaccggggucaccu

SEQ ID NO: 1332155 - RNA, 22 nt, Mycobacterium tuberculosis H37Rv
gaagaacucggugcccccaccc

SEQ ID NO: 1332156 - RNA, 12 nt, Mycobacterium tuberculosis H37Rv
gaagcacacugu

SEQ ID NO: 1332157 - RNA, 13 nt, Mycobacterium tuberculosis H37Rv
gaagcaccucccg

SEQ ID NO: 1332158 - RNA, 22 nt, Mycobacterium tuberculosis H37Rv
gaagcccagcaccaccacccga

SEQ ID NO: 1332159 - RNA, 16 nt, Mycobacterium tuberculosis H37Rv
gaagcccagaucuugc

SEQ ID NO: 1332160 - RNA, 18 nt, Mycobacterium tuberculosis H37Rv
gaagagggcgccgcgcgc

SEQ ID NO: 1332161 - RNA, 21 nt, Mycobacterium tuberculosis H37Rv
gaagcgggacugcagcgcggu

SEQ ID NO: 1332162 - RNA, 19 nt, Mycobacterium tuberculosis H37Rv
gaagcgggaaggcucacca

SEQ ID NO: 1332163 - RNA, 13 nt, Mycobacterium tuberculosis H37Rv
gaagcggccaccg

SEQ ID NO: 1332164 - RNA, 20 nt, Mycobacterium tuberculosis H37Rv
gaagccccgguggcagggaa

SEQ ID NO: 1332165 - RNA, 19 nt, Mycobacterium tuberculosis H37Rv
gaagccccgguggcaggga

SEQ ID NO: 1332166 - RNA, 13 nt, Mycobacterium tuberculosis H37Rv
gaagcgccaaccc

SEQ ID NO: 1332167 - RNA, 17 nt, Mycobacterium tuberculosis H37Rv
gaagcgccggccgaucg

SEQ ID NO: 1332168 - RNA, 16 nt, Mycobacterium tuberculosis H37Rv
gaaggcgcgcgcccgg

SEQ ID NO: 1332169 - RNA, 19 nt, Mycobacterium tuberculosis H37Rv
gaaggcggcgauacccauc

SEQ ID NO: 1332170 - RNA, 17 nt, Mycobacterium tuberculosis H37Rv
gaaggccgcgcgcaggg

SEQ ID NO: 1332171 - RNA, 15 nt, Mycobacterium tuberculosis H37Rv
gaaguacaucugccg

SEQ ID NO: 1332172 - RNA, 13 nt, Mycobacterium tuberculosis H37Rv
gaaguacacggcg

SEQ ID NO: 1332173 - RNA, 15 nt, Mycobacterium tuberculosis H37Rv
gaaguaauagcuguu

SEQ ID NO: 1332174 - RNA, 23 nt, Mycobacterium tuberculosis H37Rv
gaaggcgacaucaccaccgaccu

SEQ ID NO: 1332175 - RNA, 22 nt, Mycobacterium tuberculosis H37Rv
gaaggccgcgcgcagggcgucg

SEQ ID NO: 1332176 - RNA, 23 nt, Mycobacterium tuberculosis H37Rv
gaaggagauccuuaucgcucucg

SEQ ID NO: 1332177 - RNA, 18 nt, Mycobacterium tuberculosis H37Rv
gaaggaucagcgcacugg

SEQ ID NO: 1332178 - RNA, 22 nt, Mycobacterium tuberculosis H37Rv
gaaggaugcggccccaugcgcc

SEQ ID NO: 1332179 - RNA, 23 nt, Mycobacterium tuberculosis H37Rv
gaaggauuuggagcuuuuugcgu

SEQ ID NO: 1332180 - RNA, 20 nt, Mycobacterium tuberculosis H37Rv
gaaggauucgaagccgagcu

SEQ ID NO: 1332181 - RNA, 16 nt, Mycobacterium tuberculosis H37Rv
gaaguccuccacgcug

SEQ ID NO: 1332182 - RNA, 21 nt, Mycobacterium tuberculosis H37Rv
gaagucgcggacgucgccccg

SEQ ID NO: 1332183 - RNA, 13 nt, Mycobacterium tuberculosis H37Rv
gaaguuccagccg

SEQ ID NO: 1332184 - RNA, 22 nt, Mycobacterium tuberculosis H37Rv
gaaguucgucgguugccacgcc

SEQ ID NO: 1332185 - RNA, 16 nt, Mycobacterium tuberculosis H37Rv
gaaguuuuggaagccc

SEQ ID NO: 1332186 - RNA, 18 nt, Mycobacterium tuberculosis H37Rv
gaauacccgcuggcccgc

SEQ ID NO: 1332187 - RNA, 22 nt, Mycobacterium tuberculosis H37Rv
gaauacagcuugaucgccgagg

SEQ ID NO: 1332188 - RNA, 21 nt, Mycobacterium tuberculosis H37Rv
gaaucauguacguugucgugg

SEQ ID NO: 1332189 - RNA, 21 nt, Mycobacterium tuberculosis H37Rv
gaauccaccagccgguagccg

SEQ ID NO: 1332190 - RNA, 22 nt, Mycobacterium tuberculosis H37Rv
gaauccaccagccgguagccgg

SEQ ID NO: 1332191 - RNA, 15 nt, Mycobacterium tuberculosis H37Rv
gaauccccccugucg

SEQ ID NO: 1332192 - RNA, 13 nt, Mycobacterium tuberculosis H37Rv
gaaucccaucggg

SEQ ID NO: 1332193 - RNA, 17 nt, Mycobacterium tuberculosis H37Rv
gaaucccaacuccucca

SEQ ID NO: 1332194 - RNA, 16 nt, Mycobacterium tuberculosis H37Rv
gaauccaggagcccca

SEQ ID NO: 1332195 - RNA, 21 nt, Mycobacterium tuberculosis H37Rv
gaaucagcaccccauggccac

SEQ ID NO: 1332196 - RNA, 15 nt, Mycobacterium tuberculosis H37Rv
gaaucagugaagaca

SEQ ID NO: 1332197 - RNA, 17 nt, Mycobacterium tuberculosis H37Rv
gaaucagggucugcgcc

SEQ ID NO: 1332198 - RNA, 17 nt, Mycobacterium tuberculosis H37Rv
gaaucuucugagacugc

SEQ ID NO: 1332199 - RNA, 23 nt, Mycobacterium tuberculosis H37Rv
gaaucuucugagacugccgccgc

SEQ ID NO: 1332200 - RNA, 18 nt, Mycobacterium tuberculosis H37Rv
gaaugacgauccagccca

SEQ ID NO: 1332201 - RNA, 19 nt, Mycobacterium tuberculosis H37Rv
gaaugaccuugcccugcgu

SEQ ID NO: 1332202 - RNA, 23 nt, Mycobacterium tuberculosis H37Rv
gaaugucgcgcuguuguggaaca

SEQ ID NO: 1332203 - RNA, 17 nt, Mycobacterium tuberculosis H37Rv
gaaugucguugagaagc

SEQ ID NO: 1332204 - RNA, 18 nt, Mycobacterium tuberculosis H37Rv
gaaugucuccaguagccg

SEQ ID NO: 1332205 - RNA, 16 nt, Mycobacterium tuberculosis H37Rv
gaaugucuuuggucgc

SEQ ID NO: 1332206 - RNA, 17 nt, Mycobacterium tuberculosis H37Rv
gaauguugccgccgcgg

SEQ ID NO: 1332207 - RNA, 21 nt, Mycobacterium tuberculosis H37Rv
gaauguugcgaucugcggcgc

SEQ ID NO: 1332208 - RNA, 22 nt, Mycobacterium tuberculosis H37Rv
gaaugucccgguguccagccac

SEQ ID NO: 1332209 - RNA, 21 nt, Mycobacterium tuberculosis H37Rv
gaaugcggugaguccgcugag

SEQ ID NO: 1332210 - RNA, 15 nt, Mycobacterium tuberculosis H37Rv
gaaugccuggcccgu

SEQ ID NO: 1332211 - RNA, 14 nt, Mycobacterium tuberculosis H37Rv
gaaugcgccgucgg

SEQ ID NO: 1332212 - RNA, 17 nt, Mycobacterium tuberculosis H37Rv
gacaaccccgccaggau

SEQ ID NO: 1332213 - RNA, 15 nt, Mycobacterium tuberculosis H37Rv
gacaaccgagcugac

SEQ ID NO: 1332214 - RNA, 19 nt, Mycobacterium tuberculosis H37Rv
gacaaccggccagauggug

SEQ ID NO: 1332215 - RNA, 17 nt, Mycobacterium tuberculosis H37Rv
gacaacgacgucgccga

SEQ ID NO: 1332216 - RNA, 20 nt, Mycobacterium tuberculosis H37Rv
gacaagugccggcgcggagu

SEQ ID NO: 1332217 - RNA, 16 nt, Mycobacterium tuberculosis H37Rv
gacaaguggugcccuu

SEQ ID NO: 1332218 - RNA, 13 nt, Mycobacterium tuberculosis H37Rv
gacaagucaagau

SEQ ID NO: 1332219 - RNA, 13 nt, Mycobacterium tuberculosis H37Rv
gacaacggcgguc

SEQ ID NO: 1332220 - RNA, 22 nt, Mycobacterium tuberculosis H37Rv
gacaacgggccuucagcucacc

SEQ ID NO: 1332221 - RNA, 15 nt, Mycobacterium tuberculosis H37Rv
gacaaaccgggcggc

SEQ ID NO: 1332222 - RNA, 15 nt, Mycobacterium tuberculosis H37Rv
gacaaagaagugguc

SEQ ID NO: 1332223 - RNA, 18 nt, Mycobacterium tuberculosis H37Rv
gacaaaaucagcagcccc

SEQ ID NO: 1332224 - RNA, 22 nt, Mycobacterium tuberculosis H37Rv
gacaaaaucagcagccccccgc

SEQ ID NO: 1332225 - RNA, 16 nt, Mycobacterium tuberculosis H37Rv
gacaaaaucagcagcc

SEQ ID NO: 1332226 - RNA, 15 nt, Mycobacterium tuberculosis H37Rv
gacaccaccgcccgc

SEQ ID NO: 1332227 - RNA, 16 nt, Mycobacterium tuberculosis H37Rv
gacaccauaggccgac

SEQ ID NO: 1332228 - RNA, 15 nt, Mycobacterium tuberculosis H37Rv
gacaccccgcacgga

SEQ ID NO: 1332229 - RNA, 18 nt, Mycobacterium tuberculosis H37Rv
gacaccccaccacagacg

SEQ ID NO: 1332230 - RNA, 18 nt, Mycobacterium tuberculosis H37Rv
gacacccccggugccggc

SEQ ID NO: 1332231 - RNA, 14 nt, Mycobacterium tuberculosis H37Rv
gacacccagccgca

SEQ ID NO: 1332232 - RNA, 17 nt, Mycobacterium tuberculosis H37Rv
gacacccagccgcagcc

SEQ ID NO: 1332233 - RNA, 13 nt, Mycobacterium tuberculosis H37Rv
gacaauggacacc

SEQ ID NO: 1332234 - RNA, 15 nt, Mycobacterium tuberculosis H37Rv
gacaauggacaccaa

SEQ ID NO: 1332235 - RNA, 15 nt, Mycobacterium tuberculosis H37Rv
gacaagugcccggcc

SEQ ID NO: 1332236 - RNA, 14 nt, Mycobacterium tuberculosis H37Rv
gacaaucucggccg

SEQ ID NO: 1332237 - RNA, 19 nt, Mycobacterium tuberculosis H37Rv
gaauuaaagccaccagaau

SEQ ID NO: 1332238 - RNA, 20 nt, Mycobacterium tuberculosis H37Rv
gaauuaaagccaccagaauc

SEQ ID NO: 1332239 - RNA, 20 nt, Mycobacterium tuberculosis H37Rv
gaauuaguuucguccccaga

SEQ ID NO: 1332240 - RNA, 15 nt, Mycobacterium tuberculosis H37Rv
cugaccgaagaagcc

SEQ ID NO: 1332241 - RNA, 14 nt, Mycobacterium tuberculosis H37Rv
cugaccgccacccc

SEQ ID NO: 1332242 - RNA, 14 nt, Mycobacterium tuberculosis H37Rv
cugaccgccagcgg

SEQ ID NO: 1332243 - RNA, 11 nt, Mycobacterium tuberculosis H37Rv
cugaccgccac

SEQ ID NO: 1332244 - RNA, 22 nt, Mycobacterium tuberculosis H37Rv
cugaccgaauggccgccgcagc

SEQ ID NO: 1332245 - RNA, 16 nt, Mycobacterium tuberculosis H37Rv
cugaccgaagaagccc

SEQ ID NO: 1332246 - RNA, 17 nt, Mycobacterium tuberculosis H37Rv
cugaccgaagaagcccg

SEQ ID NO: 1332247 - RNA, 21 nt, Mycobacterium tuberculosis H37Rv
cugaccgguucccgggcagcc

SEQ ID NO: 1332248 - RNA, 18 nt, Mycobacterium tuberculosis H37Rv
cugaccgguucccgggca

SEQ ID NO: 1332249 - RNA, 22 nt, Mycobacterium tuberculosis H37Rv
cugaccgcuaccagcugggcga

SEQ ID NO: 1332250 - RNA, 13 nt, Mycobacterium tuberculosis H37Rv
cugaccggcuauu

SEQ ID NO: 1332251 - RNA, 20 nt, Mycobacterium tuberculosis H37Rv
cugacagaccgggcaccaga

SEQ ID NO: 1332252 - RNA, 13 nt, Mycobacterium tuberculosis H37Rv
cugacgugucggc

SEQ ID NO: 1332253 - RNA, 21 nt, Mycobacterium tuberculosis H37Rv
cugacgucacguucggcgcaa

SEQ ID NO: 1332254 - RNA, 16 nt, Mycobacterium tuberculosis H37Rv
cugacgguacagcucc

SEQ ID NO: 1332255 - RNA, 13 nt, Mycobacterium tuberculosis H37Rv
cugacgggccgcu

SEQ ID NO: 1332256 - RNA, 15 nt, Mycobacterium tuberculosis H37Rv
cugacggcuuccaac

SEQ ID NO: 1332257 - RNA, 15 nt, Mycobacterium tuberculosis H37Rv
cugacgacugggcgc

SEQ ID NO: 1332258 - RNA, 21 nt, Mycobacterium tuberculosis H37Rv
cugacgagcagcuagcccggc

SEQ ID NO: 1332259 - RNA, 22 nt, Mycobacterium tuberculosis H37Rv
cugacgagcagcuagcccggca

SEQ ID NO: 1332260 - RNA, 13 nt, Mycobacterium tuberculosis H37Rv
cugacgaguugau

SEQ ID NO: 1332261 - RNA, 19 nt, Mycobacterium tuberculosis H37Rv
cugaaguggcacaagcugg

SEQ ID NO: 1332262 - RNA, 22 nt, Mycobacterium tuberculosis H37Rv
cugaaguggcacaagcugggga

SEQ ID NO: 1332263 - RNA, 17 nt, Mycobacterium tuberculosis H37Rv
cugaagucuaaguguug

SEQ ID NO: 1332264 - RNA, 19 nt, Mycobacterium tuberculosis H37Rv
cugaaugcuugcgcagcac

SEQ ID NO: 1332265 - RNA, 21 nt, Mycobacterium tuberculosis H37Rv
cugagcgaagugucgcugcaa

SEQ ID NO: 1332266 - RNA, 14 nt, Mycobacterium tuberculosis H37Rv
cugagcgggcgggc

SEQ ID NO: 1332267 - RNA, 18 nt, Mycobacterium tuberculosis H37Rv
cugagcgggcgggccugc

SEQ ID NO: 1332268 - RNA, 18 nt, Mycobacterium tuberculosis H37Rv
cugagcgccaggccgcac

SEQ ID NO: 1332269 - RNA, 12 nt, Mycobacterium tuberculosis H37Rv
cugagcugccga

SEQ ID NO: 1332270 - RNA, 15 nt, Mycobacterium tuberculosis H37Rv
cugagcugccgagcg

SEQ ID NO: 1332271 - RNA, 17 nt, Mycobacterium tuberculosis H37Rv
cugaggaacgccggcau

SEQ ID NO: 1332272 - RNA, 17 nt, Mycobacterium tuberculosis H37Rv
cugaggaagcggcggca

SEQ ID NO: 1332273 - RNA, 13 nt, Mycobacterium tuberculosis H37Rv
cugaggagaccac

SEQ ID NO: 1332274 - RNA, 14 nt, Mycobacterium tuberculosis H37Rv
cugaggugcugcca

SEQ ID NO: 1332275 - RNA, 20 nt, Mycobacterium tuberculosis H37Rv
cugagggcccuuggccuucu

SEQ ID NO: 1332276 - RNA, 23 nt, Mycobacterium tuberculosis H37Rv
cugagggcggaaaaucggcuggc

SEQ ID NO: 1332277 - RNA, 22 nt, Mycobacterium tuberculosis H37Rv
cugaugggccgguuccucagcg

SEQ ID NO: 1332278 - RNA, 21 nt, Mycobacterium tuberculosis H37Rv
cugaugaaccacggcaggcag

SEQ ID NO: 1332279 - RNA, 18 nt, Mycobacterium tuberculosis H37Rv
cugaucuuggcccgggcc

SEQ ID NO: 1332280 - RNA, 19 nt, Mycobacterium tuberculosis H37Rv
cugaugugaguccagccgg

SEQ ID NO: 1332281 - RNA, 21 nt, Mycobacterium tuberculosis H37Rv
cugauuccacugggccugcca

SEQ ID NO: 1332282 - RNA, 21 nt, Mycobacterium tuberculosis H37Rv
cugauucgcaggcucagcugg

SEQ ID NO: 1332283 - RNA, 20 nt, Mycobacterium tuberculosis H37Rv
cugcaggcggccgagcuggu

SEQ ID NO: 1332284 - RNA, 16 nt, Mycobacterium tuberculosis H37Rv
cugcaggcggccuugc

SEQ ID NO: 1332285 - RNA, 14 nt, Mycobacterium tuberculosis H37Rv
cugcagggcgugau

SEQ ID NO: 1332286 - RNA, 14 nt, Mycobacterium tuberculosis H37Rv
cugcaucaccacug

SEQ ID NO: 1332287 - RNA, 20 nt, Mycobacterium tuberculosis H37Rv
cugcauaggcgcggucaccg

SEQ ID NO: 1332288 - RNA, 14 nt, Mycobacterium tuberculosis H37Rv
cugcagcgcggccg

SEQ ID NO: 1332289 - RNA, 21 nt, Mycobacterium tuberculosis H37Rv
cugcagcgucaagggcugggu

SEQ ID NO: 1332290 - RNA, 15 nt, Mycobacterium tuberculosis H37Rv
cugcagcgaugcggc

SEQ ID NO: 1332291 - RNA, 13 nt, Mycobacterium tuberculosis H37Rv
cugcagcgcggcc

SEQ ID NO: 1332292 - RNA, 18 nt, Mycobacterium tuberculosis H37Rv
cugcagcgccucgauccg

SEQ ID NO: 1332293 - RNA, 18 nt, Mycobacterium tuberculosis H37Rv
cugcagcccgggcagcac

SEQ ID NO: 1332294 - RNA, 17 nt, Mycobacterium tuberculosis H37Rv
cugcagcccgggcagca

SEQ ID NO: 1332295 - RNA, 16 nt, Mycobacterium tuberculosis H37Rv
cugcagcccgggcagc

SEQ ID NO: 1332296 - RNA, 19 nt, Mycobacterium tuberculosis H37Rv
cugcagcgaaacaccggcc

SEQ ID NO: 1332297 - RNA, 19 nt, Mycobacterium tuberculosis H37Rv
cugcagcauggcccuggcg

SEQ ID NO: 1332298 - RNA, 21 nt, Mycobacterium tuberculosis H37Rv
cugcagcacucggugucggcc

SEQ ID NO: 1332299 - RNA, 16 nt, Mycobacterium tuberculosis H37Rv
cugcagaaacagccgc

SEQ ID NO: 1332300 - RNA, 13 nt, Mycobacterium tuberculosis H37Rv
cugcagacgcccc

SEQ ID NO: 1332301 - RNA, 15 nt, Mycobacterium tuberculosis H37Rv
cugcagacgguccgc

SEQ ID NO: 1332302 - RNA, 22 nt, Mycobacterium tuberculosis H37Rv
cugcagaucguagugcgcgcca

SEQ ID NO: 1332303 - RNA, 15 nt, Mycobacterium tuberculosis H37Rv
cugcacgccggcgcu

SEQ ID NO: 1332304 - RNA, 14 nt, Mycobacterium tuberculosis H37Rv
cugcacgucggccc

SEQ ID NO: 1332305 - RNA, 18 nt, Mycobacterium tuberculosis H37Rv
cugcacgugacccugggg

SEQ ID NO: 1332306 - RNA, 18 nt, Mycobacterium tuberculosis H37Rv
cugcacccgccagggcgg

SEQ ID NO: 1332307 - RNA, 19 nt, Mycobacterium tuberculosis H37Rv
cugcacccgacccgaugcg

SEQ ID NO: 1332308 - RNA, 17 nt, Mycobacterium tuberculosis H37Rv
cugcaccgauucgggcu

SEQ ID NO: 1332309 - RNA, 22 nt, Mycobacterium tuberculosis H37Rv
cugcaccggcuugggccaggcc

SEQ ID NO: 1332310 - RNA, 16 nt, Mycobacterium tuberculosis H37Rv
cugcaccuggcgcagc

SEQ ID NO: 1332311 - RNA, 23 nt, Mycobacterium tuberculosis H37Rv
cugcaccagcgaguugagcaugu

SEQ ID NO: 1332312 - RNA, 22 nt, Mycobacterium tuberculosis H37Rv
cugccggccggcgggccugccc

SEQ ID NO: 1332313 - RNA, 14 nt, Mycobacterium tuberculosis H37Rv
cugccggcgccgcc

SEQ ID NO: 1332314 - RNA, 14 nt, Mycobacterium tuberculosis H37Rv
cugccgcucgccgg

SEQ ID NO: 1332315 - RNA, 17 nt, Mycobacterium tuberculosis H37Rv
cugccggagacacccgc

SEQ ID NO: 1332316 - RNA, 11 nt, Mycobacterium tuberculosis H37Rv
cugccuucuuu

SEQ ID NO: 1332317 - RNA, 21 nt, Mycobacterium tuberculosis H37Rv
cugccuucuuugccggcgccu

SEQ ID NO: 1332318 - RNA, 18 nt, Mycobacterium tuberculosis H37Rv
cugccuuggccggcuugu

SEQ ID NO: 1332319 - RNA, 17 nt, Mycobacterium tuberculosis H37Rv
cugccuugggaccgcgc

SEQ ID NO: 1332320 - RNA, 15 nt, Mycobacterium tuberculosis H37Rv
cugccgucuccuggu

SEQ ID NO: 1332321 - RNA, 16 nt, Mycobacterium tuberculosis H37Rv
cugccgucgcugcccc

SEQ ID NO: 1332322 - RNA, 19 nt, Mycobacterium tuberculosis H37Rv
cugccgaucaauggcaacg

SEQ ID NO: 1332323 - RNA, 21 nt, Mycobacterium tuberculosis H37Rv
cugccgccgcggccacaaccu

SEQ ID NO: 1332324 - RNA, 14 nt, Mycobacterium tuberculosis H37Rv
cugccgccggcccc

SEQ ID NO: 1332325 - RNA, 18 nt, Mycobacterium tuberculosis H37Rv
cugccgccggccccgccg

SEQ ID NO: 1332326 - RNA, 14 nt, Mycobacterium tuberculosis H37Rv
cugccgcgcggcga

SEQ ID NO: 1332327 - RNA, 21 nt, Mycobacterium tuberculosis H37Rv
cugccgcgggcagcguguaac

SEQ ID NO: 1332328 - RNA, 19 nt, Mycobacterium tuberculosis H37Rv
cugccgcggugccaaccgc

SEQ ID NO: 1332329 - RNA, 22 nt, Mycobacterium tuberculosis H37Rv
cugccgcguagaacccaggccg

SEQ ID NO: 1332330 - RNA, 20 nt, Mycobacterium tuberculosis H37Rv
cugccgcucgaccccgcgcu

SEQ ID NO: 1332331 - RNA, 17 nt, Mycobacterium tuberculosis H37Rv
cugccgcgaugagcggc

SEQ ID NO: 1332332 - RNA, 21 nt, Mycobacterium tuberculosis H37Rv
cugcccuccgugggcagcgcg

SEQ ID NO: 1332333 - RNA, 22 nt, Mycobacterium tuberculosis H37Rv
cugcccuuguugaaguaaugga

SEQ ID NO: 1332334 - RNA, 17 nt, Mycobacterium tuberculosis H37Rv
cugccgaaacgccgacc

SEQ ID NO: 1332335 - RNA, 18 nt, Mycobacterium tuberculosis H37Rv
cugccgaagcggccaccg

SEQ ID NO: 1332336 - RNA, 20 nt, Mycobacterium tuberculosis H37Rv
cugccgaaguugaagaagcc

SEQ ID NO: 1332337 - RNA, 15 nt, Mycobacterium tuberculosis H37Rv
cugccgaccagcgcg

SEQ ID NO: 1332338 - RNA, 16 nt, Mycobacterium tuberculosis H37Rv
cugccgaccagcgcgc

SEQ ID NO: 1332339 - RNA, 15 nt, Mycobacterium tuberculosis H37Rv
cugccgacgcuccag

SEQ ID NO: 1332340 - RNA, 19 nt, Mycobacterium tuberculosis H37Rv
cugccgacucaucggccgc

SEQ ID NO: 1332341 - RNA, 12 nt, Mycobacterium tuberculosis H37Rv
cugccccuccgg

SEQ ID NO: 1332342 - RNA, 14 nt, Mycobacterium tuberculosis H37Rv
cugccccgccaccu

SEQ ID NO: 1332343 - RNA, 18 nt, Mycobacterium tuberculosis H37Rv
cugcccccggcgcggcgg

SEQ ID NO: 1332344 - RNA, 17 nt, Mycobacterium tuberculosis H37Rv
cugcccccggcgcggcg

SEQ ID NO: 1332345 - RNA, 20 nt, Mycobacterium tuberculosis H37Rv
cugcccccguucuggaaccc

SEQ ID NO: 1332346 - RNA, 16 nt, Mycobacterium tuberculosis H37Rv
cugcccgaaccaccac

SEQ ID NO: 1332347 - RNA, 17 nt, Mycobacterium tuberculosis H37Rv
cugcccggcccgcucag

SEQ ID NO: 1332348 - RNA, 19 nt, Mycobacterium tuberculosis H37Rv
cugcccggcccgcucagcc

SEQ ID NO: 1332349 - RNA, 22 nt, Mycobacterium tuberculosis H37Rv
cugcccuccgugggcagcgcgc

SEQ ID NO: 1332350 - RNA, 19 nt, Mycobacterium tuberculosis H37Rv
cugcccguucugcccaggc

SEQ ID NO: 1332351 - RNA, 16 nt, Mycobacterium tuberculosis H37Rv
cugccauugccugggc

SEQ ID NO: 1332352 - RNA, 14 nt, Mycobacterium tuberculosis H37Rv
cugccaugcgggug

SEQ ID NO: 1332353 - RNA, 14 nt, Mycobacterium tuberculosis H37Rv
cugcccccgcgcgc

SEQ ID NO: 1332354 - RNA, 14 nt, Mycobacterium tuberculosis H37Rv
cugcccccgccggc

SEQ ID NO: 1332355 - RNA, 14 nt, Mycobacterium tuberculosis H37Rv
cugcccaccgcagc

SEQ ID NO: 1332356 - RNA, 14 nt, Mycobacterium tuberculosis H37Rv
cugccaggagcacg

SEQ ID NO: 1332357 - RNA, 12 nt, Mycobacterium tuberculosis H37Rv
cugccagccugg

SEQ ID NO: 1332358 - RNA, 13 nt, Mycobacterium tuberculosis H37Rv
cugccagccugga

SEQ ID NO: 1332359 - RNA, 20 nt, Mycobacterium tuberculosis H37Rv
cugccacgcguuccuccagc

SEQ ID NO: 1332360 - RNA, 17 nt, Mycobacterium tuberculosis H37Rv
cugccaccgugugcacg

SEQ ID NO: 1332361 - RNA, 16 nt, Mycobacterium tuberculosis H37Rv
cugccacccggccagg

SEQ ID NO: 1332362 - RNA, 20 nt, Mycobacterium tuberculosis H37Rv
cugccacgaacgcuuccagc

SEQ ID NO: 1332363 - RNA, 13 nt, Mycobacterium tuberculosis H37Rv
cugccaccagaca

SEQ ID NO: 1332364 - RNA, 19 nt, Mycobacterium tuberculosis H37Rv
cugccaccagacaacgccg

SEQ ID NO: 1332365 - RNA, 17 nt, Mycobacterium tuberculosis H37Rv
cugcaucacgccgucgc

SEQ ID NO: 1332366 - RNA, 18 nt, Mycobacterium tuberculosis H37Rv
cugcgucugcucgcgcag

SEQ ID NO: 1332367 - RNA, 21 nt, Mycobacterium tuberculosis H37Rv
cugcgucugcucgccagccgg

SEQ ID NO: 1332368 - RNA, 15 nt, Mycobacterium tuberculosis H37Rv
cugcgucggcggcuu

SEQ ID NO: 1332369 - RNA, 19 nt, Mycobacterium tuberculosis H37Rv
cugcggucgaacaucaucg

SEQ ID NO: 1332370 - RNA, 17 nt, Mycobacterium tuberculosis H37Rv
cugcggucaauguggcg

SEQ ID NO: 1332371 - RNA, 22 nt, Mycobacterium tuberculosis H37Rv
cugcgggucgugccccggcgcg

SEQ ID NO: 1332372 - RNA, 17 nt, Mycobacterium tuberculosis H37Rv
cugcggcccaugaucuc

SEQ ID NO: 1332373 - RNA, 16 nt, Mycobacterium tuberculosis H37Rv
cugcgggucagcgccg

SEQ ID NO: 1332374 - RNA, 21 nt, Mycobacterium tuberculosis H37Rv
cugcggggcgauccccagcac

SEQ ID NO: 1332375 - RNA, 16 nt, Mycobacterium tuberculosis H37Rv
cugcggccgauacaga

SEQ ID NO: 1332376 - RNA, 14 nt, Mycobacterium tuberculosis H37Rv
cugcggggagcugu

SEQ ID NO: 1332377 - RNA, 19 nt, Mycobacterium tuberculosis H37Rv
cugcgggcgggucugggug

SEQ ID NO: 1332378 - RNA, 14 nt, Mycobacterium tuberculosis H37Rv
cugcggccagucag

SEQ ID NO: 1332379 - RNA, 12 nt, Mycobacterium tuberculosis H37Rv
cugcggccaggg

SEQ ID NO: 1332380 - RNA, 18 nt, Mycobacterium tuberculosis H37Rv
cugcggcccacaccagcg

SEQ ID NO: 1332381 - RNA, 23 nt, Mycobacterium tuberculosis H37Rv
cugcggccaauggugggcgagcu

SEQ ID NO: 1332382 - RNA, 12 nt, Mycobacterium tuberculosis H37Rv
cugcggcaccuc

SEQ ID NO: 1332383 - RNA, 15 nt, Mycobacterium tuberculosis H37Rv
cugcgaaacgccacc

SEQ ID NO: 1332384 - RNA, 13 nt, Mycobacterium tuberculosis H37Rv
cugcgaaacgcca

SEQ ID NO: 1332385 - RNA, 20 nt, Mycobacterium tuberculosis H37Rv
cugcgaagccgagcaucaga

SEQ ID NO: 1332386 - RNA, 18 nt, Mycobacterium tuberculosis H37Rv
cugcgacagcacgugccc

SEQ ID NO: 1332387 - RNA, 14 nt, Mycobacterium tuberculosis H37Rv
cugcgaaugcuggg

SEQ ID NO: 1332388 - RNA, 21 nt, Mycobacterium tuberculosis H37Rv
cugcgaccaagucaugcccac

SEQ ID NO: 1332389 - RNA, 18 nt, Mycobacterium tuberculosis H37Rv
cugcgaccgucccggccu

SEQ ID NO: 1332390 - RNA, 22 nt, Mycobacterium tuberculosis H37Rv
cugcgaccgucccggccucgau

SEQ ID NO: 1332391 - RNA, 18 nt, Mycobacterium tuberculosis H37Rv
cugcgacuaagggcacuc

SEQ ID NO: 1332392 - RNA, 22 nt, Mycobacterium tuberculosis H37Rv
cugcgcuuugcacagcggcauc

SEQ ID NO: 1332393 - RNA, 22 nt, Mycobacterium tuberculosis H37Rv
cugcggacaagucggcaccggu

SEQ ID NO: 1332394 - RNA, 20 nt, Mycobacterium tuberculosis H37Rv
cugcggacaagucggcaccg

SEQ ID NO: 1332395 - RNA, 15 nt, Mycobacterium tuberculosis H37Rv
cugcggaccggcgcg

SEQ ID NO: 1332396 - RNA, 18 nt, Mycobacterium tuberculosis H37Rv
cugcggaccggcgcgcuc

SEQ ID NO: 1332397 - RNA, 13 nt, Mycobacterium tuberculosis H37Rv
cugcggcaccacc

SEQ ID NO: 1332398 - RNA, 12 nt, Mycobacterium tuberculosis H37Rv
cugcucauccac

SEQ ID NO: 1332399 - RNA, 16 nt, Mycobacterium tuberculosis H37Rv
cugcucauccaccucg

SEQ ID NO: 1332400 - RNA, 16 nt, Mycobacterium tuberculosis H37Rv
cugcuaguggucugcu

SEQ ID NO: 1332401 - RNA, 19 nt, Mycobacterium tuberculosis H37Rv
cugcuccaggcgcgccgca

SEQ ID NO: 1332402 - RNA, 16 nt, Mycobacterium tuberculosis H37Rv
cugcuagcccggcggc

SEQ ID NO: 1332403 - RNA, 15 nt, Mycobacterium tuberculosis H37Rv
cugcucggccuggau

SEQ ID NO: 1332404 - RNA, 17 nt, Mycobacterium tuberculosis H37Rv
cugcucggcggugccgc

SEQ ID NO: 1332405 - RNA, 15 nt, Mycobacterium tuberculosis H37Rv
cugcucggcgcagcu

SEQ ID NO: 1332406 - RNA, 18 nt, Mycobacterium tuberculosis H37Rv
cugcucggcgcagcuaac

SEQ ID NO: 1332407 - RNA, 23 nt, Mycobacterium tuberculosis H37Rv
cugcucuggacggucauccggcc

SEQ ID NO: 1332408 - RNA, 17 nt, Mycobacterium tuberculosis H37Rv
cugcucgccguggugga

SEQ ID NO: 1332409 - RNA, 14 nt, Mycobacterium tuberculosis H37Rv
cugcucgcgccgcu

SEQ ID NO: 1332410 - RNA, 13 nt, Mycobacterium tuberculosis H37Rv
cugcucgcgccgc

SEQ ID NO: 1332411 - RNA, 23 nt, Mycobacterium tuberculosis H37Rv
cugcucgccggacggagguccua

SEQ ID NO: 1332412 - RNA, 14 nt, Mycobacterium tuberculosis H37Rv
cugcucgccggcca

SEQ ID NO: 1332413 - RNA, 15 nt, Mycobacterium tuberculosis H37Rv
cugcucgccggccaa

SEQ ID NO: 1332414 - RNA, 24 nt, Mycobacterium tuberculosis H37Rv
cugcucgccggccaacugggccga

SEQ ID NO: 1332415 - RNA, 13 nt, Mycobacterium tuberculosis H37Rv
cugcuggugacga

SEQ ID NO: 1332416 - RNA, 22 nt, Mycobacterium tuberculosis H37Rv
cugcuggugacgaaagcgccca

SEQ ID NO: 1332417 - RNA, 18 nt, Mycobacterium tuberculosis H37Rv
cugcugguaccgggcucc

SEQ ID NO: 1332418 - RNA, 14 nt, Mycobacterium tuberculosis H37Rv
cugcugggcacgau

SEQ ID NO: 1332419 - RNA, 21 nt, Mycobacterium tuberculosis H37Rv
cugcuggcgcuuugggcugcc

SEQ ID NO: 1332420 - RNA, 19 nt, Mycobacterium tuberculosis H37Rv
cugcuuccggaacaaaggc

SEQ ID NO: 1332421 - RNA, 21 nt, Mycobacterium tuberculosis H37Rv
cugcuguuccaucaaggucau

SEQ ID NO: 1332422 - RNA, 20 nt, Mycobacterium tuberculosis H37Rv
cugcugugucguacccggca

SEQ ID NO: 1332423 - RNA, 18 nt, Mycobacterium tuberculosis H37Rv
cugcuugccaccgccgcc

SEQ ID NO: 1332424 - RNA, 13 nt, Mycobacterium tuberculosis H37Rv
cugcuugacuccg

SEQ ID NO: 1332425 - RNA, 20 nt, Mycobacterium tuberculosis H37Rv
cugcuucuucggacagcagc

SEQ ID NO: 1332426 - RNA, 20 nt, Mycobacterium tuberculosis H37Rv
cugcuuggucgcccagccac

SEQ ID NO: 1332427 - RNA, 14 nt, Mycobacterium tuberculosis H37Rv
cuggaaccccgagc

SEQ ID NO: 1332428 - RNA, 16 nt, Mycobacterium tuberculosis H37Rv
cuggagcagccacgau

SEQ ID NO: 1332429 - RNA, 23 nt, Mycobacterium tuberculosis H37Rv
cuggagccgugcggucgcgcccu

SEQ ID NO: 1332430 - RNA, 14 nt, Mycobacterium tuberculosis H37Rv
cuggagugaggcug

SEQ ID NO: 1332431 - RNA, 21 nt, Mycobacterium tuberculosis H37Rv
cuggaggugaacucguucagc

SEQ ID NO: 1332432 - RNA, 22 nt, Mycobacterium tuberculosis H37Rv
cuggaauggcucacgcuccgcc

SEQ ID NO: 1332433 - RNA, 22 nt, Mycobacterium tuberculosis H37Rv
cuggaagcggcgacuacccagc

SEQ ID NO: 1332434 - RNA, 13 nt, Mycobacterium tuberculosis H37Rv
cuggaagccgucu

SEQ ID NO: 1332435 - RNA, 15 nt, Mycobacterium tuberculosis H37Rv
cuggaaggucagcgc

SEQ ID NO: 1332436 - RNA, 14 nt, Mycobacterium tuberculosis H37Rv
cuggaaguaguccc

SEQ ID NO: 1332437 - RNA, 17 nt, Mycobacterium tuberculosis H37Rv
cuggcaccucccgggcg

SEQ ID NO: 1332438 - RNA, 21 nt, Mycobacterium tuberculosis H37Rv
cuggcaccucccgggcgagcc

SEQ ID NO: 1332439 - RNA, 17 nt, Mycobacterium tuberculosis H37Rv
cuggcaccgccagccac

SEQ ID NO: 1332440 - RNA, 19 nt, Mycobacterium tuberculosis H37Rv
cuggauacccagcgcccgg

SEQ ID NO: 1332441 - RNA, 16 nt, Mycobacterium tuberculosis H37Rv
cuggcuacgggccgcg

SEQ ID NO: 1332442 - RNA, 17 nt, Mycobacterium tuberculosis H37Rv
cuggcuacgggccgcgg

SEQ ID NO: 1332443 - RNA, 19 nt, Mycobacterium tuberculosis H37Rv
cuggcuaucugauccagcc

SEQ ID NO: 1332444 - RNA, 12 nt, Mycobacterium tuberculosis H37Rv
cuggcguucagc

SEQ ID NO: 1332445 - RNA, 15 nt, Mycobacterium tuberculosis H37Rv
cuggcguugccaccg

SEQ ID NO: 1332446 - RNA, 18 nt, Mycobacterium tuberculosis H37Rv
cuggcgugucgccgccac

SEQ ID NO: 1332447 - RNA, 21 nt, Mycobacterium tuberculosis H37Rv
cuggcgugucgccgccaccag

SEQ ID NO: 1332448 - RNA, 15 nt, Mycobacterium tuberculosis H37Rv
cuggcgugucgccgc

SEQ ID NO: 1332449 - RNA, 22 nt, Mycobacterium tuberculosis H37Rv
cuggcugaacauuccggcaccu

SEQ ID NO: 1332450 - RNA, 15 nt, Mycobacterium tuberculosis H37Rv
cuggcggcugcagcc

SEQ ID NO: 1332451 - RNA, 22 nt, Mycobacterium tuberculosis H37Rv
cuggcggcugcagccgaccgaa

SEQ ID NO: 1332452 - RNA, 19 nt, Mycobacterium tuberculosis H37Rv
cuggcggggaucagcgagu

SEQ ID NO: 1332453 - RNA, 15 nt, Mycobacterium tuberculosis H37Rv
cuggcggugccggcg

SEQ ID NO: 1332454 - RNA, 22 nt, Mycobacterium tuberculosis H37Rv
cuggcgucgaugccggcugccg

SEQ ID NO: 1332455 - RNA, 23 nt, Mycobacterium tuberculosis H37Rv
cuggcgucaccgcggguggaugu

SEQ ID NO: 1332456 - RNA, 16 nt, Mycobacterium tuberculosis H37Rv
cuggcguagugcagcu

SEQ ID NO: 1332457 - RNA, 23 nt, Mycobacterium tuberculosis H37Rv
cugggcgaagcccagaucuugca

SEQ ID NO: 1332458 - RNA, 14 nt, Mycobacterium tuberculosis H37Rv
cugggccgccgccc

SEQ ID NO: 1332459 - RNA, 19 nt, Mycobacterium tuberculosis H37Rv
cugggccggggaggcuagg

SEQ ID NO: 1332460 - RNA, 14 nt, Mycobacterium tuberculosis H37Rv
cugggccggggagg

SEQ ID NO: 1332461 - RNA, 15 nt, Mycobacterium tuberculosis H37Rv
cugggccaacacagc

SEQ ID NO: 1332462 - RNA, 16 nt, Mycobacterium tuberculosis H37Rv
cugggcccgccagccc

SEQ ID NO: 1332463 - RNA, 19 nt, Mycobacterium tuberculosis H37Rv
cugggcagaccgaucggca

SEQ ID NO: 1332464 - RNA, 13 nt, Mycobacterium tuberculosis H37Rv
cugggcaucaccg

SEQ ID NO: 1332465 - RNA, 19 nt, Mycobacterium tuberculosis H37Rv
cugggcaaacugggcaccg

SEQ ID NO: 1332466 - RNA, 20 nt, Mycobacterium tuberculosis H37Rv
cugggcaccggcggucugca

SEQ ID NO: 1332467 - RNA, 14 nt, Mycobacterium tuberculosis H37Rv
cugggagcggaugu

SEQ ID NO: 1332468 - RNA, 16 nt, Mycobacterium tuberculosis H37Rv
cugggaggcggcgcca

SEQ ID NO: 1332469 - RNA, 18 nt, Mycobacterium tuberculosis H37Rv
cugggaucccgacgaagg

SEQ ID NO: 1332470 - RNA, 21 nt, Mycobacterium tuberculosis H37Rv
cugggauguucuuggucaccg

SEQ ID NO: 1332471 - RNA, 16 nt, Mycobacterium tuberculosis H37Rv
cuggcuguccgcgggc

SEQ ID NO: 1332472 - RNA, 15 nt, Mycobacterium tuberculosis H37Rv
cuggcuggugauggc

SEQ ID NO: 1332473 - RNA, 18 nt, Mycobacterium tuberculosis H37Rv
cuggcuggugauggccau

SEQ ID NO: 1332474 - RNA, 13 nt, Mycobacterium tuberculosis H37Rv
cuggcuggucagg

SEQ ID NO: 1332475 - RNA, 15 nt, Mycobacterium tuberculosis H37Rv
cuggcuggaccacuc

SEQ ID NO: 1332476 - RNA, 18 nt, Mycobacterium tuberculosis H37Rv
cuggcuggaccacucgcc

SEQ ID NO: 1332477 - RNA, 22 nt, Mycobacterium tuberculosis H37Rv
cuggcuggaccacucgccggcg

SEQ ID NO: 1332478 - RNA, 23 nt, Mycobacterium tuberculosis H37Rv
cuggcuggaccacucgccggcgg

SEQ ID NO: 1332479 - RNA, 15 nt, Mycobacterium tuberculosis H37Rv
cuggcuucucgcagu

SEQ ID NO: 1332480 - RNA, 14 nt, Mycobacterium tuberculosis H37Rv
cuggcuugugccca

SEQ ID NO: 1332481 - RNA, 16 nt, Mycobacterium tuberculosis H37Rv
cugggaaacugggucu

SEQ ID NO: 1332482 - RNA, 14 nt, Mycobacterium tuberculosis H37Rv
cuggcgccguuagc

SEQ ID NO: 1332483 - RNA, 13 nt, Mycobacterium tuberculosis H37Rv
cuggcgcccagcc

SEQ ID NO: 1332484 - RNA, 18 nt, Mycobacterium tuberculosis H37Rv
cuggcgcccuugccggcg

SEQ ID NO: 1332485 - RNA, 17 nt, Mycobacterium tuberculosis H37Rv
cuggcgccggugccgcc

SEQ ID NO: 1332486 - RNA, 17 nt, Mycobacterium tuberculosis H37Rv
cuggcgaucgcgacgau

SEQ ID NO: 1332487 - RNA, 21 nt, Mycobacterium tuberculosis H37Rv
cuggcgaucucuaccagccgc

SEQ ID NO: 1332488 - RNA, 21 nt, Mycobacterium tuberculosis H37Rv
cuggcgcagccugccgaugac

SEQ ID NO: 1332489 - RNA, 12 nt, Mycobacterium tuberculosis H37Rv
cuggcgcagccu

SEQ ID NO: 1332490 - RNA, 20 nt, Mycobacterium tuberculosis H37Rv
cuggcggccagcaucgggug

SEQ ID NO: 1332491 - RNA, 16 nt, Mycobacterium tuberculosis H37Rv
cuggcggauggccgcc

SEQ ID NO: 1332492 - RNA, 21 nt, Mycobacterium tuberculosis H37Rv
cuggcggcagcgguuuuaggc

SEQ ID NO: 1332493 - RNA, 23 nt, Mycobacterium tuberculosis H37Rv
cuggcggcgugcuuaacacaugc

SEQ ID NO: 1332494 - RNA, 13 nt, Mycobacterium tuberculosis H37Rv
cuggcggcccggg

SEQ ID NO: 1332495 - RNA, 14 nt, Mycobacterium tuberculosis H37Rv
cuggcggcgcagcg

SEQ ID NO: 1332496 - RNA, 18 nt, Mycobacterium tuberculosis H37Rv
cuggcgcuuugggcugcc

SEQ ID NO: 1332497 - RNA, 21 nt, Mycobacterium tuberculosis H37Rv
cuggcgcgccugugccaccgc

SEQ ID NO: 1332498 - RNA, 21 nt, Mycobacterium tuberculosis H37Rv
cuggcagugugggggucaggg

SEQ ID NO: 1332499 - RNA, 16 nt, Mycobacterium tuberculosis H37Rv
cuggcacgcagagcca

SEQ ID NO: 1332500 - RNA, 18 nt, Mycobacterium tuberculosis H37Rv
cuggcaccucgcccuccc

SEQ ID NO: 1332501 - RNA, 18 nt, Mycobacterium tuberculosis H37Rv
cuggcauaucccuugccg

SEQ ID NO: 1332502 - RNA, 13 nt, Mycobacterium tuberculosis H37Rv
cuggccgcccggc

SEQ ID NO: 1332503 - RNA, 15 nt, Mycobacterium tuberculosis H37Rv
cuggccgccgcgcac

SEQ ID NO: 1332504 - RNA, 12 nt, Mycobacterium tuberculosis H37Rv
cuggccgcgccu

SEQ ID NO: 1332505 - RNA, 16 nt, Mycobacterium tuberculosis H37Rv
cuggccgcgccucggu

SEQ ID NO: 1332506 - RNA, 23 nt, Mycobacterium tuberculosis H37Rv
cuggccguccuaccgaugaacca

SEQ ID NO: 1332507 - RNA, 13 nt, Mycobacterium tuberculosis H37Rv
cuggccuccagcu

SEQ ID NO: 1332508 - RNA, 22 nt, Mycobacterium tuberculosis H37Rv
cuggccugauuguugagccacg

SEQ ID NO: 1332509 - RNA, 20 nt, Mycobacterium tuberculosis H37Rv
cuggccggugcgcagguacg

SEQ ID NO: 1332510 - RNA, 14 nt, Mycobacterium tuberculosis H37Rv
cuggccgggaccgc

SEQ ID NO: 1332511 - RNA, 22 nt, Mycobacterium tuberculosis H37Rv
cuggccggugguagcggacagc

SEQ ID NO: 1332512 - RNA, 23 nt, Mycobacterium tuberculosis H37Rv
cuggcgaacucgaggucgagcgc

SEQ ID NO: 1332513 - RNA, 17 nt, Mycobacterium tuberculosis H37Rv
cuggcgaacucgcgcag

SEQ ID NO: 1332514 - RNA, 21 nt, Mycobacterium tuberculosis H37Rv
cuggcgaacucgcgcaggaag

SEQ ID NO: 1332515 - RNA, 15 nt, Mycobacterium tuberculosis H37Rv
cuggccugcggcagg

SEQ ID NO: 1332516 - RNA, 17 nt, Mycobacterium tuberculosis H37Rv
cuggccugcccagcacc

SEQ ID NO: 1332517 - RNA, 22 nt, Mycobacterium tuberculosis H37Rv
cuggcgaaggacaacagccgcu

SEQ ID NO: 1332518 - RNA, 21 nt, Mycobacterium tuberculosis H37Rv
cuggcgaaugcgggccuccug

SEQ ID NO: 1332519 - RNA, 22 nt, Mycobacterium tuberculosis H37Rv
cuggcgaaugcgggccuccugc

SEQ ID NO: 1332520 - RNA, 19 nt, Mycobacterium tuberculosis H37Rv
cuggcgaaugcgggccucc

SEQ ID NO: 1332521 - RNA, 16 nt, Mycobacterium tuberculosis H37Rv
cuggcgaaggacaaca

SEQ ID NO: 1332522 - RNA, 17 nt, Mycobacterium tuberculosis H37Rv
cuggcgauacagcgaca

SEQ ID NO: 1332523 - RNA, 22 nt, Mycobacterium tuberculosis H37Rv
cuggcgacggugcgcuggaugu

SEQ ID NO: 1332524 - RNA, 20 nt, Mycobacterium tuberculosis H37Rv
cuggcgacucgugucugccu

SEQ ID NO: 1332525 - RNA, 19 nt, Mycobacterium tuberculosis H37Rv
cuggugaucugcugggcaa

SEQ ID NO: 1332526 - RNA, 15 nt, Mycobacterium tuberculosis H37Rv
cuggucuugacucca

SEQ ID NO: 1332527 - RNA, 22 nt, Mycobacterium tuberculosis H37Rv
cuggugacgaaagcgcccagga

SEQ ID NO: 1332528 - RNA, 20 nt, Mycobacterium tuberculosis H37Rv
cuggucgugggccaccaccu

SEQ ID NO: 1332529 - RNA, 13 nt, Mycobacterium tuberculosis H37Rv
cuggucggugggc

SEQ ID NO: 1332530 - RNA, 18 nt, Mycobacterium tuberculosis H37Rv
cuggucggcuaccgccga

SEQ ID NO: 1332531 - RNA, 21 nt, Mycobacterium tuberculosis H37Rv
cuggucgccaacgccagcacc

SEQ ID NO: 1332532 - RNA, 14 nt, Mycobacterium tuberculosis H37Rv
cuggucgcaauggu

SEQ ID NO: 1332533 - RNA, 19 nt, Mycobacterium tuberculosis H37Rv
cuggucgagcacgcugcug

SEQ ID NO: 1332534 - RNA, 20 nt, Mycobacterium tuberculosis H37Rv
cuggucgcuggugcacggcu

SEQ ID NO: 1332535 - RNA, 16 nt, Mycobacterium tuberculosis H37Rv
cuggucgcgcagcucc

SEQ ID NO: 1332536 - RNA, 18 nt, Mycobacterium tuberculosis H37Rv
cuggucgcguccacccac

SEQ ID NO: 1332537 - RNA, 21 nt, Mycobacterium tuberculosis H37Rv
cuggucauggccgaacauucc

SEQ ID NO: 1332538 - RNA, 13 nt, Mycobacterium tuberculosis H37Rv
cugguccaaucgc

SEQ ID NO: 1332539 - RNA, 22 nt, Mycobacterium tuberculosis H37Rv
cugguccaaucgcgacagugcg

SEQ ID NO: 1332540 - RNA, 19 nt, Mycobacterium tuberculosis H37Rv
cugguccaggcggugacgu

SEQ ID NO: 1332541 - RNA, 18 nt, Mycobacterium tuberculosis H37Rv
cuggucccacaccuccuc

SEQ ID NO: 1332542 - RNA, 16 nt, Mycobacterium tuberculosis H37Rv
cuggucgaccaucggu

SEQ ID NO: 1332543 - RNA, 20 nt, Mycobacterium tuberculosis H37Rv
cuggucgacgaaucugcggu

SEQ ID NO: 1332544 - RNA, 21 nt, Mycobacterium tuberculosis H37Rv
cuggucgacgcgucucuggcu

SEQ ID NO: 1332545 - RNA, 22 nt, Mycobacterium tuberculosis H37Rv
cugguaggagaucaccucggug

SEQ ID NO: 1332546 - RNA, 13 nt, Mycobacterium tuberculosis H37Rv
cugguagcgcacc

SEQ ID NO: 1332547 - RNA, 15 nt, Mycobacterium tuberculosis H37Rv
cugguaagucagcuc

SEQ ID NO: 1332548 - RNA, 13 nt, Mycobacterium tuberculosis H37Rv
cugguacaccagg

SEQ ID NO: 1332549 - RNA, 12 nt, Mycobacterium tuberculosis H37Rv
cuggucaacagc

SEQ ID NO: 1332550 - RNA, 16 nt, Mycobacterium tuberculosis H37Rv
cugguauuuguccggc

SEQ ID NO: 1332551 - RNA, 19 nt, Mycobacterium tuberculosis H37Rv
cugguaugccgcccgcagc

SEQ ID NO: 1332552 - RNA, 17 nt, Mycobacterium tuberculosis H37Rv
cugggcggugaaggccc

SEQ ID NO: 1332553 - RNA, 17 nt, Mycobacterium tuberculosis H37Rv
cugggcggccuuuuccg

SEQ ID NO: 1332554 - RNA, 14 nt, Mycobacterium tuberculosis H37Rv
cugggcgccaccau

SEQ ID NO: 1332555 - RNA, 22 nt, Mycobacterium tuberculosis H37Rv
cugggcgcgaccccaggcgcuc

SEQ ID NO: 1332556 - RNA, 21 nt, Mycobacterium tuberculosis H37Rv
cugggcgccgucgggccugcc

SEQ ID NO: 1332557 - RNA, 23 nt, Mycobacterium tuberculosis H37Rv
cugggcgcccgcgguccggcgaa

SEQ ID NO: 1332558 - RNA, 17 nt, Mycobacterium tuberculosis H37Rv
cugggcuuucagcaccg

SEQ ID NO: 1332559 - RNA, 18 nt, Mycobacterium tuberculosis H37Rv
cuggggaacagcagcgca

SEQ ID NO: 1332560 - RNA, 15 nt, Mycobacterium tuberculosis H37Rv
cugggcugcggccgc

SEQ ID NO: 1332561 - RNA, 21 nt, Mycobacterium tuberculosis H37Rv
cugggguagccaucggcuagg

SEQ ID NO: 1332562 - RNA, 20 nt, Mycobacterium tuberculosis H37Rv
cuggggccguccggcuuggc

SEQ ID NO: 1332563 - RNA, 12 nt, Mycobacterium tuberculosis H37Rv
cuggggccacca

SEQ ID NO: 1332564 - RNA, 16 nt, Mycobacterium tuberculosis H37Rv
cuggggcagccgggcg

SEQ ID NO: 1332565 - RNA, 16 nt, Mycobacterium tuberculosis H37Rv
cugggugccggcagcg

SEQ ID NO: 1332566 - RNA, 19 nt, Mycobacterium tuberculosis H37Rv
cugggugccggcagcggcg

SEQ ID NO: 1332567 - RNA, 21 nt, Mycobacterium tuberculosis H37Rv
cugggugcgcggccgcccgua

SEQ ID NO: 1332568 - RNA, 14 nt, Mycobacterium tuberculosis H37Rv
cuggguuggcaucc

SEQ ID NO: 1332569 - RNA, 22 nt, Mycobacterium tuberculosis H37Rv
cuggguuggugauugcggccgc

SEQ ID NO: 1332570 - RNA, 20 nt, Mycobacterium tuberculosis H37Rv
cuggggugacugcgggccgc

SEQ ID NO: 1332571 - RNA, 13 nt, Mycobacterium tuberculosis H37Rv
cuggggugcugcg

SEQ ID NO: 1332572 - RNA, 19 nt, Mycobacterium tuberculosis H37Rv
cuggggugucaaucaccca

SEQ ID NO: 1332573 - RNA, 14 nt, Mycobacterium tuberculosis H37Rv
cugggugaccagga

SEQ ID NO: 1332574 - RNA, 21 nt, Mycobacterium tuberculosis H37Rv
cugggucggaccuuccgggug

SEQ ID NO: 1332575 - RNA, 14 nt, Mycobacterium tuberculosis H37Rv
cuggguauccaccg

SEQ ID NO: 1332576 - RNA, 22 nt, Mycobacterium tuberculosis H37Rv
cuggugccuuaccaccgucucc

SEQ ID NO: 1332577 - RNA, 15 nt, Mycobacterium tuberculosis H37Rv
cuggugccuuaccac

SEQ ID NO: 1332578 - RNA, 15 nt, Mycobacterium tuberculosis H37Rv
cuggugcgggacgcc

SEQ ID NO: 1332579 - RNA, 14 nt, Mycobacterium tuberculosis H37Rv
cuggugcgggacgc

SEQ ID NO: 1332580 - RNA, 16 nt, Mycobacterium tuberculosis H37Rv
cuggugcguagcccac

SEQ ID NO: 1332581 - RNA, 19 nt, Mycobacterium tuberculosis H37Rv
cuggugcgcggagggcgcc

SEQ ID NO: 1332582 - RNA, 19 nt, Mycobacterium tuberculosis H37Rv
cugguguccaccgcaaagg

SEQ ID NO: 1332583 - RNA, 18 nt, Mycobacterium tuberculosis H37Rv
cugguguccagccaggcg

SEQ ID NO: 1332584 - RNA, 16 nt, Mycobacterium tuberculosis H37Rv
cuggugucgggcguca

SEQ ID NO: 1332585 - RNA, 14 nt, Mycobacterium tuberculosis H37Rv
cugguggucggcga

SEQ ID NO: 1332586 - RNA, 21 nt, Mycobacterium tuberculosis H37Rv
cugguggcggcacuggccccg

SEQ ID NO: 1332587 - RNA, 15 nt, Mycobacterium tuberculosis H37Rv
cugguggucagcacc

SEQ ID NO: 1332588 - RNA, 20 nt, Mycobacterium tuberculosis H37Rv
cuggugggggagcggccgcc

SEQ ID NO: 1332589 - RNA, 13 nt, Mycobacterium tuberculosis H37Rv
cuggugggccauc

SEQ ID NO: 1332590 - RNA, 14 nt, Mycobacterium tuberculosis H37Rv
cuggugggccaucg

SEQ ID NO: 1332591 - RNA, 20 nt, Mycobacterium tuberculosis H37Rv
cugguggcggcacuggcccc

SEQ ID NO: 1332592 - RNA, 17 nt, Mycobacterium tuberculosis H37Rv
cugguggcagaaaccgg

SEQ ID NO: 1332593 - RNA, 22 nt, Mycobacterium tuberculosis H37Rv
cugguugaacauguccagugcc

SEQ ID NO: 1332594 - RNA, 22 nt, Mycobacterium tuberculosis H37Rv
cugguucguuaggucacuccau

SEQ ID NO: 1332595 - RNA, 16 nt, Mycobacterium tuberculosis H37Rv
cugguucagccauucu

SEQ ID NO: 1332596 - RNA, 20 nt, Mycobacterium tuberculosis H37Rv
cugguucagccauucuaggu

SEQ ID NO: 1332597 - RNA, 17 nt, Mycobacterium tuberculosis H37Rv
cugguguuguacuggcu

SEQ ID NO: 1332598 - RNA, 17 nt, Mycobacterium tuberculosis H37Rv
cugguugaccucgguga

SEQ ID NO: 1332599 - RNA, 18 nt, Mycobacterium tuberculosis H37Rv
cugguugcgccacugcgu

SEQ ID NO: 1332600 - RNA, 18 nt, Mycobacterium tuberculosis H37Rv
cugguuggcuucucccgc

SEQ ID NO: 1332601 - RNA, 18 nt, Mycobacterium tuberculosis H37Rv
cugguugggccagcuccu

SEQ ID NO: 1332602 - RNA, 17 nt, Mycobacterium tuberculosis H37Rv
cuguacggaucaggccc

SEQ ID NO: 1332603 - RNA, 17 nt, Mycobacterium tuberculosis H37Rv
cuguacccgaccagcac

SEQ ID NO: 1332604 - RNA, 19 nt, Mycobacterium tuberculosis H37Rv
cuguaacacccggccgccg

SEQ ID NO: 1332605 - RNA, 21 nt, Mycobacterium tuberculosis H37Rv
cuguaagacagcuaucccagg

SEQ ID NO: 1332606 - RNA, 17 nt, Mycobacterium tuberculosis H37Rv
cuguaacugcuccuggu

SEQ ID NO: 1332607 - RNA, 22 nt, Mycobacterium tuberculosis H37Rv
cuguccaccgaggccugacuga

SEQ ID NO: 1332608 - RNA, 15 nt, Mycobacterium tuberculosis H37Rv
cugucccagcccggc

SEQ ID NO: 1332609 - RNA, 17 nt, Mycobacterium tuberculosis H37Rv
cugucccaccagguacg

SEQ ID NO: 1332610 - RNA, 18 nt, Mycobacterium tuberculosis H37Rv
cuguccacugccaccgcg

SEQ ID NO: 1332611 - RNA, 15 nt, Mycobacterium tuberculosis H37Rv
cugucccgcgggcca

SEQ ID NO: 1332612 - RNA, 20 nt, Mycobacterium tuberculosis H37Rv
cuguccgaccucgccgcgcg

SEQ ID NO: 1332613 - RNA, 21 nt, Mycobacterium tuberculosis H37Rv
cuguccggguagcggcgccgc

SEQ ID NO: 1332614 - RNA, 14 nt, Mycobacterium tuberculosis H37Rv
cugucacgccugcc

SEQ ID NO: 1332615 - RNA, 17 nt, Mycobacterium tuberculosis H37Rv
aaacugccgcggcaccg

SEQ ID NO: 1332616 - RNA, 16 nt, Mycobacterium tuberculosis H37Rv
cugucaccccugggcg

SEQ ID NO: 1332617 - RNA, 22 nt, Mycobacterium tuberculosis H37Rv
cuguaggccagcccggcgugca

SEQ ID NO: 1332618 - RNA, 19 nt, Mycobacterium tuberculosis H37Rv
cuguagggccggugacuca

SEQ ID NO: 1332619 - RNA, 22 nt, Mycobacterium tuberculosis H37Rv
cuguagucccucaucaccucuc

SEQ ID NO: 1332620 - RNA, 22 nt, Mycobacterium tuberculosis H37Rv
cuguagcgaaugaucuugccac

SEQ ID NO: 1332621 - RNA, 22 nt, Mycobacterium tuberculosis H37Rv
cuguacggaucaggcccgggcg

SEQ ID NO: 1332622 - RNA, 17 nt, Mycobacterium tuberculosis H37Rv
cugucaagcgggcuggc

SEQ ID NO: 1332623 - RNA, 15 nt, Mycobacterium tuberculosis H37Rv
cugugcguuccugau

SEQ ID NO: 1332624 - RNA, 18 nt, Mycobacterium tuberculosis H37Rv
cugugcgcggacaccuuu

SEQ ID NO: 1332625 - RNA, 20 nt, Mycobacterium tuberculosis H37Rv
cugugggcgagucgggggcc

SEQ ID NO: 1332626 - RNA, 15 nt, Mycobacterium tuberculosis H37Rv
cugugggcugagaug

SEQ ID NO: 1332627 - RNA, 17 nt, Mycobacterium tuberculosis H37Rv
cuguggaugccgacggc

SEQ ID NO: 1332628 - RNA, 13 nt, Mycobacterium tuberculosis H37Rv
cuguggcgccgcc

SEQ ID NO: 1332629 - RNA, 22 nt, Mycobacterium tuberculosis H37Rv
cuguggaagcccgucgcggccg

SEQ ID NO: 1332630 - RNA, 13 nt, Mycobacterium tuberculosis H37Rv
cuguggaagcccg

SEQ ID NO: 1332631 - RNA, 14 nt, Mycobacterium tuberculosis H37Rv
cugugaggucauug

SEQ ID NO: 1332632 - RNA, 16 nt, Mycobacterium tuberculosis H37Rv
cugugauccgacagug

SEQ ID NO: 1332633 - RNA, 18 nt, Mycobacterium tuberculosis H37Rv
cugugauccgacaguggc

SEQ ID NO: 1332634 - RNA, 20 nt, Mycobacterium tuberculosis H37Rv
cugugacacccgagggccug

SEQ ID NO: 1332635 - RNA, 17 nt, Mycobacterium tuberculosis H37Rv
cugugaacagcgcgucg

SEQ ID NO: 1332636 - RNA, 11 nt, Mycobacterium tuberculosis H37Rv
cugugagguca

SEQ ID NO: 1332637 - RNA, 18 nt, Mycobacterium tuberculosis H37Rv
cugugacgccgggcuggg

SEQ ID NO: 1332638 - RNA, 22 nt, Mycobacterium tuberculosis H37Rv
cugugcccggcuccuccccggc

SEQ ID NO: 1332639 - RNA, 20 nt, Mycobacterium tuberculosis H37Rv
cugugccccagggcagugcg

SEQ ID NO: 1332640 - RNA, 16 nt, Mycobacterium tuberculosis H37Rv
cugugccagcagcagc

SEQ ID NO: 1332641 - RNA, 15 nt, Mycobacterium tuberculosis H37Rv
cugucgaagauccag

SEQ ID NO: 1332642 - RNA, 14 nt, Mycobacterium tuberculosis H37Rv
cuguccugccagaa

SEQ ID NO: 1332643 - RNA, 15 nt, Mycobacterium tuberculosis H37Rv
cuguccucgcgggcu

SEQ ID NO: 1332644 - RNA, 12 nt, Mycobacterium tuberculosis H37Rv
cuguccuccuga

SEQ ID NO: 1332645 - RNA, 14 nt, Mycobacterium tuberculosis H37Rv
cugucgaccgccac

SEQ ID NO: 1332646 - RNA, 22 nt, Mycobacterium tuberculosis H37Rv
cugucgaccgccacguaauucc

SEQ ID NO: 1332647 - RNA, 14 nt, Mycobacterium tuberculosis H37Rv
cugucgcgggccac

SEQ ID NO: 1332648 - RNA, 15 nt, Mycobacterium tuberculosis H37Rv
cugucggcuuccucc

SEQ ID NO: 1332649 - RNA, 17 nt, Mycobacterium tuberculosis H37Rv
cugucggcuuccuccuc

SEQ ID NO: 1332650 - RNA, 15 nt, Mycobacterium tuberculosis H37Rv
cuguugaagaagccc

SEQ ID NO: 1332651 - RNA, 16 nt, Mycobacterium tuberculosis H37Rv
cuguugaagaagcccg

SEQ ID NO: 1332652 - RNA, 17 nt, Mycobacterium tuberculosis H37Rv
cuguugaagaagcccga

SEQ ID NO: 1332653 - RNA, 23 nt, Mycobacterium tuberculosis H37Rv
cuguugaagaggcgcaccuccug

SEQ ID NO: 1332654 - RNA, 18 nt, Mycobacterium tuberculosis H37Rv
cuguugaucugcccuguu

SEQ ID NO: 1332655 - RNA, 21 nt, Mycobacterium tuberculosis H37Rv
cuguucuuggugaccaaugcg

SEQ ID NO: 1332656 - RNA, 21 nt, Mycobacterium tuberculosis H37Rv
cuguggucggugccagcacca

SEQ ID NO: 1332657 - RNA, 18 nt, Mycobacterium tuberculosis H37Rv
cuguguugagcggcagcc

SEQ ID NO: 1332658 - RNA, 16 nt, Mycobacterium tuberculosis H37Rv
cuguugcggcggcgcu

SEQ ID NO: 1332659 - RNA, 20 nt, Mycobacterium tuberculosis H37Rv
cuguugcccaauucgacugc

SEQ ID NO: 1332660 - RNA, 13 nt, Mycobacterium tuberculosis H37Rv
cuguugccccucc

SEQ ID NO: 1332661 - RNA, 22 nt, Mycobacterium tuberculosis H37Rv
cuguuggcguggaucuuggcca

SEQ ID NO: 1332662 - RNA, 19 nt, Mycobacterium tuberculosis H37Rv
cuguuggcgaaggccgcaa

SEQ ID NO: 1332663 - RNA, 13 nt, Mycobacterium tuberculosis H37Rv
aaacugggcaccg

SEQ ID NO: 1332664 - RNA, 18 nt, Mycobacterium tuberculosis H37Rv
cuuagaacgugcuggugg

SEQ ID NO: 1332665 - RNA, 15 nt, Mycobacterium tuberculosis H37Rv
cuuacacgccuggcu

SEQ ID NO: 1332666 - RNA, 16 nt, Mycobacterium tuberculosis H37Rv
cuuacuuccauccaca

SEQ ID NO: 1332667 - RNA, 13 nt, Mycobacterium tuberculosis H37Rv
cuucagcgcggca

SEQ ID NO: 1332668 - RNA, 19 nt, Mycobacterium tuberculosis H37Rv
cuucagcggccgguacacg

SEQ ID NO: 1332669 - RNA, 13 nt, Mycobacterium tuberculosis H37Rv
cuuccaaacccgg

SEQ ID NO: 1332670 - RNA, 15 nt, Mycobacterium tuberculosis H37Rv
cuucaugaacagccg

SEQ ID NO: 1332671 - RNA, 18 nt, Mycobacterium tuberculosis H37Rv
cuucaaggaagccgcggc

SEQ ID NO: 1332672 - RNA, 22 nt, Mycobacterium tuberculosis H37Rv
cuucaccgggugacccgccaac

SEQ ID NO: 1332673 - RNA, 21 nt, Mycobacterium tuberculosis H37Rv
cuuccugauuucaacggucaa

SEQ ID NO: 1332674 - RNA, 14 nt, Mycobacterium tuberculosis H37Rv
cuuccugaggguuu

SEQ ID NO: 1332675 - RNA, 22 nt, Mycobacterium tuberculosis H37Rv
cuuccugaggguuuccaagucg

SEQ ID NO: 1332676 - RNA, 14 nt, Mycobacterium tuberculosis H37Rv
cuuccucgccggaa

SEQ ID NO: 1332677 - RNA, 16 nt, Mycobacterium tuberculosis H37Rv
cuuccucggccacccg

SEQ ID NO: 1332678 - RNA, 19 nt, Mycobacterium tuberculosis H37Rv
cuuccucggauugcagcgc

SEQ ID NO: 1332679 - RNA, 23 nt, Mycobacterium tuberculosis H37Rv
cuucgauggccaugguggagauu

SEQ ID NO: 1332680 - RNA, 19 nt, Mycobacterium tuberculosis H37Rv
cuucgaucuccaggcccgg

SEQ ID NO: 1332681 - RNA, 16 nt, Mycobacterium tuberculosis H37Rv
cuucgaucagcggcag

SEQ ID NO: 1332682 - RNA, 18 nt, Mycobacterium tuberculosis H37Rv
cuucgccagcgccacugg

SEQ ID NO: 1332683 - RNA, 17 nt, Mycobacterium tuberculosis H37Rv
cuucgcccuugccgcag

SEQ ID NO: 1332684 - RNA, 20 nt, Mycobacterium tuberculosis H37Rv
cuucgcggugugcggcagcc

SEQ ID NO: 1332685 - RNA, 22 nt, Mycobacterium tuberculosis H37Rv
cuucgcggugugcggcagcccg

SEQ ID NO: 1332686 - RNA, 16 nt, Mycobacterium tuberculosis H37Rv
cuucgcccgggccgcg

SEQ ID NO: 1332687 - RNA, 23 nt, Mycobacterium tuberculosis H37Rv
cuuccaauugauaggccccgagg

SEQ ID NO: 1332688 - RNA, 23 nt, Mycobacterium tuberculosis H37Rv
cuuccagccggagucaccgaaau

SEQ ID NO: 1332689 - RNA, 19 nt, Mycobacterium tuberculosis H37Rv
cuucccaguaaguccucga

SEQ ID NO: 1332690 - RNA, 21 nt, Mycobacterium tuberculosis H37Rv
cguaccgguggaaacccugca

SEQ ID NO: 1332691 - RNA, 14 nt, Mycobacterium tuberculosis H37Rv
cguacgccggcggu

SEQ ID NO: 1332692 - RNA, 15 nt, Mycobacterium tuberculosis H37Rv
cguacugguagcacu

SEQ ID NO: 1332693 - RNA, 20 nt, Mycobacterium tuberculosis H37Rv
cguacugugaguagcccgcg

SEQ ID NO: 1332694 - RNA, 19 nt, Mycobacterium tuberculosis H37Rv
cguacuucgcuggaaaccu

SEQ ID NO: 1332695 - RNA, 15 nt, Mycobacterium tuberculosis H37Rv
cguacugcuugaugg

SEQ ID NO: 1332696 - RNA, 18 nt, Mycobacterium tuberculosis H37Rv
cguacggggucgccggca

SEQ ID NO: 1332697 - RNA, 14 nt, Mycobacterium tuberculosis H37Rv
cguacaacagcgcg

SEQ ID NO: 1332698 - RNA, 13 nt, Mycobacterium tuberculosis H37Rv
cguaauuccccag

SEQ ID NO: 1332699 - RNA, 14 nt, Mycobacterium tuberculosis H37Rv
cguaauuccccagg

SEQ ID NO: 1332700 - RNA, 23 nt, Mycobacterium tuberculosis H37Rv
cggcguacucgugcaccgucggg

SEQ ID NO: 1332701 - RNA, 22 nt, Mycobacterium tuberculosis H37Rv
cggcguacucgugcaccgucgg

SEQ ID NO: 1332702 - RNA, 18 nt, Mycobacterium tuberculosis H37Rv
cggcguacucgugcaccg

SEQ ID NO: 1332703 - RNA, 19 nt, Mycobacterium tuberculosis H37Rv
cguaaugcugcugcagcaa

SEQ ID NO: 1332704 - RNA, 17 nt, Mycobacterium tuberculosis H37Rv
cguacaucagcgcgaac

SEQ ID NO: 1332705 - RNA, 14 nt, Mycobacterium tuberculosis H37Rv
cguaguacagcgcg

SEQ ID NO: 1332706 - RNA, 16 nt, Mycobacterium tuberculosis H37Rv
cguaguagcgaugcac

SEQ ID NO: 1332707 - RNA, 15 nt, Mycobacterium tuberculosis H37Rv
cguaguaggcgccgc

SEQ ID NO: 1332708 - RNA, 19 nt, Mycobacterium tuberculosis H37Rv
cguagguggccggcuugca

SEQ ID NO: 1332709 - RNA, 12 nt, Mycobacterium tuberculosis H37Rv
cguauccaggcg

SEQ ID NO: 1332710 - RNA, 12 nt, Mycobacterium tuberculosis H37Rv
cguagggugggu

SEQ ID NO: 1332711 - RNA, 20 nt, Mycobacterium tuberculosis H37Rv
cguagggcagcgccaggccg

SEQ ID NO: 1332712 - RNA, 16 nt, Mycobacterium tuberculosis H37Rv
cguagguugcgccccg

SEQ ID NO: 1332713 - RNA, 17 nt, Mycobacterium tuberculosis H37Rv
cguagguggccagcgcg

SEQ ID NO: 1332714 - RNA, 16 nt, Mycobacterium tuberculosis H37Rv
cguaggcaggaucgcc

SEQ ID NO: 1332715 - RNA, 22 nt, Mycobacterium tuberculosis H37Rv
cguaggcguuguagcgguccag

SEQ ID NO: 1332716 - RNA, 16 nt, Mycobacterium tuberculosis H37Rv
cguaggcgauggcggc

SEQ ID NO: 1332717 - RNA, 15 nt, Mycobacterium tuberculosis H37Rv
cguagccgccgucgc

SEQ ID NO: 1332718 - RNA, 15 nt, Mycobacterium tuberculosis H37Rv
cguagcucgcggggc

SEQ ID NO: 1332719 - RNA, 18 nt, Mycobacterium tuberculosis H37Rv
cguagcucgcggggcgca

SEQ ID NO: 1332720 - RNA, 15 nt, Mycobacterium tuberculosis H37Rv
cguagcugcgcagcg

SEQ ID NO: 1332721 - RNA, 15 nt, Mycobacterium tuberculosis H37Rv
cguagcuggucccac

SEQ ID NO: 1332722 - RNA, 18 nt, Mycobacterium tuberculosis H37Rv
cguagcuggccagguugc

SEQ ID NO: 1332723 - RNA, 21 nt, Mycobacterium tuberculosis H37Rv
cguagcuggugcguagcccac

SEQ ID NO: 1332724 - RNA, 17 nt, Mycobacterium tuberculosis H37Rv
cguagcuucccuccaga

SEQ ID NO: 1332725 - RNA, 18 nt, Mycobacterium tuberculosis H37Rv
cguagcuucccuccagau

SEQ ID NO: 1332726 - RNA, 15 nt, Mycobacterium tuberculosis H37Rv
cguagcccugcucag

SEQ ID NO: 1332727 - RNA, 12 nt, Mycobacterium tuberculosis H37Rv
cguagccagcag

SEQ ID NO: 1332728 - RNA, 13 nt, Mycobacterium tuberculosis H37Rv
cguagccagcagg

SEQ ID NO: 1332729 - RNA, 16 nt, Mycobacterium tuberculosis H37Rv
cguagcaccggucccu

SEQ ID NO: 1332730 - RNA, 17 nt, Mycobacterium tuberculosis H37Rv
cguagcaccacaucggu

SEQ ID NO: 1332731 - RNA, 14 nt, Mycobacterium tuberculosis H37Rv
cguagcaccacauc

SEQ ID NO: 1332732 - RNA, 15 nt, Mycobacterium tuberculosis H37Rv
cguagaccuucuuga

SEQ ID NO: 1332733 - RNA, 15 nt, Mycobacterium tuberculosis H37Rv
cguagagcagcagcg

SEQ ID NO: 1332734 - RNA, 14 nt, Mycobacterium tuberculosis H37Rv
cguacuugccaccc

SEQ ID NO: 1332735 - RNA, 22 nt, Mycobacterium tuberculosis H37Rv
cguagaaugcgccgucgguggg

SEQ ID NO: 1332736 - RNA, 18 nt, Mycobacterium tuberculosis H37Rv
cguagaaggcgauuugcu

SEQ ID NO: 1332737 - RNA, 23 nt, Mycobacterium tuberculosis H37Rv
cguagaugguggucaccaccauc

SEQ ID NO: 1332738 - RNA, 23 nt, Mycobacterium tuberculosis H37Rv
cguagauggugguggcccggcug

SEQ ID NO: 1332739 - RNA, 15 nt, Mycobacterium tuberculosis H37Rv
cguagaucaucagcg

SEQ ID NO: 1332740 - RNA, 22 nt, Mycobacterium tuberculosis H37Rv
cguagagcuggugcgggacgcc

SEQ ID NO: 1332741 - RNA, 17 nt, Mycobacterium tuberculosis H37Rv
cguagagcaugccgccc

SEQ ID NO: 1332742 - RNA, 14 nt, Mycobacterium tuberculosis H37Rv
cguagacuugcugc

SEQ ID NO: 1332743 - RNA, 21 nt, Mycobacterium tuberculosis H37Rv
cguagagucguuuggcgccgc

SEQ ID NO: 1332744 - RNA, 23 nt, Mycobacterium tuberculosis H37Rv
cguagagucguuuggcgccgccg

SEQ ID NO: 1332745 - RNA, 17 nt, Mycobacterium tuberculosis H37Rv
cguagaguguccccggc

SEQ ID NO: 1332746 - RNA, 20 nt, Mycobacterium tuberculosis H37Rv
cguccgaccgauaacacccg

SEQ ID NO: 1332747 - RNA, 14 nt, Mycobacterium tuberculosis H37Rv
cguccgacggcgga

SEQ ID NO: 1332748 - RNA, 15 nt, Mycobacterium tuberculosis H37Rv
cguccgcaccggcgg

SEQ ID NO: 1332749 - RNA, 21 nt, Mycobacterium tuberculosis H37Rv
cguccgcccagccgcagcacc

SEQ ID NO: 1332750 - RNA, 12 nt, Mycobacterium tuberculosis H37Rv
cguccgcccagc

SEQ ID NO: 1332751 - RNA, 15 nt, Mycobacterium tuberculosis H37Rv
cguccgcccagccgc

SEQ ID NO: 1332752 - RNA, 13 nt, Mycobacterium tuberculosis H37Rv
cguccgccggcga

SEQ ID NO: 1332753 - RNA, 19 nt, Mycobacterium tuberculosis H37Rv
cguccagacgccacugcca

SEQ ID NO: 1332754 - RNA, 21 nt, Mycobacterium tuberculosis H37Rv
cguccagacgccacugccagc

SEQ ID NO: 1332755 - RNA, 22 nt, Mycobacterium tuberculosis H37Rv
cguccagcaggacggugaagca

SEQ ID NO: 1332756 - RNA, 23 nt, Mycobacterium tuberculosis H37Rv
cguccagcccagauccagcaacg

SEQ ID NO: 1332757 - RNA, 14 nt, Mycobacterium tuberculosis H37Rv
cgucccgagcccgu

SEQ ID NO: 1332758 - RNA, 22 nt, Mycobacterium tuberculosis H37Rv
cgucccggcgaccggguccggc

SEQ ID NO: 1332759 - RNA, 21 nt, Mycobacterium tuberculosis H37Rv
cgucccgguugacgccggucc

SEQ ID NO: 1332760 - RNA, 13 nt, Mycobacterium tuberculosis H37Rv
cgucccgcggcgc

SEQ ID NO: 1332761 - RNA, 16 nt, Mycobacterium tuberculosis H37Rv
cgucccgccggccccg

SEQ ID NO: 1332762 - RNA, 14 nt, Mycobacterium tuberculosis H37Rv
cgucaugcccaggu

SEQ ID NO: 1332763 - RNA, 23 nt, Mycobacterium tuberculosis H37Rv
cgucaugaagccguugccgccac

SEQ ID NO: 1332764 - RNA, 20 nt, Mycobacterium tuberculosis H37Rv
cguccaaaccuucaacaacg

SEQ ID NO: 1332765 - RNA, 14 nt, Mycobacterium tuberculosis H37Rv
cgucauucaccgcg

SEQ ID NO: 1332766 - RNA, 21 nt, Mycobacterium tuberculosis H37Rv
cguccaagccagcguuggcgg

SEQ ID NO: 1332767 - RNA, 15 nt, Mycobacterium tuberculosis H37Rv
cguccaagccggcca

SEQ ID NO: 1332768 - RNA, 16 nt, Mycobacterium tuberculosis H37Rv
cguccaagccggcugc

SEQ ID NO: 1332769 - RNA, 20 nt, Mycobacterium tuberculosis H37Rv
cguccaagccguagaccagg

SEQ ID NO: 1332770 - RNA, 13 nt, Mycobacterium tuberculosis H37Rv
cguccaagauguc

SEQ ID NO: 1332771 - RNA, 20 nt, Mycobacterium tuberculosis H37Rv
cguccaccgccgacauggcg

SEQ ID NO: 1332772 - RNA, 20 nt, Mycobacterium tuberculosis H37Rv
cguccaccgauacccccggc

SEQ ID NO: 1332773 - RNA, 13 nt, Mycobacterium tuberculosis H37Rv
cguccaccgccga

SEQ ID NO: 1332774 - RNA, 17 nt, Mycobacterium tuberculosis H37Rv
cguccacgacagcagag

SEQ ID NO: 1332775 - RNA, 19 nt, Mycobacterium tuberculosis H37Rv
cguccacgaccccggcggu

SEQ ID NO: 1332776 - RNA, 22 nt, Mycobacterium tuberculosis H37Rv
cguccacccacgaucagcagcg

SEQ ID NO: 1332777 - RNA, 22 nt, Mycobacterium tuberculosis H37Rv
cguccaccacaccugcggcugc

SEQ ID NO: 1332778 - RNA, 23 nt, Mycobacterium tuberculosis H37Rv
cguccaauuggcgucgucggcgg

SEQ ID NO: 1332779 - RNA, 17 nt, Mycobacterium tuberculosis H37Rv
cgucagcgggcagcagg

SEQ ID NO: 1332780 - RNA, 23 nt, Mycobacterium tuberculosis H37Rv
cgucaggaugaucugcgcggccc

SEQ ID NO: 1332781 - RNA, 22 nt, Mycobacterium tuberculosis H37Rv
cgucaggcagcuccgccgccga

SEQ ID NO: 1332782 - RNA, 15 nt, Mycobacterium tuberculosis H37Rv
cgucacuucccggau

SEQ ID NO: 1332783 - RNA, 23 nt, Mycobacterium tuberculosis H37Rv
cgucacuucccggauagacggcg

SEQ ID NO: 1332784 - RNA, 19 nt, Mycobacterium tuberculosis H37Rv
cgucaggugcgcgaccagg

SEQ ID NO: 1332785 - RNA, 17 nt, Mycobacterium tuberculosis H37Rv
cgucagguggccaaugc

SEQ ID NO: 1332786 - RNA, 15 nt, Mycobacterium tuberculosis H37Rv
cgucaggugcgcgac

SEQ ID NO: 1332787 - RNA, 16 nt, Mycobacterium tuberculosis H37Rv
cgucaggugcgcgacc

SEQ ID NO: 1332788 - RNA, 22 nt, Mycobacterium tuberculosis H37Rv
cgucaucccgauguaccccagc

SEQ ID NO: 1332789 - RNA, 20 nt, Mycobacterium tuberculosis H37Rv
cgucaucgcguagugauggc

SEQ ID NO: 1332790 - RNA, 15 nt, Mycobacterium tuberculosis H37Rv
cgucaucgacgagcg

SEQ ID NO: 1332791 - RNA, 14 nt, Mycobacterium tuberculosis H37Rv
cgucaucgcggugu

SEQ ID NO: 1332792 - RNA, 19 nt, Mycobacterium tuberculosis H37Rv
cgucaucgcguagugaugg

SEQ ID NO: 1332793 - RNA, 15 nt, Mycobacterium tuberculosis H37Rv
cgucaucgucggcgg

SEQ ID NO: 1332794 - RNA, 23 nt, Mycobacterium tuberculosis H37Rv
cgucaucgucggcggauucacgc

SEQ ID NO: 1332795 - RNA, 18 nt, Mycobacterium tuberculosis H37Rv
cguaucucccaacggcag

SEQ ID NO: 1332796 - RNA, 20 nt, Mycobacterium tuberculosis H37Rv
cguaucggguuucgaucuuc

SEQ ID NO: 1332797 - RNA, 21 nt, Mycobacterium tuberculosis H37Rv
cguaucggguuucgaucuucu

SEQ ID NO: 1332798 - RNA, 17 nt, Mycobacterium tuberculosis H37Rv
cguauugauacugcccg

SEQ ID NO: 1332799 - RNA, 18 nt, Mycobacterium tuberculosis H37Rv
cgucaccgaugcgccgga

SEQ ID NO: 1332800 - RNA, 18 nt, Mycobacterium tuberculosis H37Rv
cgucacccugucgcgcac

SEQ ID NO: 1332801 - RNA, 13 nt, Mycobacterium tuberculosis H37Rv
cgucaccgcgggu

SEQ ID NO: 1332802 - RNA, 20 nt, Mycobacterium tuberculosis H37Rv
cgucaccgccggcaccgcca

SEQ ID NO: 1332803 - RNA, 13 nt, Mycobacterium tuberculosis H37Rv
cgucaccgcgacc

SEQ ID NO: 1332804 - RNA, 15 nt, Mycobacterium tuberculosis H37Rv
cgucaccgcgacccc

SEQ ID NO: 1332805 - RNA, 19 nt, Mycobacterium tuberculosis H37Rv
cgucaccguuggccgcgcu

SEQ ID NO: 1332806 - RNA, 23 nt, Mycobacterium tuberculosis H37Rv
cgucaccggguccggugaacccg

SEQ ID NO: 1332807 - RNA, 23 nt, Mycobacterium tuberculosis H37Rv
cgucaccggucagcgacgcacgc

SEQ ID NO: 1332808 - RNA, 16 nt, Mycobacterium tuberculosis H37Rv
cgucaccggaaucccc

SEQ ID NO: 1332809 - RNA, 12 nt, Mycobacterium tuberculosis H37Rv
cgugcccgacca

SEQ ID NO: 1332810 - RNA, 19 nt, Mycobacterium tuberculosis H37Rv
cgugcccgccaccggcgcg

SEQ ID NO: 1332811 - RNA, 15 nt, Mycobacterium tuberculosis H37Rv
cgugcccgguguuca

SEQ ID NO: 1332812 - RNA, 14 nt, Mycobacterium tuberculosis H37Rv
cgugccgagcgugc

SEQ ID NO: 1332813 - RNA, 23 nt, Mycobacterium tuberculosis H37Rv
cgugccgagcuucagcgcgcugc

SEQ ID NO: 1332814 - RNA, 14 nt, Mycobacterium tuberculosis H37Rv
cgugccgaccacca

SEQ ID NO: 1332815 - RNA, 15 nt, Mycobacterium tuberculosis H37Rv
cgugccgaccaccag

SEQ ID NO: 1332816 - RNA, 20 nt, Mycobacterium tuberculosis H37Rv
cgugccgaccaccagcaucg

SEQ ID NO: 1332817 - RNA, 12 nt, Mycobacterium tuberculosis H37Rv
cgugccgccagc

SEQ ID NO: 1332818 - RNA, 13 nt, Mycobacterium tuberculosis H37Rv
cgugccgccgcag

SEQ ID NO: 1332819 - RNA, 14 nt, Mycobacterium tuberculosis H37Rv
cgugccgggaccgg

SEQ ID NO: 1332820 - RNA, 13 nt, Mycobacterium tuberculosis H37Rv
cgugcuccugccc

SEQ ID NO: 1332821 - RNA, 15 nt, Mycobacterium tuberculosis H37Rv
cgugcuccugcccga

SEQ ID NO: 1332822 - RNA, 23 nt, Mycobacterium tuberculosis H37Rv
cgugcucgccguaagcaccagcc

SEQ ID NO: 1332823 - RNA, 17 nt, Mycobacterium tuberculosis H37Rv
cgugcgagggcacggcg

SEQ ID NO: 1332824 - RNA, 17 nt, Mycobacterium tuberculosis H37Rv
cgugccuugaucugagc

SEQ ID NO: 1332825 - RNA, 15 nt, Mycobacterium tuberculosis H37Rv
cgugccuuccucgcc

SEQ ID NO: 1332826 - RNA, 22 nt, Mycobacterium tuberculosis H37Rv
cgugcgauuuugugucugcucg

SEQ ID NO: 1332827 - RNA, 20 nt, Mycobacterium tuberculosis H37Rv
cgugcgacgauaucgggagc

SEQ ID NO: 1332828 - RNA, 21 nt, Mycobacterium tuberculosis H37Rv
cgugccgucggcgugcagcag

SEQ ID NO: 1332829 - RNA, 20 nt, Mycobacterium tuberculosis H37Rv
cgugccgguggcgccgccgc

SEQ ID NO: 1332830 - RNA, 16 nt, Mycobacterium tuberculosis H37Rv
cgugccucucgggggc

SEQ ID NO: 1332831 - RNA, 17 nt, Mycobacterium tuberculosis H37Rv
cgugccucucgggggcc

SEQ ID NO: 1332832 - RNA, 19 nt, Mycobacterium tuberculosis H37Rv
cgugcaggaccagcaccgc

SEQ ID NO: 1332833 - RNA, 18 nt, Mycobacterium tuberculosis H37Rv
cgugcaggaccagcaccg

SEQ ID NO: 1332834 - RNA, 16 nt, Mycobacterium tuberculosis H37Rv
cgugcaggaacaccca

SEQ ID NO: 1332835 - RNA, 19 nt, Mycobacterium tuberculosis H37Rv
cgugcaggaacacccauac

SEQ ID NO: 1332836 - RNA, 19 nt, Mycobacterium tuberculosis H37Rv
cgugcaucgcgauuccggc

SEQ ID NO: 1332837 - RNA, 23 nt, Mycobacterium tuberculosis H37Rv
cgugcagcggcgccgccaagggc

SEQ ID NO: 1332838 - RNA, 18 nt, Mycobacterium tuberculosis H37Rv
cgugcagcggcgggcgau

SEQ ID NO: 1332839 - RNA, 16 nt, Mycobacterium tuberculosis H37Rv
cgugagcgcgcgcagu

SEQ ID NO: 1332840 - RNA, 20 nt, Mycobacterium tuberculosis H37Rv
cgugauguggucggacagcg

SEQ ID NO: 1332841 - RNA, 20 nt, Mycobacterium tuberculosis H37Rv
cgugaacuguccgggugggc

SEQ ID NO: 1332842 - RNA, 21 nt, Mycobacterium tuberculosis H37Rv
cgucuugcaucagcggcgcca

SEQ ID NO: 1332843 - RNA, 22 nt, Mycobacterium tuberculosis H37Rv
cgucuucgucggagucuucguc

SEQ ID NO: 1332844 - RNA, 18 nt, Mycobacterium tuberculosis H37Rv
cgucuucggucgcggccu

SEQ ID NO: 1332845 - RNA, 22 nt, Mycobacterium tuberculosis H37Rv
cgucuuggugcgcgucagccgc

SEQ ID NO: 1332846 - RNA, 18 nt, Mycobacterium tuberculosis H37Rv
cgucuugcguccauccgc

SEQ ID NO: 1332847 - RNA, 14 nt, Mycobacterium tuberculosis H37Rv
cgugaaguggucgu

SEQ ID NO: 1332848 - RNA, 16 nt, Mycobacterium tuberculosis H37Rv
cgugagacugggcgcu

SEQ ID NO: 1332849 - RNA, 13 nt, Mycobacterium tuberculosis H37Rv
cgugagccccagc

SEQ ID NO: 1332850 - RNA, 22 nt, Mycobacterium tuberculosis H37Rv
cgugagcccggcgaucagcagc

SEQ ID NO: 1332851 - RNA, 15 nt, Mycobacterium tuberculosis H37Rv
cgucuggucagccgc

SEQ ID NO: 1332852 - RNA, 19 nt, Mycobacterium tuberculosis H37Rv
cgucugguuggcuggcggg

SEQ ID NO: 1332853 - RNA, 15 nt, Mycobacterium tuberculosis H37Rv
cgucuucgccgccac

SEQ ID NO: 1332854 - RNA, 15 nt, Mycobacterium tuberculosis H37Rv
cgucugcucgcgccg

SEQ ID NO: 1332855 - RNA, 16 nt, Mycobacterium tuberculosis H37Rv
cgucugcucgccgggc

SEQ ID NO: 1332856 - RNA, 11 nt, Mycobacterium tuberculosis H37Rv
cgucugcucgc

SEQ ID NO: 1332857 - RNA, 14 nt, Mycobacterium tuberculosis H37Rv
cgucuggccgucgc

SEQ ID NO: 1332858 - RNA, 14 nt, Mycobacterium tuberculosis H37Rv
cgucugcucgccag

SEQ ID NO: 1332859 - RNA, 20 nt, Mycobacterium tuberculosis H37Rv
cgucugcucgccagcggggc

SEQ ID NO: 1332860 - RNA, 13 nt, Mycobacterium tuberculosis H37Rv
cgucugcucgccc

SEQ ID NO: 1332861 - RNA, 13 nt, Mycobacterium tuberculosis H37Rv
cgucuagcccgcc

SEQ ID NO: 1332862 - RNA, 21 nt, Mycobacterium tuberculosis H37Rv
cgucuacgucguccagcacca

SEQ ID NO: 1332863 - RNA, 20 nt, Mycobacterium tuberculosis H37Rv
cgucuccggcgccaccgccg

SEQ ID NO: 1332864 - RNA, 13 nt, Mycobacterium tuberculosis H37Rv
cgucuccggcgcc

SEQ ID NO: 1332865 - RNA, 17 nt, Mycobacterium tuberculosis H37Rv
cgucuccuugagcuucu

SEQ ID NO: 1332866 - RNA, 21 nt, Mycobacterium tuberculosis H37Rv
cgucuccggcgccaccgccgc

SEQ ID NO: 1332867 - RNA, 14 nt, Mycobacterium tuberculosis H37Rv
cgucucgcaccgcg

SEQ ID NO: 1332868 - RNA, 14 nt, Mycobacterium tuberculosis H37Rv
cgucucgcccccuc

SEQ ID NO: 1332869 - RNA, 19 nt, Mycobacterium tuberculosis H37Rv
cgucguugaggaagcccga

SEQ ID NO: 1332870 - RNA, 17 nt, Mycobacterium tuberculosis H37Rv
cgucgugcacggcggcc

SEQ ID NO: 1332871 - RNA, 13 nt, Mycobacterium tuberculosis H37Rv
cgucgugauguca

SEQ ID NO: 1332872 - RNA, 21 nt, Mycobacterium tuberculosis H37Rv
cgucguggcgcucggcgagca

SEQ ID NO: 1332873 - RNA, 14 nt, Mycobacterium tuberculosis H37Rv
cgucgucgcggccg

SEQ ID NO: 1332874 - RNA, 14 nt, Mycobacterium tuberculosis H37Rv
cgucgucgcugaau

SEQ ID NO: 1332875 - RNA, 13 nt, Mycobacterium tuberculosis H37Rv
cgucgucgguaau

SEQ ID NO: 1332876 - RNA, 17 nt, Mycobacterium tuberculosis H37Rv
cgucgucgccgucggug

SEQ ID NO: 1332877 - RNA, 22 nt, Mycobacterium tuberculosis H37Rv
cgucgucgagcaccacccgggc

SEQ ID NO: 1332878 - RNA, 17 nt, Mycobacterium tuberculosis H37Rv
cgucgucgauccagccc

SEQ ID NO: 1332879 - RNA, 14 nt, Mycobacterium tuberculosis H37Rv
cgucgucgacgaca

SEQ ID NO: 1332880 - RNA, 18 nt, Mycobacterium tuberculosis H37Rv
cgucguccgacgggccgu

SEQ ID NO: 1332881 - RNA, 16 nt, Mycobacterium tuberculosis H37Rv
cgucgucccagggcug

SEQ ID NO: 1332882 - RNA, 17 nt, Mycobacterium tuberculosis H37Rv
cgucgucgacacgguga

SEQ ID NO: 1332883 - RNA, 14 nt, Mycobacterium tuberculosis H37Rv
cgucgucagccacc

SEQ ID NO: 1332884 - RNA, 14 nt, Mycobacterium tuberculosis H37Rv
cgucgucagccagg

SEQ ID NO: 1332885 - RNA, 16 nt, Mycobacterium tuberculosis H37Rv
cgucgucagguggcca

SEQ ID NO: 1332886 - RNA, 20 nt, Mycobacterium tuberculosis H37Rv
cgucguaccguucgggccgu

SEQ ID NO: 1332887 - RNA, 21 nt, Mycobacterium tuberculosis H37Rv
cgucggcguggucgcgcggca

SEQ ID NO: 1332888 - RNA, 19 nt, Mycobacterium tuberculosis H37Rv
cgucggcgggcugcaguga

SEQ ID NO: 1332889 - RNA, 14 nt, Mycobacterium tuberculosis H37Rv
cgucgggacgccgc

SEQ ID NO: 1332890 - RNA, 17 nt, Mycobacterium tuberculosis H37Rv
cgucgggacgccgcccc

SEQ ID NO: 1332891 - RNA, 23 nt, Mycobacterium tuberculosis H37Rv
cgucggcugccgcaaacgcggcg

SEQ ID NO: 1332892 - RNA, 15 nt, Mycobacterium tuberculosis H37Rv
cgucggcugccgcgg

SEQ ID NO: 1332893 - RNA, 12 nt, Mycobacterium tuberculosis H37Rv
cgucggcuagcu

SEQ ID NO: 1332894 - RNA, 16 nt, Mycobacterium tuberculosis H37Rv
cgucgggaugcccgcu

SEQ ID NO: 1332895 - RNA, 22 nt, Mycobacterium tuberculosis H37Rv
cgucgggacggccaacagggcg

SEQ ID NO: 1332896 - RNA, 21 nt, Mycobacterium tuberculosis H37Rv
cgucgggcacaccgacgccgc

SEQ ID NO: 1332897 - RNA, 23 nt, Mycobacterium tuberculosis H37Rv
cgucguacacgccaugguaugac

SEQ ID NO: 1332898 - RNA, 18 nt, Mycobacterium tuberculosis H37Rv
cgucgguugccacgccgc

SEQ ID NO: 1332899 - RNA, 16 nt, Mycobacterium tuberculosis H37Rv
cgucgguugccacgcc

SEQ ID NO: 1332900 - RNA, 22 nt, Mycobacterium tuberculosis H37Rv
cgucggugggcgugacguagug

SEQ ID NO: 1332901 - RNA, 22 nt, Mycobacterium tuberculosis H37Rv
cgucggugccgccgccggcgcc

SEQ ID NO: 1332902 - RNA, 13 nt, Mycobacterium tuberculosis H37Rv
cgucggugccgcu

SEQ ID NO: 1332903 - RNA, 15 nt, Mycobacterium tuberculosis H37Rv
cgucggugccaccac

SEQ ID NO: 1332904 - RNA, 18 nt, Mycobacterium tuberculosis H37Rv
cgucggugagcugcgcca

SEQ ID NO: 1332905 - RNA, 15 nt, Mycobacterium tuberculosis H37Rv
cgucgggucacccag

SEQ ID NO: 1332906 - RNA, 23 nt, Mycobacterium tuberculosis H37Rv
cgucgggugcagcacggcgccgc

SEQ ID NO: 1332907 - RNA, 21 nt, Mycobacterium tuberculosis H37Rv
cgucgggcgucccggcgguca

SEQ ID NO: 1332908 - RNA, 21 nt, Mycobacterium tuberculosis H37Rv
cgucgcggccacggucagcca

SEQ ID NO: 1332909 - RNA, 16 nt, Mycobacterium tuberculosis H37Rv
cgucgcggccagcagg

SEQ ID NO: 1332910 - RNA, 23 nt, Mycobacterium tuberculosis H37Rv
cgucgcggccggcggccgcccag

SEQ ID NO: 1332911 - RNA, 15 nt, Mycobacterium tuberculosis H37Rv
cgucgcggcgccuga

SEQ ID NO: 1332912 - RNA, 19 nt, Mycobacterium tuberculosis H37Rv
cgucgcgggauugcgcgcu

SEQ ID NO: 1332913 - RNA, 16 nt, Mycobacterium tuberculosis H37Rv
cgucgcggguccaggc

SEQ ID NO: 1332914 - RNA, 18 nt, Mycobacterium tuberculosis H37Rv
cgucgcuagggugagccc

SEQ ID NO: 1332915 - RNA, 17 nt, Mycobacterium tuberculosis H37Rv
cgucgcuagggugagcc

SEQ ID NO: 1332916 - RNA, 22 nt, Mycobacterium tuberculosis H37Rv
cgucgcguggaguggugaucca

SEQ ID NO: 1332917 - RNA, 14 nt, Mycobacterium tuberculosis H37Rv
cgucgcgucgccag

SEQ ID NO: 1332918 - RNA, 23 nt, Mycobacterium tuberculosis H37Rv
cgucgcguccgcgaucugcagcg

SEQ ID NO: 1332919 - RNA, 17 nt, Mycobacterium tuberculosis H37Rv
cgucggaauacaacagc

SEQ ID NO: 1332920 - RNA, 12 nt, Mycobacterium tuberculosis H37Rv
cgucggagccgg

SEQ ID NO: 1332921 - RNA, 18 nt, Mycobacterium tuberculosis H37Rv
cgucgcugcccgcgcggc

SEQ ID NO: 1332922 - RNA, 22 nt, Mycobacterium tuberculosis H37Rv
cgucgcuggugggaucgcagcg

SEQ ID NO: 1332923 - RNA, 18 nt, Mycobacterium tuberculosis H37Rv
cgucggcgauggccagca

SEQ ID NO: 1332924 - RNA, 13 nt, Mycobacterium tuberculosis H37Rv
cgucggcgagcag

SEQ ID NO: 1332925 - RNA, 15 nt, Mycobacterium tuberculosis H37Rv
cgucggcgagcgcgg

SEQ ID NO: 1332926 - RNA, 14 nt, Mycobacterium tuberculosis H37Rv
cgucggcgaccagg

SEQ ID NO: 1332927 - RNA, 13 nt, Mycobacterium tuberculosis H37Rv
cgucggcccggug

SEQ ID NO: 1332928 - RNA, 16 nt, Mycobacterium tuberculosis H37Rv
cgucggccgcgcugcu

SEQ ID NO: 1332929 - RNA, 20 nt, Mycobacterium tuberculosis H37Rv
cgucggccgcgcugcugacc

SEQ ID NO: 1332930 - RNA, 14 nt, Mycobacterium tuberculosis H37Rv
cgucggccggcacc

SEQ ID NO: 1332931 - RNA, 15 nt, Mycobacterium tuberculosis H37Rv
cgucggccggcaccc

SEQ ID NO: 1332932 - RNA, 12 nt, Mycobacterium tuberculosis H37Rv
cgucggccagga

SEQ ID NO: 1332933 - RNA, 17 nt, Mycobacterium tuberculosis H37Rv
cgucggccagugcgcgc

SEQ ID NO: 1332934 - RNA, 22 nt, Mycobacterium tuberculosis H37Rv
cgucggccccacaagucgcgcg

SEQ ID NO: 1332935 - RNA, 13 nt, Mycobacterium tuberculosis H37Rv
cgucggccagcag

SEQ ID NO: 1332936 - RNA, 14 nt, Mycobacterium tuberculosis H37Rv
cgucggccagcaga

SEQ ID NO: 1332937 - RNA, 13 nt, Mycobacterium tuberculosis H37Rv
cgucggccaaaga

SEQ ID NO: 1332938 - RNA, 20 nt, Mycobacterium tuberculosis H37Rv
cgucggcaugggccggcgcc

SEQ ID NO: 1332939 - RNA, 22 nt, Mycobacterium tuberculosis H37Rv
cgucggcaaagaaggcgacccg

SEQ ID NO: 1332940 - RNA, 16 nt, Mycobacterium tuberculosis H37Rv
cgucgccgccauugcc

SEQ ID NO: 1332941 - RNA, 18 nt, Mycobacterium tuberculosis H37Rv
cgucgccgccgggcagug

SEQ ID NO: 1332942 - RNA, 21 nt, Mycobacterium tuberculosis H37Rv
cgucgccgccguugccgccag

SEQ ID NO: 1332943 - RNA, 17 nt, Mycobacterium tuberculosis H37Rv
cgucgccgccgggcagu

SEQ ID NO: 1332944 - RNA, 19 nt, Mycobacterium tuberculosis H37Rv
cgucgccggauagcgcagc

SEQ ID NO: 1332945 - RNA, 19 nt, Mycobacterium tuberculosis H37Rv
cgucgccggccccgccggc

SEQ ID NO: 1332946 - RNA, 13 nt, Mycobacterium tuberculosis H37Rv
cgucgccggcccc

SEQ ID NO: 1332947 - RNA, 19 nt, Mycobacterium tuberculosis H37Rv
cgucgccgcggcggcagcg

SEQ ID NO: 1332948 - RNA, 14 nt, Mycobacterium tuberculosis H37Rv
cgucgccgcggcgg

SEQ ID NO: 1332949 - RNA, 15 nt, Mycobacterium tuberculosis H37Rv
cgucgccgcggcggc

SEQ ID NO: 1332950 - RNA, 16 nt, Mycobacterium tuberculosis H37Rv
cgucgcgcugccggcc

SEQ ID NO: 1332951 - RNA, 22 nt, Mycobacterium tuberculosis H37Rv
cgucgcggaucagcccgcgcag

SEQ ID NO: 1332952 - RNA, 23 nt, Mycobacterium tuberculosis H37Rv
cgucgcggaucagcccgcgcagc

SEQ ID NO: 1332953 - RNA, 13 nt, Mycobacterium tuberculosis H37Rv
cgucgcggaucug

SEQ ID NO: 1332954 - RNA, 16 nt, Mycobacterium tuberculosis H37Rv
cgucgcggaguagccg

SEQ ID NO: 1332955 - RNA, 18 nt, Mycobacterium tuberculosis H37Rv
cgucgcgcgccuuggcca

SEQ ID NO: 1332956 - RNA, 21 nt, Mycobacterium tuberculosis H37Rv
cgucgcccuuagggucgccgc

SEQ ID NO: 1332957 - RNA, 15 nt, Mycobacterium tuberculosis H37Rv
cgucgcccagggugu

SEQ ID NO: 1332958 - RNA, 17 nt, Mycobacterium tuberculosis H37Rv
cgucgccagggccgccg

SEQ ID NO: 1332959 - RNA, 13 nt, Mycobacterium tuberculosis H37Rv
cgucgcagugcaa

SEQ ID NO: 1332960 - RNA, 18 nt, Mycobacterium tuberculosis H37Rv
cguccgcgaucugcagcg

SEQ ID NO: 1332961 - RNA, 23 nt, Mycobacterium tuberculosis H37Rv
cgucgcauacgcccacuccagca

SEQ ID NO: 1332962 - RNA, 21 nt, Mycobacterium tuberculosis H37Rv
cgucgccaccgguaccgauca

SEQ ID NO: 1332963 - RNA, 21 nt, Mycobacterium tuberculosis H37Rv
cgucgccaccagagucaacau

SEQ ID NO: 1332964 - RNA, 13 nt, Mycobacterium tuberculosis H37Rv
cuaaucagccagg

SEQ ID NO: 1332965 - RNA, 16 nt, Mycobacterium tuberculosis H37Rv
cuaaggugggcacagc

SEQ ID NO: 1332966 - RNA, 14 nt, Mycobacterium tuberculosis H37Rv
cuaagcgccugaua

SEQ ID NO: 1332967 - RNA, 22 nt, Mycobacterium tuberculosis H37Rv
cuaaguccccgcuuggcgagcc

SEQ ID NO: 1332968 - RNA, 19 nt, Mycobacterium tuberculosis H37Rv
cuaacggcagccaccguca

SEQ ID NO: 1332969 - RNA, 17 nt, Mycobacterium tuberculosis H37Rv
cuaacaccgcaggcaca

SEQ ID NO: 1332970 - RNA, 13 nt, Mycobacterium tuberculosis H37Rv
cuaacccugcccu

SEQ ID NO: 1332971 - RNA, 20 nt, Mycobacterium tuberculosis H37Rv
cuaacaacaccaccagcacg

SEQ ID NO: 1332972 - RNA, 16 nt, Mycobacterium tuberculosis H37Rv
cuaacaacaccaccag

SEQ ID NO: 1332973 - RNA, 16 nt, Mycobacterium tuberculosis H37Rv
cguucgaccguguaac

SEQ ID NO: 1332974 - RNA, 23 nt, Mycobacterium tuberculosis H37Rv
cguucgagagccccgaccagcag

SEQ ID NO: 1332975 - RNA, 14 nt, Mycobacterium tuberculosis H37Rv
cguucggcgcacag

SEQ ID NO: 1332976 - RNA, 15 nt, Mycobacterium tuberculosis H37Rv
cguucggcgcccgcu

SEQ ID NO: 1332977 - RNA, 19 nt, Mycobacterium tuberculosis H37Rv
cguucggcgcugaucgcgc

SEQ ID NO: 1332978 - RNA, 23 nt, Mycobacterium tuberculosis H37Rv
cguucggggccccgcggcgccgc

SEQ ID NO: 1332979 - RNA, 18 nt, Mycobacterium tuberculosis H37Rv
cguucgaaggccacccgc

SEQ ID NO: 1332980 - RNA, 15 nt, Mycobacterium tuberculosis H37Rv
cguuccuccagcagc

SEQ ID NO: 1332981 - RNA, 16 nt, Mycobacterium tuberculosis H37Rv
cguuccguugugcgcc

SEQ ID NO: 1332982 - RNA, 14 nt, Mycobacterium tuberculosis H37Rv
cguuccgggccggc

SEQ ID NO: 1332983 - RNA, 17 nt, Mycobacterium tuberculosis H37Rv
cguuccgggccggcgag

SEQ ID NO: 1332984 - RNA, 18 nt, Mycobacterium tuberculosis H37Rv
cguuccgcgacagcggcg

SEQ ID NO: 1332985 - RNA, 17 nt, Mycobacterium tuberculosis H37Rv
cguugaugaccgccgcc

SEQ ID NO: 1332986 - RNA, 22 nt, Mycobacterium tuberculosis H37Rv
cguugaugacguugcagccggc

SEQ ID NO: 1332987 - RNA, 20 nt, Mycobacterium tuberculosis H37Rv
cguugaucacauucagcacg

SEQ ID NO: 1332988 - RNA, 17 nt, Mycobacterium tuberculosis H37Rv
cguugauccccagcucc

SEQ ID NO: 1332989 - RNA, 20 nt, Mycobacterium tuberculosis H37Rv
cguugaucgacaucaccacc

SEQ ID NO: 1332990 - RNA, 14 nt, Mycobacterium tuberculosis H37Rv
cguugaucgccggg

SEQ ID NO: 1332991 - RNA, 14 nt, Mycobacterium tuberculosis H37Rv
cguugagugggagc

SEQ ID NO: 1332992 - RNA, 20 nt, Mycobacterium tuberculosis H37Rv
cguugagguucuucugcgcc

SEQ ID NO: 1332993 - RNA, 21 nt, Mycobacterium tuberculosis H37Rv
cguugagguaggugagcgcgc

SEQ ID NO: 1332994 - RNA, 23 nt, Mycobacterium tuberculosis H37Rv
cguugagguaggugagcgcgcuc

SEQ ID NO: 1332995 - RNA, 18 nt, Mycobacterium tuberculosis H37Rv
cguucaacaccgccgacc

SEQ ID NO: 1332996 - RNA, 15 nt, Mycobacterium tuberculosis H37Rv
cguucccgccggcuc

SEQ ID NO: 1332997 - RNA, 20 nt, Mycobacterium tuberculosis H37Rv
cguucccgccggccccgccg

SEQ ID NO: 1332998 - RNA, 21 nt, Mycobacterium tuberculosis H37Rv
cguucagguguugacgccaac

SEQ ID NO: 1332999 - RNA, 19 nt, Mycobacterium tuberculosis H37Rv
cguucagguguugacgcca

SEQ ID NO: 1333000 - RNA, 23 nt, Mycobacterium tuberculosis H37Rv
cgugcugccguauccaggcgugc

SEQ ID NO: 1333001 - RNA, 17 nt, Mycobacterium tuberculosis H37Rv
cgugcuggugggccgga

SEQ ID NO: 1333002 - RNA, 20 nt, Mycobacterium tuberculosis H37Rv
cguggaucuuggccagcagc

SEQ ID NO: 1333003 - RNA, 22 nt, Mycobacterium tuberculosis H37Rv
cguggccaauccggcggcgacg

SEQ ID NO: 1333004 - RNA, 19 nt, Mycobacterium tuberculosis H37Rv
cguggccacggcauucgac

SEQ ID NO: 1333005 - RNA, 23 nt, Mycobacterium tuberculosis H37Rv
cguggcagucgcacggugccgcc

SEQ ID NO: 1333006 - RNA, 20 nt, Mycobacterium tuberculosis H37Rv
cguggcacugacgcgcccga

SEQ ID NO: 1333007 - RNA, 16 nt, Mycobacterium tuberculosis H37Rv
cguggcacugacgcgc

SEQ ID NO: 1333008 - RNA, 15 nt, Mycobacterium tuberculosis H37Rv
cguggcauccagcag

SEQ ID NO: 1333009 - RNA, 16 nt, Mycobacterium tuberculosis H37Rv
cguggcaucgccucca

SEQ ID NO: 1333010 - RNA, 15 nt, Mycobacterium tuberculosis H37Rv
cguuaccgacgccgg

SEQ ID NO: 1333011 - RNA, 14 nt, Mycobacterium tuberculosis H37Rv
cguuaggucacucc

SEQ ID NO: 1333012 - RNA, 21 nt, Mycobacterium tuberculosis H37Rv
cguuagaguaggccaccacug

SEQ ID NO: 1333013 - RNA, 15 nt, Mycobacterium tuberculosis H37Rv
cguuagggccgccau

SEQ ID NO: 1333014 - RNA, 21 nt, Mycobacterium tuberculosis H37Rv
cguugcaggacgcccacaugc

SEQ ID NO: 1333015 - RNA, 15 nt, Mycobacterium tuberculosis H37Rv
cguugcagccggcau

SEQ ID NO: 1333016 - RNA, 13 nt, Mycobacterium tuberculosis H37Rv
cguugcaccauuc

SEQ ID NO: 1333017 - RNA, 16 nt, Mycobacterium tuberculosis H37Rv
cguugcccccauugcc

SEQ ID NO: 1333018 - RNA, 20 nt, Mycobacterium tuberculosis H37Rv
cguugcccccauugccgccg

SEQ ID NO: 1333019 - RNA, 11 nt, Mycobacterium tuberculosis H37Rv
cguugguuggu

SEQ ID NO: 1333020 - RNA, 20 nt, Mycobacterium tuberculosis H37Rv
cguugccaacaacaucagcg

SEQ ID NO: 1333021 - RNA, 16 nt, Mycobacterium tuberculosis H37Rv
cguugccagggcgggc

SEQ ID NO: 1333022 - RNA, 13 nt, Mycobacterium tuberculosis H37Rv
cguugccauugcc

SEQ ID NO: 1333023 - RNA, 11 nt, Mycobacterium tuberculosis H37Rv
cguugcaggug

SEQ ID NO: 1333024 - RNA, 16 nt, Mycobacterium tuberculosis H37Rv
cguugccaaagcccac

SEQ ID NO: 1333025 - RNA, 15 nt, Mycobacterium tuberculosis H37Rv
cguugcaucagcacg

SEQ ID NO: 1333026 - RNA, 12 nt, Mycobacterium tuberculosis H37Rv
cguugccaccgu

SEQ ID NO: 1333027 - RNA, 16 nt, Mycobacterium tuberculosis H37Rv
cguugucggcuggacg

SEQ ID NO: 1333028 - RNA, 21 nt, Mycobacterium tuberculosis H37Rv
cguugugcgccuugaccacag

SEQ ID NO: 1333029 - RNA, 20 nt, Mycobacterium tuberculosis H37Rv
cguuguaguugcccacguug

SEQ ID NO: 1333030 - RNA, 14 nt, Mycobacterium tuberculosis H37Rv
cguuguaggagaac

SEQ ID NO: 1333031 - RNA, 20 nt, Mycobacterium tuberculosis H37Rv
cguuguaugcguuacgccgc

SEQ ID NO: 1333032 - RNA, 17 nt, Mycobacterium tuberculosis H37Rv
cguuguugaccaccacg

SEQ ID NO: 1333033 - RNA, 19 nt, Mycobacterium tuberculosis H37Rv
cguuguuggauccggccac

SEQ ID NO: 1333034 - RNA, 15 nt, Mycobacterium tuberculosis H37Rv
cguuucgccagccgg

SEQ ID NO: 1333035 - RNA, 14 nt, Mycobacterium tuberculosis H37Rv
cguuucgcagccgc

SEQ ID NO: 1333036 - RNA, 22 nt, Mycobacterium tuberculosis H37Rv
cguuucgcgaugugcgccaccu

SEQ ID NO: 1333037 - RNA, 12 nt, Mycobacterium tuberculosis H37Rv
cguuucgcuguc

SEQ ID NO: 1333038 - RNA, 16 nt, Mycobacterium tuberculosis H37Rv
cguuucgccggcgcgc

SEQ ID NO: 1333039 - RNA, 18 nt, Mycobacterium tuberculosis H37Rv
cguuuggugugauacagc

SEQ ID NO: 1333040 - RNA, 12 nt, Mycobacterium tuberculosis H37Rv
cguuuggacggg

SEQ ID NO: 1333041 - RNA, 15 nt, Mycobacterium tuberculosis H37Rv
cuaaacaggccgcca

SEQ ID NO: 1333042 - RNA, 16 nt, Mycobacterium tuberculosis H37Rv
cguuuucgucacccca

SEQ ID NO: 1333043 - RNA, 14 nt, Mycobacterium tuberculosis H37Rv
cguuuugcggcccg

SEQ ID NO: 1333044 - RNA, 18 nt, Mycobacterium tuberculosis H37Rv
cuccaccaccgucgagcc

SEQ ID NO: 1333045 - RNA, 22 nt, Mycobacterium tuberculosis H37Rv
cuccacauacgcggcggccuga

SEQ ID NO: 1333046 - RNA, 14 nt, Mycobacterium tuberculosis H37Rv
cuccacagcggcca

SEQ ID NO: 1333047 - RNA, 13 nt, Mycobacterium tuberculosis H37Rv
cuccaaguagcac

SEQ ID NO: 1333048 - RNA, 18 nt, Mycobacterium tuberculosis H37Rv
cuccaauugcggccgcgc

SEQ ID NO: 1333049 - RNA, 13 nt, Mycobacterium tuberculosis H37Rv
cuccaccuucugg

SEQ ID NO: 1333050 - RNA, 11 nt, Mycobacterium tuberculosis H37Rv
cuccaccuucu

SEQ ID NO: 1333051 - RNA, 15 nt, Mycobacterium tuberculosis H37Rv
cuccaccccacccag

SEQ ID NO: 1333052 - RNA, 21 nt, Mycobacterium tuberculosis H37Rv
cuccacccccacgcugcagau

SEQ ID NO: 1333053 - RNA, 22 nt, Mycobacterium tuberculosis H37Rv
cuccaccagugccccgccgagc

SEQ ID NO: 1333054 - RNA, 14 nt, Mycobacterium tuberculosis H37Rv
cuccacccaggccg

SEQ ID NO: 1333055 - RNA, 16 nt, Mycobacterium tuberculosis H37Rv
cuccaccgggcccgcc

SEQ ID NO: 1333056 - RNA, 13 nt, Mycobacterium tuberculosis H37Rv
cuccaccgcgccg

SEQ ID NO: 1333057 - RNA, 15 nt, Mycobacterium tuberculosis H37Rv
cuccaccgcgccguc

SEQ ID NO: 1333058 - RNA, 13 nt, Mycobacterium tuberculosis H37Rv
cuccaccgcuggc

SEQ ID NO: 1333059 - RNA, 23 nt, Mycobacterium tuberculosis H37Rv
cuccacuuggggcgccagggucg

SEQ ID NO: 1333060 - RNA, 16 nt, Mycobacterium tuberculosis H37Rv
cuccacuuggggcgcc

SEQ ID NO: 1333061 - RNA, 16 nt, Mycobacterium tuberculosis H37Rv
cuccacgcuggcgccc

SEQ ID NO: 1333062 - RNA, 15 nt, Mycobacterium tuberculosis H37Rv
cuccacgcccuggcg

SEQ ID NO: 1333063 - RNA, 14 nt, Mycobacterium tuberculosis H37Rv
cuccagacguucca

SEQ ID NO: 1333064 - RNA, 15 nt, Mycobacterium tuberculosis H37Rv
cuccagauccacgcc

SEQ ID NO: 1333065 - RNA, 23 nt, Mycobacterium tuberculosis H37Rv
cuccagagacagcgccaugcccu

SEQ ID NO: 1333066 - RNA, 15 nt, Mycobacterium tuberculosis H37Rv
cuccagcaccagcac

SEQ ID NO: 1333067 - RNA, 14 nt, Mycobacterium tuberculosis H37Rv
cuccagcaccaccg

SEQ ID NO: 1333068 - RNA, 16 nt, Mycobacterium tuberculosis H37Rv
cuccagcaccacggcg

SEQ ID NO: 1333069 - RNA, 22 nt, Mycobacterium tuberculosis H37Rv
cuccagcaccacggcgcgcgcg

SEQ ID NO: 1333070 - RNA, 17 nt, Mycobacterium tuberculosis H37Rv
cuccagcacccggucga

SEQ ID NO: 1333071 - RNA, 21 nt, Mycobacterium tuberculosis H37Rv
cuccaagcaauuccaccgccg

SEQ ID NO: 1333072 - RNA, 22 nt, Mycobacterium tuberculosis H37Rv
cuccaagccgggugggagcagc

SEQ ID NO: 1333073 - RNA, 20 nt, Mycobacterium tuberculosis H37Rv
cuccaacagguaagccacau

SEQ ID NO: 1333074 - RNA, 19 nt, Mycobacterium tuberculosis H37Rv
cuccaaaaucgcggccaca

SEQ ID NO: 1333075 - RNA, 20 nt, Mycobacterium tuberculosis H37Rv
cuccaacaacuccagcaggu

SEQ ID NO: 1333076 - RNA, 20 nt, Mycobacterium tuberculosis H37Rv
cuccaaaagccucagccgcu

SEQ ID NO: 1333077 - RNA, 18 nt, Mycobacterium tuberculosis H37Rv
cucaggaucccgguggca

SEQ ID NO: 1333078 - RNA, 17 nt, Mycobacterium tuberculosis H37Rv
cucauucgugcccgggc

SEQ ID NO: 1333079 - RNA, 13 nt, Mycobacterium tuberculosis H37Rv
cucccagugagca

SEQ ID NO: 1333080 - RNA, 21 nt, Mycobacterium tuberculosis H37Rv
cucccaaaugucguaggccgc

SEQ ID NO: 1333081 - RNA, 20 nt, Mycobacterium tuberculosis H37Rv
cucccauucccaacacagcc

SEQ ID NO: 1333082 - RNA, 15 nt, Mycobacterium tuberculosis H37Rv
cuccagcgcacuacu

SEQ ID NO: 1333083 - RNA, 16 nt, Mycobacterium tuberculosis H37Rv
cuccauggcauugcuc

SEQ ID NO: 1333084 - RNA, 18 nt, Mycobacterium tuberculosis H37Rv
cucccgggcgagccgugc

SEQ ID NO: 1333085 - RNA, 19 nt, Mycobacterium tuberculosis H37Rv
cucccgggcggcggccugg

SEQ ID NO: 1333086 - RNA, 17 nt, Mycobacterium tuberculosis H37Rv
cuccccggucgccgcgu

SEQ ID NO: 1333087 - RNA, 14 nt, Mycobacterium tuberculosis H37Rv
cuccccagagcugg

SEQ ID NO: 1333088 - RNA, 21 nt, Mycobacterium tuberculosis H37Rv
cuccccgaccgaaccgucagc

SEQ ID NO: 1333089 - RNA, 17 nt, Mycobacterium tuberculosis H37Rv
cuccccgaccgcgcccg

SEQ ID NO: 1333090 - RNA, 18 nt, Mycobacterium tuberculosis H37Rv
cuccccgaucagcaccga

SEQ ID NO: 1333091 - RNA, 18 nt, Mycobacterium tuberculosis H37Rv
cuccccggauuccucguc

SEQ ID NO: 1333092 - RNA, 16 nt, Mycobacterium tuberculosis H37Rv
cuccgggaugaagcuc

SEQ ID NO: 1333093 - RNA, 23 nt, Mycobacterium tuberculosis H37Rv
cuccggucaacacccgcccgggc

SEQ ID NO: 1333094 - RNA, 20 nt, Mycobacterium tuberculosis H37Rv
cuccgggucgaugucggggc

SEQ ID NO: 1333095 - RNA, 14 nt, Mycobacterium tuberculosis H37Rv
cuccggguggcggc

SEQ ID NO: 1333096 - RNA, 16 nt, Mycobacterium tuberculosis H37Rv
cuccgucggccaggcc

SEQ ID NO: 1333097 - RNA, 14 nt, Mycobacterium tuberculosis H37Rv
cuccgucguaguug

SEQ ID NO: 1333098 - RNA, 14 nt, Mycobacterium tuberculosis H37Rv
cuccguugagguag

SEQ ID NO: 1333099 - RNA, 15 nt, Mycobacterium tuberculosis H37Rv
cuccguuuggcugcc

SEQ ID NO: 1333100 - RNA, 16 nt, Mycobacterium tuberculosis H37Rv
cuccguuuggcugccg

SEQ ID NO: 1333101 - RNA, 19 nt, Mycobacterium tuberculosis H37Rv
cuccgcugccgcccgcgcc

SEQ ID NO: 1333102 - RNA, 22 nt, Mycobacterium tuberculosis H37Rv
cuccggacccuuacccggcgcg

SEQ ID NO: 1333103 - RNA, 22 nt, Mycobacterium tuberculosis H37Rv
cuccggaaccacucgcucagga

SEQ ID NO: 1333104 - RNA, 22 nt, Mycobacterium tuberculosis H37Rv
cuccggaaagcucucggcaccc

SEQ ID NO: 1333105 - RNA, 17 nt, Mycobacterium tuberculosis H37Rv
cuccggcgucggcggcc

SEQ ID NO: 1333106 - RNA, 14 nt, Mycobacterium tuberculosis H37Rv
cuccgggacgguga

SEQ ID NO: 1333107 - RNA, 19 nt, Mycobacterium tuberculosis H37Rv
cuccgggcgcaccaagacg

SEQ ID NO: 1333108 - RNA, 18 nt, Mycobacterium tuberculosis H37Rv
cuccggcuucggcaacca

SEQ ID NO: 1333109 - RNA, 18 nt, Mycobacterium tuberculosis H37Rv
cuccgcgguuguuucggc

SEQ ID NO: 1333110 - RNA, 16 nt, Mycobacterium tuberculosis H37Rv
cuccgagggcugcgug

SEQ ID NO: 1333111 - RNA, 21 nt, Mycobacterium tuberculosis H37Rv
cuccgaaguccacgcaccacg

SEQ ID NO: 1333112 - RNA, 14 nt, Mycobacterium tuberculosis H37Rv
cuccgaaggccgcc

SEQ ID NO: 1333113 - RNA, 16 nt, Mycobacterium tuberculosis H37Rv
cuccgaaguccacgca

SEQ ID NO: 1333114 - RNA, 16 nt, Mycobacterium tuberculosis H37Rv
cucgcgacaucaccga

SEQ ID NO: 1333115 - RNA, 19 nt, Mycobacterium tuberculosis H37Rv
cucgcgcaaggcgccgcag

SEQ ID NO: 1333116 - RNA, 19 nt, Mycobacterium tuberculosis H37Rv
cucgcgaucgcagugagca

SEQ ID NO: 1333117 - RNA, 22 nt, Mycobacterium tuberculosis H37Rv
cucgcgaucugcucguagcggc

SEQ ID NO: 1333118 - RNA, 13 nt, Mycobacterium tuberculosis H37Rv
cucgccgggcagc

SEQ ID NO: 1333119 - RNA, 17 nt, Mycobacterium tuberculosis H37Rv
cucgccguaagcaccag

SEQ ID NO: 1333120 - RNA, 21 nt, Mycobacterium tuberculosis H37Rv
cucgccguaagcaccagccag

SEQ ID NO: 1333121 - RNA, 15 nt, Mycobacterium tuberculosis H37Rv
cucgccgggcagcua

SEQ ID NO: 1333122 - RNA, 23 nt, Mycobacterium tuberculosis H37Rv
cucgccgguaggcggccagcgcg

SEQ ID NO: 1333123 - RNA, 15 nt, Mycobacterium tuberculosis H37Rv
cucgccggccgucag

SEQ ID NO: 1333124 - RNA, 15 nt, Mycobacterium tuberculosis H37Rv
cucgccugcacgccc

SEQ ID NO: 1333125 - RNA, 16 nt, Mycobacterium tuberculosis H37Rv
cucgccugcacccggc

SEQ ID NO: 1333126 - RNA, 19 nt, Mycobacterium tuberculosis H37Rv
cucgcgaaagagagcuaag

SEQ ID NO: 1333127 - RNA, 20 nt, Mycobacterium tuberculosis H37Rv
cucgccgucauagcaggccu

SEQ ID NO: 1333128 - RNA, 22 nt, Mycobacterium tuberculosis H37Rv
cucgccggaucguucgcgugcc

SEQ ID NO: 1333129 - RNA, 12 nt, Mycobacterium tuberculosis H37Rv
cucgccgcgcgu

SEQ ID NO: 1333130 - RNA, 19 nt, Mycobacterium tuberculosis H37Rv
cucgccgcacgccggcaug

SEQ ID NO: 1333131 - RNA, 21 nt, Mycobacterium tuberculosis H37Rv
cucgccgaggccuaccaggcg

SEQ ID NO: 1333132 - RNA, 14 nt, Mycobacterium tuberculosis H37Rv
cucgccgagcugug

SEQ ID NO: 1333133 - RNA, 14 nt, Mycobacterium tuberculosis H37Rv
cucgccgagcucgg

SEQ ID NO: 1333134 - RNA, 18 nt, Mycobacterium tuberculosis H37Rv
cucgccgagcagacacag

SEQ ID NO: 1333135 - RNA, 13 nt, Mycobacterium tuberculosis H37Rv
cucgcccugcaga

SEQ ID NO: 1333136 - RNA, 14 nt, Mycobacterium tuberculosis H37Rv
cucgccgaccagcu

SEQ ID NO: 1333137 - RNA, 23 nt, Mycobacterium tuberculosis H37Rv
cucgcccgccgccaccagcugcg

SEQ ID NO: 1333138 - RNA, 22 nt, Mycobacterium tuberculosis H37Rv
cucgccacgcucggcggccagc

SEQ ID NO: 1333139 - RNA, 19 nt, Mycobacterium tuberculosis H37Rv
cucgccaggcaagccagca

SEQ ID NO: 1333140 - RNA, 18 nt, Mycobacterium tuberculosis H37Rv
cucgccagggucgcgagc

SEQ ID NO: 1333141 - RNA, 22 nt, Mycobacterium tuberculosis H37Rv
cucgccagggucgcgagcccgc

SEQ ID NO: 1333142 - RNA, 11 nt, Mycobacterium tuberculosis H37Rv
cucgccagagu

SEQ ID NO: 1333143 - RNA, 13 nt, Mycobacterium tuberculosis H37Rv
cucgcccaccacc

SEQ ID NO: 1333144 - RNA, 20 nt, Mycobacterium tuberculosis H37Rv
cucgcccaccuccugguuga

SEQ ID NO: 1333145 - RNA, 19 nt, Mycobacterium tuberculosis H37Rv
cucgaacucggcggccagc

SEQ ID NO: 1333146 - RNA, 19 nt, Mycobacterium tuberculosis H37Rv
cucgaacugggucggcacg

SEQ ID NO: 1333147 - RNA, 14 nt, Mycobacterium tuberculosis H37Rv
cucgaaggccgcca

SEQ ID NO: 1333148 - RNA, 18 nt, Mycobacterium tuberculosis H37Rv
cucgaccgacugcccgau

SEQ ID NO: 1333149 - RNA, 16 nt, Mycobacterium tuberculosis H37Rv
cucgaccgccagcccg

SEQ ID NO: 1333150 - RNA, 13 nt, Mycobacterium tuberculosis H37Rv
cucgaagugcagg

SEQ ID NO: 1333151 - RNA, 16 nt, Mycobacterium tuberculosis H37Rv
cucgaccgccagccgc

SEQ ID NO: 1333152 - RNA, 18 nt, Mycobacterium tuberculosis H37Rv
cucgaccgcccggcuagg

SEQ ID NO: 1333153 - RNA, 22 nt, Mycobacterium tuberculosis H37Rv
cucgaccgcgagcaugaugucc

SEQ ID NO: 1333154 - RNA, 19 nt, Mycobacterium tuberculosis H37Rv
cucgaacagguuggccccg

SEQ ID NO: 1333155 - RNA, 20 nt, Mycobacterium tuberculosis H37Rv
cuccuccagagacagcgcca

SEQ ID NO: 1333156 - RNA, 19 nt, Mycobacterium tuberculosis H37Rv
cuccuccaccagugccccg

SEQ ID NO: 1333157 - RNA, 15 nt, Mycobacterium tuberculosis H37Rv
cuccuccggcaccaa

SEQ ID NO: 1333158 - RNA, 18 nt, Mycobacterium tuberculosis H37Rv
cuccuccggaaagcucuc

SEQ ID NO: 1333159 - RNA, 16 nt, Mycobacterium tuberculosis H37Rv
cuccuccccggcccgc

SEQ ID NO: 1333160 - RNA, 13 nt, Mycobacterium tuberculosis H37Rv
cucgauggccagg

SEQ ID NO: 1333161 - RNA, 20 nt, Mycobacterium tuberculosis H37Rv
cucgaugaugucgagcacac

SEQ ID NO: 1333162 - RNA, 20 nt, Mycobacterium tuberculosis H37Rv
cucgacgaggagccucgacc

SEQ ID NO: 1333163 - RNA, 19 nt, Mycobacterium tuberculosis H37Rv
cucgacgaucugcagcacu

SEQ ID NO: 1333164 - RNA, 18 nt, Mycobacterium tuberculosis H37Rv
cucgauguacagcgggau

SEQ ID NO: 1333165 - RNA, 17 nt, Mycobacterium tuberculosis H37Rv
cucgauuguggccagcg

SEQ ID NO: 1333166 - RNA, 14 nt, Mycobacterium tuberculosis H37Rv
cucgauggccuugu

SEQ ID NO: 1333167 - RNA, 16 nt, Mycobacterium tuberculosis H37Rv
cucgauggcggccacc

SEQ ID NO: 1333168 - RNA, 14 nt, Mycobacterium tuberculosis H37Rv
cucgaugucagcgg

SEQ ID NO: 1333169 - RNA, 15 nt, Mycobacterium tuberculosis H37Rv
cucgcacagcaccac

SEQ ID NO: 1333170 - RNA, 21 nt, Mycobacterium tuberculosis H37Rv
cucgcaggaauucgccauagc

SEQ ID NO: 1333171 - RNA, 15 nt, Mycobacterium tuberculosis H37Rv
cucgcacucguugcc

SEQ ID NO: 1333172 - RNA, 13 nt, Mycobacterium tuberculosis H37Rv
cucgcaucggccu

SEQ ID NO: 1333173 - RNA, 23 nt, Mycobacterium tuberculosis H37Rv
cucgcaguucaucgggcaccaac

SEQ ID NO: 1333174 - RNA, 16 nt, Mycobacterium tuberculosis H37Rv
cucggcgcugcgcacc

SEQ ID NO: 1333175 - RNA, 14 nt, Mycobacterium tuberculosis H37Rv
cucggcgccgccca

SEQ ID NO: 1333176 - RNA, 16 nt, Mycobacterium tuberculosis H37Rv
cucggcggccaacagc

SEQ ID NO: 1333177 - RNA, 14 nt, Mycobacterium tuberculosis H37Rv
cucggcggccagcg

SEQ ID NO: 1333178 - RNA, 19 nt, Mycobacterium tuberculosis H37Rv
cucggcggccagcucggcc

SEQ ID NO: 1333179 - RNA, 12 nt, Mycobacterium tuberculosis H37Rv
cucggcggccgc

SEQ ID NO: 1333180 - RNA, 14 nt, Mycobacterium tuberculosis H37Rv
cucggcgcccagcu

SEQ ID NO: 1333181 - RNA, 13 nt, Mycobacterium tuberculosis H37Rv
cucggcgcagccg

SEQ ID NO: 1333182 - RNA, 13 nt, Mycobacterium tuberculosis H37Rv
cucggcgcagcac

SEQ ID NO: 1333183 - RNA, 20 nt, Mycobacterium tuberculosis H37Rv
cucgcugggaaaucccgacc

SEQ ID NO: 1333184 - RNA, 18 nt, Mycobacterium tuberculosis H37Rv
cucgcuguugaagccgcc

SEQ ID NO: 1333185 - RNA, 19 nt, Mycobacterium tuberculosis H37Rv
cucgcuguugaagccgccc

SEQ ID NO: 1333186 - RNA, 19 nt, Mycobacterium tuberculosis H37Rv
cucgcugcaccagcugcuc

SEQ ID NO: 1333187 - RNA, 15 nt, Mycobacterium tuberculosis H37Rv
cucgcuggugaacca

SEQ ID NO: 1333188 - RNA, 15 nt, Mycobacterium tuberculosis H37Rv
cucgcugcaccagcu

SEQ ID NO: 1333189 - RNA, 18 nt, Mycobacterium tuberculosis H37Rv
cucgcgguaguugucccg

SEQ ID NO: 1333190 - RNA, 21 nt, Mycobacterium tuberculosis H37Rv
cucgcgggccaaagccgucag

SEQ ID NO: 1333191 - RNA, 14 nt, Mycobacterium tuberculosis H37Rv
cucggggugguggu

SEQ ID NO: 1333192 - RNA, 16 nt, Mycobacterium tuberculosis H37Rv
cucgggugcgcccggc

SEQ ID NO: 1333193 - RNA, 23 nt, Mycobacterium tuberculosis H37Rv
cucggguacaucgaggccacgcc

SEQ ID NO: 1333194 - RNA, 16 nt, Mycobacterium tuberculosis H37Rv
cucggguugcagcagc

SEQ ID NO: 1333195 - RNA, 19 nt, Mycobacterium tuberculosis H37Rv
cucggucaccacggcggcg

SEQ ID NO: 1333196 - RNA, 16 nt, Mycobacterium tuberculosis H37Rv
cucgguggccuucugg

SEQ ID NO: 1333197 - RNA, 18 nt, Mycobacterium tuberculosis H37Rv
cucggugcggaacaccgc

SEQ ID NO: 1333198 - RNA, 13 nt, Mycobacterium tuberculosis H37Rv
cucggugccccca

SEQ ID NO: 1333199 - RNA, 13 nt, Mycobacterium tuberculosis H37Rv
cucggugccgccc

SEQ ID NO: 1333200 - RNA, 16 nt, Mycobacterium tuberculosis H37Rv
cucggugccggccgca

SEQ ID NO: 1333201 - RNA, 19 nt, Mycobacterium tuberculosis H37Rv
cucggugccugucagaagg

SEQ ID NO: 1333202 - RNA, 15 nt, Mycobacterium tuberculosis H37Rv
cucggugcgccagau

SEQ ID NO: 1333203 - RNA, 18 nt, Mycobacterium tuberculosis H37Rv
cucgggggauccggcgca

SEQ ID NO: 1333204 - RNA, 12 nt, Mycobacterium tuberculosis H37Rv
cucgggggcugc

SEQ ID NO: 1333205 - RNA, 16 nt, Mycobacterium tuberculosis H37Rv
cucggcgugcucggcc

SEQ ID NO: 1333206 - RNA, 16 nt, Mycobacterium tuberculosis H37Rv
cucggcguugccgccg

SEQ ID NO: 1333207 - RNA, 14 nt, Mycobacterium tuberculosis H37Rv
cucggcgucgccgc

SEQ ID NO: 1333208 - RNA, 21 nt, Mycobacterium tuberculosis H37Rv
cucggcgguggcggugcugcu

SEQ ID NO: 1333209 - RNA, 22 nt, Mycobacterium tuberculosis H37Rv
cucggcggcgcggucgaagcug

SEQ ID NO: 1333210 - RNA, 24 nt, Mycobacterium tuberculosis H37Rv
cucggcgguaaaugccugcccacc

SEQ ID NO: 1333211 - RNA, 22 nt, Mycobacterium tuberculosis H37Rv
cucguugagcagcuggaccacc

SEQ ID NO: 1333212 - RNA, 19 nt, Mycobacterium tuberculosis H37Rv
cucgugcgugggcgcggcg

SEQ ID NO: 1333213 - RNA, 16 nt, Mycobacterium tuberculosis H37Rv
cucguggaucugccuc

SEQ ID NO: 1333214 - RNA, 17 nt, Mycobacterium tuberculosis H37Rv
cucguggaucugccucu

SEQ ID NO: 1333215 - RNA, 16 nt, Mycobacterium tuberculosis H37Rv
cucguggucgacguga

SEQ ID NO: 1333216 - RNA, 22 nt, Mycobacterium tuberculosis H37Rv
cucgugcaggaccagcaccgcc

SEQ ID NO: 1333217 - RNA, 17 nt, Mycobacterium tuberculosis H37Rv
cucguucauguagcagc

SEQ ID NO: 1333218 - RNA, 15 nt, Mycobacterium tuberculosis H37Rv
cucguggaucugccu

SEQ ID NO: 1333219 - RNA, 23 nt, Mycobacterium tuberculosis H37Rv
cucguguaggagcuggcugacga

SEQ ID NO: 1333220 - RNA, 18 nt, Mycobacterium tuberculosis H37Rv
cucguguaccggagcggu

SEQ ID NO: 1333221 - RNA, 19 nt, Mycobacterium tuberculosis H37Rv
cucguguuguugaagcccg

SEQ ID NO: 1333222 - RNA, 19 nt, Mycobacterium tuberculosis H37Rv
cucgucguccggccacggu

SEQ ID NO: 1333223 - RNA, 16 nt, Mycobacterium tuberculosis H37Rv
cucgucguccggccac

SEQ ID NO: 1333224 - RNA, 19 nt, Mycobacterium tuberculosis H37Rv
cucgucgucgauccagccc

SEQ ID NO: 1333225 - RNA, 20 nt, Mycobacterium tuberculosis H37Rv
cucgucgucgauccagccca

SEQ ID NO: 1333226 - RNA, 18 nt, Mycobacterium tuberculosis H37Rv
cucgucgucgauccagcc

SEQ ID NO: 1333227 - RNA, 22 nt, Mycobacterium tuberculosis H37Rv
cucggugugcucgccgaccagc

SEQ ID NO: 1333228 - RNA, 22 nt, Mycobacterium tuberculosis H37Rv
cucgguguacaccgcgcccgcc

SEQ ID NO: 1333229 - RNA, 19 nt, Mycobacterium tuberculosis H37Rv
cucgguuugcguccuggug

SEQ ID NO: 1333230 - RNA, 16 nt, Mycobacterium tuberculosis H37Rv
cucgucggcgccggcg

SEQ ID NO: 1333231 - RNA, 13 nt, Mycobacterium tuberculosis H37Rv
cucggugcggcug

SEQ ID NO: 1333232 - RNA, 18 nt, Mycobacterium tuberculosis H37Rv
cucgguuugcguccuggu

SEQ ID NO: 1333233 - RNA, 18 nt, Mycobacterium tuberculosis H37Rv
cuaucuggcggccggacu

SEQ ID NO: 1333234 - RNA, 15 nt, Mycobacterium tuberculosis H37Rv
cuaucucgcucgacg

SEQ ID NO: 1333235 - RNA, 15 nt, Mycobacterium tuberculosis H37Rv
cuauggcccgggccg

SEQ ID NO: 1333236 - RNA, 13 nt, Mycobacterium tuberculosis H37Rv
cuaugcuggcagc

SEQ ID NO: 1333237 - RNA, 22 nt, Mycobacterium tuberculosis H37Rv
cuauggguucgcgguuguccuc

SEQ ID NO: 1333238 - RNA, 16 nt, Mycobacterium tuberculosis H37Rv
cuauuccgcggcacgc

SEQ ID NO: 1333239 - RNA, 21 nt, Mycobacterium tuberculosis H37Rv
cucaccaaucugcgggccggu

SEQ ID NO: 1333240 - RNA, 13 nt, Mycobacterium tuberculosis H37Rv
cucaauuccaugc

SEQ ID NO: 1333241 - RNA, 18 nt, Mycobacterium tuberculosis H37Rv
cucaccacgucgaccgaa

SEQ ID NO: 1333242 - RNA, 12 nt, Mycobacterium tuberculosis H37Rv
cucaccagucag

SEQ ID NO: 1333243 - RNA, 19 nt, Mycobacterium tuberculosis H37Rv
cucaccagccgucagcgcg

SEQ ID NO: 1333244 - RNA, 20 nt, Mycobacterium tuberculosis H37Rv
cucaccagacgcugccaagc

SEQ ID NO: 1333245 - RNA, 13 nt, Mycobacterium tuberculosis H37Rv
cucacccacauga

SEQ ID NO: 1333246 - RNA, 21 nt, Mycobacterium tuberculosis H37Rv
cucaccaugggacacaaucca

SEQ ID NO: 1333247 - RNA, 14 nt, Mycobacterium tuberculosis H37Rv
cucagcaccgcugg

SEQ ID NO: 1333248 - RNA, 19 nt, Mycobacterium tuberculosis H37Rv
cucacgccguccggugugg

SEQ ID NO: 1333249 - RNA, 19 nt, Mycobacterium tuberculosis H37Rv
cucacgggugcuggcagga

SEQ ID NO: 1333250 - RNA, 17 nt, Mycobacterium tuberculosis H37Rv
cucacgggugcuggcag

SEQ ID NO: 1333251 - RNA, 15 nt, Mycobacterium tuberculosis H37Rv
cucacgugcccgcgc

SEQ ID NO: 1333252 - RNA, 19 nt, Mycobacterium tuberculosis H37Rv
cucacgugcccgcgcggcg

SEQ ID NO: 1333253 - RNA, 18 nt, Mycobacterium tuberculosis H37Rv
cucacuggugacccugau

SEQ ID NO: 1333254 - RNA, 22 nt, Mycobacterium tuberculosis H37Rv
cucagccaccgcggucagcucg

SEQ ID NO: 1333255 - RNA, 16 nt, Mycobacterium tuberculosis H37Rv
cucagccgugcccagg

SEQ ID NO: 1333256 - RNA, 18 nt, Mycobacterium tuberculosis H37Rv
cucagccgcgccgggucc

SEQ ID NO: 1333257 - RNA, 18 nt, Mycobacterium tuberculosis H37Rv
cucagcgguagagcucug

SEQ ID NO: 1333258 - RNA, 22 nt, Mycobacterium tuberculosis H37Rv
cuaguucgagcugccaggcccg

SEQ ID NO: 1333259 - RNA, 15 nt, Mycobacterium tuberculosis H37Rv
cuagugugaccguca

SEQ ID NO: 1333260 - RNA, 22 nt, Mycobacterium tuberculosis H37Rv
cuagugcgggccgugacccuca

SEQ ID NO: 1333261 - RNA, 13 nt, Mycobacterium tuberculosis H37Rv
cuaggaacgccac

SEQ ID NO: 1333262 - RNA, 22 nt, Mycobacterium tuberculosis H37Rv
cuaggaccaccagcgcuccagc

SEQ ID NO: 1333263 - RNA, 20 nt, Mycobacterium tuberculosis H37Rv
cuaggaccgcgguggccaga

SEQ ID NO: 1333264 - RNA, 14 nt, Mycobacterium tuberculosis H37Rv
cuaggaccaccagc

SEQ ID NO: 1333265 - RNA, 23 nt, Mycobacterium tuberculosis H37Rv
cuaggacgccgcccucucacggc

SEQ ID NO: 1333266 - RNA, 19 nt, Mycobacterium tuberculosis H37Rv
cuaggacggcgcgagccgc

SEQ ID NO: 1333267 - RNA, 15 nt, Mycobacterium tuberculosis H37Rv
cuaggaccaccagcg

SEQ ID NO: 1333268 - RNA, 20 nt, Mycobacterium tuberculosis H37Rv
cuaguugggugggugcagca

SEQ ID NO: 1333269 - RNA, 23 nt, Mycobacterium tuberculosis H37Rv
cuacgcggccgaggucacccggu

SEQ ID NO: 1333270 - RNA, 18 nt, Mycobacterium tuberculosis H37Rv
cuagcagggugccggcgc

SEQ ID NO: 1333271 - RNA, 19 nt, Mycobacterium tuberculosis H37Rv
cuagcgagcgcacaccggc

SEQ ID NO: 1333272 - RNA, 17 nt, Mycobacterium tuberculosis H37Rv
cuagccgauccagcagg

SEQ ID NO: 1333273 - RNA, 15 nt, Mycobacterium tuberculosis H37Rv
cuagcccgccauccg

SEQ ID NO: 1333274 - RNA, 16 nt, Mycobacterium tuberculosis H37Rv
cuagcccggcagcacg

SEQ ID NO: 1333275 - RNA, 19 nt, Mycobacterium tuberculosis H37Rv
cuagcccguuguccagaac

SEQ ID NO: 1333276 - RNA, 17 nt, Mycobacterium tuberculosis H37Rv
cuagcccucagcuagcg

SEQ ID NO: 1333277 - RNA, 19 nt, Mycobacterium tuberculosis H37Rv
cuagccgcggcaccgccga

SEQ ID NO: 1333278 - RNA, 19 nt, Mycobacterium tuberculosis H37Rv
cuagccgggcgcgccggcc

SEQ ID NO: 1333279 - RNA, 18 nt, Mycobacterium tuberculosis H37Rv
cuaccggccuuuccagca

SEQ ID NO: 1333280 - RNA, 17 nt, Mycobacterium tuberculosis H37Rv
cuaccggccuuuccagc

SEQ ID NO: 1333281 - RNA, 18 nt, Mycobacterium tuberculosis H37Rv
cuaccgagaucaccgcca

SEQ ID NO: 1333282 - RNA, 19 nt, Mycobacterium tuberculosis H37Rv
cuaccgagaucaccgccac

SEQ ID NO: 1333283 - RNA, 20 nt, Mycobacterium tuberculosis H37Rv
cuaccgagaucaccgccacc

SEQ ID NO: 1333284 - RNA, 15 nt, Mycobacterium tuberculosis H37Rv
cuacccgggccaggc

SEQ ID NO: 1333285 - RNA, 12 nt, Mycobacterium tuberculosis H37Rv
cuacccgggcca

SEQ ID NO: 1333286 - RNA, 16 nt, Mycobacterium tuberculosis H37Rv
cuacccgcggcgcgaa

SEQ ID NO: 1333287 - RNA, 12 nt, Mycobacterium tuberculosis H37Rv
cuaccggcgccg

SEQ ID NO: 1333288 - RNA, 23 nt, Mycobacterium tuberculosis H37Rv
cuaccggcuuggcgggaccguga

SEQ ID NO: 1333289 - RNA, 19 nt, Mycobacterium tuberculosis H37Rv
cuaccguacgcagcgugug

SEQ ID NO: 1333290 - RNA, 16 nt, Mycobacterium tuberculosis H37Rv
cuaccgucaguagcca

SEQ ID NO: 1333291 - RNA, 17 nt, Mycobacterium tuberculosis H37Rv
cuaccugcacccaggca

SEQ ID NO: 1333292 - RNA, 20 nt, Mycobacterium tuberculosis H37Rv
cuaccaaccgguacuccugg

SEQ ID NO: 1333293 - RNA, 22 nt, Mycobacterium tuberculosis H37Rv
cuaccaaccgguacuccugggu

SEQ ID NO: 1333294 - RNA, 22 nt, Mycobacterium tuberculosis H37Rv
cuaccaacgcaacacgggcgcc

SEQ ID NO: 1333295 - RNA, 19 nt, Mycobacterium tuberculosis H37Rv
cuacccgcgcgaccugaau

SEQ ID NO: 1333296 - RNA, 21 nt, Mycobacterium tuberculosis H37Rv
cuacccgcgcgaccugaaugc

SEQ ID NO: 1333297 - RNA, 21 nt, Mycobacterium tuberculosis H37Rv
cuacaccggcaagccacgccg

SEQ ID NO: 1333298 - RNA, 15 nt, Mycobacterium tuberculosis H37Rv
aaaaccacccccacc

SEQ ID NO: 1333299 - RNA, 14 nt, Mycobacterium tuberculosis H37Rv
aaaaccgccgcaac

SEQ ID NO: 1333300 - RNA, 22 nt, Mycobacterium tuberculosis H37Rv
aaaaccucgacgcccgcccugg

SEQ ID NO: 1333301 - RNA, 21 nt, Mycobacterium tuberculosis H37Rv
aaaaaguuaccgguauagcca

SEQ ID NO: 1333302 - RNA, 21 nt, Mycobacterium tuberculosis H37Rv
aaaaacccggugaccagcaac

SEQ ID NO: 1333303 - RNA, 20 nt, Mycobacterium tuberculosis H37Rv
aaaaaccucgacgcccgccc

SEQ ID NO: 1333304 - RNA, 18 nt, Mycobacterium tuberculosis H37Rv
aaaaacgaacccaggcac

SEQ ID NO: 1333305 - RNA, 14 nt, Mycobacterium tuberculosis H37Rv
aaaaagcccagcga

SEQ ID NO: 1333306 - RNA, 18 nt, Mycobacterium tuberculosis H37Rv
aaaagggcggcagcgagg

SEQ ID NO: 1333307 - RNA, 15 nt, Mycobacterium tuberculosis H37Rv
aaaagucaggacggc

SEQ ID NO: 1333308 - RNA, 21 nt, Mycobacterium tuberculosis H37Rv
aaaacgccaugccgggaacca

SEQ ID NO: 1333309 - RNA, 13 nt, Mycobacterium tuberculosis H37Rv
aaaacgagcuucc

SEQ ID NO: 1333310 - RNA, 16 nt, Mycobacterium tuberculosis H37Rv
aaacaccagcccggcg

SEQ ID NO: 1333311 - RNA, 20 nt, Mycobacterium tuberculosis H37Rv
aaacaccagcgaggccagcg

SEQ ID NO: 1333312 - RNA, 16 nt, Mycobacterium tuberculosis H37Rv
aaacacguucucacca

SEQ ID NO: 1333313 - RNA, 15 nt, Mycobacterium tuberculosis H37Rv
aaaauugcuccacca

SEQ ID NO: 1333314 - RNA, 13 nt, Mycobacterium tuberculosis H37Rv
aaacagguaagca

SEQ ID NO: 1333315 - RNA, 16 nt, Mycobacterium tuberculosis H37Rv
aaacagguaagcagcc

SEQ ID NO: 1333316 - RNA, 22 nt, Mycobacterium tuberculosis H37Rv
aaacagcauggcgaagaacaac

SEQ ID NO: 1333317 - RNA, 22 nt, Mycobacterium tuberculosis H37Rv
aaacagcgccaucgaugcggug

SEQ ID NO: 1333318 - RNA, 12 nt, Mycobacterium tuberculosis H37Rv
aaacagcaccca

SEQ ID NO: 1333319 - RNA, 12 nt, Mycobacterium tuberculosis H37Rv
aaacccugcugc

SEQ ID NO: 1333320 - RNA, 22 nt, Mycobacterium tuberculosis H37Rv
aaacccggugaccagcaaccac

SEQ ID NO: 1333321 - RNA, 15 nt, Mycobacterium tuberculosis H37Rv
aaaccccggccacca

SEQ ID NO: 1333322 - RNA, 18 nt, Mycobacterium tuberculosis H37Rv
aaacccgaugacuacucc

SEQ ID NO: 1333323 - RNA, 21 nt, Mycobacterium tuberculosis H37Rv
aaaccagauugccgagcccag

SEQ ID NO: 1333324 - RNA, 17 nt, Mycobacterium tuberculosis H37Rv
aaaccagauugccgagc

SEQ ID NO: 1333325 - RNA, 17 nt, Mycobacterium tuberculosis H37Rv
aaaccagguggccaggc

SEQ ID NO: 1333326 - RNA, 13 nt, Mycobacterium tuberculosis H37Rv
aaaccacccccac

SEQ ID NO: 1333327 - RNA, 17 nt, Mycobacterium tuberculosis H37Rv
aaaccacccgcaacaca

SEQ ID NO: 1333328 - RNA, 13 nt, Mycobacterium tuberculosis H37Rv
aaaccacagcgcc

SEQ ID NO: 1333329 - RNA, 23 nt, Mycobacterium tuberculosis H37Rv
aaaccacgcugguguuguacugg

SEQ ID NO: 1333330 - RNA, 18 nt, Mycobacterium tuberculosis H37Rv
aaacaucucggcgcagcc

SEQ ID NO: 1333331 - RNA, 12 nt, Mycobacterium tuberculosis H37Rv
aaacaugugggu

SEQ ID NO: 1333332 - RNA, 20 nt, Mycobacterium tuberculosis H37Rv
aaacaugugggugaacaccg

SEQ ID NO: 1333333 - RNA, 12 nt, Mycobacterium tuberculosis H37Rv
aaacauugcuag

SEQ ID NO: 1333334 - RNA, 15 nt, Mycobacterium tuberculosis H37Rv
aacaacagccgcagc

SEQ ID NO: 1333335 - RNA, 22 nt, Mycobacterium tuberculosis H37Rv
aacaaccccgaggcaacaagca

SEQ ID NO: 1333336 - RNA, 20 nt, Mycobacterium tuberculosis H37Rv
aacaacuuggccaucccggc

SEQ ID NO: 1333337 - RNA, 22 nt, Mycobacterium tuberculosis H37Rv
aacaacuuggccaucccggccu

SEQ ID NO: 1333338 - RNA, 15 nt, Mycobacterium tuberculosis H37Rv
aacaacuccagcagg

SEQ ID NO: 1333339 - RNA, 20 nt, Mycobacterium tuberculosis H37Rv
aacaagaucagacccagcgc

SEQ ID NO: 1333340 - RNA, 22 nt, Mycobacterium tuberculosis H37Rv
aaauccggggggauccagcagg

SEQ ID NO: 1333341 - RNA, 13 nt, Mycobacterium tuberculosis H37Rv
aaauccgcguggu

SEQ ID NO: 1333342 - RNA, 14 nt, Mycobacterium tuberculosis H37Rv
aaauccgcccaccg

SEQ ID NO: 1333343 - RNA, 19 nt, Mycobacterium tuberculosis H37Rv
aaauccagcagccaggagc

SEQ ID NO: 1333344 - RNA, 22 nt, Mycobacterium tuberculosis H37Rv
aaaucgggaucugcgccgcgcg

SEQ ID NO: 1333345 - RNA, 22 nt, Mycobacterium tuberculosis H37Rv
aaaugacggcugaaccugcugg

SEQ ID NO: 1333346 - RNA, 15 nt, Mycobacterium tuberculosis H37Rv
aaauggccaccggcg

SEQ ID NO: 1333347 - RNA, 13 nt, Mycobacterium tuberculosis H37Rv
aaaugucuccucc

SEQ ID NO: 1333348 - RNA, 16 nt, Mycobacterium tuberculosis H37Rv
aaauagauucccggcu

SEQ ID NO: 1333349 - RNA, 20 nt, Mycobacterium tuberculosis H37Rv
aaauaccuuuggcucccuuu

SEQ ID NO: 1333350 - RNA, 21 nt, Mycobacterium tuberculosis H37Rv
aaagcguaaggccggagucga

SEQ ID NO: 1333351 - RNA, 16 nt, Mycobacterium tuberculosis H37Rv
aaagcgagcaccgcgg

SEQ ID NO: 1333352 - RNA, 14 nt, Mycobacterium tuberculosis H37Rv
aaagcgccagcagc

SEQ ID NO: 1333353 - RNA, 22 nt, Mycobacterium tuberculosis H37Rv
aaagcaucaaagcggugccauu

SEQ ID NO: 1333354 - RNA, 16 nt, Mycobacterium tuberculosis H37Rv
aaagacccggcaccca

SEQ ID NO: 1333355 - RNA, 15 nt, Mycobacterium tuberculosis H37Rv
aaagacagcgcggga

SEQ ID NO: 1333356 - RNA, 21 nt, Mycobacterium tuberculosis H37Rv
caaacuaacggcagccaccgu

SEQ ID NO: 1333357 - RNA, 19 nt, Mycobacterium tuberculosis H37Rv
caaacuaacggcagccacc

SEQ ID NO: 1333358 - RNA, 21 nt, Mycobacterium tuberculosis H37Rv
caaacgacagcccuaucagcc

SEQ ID NO: 1333359 - RNA, 17 nt, Mycobacterium tuberculosis H37Rv
caaacgaccgcugauga

SEQ ID NO: 1333360 - RNA, 22 nt, Mycobacterium tuberculosis H37Rv
caaacacgccucgccgaagugg

SEQ ID NO: 1333361 - RNA, 20 nt, Mycobacterium tuberculosis H37Rv
caaacaccccggccuugcca

SEQ ID NO: 1333362 - RNA, 16 nt, Mycobacterium tuberculosis H37Rv
caaacaccccacacag

SEQ ID NO: 1333363 - RNA, 19 nt, Mycobacterium tuberculosis H37Rv
caaacaucgcacccaccac

SEQ ID NO: 1333364 - RNA, 14 nt, Mycobacterium tuberculosis H37Rv
caaaaucagggugc

SEQ ID NO: 1333365 - RNA, 19 nt, Mycobacterium tuberculosis H37Rv
caaaaugccuuggcagccc

SEQ ID NO: 1333366 - RNA, 21 nt, Mycobacterium tuberculosis H37Rv
caaaaugccuuggcagcccag

SEQ ID NO: 1333367 - RNA, 23 nt, Mycobacterium tuberculosis H37Rv
caaaguucgacgagaagacaccg

SEQ ID NO: 1333368 - RNA, 11 nt, Mycobacterium tuberculosis H37Rv
caaagcccaca

SEQ ID NO: 1333369 - RNA, 21 nt, Mycobacterium tuberculosis H37Rv
caaagccagcgcagccaggcu

SEQ ID NO: 1333370 - RNA, 17 nt, Mycobacterium tuberculosis H37Rv
caaagccagcgcagcca

SEQ ID NO: 1333371 - RNA, 13 nt, Mycobacterium tuberculosis H37Rv
caaagcagcgcac

SEQ ID NO: 1333372 - RNA, 14 nt, Mycobacterium tuberculosis H37Rv
caacacgccggccc

SEQ ID NO: 1333373 - RNA, 19 nt, Mycobacterium tuberculosis H37Rv
caacaccucaaacgccugg

SEQ ID NO: 1333374 - RNA, 20 nt, Mycobacterium tuberculosis H37Rv
caacaccgcgucaacgcugu

SEQ ID NO: 1333375 - RNA, 13 nt, Mycobacterium tuberculosis H37Rv
caacacagcugau

SEQ ID NO: 1333376 - RNA, 16 nt, Mycobacterium tuberculosis H37Rv
caacacagccgucgca

SEQ ID NO: 1333377 - RNA, 18 nt, Mycobacterium tuberculosis H37Rv
caacagaugccacccaga

SEQ ID NO: 1333378 - RNA, 21 nt, Mycobacterium tuberculosis H37Rv
caacagaugccacccagaugc

SEQ ID NO: 1333379 - RNA, 17 nt, Mycobacterium tuberculosis H37Rv
caacagaccuagcaccg

SEQ ID NO: 1333380 - RNA, 16 nt, Mycobacterium tuberculosis H37Rv
caacaacuccagcagg

SEQ ID NO: 1333381 - RNA, 15 nt, Mycobacterium tuberculosis H37Rv
caacaacgcauuugg

SEQ ID NO: 1333382 - RNA, 14 nt, Mycobacterium tuberculosis H37Rv
caacaacuccagca

SEQ ID NO: 1333383 - RNA, 15 nt, Mycobacterium tuberculosis H37Rv
caaaugccugcuggu

SEQ ID NO: 1333384 - RNA, 23 nt, Mycobacterium tuberculosis H37Rv
caaaugcgggcuuugccaacaaa

SEQ ID NO: 1333385 - RNA, 14 nt, Mycobacterium tuberculosis H37Rv
caacgccaaaaugg

SEQ ID NO: 1333386 - RNA, 15 nt, Mycobacterium tuberculosis H37Rv
caacgccaaaauggu

SEQ ID NO: 1333387 - RNA, 23 nt, Mycobacterium tuberculosis H37Rv
caacgccacgccgaugauggaca

SEQ ID NO: 1333388 - RNA, 17 nt, Mycobacterium tuberculosis H37Rv
caacgauugcgaagggc

SEQ ID NO: 1333389 - RNA, 18 nt, Mycobacterium tuberculosis H37Rv
caacgacgucgccgaccc

SEQ ID NO: 1333390 - RNA, 18 nt, Mycobacterium tuberculosis H37Rv
caacgacaggcgcccaca

SEQ ID NO: 1333391 - RNA, 21 nt, Mycobacterium tuberculosis H37Rv
caacgacaggcgcccacaaau

SEQ ID NO: 1333392 - RNA, 22 nt, Mycobacterium tuberculosis H37Rv
caacgacaggcgcccacaaaua

SEQ ID NO: 1333393 - RNA, 15 nt, Mycobacterium tuberculosis H37Rv
caacgaccaccacca

SEQ ID NO: 1333394 - RNA, 19 nt, Mycobacterium tuberculosis H37Rv
caacgacgacgacaagugc

SEQ ID NO: 1333395 - RNA, 16 nt, Mycobacterium tuberculosis H37Rv
caacgacccgccgccc

SEQ ID NO: 1333396 - RNA, 16 nt, Mycobacterium tuberculosis H37Rv
caacgacggcugaccu

SEQ ID NO: 1333397 - RNA, 18 nt, Mycobacterium tuberculosis H37Rv
caacgacgcuaaauuuug

SEQ ID NO: 1333398 - RNA, 18 nt, Mycobacterium tuberculosis H37Rv
caacgacugaucaagugc

SEQ ID NO: 1333399 - RNA, 20 nt, Mycobacterium tuberculosis H37Rv
caacgaaccgcucagcgcag

SEQ ID NO: 1333400 - RNA, 12 nt, Mycobacterium tuberculosis H37Rv
caaccuuuggcc

SEQ ID NO: 1333401 - RNA, 22 nt, Mycobacterium tuberculosis H37Rv
caaccugggccaucacggucag

SEQ ID NO: 1333402 - RNA, 13 nt, Mycobacterium tuberculosis H37Rv
caaccuggggcca

SEQ ID NO: 1333403 - RNA, 17 nt, Mycobacterium tuberculosis H37Rv
caaccuggggccaccag

SEQ ID NO: 1333404 - RNA, 14 nt, Mycobacterium tuberculosis H37Rv
caaccugcgcggcg

SEQ ID NO: 1333405 - RNA, 20 nt, Mycobacterium tuberculosis H37Rv
caaccugcgcaucaccacug

SEQ ID NO: 1333406 - RNA, 15 nt, Mycobacterium tuberculosis H37Rv
caaccugccgggcca

SEQ ID NO: 1333407 - RNA, 19 nt, Mycobacterium tuberculosis H37Rv
caaccugccgggccacggc

SEQ ID NO: 1333408 - RNA, 15 nt, Mycobacterium tuberculosis H37Rv
caaccgcugcugcug

SEQ ID NO: 1333409 - RNA, 11 nt, Mycobacterium tuberculosis H37Rv
caaccgcccgu

SEQ ID NO: 1333410 - RNA, 13 nt, Mycobacterium tuberculosis H37Rv
caaccgcaccgca

SEQ ID NO: 1333411 - RNA, 21 nt, Mycobacterium tuberculosis H37Rv
caaccgccaucgucgaagacc

SEQ ID NO: 1333412 - RNA, 17 nt, Mycobacterium tuberculosis H37Rv
caacccgcaccccggcc

SEQ ID NO: 1333413 - RNA, 24 nt, Mycobacterium tuberculosis H37Rv
caaccgagcgcccuccucgaugcc

SEQ ID NO: 1333414 - RNA, 13 nt, Mycobacterium tuberculosis H37Rv
caaccccgccggc

SEQ ID NO: 1333415 - RNA, 18 nt, Mycobacterium tuberculosis H37Rv
caaccccagcgacaugcc

SEQ ID NO: 1333416 - RNA, 19 nt, Mycobacterium tuberculosis H37Rv
caaccaccucgccaacauc

SEQ ID NO: 1333417 - RNA, 22 nt, Mycobacterium tuberculosis H37Rv
caaccacccacccgcaccaccg

SEQ ID NO: 1333418 - RNA, 20 nt, Mycobacterium tuberculosis H37Rv
caaccaccucgugggccacu

SEQ ID NO: 1333419 - RNA, 17 nt, Mycobacterium tuberculosis H37Rv
caacaggccaacuuggc

SEQ ID NO: 1333420 - RNA, 16 nt, Mycobacterium tuberculosis H37Rv
caacagcuuggagauc

SEQ ID NO: 1333421 - RNA, 19 nt, Mycobacterium tuberculosis H37Rv
caacaggaacaggcaaagu

SEQ ID NO: 1333422 - RNA, 14 nt, Mycobacterium tuberculosis H37Rv
caacagggccagga

SEQ ID NO: 1333423 - RNA, 22 nt, Mycobacterium tuberculosis H37Rv
caacaggccgucgaugaucugc

SEQ ID NO: 1333424 - RNA, 12 nt, Mycobacterium tuberculosis H37Rv
caacaggguggg

SEQ ID NO: 1333425 - RNA, 16 nt, Mycobacterium tuberculosis H37Rv
caacagguccaccggc

SEQ ID NO: 1333426 - RNA, 21 nt, Mycobacterium tuberculosis H37Rv
caaccaaagcgacgagcagca

SEQ ID NO: 1333427 - RNA, 17 nt, Mycobacterium tuberculosis H37Rv
caacugcagauaggacc

SEQ ID NO: 1333428 - RNA, 20 nt, Mycobacterium tuberculosis H37Rv
caacugcagcauggcccugg

SEQ ID NO: 1333429 - RNA, 14 nt, Mycobacterium tuberculosis H37Rv
caacugcaucacca

SEQ ID NO: 1333430 - RNA, 15 nt, Mycobacterium tuberculosis H37Rv
caacucgaucgccug

SEQ ID NO: 1333431 - RNA, 22 nt, Mycobacterium tuberculosis H37Rv
caacuaccuguugacacaacga

SEQ ID NO: 1333432 - RNA, 20 nt, Mycobacterium tuberculosis H37Rv
caacuccucagccgccuguc

SEQ ID NO: 1333433 - RNA, 13 nt, Mycobacterium tuberculosis H37Rv
caacuccucagcc

SEQ ID NO: 1333434 - RNA, 18 nt, Mycobacterium tuberculosis H37Rv
caacucccgaacuggcug

SEQ ID NO: 1333435 - RNA, 16 nt, Mycobacterium tuberculosis H37Rv
caagacgauucaccaa

SEQ ID NO: 1333436 - RNA, 21 nt, Mycobacterium tuberculosis H37Rv
caagaaagacgcuguccaggu

SEQ ID NO: 1333437 - RNA, 18 nt, Mycobacterium tuberculosis H37Rv
caagggcaucaaccaacu

SEQ ID NO: 1333438 - RNA, 23 nt, Mycobacterium tuberculosis H37Rv
caagggcgcgagcagacgcagaa

SEQ ID NO: 1333439 - RNA, 14 nt, Mycobacterium tuberculosis H37Rv
caagggugcccgga

SEQ ID NO: 1333440 - RNA, 16 nt, Mycobacterium tuberculosis H37Rv
caaggggcagcacguc

SEQ ID NO: 1333441 - RNA, 21 nt, Mycobacterium tuberculosis H37Rv
caagggugcuugucgccgcgu

SEQ ID NO: 1333442 - RNA, 13 nt, Mycobacterium tuberculosis H37Rv
caagguccagcga

SEQ ID NO: 1333443 - RNA, 21 nt, Mycobacterium tuberculosis H37Rv
caagguguugcggugggugaa

SEQ ID NO: 1333444 - RNA, 18 nt, Mycobacterium tuberculosis H37Rv
caagguguccagcaccug

SEQ ID NO: 1333445 - RNA, 19 nt, Mycobacterium tuberculosis H37Rv
caagguggccaccaaacgc

SEQ ID NO: 1333446 - RNA, 18 nt, Mycobacterium tuberculosis H37Rv
caagguuucgacaucacu

SEQ ID NO: 1333447 - RNA, 21 nt, Mycobacterium tuberculosis H37Rv
caaggccgucgacccagcaug

SEQ ID NO: 1333448 - RNA, 20 nt, Mycobacterium tuberculosis H37Rv
caaggcguugguagccaggg

SEQ ID NO: 1333449 - RNA, 16 nt, Mycobacterium tuberculosis H37Rv
caaggcggucaccacc

SEQ ID NO: 1333450 - RNA, 19 nt, Mycobacterium tuberculosis H37Rv
caaggcgcuaaaacgccag

SEQ ID NO: 1333451 - RNA, 22 nt, Mycobacterium tuberculosis H37Rv
caaggcucagcagcgccgcgcg

SEQ ID NO: 1333452 - RNA, 22 nt, Mycobacterium tuberculosis H37Rv
caaggcgauugucggggccgca

SEQ ID NO: 1333453 - RNA, 12 nt, Mycobacterium tuberculosis H37Rv
caagcagcagca

SEQ ID NO: 1333454 - RNA, 16 nt, Mycobacterium tuberculosis H37Rv
caagcagcccggguga

SEQ ID NO: 1333455 - RNA, 16 nt, Mycobacterium tuberculosis H37Rv
caagccagcacugcca

SEQ ID NO: 1333456 - RNA, 13 nt, Mycobacterium tuberculosis H37Rv
caagccagcacug

SEQ ID NO: 1333457 - RNA, 21 nt, Mycobacterium tuberculosis H37Rv
caagcccaaaaagaccgccgc

SEQ ID NO: 1333458 - RNA, 12 nt, Mycobacterium tuberculosis H37Rv
caagcccaaaaa

SEQ ID NO: 1333459 - RNA, 23 nt, Mycobacterium tuberculosis H37Rv
caagcggguuguggcacccggcu

SEQ ID NO: 1333460 - RNA, 21 nt, Mycobacterium tuberculosis H37Rv
caagcccgauucagcgcccca

SEQ ID NO: 1333461 - RNA, 19 nt, Mycobacterium tuberculosis H37Rv
caagcccucgggacggccg

SEQ ID NO: 1333462 - RNA, 15 nt, Mycobacterium tuberculosis H37Rv
caagagccgcagcca

SEQ ID NO: 1333463 - RNA, 15 nt, Mycobacterium tuberculosis H37Rv
caagcacagcccggc

SEQ ID NO: 1333464 - RNA, 14 nt, Mycobacterium tuberculosis H37Rv
caagcacagcgaac

SEQ ID NO: 1333465 - RNA, 16 nt, Mycobacterium tuberculosis H37Rv
caagcacagcccggcg

SEQ ID NO: 1333466 - RNA, 21 nt, Mycobacterium tuberculosis H37Rv
caagcacagcccggcgacgac

SEQ ID NO: 1333467 - RNA, 17 nt, Mycobacterium tuberculosis H37Rv
caagcaaccggugcgca

SEQ ID NO: 1333468 - RNA, 16 nt, Mycobacterium tuberculosis H37Rv
caauccggcugcggua

SEQ ID NO: 1333469 - RNA, 19 nt, Mycobacterium tuberculosis H37Rv
caauccggcgccagcagug

SEQ ID NO: 1333470 - RNA, 18 nt, Mycobacterium tuberculosis H37Rv
caauccggucagcgcggc

SEQ ID NO: 1333471 - RNA, 14 nt, Mycobacterium tuberculosis H37Rv
caaucaugucagcg

SEQ ID NO: 1333472 - RNA, 15 nt, Mycobacterium tuberculosis H37Rv
caaucauguucaucu

SEQ ID NO: 1333473 - RNA, 22 nt, Mycobacterium tuberculosis H37Rv
caauccgcaaaacgagcuucca

SEQ ID NO: 1333474 - RNA, 23 nt, Mycobacterium tuberculosis H37Rv
caauccgcccuugccgccuuggc

SEQ ID NO: 1333475 - RNA, 20 nt, Mycobacterium tuberculosis H37Rv
caaugcaaauagccuuguuc

SEQ ID NO: 1333476 - RNA, 20 nt, Mycobacterium tuberculosis H37Rv
caaugcacaccgggcaccag

SEQ ID NO: 1333477 - RNA, 18 nt, Mycobacterium tuberculosis H37Rv
caaugccaaucgcacugg

SEQ ID NO: 1333478 - RNA, 13 nt, Mycobacterium tuberculosis H37Rv
caaugcggcccgg

SEQ ID NO: 1333479 - RNA, 20 nt, Mycobacterium tuberculosis H37Rv
caaguugaccuucaccugga

SEQ ID NO: 1333480 - RNA, 23 nt, Mycobacterium tuberculosis H37Rv
caauagcugcgcgaagccaccag

SEQ ID NO: 1333481 - RNA, 13 nt, Mycobacterium tuberculosis H37Rv
caauaguguguuu

SEQ ID NO: 1333482 - RNA, 15 nt, Mycobacterium tuberculosis H37Rv
caauagaagcacguc

SEQ ID NO: 1333483 - RNA, 20 nt, Mycobacterium tuberculosis H37Rv
caauagcgacagcagcgcca

SEQ ID NO: 1333484 - RNA, 16 nt, Mycobacterium tuberculosis H37Rv
cacacugaccccgccg

SEQ ID NO: 1333485 - RNA, 22 nt, Mycobacterium tuberculosis H37Rv
cacacugccggacagccacgca

SEQ ID NO: 1333486 - RNA, 22 nt, Mycobacterium tuberculosis H37Rv
cacacucucggugaacgccgcc

SEQ ID NO: 1333487 - RNA, 15 nt, Mycobacterium tuberculosis H37Rv
cacacuccuagccaa

SEQ ID NO: 1333488 - RNA, 23 nt, Mycobacterium tuberculosis H37Rv
cacacucggccgggcucuaucag

SEQ ID NO: 1333489 - RNA, 15 nt, Mycobacterium tuberculosis H37Rv
cacaccuucggcugg

SEQ ID NO: 1333490 - RNA, 16 nt, Mycobacterium tuberculosis H37Rv
cacaccccaggcaccc

SEQ ID NO: 1333491 - RNA, 15 nt, Mycobacterium tuberculosis H37Rv
cacaccgacgccgcc

SEQ ID NO: 1333492 - RNA, 16 nt, Mycobacterium tuberculosis H37Rv
cacaccgagcgcaauc

SEQ ID NO: 1333493 - RNA, 14 nt, Mycobacterium tuberculosis H37Rv
cacaccgccagcgg

SEQ ID NO: 1333494 - RNA, 19 nt, Mycobacterium tuberculosis H37Rv
cacaccggauagguggucu

SEQ ID NO: 1333495 - RNA, 13 nt, Mycobacterium tuberculosis H37Rv
cacaccggcacug

SEQ ID NO: 1333496 - RNA, 19 nt, Mycobacterium tuberculosis H37Rv
cacaccggcacugcccagc

SEQ ID NO: 1333497 - RNA, 23 nt, Mycobacterium tuberculosis H37Rv
cacaccggcacugcccagcagac

SEQ ID NO: 1333498 - RNA, 15 nt, Mycobacterium tuberculosis H37Rv
cacaccuccucgacc

SEQ ID NO: 1333499 - RNA, 17 nt, Mycobacterium tuberculosis H37Rv
cacaccuccucgagcag

SEQ ID NO: 1333500 - RNA, 17 nt, Mycobacterium tuberculosis H37Rv
cacaacagcccguagca

SEQ ID NO: 1333501 - RNA, 14 nt, Mycobacterium tuberculosis H37Rv
cacaaacgccgccg

SEQ ID NO: 1333502 - RNA, 13 nt, Mycobacterium tuberculosis H37Rv
cacagaccgugac

SEQ ID NO: 1333503 - RNA, 18 nt, Mycobacterium tuberculosis H37Rv
cacagaccgaacagcacc

SEQ ID NO: 1333504 - RNA, 14 nt, Mycobacterium tuberculosis H37Rv
cacagccggcggcu

SEQ ID NO: 1333505 - RNA, 22 nt, Mycobacterium tuberculosis H37Rv
cacagcccggcgacgacccggg

SEQ ID NO: 1333506 - RNA, 14 nt, Mycobacterium tuberculosis H37Rv
cacagcgccgcguu

SEQ ID NO: 1333507 - RNA, 21 nt, Mycobacterium tuberculosis H37Rv
cacaggacuuguccaucacau

SEQ ID NO: 1333508 - RNA, 19 nt, Mycobacterium tuberculosis H37Rv
cacaggacaauggacacca

SEQ ID NO: 1333509 - RNA, 16 nt, Mycobacterium tuberculosis H37Rv
cacaggauuggccgcu

SEQ ID NO: 1333510 - RNA, 12 nt, Mycobacterium tuberculosis H37Rv
cacagcgcagcc

SEQ ID NO: 1333511 - RNA, 13 nt, Mycobacterium tuberculosis H37Rv
cacagcgcagccu

SEQ ID NO: 1333512 - RNA, 16 nt, Mycobacterium tuberculosis H37Rv
cacaggcggcgcugca

SEQ ID NO: 1333513 - RNA, 13 nt, Mycobacterium tuberculosis H37Rv
cacaggcugaaga

SEQ ID NO: 1333514 - RNA, 15 nt, Mycobacterium tuberculosis H37Rv
cacaggccgccuggg

SEQ ID NO: 1333515 - RNA, 14 nt, Mycobacterium tuberculosis H37Rv
cacaggggcagcgc

SEQ ID NO: 1333516 - RNA, 19 nt, Mycobacterium tuberculosis H37Rv
cacaggggcagcgcggcca

SEQ ID NO: 1333517 - RNA, 22 nt, Mycobacterium tuberculosis H37Rv
cacaggggcagcgcggccaccc

SEQ ID NO: 1333518 - RNA, 17 nt, Mycobacterium tuberculosis H37Rv
cacagugcggccccgac

SEQ ID NO: 1333519 - RNA, 15 nt, Mycobacterium tuberculosis H37Rv
cacagguccugcgcc

SEQ ID NO: 1333520 - RNA, 22 nt, Mycobacterium tuberculosis H37Rv
cacagguuugcgccgcgcagcg

SEQ ID NO: 1333521 - RNA, 18 nt, Mycobacterium tuberculosis H37Rv
caauugugcggccccguc

SEQ ID NO: 1333522 - RNA, 18 nt, Mycobacterium tuberculosis H37Rv
cacaaacauacgccaccc

SEQ ID NO: 1333523 - RNA, 17 nt, Mycobacterium tuberculosis H37Rv
cacaaaauacuccgcga

SEQ ID NO: 1333524 - RNA, 19 nt, Mycobacterium tuberculosis H37Rv
caauucacgcaccacaaac

SEQ ID NO: 1333525 - RNA, 18 nt, Mycobacterium tuberculosis H37Rv
caauugaacgcaccaacg

SEQ ID NO: 1333526 - RNA, 20 nt, Mycobacterium tuberculosis H37Rv
caaugcgucgaugcgcugcu

SEQ ID NO: 1333527 - RNA, 20 nt, Mycobacterium tuberculosis H37Rv
caaugcguugacgucgagca

SEQ ID NO: 1333528 - RNA, 23 nt, Mycobacterium tuberculosis H37Rv
caaugcguugacgucgagcagcg

SEQ ID NO: 1333529 - RNA, 21 nt, Mycobacterium tuberculosis H37Rv
cacauacagcaggccgcgcuc

SEQ ID NO: 1333530 - RNA, 15 nt, Mycobacterium tuberculosis H37Rv
cacaugccacagcgg

SEQ ID NO: 1333531 - RNA, 15 nt, Mycobacterium tuberculosis H37Rv
cacaugaucgagcag

SEQ ID NO: 1333532 - RNA, 15 nt, Mycobacterium tuberculosis H37Rv
cacauugguguccac

SEQ ID NO: 1333533 - RNA, 19 nt, Mycobacterium tuberculosis H37Rv
cacaugcucgacgcccgcc

SEQ ID NO: 1333534 - RNA, 17 nt, Mycobacterium tuberculosis H37Rv
cacaugcaucugaucag

SEQ ID NO: 1333535 - RNA, 17 nt, Mycobacterium tuberculosis H37Rv
cacaugcucagucgcuc

SEQ ID NO: 1333536 - RNA, 16 nt, Mycobacterium tuberculosis H37Rv
caccaagacgccaccc

SEQ ID NO: 1333537 - RNA, 22 nt, Mycobacterium tuberculosis H37Rv
caccaagaaguugacaccaggg

SEQ ID NO: 1333538 - RNA, 16 nt, Mycobacterium tuberculosis H37Rv
caccaagcucggccag

SEQ ID NO: 1333539 - RNA, 23 nt, Mycobacterium tuberculosis H37Rv
caccaaggucuucaggccgcgca

SEQ ID NO: 1333540 - RNA, 20 nt, Mycobacterium tuberculosis H37Rv
caccaagcucggccagcacg

SEQ ID NO: 1333541 - RNA, 22 nt, Mycobacterium tuberculosis H37Rv
caccaagcucggccagcacgcc

SEQ ID NO: 1333542 - RNA, 20 nt, Mycobacterium tuberculosis H37Rv
caccaauaccgcacccgcuc

SEQ ID NO: 1333543 - RNA, 14 nt, Mycobacterium tuberculosis H37Rv
caccaaugcuccug

SEQ ID NO: 1333544 - RNA, 22 nt, Mycobacterium tuberculosis H37Rv
caccacccgggccucggcgccg

SEQ ID NO: 1333545 - RNA, 14 nt, Mycobacterium tuberculosis H37Rv
caccacccaacagc

SEQ ID NO: 1333546 - RNA, 15 nt, Mycobacterium tuberculosis H37Rv
caccaccccagcggc

SEQ ID NO: 1333547 - RNA, 13 nt, Mycobacterium tuberculosis H37Rv
caccaccccagcg

SEQ ID NO: 1333548 - RNA, 17 nt, Mycobacterium tuberculosis H37Rv
caccaccgacagcaccc

SEQ ID NO: 1333549 - RNA, 21 nt, Mycobacterium tuberculosis H37Rv
caccaccgacagcacccggcc

SEQ ID NO: 1333550 - RNA, 21 nt, Mycobacterium tuberculosis H37Rv
caccacccuguuguugccccg

SEQ ID NO: 1333551 - RNA, 13 nt, Mycobacterium tuberculosis H37Rv
caccaccgccccg

SEQ ID NO: 1333552 - RNA, 21 nt, Mycobacterium tuberculosis H37Rv
caccacggugacuaccgugca

SEQ ID NO: 1333553 - RNA, 20 nt, Mycobacterium tuberculosis H37Rv
caccacggucaagccggcgc

SEQ ID NO: 1333554 - RNA, 23 nt, Mycobacterium tuberculosis H37Rv
caccacgguggccgcugccagcc

SEQ ID NO: 1333555 - RNA, 22 nt, Mycobacterium tuberculosis H37Rv
caccaccucggugaccaggccg

SEQ ID NO: 1333556 - RNA, 19 nt, Mycobacterium tuberculosis H37Rv
caccacggcgcgcgcgccg

SEQ ID NO: 1333557 - RNA, 19 nt, Mycobacterium tuberculosis H37Rv
caccacggcgcgcucggag

SEQ ID NO: 1333558 - RNA, 14 nt, Mycobacterium tuberculosis H37Rv
caccacggcggcca

SEQ ID NO: 1333559 - RNA, 20 nt, Mycobacterium tuberculosis H37Rv
caccacggcgcgcagcgacg

SEQ ID NO: 1333560 - RNA, 14 nt, Mycobacterium tuberculosis H37Rv
caccacggcgcgcg

SEQ ID NO: 1333561 - RNA, 15 nt, Mycobacterium tuberculosis H37Rv
caccaccggaaccac

SEQ ID NO: 1333562 - RNA, 14 nt, Mycobacterium tuberculosis H37Rv
caccaccggaacca

SEQ ID NO: 1333563 - RNA, 21 nt, Mycobacterium tuberculosis H37Rv
caccaccggaucgcucccguc

SEQ ID NO: 1333564 - RNA, 19 nt, Mycobacterium tuberculosis H37Rv
caccaccgcggcggcggcc

SEQ ID NO: 1333565 - RNA, 16 nt, Mycobacterium tuberculosis H37Rv
caccaccgccgccgga

SEQ ID NO: 1333566 - RNA, 16 nt, Mycobacterium tuberculosis H37Rv
caccaccgccgccggc

SEQ ID NO: 1333567 - RNA, 17 nt, Mycobacterium tuberculosis H37Rv
caccaccgccgccggca

SEQ ID NO: 1333568 - RNA, 12 nt, Mycobacterium tuberculosis H37Rv
caccaccgccga

SEQ ID NO: 1333569 - RNA, 14 nt, Mycobacterium tuberculosis H37Rv
caccaccgcgaccu

SEQ ID NO: 1333570 - RNA, 12 nt, Mycobacterium tuberculosis H37Rv
caccaccgccgg

SEQ ID NO: 1333571 - RNA, 20 nt, Mycobacterium tuberculosis H37Rv
caccaccgucucgccgcgca

SEQ ID NO: 1333572 - RNA, 12 nt, Mycobacterium tuberculosis H37Rv
caccaccggccc

SEQ ID NO: 1333573 - RNA, 13 nt, Mycobacterium tuberculosis H37Rv
caccaccuccgcg

SEQ ID NO: 1333574 - RNA, 23 nt, Mycobacterium tuberculosis H37Rv
caccaccggccccaccgacagcc

SEQ ID NO: 1333575 - RNA, 20 nt, Mycobacterium tuberculosis H37Rv
caccaccgucgagccggaca

SEQ ID NO: 1333576 - RNA, 14 nt, Mycobacterium tuberculosis H37Rv
caccaccguggcgc

SEQ ID NO: 1333577 - RNA, 15 nt, Mycobacterium tuberculosis H37Rv
caccaccggccccac

SEQ ID NO: 1333578 - RNA, 18 nt, Mycobacterium tuberculosis H37Rv
caccaccggcacccgcug

SEQ ID NO: 1333579 - RNA, 14 nt, Mycobacterium tuberculosis H37Rv
caccaccggcaccc

SEQ ID NO: 1333580 - RNA, 14 nt, Mycobacterium tuberculosis H37Rv
caccaccggcuccc

SEQ ID NO: 1333581 - RNA, 14 nt, Mycobacterium tuberculosis H37Rv
caccaccggcgccg

SEQ ID NO: 1333582 - RNA, 16 nt, Mycobacterium tuberculosis H37Rv
caccaucuccgccguc

SEQ ID NO: 1333583 - RNA, 16 nt, Mycobacterium tuberculosis H37Rv
caccaugaucacaccg

SEQ ID NO: 1333584 - RNA, 18 nt, Mycobacterium tuberculosis H37Rv
caccaugggucuggcagg

SEQ ID NO: 1333585 - RNA, 21 nt, Mycobacterium tuberculosis H37Rv
caccauguacaggcuguccag

SEQ ID NO: 1333586 - RNA, 21 nt, Mycobacterium tuberculosis H37Rv
caccauguauuucucccagcc

SEQ ID NO: 1333587 - RNA, 15 nt, Mycobacterium tuberculosis H37Rv
caccauguauuucuc

SEQ ID NO: 1333588 - RNA, 16 nt, Mycobacterium tuberculosis H37Rv
caccauggcgccgcgc

SEQ ID NO: 1333589 - RNA, 14 nt, Mycobacterium tuberculosis H37Rv
caccaucaucaccu

SEQ ID NO: 1333590 - RNA, 23 nt, Mycobacterium tuberculosis H37Rv
caccaucaacauugugcucgccg

SEQ ID NO: 1333591 - RNA, 14 nt, Mycobacterium tuberculosis H37Rv
caccauccccggca

SEQ ID NO: 1333592 - RNA, 20 nt, Mycobacterium tuberculosis H37Rv
caccaucacgguggccgcac

SEQ ID NO: 1333593 - RNA, 21 nt, Mycobacterium tuberculosis H37Rv
caccaucgguaucgagggcag

SEQ ID NO: 1333594 - RNA, 22 nt, Mycobacterium tuberculosis H37Rv
caccaucgguaucgagggcagc

SEQ ID NO: 1333595 - RNA, 18 nt, Mycobacterium tuberculosis H37Rv
caccaucgccucggcgcu

SEQ ID NO: 1333596 - RNA, 23 nt, Mycobacterium tuberculosis H37Rv
caccaucgccgccguugccgccg

SEQ ID NO: 1333597 - RNA, 13 nt, Mycobacterium tuberculosis H37Rv
caccaucgccgcc

SEQ ID NO: 1333598 - RNA, 19 nt, Mycobacterium tuberculosis H37Rv
caccaucgccgccgcgcgu

SEQ ID NO: 1333599 - RNA, 20 nt, Mycobacterium tuberculosis H37Rv
caccaggucggccuucagcg

SEQ ID NO: 1333600 - RNA, 22 nt, Mycobacterium tuberculosis H37Rv
caccaguuugugccgccgcggc

SEQ ID NO: 1333601 - RNA, 24 nt, Mycobacterium tuberculosis H37Rv
caccaucaaggacucggacgcgcc

SEQ ID NO: 1333602 - RNA, 14 nt, Mycobacterium tuberculosis H37Rv
caccaucaccucgc

SEQ ID NO: 1333603 - RNA, 19 nt, Mycobacterium tuberculosis H37Rv
caccaggggaccgcggcgc

SEQ ID NO: 1333604 - RNA, 17 nt, Mycobacterium tuberculosis H37Rv
caccagggugccgggca

SEQ ID NO: 1333605 - RNA, 16 nt, Mycobacterium tuberculosis H37Rv
caccaggucauugccg

SEQ ID NO: 1333606 - RNA, 14 nt, Mycobacterium tuberculosis H37Rv
caccaggugucccc

SEQ ID NO: 1333607 - RNA, 14 nt, Mycobacterium tuberculosis H37Rv
caccagggcgcgga

SEQ ID NO: 1333608 - RNA, 15 nt, Mycobacterium tuberculosis H37Rv
caccagggccaccgc

SEQ ID NO: 1333609 - RNA, 22 nt, Mycobacterium tuberculosis H37Rv
caccaggccgagccgcccgccc

SEQ ID NO: 1333610 - RNA, 23 nt, Mycobacterium tuberculosis H37Rv
caccagcgcaucggccagcagcg

SEQ ID NO: 1333611 - RNA, 18 nt, Mycobacterium tuberculosis H37Rv
caccagcugucgggcagc

SEQ ID NO: 1333612 - RNA, 19 nt, Mycobacterium tuberculosis H37Rv
caccagcgcagcauugacc

SEQ ID NO: 1333613 - RNA, 15 nt, Mycobacterium tuberculosis H37Rv
caccaggcccgguuc

SEQ ID NO: 1333614 - RNA, 20 nt, Mycobacterium tuberculosis H37Rv
caccagaauccugcuuucca

SEQ ID NO: 1333615 - RNA, 22 nt, Mycobacterium tuberculosis H37Rv
caccagaaaacauugcggcccu

SEQ ID NO: 1333616 - RNA, 21 nt, Mycobacterium tuberculosis H37Rv
caccagaccaggaagcaggug

SEQ ID NO: 1333617 - RNA, 21 nt, Mycobacterium tuberculosis H37Rv
caccagccgguuggcugccgg

SEQ ID NO: 1333618 - RNA, 18 nt, Mycobacterium tuberculosis H37Rv
caccagccgguagccggg

SEQ ID NO: 1333619 - RNA, 20 nt, Mycobacterium tuberculosis H37Rv
caccagccgguagccgggca

SEQ ID NO: 1333620 - RNA, 15 nt, Mycobacterium tuberculosis H37Rv
caccagcccggcggc

SEQ ID NO: 1333621 - RNA, 18 nt, Mycobacterium tuberculosis H37Rv
caccagcgaggccagcgg

SEQ ID NO: 1333622 - RNA, 13 nt, Mycobacterium tuberculosis H37Rv
cacccucgggccc

SEQ ID NO: 1333623 - RNA, 19 nt, Mycobacterium tuberculosis H37Rv
cacccucggguccaaccac

SEQ ID NO: 1333624 - RNA, 15 nt, Mycobacterium tuberculosis H37Rv
cacccugaccaacau

SEQ ID NO: 1333625 - RNA, 20 nt, Mycobacterium tuberculosis H37Rv
cacccguucgugagcggcca

SEQ ID NO: 1333626 - RNA, 17 nt, Mycobacterium tuberculosis H37Rv
cacccgcucggccguca

SEQ ID NO: 1333627 - RNA, 21 nt, Mycobacterium tuberculosis H37Rv
cacccgcucgcccgccgccac

SEQ ID NO: 1333628 - RNA, 17 nt, Mycobacterium tuberculosis H37Rv
cacccgcuuugcacugu

SEQ ID NO: 1333629 - RNA, 18 nt, Mycobacterium tuberculosis H37Rv
cacccggaaagaucucgg

SEQ ID NO: 1333630 - RNA, 19 nt, Mycobacterium tuberculosis H37Rv
cacccgcaccaccggcccc

SEQ ID NO: 1333631 - RNA, 18 nt, Mycobacterium tuberculosis H37Rv
cacccgcaaugaccgcgg

SEQ ID NO: 1333632 - RNA, 15 nt, Mycobacterium tuberculosis H37Rv
cacccgcacgaagcc

SEQ ID NO: 1333633 - RNA, 14 nt, Mycobacterium tuberculosis H37Rv
cacccgcggcgccg

SEQ ID NO: 1333634 - RNA, 15 nt, Mycobacterium tuberculosis H37Rv
cacccgcggcgccgu

SEQ ID NO: 1333635 - RNA, 23 nt, Mycobacterium tuberculosis H37Rv
cacccgcggcgccguugccgccg

SEQ ID NO: 1333636 - RNA, 13 nt, Mycobacterium tuberculosis H37Rv
cacccgcgcucca

SEQ ID NO: 1333637 - RNA, 20 nt, Mycobacterium tuberculosis H37Rv
cacccaauggagccgcgacc

SEQ ID NO: 1333638 - RNA, 14 nt, Mycobacterium tuberculosis H37Rv
cacccaccagugca

SEQ ID NO: 1333639 - RNA, 17 nt, Mycobacterium tuberculosis H37Rv
cacccaccacaccaagg

SEQ ID NO: 1333640 - RNA, 14 nt, Mycobacterium tuberculosis H37Rv
cacccacccgcacc

SEQ ID NO: 1333641 - RNA, 12 nt, Mycobacterium tuberculosis H37Rv
cacccaccaaca

SEQ ID NO: 1333642 - RNA, 18 nt, Mycobacterium tuberculosis H37Rv
cacccaccaacacccggg

SEQ ID NO: 1333643 - RNA, 14 nt, Mycobacterium tuberculosis H37Rv
cacccgagggccug

SEQ ID NO: 1333644 - RNA, 15 nt, Mycobacterium tuberculosis H37Rv
cacccgaugugcccg

SEQ ID NO: 1333645 - RNA, 15 nt, Mycobacterium tuberculosis H37Rv
caccccuucgccagc

SEQ ID NO: 1333646 - RNA, 22 nt, Mycobacterium tuberculosis H37Rv
cacccaacgcggugggcacagc

SEQ ID NO: 1333647 - RNA, 23 nt, Mycobacterium tuberculosis H37Rv
cacccaacggugggugggcgccg

SEQ ID NO: 1333648 - RNA, 21 nt, Mycobacterium tuberculosis H37Rv
cacccaacgcaauaagggaga

SEQ ID NO: 1333649 - RNA, 20 nt, Mycobacterium tuberculosis H37Rv
caccaugucggccacccgga

SEQ ID NO: 1333650 - RNA, 13 nt, Mycobacterium tuberculosis H37Rv
caccauuggccaa

SEQ ID NO: 1333651 - RNA, 21 nt, Mycobacterium tuberculosis H37Rv
caccauuggccuaggacaccg

SEQ ID NO: 1333652 - RNA, 20 nt, Mycobacterium tuberculosis H37Rv
caccgaaugcacgacggugu

SEQ ID NO: 1333653 - RNA, 16 nt, Mycobacterium tuberculosis H37Rv
caccgaaacgccgacc

SEQ ID NO: 1333654 - RNA, 15 nt, Mycobacterium tuberculosis H37Rv
caccgaacgcggcca

SEQ ID NO: 1333655 - RNA, 22 nt, Mycobacterium tuberculosis H37Rv
caccgacaagaauggccgccuu

SEQ ID NO: 1333656 - RNA, 21 nt, Mycobacterium tuberculosis H37Rv
caccgacaagaauggccgccu

SEQ ID NO: 1333657 - RNA, 21 nt, Mycobacterium tuberculosis H37Rv
caccgacaauucaacacacgg

SEQ ID NO: 1333658 - RNA, 14 nt, Mycobacterium tuberculosis H37Rv
caccgacaccgugc

SEQ ID NO: 1333659 - RNA, 21 nt, Mycobacterium tuberculosis H37Rv
caccgaacuugcggaccuggc

SEQ ID NO: 1333660 - RNA, 13 nt, Mycobacterium tuberculosis H37Rv
caccgacaccggc

SEQ ID NO: 1333661 - RNA, 19 nt, Mycobacterium tuberculosis H37Rv
caccgaucgacugcagccc

SEQ ID NO: 1333662 - RNA, 15 nt, Mycobacterium tuberculosis H37Rv
caccgaucccgcggc

SEQ ID NO: 1333663 - RNA, 15 nt, Mycobacterium tuberculosis H37Rv
caccgaugcacucca

SEQ ID NO: 1333664 - RNA, 17 nt, Mycobacterium tuberculosis H37Rv
caccgauggcgcgcuca

SEQ ID NO: 1333665 - RNA, 23 nt, Mycobacterium tuberculosis H37Rv
caccgaugugaccgaacaacagc

SEQ ID NO: 1333666 - RNA, 19 nt, Mycobacterium tuberculosis H37Rv
caccgcaacgcuucggcag

SEQ ID NO: 1333667 - RNA, 15 nt, Mycobacterium tuberculosis H37Rv
caccgcaagaaucag

SEQ ID NO: 1333668 - RNA, 22 nt, Mycobacterium tuberculosis H37Rv
caccgccagcaugacaccggcc

SEQ ID NO: 1333669 - RNA, 14 nt, Mycobacterium tuberculosis H37Rv
caccgccagccacc

SEQ ID NO: 1333670 - RNA, 13 nt, Mycobacterium tuberculosis H37Rv
caccgccagcaga

SEQ ID NO: 1333671 - RNA, 21 nt, Mycobacterium tuberculosis H37Rv
caccgccagcgucgacacacc

SEQ ID NO: 1333672 - RNA, 15 nt, Mycobacterium tuberculosis H37Rv
caccgccccgcgccc

SEQ ID NO: 1333673 - RNA, 15 nt, Mycobacterium tuberculosis H37Rv
caccgccccgccaac

SEQ ID NO: 1333674 - RNA, 19 nt, Mycobacterium tuberculosis H37Rv
caccgccccgccaaccacu

SEQ ID NO: 1333675 - RNA, 16 nt, Mycobacterium tuberculosis H37Rv
caccgccgccggaggu

SEQ ID NO: 1333676 - RNA, 15 nt, Mycobacterium tuberculosis H37Rv
caccgccgccggcac

SEQ ID NO: 1333677 - RNA, 18 nt, Mycobacterium tuberculosis H37Rv
caccgccgccggcaccgc

SEQ ID NO: 1333678 - RNA, 17 nt, Mycobacterium tuberculosis H37Rv
caccgccgccgccaccg

SEQ ID NO: 1333679 - RNA, 17 nt, Mycobacterium tuberculosis H37Rv
caccgccgcccccgccg

SEQ ID NO: 1333680 - RNA, 20 nt, Mycobacterium tuberculosis H37Rv
caccgccgauacaacgcggc

SEQ ID NO: 1333681 - RNA, 16 nt, Mycobacterium tuberculosis H37Rv
caccgccgacaccccc

SEQ ID NO: 1333682 - RNA, 22 nt, Mycobacterium tuberculosis H37Rv
caccgccgacaggccggccacc

SEQ ID NO: 1333683 - RNA, 14 nt, Mycobacterium tuberculosis H37Rv
caccgccgacgccc

SEQ ID NO: 1333684 - RNA, 17 nt, Mycobacterium tuberculosis H37Rv
caccgccgaccuaguca

SEQ ID NO: 1333685 - RNA, 16 nt, Mycobacterium tuberculosis H37Rv
caccgccggggugugc

SEQ ID NO: 1333686 - RNA, 19 nt, Mycobacterium tuberculosis H37Rv
caccgccguugccgccggc

SEQ ID NO: 1333687 - RNA, 20 nt, Mycobacterium tuberculosis H37Rv
caccgcgccagccuccacca

SEQ ID NO: 1333688 - RNA, 13 nt, Mycobacterium tuberculosis H37Rv
caccgcgccgagc

SEQ ID NO: 1333689 - RNA, 19 nt, Mycobacterium tuberculosis H37Rv
caccgccgccugcccggcc

SEQ ID NO: 1333690 - RNA, 20 nt, Mycobacterium tuberculosis H37Rv
caccgccgccugcccggccc

SEQ ID NO: 1333691 - RNA, 21 nt, Mycobacterium tuberculosis H37Rv
caccgccgccugcccggcccg

SEQ ID NO: 1333692 - RNA, 13 nt, Mycobacterium tuberculosis H37Rv
caccgccgcgacc

SEQ ID NO: 1333693 - RNA, 14 nt, Mycobacterium tuberculosis H37Rv
caccgccgcggccg

SEQ ID NO: 1333694 - RNA, 15 nt, Mycobacterium tuberculosis H37Rv
caccgccgcggccgc

SEQ ID NO: 1333695 - RNA, 12 nt, Mycobacterium tuberculosis H37Rv
caccgccgcggc

SEQ ID NO: 1333696 - RNA, 18 nt, Mycobacterium tuberculosis H37Rv
caccgccgcuaccgcccg

SEQ ID NO: 1333697 - RNA, 19 nt, Mycobacterium tuberculosis H37Rv
caccgccgcuaccgcccgc

SEQ ID NO: 1333698 - RNA, 23 nt, Mycobacterium tuberculosis H37Rv
caccgccgcuaccgcccgcgcca

SEQ ID NO: 1333699 - RNA, 19 nt, Mycobacterium tuberculosis H37Rv
caccgccggcgccgccguc

SEQ ID NO: 1333700 - RNA, 19 nt, Mycobacterium tuberculosis H37Rv
caccgccgcggccgccguc

SEQ ID NO: 1333701 - RNA, 21 nt, Mycobacterium tuberculosis H37Rv
caccgccgggaugccggcccc

SEQ ID NO: 1333702 - RNA, 16 nt, Mycobacterium tuberculosis H37Rv
caccucgcccucccgg

SEQ ID NO: 1333703 - RNA, 20 nt, Mycobacterium tuberculosis H37Rv
caccucgcacgacaccucga

SEQ ID NO: 1333704 - RNA, 22 nt, Mycobacterium tuberculosis H37Rv
caccucgccaacaucccaacac

SEQ ID NO: 1333705 - RNA, 16 nt, Mycobacterium tuberculosis H37Rv
caccucgcacgacacc

SEQ ID NO: 1333706 - RNA, 16 nt, Mycobacterium tuberculosis H37Rv
caccucgggcgcccgc

SEQ ID NO: 1333707 - RNA, 18 nt, Mycobacterium tuberculosis H37Rv
caccucgaucgcgccguc

SEQ ID NO: 1333708 - RNA, 16 nt, Mycobacterium tuberculosis H37Rv
caccucgaugccgccc

SEQ ID NO: 1333709 - RNA, 17 nt, Mycobacterium tuberculosis H37Rv
caccucgaugccgcccc

SEQ ID NO: 1333710 - RNA, 19 nt, Mycobacterium tuberculosis H37Rv
caccucgaugccgccccgc

SEQ ID NO: 1333711 - RNA, 20 nt, Mycobacterium tuberculosis H37Rv
caccucgaugccgccccgca

SEQ ID NO: 1333712 - RNA, 16 nt, Mycobacterium tuberculosis H37Rv
caccucgaaggcacug

SEQ ID NO: 1333713 - RNA, 17 nt, Mycobacterium tuberculosis H37Rv
caccguggaucggcagc

SEQ ID NO: 1333714 - RNA, 14 nt, Mycobacterium tuberculosis H37Rv
caccuccggcaccg

SEQ ID NO: 1333715 - RNA, 20 nt, Mycobacterium tuberculosis H37Rv
caccuccucgagcaggaugc

SEQ ID NO: 1333716 - RNA, 16 nt, Mycobacterium tuberculosis H37Rv
caccuccucgagcagg

SEQ ID NO: 1333717 - RNA, 15 nt, Mycobacterium tuberculosis H37Rv
caccguuagccaggu

SEQ ID NO: 1333718 - RNA, 19 nt, Mycobacterium tuberculosis H37Rv
caccuccgccggcaccucc

SEQ ID NO: 1333719 - RNA, 16 nt, Mycobacterium tuberculosis H37Rv
caccguuaccgccguc

SEQ ID NO: 1333720 - RNA, 20 nt, Mycobacterium tuberculosis H37Rv
caccguagagcaugccgccc

SEQ ID NO: 1333721 - RNA, 15 nt, Mycobacterium tuberculosis H37Rv
caccgugaccgccgc

SEQ ID NO: 1333722 - RNA, 17 nt, Mycobacterium tuberculosis H37Rv
caccgugaccgccgcgc

SEQ ID NO: 1333723 - RNA, 21 nt, Mycobacterium tuberculosis H37Rv
caccgugccgacgccccgauc

SEQ ID NO: 1333724 - RNA, 18 nt, Mycobacterium tuberculosis H37Rv
caccugacgugcggcgcg

SEQ ID NO: 1333725 - RNA, 22 nt, Mycobacterium tuberculosis H37Rv
caccugacgugcggcgcggcga

SEQ ID NO: 1333726 - RNA, 15 nt, Mycobacterium tuberculosis H37Rv
caccugcaugugugu

SEQ ID NO: 1333727 - RNA, 13 nt, Mycobacterium tuberculosis H37Rv
caccugcaccgca

SEQ ID NO: 1333728 - RNA, 17 nt, Mycobacterium tuberculosis H37Rv
caccugcacgugacccu

SEQ ID NO: 1333729 - RNA, 19 nt, Mycobacterium tuberculosis H37Rv
caccugcacgugacccugg

SEQ ID NO: 1333730 - RNA, 20 nt, Mycobacterium tuberculosis H37Rv
caccugcacgugacccuggg

SEQ ID NO: 1333731 - RNA, 18 nt, Mycobacterium tuberculosis H37Rv
caccucggugaccaggcc

SEQ ID NO: 1333732 - RNA, 22 nt, Mycobacterium tuberculosis H37Rv
caccucggcgaagucacgcacc

SEQ ID NO: 1333733 - RNA, 23 nt, Mycobacterium tuberculosis H37Rv
caccucgucgacaaaccacagac

SEQ ID NO: 1333734 - RNA, 21 nt, Mycobacterium tuberculosis H37Rv
caccucgucgaucgccgcgcc

SEQ ID NO: 1333735 - RNA, 23 nt, Mycobacterium tuberculosis H37Rv
caccucuucgaucuguuccugca

SEQ ID NO: 1333736 - RNA, 21 nt, Mycobacterium tuberculosis H37Rv
caccgguuuggagcucaucga

SEQ ID NO: 1333737 - RNA, 23 nt, Mycobacterium tuberculosis H37Rv
caccgguucggugagcgggagga

SEQ ID NO: 1333738 - RNA, 21 nt, Mycobacterium tuberculosis H37Rv
caccgguucggggggcagguc

SEQ ID NO: 1333739 - RNA, 15 nt, Mycobacterium tuberculosis H37Rv
caccggugccgccgu

SEQ ID NO: 1333740 - RNA, 21 nt, Mycobacterium tuberculosis H37Rv
caccgguacgcaaccaaccgu

SEQ ID NO: 1333741 - RNA, 12 nt, Mycobacterium tuberculosis H37Rv
caccgguaccgc

SEQ ID NO: 1333742 - RNA, 19 nt, Mycobacterium tuberculosis H37Rv
caccggguugagccgccgc

SEQ ID NO: 1333743 - RNA, 23 nt, Mycobacterium tuberculosis H37Rv
caccggugauggugaccagcagg

SEQ ID NO: 1333744 - RNA, 17 nt, Mycobacterium tuberculosis H37Rv
caccggucaccgcgcag

SEQ ID NO: 1333745 - RNA, 17 nt, Mycobacterium tuberculosis H37Rv
caccggucggcagcuuc

SEQ ID NO: 1333746 - RNA, 16 nt, Mycobacterium tuberculosis H37Rv
caccggugcccaccac

SEQ ID NO: 1333747 - RNA, 14 nt, Mycobacterium tuberculosis H37Rv
caccggugccgccc

SEQ ID NO: 1333748 - RNA, 14 nt, Mycobacterium tuberculosis H37Rv
caccgggcgcugcu

SEQ ID NO: 1333749 - RNA, 15 nt, Mycobacterium tuberculosis H37Rv
caccgggguugcccg

SEQ ID NO: 1333750 - RNA, 23 nt, Mycobacterium tuberculosis H37Rv
caccgggcccgccguccccgccg

SEQ ID NO: 1333751 - RNA, 17 nt, Mycobacterium tuberculosis H37Rv
caccgggcccuugcuga

SEQ ID NO: 1333752 - RNA, 21 nt, Mycobacterium tuberculosis H37Rv
caccgggccgacagcacgcca

SEQ ID NO: 1333753 - RNA, 17 nt, Mycobacterium tuberculosis H37Rv
caccggcgcgaccgcgg

SEQ ID NO: 1333754 - RNA, 12 nt, Mycobacterium tuberculosis H37Rv
caccggccgccg

SEQ ID NO: 1333755 - RNA, 23 nt, Mycobacterium tuberculosis H37Rv
caccggccgugccgccgacacca

SEQ ID NO: 1333756 - RNA, 22 nt, Mycobacterium tuberculosis H37Rv
caccggccgugccgccgacacc

SEQ ID NO: 1333757 - RNA, 14 nt, Mycobacterium tuberculosis H37Rv
caccggcgccgccc

SEQ ID NO: 1333758 - RNA, 15 nt, Mycobacterium tuberculosis H37Rv
caccggcgccgcccg

SEQ ID NO: 1333759 - RNA, 15 nt, Mycobacterium tuberculosis H37Rv
caccggcgccgccgu

SEQ ID NO: 1333760 - RNA, 12 nt, Mycobacterium tuberculosis H37Rv
caccggcgccca

SEQ ID NO: 1333761 - RNA, 21 nt, Mycobacterium tuberculosis H37Rv
caccggcgcccagcgccucga

SEQ ID NO: 1333762 - RNA, 13 nt, Mycobacterium tuberculosis H37Rv
caccggcgccgcc

SEQ ID NO: 1333763 - RNA, 12 nt, Mycobacterium tuberculosis H37Rv
caccggccagcg

SEQ ID NO: 1333764 - RNA, 17 nt, Mycobacterium tuberculosis H37Rv
caccggccacucgggac

SEQ ID NO: 1333765 - RNA, 16 nt, Mycobacterium tuberculosis H37Rv
caccggcccucgccag

SEQ ID NO: 1333766 - RNA, 18 nt, Mycobacterium tuberculosis H37Rv
caccggcccucgccagag

SEQ ID NO: 1333767 - RNA, 15 nt, Mycobacterium tuberculosis H37Rv
caccggcacccgcac

SEQ ID NO: 1333768 - RNA, 16 nt, Mycobacterium tuberculosis H37Rv
caccggcacccccguc

SEQ ID NO: 1333769 - RNA, 13 nt, Mycobacterium tuberculosis H37Rv
caccggcacccgc

SEQ ID NO: 1333770 - RNA, 19 nt, Mycobacterium tuberculosis H37Rv
caccggcaccgcugccgcu

SEQ ID NO: 1333771 - RNA, 17 nt, Mycobacterium tuberculosis H37Rv
caccggaucgcucccgu

SEQ ID NO: 1333772 - RNA, 15 nt, Mycobacterium tuberculosis H37Rv
caccggauagguggu

SEQ ID NO: 1333773 - RNA, 14 nt, Mycobacterium tuberculosis H37Rv
caccggauccacgg

SEQ ID NO: 1333774 - RNA, 15 nt, Mycobacterium tuberculosis H37Rv
caccggagaacgggu

SEQ ID NO: 1333775 - RNA, 20 nt, Mycobacterium tuberculosis H37Rv
caccggaucgucgaacagca

SEQ ID NO: 1333776 - RNA, 23 nt, Mycobacterium tuberculosis H37Rv
caccggaugauguggugugccug

SEQ ID NO: 1333777 - RNA, 16 nt, Mycobacterium tuberculosis H37Rv
caccgcgccgagcaga

SEQ ID NO: 1333778 - RNA, 12 nt, Mycobacterium tuberculosis H37Rv
caccgcgccgcg

SEQ ID NO: 1333779 - RNA, 15 nt, Mycobacterium tuberculosis H37Rv
caccgcgccggcgga

SEQ ID NO: 1333780 - RNA, 23 nt, Mycobacterium tuberculosis H37Rv
caccgcgccggcggaagcggcgg

SEQ ID NO: 1333781 - RNA, 17 nt, Mycobacterium tuberculosis H37Rv
caccgcgcaacccggac

SEQ ID NO: 1333782 - RNA, 14 nt, Mycobacterium tuberculosis H37Rv
cacgaucacccgga

SEQ ID NO: 1333783 - RNA, 14 nt, Mycobacterium tuberculosis H37Rv
cacgcacaagccuc

SEQ ID NO: 1333784 - RNA, 22 nt, Mycobacterium tuberculosis H37Rv
cacgcacccggcgcaacaaccg

SEQ ID NO: 1333785 - RNA, 14 nt, Mycobacterium tuberculosis H37Rv
cacgcaccacaaac

SEQ ID NO: 1333786 - RNA, 14 nt, Mycobacterium tuberculosis H37Rv
cacgcacgccgcgu

SEQ ID NO: 1333787 - RNA, 20 nt, Mycobacterium tuberculosis H37Rv
cacgcacgcgguucaccacg

SEQ ID NO: 1333788 - RNA, 14 nt, Mycobacterium tuberculosis H37Rv
cacgcaccgccccg

SEQ ID NO: 1333789 - RNA, 15 nt, Mycobacterium tuberculosis H37Rv
cacgcaccgccccgc

SEQ ID NO: 1333790 - RNA, 20 nt, Mycobacterium tuberculosis H37Rv
cacgcacucccgagccacaa

SEQ ID NO: 1333791 - RNA, 15 nt, Mycobacterium tuberculosis H37Rv
cacgcacucacuacc

SEQ ID NO: 1333792 - RNA, 13 nt, Mycobacterium tuberculosis H37Rv
cacgcagccgcgc

SEQ ID NO: 1333793 - RNA, 17 nt, Mycobacterium tuberculosis H37Rv
cacgcaggaaaaccccg

SEQ ID NO: 1333794 - RNA, 13 nt, Mycobacterium tuberculosis H37Rv
cacgcagcccguc

SEQ ID NO: 1333795 - RNA, 17 nt, Mycobacterium tuberculosis H37Rv
cacgcauguuggugauc

SEQ ID NO: 1333796 - RNA, 13 nt, Mycobacterium tuberculosis H37Rv
cacgcaugggcca

SEQ ID NO: 1333797 - RNA, 16 nt, Mycobacterium tuberculosis H37Rv
cacgccagccgugccg

SEQ ID NO: 1333798 - RNA, 12 nt, Mycobacterium tuberculosis H37Rv
cacgccagccgu

SEQ ID NO: 1333799 - RNA, 14 nt, Mycobacterium tuberculosis H37Rv
cacgccacguccaa

SEQ ID NO: 1333800 - RNA, 14 nt, Mycobacterium tuberculosis H37Rv
cacgccaccgcaac

SEQ ID NO: 1333801 - RNA, 13 nt, Mycobacterium tuberculosis H37Rv
cacgccaccgcgg

SEQ ID NO: 1333802 - RNA, 21 nt, Mycobacterium tuberculosis H37Rv
cacgcccaauguccaggcgcg

SEQ ID NO: 1333803 - RNA, 17 nt, Mycobacterium tuberculosis H37Rv
cacgccagcucgccggc

SEQ ID NO: 1333804 - RNA, 15 nt, Mycobacterium tuberculosis H37Rv
cacgccagcucgccg

SEQ ID NO: 1333805 - RNA, 18 nt, Mycobacterium tuberculosis H37Rv
cacgccauaccggcuggc

SEQ ID NO: 1333806 - RNA, 14 nt, Mycobacterium tuberculosis H37Rv
cacgcccaccacug

SEQ ID NO: 1333807 - RNA, 11 nt, Mycobacterium tuberculosis H37Rv
cacgcccaggc

SEQ ID NO: 1333808 - RNA, 21 nt, Mycobacterium tuberculosis H37Rv
cacgccgccgacgugaggguc

SEQ ID NO: 1333809 - RNA, 17 nt, Mycobacterium tuberculosis H37Rv
caccugcgcgcggccgc

SEQ ID NO: 1333810 - RNA, 18 nt, Mycobacterium tuberculosis H37Rv
caccugcgcgcggccgcg

SEQ ID NO: 1333811 - RNA, 22 nt, Mycobacterium tuberculosis H37Rv
caccugccgacucaucggccgc

SEQ ID NO: 1333812 - RNA, 13 nt, Mycobacterium tuberculosis H37Rv
caccugcgggccc

SEQ ID NO: 1333813 - RNA, 20 nt, Mycobacterium tuberculosis H37Rv
caccugcgggcccacgccca

SEQ ID NO: 1333814 - RNA, 12 nt, Mycobacterium tuberculosis H37Rv
caccuuccacga

SEQ ID NO: 1333815 - RNA, 17 nt, Mycobacterium tuberculosis H37Rv
caccuuguggacccgcc

SEQ ID NO: 1333816 - RNA, 18 nt, Mycobacterium tuberculosis H37Rv
caccuuucuccacauugg

SEQ ID NO: 1333817 - RNA, 22 nt, Mycobacterium tuberculosis H37Rv
caccuuggcugggcccgccguc

SEQ ID NO: 1333818 - RNA, 21 nt, Mycobacterium tuberculosis H37Rv
caccuuggccaggaagucccg

SEQ ID NO: 1333819 - RNA, 16 nt, Mycobacterium tuberculosis H37Rv
caccuugggcagcuug

SEQ ID NO: 1333820 - RNA, 15 nt, Mycobacterium tuberculosis H37Rv
caccuugcugcaguc

SEQ ID NO: 1333821 - RNA, 18 nt, Mycobacterium tuberculosis H37Rv
caccuugccuagccgcag

SEQ ID NO: 1333822 - RNA, 17 nt, Mycobacterium tuberculosis H37Rv
cacgaagugacccgaac

SEQ ID NO: 1333823 - RNA, 16 nt, Mycobacterium tuberculosis H37Rv
cacgaccgacaccccg

SEQ ID NO: 1333824 - RNA, 21 nt, Mycobacterium tuberculosis H37Rv
cacgaagcuggcgugcagcag

SEQ ID NO: 1333825 - RNA, 23 nt, Mycobacterium tuberculosis H37Rv
cacgaacugaucgaccgccuccu

SEQ ID NO: 1333826 - RNA, 18 nt, Mycobacterium tuberculosis H37Rv
cacgacgacaaccggcca

SEQ ID NO: 1333827 - RNA, 21 nt, Mycobacterium tuberculosis H37Rv
cacgacgacaaccggccagau

SEQ ID NO: 1333828 - RNA, 19 nt, Mycobacterium tuberculosis H37Rv
cacgacgccggccuggccg

SEQ ID NO: 1333829 - RNA, 16 nt, Mycobacterium tuberculosis H37Rv
cacgacgaacaccagc

SEQ ID NO: 1333830 - RNA, 17 nt, Mycobacterium tuberculosis H37Rv
cacgacgaacaccagcg

SEQ ID NO: 1333831 - RNA, 12 nt, Mycobacterium tuberculosis H37Rv
cacgaccucuug

SEQ ID NO: 1333832 - RNA, 19 nt, Mycobacterium tuberculosis H37Rv
cacgaccugcucauccacc

SEQ ID NO: 1333833 - RNA, 16 nt, Mycobacterium tuberculosis H37Rv
cacgagucgccagacc

SEQ ID NO: 1333834 - RNA, 17 nt, Mycobacterium tuberculosis H37Rv
cacgagucgccagaccg

SEQ ID NO: 1333835 - RNA, 13 nt, Mycobacterium tuberculosis H37Rv
cacgacgggccga

SEQ ID NO: 1333836 - RNA, 14 nt, Mycobacterium tuberculosis H37Rv
cacggcagcgccca

SEQ ID NO: 1333837 - RNA, 23 nt, Mycobacterium tuberculosis H37Rv
cacggcagccuugaucucguccc

SEQ ID NO: 1333838 - RNA, 15 nt, Mycobacterium tuberculosis H37Rv
cacggacaguucccc

SEQ ID NO: 1333839 - RNA, 15 nt, Mycobacterium tuberculosis H37Rv
cacggaccgccaccu

SEQ ID NO: 1333840 - RNA, 18 nt, Mycobacterium tuberculosis H37Rv
cacggacggucgggcgga

SEQ ID NO: 1333841 - RNA, 14 nt, Mycobacterium tuberculosis H37Rv
cacggcuagcgccg

SEQ ID NO: 1333842 - RNA, 12 nt, Mycobacterium tuberculosis H37Rv
cacggcugccca

SEQ ID NO: 1333843 - RNA, 18 nt, Mycobacterium tuberculosis H37Rv
cacggcgucggccaccgc

SEQ ID NO: 1333844 - RNA, 17 nt, Mycobacterium tuberculosis H37Rv
cacggcgucggccaccc

SEQ ID NO: 1333845 - RNA, 14 nt, Mycobacterium tuberculosis H37Rv
cacggcgguguguu

SEQ ID NO: 1333846 - RNA, 16 nt, Mycobacterium tuberculosis H37Rv
cacggcgggcgagcca

SEQ ID NO: 1333847 - RNA, 15 nt, Mycobacterium tuberculosis H37Rv
cacggcggccccggc

SEQ ID NO: 1333848 - RNA, 15 nt, Mycobacterium tuberculosis H37Rv
cacggccgagcaggu

SEQ ID NO: 1333849 - RNA, 18 nt, Mycobacterium tuberculosis H37Rv
cacggccccugccacgac

SEQ ID NO: 1333850 - RNA, 15 nt, Mycobacterium tuberculosis H37Rv
cacgcuucggccugu

SEQ ID NO: 1333851 - RNA, 18 nt, Mycobacterium tuberculosis H37Rv
cacgcuucggccugugcg

SEQ ID NO: 1333852 - RNA, 18 nt, Mycobacterium tuberculosis H37Rv
cacgcugccccgccgcca

SEQ ID NO: 1333853 - RNA, 18 nt, Mycobacterium tuberculosis H37Rv
cacgcugcccgccagccc

SEQ ID NO: 1333854 - RNA, 15 nt, Mycobacterium tuberculosis H37Rv
cacgcugcccacggg

SEQ ID NO: 1333855 - RNA, 13 nt, Mycobacterium tuberculosis H37Rv
cacgcugccccgc

SEQ ID NO: 1333856 - RNA, 18 nt, Mycobacterium tuberculosis H37Rv
cacgcucugcgccacagc

SEQ ID NO: 1333857 - RNA, 14 nt, Mycobacterium tuberculosis H37Rv
cacgcucggcgccg

SEQ ID NO: 1333858 - RNA, 21 nt, Mycobacterium tuberculosis H37Rv
cacgccggcaugccagccacg

SEQ ID NO: 1333859 - RNA, 19 nt, Mycobacterium tuberculosis H37Rv
cacgccggccgcgcugaac

SEQ ID NO: 1333860 - RNA, 21 nt, Mycobacterium tuberculosis H37Rv
cacgccggccucgccgaagcg

SEQ ID NO: 1333861 - RNA, 17 nt, Mycobacterium tuberculosis H37Rv
cacggucaugccgccgc

SEQ ID NO: 1333862 - RNA, 17 nt, Mycobacterium tuberculosis H37Rv
cacggucaucucggugg

SEQ ID NO: 1333863 - RNA, 16 nt, Mycobacterium tuberculosis H37Rv
cacggucaugccgccg

SEQ ID NO: 1333864 - RNA, 19 nt, Mycobacterium tuberculosis H37Rv
cacggucacacgccagccg

SEQ ID NO: 1333865 - RNA, 15 nt, Mycobacterium tuberculosis H37Rv
cacggucacacgcca

SEQ ID NO: 1333866 - RNA, 18 nt, Mycobacterium tuberculosis H37Rv
cacggucaagccggcgcc

SEQ ID NO: 1333867 - RNA, 21 nt, Mycobacterium tuberculosis H37Rv
cacggucagcucgcugacggc

SEQ ID NO: 1333868 - RNA, 21 nt, Mycobacterium tuberculosis H37Rv
cacggucaauugugcggcccc

SEQ ID NO: 1333869 - RNA, 14 nt, Mycobacterium tuberculosis H37Rv
cacggucagcacgc

SEQ ID NO: 1333870 - RNA, 19 nt, Mycobacterium tuberculosis H37Rv
cacggucagcacgcugacc

SEQ ID NO: 1333871 - RNA, 14 nt, Mycobacterium tuberculosis H37Rv
cacggcuuugcggc

SEQ ID NO: 1333872 - RNA, 21 nt, Mycobacterium tuberculosis H37Rv
cacggcuuugcggcgcgacca

SEQ ID NO: 1333873 - RNA, 16 nt, Mycobacterium tuberculosis H37Rv
cacggguggugccagg

SEQ ID NO: 1333874 - RNA, 17 nt, Mycobacterium tuberculosis H37Rv
cacggguggugccaggu

SEQ ID NO: 1333875 - RNA, 14 nt, Mycobacterium tuberculosis H37Rv
cacgguccggcggg

SEQ ID NO: 1333876 - RNA, 17 nt, Mycobacterium tuberculosis H37Rv
cacggugaccacgccgu

SEQ ID NO: 1333877 - RNA, 12 nt, Mycobacterium tuberculosis H37Rv
cacggugcccag

SEQ ID NO: 1333878 - RNA, 14 nt, Mycobacterium tuberculosis H37Rv
cacggugcccaggg

SEQ ID NO: 1333879 - RNA, 17 nt, Mycobacterium tuberculosis H37Rv
cacgguggagcgcgccu

SEQ ID NO: 1333880 - RNA, 22 nt, Mycobacterium tuberculosis H37Rv
cacgguggagcgcgccucgccc

SEQ ID NO: 1333881 - RNA, 22 nt, Mycobacterium tuberculosis H37Rv
cacggugggguuggcuccggug

SEQ ID NO: 1333882 - RNA, 22 nt, Mycobacterium tuberculosis H37Rv
cacggugguggugggaguucgc

SEQ ID NO: 1333883 - RNA, 17 nt, Mycobacterium tuberculosis H37Rv
cacgguguauuggggug

SEQ ID NO: 1333884 - RNA, 13 nt, Mycobacterium tuberculosis H37Rv
cacggugucccgc

SEQ ID NO: 1333885 - RNA, 22 nt, Mycobacterium tuberculosis H37Rv
cacguccaucaccggcggcccc

SEQ ID NO: 1333886 - RNA, 22 nt, Mycobacterium tuberculosis H37Rv
cacgucgaccaauaccaguccg

SEQ ID NO: 1333887 - RNA, 17 nt, Mycobacterium tuberculosis H37Rv
cacgucgaggcggcagu

SEQ ID NO: 1333888 - RNA, 21 nt, Mycobacterium tuberculosis H37Rv
cacgucgacggcggccgccac

SEQ ID NO: 1333889 - RNA, 20 nt, Mycobacterium tuberculosis H37Rv
cacgucgagcaggcuggcug

SEQ ID NO: 1333890 - RNA, 19 nt, Mycobacterium tuberculosis H37Rv
cacguccgcgggggaccgc

SEQ ID NO: 1333891 - RNA, 20 nt, Mycobacterium tuberculosis H37Rv
cacguccggcgaugaccaga

SEQ ID NO: 1333892 - RNA, 12 nt, Mycobacterium tuberculosis H37Rv
cacgucaacagc

SEQ ID NO: 1333893 - RNA, 15 nt, Mycobacterium tuberculosis H37Rv
cacgucaaccucgcc

SEQ ID NO: 1333894 - RNA, 19 nt, Mycobacterium tuberculosis H37Rv
cacgguguugcgcacccgc

SEQ ID NO: 1333895 - RNA, 20 nt, Mycobacterium tuberculosis H37Rv
cacgguguugcgcacccgcg

SEQ ID NO: 1333896 - RNA, 17 nt, Mycobacterium tuberculosis H37Rv
cacggugucgcgcgacc

SEQ ID NO: 1333897 - RNA, 17 nt, Mycobacterium tuberculosis H37Rv
cacgguugccggcggcg

SEQ ID NO: 1333898 - RNA, 22 nt, Mycobacterium tuberculosis H37Rv
cacgguucgggcagcacccgcg

SEQ ID NO: 1333899 - RNA, 13 nt, Mycobacterium tuberculosis H37Rv
cacguaacccagu

SEQ ID NO: 1333900 - RNA, 12 nt, Mycobacterium tuberculosis H37Rv
cacguaauuccc

SEQ ID NO: 1333901 - RNA, 14 nt, Mycobacterium tuberculosis H37Rv
cacguaauucccca

SEQ ID NO: 1333902 - RNA, 15 nt, Mycobacterium tuberculosis H37Rv
cacguaauuccccag

SEQ ID NO: 1333903 - RNA, 17 nt, Mycobacterium tuberculosis H37Rv
cacguaauuccccaggu

SEQ ID NO: 1333904 - RNA, 19 nt, Mycobacterium tuberculosis H37Rv
cacguaauuccccaggugu

SEQ ID NO: 1333905 - RNA, 15 nt, Mycobacterium tuberculosis H37Rv
cacguagcagcagac

SEQ ID NO: 1333906 - RNA, 17 nt, Mycobacterium tuberculosis H37Rv
cacguacucggccagcu

SEQ ID NO: 1333907 - RNA, 19 nt, Mycobacterium tuberculosis H37Rv
cacgguuuucgagggaugg

SEQ ID NO: 1333908 - RNA, 21 nt, Mycobacterium tuberculosis H37Rv
cacguagcagcgccggcaccg

SEQ ID NO: 1333909 - RNA, 20 nt, Mycobacterium tuberculosis H37Rv
auuucgacgaccaccuucug

SEQ ID NO: 1333910 - RNA, 21 nt, Mycobacterium tuberculosis H37Rv
auuuccaccacgcgcguuuag

SEQ ID NO: 1333911 - RNA, 20 nt, Mycobacterium tuberculosis H37Rv
auuuggccgauguuguugac

SEQ ID NO: 1333912 - RNA, 20 nt, Mycobacterium tuberculosis H37Rv
caaaaaucgucggaaucauc

SEQ ID NO: 1333913 - RNA, 22 nt, Mycobacterium tuberculosis H37Rv
caaaaaccagcguccaacccag

SEQ ID NO: 1333914 - RNA, 14 nt, Mycobacterium tuberculosis H37Rv
auugugcugaccug

SEQ ID NO: 1333915 - RNA, 20 nt, Mycobacterium tuberculosis H37Rv
auuggaugccauaggacagg

SEQ ID NO: 1333916 - RNA, 14 nt, Mycobacterium tuberculosis H37Rv
auuggcgaucagca

SEQ ID NO: 1333917 - RNA, 18 nt, Mycobacterium tuberculosis H37Rv
auuggcgaucagcagccg

SEQ ID NO: 1333918 - RNA, 14 nt, Mycobacterium tuberculosis H37Rv
auuggcgccgccga

SEQ ID NO: 1333919 - RNA, 24 nt, Mycobacterium tuberculosis H37Rv
auuggcgccgucaccgaucgaaca

SEQ ID NO: 1333920 - RNA, 11 nt, Mycobacterium tuberculosis H37Rv
auuggccaggu

SEQ ID NO: 1333921 - RNA, 12 nt, Mycobacterium tuberculosis H37Rv
auuggccaggug

SEQ ID NO: 1333922 - RNA, 22 nt, Mycobacterium tuberculosis H37Rv
auuggcccgucacgcccgcgaa

SEQ ID NO: 1333923 - RNA, 13 nt, Mycobacterium tuberculosis H37Rv
auugguugaggag

SEQ ID NO: 1333924 - RNA, 16 nt, Mycobacterium tuberculosis H37Rv
auugucaacgaauggu

SEQ ID NO: 1333925 - RNA, 17 nt, Mycobacterium tuberculosis H37Rv
auuggucaccugcugca

SEQ ID NO: 1333926 - RNA, 13 nt, Mycobacterium tuberculosis H37Rv
auugcgcccggcc

SEQ ID NO: 1333927 - RNA, 12 nt, Mycobacterium tuberculosis H37Rv
auugcgcuucca

SEQ ID NO: 1333928 - RNA, 15 nt, Mycobacterium tuberculosis H37Rv
auugcuuggccgcgc

SEQ ID NO: 1333929 - RNA, 17 nt, Mycobacterium tuberculosis H37Rv
auuccggcgcggccggc

SEQ ID NO: 1333930 - RNA, 16 nt, Mycobacterium tuberculosis H37Rv
auuccggcggccacgc

SEQ ID NO: 1333931 - RNA, 21 nt, Mycobacterium tuberculosis H37Rv
auuccggcggagcgggccagc

SEQ ID NO: 1333932 - RNA, 17 nt, Mycobacterium tuberculosis H37Rv
auuccgaguuguucagc

SEQ ID NO: 1333933 - RNA, 13 nt, Mycobacterium tuberculosis H37Rv
auuccgcagagac

SEQ ID NO: 1333934 - RNA, 18 nt, Mycobacterium tuberculosis H37Rv
auuccgcagagaccaagg

SEQ ID NO: 1333935 - RNA, 12 nt, Mycobacterium tuberculosis H37Rv
auuccgcagaga

SEQ ID NO: 1333936 - RNA, 17 nt, Mycobacterium tuberculosis H37Rv
auuccgcgucugcucgg

SEQ ID NO: 1333937 - RNA, 19 nt, Mycobacterium tuberculosis H37Rv
auuccagcggaagcgguug

SEQ ID NO: 1333938 - RNA, 13 nt, Mycobacterium tuberculosis H37Rv
auucccacugcau

SEQ ID NO: 1333939 - RNA, 12 nt, Mycobacterium tuberculosis H37Rv
auuccccagccg

SEQ ID NO: 1333940 - RNA, 13 nt, Mycobacterium tuberculosis H37Rv
auuccccagccgc

SEQ ID NO: 1333941 - RNA, 12 nt, Mycobacterium tuberculosis H37Rv
auucccagucca

SEQ ID NO: 1333942 - RNA, 14 nt, Mycobacterium tuberculosis H37Rv
auuccagaucaacg

SEQ ID NO: 1333943 - RNA, 14 nt, Mycobacterium tuberculosis H37Rv
auuccagccccccg

SEQ ID NO: 1333944 - RNA, 20 nt, Mycobacterium tuberculosis H37Rv
auuccagccggugccgccgu

SEQ ID NO: 1333945 - RNA, 17 nt, Mycobacterium tuberculosis H37Rv
auucgggaucggccggc

SEQ ID NO: 1333946 - RNA, 18 nt, Mycobacterium tuberculosis H37Rv
auucguuggcgaacuggu

SEQ ID NO: 1333947 - RNA, 17 nt, Mycobacterium tuberculosis H37Rv
auucggcugccaccgca

SEQ ID NO: 1333948 - RNA, 16 nt, Mycobacterium tuberculosis H37Rv
auucggcugccaccgc

SEQ ID NO: 1333949 - RNA, 22 nt, Mycobacterium tuberculosis H37Rv
auucggcggcauguucaucgca

SEQ ID NO: 1333950 - RNA, 18 nt, Mycobacterium tuberculosis H37Rv
auucguuuguagucacgg

SEQ ID NO: 1333951 - RNA, 22 nt, Mycobacterium tuberculosis H37Rv
auucgcagccgcggggcccaca

SEQ ID NO: 1333952 - RNA, 12 nt, Mycobacterium tuberculosis H37Rv
auucgccgggcg

SEQ ID NO: 1333953 - RNA, 23 nt, Mycobacterium tuberculosis H37Rv
auucgacucuuucuuugccggag

SEQ ID NO: 1333954 - RNA, 21 nt, Mycobacterium tuberculosis H37Rv
auuccugccgucucgucggca

SEQ ID NO: 1333955 - RNA, 20 nt, Mycobacterium tuberculosis H37Rv
auugacgccguugccgccgu

SEQ ID NO: 1333956 - RNA, 12 nt, Mycobacterium tuberculosis H37Rv
auugacccgacg

SEQ ID NO: 1333957 - RNA, 18 nt, Mycobacterium tuberculosis H37Rv
auugaagccccccgagcu

SEQ ID NO: 1333958 - RNA, 18 nt, Mycobacterium tuberculosis H37Rv
auugagcucagguucagc

SEQ ID NO: 1333959 - RNA, 18 nt, Mycobacterium tuberculosis H37Rv
auugagcagcaagccgcc

SEQ ID NO: 1333960 - RNA, 22 nt, Mycobacterium tuberculosis H37Rv
auucugugucugcucgcgccgc

SEQ ID NO: 1333961 - RNA, 20 nt, Mycobacterium tuberculosis H37Rv
auucuagguucgaguccugg

SEQ ID NO: 1333962 - RNA, 16 nt, Mycobacterium tuberculosis H37Rv
augcagguggagugca

SEQ ID NO: 1333963 - RNA, 16 nt, Mycobacterium tuberculosis H37Rv
augcauccagcugcug

SEQ ID NO: 1333964 - RNA, 23 nt, Mycobacterium tuberculosis H37Rv
augcaucgcaacgagucuuucca

SEQ ID NO: 1333965 - RNA, 16 nt, Mycobacterium tuberculosis H37Rv
augaucgcggcggcga

SEQ ID NO: 1333966 - RNA, 23 nt, Mycobacterium tuberculosis H37Rv
augaucgcgaacaucgccagcgc

SEQ ID NO: 1333967 - RNA, 20 nt, Mycobacterium tuberculosis H37Rv
augcacgucgagcaggcugg

SEQ ID NO: 1333968 - RNA, 13 nt, Mycobacterium tuberculosis H37Rv
augccgguguuga

SEQ ID NO: 1333969 - RNA, 15 nt, Mycobacterium tuberculosis H37Rv
augccggaucgggac

SEQ ID NO: 1333970 - RNA, 18 nt, Mycobacterium tuberculosis H37Rv
augccggcgaaggccagc

SEQ ID NO: 1333971 - RNA, 22 nt, Mycobacterium tuberculosis H37Rv
augccggcgaaggccagcagaa

SEQ ID NO: 1333972 - RNA, 15 nt, Mycobacterium tuberculosis H37Rv
augccggcgagggcc

SEQ ID NO: 1333973 - RNA, 19 nt, Mycobacterium tuberculosis H37Rv
augccggcgccggcccgca

SEQ ID NO: 1333974 - RNA, 20 nt, Mycobacterium tuberculosis H37Rv
augccgggaaccaacaccag

SEQ ID NO: 1333975 - RNA, 21 nt, Mycobacterium tuberculosis H37Rv
augcccuuggcgauguagccu

SEQ ID NO: 1333976 - RNA, 12 nt, Mycobacterium tuberculosis H37Rv
augcccuugaga

SEQ ID NO: 1333977 - RNA, 18 nt, Mycobacterium tuberculosis H37Rv
augcccuugcggaagaag

SEQ ID NO: 1333978 - RNA, 15 nt, Mycobacterium tuberculosis H37Rv
augcccugcgcucgg

SEQ ID NO: 1333979 - RNA, 20 nt, Mycobacterium tuberculosis H37Rv
augccacuaggaagguggcc

SEQ ID NO: 1333980 - RNA, 14 nt, Mycobacterium tuberculosis H37Rv
augccagaucggcc

SEQ ID NO: 1333981 - RNA, 22 nt, Mycobacterium tuberculosis H37Rv
augcccacgcugccgcaguuca

SEQ ID NO: 1333982 - RNA, 19 nt, Mycobacterium tuberculosis H37Rv
augcccacgcugccgcagu

SEQ ID NO: 1333983 - RNA, 20 nt, Mycobacterium tuberculosis H37Rv
augccagcuguugcggggug

SEQ ID NO: 1333984 - RNA, 14 nt, Mycobacterium tuberculosis H37Rv
augcgucugcucgc

SEQ ID NO: 1333985 - RNA, 22 nt, Mycobacterium tuberculosis H37Rv
augcggugguaggacgccagca

SEQ ID NO: 1333986 - RNA, 20 nt, Mycobacterium tuberculosis H37Rv
augcgguucucgagcucggc

SEQ ID NO: 1333987 - RNA, 13 nt, Mycobacterium tuberculosis H37Rv
augcggcccucga

SEQ ID NO: 1333988 - RNA, 20 nt, Mycobacterium tuberculosis H37Rv
augcggcccggguggcccgg

SEQ ID NO: 1333989 - RNA, 17 nt, Mycobacterium tuberculosis H37Rv
augcgggccgccaggcg

SEQ ID NO: 1333990 - RNA, 16 nt, Mycobacterium tuberculosis H37Rv
augcgggccgccaggc

SEQ ID NO: 1333991 - RNA, 12 nt, Mycobacterium tuberculosis H37Rv
augcgggcuggg

SEQ ID NO: 1333992 - RNA, 20 nt, Mycobacterium tuberculosis H37Rv
augcggggcaauccccugga

SEQ ID NO: 1333993 - RNA, 16 nt, Mycobacterium tuberculosis H37Rv
augcggucccugauca

SEQ ID NO: 1333994 - RNA, 16 nt, Mycobacterium tuberculosis H37Rv
augcgcuaggugcgaa

SEQ ID NO: 1333995 - RNA, 17 nt, Mycobacterium tuberculosis H37Rv
augcgcagugcaccgcg

SEQ ID NO: 1333996 - RNA, 20 nt, Mycobacterium tuberculosis H37Rv
augcggaucacaucggccau

SEQ ID NO: 1333997 - RNA, 22 nt, Mycobacterium tuberculosis H37Rv
augcggaugucgucgaccaggc

SEQ ID NO: 1333998 - RNA, 20 nt, Mycobacterium tuberculosis H37Rv
augccguugagugggagcua

SEQ ID NO: 1333999 - RNA, 15 nt, Mycobacterium tuberculosis H37Rv
augccgugccgggcc

SEQ ID NO: 1334000 - RNA, 22 nt, Mycobacterium tuberculosis H37Rv
augcgcaacuucuucagcagcg

SEQ ID NO: 1334001 - RNA, 20 nt, Mycobacterium tuberculosis H37Rv
augcgcacucuagccgggug

SEQ ID NO: 1334002 - RNA, 15 nt, Mycobacterium tuberculosis H37Rv
augcgaugcgcgccg

SEQ ID NO: 1334003 - RNA, 21 nt, Mycobacterium tuberculosis H37Rv
augcuaggcaugccacacacu

SEQ ID NO: 1334004 - RNA, 17 nt, Mycobacterium tuberculosis H37Rv
augcucaggucaccggc

SEQ ID NO: 1334005 - RNA, 11 nt, Mycobacterium tuberculosis H37Rv
augcucagguc

SEQ ID NO: 1334006 - RNA, 14 nt, Mycobacterium tuberculosis H37Rv
augcucuugaugcc

SEQ ID NO: 1334007 - RNA, 17 nt, Mycobacterium tuberculosis H37Rv
augcguucggccgggcc

SEQ ID NO: 1334008 - RNA, 16 nt, Mycobacterium tuberculosis H37Rv
auggccagcacggugu

SEQ ID NO: 1334009 - RNA, 11 nt, Mycobacterium tuberculosis H37Rv
auggccagcac

SEQ ID NO: 1334010 - RNA, 21 nt, Mycobacterium tuberculosis H37Rv
auggccagguuguagacggca

SEQ ID NO: 1334011 - RNA, 15 nt, Mycobacterium tuberculosis H37Rv
auggccaugguggag

SEQ ID NO: 1334012 - RNA, 20 nt, Mycobacterium tuberculosis H37Rv
auggccacccgguggcguuu

SEQ ID NO: 1334013 - RNA, 16 nt, Mycobacterium tuberculosis H37Rv
auggcaauauccggga

SEQ ID NO: 1334014 - RNA, 22 nt, Mycobacterium tuberculosis H37Rv
auggcaccgcccccgucggccu

SEQ ID NO: 1334015 - RNA, 20 nt, Mycobacterium tuberculosis H37Rv
auggcgcgcaacguagccag

SEQ ID NO: 1334016 - RNA, 17 nt, Mycobacterium tuberculosis H37Rv
auggcgccuguccugcg

SEQ ID NO: 1334017 - RNA, 17 nt, Mycobacterium tuberculosis H37Rv
augcugagcgccaggcc

SEQ ID NO: 1334018 - RNA, 13 nt, Mycobacterium tuberculosis H37Rv
augcugggcgaga

SEQ ID NO: 1334019 - RNA, 16 nt, Mycobacterium tuberculosis H37Rv
augcugggauguucuu

SEQ ID NO: 1334020 - RNA, 21 nt, Mycobacterium tuberculosis H37Rv
augcugggcccgccagcccag

SEQ ID NO: 1334021 - RNA, 23 nt, Mycobacterium tuberculosis H37Rv
augcuggcggcgcgacaggugcu

SEQ ID NO: 1334022 - RNA, 19 nt, Mycobacterium tuberculosis H37Rv
auggcggugcgcagcuugg

SEQ ID NO: 1334023 - RNA, 24 nt, Mycobacterium tuberculosis H37Rv
auggcggcauagccgaacagcgga

SEQ ID NO: 1334024 - RNA, 12 nt, Mycobacterium tuberculosis H37Rv
auggcggccacc

SEQ ID NO: 1334025 - RNA, 19 nt, Mycobacterium tuberculosis H37Rv
auggcggccgggucgguga

SEQ ID NO: 1334026 - RNA, 14 nt, Mycobacterium tuberculosis H37Rv
augggacacaaucc

SEQ ID NO: 1334027 - RNA, 13 nt, Mycobacterium tuberculosis H37Rv
auggcuuggacca

SEQ ID NO: 1334028 - RNA, 20 nt, Mycobacterium tuberculosis H37Rv
auggcggucggccugcggca

SEQ ID NO: 1334029 - RNA, 17 nt, Mycobacterium tuberculosis H37Rv
augggccgguuccucag

SEQ ID NO: 1334030 - RNA, 20 nt, Mycobacterium tuberculosis H37Rv
augggccgguuccucagcgg

SEQ ID NO: 1334031 - RNA, 18 nt, Mycobacterium tuberculosis H37Rv
auggggccaacaccucaa

SEQ ID NO: 1334032 - RNA, 16 nt, Mycobacterium tuberculosis H37Rv
augggugugcugccac

SEQ ID NO: 1334033 - RNA, 22 nt, Mycobacterium tuberculosis H37Rv
augggucuggcaggccagcaug

SEQ ID NO: 1334034 - RNA, 21 nt, Mycobacterium tuberculosis H37Rv
auggggucagcucgccagccu

SEQ ID NO: 1334035 - RNA, 15 nt, Mycobacterium tuberculosis H37Rv
augggguuaggagug

SEQ ID NO: 1334036 - RNA, 21 nt, Mycobacterium tuberculosis H37Rv
auggguacccgaucacucgga

SEQ ID NO: 1334037 - RNA, 21 nt, Mycobacterium tuberculosis H37Rv
auggucucccggcugaugccu

SEQ ID NO: 1334038 - RNA, 11 nt, Mycobacterium tuberculosis H37Rv
auggucagcag

SEQ ID NO: 1334039 - RNA, 16 nt, Mycobacterium tuberculosis H37Rv
auggucauccagccag

SEQ ID NO: 1334040 - RNA, 21 nt, Mycobacterium tuberculosis H37Rv
auggugaacgcgaauaccaga

SEQ ID NO: 1334041 - RNA, 23 nt, Mycobacterium tuberculosis H37Rv
auguaaccguagcccugcucagc

SEQ ID NO: 1334042 - RNA, 15 nt, Mycobacterium tuberculosis H37Rv
auguaggcuucgccg

SEQ ID NO: 1334043 - RNA, 23 nt, Mycobacterium tuberculosis H37Rv
aaaagaucuucgccgagaacgau

SEQ ID NO: 1334044 - RNA, 14 nt, Mycobacterium tuberculosis H37Rv
auguaguccagcuc

SEQ ID NO: 1334045 - RNA, 20 nt, Mycobacterium tuberculosis H37Rv
augucaacgugucccaagcc

SEQ ID NO: 1334046 - RNA, 17 nt, Mycobacterium tuberculosis H37Rv
auguauuuggugaugca

SEQ ID NO: 1334047 - RNA, 16 nt, Mycobacterium tuberculosis H37Rv
augucagccaccaucu

SEQ ID NO: 1334048 - RNA, 20 nt, Mycobacterium tuberculosis H37Rv
augucagugaucaccaaccc

SEQ ID NO: 1334049 - RNA, 21 nt, Mycobacterium tuberculosis H37Rv
auuacgcaccgaggccgccga

SEQ ID NO: 1334050 - RNA, 20 nt, Mycobacterium tuberculosis H37Rv
auucagauagucgccgccgu

SEQ ID NO: 1334051 - RNA, 14 nt, Mycobacterium tuberculosis H37Rv
auucacgcaccaca

SEQ ID NO: 1334052 - RNA, 22 nt, Mycobacterium tuberculosis H37Rv
auucagcggcaacgaucgacac

SEQ ID NO: 1334053 - RNA, 17 nt, Mycobacterium tuberculosis H37Rv
auucagcgccccaugca

SEQ ID NO: 1334054 - RNA, 20 nt, Mycobacterium tuberculosis H37Rv
auucaggccgaggaaggagc

SEQ ID NO: 1334055 - RNA, 20 nt, Mycobacterium tuberculosis H37Rv
auuauugauuacguggauca

SEQ ID NO: 1334056 - RNA, 18 nt, Mycobacterium tuberculosis H37Rv
auguccauagccggcauu

SEQ ID NO: 1334057 - RNA, 22 nt, Mycobacterium tuberculosis H37Rv
auguccuauuugcagccuucga

SEQ ID NO: 1334058 - RNA, 18 nt, Mycobacterium tuberculosis H37Rv
auguccuauuugcagccu

SEQ ID NO: 1334059 - RNA, 20 nt, Mycobacterium tuberculosis H37Rv
auguccugggccgccgcccu

SEQ ID NO: 1334060 - RNA, 11 nt, Mycobacterium tuberculosis H37Rv
auguuggugau

SEQ ID NO: 1334061 - RNA, 16 nt, Mycobacterium tuberculosis H37Rv
auguuguucagcaggc

SEQ ID NO: 1334062 - RNA, 14 nt, Mycobacterium tuberculosis H37Rv
auguuggccggcgc

SEQ ID NO: 1334063 - RNA, 21 nt, Mycobacterium tuberculosis H37Rv
auguuggcagggccagcggca

SEQ ID NO: 1334064 - RNA, 15 nt, Mycobacterium tuberculosis H37Rv
auguuggugaucaaa

SEQ ID NO: 1334065 - RNA, 14 nt, Mycobacterium tuberculosis H37Rv
auguugcagaacuc

SEQ ID NO: 1334066 - RNA, 18 nt, Mycobacterium tuberculosis H37Rv
auguugcgacggccggca

SEQ ID NO: 1334067 - RNA, 16 nt, Mycobacterium tuberculosis H37Rv
auguuuugcugcaugc

SEQ ID NO: 1334068 - RNA, 22 nt, Mycobacterium tuberculosis H37Rv
auguuugaaacguaugacgccc

SEQ ID NO: 1334069 - RNA, 20 nt, Mycobacterium tuberculosis H37Rv
aucuuuucaccaccucgguu

SEQ ID NO: 1334070 - RNA, 18 nt, Mycobacterium tuberculosis H37Rv
aucuucggacgccagcuc

SEQ ID NO: 1334071 - RNA, 19 nt, Mycobacterium tuberculosis H37Rv
aucuucgacaggccaccgc

SEQ ID NO: 1334072 - RNA, 22 nt, Mycobacterium tuberculosis H37Rv
augaacagcgacgccaugguca

SEQ ID NO: 1334073 - RNA, 15 nt, Mycobacterium tuberculosis H37Rv
augaaccaggcggcc

SEQ ID NO: 1334074 - RNA, 20 nt, Mycobacterium tuberculosis H37Rv
augaacgcaaccgagggcau

SEQ ID NO: 1334075 - RNA, 13 nt, Mycobacterium tuberculosis H37Rv
augaacgccagca

SEQ ID NO: 1334076 - RNA, 16 nt, Mycobacterium tuberculosis H37Rv
augaacgccagcagcg

SEQ ID NO: 1334077 - RNA, 15 nt, Mycobacterium tuberculosis H37Rv
augaacggaaucuug

SEQ ID NO: 1334078 - RNA, 22 nt, Mycobacterium tuberculosis H37Rv
augaagcuggugaucagcucag

SEQ ID NO: 1334079 - RNA, 21 nt, Mycobacterium tuberculosis H37Rv
augacaaaccugcaugcccag

SEQ ID NO: 1334080 - RNA, 17 nt, Mycobacterium tuberculosis H37Rv
augacguugcagccggc

SEQ ID NO: 1334081 - RNA, 16 nt, Mycobacterium tuberculosis H37Rv
augagcggcgcggcaa

SEQ ID NO: 1334082 - RNA, 18 nt, Mycobacterium tuberculosis H37Rv
augagcgugccgcagcgg

SEQ ID NO: 1334083 - RNA, 16 nt, Mycobacterium tuberculosis H37Rv
augagccggcgccgcc

SEQ ID NO: 1334084 - RNA, 23 nt, Mycobacterium tuberculosis H37Rv
augagguucaucgccggcgcgcc

SEQ ID NO: 1334085 - RNA, 14 nt, Mycobacterium tuberculosis H37Rv
augaggcccaucau

SEQ ID NO: 1334086 - RNA, 17 nt, Mycobacterium tuberculosis H37Rv
augagggcuugugguga

SEQ ID NO: 1334087 - RNA, 23 nt, Mycobacterium tuberculosis H37Rv
augaggcugccgaaguugaagaa

SEQ ID NO: 1334088 - RNA, 15 nt, Mycobacterium tuberculosis H37Rv
augaucccgccaccg

SEQ ID NO: 1334089 - RNA, 19 nt, Mycobacterium tuberculosis H37Rv
augaucccgcugaccuggg

SEQ ID NO: 1334090 - RNA, 15 nt, Mycobacterium tuberculosis H37Rv
augaucccaugaagu

SEQ ID NO: 1334091 - RNA, 22 nt, Mycobacterium tuberculosis H37Rv
aucucgccggcgaagaccgccg

SEQ ID NO: 1334092 - RNA, 18 nt, Mycobacterium tuberculosis H37Rv
aucucgaccagcgccgau

SEQ ID NO: 1334093 - RNA, 20 nt, Mycobacterium tuberculosis H37Rv
aucuccaccgucgccgccgg

SEQ ID NO: 1334094 - RNA, 23 nt, Mycobacterium tuberculosis H37Rv
aucuccaccuucugguccagcac

SEQ ID NO: 1334095 - RNA, 21 nt, Mycobacterium tuberculosis H37Rv
aucuccggcggaucugggcuu

SEQ ID NO: 1334096 - RNA, 20 nt, Mycobacterium tuberculosis H37Rv
aucuccggcuggcccaccuc

SEQ ID NO: 1334097 - RNA, 17 nt, Mycobacterium tuberculosis H37Rv
aucuccgucggccaggc

SEQ ID NO: 1334098 - RNA, 18 nt, Mycobacterium tuberculosis H37Rv
aucuccuccaccagugcc

SEQ ID NO: 1334099 - RNA, 12 nt, Mycobacterium tuberculosis H37Rv
aucgucaggccc

SEQ ID NO: 1334100 - RNA, 17 nt, Mycobacterium tuberculosis H37Rv
aucgucauccaggggcg

SEQ ID NO: 1334101 - RNA, 13 nt, Mycobacterium tuberculosis H37Rv
aucgucaggaacc

SEQ ID NO: 1334102 - RNA, 16 nt, Mycobacterium tuberculosis H37Rv
aucgucacggaggccu

SEQ ID NO: 1334103 - RNA, 15 nt, Mycobacterium tuberculosis H37Rv
aucuucaccacgccg

SEQ ID NO: 1334104 - RNA, 16 nt, Mycobacterium tuberculosis H37Rv
aucuguaaccuccucg

SEQ ID NO: 1334105 - RNA, 15 nt, Mycobacterium tuberculosis H37Rv
aucuguaaccuccuc

SEQ ID NO: 1334106 - RNA, 16 nt, Mycobacterium tuberculosis H37Rv
aucuggccuuggcagu

SEQ ID NO: 1334107 - RNA, 18 nt, Mycobacterium tuberculosis H37Rv
aucuggcuccggccaggg

SEQ ID NO: 1334108 - RNA, 22 nt, Mycobacterium tuberculosis H37Rv
aucugcuagcuuggcggccagc

SEQ ID NO: 1334109 - RNA, 13 nt, Mycobacterium tuberculosis H37Rv
aucugcggcgccc

SEQ ID NO: 1334110 - RNA, 20 nt, Mycobacterium tuberculosis H37Rv
aucugaaaauugacccccua

SEQ ID NO: 1334111 - RNA, 23 nt, Mycobacterium tuberculosis H37Rv
auccacugccgcgcgcccgccuc

SEQ ID NO: 1334112 - RNA, 18 nt, Mycobacterium tuberculosis H37Rv
auccaccgguccagggcc

SEQ ID NO: 1334113 - RNA, 17 nt, Mycobacterium tuberculosis H37Rv
auccacuugaaguucuu

SEQ ID NO: 1334114 - RNA, 17 nt, Mycobacterium tuberculosis H37Rv
auccagaaacugcucgg

SEQ ID NO: 1334115 - RNA, 22 nt, Mycobacterium tuberculosis H37Rv
auccagcccuguuugacugcga

SEQ ID NO: 1334116 - RNA, 15 nt, Mycobacterium tuberculosis H37Rv
auccagaaguaggcg

SEQ ID NO: 1334117 - RNA, 14 nt, Mycobacterium tuberculosis H37Rv
auccaggcccagcc

SEQ ID NO: 1334118 - RNA, 22 nt, Mycobacterium tuberculosis H37Rv
auccaggcccagccgagcggcg

SEQ ID NO: 1334119 - RNA, 15 nt, Mycobacterium tuberculosis H37Rv
auccaggcgugcauc

SEQ ID NO: 1334120 - RNA, 15 nt, Mycobacterium tuberculosis H37Rv
auccaggagugauuc

SEQ ID NO: 1334121 - RNA, 22 nt, Mycobacterium tuberculosis H37Rv
auccaggcuguggccagcauca

SEQ ID NO: 1334122 - RNA, 22 nt, Mycobacterium tuberculosis H37Rv
auccccgaccacugaucggcau

SEQ ID NO: 1334123 - RNA, 20 nt, Mycobacterium tuberculosis H37Rv
auccccgcggcgguaaaccu

SEQ ID NO: 1334124 - RNA, 13 nt, Mycobacterium tuberculosis H37Rv
aucccggccaggc

SEQ ID NO: 1334125 - RNA, 20 nt, Mycobacterium tuberculosis H37Rv
aucccgcucccccgccaacc

SEQ ID NO: 1334126 - RNA, 22 nt, Mycobacterium tuberculosis H37Rv
aucccgcccaagguggcggcca

SEQ ID NO: 1334127 - RNA, 19 nt, Mycobacterium tuberculosis H37Rv
aucccgccgcugccgccgg

SEQ ID NO: 1334128 - RNA, 13 nt, Mycobacterium tuberculosis H37Rv
auccgcccuugcc

SEQ ID NO: 1334129 - RNA, 15 nt, Mycobacterium tuberculosis H37Rv
auccgccccgcccgc

SEQ ID NO: 1334130 - RNA, 14 nt, Mycobacterium tuberculosis H37Rv
auccgacgaaccgg

SEQ ID NO: 1334131 - RNA, 17 nt, Mycobacterium tuberculosis H37Rv
auccgacgaaccgggac

SEQ ID NO: 1334132 - RNA, 14 nt, Mycobacterium tuberculosis H37Rv
auccgagcgguggu

SEQ ID NO: 1334133 - RNA, 19 nt, Mycobacterium tuberculosis H37Rv
auccgcaccgaaaccaugc

SEQ ID NO: 1334134 - RNA, 16 nt, Mycobacterium tuberculosis H37Rv
auccgcacgcaaugcg

SEQ ID NO: 1334135 - RNA, 17 nt, Mycobacterium tuberculosis H37Rv
aucccgguggcagcaca

SEQ ID NO: 1334136 - RNA, 23 nt, Mycobacterium tuberculosis H37Rv
aucccggucgguguggacugggc

SEQ ID NO: 1334137 - RNA, 21 nt, Mycobacterium tuberculosis H37Rv
aucccguagccgugccaauga

SEQ ID NO: 1334138 - RNA, 13 nt, Mycobacterium tuberculosis H37Rv
aucccgucgggca

SEQ ID NO: 1334139 - RNA, 13 nt, Mycobacterium tuberculosis H37Rv
aucccgguggcag

SEQ ID NO: 1334140 - RNA, 22 nt, Mycobacterium tuberculosis H37Rv
auccgaacuucgugggggaccu

SEQ ID NO: 1334141 - RNA, 17 nt, Mycobacterium tuberculosis H37Rv
aucgcggcgcccaggaa

SEQ ID NO: 1334142 - RNA, 12 nt, Mycobacterium tuberculosis H37Rv
aucgcggccaca

SEQ ID NO: 1334143 - RNA, 19 nt, Mycobacterium tuberculosis H37Rv
aucgcggcggccuccacca

SEQ ID NO: 1334144 - RNA, 16 nt, Mycobacterium tuberculosis H37Rv
aucgcgccuauccaaa

SEQ ID NO: 1334145 - RNA, 14 nt, Mycobacterium tuberculosis H37Rv
aucgcggccgcugg

SEQ ID NO: 1334146 - RNA, 19 nt, Mycobacterium tuberculosis H37Rv
aucgcccugacacccaucg

SEQ ID NO: 1334147 - RNA, 11 nt, Mycobacterium tuberculosis H37Rv
aucgcccgguu

SEQ ID NO: 1334148 - RNA, 20 nt, Mycobacterium tuberculosis H37Rv
aucgcccgguucagcgcugg

SEQ ID NO: 1334149 - RNA, 21 nt, Mycobacterium tuberculosis H37Rv
aucgccaggcccugaaucuug

SEQ ID NO: 1334150 - RNA, 16 nt, Mycobacterium tuberculosis H37Rv
aucgccgacagcgccu

SEQ ID NO: 1334151 - RNA, 21 nt, Mycobacterium tuberculosis H37Rv
aucggacucggaauucggcgu

SEQ ID NO: 1334152 - RNA, 13 nt, Mycobacterium tuberculosis H37Rv
aucggcagcagcg

SEQ ID NO: 1334153 - RNA, 15 nt, Mycobacterium tuberculosis H37Rv
aucggcagcagcgca

SEQ ID NO: 1334154 - RNA, 21 nt, Mycobacterium tuberculosis H37Rv
aucggaacgaucauuccugcc

SEQ ID NO: 1334155 - RNA, 19 nt, Mycobacterium tuberculosis H37Rv
aucggacagcgccuggccg

SEQ ID NO: 1334156 - RNA, 20 nt, Mycobacterium tuberculosis H37Rv
aucggccccgaaacgauggc

SEQ ID NO: 1334157 - RNA, 19 nt, Mycobacterium tuberculosis H37Rv
aucggcccagcccuucagc

SEQ ID NO: 1334158 - RNA, 21 nt, Mycobacterium tuberculosis H37Rv
aucggcaggguggccagcagg

SEQ ID NO: 1334159 - RNA, 17 nt, Mycobacterium tuberculosis H37Rv
aucggcagucccagcgc

SEQ ID NO: 1334160 - RNA, 15 nt, Mycobacterium tuberculosis H37Rv
aucggccaacagguc

SEQ ID NO: 1334161 - RNA, 13 nt, Mycobacterium tuberculosis H37Rv
aucggccaccugu

SEQ ID NO: 1334162 - RNA, 17 nt, Mycobacterium tuberculosis H37Rv
aucgcuccggcccugcc

SEQ ID NO: 1334163 - RNA, 22 nt, Mycobacterium tuberculosis H37Rv
aucgcuccggcccugccgccgg

SEQ ID NO: 1334164 - RNA, 21 nt, Mycobacterium tuberculosis H37Rv
aucgcucauucgugcccgggc

SEQ ID NO: 1334165 - RNA, 14 nt, Mycobacterium tuberculosis H37Rv
aucgcuugaacgca

SEQ ID NO: 1334166 - RNA, 21 nt, Mycobacterium tuberculosis H37Rv
aucgggucacccccggccagc

SEQ ID NO: 1334167 - RNA, 16 nt, Mycobacterium tuberculosis H37Rv
aucgggucacccccgg

SEQ ID NO: 1334168 - RNA, 18 nt, Mycobacterium tuberculosis H37Rv
aucggcccgugccacagc

SEQ ID NO: 1334169 - RNA, 21 nt, Mycobacterium tuberculosis H37Rv
aucggccggcgucagccccga

SEQ ID NO: 1334170 - RNA, 17 nt, Mycobacterium tuberculosis H37Rv
aucggcggggcccacac

SEQ ID NO: 1334171 - RNA, 19 nt, Mycobacterium tuberculosis H37Rv
aucggcggcguccagcagc

SEQ ID NO: 1334172 - RNA, 18 nt, Mycobacterium tuberculosis H37Rv
aucggcggcguccagcag

SEQ ID NO: 1334173 - RNA, 14 nt, Mycobacterium tuberculosis H37Rv
aucggcggaccgca

SEQ ID NO: 1334174 - RNA, 15 nt, Mycobacterium tuberculosis H37Rv
aucggcgcuagccag

SEQ ID NO: 1334175 - RNA, 17 nt, Mycobacterium tuberculosis H37Rv
aucggcggccggcgccg

SEQ ID NO: 1334176 - RNA, 14 nt, Mycobacterium tuberculosis H37Rv
aucggcggccugcu

SEQ ID NO: 1334177 - RNA, 20 nt, Mycobacterium tuberculosis H37Rv
aucgggcuugcgcagcagcg

SEQ ID NO: 1334178 - RNA, 16 nt, Mycobacterium tuberculosis H37Rv
aucgggcggcaccgcu

SEQ ID NO: 1334179 - RNA, 18 nt, Mycobacterium tuberculosis H37Rv
aucgggaaguacggcagg

SEQ ID NO: 1334180 - RNA, 19 nt, Mycobacterium tuberculosis H37Rv
aucgggaaguacggcaggc

SEQ ID NO: 1334181 - RNA, 18 nt, Mycobacterium tuberculosis H37Rv
auccuugcgacguucuug

SEQ ID NO: 1334182 - RNA, 21 nt, Mycobacterium tuberculosis H37Rv
auccuucgccggcgccagcag

SEQ ID NO: 1334183 - RNA, 22 nt, Mycobacterium tuberculosis H37Rv
auccuucgccggcgccagcaga

SEQ ID NO: 1334184 - RNA, 12 nt, Mycobacterium tuberculosis H37Rv
auccuggucacc

SEQ ID NO: 1334185 - RNA, 20 nt, Mycobacterium tuberculosis H37Rv
auccuggucaccagccaccg

SEQ ID NO: 1334186 - RNA, 19 nt, Mycobacterium tuberculosis H37Rv
auccgcggcaugcaaugcu

SEQ ID NO: 1334187 - RNA, 22 nt, Mycobacterium tuberculosis H37Rv
auccgcggcaugcaaugcuggc

SEQ ID NO: 1334188 - RNA, 17 nt, Mycobacterium tuberculosis H37Rv
auccgcucacccgcccg

SEQ ID NO: 1334189 - RNA, 16 nt, Mycobacterium tuberculosis H37Rv
auccggaucccaccac

SEQ ID NO: 1334190 - RNA, 19 nt, Mycobacterium tuberculosis H37Rv
auccugcagcucgggcagg

SEQ ID NO: 1334191 - RNA, 17 nt, Mycobacterium tuberculosis H37Rv
auccugcaguacggcca

SEQ ID NO: 1334192 - RNA, 22 nt, Mycobacterium tuberculosis H37Rv
auccggaauagcaacgcugcag

SEQ ID NO: 1334193 - RNA, 24 nt, Mycobacterium tuberculosis H37Rv
auccugcgguugaguugcagaccg

SEQ ID NO: 1334194 - RNA, 16 nt, Mycobacterium tuberculosis H37Rv
auccugcgguugaguu

SEQ ID NO: 1334195 - RNA, 19 nt, Mycobacterium tuberculosis H37Rv
auccuggccacucccagcc

SEQ ID NO: 1334196 - RNA, 13 nt, Mycobacterium tuberculosis H37Rv
auccuggacaagu

SEQ ID NO: 1334197 - RNA, 13 nt, Mycobacterium tuberculosis H37Rv
aucgacagcagcg

SEQ ID NO: 1334198 - RNA, 16 nt, Mycobacterium tuberculosis H37Rv
aucgacccgaugaccc

SEQ ID NO: 1334199 - RNA, 13 nt, Mycobacterium tuberculosis H37Rv
aucgaccaugguc

SEQ ID NO: 1334200 - RNA, 14 nt, Mycobacterium tuberculosis H37Rv
aucgaccauggucg

SEQ ID NO: 1334201 - RNA, 12 nt, Mycobacterium tuberculosis H37Rv
aucgacacccuu

SEQ ID NO: 1334202 - RNA, 15 nt, Mycobacterium tuberculosis H37Rv
aucgacaccgcccga

SEQ ID NO: 1334203 - RNA, 20 nt, Mycobacterium tuberculosis H37Rv
aucgacgucgcggcgccuga

SEQ ID NO: 1334204 - RNA, 17 nt, Mycobacterium tuberculosis H37Rv
aucgacguuccagcagu

SEQ ID NO: 1334205 - RNA, 16 nt, Mycobacterium tuberculosis H37Rv
aucgacgccgccaccc

SEQ ID NO: 1334206 - RNA, 12 nt, Mycobacterium tuberculosis H37Rv
aucgaccgcccg

SEQ ID NO: 1334207 - RNA, 19 nt, Mycobacterium tuberculosis H37Rv
aucgacggccagcccagca

SEQ ID NO: 1334208 - RNA, 17 nt, Mycobacterium tuberculosis H37Rv
aucgaggcgaaagaugg

SEQ ID NO: 1334209 - RNA, 16 nt, Mycobacterium tuberculosis H37Rv
aucgacucacacaccg

SEQ ID NO: 1334210 - RNA, 22 nt, Mycobacterium tuberculosis H37Rv
aucgacuccggauggaacugga

SEQ ID NO: 1334211 - RNA, 15 nt, Mycobacterium tuberculosis H37Rv
aucgacucacacacc

SEQ ID NO: 1334212 - RNA, 20 nt, Mycobacterium tuberculosis H37Rv
aucgaguugcggugcccgca

SEQ ID NO: 1334213 - RNA, 17 nt, Mycobacterium tuberculosis H37Rv
aucgcauugggcgggcu

SEQ ID NO: 1334214 - RNA, 22 nt, Mycobacterium tuberculosis H37Rv
aucgccaaauccggugcccgca

SEQ ID NO: 1334215 - RNA, 21 nt, Mycobacterium tuberculosis H37Rv
aucgccacuguugaagaagcc

SEQ ID NO: 1334216 - RNA, 18 nt, Mycobacterium tuberculosis H37Rv
aucgccacacccaaaccg

SEQ ID NO: 1334217 - RNA, 11 nt, Mycobacterium tuberculosis H37Rv
aucgccacagu

SEQ ID NO: 1334218 - RNA, 14 nt, Mycobacterium tuberculosis H37Rv
aucgccagcggcaa

SEQ ID NO: 1334219 - RNA, 11 nt, Mycobacterium tuberculosis H37Rv
aucgccagcag

SEQ ID NO: 1334220 - RNA, 18 nt, Mycobacterium tuberculosis H37Rv
auaccuuccagaucgcgg

SEQ ID NO: 1334221 - RNA, 19 nt, Mycobacterium tuberculosis H37Rv
auacgccggccgcgcuggu

SEQ ID NO: 1334222 - RNA, 21 nt, Mycobacterium tuberculosis H37Rv
auacaggccacgcaccgggug

SEQ ID NO: 1334223 - RNA, 20 nt, Mycobacterium tuberculosis H37Rv
auacaggcccgccagcaggg

SEQ ID NO: 1334224 - RNA, 13 nt, Mycobacterium tuberculosis H37Rv
auaccgcaccaaa

SEQ ID NO: 1334225 - RNA, 14 nt, Mycobacterium tuberculosis H37Rv
auaccgccagcgcc

SEQ ID NO: 1334226 - RNA, 21 nt, Mycobacterium tuberculosis H37Rv
auaccggcuggccagguggcc

SEQ ID NO: 1334227 - RNA, 18 nt, Mycobacterium tuberculosis H37Rv
auaccggcaucgaagugc

SEQ ID NO: 1334228 - RNA, 17 nt, Mycobacterium tuberculosis H37Rv
auaccucgccgcccugu

SEQ ID NO: 1334229 - RNA, 20 nt, Mycobacterium tuberculosis H37Rv
auaccugaaugucguugaga

SEQ ID NO: 1334230 - RNA, 14 nt, Mycobacterium tuberculosis H37Rv
auaccucgccaucc

SEQ ID NO: 1334231 - RNA, 15 nt, Mycobacterium tuberculosis H37Rv
auaccugccggacca

SEQ ID NO: 1334232 - RNA, 19 nt, Mycobacterium tuberculosis H37Rv
auacucucgcgacaucacc

SEQ ID NO: 1334233 - RNA, 21 nt, Mycobacterium tuberculosis H37Rv
auacucgaguggcgaacgggu

SEQ ID NO: 1334234 - RNA, 19 nt, Mycobacterium tuberculosis H37Rv
auagccggugucugggugg

SEQ ID NO: 1334235 - RNA, 21 nt, Mycobacterium tuberculosis H37Rv
auagccgguugucgcagcgca

SEQ ID NO: 1334236 - RNA, 17 nt, Mycobacterium tuberculosis H37Rv
auagcaccaguuugugc

SEQ ID NO: 1334237 - RNA, 16 nt, Mycobacterium tuberculosis H37Rv
auagcaacggugcucu

SEQ ID NO: 1334238 - RNA, 15 nt, Mycobacterium tuberculosis H37Rv
auagauucccggcuc

SEQ ID NO: 1334239 - RNA, 20 nt, Mycobacterium tuberculosis H37Rv
auagcugcguccggaaccaa

SEQ ID NO: 1334240 - RNA, 18 nt, Mycobacterium tuberculosis H37Rv
auagcugccggcccacca

SEQ ID NO: 1334241 - RNA, 14 nt, Mycobacterium tuberculosis H37Rv
auaucgccuaacag

SEQ ID NO: 1334242 - RNA, 21 nt, Mycobacterium tuberculosis H37Rv
auaucgggagcggcugcggca

SEQ ID NO: 1334243 - RNA, 22 nt, Mycobacterium tuberculosis H37Rv
auaucggcacggucacacgcca

SEQ ID NO: 1334244 - RNA, 20 nt, Mycobacterium tuberculosis H37Rv
auaucagugaaggaauacgc

SEQ ID NO: 1334245 - RNA, 11 nt, Mycobacterium tuberculosis H37Rv
auaucugccac

SEQ ID NO: 1334246 - RNA, 16 nt, Mycobacterium tuberculosis H37Rv
auaucucgccguacau

SEQ ID NO: 1334247 - RNA, 19 nt, Mycobacterium tuberculosis H37Rv
auaucuuuagcgcgugcug

SEQ ID NO: 1334248 - RNA, 14 nt, Mycobacterium tuberculosis H37Rv
aucaacgacaccag

SEQ ID NO: 1334249 - RNA, 19 nt, Mycobacterium tuberculosis H37Rv
aucaacgcguugcacagca

SEQ ID NO: 1334250 - RNA, 14 nt, Mycobacterium tuberculosis H37Rv
aucaagcacagccc

SEQ ID NO: 1334251 - RNA, 15 nt, Mycobacterium tuberculosis H37Rv
aucaagcacagcccg

SEQ ID NO: 1334252 - RNA, 17 nt, Mycobacterium tuberculosis H37Rv
aucaaacccccggggcg

SEQ ID NO: 1334253 - RNA, 19 nt, Mycobacterium tuberculosis H37Rv
aucaacaacagccgcagcc

SEQ ID NO: 1334254 - RNA, 14 nt, Mycobacterium tuberculosis H37Rv
aucaagggggucga

SEQ ID NO: 1334255 - RNA, 13 nt, Mycobacterium tuberculosis H37Rv
aucaaggccaccu

SEQ ID NO: 1334256 - RNA, 15 nt, Mycobacterium tuberculosis H37Rv
aucaauggcagcuga

SEQ ID NO: 1334257 - RNA, 17 nt, Mycobacterium tuberculosis H37Rv
aucaaugcggucccucc

SEQ ID NO: 1334258 - RNA, 15 nt, Mycobacterium tuberculosis H37Rv
aucagugaagacacc

SEQ ID NO: 1334259 - RNA, 17 nt, Mycobacterium tuberculosis H37Rv
aaaacgcccggcacacg

SEQ ID NO: 1334260 - RNA, 23 nt, Mycobacterium tuberculosis H37Rv
aucaucgccgcggccagguugau

SEQ ID NO: 1334261 - RNA, 17 nt, Mycobacterium tuberculosis H37Rv
aucaucaugucggcgca

SEQ ID NO: 1334262 - RNA, 21 nt, Mycobacterium tuberculosis H37Rv
aucauauccgccccagcugcg

SEQ ID NO: 1334263 - RNA, 20 nt, Mycobacterium tuberculosis H37Rv
aucauauccgccccagcugc

SEQ ID NO: 1334264 - RNA, 19 nt, Mycobacterium tuberculosis H37Rv
aucagcaugguccacagcc

SEQ ID NO: 1334265 - RNA, 19 nt, Mycobacterium tuberculosis H37Rv
aucagccagaccaacauga

SEQ ID NO: 1334266 - RNA, 21 nt, Mycobacterium tuberculosis H37Rv
aucagcugcgcaucgccacca

SEQ ID NO: 1334267 - RNA, 20 nt, Mycobacterium tuberculosis H37Rv
aucagagcguucuucagcca

SEQ ID NO: 1334268 - RNA, 21 nt, Mycobacterium tuberculosis H37Rv
aucagagcguucuucagccag

SEQ ID NO: 1334269 - RNA, 21 nt, Mycobacterium tuberculosis H37Rv
aucagcaagagccgcagccac

SEQ ID NO: 1334270 - RNA, 13 nt, Mycobacterium tuberculosis H37Rv
aucacggucagcc

SEQ ID NO: 1334271 - RNA, 20 nt, Mycobacterium tuberculosis H37Rv
aucacggcgggaugcagcug

SEQ ID NO: 1334272 - RNA, 15 nt, Mycobacterium tuberculosis H37Rv
aucacggcggggauc

SEQ ID NO: 1334273 - RNA, 21 nt, Mycobacterium tuberculosis H37Rv
aucacgggcuaccggcagcug

SEQ ID NO: 1334274 - RNA, 15 nt, Mycobacterium tuberculosis H37Rv
aucacgcgaaugacg

SEQ ID NO: 1334275 - RNA, 19 nt, Mycobacterium tuberculosis H37Rv
aucacuuucgaagaaccgc

SEQ ID NO: 1334276 - RNA, 18 nt, Mycobacterium tuberculosis H37Rv
aucaccggcauacagccg

SEQ ID NO: 1334277 - RNA, 13 nt, Mycobacterium tuberculosis H37Rv
aucaccgcggcgg

SEQ ID NO: 1334278 - RNA, 23 nt, Mycobacterium tuberculosis H37Rv
aucaccgccagcugggcagccag

SEQ ID NO: 1334279 - RNA, 20 nt, Mycobacterium tuberculosis H37Rv
aucaccgccgcggccgccgu

SEQ ID NO: 1334280 - RNA, 22 nt, Mycobacterium tuberculosis H37Rv
aucaccgucguacucggcggcc

SEQ ID NO: 1334281 - RNA, 22 nt, Mycobacterium tuberculosis H37Rv
aucaccucgaugccgcccguga

SEQ ID NO: 1334282 - RNA, 14 nt, Mycobacterium tuberculosis H37Rv
aucacgacuccccc

SEQ ID NO: 1334283 - RNA, 20 nt, Mycobacterium tuberculosis H37Rv
auacacauuuccaacguaug

SEQ ID NO: 1334284 - RNA, 15 nt, Mycobacterium tuberculosis H37Rv
auacaccugcuggaa

SEQ ID NO: 1334285 - RNA, 13 nt, Mycobacterium tuberculosis H37Rv
auacagccgccga

SEQ ID NO: 1334286 - RNA, 16 nt, Mycobacterium tuberculosis H37Rv
auacagcaauccgcaa

SEQ ID NO: 1334287 - RNA, 10 nt, Mycobacterium tuberculosis H37Rv
auaacccagc

SEQ ID NO: 1334288 - RNA, 13 nt, Mycobacterium tuberculosis H37Rv
auaacccagcacc

SEQ ID NO: 1334289 - RNA, 14 nt, Mycobacterium tuberculosis H37Rv
auaacgcggaguuc

SEQ ID NO: 1334290 - RNA, 16 nt, Mycobacterium tuberculosis H37Rv
auaacagcaggcauuc

SEQ ID NO: 1334291 - RNA, 21 nt, Mycobacterium tuberculosis H37Rv
aguguccggcgacgcguagca

SEQ ID NO: 1334292 - RNA, 12 nt, Mycobacterium tuberculosis H37Rv
agugucagcaga

SEQ ID NO: 1334293 - RNA, 21 nt, Mycobacterium tuberculosis H37Rv
aguuagccaccuuggacacca

SEQ ID NO: 1334294 - RNA, 16 nt, Mycobacterium tuberculosis H37Rv
aguugcacaccggcac

SEQ ID NO: 1334295 - RNA, 16 nt, Mycobacterium tuberculosis H37Rv
aguucuucgcgaagaa

SEQ ID NO: 1334296 - RNA, 19 nt, Mycobacterium tuberculosis H37Rv
aguucgucgguugccacgc

SEQ ID NO: 1334297 - RNA, 22 nt, Mycobacterium tuberculosis H37Rv
aguucgguugcccccagggccg

SEQ ID NO: 1334298 - RNA, 18 nt, Mycobacterium tuberculosis H37Rv
aguucggugagccgggcg

SEQ ID NO: 1334299 - RNA, 18 nt, Mycobacterium tuberculosis H37Rv
aguucggcccgcaaacag

SEQ ID NO: 1334300 - RNA, 16 nt, Mycobacterium tuberculosis H37Rv
aguucgggcugcggca

SEQ ID NO: 1334301 - RNA, 21 nt, Mycobacterium tuberculosis H37Rv
aguucggccgucauggcccga

SEQ ID NO: 1334302 - RNA, 22 nt, Mycobacterium tuberculosis H37Rv
aguucggcgucuugcaucagcg

SEQ ID NO: 1334303 - RNA, 16 nt, Mycobacterium tuberculosis H37Rv
aguucggccaccaacc

SEQ ID NO: 1334304 - RNA, 13 nt, Mycobacterium tuberculosis H37Rv
aguucggccacca

SEQ ID NO: 1334305 - RNA, 23 nt, Mycobacterium tuberculosis H37Rv
aguugucuggucauggccgaaca

SEQ ID NO: 1334306 - RNA, 16 nt, Mycobacterium tuberculosis H37Rv
aguugugcggccaggc

SEQ ID NO: 1334307 - RNA, 15 nt, Mycobacterium tuberculosis H37Rv
aguugccggucaggc

SEQ ID NO: 1334308 - RNA, 21 nt, Mycobacterium tuberculosis H37Rv
aguuguuggccagaccgcgcg

SEQ ID NO: 1334309 - RNA, 19 nt, Mycobacterium tuberculosis H37Rv
aguuucugcucgaccguca

SEQ ID NO: 1334310 - RNA, 16 nt, Mycobacterium tuberculosis H37Rv
aguuuccagaugcacg

SEQ ID NO: 1334311 - RNA, 13 nt, Mycobacterium tuberculosis H37Rv
agugccuccgaca

SEQ ID NO: 1334312 - RNA, 22 nt, Mycobacterium tuberculosis H37Rv
agugccgccaccgccaccgcgg

SEQ ID NO: 1334313 - RNA, 16 nt, Mycobacterium tuberculosis H37Rv
agugccgccgucgcca

SEQ ID NO: 1334314 - RNA, 21 nt, Mycobacterium tuberculosis H37Rv
agugccucgauuguggccagc

SEQ ID NO: 1334315 - RNA, 17 nt, Mycobacterium tuberculosis H37Rv
agugcgaaauugcuugg

SEQ ID NO: 1334316 - RNA, 22 nt, Mycobacterium tuberculosis H37Rv
agugcgacugcgaaugcugggc

SEQ ID NO: 1334317 - RNA, 23 nt, Mycobacterium tuberculosis H37Rv
agugcgacugcgaaugcugggcc

SEQ ID NO: 1334318 - RNA, 21 nt, Mycobacterium tuberculosis H37Rv
agugcucgcaaucguuggcca

SEQ ID NO: 1334319 - RNA, 20 nt, Mycobacterium tuberculosis H37Rv
agugcuggccgaagaacuca

SEQ ID NO: 1334320 - RNA, 20 nt, Mycobacterium tuberculosis H37Rv
agugcgcgugcccgugguga

SEQ ID NO: 1334321 - RNA, 18 nt, Mycobacterium tuberculosis H37Rv
agugcggaacggccagga

SEQ ID NO: 1334322 - RNA, 13 nt, Mycobacterium tuberculosis H37Rv
agugcuucuuccc

SEQ ID NO: 1334323 - RNA, 22 nt, Mycobacterium tuberculosis H37Rv
agugcugccuugggaccgcgcc

SEQ ID NO: 1334324 - RNA, 15 nt, Mycobacterium tuberculosis H37Rv
aguggugggcguggc

SEQ ID NO: 1334325 - RNA, 17 nt, Mycobacterium tuberculosis H37Rv
aguggugauccagccgu

SEQ ID NO: 1334326 - RNA, 13 nt, Mycobacterium tuberculosis H37Rv
aguggccgccacc

SEQ ID NO: 1334327 - RNA, 14 nt, Mycobacterium tuberculosis H37Rv
agugggugccggca

SEQ ID NO: 1334328 - RNA, 15 nt, Mycobacterium tuberculosis H37Rv
aguggccaccaucac

SEQ ID NO: 1334329 - RNA, 20 nt, Mycobacterium tuberculosis H37Rv
agugaauaccccagaccgcc

SEQ ID NO: 1334330 - RNA, 19 nt, Mycobacterium tuberculosis H37Rv
agugaaucgcggaugccag

SEQ ID NO: 1334331 - RNA, 22 nt, Mycobacterium tuberculosis H37Rv
agugauggcgcggucgcugaug

SEQ ID NO: 1334332 - RNA, 14 nt, Mycobacterium tuberculosis H37Rv
agugauguggcuga

SEQ ID NO: 1334333 - RNA, 14 nt, Mycobacterium tuberculosis H37Rv
agugcaccgccugc

SEQ ID NO: 1334334 - RNA, 17 nt, Mycobacterium tuberculosis H37Rv
agugcacgaaguccugg

SEQ ID NO: 1334335 - RNA, 19 nt, Mycobacterium tuberculosis H37Rv
agugcacagccgggcucuc

SEQ ID NO: 1334336 - RNA, 23 nt, Mycobacterium tuberculosis H37Rv
agugcagcacgauccagcuguac

SEQ ID NO: 1334337 - RNA, 18 nt, Mycobacterium tuberculosis H37Rv
agugcagguuggccugcu

SEQ ID NO: 1334338 - RNA, 12 nt, Mycobacterium tuberculosis H37Rv
agugcagggcug

SEQ ID NO: 1334339 - RNA, 14 nt, Mycobacterium tuberculosis H37Rv
agugcaggcggccg

SEQ ID NO: 1334340 - RNA, 13 nt, Mycobacterium tuberculosis H37Rv
agugccagguggg

SEQ ID NO: 1334341 - RNA, 24 nt, Mycobacterium tuberculosis H37Rv
agugccagcguccgucucgcaggc

SEQ ID NO: 1334342 - RNA, 20 nt, Mycobacterium tuberculosis H37Rv
agugcccgcacugccgccgg

SEQ ID NO: 1334343 - RNA, 15 nt, Mycobacterium tuberculosis H37Rv
agugccgcacccaga

SEQ ID NO: 1334344 - RNA, 22 nt, Mycobacterium tuberculosis H37Rv
agugccaauuccagccccccgg

SEQ ID NO: 1334345 - RNA, 21 nt, Mycobacterium tuberculosis H37Rv
agugccacgccugagccacca

SEQ ID NO: 1334346 - RNA, 13 nt, Mycobacterium tuberculosis H37Rv
agucgggcaaggc

SEQ ID NO: 1334347 - RNA, 23 nt, Mycobacterium tuberculosis H37Rv
agucgggccgguacuugaggguc

SEQ ID NO: 1334348 - RNA, 17 nt, Mycobacterium tuberculosis H37Rv
agucggggugggacagg

SEQ ID NO: 1334349 - RNA, 13 nt, Mycobacterium tuberculosis H37Rv
agucggcaaacaa

SEQ ID NO: 1334350 - RNA, 14 nt, Mycobacterium tuberculosis H37Rv
agucggagcgggga

SEQ ID NO: 1334351 - RNA, 21 nt, Mycobacterium tuberculosis H37Rv
agucggagugguauccaggcc

SEQ ID NO: 1334352 - RNA, 21 nt, Mycobacterium tuberculosis H37Rv
agucggcaaacaacgacuccu

SEQ ID NO: 1334353 - RNA, 20 nt, Mycobacterium tuberculosis H37Rv
agucuccggcgucggcggcc

SEQ ID NO: 1334354 - RNA, 15 nt, Mycobacterium tuberculosis H37Rv
agucuccggaaccac

SEQ ID NO: 1334355 - RNA, 20 nt, Mycobacterium tuberculosis H37Rv
agucuccggaaccacucgcu

SEQ ID NO: 1334356 - RNA, 15 nt, Mycobacterium tuberculosis H37Rv
agucucgacaaagcg

SEQ ID NO: 1334357 - RNA, 13 nt, Mycobacterium tuberculosis H37Rv
agucggugaaaug

SEQ ID NO: 1334358 - RNA, 13 nt, Mycobacterium tuberculosis H37Rv
agucgguccugcc

SEQ ID NO: 1334359 - RNA, 22 nt, Mycobacterium tuberculosis H37Rv
agucgguagcugaccgugcuga

SEQ ID NO: 1334360 - RNA, 22 nt, Mycobacterium tuberculosis H37Rv
agucggugaaaugacggcugaa

SEQ ID NO: 1334361 - RNA, 15 nt, Mycobacterium tuberculosis H37Rv
agucggugaaaugac

SEQ ID NO: 1334362 - RNA, 15 nt, Mycobacterium tuberculosis H37Rv
agugaagacaccagg

SEQ ID NO: 1334363 - RNA, 16 nt, Mycobacterium tuberculosis H37Rv
agucgacggccagugc

SEQ ID NO: 1334364 - RNA, 21 nt, Mycobacterium tuberculosis H37Rv
agucgaccaugagccggcgcc

SEQ ID NO: 1334365 - RNA, 15 nt, Mycobacterium tuberculosis H37Rv
agucgcgggccaagc

SEQ ID NO: 1334366 - RNA, 13 nt, Mycobacterium tuberculosis H37Rv
agucgcugggugg

SEQ ID NO: 1334367 - RNA, 17 nt, Mycobacterium tuberculosis H37Rv
aguccugcagugcggcg

SEQ ID NO: 1334368 - RNA, 20 nt, Mycobacterium tuberculosis H37Rv
aguccgguagcugugguggu

SEQ ID NO: 1334369 - RNA, 13 nt, Mycobacterium tuberculosis H37Rv
aguccguggagcg

SEQ ID NO: 1334370 - RNA, 20 nt, Mycobacterium tuberculosis H37Rv
aguccgcgccgacggccagc

SEQ ID NO: 1334371 - RNA, 13 nt, Mycobacterium tuberculosis H37Rv
aguccggcccccc

SEQ ID NO: 1334372 - RNA, 21 nt, Mycobacterium tuberculosis H37Rv
aguccggcucauccgacggga

SEQ ID NO: 1334373 - RNA, 17 nt, Mycobacterium tuberculosis H37Rv
aguccgccgccugcgca

SEQ ID NO: 1334374 - RNA, 14 nt, Mycobacterium tuberculosis H37Rv
aguccgccgccugc

SEQ ID NO: 1334375 - RNA, 19 nt, Mycobacterium tuberculosis H37Rv
aguccgcacgcggcaaugg

SEQ ID NO: 1334376 - RNA, 19 nt, Mycobacterium tuberculosis H37Rv
agucaaacaaccgugaacu

SEQ ID NO: 1334377 - RNA, 15 nt, Mycobacterium tuberculosis H37Rv
agguuugcgccgcgc

SEQ ID NO: 1334378 - RNA, 18 nt, Mycobacterium tuberculosis H37Rv
agguggaagugcaccugg

SEQ ID NO: 1334379 - RNA, 20 nt, Mycobacterium tuberculosis H37Rv
agguggaagugcaccuggau

SEQ ID NO: 1334380 - RNA, 21 nt, Mycobacterium tuberculosis H37Rv
agguugcaaccuugggcgccg

SEQ ID NO: 1334381 - RNA, 18 nt, Mycobacterium tuberculosis H37Rv
agguuguagucagaaccg

SEQ ID NO: 1334382 - RNA, 14 nt, Mycobacterium tuberculosis H37Rv
agguugggaacagc

SEQ ID NO: 1334383 - RNA, 17 nt, Mycobacterium tuberculosis H37Rv
agguugcguugcaggaa

SEQ ID NO: 1334384 - RNA, 17 nt, Mycobacterium tuberculosis H37Rv
agguugccuuggcggcc

SEQ ID NO: 1334385 - RNA, 16 nt, Mycobacterium tuberculosis H37Rv
agguugcguugcagga

SEQ ID NO: 1334386 - RNA, 21 nt, Mycobacterium tuberculosis H37Rv
aguaaucgaccgaacgccagg

SEQ ID NO: 1334387 - RNA, 21 nt, Mycobacterium tuberculosis H37Rv
aguaccacuguuacggccaca

SEQ ID NO: 1334388 - RNA, 17 nt, Mycobacterium tuberculosis H37Rv
aguagucgcuggccaga

SEQ ID NO: 1334389 - RNA, 23 nt, Mycobacterium tuberculosis H37Rv
aguaguggccgccacccgcaacu

SEQ ID NO: 1334390 - RNA, 12 nt, Mycobacterium tuberculosis H37Rv
aguagugguggg

SEQ ID NO: 1334391 - RNA, 11 nt, Mycobacterium tuberculosis H37Rv
aguagcugacc

SEQ ID NO: 1334392 - RNA, 14 nt, Mycobacterium tuberculosis H37Rv
aguagcugaccauc

SEQ ID NO: 1334393 - RNA, 21 nt, Mycobacterium tuberculosis H37Rv
aguaggcuucgaccguggugg

SEQ ID NO: 1334394 - RNA, 17 nt, Mycobacterium tuberculosis H37Rv
aguagcacguugacguc

SEQ ID NO: 1334395 - RNA, 23 nt, Mycobacterium tuberculosis H37Rv
aguagccgaccaggaccaccgca

SEQ ID NO: 1334396 - RNA, 21 nt, Mycobacterium tuberculosis H37Rv
aguagccggucggcaccacca

SEQ ID NO: 1334397 - RNA, 16 nt, Mycobacterium tuberculosis H37Rv
aguaccccuuggacug

SEQ ID NO: 1334398 - RNA, 15 nt, Mycobacterium tuberculosis H37Rv
aguauggccgccacc

SEQ ID NO: 1334399 - RNA, 13 nt, Mycobacterium tuberculosis H37Rv
aggcggcaaggac

SEQ ID NO: 1334400 - RNA, 18 nt, Mycobacterium tuberculosis H37Rv
aggcuuuccggggaauga

SEQ ID NO: 1334401 - RNA, 22 nt, Mycobacterium tuberculosis H37Rv
agggaauccgaacucgcgggcg

SEQ ID NO: 1334402 - RNA, 19 nt, Mycobacterium tuberculosis H37Rv
agggagcgccgcagggucc

SEQ ID NO: 1334403 - RNA, 14 nt, Mycobacterium tuberculosis H37Rv
agggagugccgcac

SEQ ID NO: 1334404 - RNA, 16 nt, Mycobacterium tuberculosis H37Rv
agggcggccgcgguga

SEQ ID NO: 1334405 - RNA, 14 nt, Mycobacterium tuberculosis H37Rv
agggccgcgaucga

SEQ ID NO: 1334406 - RNA, 12 nt, Mycobacterium tuberculosis H37Rv
agggccgccauc

SEQ ID NO: 1334407 - RNA, 23 nt, Mycobacterium tuberculosis H37Rv
agggccgccgcgaacgggucggg

SEQ ID NO: 1334408 - RNA, 18 nt, Mycobacterium tuberculosis H37Rv
agggccgccgcugccgcc

SEQ ID NO: 1334409 - RNA, 19 nt, Mycobacterium tuberculosis H37Rv
agggcggugccaucgggcg

SEQ ID NO: 1334410 - RNA, 13 nt, Mycobacterium tuberculosis H37Rv
agggcccuggcgg

SEQ ID NO: 1334411 - RNA, 15 nt, Mycobacterium tuberculosis H37Rv
agggcguuggcggcu

SEQ ID NO: 1334412 - RNA, 18 nt, Mycobacterium tuberculosis H37Rv
agggcgucgaacucaucu

SEQ ID NO: 1334413 - RNA, 14 nt, Mycobacterium tuberculosis H37Rv
agggccagcggcag

SEQ ID NO: 1334414 - RNA, 18 nt, Mycobacterium tuberculosis H37Rv
agggccgagcagcuccuu

SEQ ID NO: 1334415 - RNA, 20 nt, Mycobacterium tuberculosis H37Rv
agggccccaccgagcgguga

SEQ ID NO: 1334416 - RNA, 21 nt, Mycobacterium tuberculosis H37Rv
agggccaccgccgccugcccg

SEQ ID NO: 1334417 - RNA, 19 nt, Mycobacterium tuberculosis H37Rv
agggcauugcggcccgcga

SEQ ID NO: 1334418 - RNA, 22 nt, Mycobacterium tuberculosis H37Rv
agggcacggcgguguguuccaa

SEQ ID NO: 1334419 - RNA, 15 nt, Mycobacterium tuberculosis H37Rv
agggcaccggcgauc

SEQ ID NO: 1334420 - RNA, 18 nt, Mycobacterium tuberculosis H37Rv
agggcugucguuugacga

SEQ ID NO: 1334421 - RNA, 21 nt, Mycobacterium tuberculosis H37Rv
agggcugacgggaugguuccg

SEQ ID NO: 1334422 - RNA, 15 nt, Mycobacterium tuberculosis H37Rv
agggcucggcggccc

SEQ ID NO: 1334423 - RNA, 12 nt, Mycobacterium tuberculosis H37Rv
agggcuccaccg

SEQ ID NO: 1334424 - RNA, 15 nt, Mycobacterium tuberculosis H37Rv
aggggcaacagggga

SEQ ID NO: 1334425 - RNA, 11 nt, Mycobacterium tuberculosis H37Rv
agggguuggcg

SEQ ID NO: 1334426 - RNA, 16 nt, Mycobacterium tuberculosis H37Rv
agggguggcgcgggcc

SEQ ID NO: 1334427 - RNA, 20 nt, Mycobacterium tuberculosis H37Rv
agggguggcgcgggccggcg

SEQ ID NO: 1334428 - RNA, 23 nt, Mycobacterium tuberculosis H37Rv
aggugcuggugaucugcugggca

SEQ ID NO: 1334429 - RNA, 15 nt, Mycobacterium tuberculosis H37Rv
aggugcaucgccaca

SEQ ID NO: 1334430 - RNA, 15 nt, Mycobacterium tuberculosis H37Rv
aggugaucagcagga

SEQ ID NO: 1334431 - RNA, 17 nt, Mycobacterium tuberculosis H37Rv
aggugaucggaagaaac

SEQ ID NO: 1334432 - RNA, 15 nt, Mycobacterium tuberculosis H37Rv
aggugaugccgccgu

SEQ ID NO: 1334433 - RNA, 16 nt, Mycobacterium tuberculosis H37Rv
aggugaugaacaccgg

SEQ ID NO: 1334434 - RNA, 13 nt, Mycobacterium tuberculosis H37Rv
aggucggcgauga

SEQ ID NO: 1334435 - RNA, 12 nt, Mycobacterium tuberculosis H37Rv
aggucggccacc

SEQ ID NO: 1334436 - RNA, 16 nt, Mycobacterium tuberculosis H37Rv
aggucgguaccccagc

SEQ ID NO: 1334437 - RNA, 20 nt, Mycobacterium tuberculosis H37Rv
aggucgguaccccagcgcug

SEQ ID NO: 1334438 - RNA, 19 nt, Mycobacterium tuberculosis H37Rv
aggucggggaacgcggcga

SEQ ID NO: 1334439 - RNA, 19 nt, Mycobacterium tuberculosis H37Rv
agguccccacauggcccgg

SEQ ID NO: 1334440 - RNA, 16 nt, Mycobacterium tuberculosis H37Rv
aggucgaucugcgcca

SEQ ID NO: 1334441 - RNA, 15 nt, Mycobacterium tuberculosis H37Rv
aggucccggcuggga

SEQ ID NO: 1334442 - RNA, 20 nt, Mycobacterium tuberculosis H37Rv
aggucgccgcaacaugggug

SEQ ID NO: 1334443 - RNA, 17 nt, Mycobacterium tuberculosis H37Rv
aggucgcggucgagcag

SEQ ID NO: 1334444 - RNA, 22 nt, Mycobacterium tuberculosis H37Rv
aggucgccggccacgaccucuu

SEQ ID NO: 1334445 - RNA, 13 nt, Mycobacterium tuberculosis H37Rv
agguacgccucga

SEQ ID NO: 1334446 - RNA, 15 nt, Mycobacterium tuberculosis H37Rv
agguacccggucggg

SEQ ID NO: 1334447 - RNA, 20 nt, Mycobacterium tuberculosis H37Rv
agguacccggucggguccaa

SEQ ID NO: 1334448 - RNA, 17 nt, Mycobacterium tuberculosis H37Rv
agguauaaacgcggcgc

SEQ ID NO: 1334449 - RNA, 22 nt, Mycobacterium tuberculosis H37Rv
agguagucggcgcgucguugcc

SEQ ID NO: 1334450 - RNA, 20 nt, Mycobacterium tuberculosis H37Rv
agguacuuugcgcccggcac

SEQ ID NO: 1334451 - RNA, 15 nt, Mycobacterium tuberculosis H37Rv
agggugccgucgggu

SEQ ID NO: 1334452 - RNA, 16 nt, Mycobacterium tuberculosis H37Rv
agguaagcagccagca

SEQ ID NO: 1334453 - RNA, 23 nt, Mycobacterium tuberculosis H37Rv
aggguagacggggcgagcaugcc

SEQ ID NO: 1334454 - RNA, 22 nt, Mycobacterium tuberculosis H37Rv
aggguaucgaaaaguagaccga

SEQ ID NO: 1334455 - RNA, 18 nt, Mycobacterium tuberculosis H37Rv
agggugacccccaauccu

SEQ ID NO: 1334456 - RNA, 13 nt, Mycobacterium tuberculosis H37Rv
agggugcccgcgu

SEQ ID NO: 1334457 - RNA, 17 nt, Mycobacterium tuberculosis H37Rv
agggugcccucggccgc

SEQ ID NO: 1334458 - RNA, 21 nt, Mycobacterium tuberculosis H37Rv
aggccgccaucgccgccaacc

SEQ ID NO: 1334459 - RNA, 18 nt, Mycobacterium tuberculosis H37Rv
aggccgcaugccacggca

SEQ ID NO: 1334460 - RNA, 22 nt, Mycobacterium tuberculosis H37Rv
aggccggcggucagcagcgccg

SEQ ID NO: 1334461 - RNA, 21 nt, Mycobacterium tuberculosis H37Rv
aggccggcgucgaucaacaac

SEQ ID NO: 1334462 - RNA, 13 nt, Mycobacterium tuberculosis H37Rv
aggccggcucgcu

SEQ ID NO: 1334463 - RNA, 16 nt, Mycobacterium tuberculosis H37Rv
aggccggguggccacg

SEQ ID NO: 1334464 - RNA, 17 nt, Mycobacterium tuberculosis H37Rv
aggccgggccggccacg

SEQ ID NO: 1334465 - RNA, 23 nt, Mycobacterium tuberculosis H37Rv
aggccggugcgucacagccgggu

SEQ ID NO: 1334466 - RNA, 13 nt, Mycobacterium tuberculosis H37Rv
aggccgucaggcg

SEQ ID NO: 1334467 - RNA, 16 nt, Mycobacterium tuberculosis H37Rv
aggccgucgacccagc

SEQ ID NO: 1334468 - RNA, 13 nt, Mycobacterium tuberculosis H37Rv
aggccgcaccgcc

SEQ ID NO: 1334469 - RNA, 13 nt, Mycobacterium tuberculosis H37Rv
aggccgcaaugcg

SEQ ID NO: 1334470 - RNA, 23 nt, Mycobacterium tuberculosis H37Rv
aggcccaucaucuuugcguacaa

SEQ ID NO: 1334471 - RNA, 12 nt, Mycobacterium tuberculosis H37Rv
aggccgagcaga

SEQ ID NO: 1334472 - RNA, 14 nt, Mycobacterium tuberculosis H37Rv
aggccgaccgcgca

SEQ ID NO: 1334473 - RNA, 19 nt, Mycobacterium tuberculosis H37Rv
aggccccccgcgccugccu

SEQ ID NO: 1334474 - RNA, 22 nt, Mycobacterium tuberculosis H37Rv
aggccccggugccgaccgguug

SEQ ID NO: 1334475 - RNA, 22 nt, Mycobacterium tuberculosis H37Rv
aggccuaguccggcacugcggc

SEQ ID NO: 1334476 - RNA, 14 nt, Mycobacterium tuberculosis H37Rv
aggccuccaaaauc

SEQ ID NO: 1334477 - RNA, 13 nt, Mycobacterium tuberculosis H37Rv
aggccuccacaua

SEQ ID NO: 1334478 - RNA, 15 nt, Mycobacterium tuberculosis H37Rv
aggccucggccagcg

SEQ ID NO: 1334479 - RNA, 13 nt, Mycobacterium tuberculosis H37Rv
aggcgaaaucgga

SEQ ID NO: 1334480 - RNA, 16 nt, Mycobacterium tuberculosis H37Rv
aggcgacggcucuacc

SEQ ID NO: 1334481 - RNA, 16 nt, Mycobacterium tuberculosis H37Rv
aggcgauugcgccgca

SEQ ID NO: 1334482 - RNA, 17 nt, Mycobacterium tuberculosis H37Rv
aggcgauugcgccgcac

SEQ ID NO: 1334483 - RNA, 21 nt, Mycobacterium tuberculosis H37Rv
aggcgaucgcccggccccgca

SEQ ID NO: 1334484 - RNA, 14 nt, Mycobacterium tuberculosis H37Rv
aggcgaucgcaucc

SEQ ID NO: 1334485 - RNA, 16 nt, Mycobacterium tuberculosis H37Rv
aggcgcagcgccagcg

SEQ ID NO: 1334486 - RNA, 15 nt, Mycobacterium tuberculosis H37Rv
aggcgccgcagggcc

SEQ ID NO: 1334487 - RNA, 22 nt, Mycobacterium tuberculosis H37Rv
aggcgccacugcuuccggaaca

SEQ ID NO: 1334488 - RNA, 23 nt, Mycobacterium tuberculosis H37Rv
aggcgccacgguguacgcgaacc

SEQ ID NO: 1334489 - RNA, 12 nt, Mycobacterium tuberculosis H37Rv
aggcgcccacaa

SEQ ID NO: 1334490 - RNA, 13 nt, Mycobacterium tuberculosis H37Rv
aggcgcccagcac

SEQ ID NO: 1334491 - RNA, 17 nt, Mycobacterium tuberculosis H37Rv
aggcgcccaacaggcgg

SEQ ID NO: 1334492 - RNA, 14 nt, Mycobacterium tuberculosis H37Rv
aggcgcugcagcau

SEQ ID NO: 1334493 - RNA, 13 nt, Mycobacterium tuberculosis H37Rv
aggcgcgccgcac

SEQ ID NO: 1334494 - RNA, 19 nt, Mycobacterium tuberculosis H37Rv
aggccaccacugcgcccgc

SEQ ID NO: 1334495 - RNA, 18 nt, Mycobacterium tuberculosis H37Rv
aggccaacuuggcggcca

SEQ ID NO: 1334496 - RNA, 21 nt, Mycobacterium tuberculosis H37Rv
aggccacgcaccgggugcagg

SEQ ID NO: 1334497 - RNA, 12 nt, Mycobacterium tuberculosis H37Rv
aggcccagcacg

SEQ ID NO: 1334498 - RNA, 14 nt, Mycobacterium tuberculosis H37Rv
aggccagagccgcc

SEQ ID NO: 1334499 - RNA, 18 nt, Mycobacterium tuberculosis H37Rv
aggccaagguggccacca

SEQ ID NO: 1334500 - RNA, 13 nt, Mycobacterium tuberculosis H37Rv
aggccaacugggc

SEQ ID NO: 1334501 - RNA, 16 nt, Mycobacterium tuberculosis H37Rv
aggccaacccugcggc

SEQ ID NO: 1334502 - RNA, 14 nt, Mycobacterium tuberculosis H37Rv
aggcaugccacaca

SEQ ID NO: 1334503 - RNA, 20 nt, Mycobacterium tuberculosis H37Rv
aggcauucccgcggcaacgc

SEQ ID NO: 1334504 - RNA, 13 nt, Mycobacterium tuberculosis H37Rv
aggcacccgugcc

SEQ ID NO: 1334505 - RNA, 16 nt, Mycobacterium tuberculosis H37Rv
aggcacccuguacgaa

SEQ ID NO: 1334506 - RNA, 13 nt, Mycobacterium tuberculosis H37Rv
aggcacguucagc

SEQ ID NO: 1334507 - RNA, 18 nt, Mycobacterium tuberculosis H37Rv
aggcacuagacugcuggu

SEQ ID NO: 1334508 - RNA, 16 nt, Mycobacterium tuberculosis H37Rv
aggagcuggcugacga

SEQ ID NO: 1334509 - RNA, 23 nt, Mycobacterium tuberculosis H37Rv
aggauucgcgcgaauguccggca

SEQ ID NO: 1334510 - RNA, 18 nt, Mycobacterium tuberculosis H37Rv
aggauuugauaggcgcgc

SEQ ID NO: 1334511 - RNA, 14 nt, Mycobacterium tuberculosis H37Rv
aggauugccgagcg

SEQ ID NO: 1334512 - RNA, 13 nt, Mycobacterium tuberculosis H37Rv
aggcaagccagca

SEQ ID NO: 1334513 - RNA, 15 nt, Mycobacterium tuberculosis H37Rv
agcugccgcaccccc

SEQ ID NO: 1334514 - RNA, 17 nt, Mycobacterium tuberculosis H37Rv
agcugccguuggggugg

SEQ ID NO: 1334515 - RNA, 16 nt, Mycobacterium tuberculosis H37Rv
agcugcucgccggcca

SEQ ID NO: 1334516 - RNA, 15 nt, Mycobacterium tuberculosis H37Rv
agcugcucgagcaga

SEQ ID NO: 1334517 - RNA, 18 nt, Mycobacterium tuberculosis H37Rv
agcugcuggcgcgccugu

SEQ ID NO: 1334518 - RNA, 19 nt, Mycobacterium tuberculosis H37Rv
agcuccaaccaugcgguua

SEQ ID NO: 1334519 - RNA, 15 nt, Mycobacterium tuberculosis H37Rv
agcuccaaccaugcg

SEQ ID NO: 1334520 - RNA, 20 nt, Mycobacterium tuberculosis H37Rv
agcugugaacaggccgaggc

SEQ ID NO: 1334521 - RNA, 20 nt, Mycobacterium tuberculosis H37Rv
agcugucggcuuccuccucg

SEQ ID NO: 1334522 - RNA, 18 nt, Mycobacterium tuberculosis H37Rv
agcuguccucgcgggcuu

SEQ ID NO: 1334523 - RNA, 22 nt, Mycobacterium tuberculosis H37Rv
agcuggucccacaccuccucga

SEQ ID NO: 1334524 - RNA, 12 nt, Mycobacterium tuberculosis H37Rv
agcuggucccac

SEQ ID NO: 1334525 - RNA, 20 nt, Mycobacterium tuberculosis H37Rv
agcuggucggcuucggggua

SEQ ID NO: 1334526 - RNA, 14 nt, Mycobacterium tuberculosis H37Rv
agcugguggugcgg

SEQ ID NO: 1334527 - RNA, 22 nt, Mycobacterium tuberculosis H37Rv
agcugguaggucaccggucacc

SEQ ID NO: 1334528 - RNA, 21 nt, Mycobacterium tuberculosis H37Rv
agcuuaggcgugguucccggc

SEQ ID NO: 1334529 - RNA, 12 nt, Mycobacterium tuberculosis H37Rv
agcuucgccagg

SEQ ID NO: 1334530 - RNA, 15 nt, Mycobacterium tuberculosis H37Rv
agcuuggucgccggg

SEQ ID NO: 1334531 - RNA, 23 nt, Mycobacterium tuberculosis H37Rv
agcuuggucgccaugucggccag

SEQ ID NO: 1334532 - RNA, 15 nt, Mycobacterium tuberculosis H37Rv
agcuugucgggcacc

SEQ ID NO: 1334533 - RNA, 14 nt, Mycobacterium tuberculosis H37Rv
agcuugucgagcag

SEQ ID NO: 1334534 - RNA, 19 nt, Mycobacterium tuberculosis H37Rv
agcuugacguugccgggcu

SEQ ID NO: 1334535 - RNA, 20 nt, Mycobacterium tuberculosis H37Rv
aggacaccaccguggccucg

SEQ ID NO: 1334536 - RNA, 15 nt, Mycobacterium tuberculosis H37Rv
aggacaccagcugga

SEQ ID NO: 1334537 - RNA, 23 nt, Mycobacterium tuberculosis H37Rv
aggacacguggugggcgcagagu

SEQ ID NO: 1334538 - RNA, 16 nt, Mycobacterium tuberculosis H37Rv
aggacaauggacacca

SEQ ID NO: 1334539 - RNA, 16 nt, Mycobacterium tuberculosis H37Rv
aggacaagccgcugau

SEQ ID NO: 1334540 - RNA, 20 nt, Mycobacterium tuberculosis H37Rv
aggacagcugguugugcugg

SEQ ID NO: 1334541 - RNA, 15 nt, Mycobacterium tuberculosis H37Rv
aggacacauugacca

SEQ ID NO: 1334542 - RNA, 20 nt, Mycobacterium tuberculosis H37Rv
aggaaguagaugagcagacc

SEQ ID NO: 1334543 - RNA, 18 nt, Mycobacterium tuberculosis H37Rv
aggaagucccgggcaccg

SEQ ID NO: 1334544 - RNA, 23 nt, Mycobacterium tuberculosis H37Rv
aggaagggcuaucguggcggcgu

SEQ ID NO: 1334545 - RNA, 15 nt, Mycobacterium tuberculosis H37Rv
aggacaucacgaagg

SEQ ID NO: 1334546 - RNA, 15 nt, Mycobacterium tuberculosis H37Rv
aggacuggcaccgcc

SEQ ID NO: 1334547 - RNA, 17 nt, Mycobacterium tuberculosis H37Rv
aggacuggaaagcagca

SEQ ID NO: 1334548 - RNA, 14 nt, Mycobacterium tuberculosis H37Rv
aggacuucugcugc

SEQ ID NO: 1334549 - RNA, 13 nt, Mycobacterium tuberculosis H37Rv
aggagaucagcac

SEQ ID NO: 1334550 - RNA, 13 nt, Mycobacterium tuberculosis H37Rv
aggagaccacggc

SEQ ID NO: 1334551 - RNA, 11 nt, Mycobacterium tuberculosis H37Rv
aggaaccgggc

SEQ ID NO: 1334552 - RNA, 19 nt, Mycobacterium tuberculosis H37Rv
aggaaccgggcaaaucaag

SEQ ID NO: 1334553 - RNA, 22 nt, Mycobacterium tuberculosis H37Rv
aggaaccgggcaaaucaagcac

SEQ ID NO: 1334554 - RNA, 15 nt, Mycobacterium tuberculosis H37Rv
aggaaccgucgaaga

SEQ ID NO: 1334555 - RNA, 22 nt, Mycobacterium tuberculosis H37Rv
aggaaccgucgaagaugaccug

SEQ ID NO: 1334556 - RNA, 21 nt, Mycobacterium tuberculosis H37Rv
aggaaccacccaccggccacc

SEQ ID NO: 1334557 - RNA, 18 nt, Mycobacterium tuberculosis H37Rv
aggaacucggacccaccc

SEQ ID NO: 1334558 - RNA, 15 nt, Mycobacterium tuberculosis H37Rv
aggaacucggaccca

SEQ ID NO: 1334559 - RNA, 17 nt, Mycobacterium tuberculosis H37Rv
aggaagaucaccucccg

SEQ ID NO: 1334560 - RNA, 17 nt, Mycobacterium tuberculosis H37Rv
aggaagcggccggugga

SEQ ID NO: 1334561 - RNA, 21 nt, Mycobacterium tuberculosis H37Rv
agcuuucuuggcgggcgccuu

SEQ ID NO: 1334562 - RNA, 14 nt, Mycobacterium tuberculosis H37Rv
agcuuguugcagcg

SEQ ID NO: 1334563 - RNA, 17 nt, Mycobacterium tuberculosis H37Rv
agaaacccggcgaccac

SEQ ID NO: 1334564 - RNA, 23 nt, Mycobacterium tuberculosis H37Rv
agaaacccucggggguccaguuc

SEQ ID NO: 1334565 - RNA, 14 nt, Mycobacterium tuberculosis H37Rv
agaaacccugcugc

SEQ ID NO: 1334566 - RNA, 21 nt, Mycobacterium tuberculosis H37Rv
agaaaacauugcggcccucga

SEQ ID NO: 1334567 - RNA, 14 nt, Mycobacterium tuberculosis H37Rv
agaaggaccgcucg

SEQ ID NO: 1334568 - RNA, 15 nt, Mycobacterium tuberculosis H37Rv
agaaggaucagcgca

SEQ ID NO: 1334569 - RNA, 20 nt, Mycobacterium tuberculosis H37Rv
agaaggaucagcgcacuggc

SEQ ID NO: 1334570 - RNA, 17 nt, Mycobacterium tuberculosis H37Rv
agaagauggcaccgccc

SEQ ID NO: 1334571 - RNA, 21 nt, Mycobacterium tuberculosis H37Rv
agaagcagggauucuggaugc

SEQ ID NO: 1334572 - RNA, 18 nt, Mycobacterium tuberculosis H37Rv
agaaccggucgcagugca

SEQ ID NO: 1334573 - RNA, 19 nt, Mycobacterium tuberculosis H37Rv
agaaccggucgcagugcac

SEQ ID NO: 1334574 - RNA, 12 nt, Mycobacterium tuberculosis H37Rv
agaacuggcugc

SEQ ID NO: 1334575 - RNA, 16 nt, Mycobacterium tuberculosis H37Rv
agaacuggcugcuguu

SEQ ID NO: 1334576 - RNA, 19 nt, Mycobacterium tuberculosis H37Rv
agaacucguugagcagcug

SEQ ID NO: 1334577 - RNA, 22 nt, Mycobacterium tuberculosis H37Rv
agaacucggcgucgugguggcc

SEQ ID NO: 1334578 - RNA, 17 nt, Mycobacterium tuberculosis H37Rv
agaaccgacggccagca

SEQ ID NO: 1334579 - RNA, 16 nt, Mycobacterium tuberculosis H37Rv
agaacaccaccgccag

SEQ ID NO: 1334580 - RNA, 18 nt, Mycobacterium tuberculosis H37Rv
agacacggcagcugcaau

SEQ ID NO: 1334581 - RNA, 18 nt, Mycobacterium tuberculosis H37Rv
agacacuaaagcccucga

SEQ ID NO: 1334582 - RNA, 18 nt, Mycobacterium tuberculosis H37Rv
agacaccggcuauauccc

SEQ ID NO: 1334583 - RNA, 21 nt, Mycobacterium tuberculosis H37Rv
agacagccguuguacauagcc

SEQ ID NO: 1334584 - RNA, 20 nt, Mycobacterium tuberculosis H37Rv
agacaccggcuauaucccgc

SEQ ID NO: 1334585 - RNA, 22 nt, Mycobacterium tuberculosis H37Rv
agacacgcccuaacccugcccu

SEQ ID NO: 1334586 - RNA, 13 nt, Mycobacterium tuberculosis H37Rv
agacaaaggugcc

SEQ ID NO: 1334587 - RNA, 13 nt, Mycobacterium tuberculosis H37Rv
agacaacaacacg

SEQ ID NO: 1334588 - RNA, 15 nt, Mycobacterium tuberculosis H37Rv
agaaggcgcgggcga

SEQ ID NO: 1334589 - RNA, 16 nt, Mycobacterium tuberculosis H37Rv
agaauccggcaaccac

SEQ ID NO: 1334590 - RNA, 18 nt, Mycobacterium tuberculosis H37Rv
agaaucccgcucccauga

SEQ ID NO: 1334591 - RNA, 13 nt, Mycobacterium tuberculosis H37Rv
agaauccaggugg

SEQ ID NO: 1334592 - RNA, 14 nt, Mycobacterium tuberculosis H37Rv
agaccgcggcggcc

SEQ ID NO: 1334593 - RNA, 15 nt, Mycobacterium tuberculosis H37Rv
agaccgcgaacagcg

SEQ ID NO: 1334594 - RNA, 21 nt, Mycobacterium tuberculosis H37Rv
agaccgcgugcucgagcaccu

SEQ ID NO: 1334595 - RNA, 16 nt, Mycobacterium tuberculosis H37Rv
agaccgaucggcaggc

SEQ ID NO: 1334596 - RNA, 23 nt, Mycobacterium tuberculosis H37Rv
agaccaugaagaacuggcugcug

SEQ ID NO: 1334597 - RNA, 16 nt, Mycobacterium tuberculosis H37Rv
agaccauggucauguu

SEQ ID NO: 1334598 - RNA, 18 nt, Mycobacterium tuberculosis H37Rv
agaccuggccugcggcag

SEQ ID NO: 1334599 - RNA, 20 nt, Mycobacterium tuberculosis H37Rv
agacgcacggccaccgcgca

SEQ ID NO: 1334600 - RNA, 15 nt, Mycobacterium tuberculosis H37Rv
agacgcacggccacc

SEQ ID NO: 1334601 - RNA, 19 nt, Mycobacterium tuberculosis H37Rv
agacgauggcaacggcauc

SEQ ID NO: 1334602 - RNA, 20 nt, Mycobacterium tuberculosis H37Rv
agacgcaaaauccccucgca

SEQ ID NO: 1334603 - RNA, 12 nt, Mycobacterium tuberculosis H37Rv
agacgccgccgu

SEQ ID NO: 1334604 - RNA, 21 nt, Mycobacterium tuberculosis H37Rv
agacgccacugccagccgugc

SEQ ID NO: 1334605 - RNA, 17 nt, Mycobacterium tuberculosis H37Rv
agacgguguugccuagg

SEQ ID NO: 1334606 - RNA, 19 nt, Mycobacterium tuberculosis H37Rv
agacaggcggcggccuggc

SEQ ID NO: 1334607 - RNA, 17 nt, Mycobacterium tuberculosis H37Rv
agaccagcaggcccugg

SEQ ID NO: 1334608 - RNA, 14 nt, Mycobacterium tuberculosis H37Rv
agaccagcaggccc

SEQ ID NO: 1334609 - RNA, 17 nt, Mycobacterium tuberculosis H37Rv
agaccagacugcagugc

SEQ ID NO: 1334610 - RNA, 16 nt, Mycobacterium tuberculosis H37Rv
agaccaaggcgaaggu

SEQ ID NO: 1334611 - RNA, 15 nt, Mycobacterium tuberculosis H37Rv
agacgugccaaugau

SEQ ID NO: 1334612 - RNA, 19 nt, Mycobacterium tuberculosis H37Rv
agacguccgcggucgcagc

SEQ ID NO: 1334613 - RNA, 14 nt, Mycobacterium tuberculosis H37Rv
agacguccugggcc

SEQ ID NO: 1334614 - RNA, 12 nt, Mycobacterium tuberculosis H37Rv
agagcagcagcg

SEQ ID NO: 1334615 - RNA, 15 nt, Mycobacterium tuberculosis H37Rv
agagcaggcccauac

SEQ ID NO: 1334616 - RNA, 17 nt, Mycobacterium tuberculosis H37Rv
agagcacgucaacagcc

SEQ ID NO: 1334617 - RNA, 19 nt, Mycobacterium tuberculosis H37Rv
agagcacgucaacagccag

SEQ ID NO: 1334618 - RNA, 20 nt, Mycobacterium tuberculosis H37Rv
agagggcggggcagaagucg

SEQ ID NO: 1334619 - RNA, 15 nt, Mycobacterium tuberculosis H37Rv
agagguagagcagau

SEQ ID NO: 1334620 - RNA, 12 nt, Mycobacterium tuberculosis H37Rv
agaggcccgcgg

SEQ ID NO: 1334621 - RNA, 18 nt, Mycobacterium tuberculosis H37Rv
agaggcgcaccuccugcg

SEQ ID NO: 1334622 - RNA, 18 nt, Mycobacterium tuberculosis H37Rv
agaggauggucagcagcu

SEQ ID NO: 1334623 - RNA, 14 nt, Mycobacterium tuberculosis H37Rv
agaggauggucagc

SEQ ID NO: 1334624 - RNA, 12 nt, Mycobacterium tuberculosis H37Rv
agauaugcagga

SEQ ID NO: 1334625 - RNA, 22 nt, Mycobacterium tuberculosis H37Rv
agaucagcaugguccacagccg

SEQ ID NO: 1334626 - RNA, 21 nt, Mycobacterium tuberculosis H37Rv
agaucagccucgcgggcaggg

SEQ ID NO: 1334627 - RNA, 18 nt, Mycobacterium tuberculosis H37Rv
agaucagccucgcgggca

SEQ ID NO: 1334628 - RNA, 18 nt, Mycobacterium tuberculosis H37Rv
agauacgcguguggcaga

SEQ ID NO: 1334629 - RNA, 14 nt, Mycobacterium tuberculosis H37Rv
agauacggccacca

SEQ ID NO: 1334630 - RNA, 15 nt, Mycobacterium tuberculosis H37Rv
agaguucgcgcgccg

SEQ ID NO: 1334631 - RNA, 19 nt, Mycobacterium tuberculosis H37Rv
agaguuggggcacaaccgg

SEQ ID NO: 1334632 - RNA, 14 nt, Mycobacterium tuberculosis H37Rv
aaaacccaacaccc

SEQ ID NO: 1334633 - RNA, 21 nt, Mycobacterium tuberculosis H37Rv
aaaacccggugaccagcaacc

SEQ ID NO: 1334634 - RNA, 12 nt, Mycobacterium tuberculosis H37Rv
aaaaccgcaccg

SEQ ID NO: 1334635 - RNA, 19 nt, Mycobacterium tuberculosis H37Rv
aaaaccgcaccgucccagu

SEQ ID NO: 1334636 - RNA, 12 nt, Mycobacterium tuberculosis H37Rv
aaaaccgcgaac

SEQ ID NO: 1334637 - RNA, 13 nt, Mycobacterium tuberculosis H37Rv
agauggcgaucau

SEQ ID NO: 1334638 - RNA, 18 nt, Mycobacterium tuberculosis H37Rv
agauggcgcgcugggcug

SEQ ID NO: 1334639 - RNA, 22 nt, Mycobacterium tuberculosis H37Rv
agauggcgaucaugagcagcac

SEQ ID NO: 1334640 - RNA, 21 nt, Mycobacterium tuberculosis H37Rv
agauggcgaucaugagcagca

SEQ ID NO: 1334641 - RNA, 19 nt, Mycobacterium tuberculosis H37Rv
agauggcauugcgcccacc

SEQ ID NO: 1334642 - RNA, 22 nt, Mycobacterium tuberculosis H37Rv
agauguccucccauucccaaca

SEQ ID NO: 1334643 - RNA, 21 nt, Mycobacterium tuberculosis H37Rv
agaugccgcgaucgugcaggu

SEQ ID NO: 1334644 - RNA, 19 nt, Mycobacterium tuberculosis H37Rv
agaugccugcuagcagcag

SEQ ID NO: 1334645 - RNA, 16 nt, Mycobacterium tuberculosis H37Rv
agaugcauccagcugc

SEQ ID NO: 1334646 - RNA, 12 nt, Mycobacterium tuberculosis H37Rv
agaugccgggcu

SEQ ID NO: 1334647 - RNA, 16 nt, Mycobacterium tuberculosis H37Rv
agaugcccagcaggaa

SEQ ID NO: 1334648 - RNA, 14 nt, Mycobacterium tuberculosis H37Rv
agauucauuggccu

SEQ ID NO: 1334649 - RNA, 15 nt, Mycobacterium tuberculosis H37Rv
agauucggugccagc

SEQ ID NO: 1334650 - RNA, 20 nt, Mycobacterium tuberculosis H37Rv
agauugguggcccgggccac

SEQ ID NO: 1334651 - RNA, 16 nt, Mycobacterium tuberculosis H37Rv
agauuggcgcugcccg

SEQ ID NO: 1334652 - RNA, 17 nt, Mycobacterium tuberculosis H37Rv
agauugugagcaauggc

SEQ ID NO: 1334653 - RNA, 18 nt, Mycobacterium tuberculosis H37Rv
agcaacagcgcgguguuc

SEQ ID NO: 1334654 - RNA, 16 nt, Mycobacterium tuberculosis H37Rv
agcaaagccagcgcag

SEQ ID NO: 1334655 - RNA, 20 nt, Mycobacterium tuberculosis H37Rv
agcaaaggggugugugcugc

SEQ ID NO: 1334656 - RNA, 14 nt, Mycobacterium tuberculosis H37Rv
agcaaaauggccac

SEQ ID NO: 1334657 - RNA, 16 nt, Mycobacterium tuberculosis H37Rv
agcaaacgaggauuca

SEQ ID NO: 1334658 - RNA, 16 nt, Mycobacterium tuberculosis H37Rv
agcaaaccagauugcc

SEQ ID NO: 1334659 - RNA, 15 nt, Mycobacterium tuberculosis H37Rv
agcaaaaacauugcu

SEQ ID NO: 1334660 - RNA, 14 nt, Mycobacterium tuberculosis H37Rv
agccuggccucgcc

SEQ ID NO: 1334661 - RNA, 12 nt, Mycobacterium tuberculosis H37Rv
agccugugcugc

SEQ ID NO: 1334662 - RNA, 16 nt, Mycobacterium tuberculosis H37Rv
agccuuucgugcaccg

SEQ ID NO: 1334663 - RNA, 21 nt, Mycobacterium tuberculosis H37Rv
agccgcauaggccccgccagc

SEQ ID NO: 1334664 - RNA, 16 nt, Mycobacterium tuberculosis H37Rv
agccgcagcuuggccu

SEQ ID NO: 1334665 - RNA, 21 nt, Mycobacterium tuberculosis H37Rv
agccgcagcuuggccucagcc

SEQ ID NO: 1334666 - RNA, 23 nt, Mycobacterium tuberculosis H37Rv
agccugaccgaagucugcagacg

SEQ ID NO: 1334667 - RNA, 20 nt, Mycobacterium tuberculosis H37Rv
agccugauaaagcccggcgg

SEQ ID NO: 1334668 - RNA, 18 nt, Mycobacterium tuberculosis H37Rv
agccugcgccgacccgcg

SEQ ID NO: 1334669 - RNA, 21 nt, Mycobacterium tuberculosis H37Rv
agccugcggcggucaugggcg

SEQ ID NO: 1334670 - RNA, 15 nt, Mycobacterium tuberculosis H37Rv
agccuggagauggca

SEQ ID NO: 1334671 - RNA, 13 nt, Mycobacterium tuberculosis H37Rv
agccugccgaacc

SEQ ID NO: 1334672 - RNA, 21 nt, Mycobacterium tuberculosis H37Rv
agcgaugcaccccaugaccgg

SEQ ID NO: 1334673 - RNA, 21 nt, Mycobacterium tuberculosis H37Rv
agcgaucuugguggccucauc

SEQ ID NO: 1334674 - RNA, 17 nt, Mycobacterium tuberculosis H37Rv
agcgaguuucugcucga

SEQ ID NO: 1334675 - RNA, 20 nt, Mycobacterium tuberculosis H37Rv
agcgagucgacgucgaucac

SEQ ID NO: 1334676 - RNA, 22 nt, Mycobacterium tuberculosis H37Rv
agcgagcgcgcguagcggggga

SEQ ID NO: 1334677 - RNA, 19 nt, Mycobacterium tuberculosis H37Rv
agcgaggaauuccgcuacc

SEQ ID NO: 1334678 - RNA, 20 nt, Mycobacterium tuberculosis H37Rv
agcgacaagugcacgaaguc

SEQ ID NO: 1334679 - RNA, 14 nt, Mycobacterium tuberculosis H37Rv
agcgacaacaccac

SEQ ID NO: 1334680 - RNA, 16 nt, Mycobacterium tuberculosis H37Rv
agcgaauggggcagcu

SEQ ID NO: 1334681 - RNA, 23 nt, Mycobacterium tuberculosis H37Rv
agcgacuccguaccggguuccau

SEQ ID NO: 1334682 - RNA, 14 nt, Mycobacterium tuberculosis H37Rv
agcgccgagcucgg

SEQ ID NO: 1334683 - RNA, 16 nt, Mycobacterium tuberculosis H37Rv
agcgcccguuggccaa

SEQ ID NO: 1334684 - RNA, 18 nt, Mycobacterium tuberculosis H37Rv
agcgccgaaacagcaccc

SEQ ID NO: 1334685 - RNA, 20 nt, Mycobacterium tuberculosis H37Rv
agcgccgaaacagcacccag

SEQ ID NO: 1334686 - RNA, 15 nt, Mycobacterium tuberculosis H37Rv
agcgccgauggccgc

SEQ ID NO: 1334687 - RNA, 17 nt, Mycobacterium tuberculosis H37Rv
agcgccgauaccagcca

SEQ ID NO: 1334688 - RNA, 21 nt, Mycobacterium tuberculosis H37Rv
agcgccucgccggccacccgc

SEQ ID NO: 1334689 - RNA, 18 nt, Mycobacterium tuberculosis H37Rv
agcgccucgccggccacc

SEQ ID NO: 1334690 - RNA, 15 nt, Mycobacterium tuberculosis H37Rv
agcgccuccagcacc

SEQ ID NO: 1334691 - RNA, 16 nt, Mycobacterium tuberculosis H37Rv
agcgccuccagcacca

SEQ ID NO: 1334692 - RNA, 20 nt, Mycobacterium tuberculosis H37Rv
agcgccucaagcucgccgga

SEQ ID NO: 1334693 - RNA, 13 nt, Mycobacterium tuberculosis H37Rv
agcgccgcagggu

SEQ ID NO: 1334694 - RNA, 19 nt, Mycobacterium tuberculosis H37Rv
agcgccuugucgaucucgu

SEQ ID NO: 1334695 - RNA, 16 nt, Mycobacterium tuberculosis H37Rv
agcgccuuguggcaca

SEQ ID NO: 1334696 - RNA, 13 nt, Mycobacterium tuberculosis H37Rv
agcgccugguccu

SEQ ID NO: 1334697 - RNA, 13 nt, Mycobacterium tuberculosis H37Rv
agcgcgacaaagu

SEQ ID NO: 1334698 - RNA, 22 nt, Mycobacterium tuberculosis H37Rv
agcgcgccagcuugucgggcac

SEQ ID NO: 1334699 - RNA, 17 nt, Mycobacterium tuberculosis H37Rv
agcgcgaacgccugcug

SEQ ID NO: 1334700 - RNA, 18 nt, Mycobacterium tuberculosis H37Rv
agcgcgccucgcccagca

SEQ ID NO: 1334701 - RNA, 19 nt, Mycobacterium tuberculosis H37Rv
agcgcgccguugccgccca

SEQ ID NO: 1334702 - RNA, 19 nt, Mycobacterium tuberculosis H37Rv
agcgcgcgccgcuggguga

SEQ ID NO: 1334703 - RNA, 21 nt, Mycobacterium tuberculosis H37Rv
agcgcgcgcggugcggccacu

SEQ ID NO: 1334704 - RNA, 13 nt, Mycobacterium tuberculosis H37Rv
agcgcggccaccc

SEQ ID NO: 1334705 - RNA, 13 nt, Mycobacterium tuberculosis H37Rv
agcgcggccagca

SEQ ID NO: 1334706 - RNA, 19 nt, Mycobacterium tuberculosis H37Rv
agcgcggccaauugcgccg

SEQ ID NO: 1334707 - RNA, 13 nt, Mycobacterium tuberculosis H37Rv
agcgcggccggaa

SEQ ID NO: 1334708 - RNA, 13 nt, Mycobacterium tuberculosis H37Rv
agcgcggcgacga

SEQ ID NO: 1334709 - RNA, 14 nt, Mycobacterium tuberculosis H37Rv
agcgcggcgagggc

SEQ ID NO: 1334710 - RNA, 20 nt, Mycobacterium tuberculosis H37Rv
agcgcggcgcccuggccgcc

SEQ ID NO: 1334711 - RNA, 16 nt, Mycobacterium tuberculosis H37Rv
agcgcggcgcgacaga

SEQ ID NO: 1334712 - RNA, 17 nt, Mycobacterium tuberculosis H37Rv
agcgauuccacggcagc

SEQ ID NO: 1334713 - RNA, 18 nt, Mycobacterium tuberculosis H37Rv
agcgcaacggccagcgcu

SEQ ID NO: 1334714 - RNA, 12 nt, Mycobacterium tuberculosis H37Rv
agcgcaacaucg

SEQ ID NO: 1334715 - RNA, 23 nt, Mycobacterium tuberculosis H37Rv
agcgcaacccguuguggccgccu

SEQ ID NO: 1334716 - RNA, 17 nt, Mycobacterium tuberculosis H37Rv
agcgcaaagcccuccuc

SEQ ID NO: 1334717 - RNA, 16 nt, Mycobacterium tuberculosis H37Rv
agcgcaucgagcccgg

SEQ ID NO: 1334718 - RNA, 17 nt, Mycobacterium tuberculosis H37Rv
agcgcaucgagcccgga

SEQ ID NO: 1334719 - RNA, 12 nt, Mycobacterium tuberculosis H37Rv
agcgcaaugcgc

SEQ ID NO: 1334720 - RNA, 14 nt, Mycobacterium tuberculosis H37Rv
agcgcaagguugcc

SEQ ID NO: 1334721 - RNA, 12 nt, Mycobacterium tuberculosis H37Rv
agcgcaucgcca

SEQ ID NO: 1334722 - RNA, 17 nt, Mycobacterium tuberculosis H37Rv
agcgccacgccgaggcg

SEQ ID NO: 1334723 - RNA, 21 nt, Mycobacterium tuberculosis H37Rv
agcgccagccgcugccacagg

SEQ ID NO: 1334724 - RNA, 20 nt, Mycobacterium tuberculosis H37Rv
agcgcccgucguagguggcc

SEQ ID NO: 1334725 - RNA, 17 nt, Mycobacterium tuberculosis H37Rv
agcgccagugccucgcg

SEQ ID NO: 1334726 - RNA, 22 nt, Mycobacterium tuberculosis H37Rv
agcgccaggggugugccguggu

SEQ ID NO: 1334727 - RNA, 15 nt, Mycobacterium tuberculosis H37Rv
agcgccagcgccagu

SEQ ID NO: 1334728 - RNA, 16 nt, Mycobacterium tuberculosis H37Rv
agcgccagcgggauga

SEQ ID NO: 1334729 - RNA, 16 nt, Mycobacterium tuberculosis H37Rv
agcgugcugccgccuu

SEQ ID NO: 1334730 - RNA, 23 nt, Mycobacterium tuberculosis H37Rv
agcguggcgcccgugccgcccgc

SEQ ID NO: 1334731 - RNA, 15 nt, Mycobacterium tuberculosis H37Rv
agcgugccugcaguu

SEQ ID NO: 1334732 - RNA, 19 nt, Mycobacterium tuberculosis H37Rv
agcgugccgaacagggagg

SEQ ID NO: 1334733 - RNA, 13 nt, Mycobacterium tuberculosis H37Rv
agcgugcggggcg

SEQ ID NO: 1334734 - RNA, 23 nt, Mycobacterium tuberculosis H37Rv
agcgugccgcagcggcggcaacc

SEQ ID NO: 1334735 - RNA, 14 nt, Mycobacterium tuberculosis H37Rv
agcgugcacgggga

SEQ ID NO: 1334736 - RNA, 17 nt, Mycobacterium tuberculosis H37Rv
agcguuaggucgccggc

SEQ ID NO: 1334737 - RNA, 17 nt, Mycobacterium tuberculosis H37Rv
agcguuccgcucgaauc

SEQ ID NO: 1334738 - RNA, 21 nt, Mycobacterium tuberculosis H37Rv
agcguccgcggaugcauguca

SEQ ID NO: 1334739 - RNA, 16 nt, Mycobacterium tuberculosis H37Rv
agcguccgguggucag

SEQ ID NO: 1334740 - RNA, 13 nt, Mycobacterium tuberculosis H37Rv
agcguccuggcgu

SEQ ID NO: 1334741 - RNA, 13 nt, Mycobacterium tuberculosis H37Rv
agcguccaggagg

SEQ ID NO: 1334742 - RNA, 13 nt, Mycobacterium tuberculosis H37Rv
agcguccaaccca

SEQ ID NO: 1334743 - RNA, 12 nt, Mycobacterium tuberculosis H37Rv
agcguccacaug

SEQ ID NO: 1334744 - RNA, 23 nt, Mycobacterium tuberculosis H37Rv
agcgcguugagcucaauggcuuc

SEQ ID NO: 1334745 - RNA, 22 nt, Mycobacterium tuberculosis H37Rv
agcgcgucguccagggcgacga

SEQ ID NO: 1334746 - RNA, 18 nt, Mycobacterium tuberculosis H37Rv
agcgcguucggcaccugg

SEQ ID NO: 1334747 - RNA, 19 nt, Mycobacterium tuberculosis H37Rv
agcgcgugguaccgcuugu

SEQ ID NO: 1334748 - RNA, 12 nt, Mycobacterium tuberculosis H37Rv
agcggccagcag

SEQ ID NO: 1334749 - RNA, 16 nt, Mycobacterium tuberculosis H37Rv
agcggccagcccagcc

SEQ ID NO: 1334750 - RNA, 23 nt, Mycobacterium tuberculosis H37Rv
agcggccaucgggauggacacca

SEQ ID NO: 1334751 - RNA, 20 nt, Mycobacterium tuberculosis H37Rv
agcggccauaucgcccacca

SEQ ID NO: 1334752 - RNA, 21 nt, Mycobacterium tuberculosis H37Rv
agcggcccgaucaccagcccc

SEQ ID NO: 1334753 - RNA, 19 nt, Mycobacterium tuberculosis H37Rv
agcggcccgaucaccagcc

SEQ ID NO: 1334754 - RNA, 22 nt, Mycobacterium tuberculosis H37Rv
agcggcgggccguacacaccga

SEQ ID NO: 1334755 - RNA, 20 nt, Mycobacterium tuberculosis H37Rv
agcggcgucggugccgcuga

SEQ ID NO: 1334756 - RNA, 18 nt, Mycobacterium tuberculosis H37Rv
agcggcggccacggccau

SEQ ID NO: 1334757 - RNA, 22 nt, Mycobacterium tuberculosis H37Rv
agcggccgguacacguccagug

SEQ ID NO: 1334758 - RNA, 17 nt, Mycobacterium tuberculosis H37Rv
agcggccgcuccaccuc

SEQ ID NO: 1334759 - RNA, 19 nt, Mycobacterium tuberculosis H37Rv
agcggccgggcggccaggc

SEQ ID NO: 1334760 - RNA, 12 nt, Mycobacterium tuberculosis H37Rv
agcggccgcagg

SEQ ID NO: 1334761 - RNA, 17 nt, Mycobacterium tuberculosis H37Rv
agcggccgaccgcgacc

SEQ ID NO: 1334762 - RNA, 16 nt, Mycobacterium tuberculosis H37Rv
agcgguugacccacag

SEQ ID NO: 1334763 - RNA, 16 nt, Mycobacterium tuberculosis H37Rv
agcgggcuccggcucg

SEQ ID NO: 1334764 - RNA, 22 nt, Mycobacterium tuberculosis H37Rv
agcggggcuagucgggguggga

SEQ ID NO: 1334765 - RNA, 16 nt, Mycobacterium tuberculosis H37Rv
agcgggcaacugcagc

SEQ ID NO: 1334766 - RNA, 21 nt, Mycobacterium tuberculosis H37Rv
agcgggcagcaggcgaugcgc

SEQ ID NO: 1334767 - RNA, 22 nt, Mycobacterium tuberculosis H37Rv
agcggcucgccuaucgacucag

SEQ ID NO: 1334768 - RNA, 22 nt, Mycobacterium tuberculosis H37Rv
agcggcugaggcuuuuggagcg

SEQ ID NO: 1334769 - RNA, 17 nt, Mycobacterium tuberculosis H37Rv
agcggcguucgaugcca

SEQ ID NO: 1334770 - RNA, 18 nt, Mycobacterium tuberculosis H37Rv
agcggcuccgaaggccgc

SEQ ID NO: 1334771 - RNA, 13 nt, Mycobacterium tuberculosis H37Rv
agcggcuccggga

SEQ ID NO: 1334772 - RNA, 20 nt, Mycobacterium tuberculosis H37Rv
agcggcugggacgucuccac

SEQ ID NO: 1334773 - RNA, 20 nt, Mycobacterium tuberculosis H37Rv
agcuacuaugccaacgacag

SEQ ID NO: 1334774 - RNA, 16 nt, Mycobacterium tuberculosis H37Rv
agcuagaccgaucacc

SEQ ID NO: 1334775 - RNA, 17 nt, Mycobacterium tuberculosis H37Rv
agcuagcgcgggcucac

SEQ ID NO: 1334776 - RNA, 18 nt, Mycobacterium tuberculosis H37Rv
agcguugccaggugcugu

SEQ ID NO: 1334777 - RNA, 14 nt, Mycobacterium tuberculosis H37Rv
agcuaaacccccac

SEQ ID NO: 1334778 - RNA, 12 nt, Mycobacterium tuberculosis H37Rv
agcucagcugcg

SEQ ID NO: 1334779 - RNA, 22 nt, Mycobacterium tuberculosis H37Rv
agcucaccacccgcacuccaag

SEQ ID NO: 1334780 - RNA, 22 nt, Mycobacterium tuberculosis H37Rv
agcucaccucaugaucucacca

SEQ ID NO: 1334781 - RNA, 22 nt, Mycobacterium tuberculosis H37Rv
agcucacgugcugccgauagcg

SEQ ID NO: 1334782 - RNA, 19 nt, Mycobacterium tuberculosis H37Rv
agcuaucccaggggcaccg

SEQ ID NO: 1334783 - RNA, 17 nt, Mycobacterium tuberculosis H37Rv
agcccgccggccucugg

SEQ ID NO: 1334784 - RNA, 14 nt, Mycobacterium tuberculosis H37Rv
agcccgccgcgacc

SEQ ID NO: 1334785 - RNA, 17 nt, Mycobacterium tuberculosis H37Rv
agcccggcguuguugac

SEQ ID NO: 1334786 - RNA, 16 nt, Mycobacterium tuberculosis H37Rv
agcccgcgaucaccau

SEQ ID NO: 1334787 - RNA, 15 nt, Mycobacterium tuberculosis H37Rv
agcccggcggcgaga

SEQ ID NO: 1334788 - RNA, 17 nt, Mycobacterium tuberculosis H37Rv
agcccgggccugaacca

SEQ ID NO: 1334789 - RNA, 18 nt, Mycobacterium tuberculosis H37Rv
agcccgguacgccgcgcc

SEQ ID NO: 1334790 - RNA, 12 nt, Mycobacterium tuberculosis H37Rv
agcccggggaga

SEQ ID NO: 1334791 - RNA, 14 nt, Mycobacterium tuberculosis H37Rv
agcccgucgcggcc

SEQ ID NO: 1334792 - RNA, 17 nt, Mycobacterium tuberculosis H37Rv
agcccgucgucgugcac

SEQ ID NO: 1334793 - RNA, 16 nt, Mycobacterium tuberculosis H37Rv
agcccguccggccccc

SEQ ID NO: 1334794 - RNA, 16 nt, Mycobacterium tuberculosis H37Rv
agcccgccacagcccc

SEQ ID NO: 1334795 - RNA, 13 nt, Mycobacterium tuberculosis H37Rv
agcccgccacccu

SEQ ID NO: 1334796 - RNA, 14 nt, Mycobacterium tuberculosis H37Rv
agcccgccagcgcc

SEQ ID NO: 1334797 - RNA, 22 nt, Mycobacterium tuberculosis H37Rv
agcccgaugaucccgccaccga

SEQ ID NO: 1334798 - RNA, 20 nt, Mycobacterium tuberculosis H37Rv
agcccgaugccgugcccggu

SEQ ID NO: 1334799 - RNA, 20 nt, Mycobacterium tuberculosis H37Rv
agcccgaugaucccgccacc

SEQ ID NO: 1334800 - RNA, 14 nt, Mycobacterium tuberculosis H37Rv
agcccgaugauccc

SEQ ID NO: 1334801 - RNA, 19 nt, Mycobacterium tuberculosis H37Rv
agcccgaucggcgggcugg

SEQ ID NO: 1334802 - RNA, 15 nt, Mycobacterium tuberculosis H37Rv
agcccgagcgcuuga

SEQ ID NO: 1334803 - RNA, 14 nt, Mycobacterium tuberculosis H37Rv
agccgaccggcagc

SEQ ID NO: 1334804 - RNA, 16 nt, Mycobacterium tuberculosis H37Rv
agccgaccucacggca

SEQ ID NO: 1334805 - RNA, 16 nt, Mycobacterium tuberculosis H37Rv
agcccuucgcgggaga

SEQ ID NO: 1334806 - RNA, 22 nt, Mycobacterium tuberculosis H37Rv
agccgagguucaaagcagcgca

SEQ ID NO: 1334807 - RNA, 12 nt, Mycobacterium tuberculosis H37Rv
agccgcaccgcu

SEQ ID NO: 1334808 - RNA, 16 nt, Mycobacterium tuberculosis H37Rv
agccgcagcugagccg

SEQ ID NO: 1334809 - RNA, 12 nt, Mycobacterium tuberculosis H37Rv
agccgcagcacc

SEQ ID NO: 1334810 - RNA, 13 nt, Mycobacterium tuberculosis H37Rv
agccgcagcaccu

SEQ ID NO: 1334811 - RNA, 18 nt, Mycobacterium tuberculosis H37Rv
agccgcagaugcaccugc

SEQ ID NO: 1334812 - RNA, 20 nt, Mycobacterium tuberculosis H37Rv
agccgagguucaaagcagcg

SEQ ID NO: 1334813 - RNA, 19 nt, Mycobacterium tuberculosis H37Rv
agccgaggugcugcacacu

SEQ ID NO: 1334814 - RNA, 16 nt, Mycobacterium tuberculosis H37Rv
agccgagccagcagcu

SEQ ID NO: 1334815 - RNA, 16 nt, Mycobacterium tuberculosis H37Rv
agccgagaagagaucc

SEQ ID NO: 1334816 - RNA, 15 nt, Mycobacterium tuberculosis H37Rv
agccgagcacgggca

SEQ ID NO: 1334817 - RNA, 17 nt, Mycobacterium tuberculosis H37Rv
agcccaugccgaugccc

SEQ ID NO: 1334818 - RNA, 14 nt, Mycobacterium tuberculosis H37Rv
agcccagcgccucc

SEQ ID NO: 1334819 - RNA, 22 nt, Mycobacterium tuberculosis H37Rv
agcccagcagguuccacggcca

SEQ ID NO: 1334820 - RNA, 17 nt, Mycobacterium tuberculosis H37Rv
agcccagccgggcaccc

SEQ ID NO: 1334821 - RNA, 15 nt, Mycobacterium tuberculosis H37Rv
agcccaggacggcua

SEQ ID NO: 1334822 - RNA, 13 nt, Mycobacterium tuberculosis H37Rv
agcccagcugcgc

SEQ ID NO: 1334823 - RNA, 14 nt, Mycobacterium tuberculosis H37Rv
agcccagaucuugc

SEQ ID NO: 1334824 - RNA, 20 nt, Mycobacterium tuberculosis H37Rv
agcccacccauggccuccca

SEQ ID NO: 1334825 - RNA, 21 nt, Mycobacterium tuberculosis H37Rv
agcccacacgcucacgggcuc

SEQ ID NO: 1334826 - RNA, 21 nt, Mycobacterium tuberculosis H37Rv
agccccugaaggccagccaac

SEQ ID NO: 1334827 - RNA, 21 nt, Mycobacterium tuberculosis H37Rv
agccccuggaggggcaacagg

SEQ ID NO: 1334828 - RNA, 17 nt, Mycobacterium tuberculosis H37Rv
agccccuccgcgccgau

SEQ ID NO: 1334829 - RNA, 12 nt, Mycobacterium tuberculosis H37Rv
agccccucaccu

SEQ ID NO: 1334830 - RNA, 17 nt, Mycobacterium tuberculosis H37Rv
agccccguuucgccaga

SEQ ID NO: 1334831 - RNA, 20 nt, Mycobacterium tuberculosis H37Rv
agccccgccggggccgccgu

SEQ ID NO: 1334832 - RNA, 14 nt, Mycobacterium tuberculosis H37Rv
agccccgcgcccac

SEQ ID NO: 1334833 - RNA, 20 nt, Mycobacterium tuberculosis H37Rv
agcccccgacacgccgugcg

SEQ ID NO: 1334834 - RNA, 13 nt, Mycobacterium tuberculosis H37Rv
agcccccgcacgc

SEQ ID NO: 1334835 - RNA, 18 nt, Mycobacterium tuberculosis H37Rv
agccccccgagcccgcca

SEQ ID NO: 1334836 - RNA, 17 nt, Mycobacterium tuberculosis H37Rv
agccccagcguucccgc

SEQ ID NO: 1334837 - RNA, 14 nt, Mycobacterium tuberculosis H37Rv
agccacggcacugg

SEQ ID NO: 1334838 - RNA, 18 nt, Mycobacterium tuberculosis H37Rv
agccagaccaacaugaac

SEQ ID NO: 1334839 - RNA, 18 nt, Mycobacterium tuberculosis H37Rv
agccacgcugucccgcgg

SEQ ID NO: 1334840 - RNA, 17 nt, Mycobacterium tuberculosis H37Rv
agccacgccacguccaa

SEQ ID NO: 1334841 - RNA, 12 nt, Mycobacterium tuberculosis H37Rv
agccacgcaugg

SEQ ID NO: 1334842 - RNA, 14 nt, Mycobacterium tuberculosis H37Rv
agccacgacccagc

SEQ ID NO: 1334843 - RNA, 17 nt, Mycobacterium tuberculosis H37Rv
agccagcguuggcggcg

SEQ ID NO: 1334844 - RNA, 20 nt, Mycobacterium tuberculosis H37Rv
agccagcgguagcugcccag

SEQ ID NO: 1334845 - RNA, 18 nt, Mycobacterium tuberculosis H37Rv
agccagcggcugcccauc

SEQ ID NO: 1334846 - RNA, 22 nt, Mycobacterium tuberculosis H37Rv
agccagcgggcgaugagcgcga

SEQ ID NO: 1334847 - RNA, 23 nt, Mycobacterium tuberculosis H37Rv
agccagccugcuggccgcggccu

SEQ ID NO: 1334848 - RNA, 23 nt, Mycobacterium tuberculosis H37Rv
agcaugccuucggccaaccaugc

SEQ ID NO: 1334849 - RNA, 17 nt, Mycobacterium tuberculosis H37Rv
agccaaccugaagccag

SEQ ID NO: 1334850 - RNA, 22 nt, Mycobacterium tuberculosis H37Rv
agccaacgcgucccgccgcacc

SEQ ID NO: 1334851 - RNA, 15 nt, Mycobacterium tuberculosis H37Rv
agccaacgcaucaug

SEQ ID NO: 1334852 - RNA, 18 nt, Mycobacterium tuberculosis H37Rv
agccaucgucgagcgcga

SEQ ID NO: 1334853 - RNA, 15 nt, Mycobacterium tuberculosis H37Rv
agccauacgcgcuga

SEQ ID NO: 1334854 - RNA, 19 nt, Mycobacterium tuberculosis H37Rv
agccauucgguguggccgu

SEQ ID NO: 1334855 - RNA, 17 nt, Mycobacterium tuberculosis H37Rv
agccauuuccuuggcgc

SEQ ID NO: 1334856 - RNA, 13 nt, Mycobacterium tuberculosis H37Rv
agcccaaauccca

SEQ ID NO: 1334857 - RNA, 15 nt, Mycobacterium tuberculosis H37Rv
agcccaacagcaacc

SEQ ID NO: 1334858 - RNA, 23 nt, Mycobacterium tuberculosis H37Rv
agccauggccgccaggugaauuc

SEQ ID NO: 1334859 - RNA, 17 nt, Mycobacterium tuberculosis H37Rv
agcaccuagucgcggcc

SEQ ID NO: 1334860 - RNA, 21 nt, Mycobacterium tuberculosis H37Rv
agcaccugccgaucgggcuca

SEQ ID NO: 1334861 - RNA, 15 nt, Mycobacterium tuberculosis H37Rv
agcaccucgaagugc

SEQ ID NO: 1334862 - RNA, 13 nt, Mycobacterium tuberculosis H37Rv
agcaccugcaccg

SEQ ID NO: 1334863 - RNA, 14 nt, Mycobacterium tuberculosis H37Rv
agcaccgugacagc

SEQ ID NO: 1334864 - RNA, 14 nt, Mycobacterium tuberculosis H37Rv
agcaccgugcccug

SEQ ID NO: 1334865 - RNA, 19 nt, Mycobacterium tuberculosis H37Rv
agcaccggaucgaccaauu

SEQ ID NO: 1334866 - RNA, 19 nt, Mycobacterium tuberculosis H37Rv
agcaccggauacagccacg

SEQ ID NO: 1334867 - RNA, 13 nt, Mycobacterium tuberculosis H37Rv
agcacucggccac

SEQ ID NO: 1334868 - RNA, 17 nt, Mycobacterium tuberculosis H37Rv
agcacucggugucggcc

SEQ ID NO: 1334869 - RNA, 17 nt, Mycobacterium tuberculosis H37Rv
agcacucccugguucgg

SEQ ID NO: 1334870 - RNA, 15 nt, Mycobacterium tuberculosis H37Rv
agcacucgcccaagc

SEQ ID NO: 1334871 - RNA, 16 nt, Mycobacterium tuberculosis H37Rv
agcacguugcacagcu

SEQ ID NO: 1334872 - RNA, 18 nt, Mycobacterium tuberculosis H37Rv
agcacgucgucgcgggaa

SEQ ID NO: 1334873 - RNA, 22 nt, Mycobacterium tuberculosis H37Rv
agcacgucgcggccguggaugu

SEQ ID NO: 1334874 - RNA, 23 nt, Mycobacterium tuberculosis H37Rv
agcacgguguugcgcacccgcgg

SEQ ID NO: 1334875 - RNA, 22 nt, Mycobacterium tuberculosis H37Rv
agcacguccugaaucgguucgg

SEQ ID NO: 1334876 - RNA, 16 nt, Mycobacterium tuberculosis H37Rv
agcacgucgcggccgu

SEQ ID NO: 1334877 - RNA, 14 nt, Mycobacterium tuberculosis H37Rv
agcacguacauggu

SEQ ID NO: 1334878 - RNA, 18 nt, Mycobacterium tuberculosis H37Rv
agcaccugggcgcgcugg

SEQ ID NO: 1334879 - RNA, 15 nt, Mycobacterium tuberculosis H37Rv
agcacgaaagucaau

SEQ ID NO: 1334880 - RNA, 15 nt, Mycobacterium tuberculosis H37Rv
agcagcagagccaac

SEQ ID NO: 1334881 - RNA, 12 nt, Mycobacterium tuberculosis H37Rv
agcagcacccgg

SEQ ID NO: 1334882 - RNA, 21 nt, Mycobacterium tuberculosis H37Rv
agcagcaacgcggugccggga

SEQ ID NO: 1334883 - RNA, 14 nt, Mycobacterium tuberculosis H37Rv
agcagcaccaacug

SEQ ID NO: 1334884 - RNA, 13 nt, Mycobacterium tuberculosis H37Rv
agcagcagugcca

SEQ ID NO: 1334885 - RNA, 17 nt, Mycobacterium tuberculosis H37Rv
agcagccagcaacacca

SEQ ID NO: 1334886 - RNA, 18 nt, Mycobacterium tuberculosis H37Rv
agcagccagcaacaccag

SEQ ID NO: 1334887 - RNA, 12 nt, Mycobacterium tuberculosis H37Rv
agcagccagcaa

SEQ ID NO: 1334888 - RNA, 15 nt, Mycobacterium tuberculosis H37Rv
agcagccagcccagc

SEQ ID NO: 1334889 - RNA, 14 nt, Mycobacterium tuberculosis H37Rv
agcagccagccacc

SEQ ID NO: 1334890 - RNA, 16 nt, Mycobacterium tuberculosis H37Rv
agcagccagcccagcc

SEQ ID NO: 1334891 - RNA, 19 nt, Mycobacterium tuberculosis H37Rv
agcagagcggcacgcacgc

SEQ ID NO: 1334892 - RNA, 13 nt, Mycobacterium tuberculosis H37Rv
agcagagccccgg

SEQ ID NO: 1334893 - RNA, 12 nt, Mycobacterium tuberculosis H37Rv
agcagcccgcgg

SEQ ID NO: 1334894 - RNA, 16 nt, Mycobacterium tuberculosis H37Rv
agcagcgccaucaucu

SEQ ID NO: 1334895 - RNA, 22 nt, Mycobacterium tuberculosis H37Rv
agcagcccgcccugaccgcccg

SEQ ID NO: 1334896 - RNA, 15 nt, Mycobacterium tuberculosis H37Rv
agcagcgccagcagc

SEQ ID NO: 1334897 - RNA, 16 nt, Mycobacterium tuberculosis H37Rv
agcagcgccagcagcu

SEQ ID NO: 1334898 - RNA, 23 nt, Mycobacterium tuberculosis H37Rv
agcagcgggacauccagugcggu

SEQ ID NO: 1334899 - RNA, 18 nt, Mycobacterium tuberculosis H37Rv
agcagcucggccgaggcg

SEQ ID NO: 1334900 - RNA, 20 nt, Mycobacterium tuberculosis H37Rv
agcagcucgccggcacgcag

SEQ ID NO: 1334901 - RNA, 15 nt, Mycobacterium tuberculosis H37Rv
agcagcggugcagcc

SEQ ID NO: 1334902 - RNA, 16 nt, Mycobacterium tuberculosis H37Rv
agcagcggugcagccc

SEQ ID NO: 1334903 - RNA, 14 nt, Mycobacterium tuberculosis H37Rv
agcagcggugcagc

SEQ ID NO: 1334904 - RNA, 14 nt, Mycobacterium tuberculosis H37Rv
agcagcgucaucag

SEQ ID NO: 1334905 - RNA, 19 nt, Mycobacterium tuberculosis H37Rv
agcagcgguugaugcggcc

SEQ ID NO: 1334906 - RNA, 21 nt, Mycobacterium tuberculosis H37Rv
agcagcguggcgaugggucug

SEQ ID NO: 1334907 - RNA, 19 nt, Mycobacterium tuberculosis H37Rv
agcagcgugaccaccgccg

SEQ ID NO: 1334908 - RNA, 20 nt, Mycobacterium tuberculosis H37Rv
agcaggcggcugaacggcag

SEQ ID NO: 1334909 - RNA, 13 nt, Mycobacterium tuberculosis H37Rv
agcaggcggggga

SEQ ID NO: 1334910 - RNA, 20 nt, Mycobacterium tuberculosis H37Rv
agcaggcucgaaccgacgcg

SEQ ID NO: 1334911 - RNA, 13 nt, Mycobacterium tuberculosis H37Rv
agcaggcccagcg

SEQ ID NO: 1334912 - RNA, 13 nt, Mycobacterium tuberculosis H37Rv
agcaggcccauac

SEQ ID NO: 1334913 - RNA, 11 nt, Mycobacterium tuberculosis H37Rv
agcaggaugau

SEQ ID NO: 1334914 - RNA, 13 nt, Mycobacterium tuberculosis H37Rv
agcaggcgcacca

SEQ ID NO: 1334915 - RNA, 20 nt, Mycobacterium tuberculosis H37Rv
agcaggcgcaccaggcggcc

SEQ ID NO: 1334916 - RNA, 14 nt, Mycobacterium tuberculosis H37Rv
agcaugaagucccg

SEQ ID NO: 1334917 - RNA, 15 nt, Mycobacterium tuberculosis H37Rv
agcaucuuuggcggc

SEQ ID NO: 1334918 - RNA, 18 nt, Mycobacterium tuberculosis H37Rv
agcaucagcucgaugccg

SEQ ID NO: 1334919 - RNA, 17 nt, Mycobacterium tuberculosis H37Rv
agcaucacgcccacgau

SEQ ID NO: 1334920 - RNA, 13 nt, Mycobacterium tuberculosis H37Rv
agcagugccucgg

SEQ ID NO: 1334921 - RNA, 18 nt, Mycobacterium tuberculosis H37Rv
agcauaccgccgcugcca

SEQ ID NO: 1334922 - RNA, 23 nt, Mycobacterium tuberculosis H37Rv
agcagugcgguaaagaucuuguc

SEQ ID NO: 1334923 - RNA, 17 nt, Mycobacterium tuberculosis H37Rv
agcaguacaccgcccgg

SEQ ID NO: 1334924 - RNA, 17 nt, Mycobacterium tuberculosis H37Rv
agcaguacuaacaacac

SEQ ID NO: 1334925 - RNA, 16 nt, Mycobacterium tuberculosis H37Rv
accaugaucacaccga

SEQ ID NO: 1334926 - RNA, 17 nt, Mycobacterium tuberculosis H37Rv
accaugauugccaggac

SEQ ID NO: 1334927 - RNA, 17 nt, Mycobacterium tuberculosis H37Rv
accaugguugaugacgg

SEQ ID NO: 1334928 - RNA, 16 nt, Mycobacterium tuberculosis H37Rv
accaugcuguguauca

SEQ ID NO: 1334929 - RNA, 21 nt, Mycobacterium tuberculosis H37Rv
accauacuaauggcgccaccg

SEQ ID NO: 1334930 - RNA, 15 nt, Mycobacterium tuberculosis H37Rv
accaucaccacggcc

SEQ ID NO: 1334931 - RNA, 22 nt, Mycobacterium tuberculosis H37Rv
accaucaccgcgccagccucca

SEQ ID NO: 1334932 - RNA, 23 nt, Mycobacterium tuberculosis H37Rv
accaucaccgcgccagccuccac

SEQ ID NO: 1334933 - RNA, 15 nt, Mycobacterium tuberculosis H37Rv
accaucaccgcgcca

SEQ ID NO: 1334934 - RNA, 12 nt, Mycobacterium tuberculosis H37Rv
accagaaccagc

SEQ ID NO: 1334935 - RNA, 16 nt, Mycobacterium tuberculosis H37Rv
accagaaccagcgacc

SEQ ID NO: 1334936 - RNA, 16 nt, Mycobacterium tuberculosis H37Rv
accagaacgccagacc

SEQ ID NO: 1334937 - RNA, 22 nt, Mycobacterium tuberculosis H37Rv
accauguauuucucccagccca

SEQ ID NO: 1334938 - RNA, 16 nt, Mycobacterium tuberculosis H37Rv
acccaagucgccgagg

SEQ ID NO: 1334939 - RNA, 18 nt, Mycobacterium tuberculosis H37Rv
acccacaucagccgcacc

SEQ ID NO: 1334940 - RNA, 22 nt, Mycobacterium tuberculosis H37Rv
acccacacgcccucgacgccgc

SEQ ID NO: 1334941 - RNA, 23 nt, Mycobacterium tuberculosis H37Rv
acccaaaaugccuuggcagccca

SEQ ID NO: 1334942 - RNA, 17 nt, Mycobacterium tuberculosis H37Rv
accccaggcgcucauca

SEQ ID NO: 1334943 - RNA, 23 nt, Mycobacterium tuberculosis H37Rv
accccaucagaaugccuggcccg

SEQ ID NO: 1334944 - RNA, 16 nt, Mycobacterium tuberculosis H37Rv
accccauggccaccga

SEQ ID NO: 1334945 - RNA, 13 nt, Mycobacterium tuberculosis H37Rv
accccauggccag

SEQ ID NO: 1334946 - RNA, 21 nt, Mycobacterium tuberculosis H37Rv
accccaugaccgggaggcggc

SEQ ID NO: 1334947 - RNA, 23 nt, Mycobacterium tuberculosis H37Rv
acccccaacugcgaaacgccacc

SEQ ID NO: 1334948 - RNA, 20 nt, Mycobacterium tuberculosis H37Rv
accccggcauacaacuggug

SEQ ID NO: 1334949 - RNA, 22 nt, Mycobacterium tuberculosis H37Rv
accccggaauccccaagcccga

SEQ ID NO: 1334950 - RNA, 16 nt, Mycobacterium tuberculosis H37Rv
accccggaccgcggcc

SEQ ID NO: 1334951 - RNA, 17 nt, Mycobacterium tuberculosis H37Rv
accccggaccgcggcca

SEQ ID NO: 1334952 - RNA, 12 nt, Mycobacterium tuberculosis H37Rv
accccggccacu

SEQ ID NO: 1334953 - RNA, 19 nt, Mycobacterium tuberculosis H37Rv
accccgcguaugccaggac

SEQ ID NO: 1334954 - RNA, 21 nt, Mycobacterium tuberculosis H37Rv
accccgcgcggugcccugccg

SEQ ID NO: 1334955 - RNA, 18 nt, Mycobacterium tuberculosis H37Rv
accccggaauccccaagc

SEQ ID NO: 1334956 - RNA, 19 nt, Mycobacterium tuberculosis H37Rv
accccgcgcggugcccugc

SEQ ID NO: 1334957 - RNA, 13 nt, Mycobacterium tuberculosis H37Rv
accccccagcgcc

SEQ ID NO: 1334958 - RNA, 13 nt, Mycobacterium tuberculosis H37Rv
acccccacgcugc

SEQ ID NO: 1334959 - RNA, 14 nt, Mycobacterium tuberculosis H37Rv
acccccagacaaag

SEQ ID NO: 1334960 - RNA, 18 nt, Mycobacterium tuberculosis H37Rv
accccccccacccaccac

SEQ ID NO: 1334961 - RNA, 17 nt, Mycobacterium tuberculosis H37Rv
accccgcagcucaccuc

SEQ ID NO: 1334962 - RNA, 17 nt, Mycobacterium tuberculosis H37Rv
accccgauggucgagag

SEQ ID NO: 1334963 - RNA, 12 nt, Mycobacterium tuberculosis H37Rv
accccgccgagc

SEQ ID NO: 1334964 - RNA, 13 nt, Mycobacterium tuberculosis H37Rv
accccgccagccg

SEQ ID NO: 1334965 - RNA, 13 nt, Mycobacterium tuberculosis H37Rv
acccaugcaugcg

SEQ ID NO: 1334966 - RNA, 21 nt, Mycobacterium tuberculosis H37Rv
acccauggccucccacucacc

SEQ ID NO: 1334967 - RNA, 21 nt, Mycobacterium tuberculosis H37Rv
acccauggcuccgcccaggau

SEQ ID NO: 1334968 - RNA, 19 nt, Mycobacterium tuberculosis H37Rv
acccauggucaccagcugg

SEQ ID NO: 1334969 - RNA, 18 nt, Mycobacterium tuberculosis H37Rv
acccauggccucccacuc

SEQ ID NO: 1334970 - RNA, 21 nt, Mycobacterium tuberculosis H37Rv
acccaucccguucagcgacca

SEQ ID NO: 1334971 - RNA, 15 nt, Mycobacterium tuberculosis H37Rv
acccaucagcccucg

SEQ ID NO: 1334972 - RNA, 14 nt, Mycobacterium tuberculosis H37Rv
accccacggccagu

SEQ ID NO: 1334973 - RNA, 19 nt, Mycobacterium tuberculosis H37Rv
accccagccggcagcagcg

SEQ ID NO: 1334974 - RNA, 14 nt, Mycobacterium tuberculosis H37Rv
accccagcgcaacc

SEQ ID NO: 1334975 - RNA, 16 nt, Mycobacterium tuberculosis H37Rv
acccaccucccgcagc

SEQ ID NO: 1334976 - RNA, 20 nt, Mycobacterium tuberculosis H37Rv
acccaccggccaccagggcc

SEQ ID NO: 1334977 - RNA, 15 nt, Mycobacterium tuberculosis H37Rv
acccaucaccagcgg

SEQ ID NO: 1334978 - RNA, 16 nt, Mycobacterium tuberculosis H37Rv
acccaucaccgccagc

SEQ ID NO: 1334979 - RNA, 23 nt, Mycobacterium tuberculosis H37Rv
acccaccaacacccgggccuugu

SEQ ID NO: 1334980 - RNA, 14 nt, Mycobacterium tuberculosis H37Rv
acccaccacaggac

SEQ ID NO: 1334981 - RNA, 16 nt, Mycobacterium tuberculosis H37Rv
acccacccgcaccgcc

SEQ ID NO: 1334982 - RNA, 13 nt, Mycobacterium tuberculosis H37Rv
acccaccccccag

SEQ ID NO: 1334983 - RNA, 13 nt, Mycobacterium tuberculosis H37Rv
acccacccgcacc

SEQ ID NO: 1334984 - RNA, 15 nt, Mycobacterium tuberculosis H37Rv
acccaccaccgcaac

SEQ ID NO: 1334985 - RNA, 13 nt, Mycobacterium tuberculosis H37Rv
acccgggcagccu

SEQ ID NO: 1334986 - RNA, 14 nt, Mycobacterium tuberculosis H37Rv
acccgggaaggaac

SEQ ID NO: 1334987 - RNA, 19 nt, Mycobacterium tuberculosis H37Rv
acccggcgugagcuccgca

SEQ ID NO: 1334988 - RNA, 22 nt, Mycobacterium tuberculosis H37Rv
acccgggcgugggugucggcga

SEQ ID NO: 1334989 - RNA, 20 nt, Mycobacterium tuberculosis H37Rv
acccgggcgagcgcggccug

SEQ ID NO: 1334990 - RNA, 15 nt, Mycobacterium tuberculosis H37Rv
acccgggccugggac

SEQ ID NO: 1334991 - RNA, 13 nt, Mycobacterium tuberculosis H37Rv
acccgggccacgu

SEQ ID NO: 1334992 - RNA, 16 nt, Mycobacterium tuberculosis H37Rv
acccggcuccagcacc

SEQ ID NO: 1334993 - RNA, 17 nt, Mycobacterium tuberculosis H37Rv
acccggcgggcgguggg

SEQ ID NO: 1334994 - RNA, 16 nt, Mycobacterium tuberculosis H37Rv
acccggcgggcccgcc

SEQ ID NO: 1334995 - RNA, 16 nt, Mycobacterium tuberculosis H37Rv
acccggcgaccacggc

SEQ ID NO: 1334996 - RNA, 21 nt, Mycobacterium tuberculosis H37Rv
acccggcgaccacggcaccga

SEQ ID NO: 1334997 - RNA, 17 nt, Mycobacterium tuberculosis H37Rv
acccggcgaugcagccg

SEQ ID NO: 1334998 - RNA, 12 nt, Mycobacterium tuberculosis H37Rv
acccggccguug

SEQ ID NO: 1334999 - RNA, 20 nt, Mycobacterium tuberculosis H37Rv
acccggccgggccugcacca

SEQ ID NO: 1335000 - RNA, 13 nt, Mycobacterium tuberculosis H37Rv
acccggaaccagc

SEQ ID NO: 1335001 - RNA, 14 nt, Mycobacterium tuberculosis H37Rv
acccggaccugggc

SEQ ID NO: 1335002 - RNA, 13 nt, Mycobacterium tuberculosis H37Rv
acccgcuucgccc

SEQ ID NO: 1335003 - RNA, 17 nt, Mycobacterium tuberculosis H37Rv
acccgcuggcccgccag

SEQ ID NO: 1335004 - RNA, 15 nt, Mycobacterium tuberculosis H37Rv
acccgcuggcccgcc

SEQ ID NO: 1335005 - RNA, 19 nt, Mycobacterium tuberculosis H37Rv
acccgcuucgcccggcugc

SEQ ID NO: 1335006 - RNA, 15 nt, Mycobacterium tuberculosis H37Rv
acccgcucggcgcgc

SEQ ID NO: 1335007 - RNA, 19 nt, Mycobacterium tuberculosis H37Rv
acccgcucggcggucggga

SEQ ID NO: 1335008 - RNA, 19 nt, Mycobacterium tuberculosis H37Rv
acccgcuggucgagcagug

SEQ ID NO: 1335009 - RNA, 21 nt, Mycobacterium tuberculosis H37Rv
acccgcgcgaccugaaugcgg

SEQ ID NO: 1335010 - RNA, 22 nt, Mycobacterium tuberculosis H37Rv
acccgcggcgccguugccgccg

SEQ ID NO: 1335011 - RNA, 22 nt, Mycobacterium tuberculosis H37Rv
acccgcgcgucgcccagugcgc

SEQ ID NO: 1335012 - RNA, 16 nt, Mycobacterium tuberculosis H37Rv
acccgcgccggccgcu

SEQ ID NO: 1335013 - RNA, 14 nt, Mycobacterium tuberculosis H37Rv
acccgcgccgccag

SEQ ID NO: 1335014 - RNA, 21 nt, Mycobacterium tuberculosis H37Rv
acccgcgagaucgggccggcc

SEQ ID NO: 1335015 - RNA, 21 nt, Mycobacterium tuberculosis H37Rv
acccgcgagguugaccaccag

SEQ ID NO: 1335016 - RNA, 17 nt, Mycobacterium tuberculosis H37Rv
acccgcgucgagugccg

SEQ ID NO: 1335017 - RNA, 21 nt, Mycobacterium tuberculosis H37Rv
acccgcggugacgccagccug

SEQ ID NO: 1335018 - RNA, 22 nt, Mycobacterium tuberculosis H37Rv
accccuuggacugucccaccag

SEQ ID NO: 1335019 - RNA, 23 nt, Mycobacterium tuberculosis H37Rv
accccuuggacugucccaccagg

SEQ ID NO: 1335020 - RNA, 23 nt, Mycobacterium tuberculosis H37Rv
accccuugccuuccgacccaacg

SEQ ID NO: 1335021 - RNA, 17 nt, Mycobacterium tuberculosis H37Rv
accccugguagcaccca

SEQ ID NO: 1335022 - RNA, 19 nt, Mycobacterium tuberculosis H37Rv
accccugguagcacccacg

SEQ ID NO: 1335023 - RNA, 21 nt, Mycobacterium tuberculosis H37Rv
accccuucgccagcgccacug

SEQ ID NO: 1335024 - RNA, 15 nt, Mycobacterium tuberculosis H37Rv
accccuggccgccgg

SEQ ID NO: 1335025 - RNA, 17 nt, Mycobacterium tuberculosis H37Rv
accgcccggcccggcuc

SEQ ID NO: 1335026 - RNA, 15 nt, Mycobacterium tuberculosis H37Rv
accgcccgcaccccc

SEQ ID NO: 1335027 - RNA, 20 nt, Mycobacterium tuberculosis H37Rv
accgcccagugccagaaccc

SEQ ID NO: 1335028 - RNA, 15 nt, Mycobacterium tuberculosis H37Rv
accgccccgugggcc

SEQ ID NO: 1335029 - RNA, 12 nt, Mycobacterium tuberculosis H37Rv
accgcccuugcc

SEQ ID NO: 1335030 - RNA, 19 nt, Mycobacterium tuberculosis H37Rv
accgccgaucggccacagu

SEQ ID NO: 1335031 - RNA, 22 nt, Mycobacterium tuberculosis H37Rv
accgccgaucggccacagugca

SEQ ID NO: 1335032 - RNA, 11 nt, Mycobacterium tuberculosis H37Rv
accgccgccgg

SEQ ID NO: 1335033 - RNA, 11 nt, Mycobacterium tuberculosis H37Rv
accgccacccc

SEQ ID NO: 1335034 - RNA, 15 nt, Mycobacterium tuberculosis H37Rv
accgccaccagacca

SEQ ID NO: 1335035 - RNA, 16 nt, Mycobacterium tuberculosis H37Rv
accgccaccagaccag

SEQ ID NO: 1335036 - RNA, 20 nt, Mycobacterium tuberculosis H37Rv
accgccaucgccaacaccaa

SEQ ID NO: 1335037 - RNA, 22 nt, Mycobacterium tuberculosis H37Rv
accgccaggucgaggcaggccu

SEQ ID NO: 1335038 - RNA, 15 nt, Mycobacterium tuberculosis H37Rv
accgccagcgccacc

SEQ ID NO: 1335039 - RNA, 19 nt, Mycobacterium tuberculosis H37Rv
accgccagcggccgcucca

SEQ ID NO: 1335040 - RNA, 17 nt, Mycobacterium tuberculosis H37Rv
accgcaucauggugcgc

SEQ ID NO: 1335041 - RNA, 16 nt, Mycobacterium tuberculosis H37Rv
accgccaaccuacccu

SEQ ID NO: 1335042 - RNA, 19 nt, Mycobacterium tuberculosis H37Rv
accgccaccacccaggcca

SEQ ID NO: 1335043 - RNA, 23 nt, Mycobacterium tuberculosis H37Rv
accgcagcggaacugggccccca

SEQ ID NO: 1335044 - RNA, 18 nt, Mycobacterium tuberculosis H37Rv
accgcagcggaacugggc

SEQ ID NO: 1335045 - RNA, 18 nt, Mycobacterium tuberculosis H37Rv
accgcagauccccgccac

SEQ ID NO: 1335046 - RNA, 17 nt, Mycobacterium tuberculosis H37Rv
accgcagucccagcaca

SEQ ID NO: 1335047 - RNA, 13 nt, Mycobacterium tuberculosis H37Rv
accgcagcgggug

SEQ ID NO: 1335048 - RNA, 17 nt, Mycobacterium tuberculosis H37Rv
accgagcgcccuccucg

SEQ ID NO: 1335049 - RNA, 18 nt, Mycobacterium tuberculosis H37Rv
accgagccacgacccagc

SEQ ID NO: 1335050 - RNA, 21 nt, Mycobacterium tuberculosis H37Rv
accgagccacgacccagcaug

SEQ ID NO: 1335051 - RNA, 13 nt, Mycobacterium tuberculosis H37Rv
accgauacccccg

SEQ ID NO: 1335052 - RNA, 15 nt, Mycobacterium tuberculosis H37Rv
accgauccaguucac

SEQ ID NO: 1335053 - RNA, 16 nt, Mycobacterium tuberculosis H37Rv
accgaucgacugcagc

SEQ ID NO: 1335054 - RNA, 16 nt, Mycobacterium tuberculosis H37Rv
accgcaaucggauacc

SEQ ID NO: 1335055 - RNA, 22 nt, Mycobacterium tuberculosis H37Rv
accgcaaucggauacccagccg

SEQ ID NO: 1335056 - RNA, 15 nt, Mycobacterium tuberculosis H37Rv
accgcacaccugcgc

SEQ ID NO: 1335057 - RNA, 13 nt, Mycobacterium tuberculosis H37Rv
accgcaccugggc

SEQ ID NO: 1335058 - RNA, 20 nt, Mycobacterium tuberculosis H37Rv
accgcaccgacuccugggcc

SEQ ID NO: 1335059 - RNA, 15 nt, Mycobacterium tuberculosis H37Rv
accgaugccacaucg

SEQ ID NO: 1335060 - RNA, 20 nt, Mycobacterium tuberculosis H37Rv
accgaucuuggccaccgccg

SEQ ID NO: 1335061 - RNA, 18 nt, Mycobacterium tuberculosis H37Rv
accgaugaaccaggcggc

SEQ ID NO: 1335062 - RNA, 14 nt, Mycobacterium tuberculosis H37Rv
accgcaagaaucag

SEQ ID NO: 1335063 - RNA, 13 nt, Mycobacterium tuberculosis H37Rv
acccuccgccggu

SEQ ID NO: 1335064 - RNA, 13 nt, Mycobacterium tuberculosis H37Rv
acccuccgcagcu

SEQ ID NO: 1335065 - RNA, 15 nt, Mycobacterium tuberculosis H37Rv
accgagacuugcugg

SEQ ID NO: 1335066 - RNA, 18 nt, Mycobacterium tuberculosis H37Rv
accgagaucaccgccacc

SEQ ID NO: 1335067 - RNA, 13 nt, Mycobacterium tuberculosis H37Rv
accgagaugcgca

SEQ ID NO: 1335068 - RNA, 14 nt, Mycobacterium tuberculosis H37Rv
acccgugccgccga

SEQ ID NO: 1335069 - RNA, 16 nt, Mycobacterium tuberculosis H37Rv
acccgucggcccgcuc

SEQ ID NO: 1335070 - RNA, 20 nt, Mycobacterium tuberculosis H37Rv
acccguugaucgcggacacu

SEQ ID NO: 1335071 - RNA, 22 nt, Mycobacterium tuberculosis H37Rv
acccguucuucgcgauguccuc

SEQ ID NO: 1335072 - RNA, 20 nt, Mycobacterium tuberculosis H37Rv
acccguucgaacuggcuggu

SEQ ID NO: 1335073 - RNA, 21 nt, Mycobacterium tuberculosis H37Rv
acccguguucgccacacccgu

SEQ ID NO: 1335074 - RNA, 13 nt, Mycobacterium tuberculosis H37Rv
acccuccagcacg

SEQ ID NO: 1335075 - RNA, 17 nt, Mycobacterium tuberculosis H37Rv
acccuccacagcggcca

SEQ ID NO: 1335076 - RNA, 22 nt, Mycobacterium tuberculosis H37Rv
acccuaaaccagccaccaccag

SEQ ID NO: 1335077 - RNA, 15 nt, Mycobacterium tuberculosis H37Rv
acccguuccacgccg

SEQ ID NO: 1335078 - RNA, 15 nt, Mycobacterium tuberculosis H37Rv
accggcgauccggua

SEQ ID NO: 1335079 - RNA, 16 nt, Mycobacterium tuberculosis H37Rv
accggcgccgccgucg

SEQ ID NO: 1335080 - RNA, 17 nt, Mycobacterium tuberculosis H37Rv
accggcgcccagcgccu

SEQ ID NO: 1335081 - RNA, 10 nt, Mycobacterium tuberculosis H37Rv
accggcgcca

SEQ ID NO: 1335082 - RNA, 21 nt, Mycobacterium tuberculosis H37Rv
accggccuuuccagcaccccg

SEQ ID NO: 1335083 - RNA, 16 nt, Mycobacterium tuberculosis H37Rv
accggccgugccgccg

SEQ ID NO: 1335084 - RNA, 14 nt, Mycobacterium tuberculosis H37Rv
accggccggugcca

SEQ ID NO: 1335085 - RNA, 17 nt, Mycobacterium tuberculosis H37Rv
accggccgcuauggccc

SEQ ID NO: 1335086 - RNA, 17 nt, Mycobacterium tuberculosis H37Rv
accggcguaaccggcag

SEQ ID NO: 1335087 - RNA, 14 nt, Mycobacterium tuberculosis H37Rv
accggcgccgccgg

SEQ ID NO: 1335088 - RNA, 19 nt, Mycobacterium tuberculosis H37Rv
accggcggcuacggcugcc

SEQ ID NO: 1335089 - RNA, 22 nt, Mycobacterium tuberculosis H37Rv
accggcggcgccgaaaccgccg

SEQ ID NO: 1335090 - RNA, 19 nt, Mycobacterium tuberculosis H37Rv
accggcggucugcagugca

SEQ ID NO: 1335091 - RNA, 19 nt, Mycobacterium tuberculosis H37Rv
accggcgggaugcgcgccc

SEQ ID NO: 1335092 - RNA, 16 nt, Mycobacterium tuberculosis H37Rv
accggcgccgccguug

SEQ ID NO: 1335093 - RNA, 12 nt, Mycobacterium tuberculosis H37Rv
accggcgccgcg

SEQ ID NO: 1335094 - RNA, 20 nt, Mycobacterium tuberculosis H37Rv
accggcugaccggggcgccc

SEQ ID NO: 1335095 - RNA, 15 nt, Mycobacterium tuberculosis H37Rv
accggcugcugagga

SEQ ID NO: 1335096 - RNA, 19 nt, Mycobacterium tuberculosis H37Rv
accggcucguagcuggugc

SEQ ID NO: 1335097 - RNA, 20 nt, Mycobacterium tuberculosis H37Rv
accggcuauaucccgccccg

SEQ ID NO: 1335098 - RNA, 22 nt, Mycobacterium tuberculosis H37Rv
accggcucaaggacgcaccgcc

SEQ ID NO: 1335099 - RNA, 21 nt, Mycobacterium tuberculosis H37Rv
accggcucaccacgccggucg

SEQ ID NO: 1335100 - RNA, 16 nt, Mycobacterium tuberculosis H37Rv
accggcuccagcaugg

SEQ ID NO: 1335101 - RNA, 13 nt, Mycobacterium tuberculosis H37Rv
accggcugcaggu

SEQ ID NO: 1335102 - RNA, 19 nt, Mycobacterium tuberculosis H37Rv
accggcugauucgagccac

SEQ ID NO: 1335103 - RNA, 15 nt, Mycobacterium tuberculosis H37Rv
accggcugggcgcca

SEQ ID NO: 1335104 - RNA, 21 nt, Mycobacterium tuberculosis H37Rv
accggcaagccacgccggucg

SEQ ID NO: 1335105 - RNA, 12 nt, Mycobacterium tuberculosis H37Rv
accggccagccg

SEQ ID NO: 1335106 - RNA, 17 nt, Mycobacterium tuberculosis H37Rv
accggccaguccgggga

SEQ ID NO: 1335107 - RNA, 20 nt, Mycobacterium tuberculosis H37Rv
accggccaucgaccguccgg

SEQ ID NO: 1335108 - RNA, 17 nt, Mycobacterium tuberculosis H37Rv
accggcccagugggacu

SEQ ID NO: 1335109 - RNA, 17 nt, Mycobacterium tuberculosis H37Rv
accggccccaccggcac

SEQ ID NO: 1335110 - RNA, 17 nt, Mycobacterium tuberculosis H37Rv
accggcccgcauccgca

SEQ ID NO: 1335111 - RNA, 19 nt, Mycobacterium tuberculosis H37Rv
accggcccgguccagcccc

SEQ ID NO: 1335112 - RNA, 13 nt, Mycobacterium tuberculosis H37Rv
accgcugccugcc

SEQ ID NO: 1335113 - RNA, 14 nt, Mycobacterium tuberculosis H37Rv
accgcugccugccg

SEQ ID NO: 1335114 - RNA, 13 nt, Mycobacterium tuberculosis H37Rv
accgcugccggcg

SEQ ID NO: 1335115 - RNA, 15 nt, Mycobacterium tuberculosis H37Rv
accgcugccggcagc

SEQ ID NO: 1335116 - RNA, 14 nt, Mycobacterium tuberculosis H37Rv
accgcugccgcauc

SEQ ID NO: 1335117 - RNA, 13 nt, Mycobacterium tuberculosis H37Rv
accgcugucaccg

SEQ ID NO: 1335118 - RNA, 21 nt, Mycobacterium tuberculosis H37Rv
accgcugggggcggucgccuc

SEQ ID NO: 1335119 - RNA, 23 nt, Mycobacterium tuberculosis H37Rv
accggaucgaccaauucgaccgc

SEQ ID NO: 1335120 - RNA, 17 nt, Mycobacterium tuberculosis H37Rv
accgcgguacgccgguc

SEQ ID NO: 1335121 - RNA, 18 nt, Mycobacterium tuberculosis H37Rv
accgcgggcggcaucgcc

SEQ ID NO: 1335122 - RNA, 22 nt, Mycobacterium tuberculosis H37Rv
accgcggcugucacgccugcca

SEQ ID NO: 1335123 - RNA, 23 nt, Mycobacterium tuberculosis H37Rv
accgcggugacucggccuccgcc

SEQ ID NO: 1335124 - RNA, 12 nt, Mycobacterium tuberculosis H37Rv
accgcugagccc

SEQ ID NO: 1335125 - RNA, 22 nt, Mycobacterium tuberculosis H37Rv
accgcugagguaauucgcggcc

SEQ ID NO: 1335126 - RNA, 20 nt, Mycobacterium tuberculosis H37Rv
accgcggacccgcagcugcg

SEQ ID NO: 1335127 - RNA, 16 nt, Mycobacterium tuberculosis H37Rv
accgcggauaggccgc

SEQ ID NO: 1335128 - RNA, 17 nt, Mycobacterium tuberculosis H37Rv
accgcggacccgcagcu

SEQ ID NO: 1335129 - RNA, 23 nt, Mycobacterium tuberculosis H37Rv
accgcgcugguugaacaugucca

SEQ ID NO: 1335130 - RNA, 17 nt, Mycobacterium tuberculosis H37Rv
accgcggaaggccagcu

SEQ ID NO: 1335131 - RNA, 19 nt, Mycobacterium tuberculosis H37Rv
accgcggaaggccagcucu

SEQ ID NO: 1335132 - RNA, 14 nt, Mycobacterium tuberculosis H37Rv
accgcggcccggac

SEQ ID NO: 1335133 - RNA, 14 nt, Mycobacterium tuberculosis H37Rv
accgcggccuuggc

SEQ ID NO: 1335134 - RNA, 13 nt, Mycobacterium tuberculosis H37Rv
accgcggccccgc

SEQ ID NO: 1335135 - RNA, 17 nt, Mycobacterium tuberculosis H37Rv
accgcggccaccgccug

SEQ ID NO: 1335136 - RNA, 22 nt, Mycobacterium tuberculosis H37Rv
accgcggcgcguccgggcucgc

SEQ ID NO: 1335137 - RNA, 20 nt, Mycobacterium tuberculosis H37Rv
accgcggcgcguccgggcuc

SEQ ID NO: 1335138 - RNA, 18 nt, Mycobacterium tuberculosis H37Rv
accgcggcgaucugcgac

SEQ ID NO: 1335139 - RNA, 20 nt, Mycobacterium tuberculosis H37Rv
accgcggcgauuacggccag

SEQ ID NO: 1335140 - RNA, 21 nt, Mycobacterium tuberculosis H37Rv
accgcgccgcgccgcgccgcc

SEQ ID NO: 1335141 - RNA, 17 nt, Mycobacterium tuberculosis H37Rv
accgcgcggcgcagcac

SEQ ID NO: 1335142 - RNA, 17 nt, Mycobacterium tuberculosis H37Rv
accgcgcggaucucacc

SEQ ID NO: 1335143 - RNA, 16 nt, Mycobacterium tuberculosis H37Rv
accgcgcccuucagca

SEQ ID NO: 1335144 - RNA, 17 nt, Mycobacterium tuberculosis H37Rv
accgcgccgaucaccac

SEQ ID NO: 1335145 - RNA, 20 nt, Mycobacterium tuberculosis H37Rv
accgcgccgaucaccaccgg

SEQ ID NO: 1335146 - RNA, 18 nt, Mycobacterium tuberculosis H37Rv
accgcgccaacagaugcc

SEQ ID NO: 1335147 - RNA, 21 nt, Mycobacterium tuberculosis H37Rv
accgcgcaucaucgcccaccg

SEQ ID NO: 1335148 - RNA, 14 nt, Mycobacterium tuberculosis H37Rv
accgcgcagcggug

SEQ ID NO: 1335149 - RNA, 20 nt, Mycobacterium tuberculosis H37Rv
accgcgaucaccaccggauc

SEQ ID NO: 1335150 - RNA, 18 nt, Mycobacterium tuberculosis H37Rv
accgccgccggcaccgcc

SEQ ID NO: 1335151 - RNA, 20 nt, Mycobacterium tuberculosis H37Rv
accgccgcgaccgccucgcc

SEQ ID NO: 1335152 - RNA, 18 nt, Mycobacterium tuberculosis H37Rv
accgccgcgcagccgcuc

SEQ ID NO: 1335153 - RNA, 15 nt, Mycobacterium tuberculosis H37Rv
accgccggcaccgcc

SEQ ID NO: 1335154 - RNA, 13 nt, Mycobacterium tuberculosis H37Rv
accgccgcugccg

SEQ ID NO: 1335155 - RNA, 19 nt, Mycobacterium tuberculosis H37Rv
accgccggggugugcagcg

SEQ ID NO: 1335156 - RNA, 21 nt, Mycobacterium tuberculosis H37Rv
accgccggcaccgccgccccc

SEQ ID NO: 1335157 - RNA, 16 nt, Mycobacterium tuberculosis H37Rv
accgccggccccaccg

SEQ ID NO: 1335158 - RNA, 14 nt, Mycobacterium tuberculosis H37Rv
accgccggcgcccc

SEQ ID NO: 1335159 - RNA, 16 nt, Mycobacterium tuberculosis H37Rv
accgccgucccggcuc

SEQ ID NO: 1335160 - RNA, 22 nt, Mycobacterium tuberculosis H37Rv
accgccgucccggcucgagcuc

SEQ ID NO: 1335161 - RNA, 16 nt, Mycobacterium tuberculosis H37Rv
accgccguugccgccg

SEQ ID NO: 1335162 - RNA, 15 nt, Mycobacterium tuberculosis H37Rv
accgcgacaccccgg

SEQ ID NO: 1335163 - RNA, 14 nt, Mycobacterium tuberculosis H37Rv
accgcgacccggcc

SEQ ID NO: 1335164 - RNA, 15 nt, Mycobacterium tuberculosis H37Rv
accgcgacggcgccg

SEQ ID NO: 1335165 - RNA, 17 nt, Mycobacterium tuberculosis H37Rv
accgcgaucaccaccgg

SEQ ID NO: 1335166 - RNA, 13 nt, Mycobacterium tuberculosis H37Rv
accgccugcgccu

SEQ ID NO: 1335167 - RNA, 22 nt, Mycobacterium tuberculosis H37Rv
accgccugugccgccggcgcca

SEQ ID NO: 1335168 - RNA, 22 nt, Mycobacterium tuberculosis H37Rv
accucgccaacaucccaacaca

SEQ ID NO: 1335169 - RNA, 21 nt, Mycobacterium tuberculosis H37Rv
accucgccaacaucccaacac

SEQ ID NO: 1335170 - RNA, 21 nt, Mycobacterium tuberculosis H37Rv
accucgaugccgccccgcagc

SEQ ID NO: 1335171 - RNA, 17 nt, Mycobacterium tuberculosis H37Rv
accucgcccugcagacg

SEQ ID NO: 1335172 - RNA, 13 nt, Mycobacterium tuberculosis H37Rv
accucgccgcccu

SEQ ID NO: 1335173 - RNA, 23 nt, Mycobacterium tuberculosis H37Rv
accucgccggccgucagcacaaa

SEQ ID NO: 1335174 - RNA, 15 nt, Mycobacterium tuberculosis H37Rv
accucggaucgccag

SEQ ID NO: 1335175 - RNA, 15 nt, Mycobacterium tuberculosis H37Rv
accucggacugcagc

SEQ ID NO: 1335176 - RNA, 16 nt, Mycobacterium tuberculosis H37Rv
accucggacugcagcg

SEQ ID NO: 1335177 - RNA, 16 nt, Mycobacterium tuberculosis H37Rv
accucggcguuggaaa

SEQ ID NO: 1335178 - RNA, 22 nt, Mycobacterium tuberculosis H37Rv
accucggcgacgaugaucucgc

SEQ ID NO: 1335179 - RNA, 14 nt, Mycobacterium tuberculosis H37Rv
accucggccgccag

SEQ ID NO: 1335180 - RNA, 21 nt, Mycobacterium tuberculosis H37Rv
accucguauacccgggcgguc

SEQ ID NO: 1335181 - RNA, 21 nt, Mycobacterium tuberculosis H37Rv
accucgucggcuuuggacagg

SEQ ID NO: 1335182 - RNA, 14 nt, Mycobacterium tuberculosis H37Rv
accucgucacccgg

SEQ ID NO: 1335183 - RNA, 18 nt, Mycobacterium tuberculosis H37Rv
accucggccgccagcccc

SEQ ID NO: 1335184 - RNA, 17 nt, Mycobacterium tuberculosis H37Rv
accucguugcugccggc

SEQ ID NO: 1335185 - RNA, 13 nt, Mycobacterium tuberculosis H37Rv
accucgugggcca

SEQ ID NO: 1335186 - RNA, 19 nt, Mycobacterium tuberculosis H37Rv
accucgugguucugcaggu

SEQ ID NO: 1335187 - RNA, 23 nt, Mycobacterium tuberculosis H37Rv
accucgucaaucaccaccgccag

SEQ ID NO: 1335188 - RNA, 17 nt, Mycobacterium tuberculosis H37Rv
accucugcugagcugcu

SEQ ID NO: 1335189 - RNA, 20 nt, Mycobacterium tuberculosis H37Rv
accucugcugagcugcucgc

SEQ ID NO: 1335190 - RNA, 16 nt, Mycobacterium tuberculosis H37Rv
accucucugucgcguu

SEQ ID NO: 1335191 - RNA, 19 nt, Mycobacterium tuberculosis H37Rv
accucuucgggugcagcca

SEQ ID NO: 1335192 - RNA, 15 nt, Mycobacterium tuberculosis H37Rv
accugacgcucgguc

SEQ ID NO: 1335193 - RNA, 22 nt, Mycobacterium tuberculosis H37Rv
accugacggaaguacuccaugg

SEQ ID NO: 1335194 - RNA, 17 nt, Mycobacterium tuberculosis H37Rv
accucagaaaguccccg

SEQ ID NO: 1335195 - RNA, 12 nt, Mycobacterium tuberculosis H37Rv
accucagcgcgg

SEQ ID NO: 1335196 - RNA, 17 nt, Mycobacterium tuberculosis H37Rv
accuccggguccaggaa

SEQ ID NO: 1335197 - RNA, 20 nt, Mycobacterium tuberculosis H37Rv
accuccucgaaggcuucgcu

SEQ ID NO: 1335198 - RNA, 14 nt, Mycobacterium tuberculosis H37Rv
accuccucgagcag

SEQ ID NO: 1335199 - RNA, 14 nt, Mycobacterium tuberculosis H37Rv
accuccgccggcac

SEQ ID NO: 1335200 - RNA, 16 nt, Mycobacterium tuberculosis H37Rv
accuccgccggcaccu

SEQ ID NO: 1335201 - RNA, 15 nt, Mycobacterium tuberculosis H37Rv
accuccggcaccgcc

SEQ ID NO: 1335202 - RNA, 17 nt, Mycobacterium tuberculosis H37Rv
accucgaagcccagcac

SEQ ID NO: 1335203 - RNA, 19 nt, Mycobacterium tuberculosis H37Rv
accuccugguugaccucgg

SEQ ID NO: 1335204 - RNA, 18 nt, Mycobacterium tuberculosis H37Rv
accuauccguucaauuuc

SEQ ID NO: 1335205 - RNA, 20 nt, Mycobacterium tuberculosis H37Rv
accgguggggacccgcucca

SEQ ID NO: 1335206 - RNA, 19 nt, Mycobacterium tuberculosis H37Rv
accgguggcgcccuugggc

SEQ ID NO: 1335207 - RNA, 15 nt, Mycobacterium tuberculosis H37Rv
accgguguagcagcg

SEQ ID NO: 1335208 - RNA, 14 nt, Mycobacterium tuberculosis H37Rv
accggugccgcccg

SEQ ID NO: 1335209 - RNA, 14 nt, Mycobacterium tuberculosis H37Rv
accgguggcagccu

SEQ ID NO: 1335210 - RNA, 18 nt, Mycobacterium tuberculosis H37Rv
accgggucgggcaccgcg

SEQ ID NO: 1335211 - RNA, 22 nt, Mycobacterium tuberculosis H37Rv
accggugauggugaccagcagg

SEQ ID NO: 1335212 - RNA, 18 nt, Mycobacterium tuberculosis H37Rv
accggugauggugaccag

SEQ ID NO: 1335213 - RNA, 15 nt, Mycobacterium tuberculosis H37Rv
accggugcccaccac

SEQ ID NO: 1335214 - RNA, 23 nt, Mycobacterium tuberculosis H37Rv
accgggcggcguuugagaacaac

SEQ ID NO: 1335215 - RNA, 20 nt, Mycobacterium tuberculosis H37Rv
accggggcgcccggccaggu

SEQ ID NO: 1335216 - RNA, 13 nt, Mycobacterium tuberculosis H37Rv
accggggcggccg

SEQ ID NO: 1335217 - RNA, 18 nt, Mycobacterium tuberculosis H37Rv
accggguccggugaaccc

SEQ ID NO: 1335218 - RNA, 16 nt, Mycobacterium tuberculosis H37Rv
acgaaccggaucaucg

SEQ ID NO: 1335219 - RNA, 15 nt, Mycobacterium tuberculosis H37Rv
acgaaccgccgccgc

SEQ ID NO: 1335220 - RNA, 16 nt, Mycobacterium tuberculosis H37Rv
acgaaccccacgcaga

SEQ ID NO: 1335221 - RNA, 16 nt, Mycobacterium tuberculosis H37Rv
acgaaccccaucagaa

SEQ ID NO: 1335222 - RNA, 18 nt, Mycobacterium tuberculosis H37Rv
acgaaaugcacgccgggc

SEQ ID NO: 1335223 - RNA, 12 nt, Mycobacterium tuberculosis H37Rv
accuucggccga

SEQ ID NO: 1335224 - RNA, 19 nt, Mycobacterium tuberculosis H37Rv
accuucggccgaccgggcu

SEQ ID NO: 1335225 - RNA, 18 nt, Mycobacterium tuberculosis H37Rv
accuucgcuauggcggcu

SEQ ID NO: 1335226 - RNA, 16 nt, Mycobacterium tuberculosis H37Rv
accuucgggacaaagc

SEQ ID NO: 1335227 - RNA, 18 nt, Mycobacterium tuberculosis H37Rv
accuugcggcagaccaag

SEQ ID NO: 1335228 - RNA, 23 nt, Mycobacterium tuberculosis H37Rv
accugguaguccccgaaccgagc

SEQ ID NO: 1335229 - RNA, 20 nt, Mycobacterium tuberculosis H37Rv
accugggcugccggccagac

SEQ ID NO: 1335230 - RNA, 14 nt, Mycobacterium tuberculosis H37Rv
accuggugcaaccg

SEQ ID NO: 1335231 - RNA, 16 nt, Mycobacterium tuberculosis H37Rv
accuguuuggggcugu

SEQ ID NO: 1335232 - RNA, 21 nt, Mycobacterium tuberculosis H37Rv
accugagcaucuccucgccug

SEQ ID NO: 1335233 - RNA, 15 nt, Mycobacterium tuberculosis H37Rv
accugaguccggcac

SEQ ID NO: 1335234 - RNA, 16 nt, Mycobacterium tuberculosis H37Rv
accugaggcaccucgg

SEQ ID NO: 1335235 - RNA, 18 nt, Mycobacterium tuberculosis H37Rv
accugggccaucacgguc

SEQ ID NO: 1335236 - RNA, 13 nt, Mycobacterium tuberculosis H37Rv
accuggggccacc

SEQ ID NO: 1335237 - RNA, 21 nt, Mycobacterium tuberculosis H37Rv
accuggggccaccagaaccac

SEQ ID NO: 1335238 - RNA, 22 nt, Mycobacterium tuberculosis H37Rv
accugggguguagccagcggcu

SEQ ID NO: 1335239 - RNA, 20 nt, Mycobacterium tuberculosis H37Rv
accugggcgacuaccggcuc

SEQ ID NO: 1335240 - RNA, 23 nt, Mycobacterium tuberculosis H37Rv
acgauccagcccaacucggccag

SEQ ID NO: 1335241 - RNA, 13 nt, Mycobacterium tuberculosis H37Rv
acgauccagcugu

SEQ ID NO: 1335242 - RNA, 21 nt, Mycobacterium tuberculosis H37Rv
acgaucgaugaccuuugaguc

SEQ ID NO: 1335243 - RNA, 20 nt, Mycobacterium tuberculosis H37Rv
acgauccccauugcgcccca

SEQ ID NO: 1335244 - RNA, 21 nt, Mycobacterium tuberculosis H37Rv
acgauccccauugcgccccau

SEQ ID NO: 1335245 - RNA, 14 nt, Mycobacterium tuberculosis H37Rv
acgaucgaugaccu

SEQ ID NO: 1335246 - RNA, 22 nt, Mycobacterium tuberculosis H37Rv
acgaucugcaggcccaggcugu

SEQ ID NO: 1335247 - RNA, 21 nt, Mycobacterium tuberculosis H37Rv
acgaucucguggaucugccuc

SEQ ID NO: 1335248 - RNA, 18 nt, Mycobacterium tuberculosis H37Rv
acgaugccucggcggccu

SEQ ID NO: 1335249 - RNA, 13 nt, Mycobacterium tuberculosis H37Rv
acgauggcggcca

SEQ ID NO: 1335250 - RNA, 19 nt, Mycobacterium tuberculosis H37Rv
acgauggcgucggccagga

SEQ ID NO: 1335251 - RNA, 16 nt, Mycobacterium tuberculosis H37Rv
acgauggcgaugaggu

SEQ ID NO: 1335252 - RNA, 16 nt, Mycobacterium tuberculosis H37Rv
acgauguccuggaagc

SEQ ID NO: 1335253 - RNA, 15 nt, Mycobacterium tuberculosis H37Rv
acgaugucacccucc

SEQ ID NO: 1335254 - RNA, 20 nt, Mycobacterium tuberculosis H37Rv
acgaugguguacugcugcuu

SEQ ID NO: 1335255 - RNA, 19 nt, Mycobacterium tuberculosis H37Rv
acgaugguguacugcugcu

SEQ ID NO: 1335256 - RNA, 13 nt, Mycobacterium tuberculosis H37Rv
acgauucaccaau

SEQ ID NO: 1335257 - RNA, 16 nt, Mycobacterium tuberculosis H37Rv
acgauuuuagcggcug

SEQ ID NO: 1335258 - RNA, 13 nt, Mycobacterium tuberculosis H37Rv
acgcaaaagaacc

SEQ ID NO: 1335259 - RNA, 18 nt, Mycobacterium tuberculosis H37Rv
acgaagaucuucaccggc

SEQ ID NO: 1335260 - RNA, 15 nt, Mycobacterium tuberculosis H37Rv
acgaagagcaccgcg

SEQ ID NO: 1335261 - RNA, 21 nt, Mycobacterium tuberculosis H37Rv
acgaagagggcgccgcgcgca

SEQ ID NO: 1335262 - RNA, 22 nt, Mycobacterium tuberculosis H37Rv
acgaacuccgcguugggcaccu

SEQ ID NO: 1335263 - RNA, 23 nt, Mycobacterium tuberculosis H37Rv
acgaaggucgcggucgagcaggu

SEQ ID NO: 1335264 - RNA, 21 nt, Mycobacterium tuberculosis H37Rv
acgacugucccagcucccgcg

SEQ ID NO: 1335265 - RNA, 18 nt, Mycobacterium tuberculosis H37Rv
acgaggacgucaccguca

SEQ ID NO: 1335266 - RNA, 18 nt, Mycobacterium tuberculosis H37Rv
acgaguacgggcaggccg

SEQ ID NO: 1335267 - RNA, 14 nt, Mycobacterium tuberculosis H37Rv
acgaggucugcggc

SEQ ID NO: 1335268 - RNA, 15 nt, Mycobacterium tuberculosis H37Rv
acgagguugccgcac

SEQ ID NO: 1335269 - RNA, 17 nt, Mycobacterium tuberculosis H37Rv
acgaggcguucaccacg

SEQ ID NO: 1335270 - RNA, 20 nt, Mycobacterium tuberculosis H37Rv
acgagggccacguagcagca

SEQ ID NO: 1335271 - RNA, 23 nt, Mycobacterium tuberculosis H37Rv
acgauagaacguagcgcccaccg

SEQ ID NO: 1335272 - RNA, 14 nt, Mycobacterium tuberculosis H37Rv
acgcagcgcggcug

SEQ ID NO: 1335273 - RNA, 22 nt, Mycobacterium tuberculosis H37Rv
acgcaggaaaaccccggccacc

SEQ ID NO: 1335274 - RNA, 15 nt, Mycobacterium tuberculosis H37Rv
acgcaggaucacacu

SEQ ID NO: 1335275 - RNA, 19 nt, Mycobacterium tuberculosis H37Rv
acgcagccguagcugggca

SEQ ID NO: 1335276 - RNA, 23 nt, Mycobacterium tuberculosis H37Rv
acgcagccguagcugggcacccc

SEQ ID NO: 1335277 - RNA, 17 nt, Mycobacterium tuberculosis H37Rv
acgcacucccgagccac

SEQ ID NO: 1335278 - RNA, 22 nt, Mycobacterium tuberculosis H37Rv
acgcacucggggcugucggcga

SEQ ID NO: 1335279 - RNA, 17 nt, Mycobacterium tuberculosis H37Rv
acgcacugccccgcauc

SEQ ID NO: 1335280 - RNA, 17 nt, Mycobacterium tuberculosis H37Rv
acgcagaccguccagca

SEQ ID NO: 1335281 - RNA, 16 nt, Mycobacterium tuberculosis H37Rv
acgcagagucaacaga

SEQ ID NO: 1335282 - RNA, 11 nt, Mycobacterium tuberculosis H37Rv
acgcaacaucg

SEQ ID NO: 1335283 - RNA, 17 nt, Mycobacterium tuberculosis H37Rv
acgcaccgcgguggggu

SEQ ID NO: 1335284 - RNA, 12 nt, Mycobacterium tuberculosis H37Rv
acgcaccgcccc

SEQ ID NO: 1335285 - RNA, 16 nt, Mycobacterium tuberculosis H37Rv
acgcaccacgagcagc

SEQ ID NO: 1335286 - RNA, 23 nt, Mycobacterium tuberculosis H37Rv
acgcaccacaaacaccccacaca

SEQ ID NO: 1335287 - RNA, 15 nt, Mycobacterium tuberculosis H37Rv
acgcaccacaaucca

SEQ ID NO: 1335288 - RNA, 19 nt, Mycobacterium tuberculosis H37Rv
acgcaugucgggccaggcg

SEQ ID NO: 1335289 - RNA, 13 nt, Mycobacterium tuberculosis H37Rv
acgcaugagggca

SEQ ID NO: 1335290 - RNA, 21 nt, Mycobacterium tuberculosis H37Rv
acgcauaucgcuugaacgcau

SEQ ID NO: 1335291 - RNA, 20 nt, Mycobacterium tuberculosis H37Rv
acgcagucgcccacuauggc

SEQ ID NO: 1335292 - RNA, 22 nt, Mycobacterium tuberculosis H37Rv
acgcaggugaacgccggugcgc

SEQ ID NO: 1335293 - RNA, 18 nt, Mycobacterium tuberculosis H37Rv
acgcagucgggcagcgcu

SEQ ID NO: 1335294 - RNA, 13 nt, Mycobacterium tuberculosis H37Rv
acgccacccaggg

SEQ ID NO: 1335295 - RNA, 15 nt, Mycobacterium tuberculosis H37Rv
acgccacccagggcc

SEQ ID NO: 1335296 - RNA, 21 nt, Mycobacterium tuberculosis H37Rv
acgccaccgccaccacccagg

SEQ ID NO: 1335297 - RNA, 13 nt, Mycobacterium tuberculosis H37Rv
acgccacugccag

SEQ ID NO: 1335298 - RNA, 23 nt, Mycobacterium tuberculosis H37Rv
acgccagaacguggccauccucg

SEQ ID NO: 1335299 - RNA, 15 nt, Mycobacterium tuberculosis H37Rv
acgccagucgagcac

SEQ ID NO: 1335300 - RNA, 21 nt, Mycobacterium tuberculosis H37Rv
acgccagugaacgcgcgugca

SEQ ID NO: 1335301 - RNA, 16 nt, Mycobacterium tuberculosis H37Rv
acgccaggugcagcac

SEQ ID NO: 1335302 - RNA, 17 nt, Mycobacterium tuberculosis H37Rv
acgccagccuggccauc

SEQ ID NO: 1335303 - RNA, 23 nt, Mycobacterium tuberculosis H37Rv
acgguggccgcugccagccguuc

SEQ ID NO: 1335304 - RNA, 12 nt, Mycobacterium tuberculosis H37Rv
acggugcugccg

SEQ ID NO: 1335305 - RNA, 16 nt, Mycobacterium tuberculosis H37Rv
acggugcgcuggaugu

SEQ ID NO: 1335306 - RNA, 19 nt, Mycobacterium tuberculosis H37Rv
acggugcucuucgaugacu

SEQ ID NO: 1335307 - RNA, 15 nt, Mycobacterium tuberculosis H37Rv
acggugggugguugu

SEQ ID NO: 1335308 - RNA, 18 nt, Mycobacterium tuberculosis H37Rv
acgguuggaugccugccu

SEQ ID NO: 1335309 - RNA, 20 nt, Mycobacterium tuberculosis H37Rv
acgguggcgccgucggccga

SEQ ID NO: 1335310 - RNA, 14 nt, Mycobacterium tuberculosis H37Rv
acggugauggggga

SEQ ID NO: 1335311 - RNA, 17 nt, Mycobacterium tuberculosis H37Rv
acggugcaggaccagaa

SEQ ID NO: 1335312 - RNA, 18 nt, Mycobacterium tuberculosis H37Rv
acggugaucgccggcuuc

SEQ ID NO: 1335313 - RNA, 16 nt, Mycobacterium tuberculosis H37Rv
acgguacagcuccaca

SEQ ID NO: 1335314 - RNA, 18 nt, Mycobacterium tuberculosis H37Rv
acggguugucguugcugg

SEQ ID NO: 1335315 - RNA, 20 nt, Mycobacterium tuberculosis H37Rv
acggguggugccaggucggc

SEQ ID NO: 1335316 - RNA, 17 nt, Mycobacterium tuberculosis H37Rv
acgggcucggcaggccc

SEQ ID NO: 1335317 - RNA, 13 nt, Mycobacterium tuberculosis H37Rv
acgggcggccacc

SEQ ID NO: 1335318 - RNA, 19 nt, Mycobacterium tuberculosis H37Rv
acgggcuaccggcagcugc

SEQ ID NO: 1335319 - RNA, 16 nt, Mycobacterium tuberculosis H37Rv
acgggcuaccggcagc

SEQ ID NO: 1335320 - RNA, 15 nt, Mycobacterium tuberculosis H37Rv
acggcaagccauuca

SEQ ID NO: 1335321 - RNA, 19 nt, Mycobacterium tuberculosis H37Rv
acggcaaguuccacgggug

SEQ ID NO: 1335322 - RNA, 15 nt, Mycobacterium tuberculosis H37Rv
acggcgcccagcgcu

SEQ ID NO: 1335323 - RNA, 18 nt, Mycobacterium tuberculosis H37Rv
acggcgcccauagcaccu

SEQ ID NO: 1335324 - RNA, 21 nt, Mycobacterium tuberculosis H37Rv
acggcgcaugcguaugcccac

SEQ ID NO: 1335325 - RNA, 23 nt, Mycobacterium tuberculosis H37Rv
acggcgccgaacccgguguugag

SEQ ID NO: 1335326 - RNA, 19 nt, Mycobacterium tuberculosis H37Rv
acggcgccgacccgaucac

SEQ ID NO: 1335327 - RNA, 13 nt, Mycobacterium tuberculosis H37Rv
acggcuaccaccg

SEQ ID NO: 1335328 - RNA, 20 nt, Mycobacterium tuberculosis H37Rv
acggcguuuucaauuucacu

SEQ ID NO: 1335329 - RNA, 16 nt, Mycobacterium tuberculosis H37Rv
acggcgugucggggua

SEQ ID NO: 1335330 - RNA, 21 nt, Mycobacterium tuberculosis H37Rv
acggcguugcggaaucagcac

SEQ ID NO: 1335331 - RNA, 17 nt, Mycobacterium tuberculosis H37Rv
acggcguugagcaggug

SEQ ID NO: 1335332 - RNA, 17 nt, Mycobacterium tuberculosis H37Rv
acggcguugaucagugc

SEQ ID NO: 1335333 - RNA, 21 nt, Mycobacterium tuberculosis H37Rv
acggcgugaaguggucguaga

SEQ ID NO: 1335334 - RNA, 22 nt, Mycobacterium tuberculosis H37Rv
acggcgucgggccguugugcgg

SEQ ID NO: 1335335 - RNA, 19 nt, Mycobacterium tuberculosis H37Rv
acggcgcucggcgagcuca

SEQ ID NO: 1335336 - RNA, 14 nt, Mycobacterium tuberculosis H37Rv
acggcuccuccggu

SEQ ID NO: 1335337 - RNA, 17 nt, Mycobacterium tuberculosis H37Rv
acggcuccuccgguauc

SEQ ID NO: 1335338 - RNA, 18 nt, Mycobacterium tuberculosis H37Rv
acggcugccgucagccgu

SEQ ID NO: 1335339 - RNA, 21 nt, Mycobacterium tuberculosis H37Rv
acggcugaccggggucggccu

SEQ ID NO: 1335340 - RNA, 23 nt, Mycobacterium tuberculosis H37Rv
acggcugaccuucucacgcacca

SEQ ID NO: 1335341 - RNA, 14 nt, Mycobacterium tuberculosis H37Rv
acggcugccacgcg

SEQ ID NO: 1335342 - RNA, 22 nt, Mycobacterium tuberculosis H37Rv
acggcucgggcagcgucacccu

SEQ ID NO: 1335343 - RNA, 20 nt, Mycobacterium tuberculosis H37Rv
acggcuuggcugccuccauc

SEQ ID NO: 1335344 - RNA, 21 nt, Mycobacterium tuberculosis H37Rv
acgggccuucagcucaccacc

SEQ ID NO: 1335345 - RNA, 16 nt, Mycobacterium tuberculosis H37Rv
acgccaguguugcgcu

SEQ ID NO: 1335346 - RNA, 22 nt, Mycobacterium tuberculosis H37Rv
acgcucguuugcgagcagggga

SEQ ID NO: 1335347 - RNA, 20 nt, Mycobacterium tuberculosis H37Rv
acgcucguuugcgagcaggg

SEQ ID NO: 1335348 - RNA, 17 nt, Mycobacterium tuberculosis H37Rv
acgcucugcgccacagc

SEQ ID NO: 1335349 - RNA, 19 nt, Mycobacterium tuberculosis H37Rv
acgcucguuugcgagcagg

SEQ ID NO: 1335350 - RNA, 17 nt, Mycobacterium tuberculosis H37Rv
acgcucaguuuggccug

SEQ ID NO: 1335351 - RNA, 18 nt, Mycobacterium tuberculosis H37Rv
acgcugacgcccucauag

SEQ ID NO: 1335352 - RNA, 12 nt, Mycobacterium tuberculosis H37Rv
acgcugcaggcg

SEQ ID NO: 1335353 - RNA, 13 nt, Mycobacterium tuberculosis H37Rv
acgcugccaagcg

SEQ ID NO: 1335354 - RNA, 23 nt, Mycobacterium tuberculosis H37Rv
acgcugaucuuccccucggccgc

SEQ ID NO: 1335355 - RNA, 22 nt, Mycobacterium tuberculosis H37Rv
acgcuucggcagcucccgccac

SEQ ID NO: 1335356 - RNA, 22 nt, Mycobacterium tuberculosis H37Rv
acgcuucuuccgcgcgccggcg

SEQ ID NO: 1335357 - RNA, 23 nt, Mycobacterium tuberculosis H37Rv
acggauaauucaacagcaccgcg

SEQ ID NO: 1335358 - RNA, 17 nt, Mycobacterium tuberculosis H37Rv
acggaucgcggcggcgu

SEQ ID NO: 1335359 - RNA, 21 nt, Mycobacterium tuberculosis H37Rv
acggaucgcccugacacccau

SEQ ID NO: 1335360 - RNA, 20 nt, Mycobacterium tuberculosis H37Rv
acggauucccgcccagcagc

SEQ ID NO: 1335361 - RNA, 17 nt, Mycobacterium tuberculosis H37Rv
acggauucgaaggcacc

SEQ ID NO: 1335362 - RNA, 23 nt, Mycobacterium tuberculosis H37Rv
acggaccguuaccggacccgcug

SEQ ID NO: 1335363 - RNA, 15 nt, Mycobacterium tuberculosis H37Rv
acggagaccguggau

SEQ ID NO: 1335364 - RNA, 15 nt, Mycobacterium tuberculosis H37Rv
acggaaccgauaccu

SEQ ID NO: 1335365 - RNA, 16 nt, Mycobacterium tuberculosis H37Rv
acuagccaguuacguu

SEQ ID NO: 1335366 - RNA, 19 nt, Mycobacterium tuberculosis H37Rv
acuagccgauccagcaggc

SEQ ID NO: 1335367 - RNA, 15 nt, Mycobacterium tuberculosis H37Rv
acuaccgaucacaua

SEQ ID NO: 1335368 - RNA, 16 nt, Mycobacterium tuberculosis H37Rv
acuaagggcacuccac

SEQ ID NO: 1335369 - RNA, 19 nt, Mycobacterium tuberculosis H37Rv
acuaaccuggcguagauca

SEQ ID NO: 1335370 - RNA, 16 nt, Mycobacterium tuberculosis H37Rv
acuaacggcagccacc

SEQ ID NO: 1335371 - RNA, 16 nt, Mycobacterium tuberculosis H37Rv
acuaacaacaccacca

SEQ ID NO: 1335372 - RNA, 22 nt, Mycobacterium tuberculosis H37Rv
acgucuucgaccucacccaccc

SEQ ID NO: 1335373 - RNA, 14 nt, Mycobacterium tuberculosis H37Rv
acgugccuuccucg

SEQ ID NO: 1335374 - RNA, 23 nt, Mycobacterium tuberculosis H37Rv
acgugcgaaucgagacggccacg

SEQ ID NO: 1335375 - RNA, 23 nt, Mycobacterium tuberculosis H37Rv
acgugcgagcccaccuggggccg

SEQ ID NO: 1335376 - RNA, 18 nt, Mycobacterium tuberculosis H37Rv
acguagcagcgccggcac

SEQ ID NO: 1335377 - RNA, 23 nt, Mycobacterium tuberculosis H37Rv
acguagccguacgguccgaacac

SEQ ID NO: 1335378 - RNA, 15 nt, Mycobacterium tuberculosis H37Rv
acguaggcgcugaag

SEQ ID NO: 1335379 - RNA, 15 nt, Mycobacterium tuberculosis H37Rv
acgucugccaggcgc

SEQ ID NO: 1335380 - RNA, 21 nt, Mycobacterium tuberculosis H37Rv
acgugcucguagacuugcugc

SEQ ID NO: 1335381 - RNA, 18 nt, Mycobacterium tuberculosis H37Rv
acguugacguccaacagc

SEQ ID NO: 1335382 - RNA, 22 nt, Mycobacterium tuberculosis H37Rv
acguuggccgagcagggccggc

SEQ ID NO: 1335383 - RNA, 22 nt, Mycobacterium tuberculosis H37Rv
acguugauccgcgcaacuucca

SEQ ID NO: 1335384 - RNA, 17 nt, Mycobacterium tuberculosis H37Rv
acguugcagccggcaua

SEQ ID NO: 1335385 - RNA, 12 nt, Mycobacterium tuberculosis H37Rv
acguugcagccg

SEQ ID NO: 1335386 - RNA, 19 nt, Mycobacterium tuberculosis H37Rv
acuuagcgggugccagccc

SEQ ID NO: 1335387 - RNA, 13 nt, Mycobacterium tuberculosis H37Rv
acuguuccgggug

SEQ ID NO: 1335388 - RNA, 17 nt, Mycobacterium tuberculosis H37Rv
acugucuugggggccaa

SEQ ID NO: 1335389 - RNA, 23 nt, Mycobacterium tuberculosis H37Rv
acugucggguaaccccaccugga

SEQ ID NO: 1335390 - RNA, 18 nt, Mycobacterium tuberculosis H37Rv
acuugagcuccucacgga

SEQ ID NO: 1335391 - RNA, 15 nt, Mycobacterium tuberculosis H37Rv
acuucuucacuggcg

SEQ ID NO: 1335392 - RNA, 17 nt, Mycobacterium tuberculosis H37Rv
acuucuucgacgcgcau

SEQ ID NO: 1335393 - RNA, 17 nt, Mycobacterium tuberculosis H37Rv
acuucggugagcagggc

SEQ ID NO: 1335394 - RNA, 14 nt, Mycobacterium tuberculosis H37Rv
acuucuccaggcug

SEQ ID NO: 1335395 - RNA, 19 nt, Mycobacterium tuberculosis H37Rv
acuuccgggcagcugggca

SEQ ID NO: 1335396 - RNA, 21 nt, Mycobacterium tuberculosis H37Rv
acuuccgggcagcugggcagg

SEQ ID NO: 1335397 - RNA, 17 nt, Mycobacterium tuberculosis H37Rv
acuucggggucaccggc

SEQ ID NO: 1335398 - RNA, 15 nt, Mycobacterium tuberculosis H37Rv
acuucaugaugacaa

SEQ ID NO: 1335399 - RNA, 20 nt, Mycobacterium tuberculosis H37Rv
acuucccgcgcgagccgcuc

SEQ ID NO: 1335400 - RNA, 17 nt, Mycobacterium tuberculosis H37Rv
acugaggcucaggugcu

SEQ ID NO: 1335401 - RNA, 15 nt, Mycobacterium tuberculosis H37Rv
acugagccacaggga

SEQ ID NO: 1335402 - RNA, 17 nt, Mycobacterium tuberculosis H37Rv
acugagaucgcuucccg

SEQ ID NO: 1335403 - RNA, 17 nt, Mycobacterium tuberculosis H37Rv
acugcaacucuucccau

SEQ ID NO: 1335404 - RNA, 14 nt, Mycobacterium tuberculosis H37Rv
acugcaucaccacu

SEQ ID NO: 1335405 - RNA, 20 nt, Mycobacterium tuberculosis H37Rv
acugaucgaccgccuccucg

SEQ ID NO: 1335406 - RNA, 19 nt, Mycobacterium tuberculosis H37Rv
acugaucuuggcccgggcc

SEQ ID NO: 1335407 - RNA, 15 nt, Mycobacterium tuberculosis H37Rv
acugcgaaugcuggg

SEQ ID NO: 1335408 - RNA, 17 nt, Mycobacterium tuberculosis H37Rv
acugcgaaugcugggcc

SEQ ID NO: 1335409 - RNA, 13 nt, Mycobacterium tuberculosis H37Rv
acugcgccgccgg

SEQ ID NO: 1335410 - RNA, 19 nt, Mycobacterium tuberculosis H37Rv
acugcggcccgacccggcc

SEQ ID NO: 1335411 - RNA, 13 nt, Mycobacterium tuberculosis H37Rv
acugcgccguucg

SEQ ID NO: 1335412 - RNA, 14 nt, Mycobacterium tuberculosis H37Rv
acugcgccguucgc

SEQ ID NO: 1335413 - RNA, 17 nt, Mycobacterium tuberculosis H37Rv
acugcgcaccugggucg

SEQ ID NO: 1335414 - RNA, 18 nt, Mycobacterium tuberculosis H37Rv
acugcgaccgucccggcc

SEQ ID NO: 1335415 - RNA, 15 nt, Mycobacterium tuberculosis H37Rv
acugcugggcuucga

SEQ ID NO: 1335416 - RNA, 15 nt, Mycobacterium tuberculosis H37Rv
acugcggccugcucg

SEQ ID NO: 1335417 - RNA, 18 nt, Mycobacterium tuberculosis H37Rv
acugcguaguugauggcc

SEQ ID NO: 1335418 - RNA, 20 nt, Mycobacterium tuberculosis H37Rv
acuggaauggcucacgcucc

SEQ ID NO: 1335419 - RNA, 18 nt, Mycobacterium tuberculosis H37Rv
acuggacaagcuccucgc

SEQ ID NO: 1335420 - RNA, 11 nt, Mycobacterium tuberculosis H37Rv
acuggaaagca

SEQ ID NO: 1335421 - RNA, 17 nt, Mycobacterium tuberculosis H37Rv
acuggaaagcagcagcg

SEQ ID NO: 1335422 - RNA, 16 nt, Mycobacterium tuberculosis H37Rv
acuccggucagcgcgg

SEQ ID NO: 1335423 - RNA, 18 nt, Mycobacterium tuberculosis H37Rv
acucccguggccgaugug

SEQ ID NO: 1335424 - RNA, 20 nt, Mycobacterium tuberculosis H37Rv
acucccggcucggccagcca

SEQ ID NO: 1335425 - RNA, 24 nt, Mycobacterium tuberculosis H37Rv
acucccggcucggccagccagcgg

SEQ ID NO: 1335426 - RNA, 16 nt, Mycobacterium tuberculosis H37Rv
acucccggcucggcca

SEQ ID NO: 1335427 - RNA, 19 nt, Mycobacterium tuberculosis H37Rv
acucccggauauugccauc

SEQ ID NO: 1335428 - RNA, 15 nt, Mycobacterium tuberculosis H37Rv
acucccgagccacaa

SEQ ID NO: 1335429 - RNA, 15 nt, Mycobacterium tuberculosis H37Rv
acuccccgccgggca

SEQ ID NO: 1335430 - RNA, 12 nt, Mycobacterium tuberculosis H37Rv
acuccccagaca

SEQ ID NO: 1335431 - RNA, 12 nt, Mycobacterium tuberculosis H37Rv
acucggcccaca

SEQ ID NO: 1335432 - RNA, 12 nt, Mycobacterium tuberculosis H37Rv
acucggcggcuu

SEQ ID NO: 1335433 - RNA, 16 nt, Mycobacterium tuberculosis H37Rv
acucggccgggcucua

SEQ ID NO: 1335434 - RNA, 19 nt, Mycobacterium tuberculosis H37Rv
acucguugagcagcuggac

SEQ ID NO: 1335435 - RNA, 20 nt, Mycobacterium tuberculosis H37Rv
acucggcgucgugguggcca

SEQ ID NO: 1335436 - RNA, 15 nt, Mycobacterium tuberculosis H37Rv
acucggcggaagacc

SEQ ID NO: 1335437 - RNA, 18 nt, Mycobacterium tuberculosis H37Rv
acucggacccacccuggu

SEQ ID NO: 1335438 - RNA, 14 nt, Mycobacterium tuberculosis H37Rv
acucggacccaccc

SEQ ID NO: 1335439 - RNA, 17 nt, Mycobacterium tuberculosis H37Rv
acucgauaugcagcucg

SEQ ID NO: 1335440 - RNA, 21 nt, Mycobacterium tuberculosis H37Rv
acucgagcgcucacauucaac

SEQ ID NO: 1335441 - RNA, 12 nt, Mycobacterium tuberculosis H37Rv
acucgcucagga

SEQ ID NO: 1335442 - RNA, 15 nt, Mycobacterium tuberculosis H37Rv
acucgaccaggaccg

SEQ ID NO: 1335443 - RNA, 19 nt, Mycobacterium tuberculosis H37Rv
acucgaccaccgccggccc

SEQ ID NO: 1335444 - RNA, 13 nt, Mycobacterium tuberculosis H37Rv
acucgaagcggug

SEQ ID NO: 1335445 - RNA, 18 nt, Mycobacterium tuberculosis H37Rv
acucgaggaccugcucgg

SEQ ID NO: 1335446 - RNA, 18 nt, Mycobacterium tuberculosis H37Rv
acucgagagcgaucaacg

SEQ ID NO: 1335447 - RNA, 13 nt, Mycobacterium tuberculosis H37Rv
acuccucagccgc

SEQ ID NO: 1335448 - RNA, 16 nt, Mycobacterium tuberculosis H37Rv
acuccucagccgccug

SEQ ID NO: 1335449 - RNA, 18 nt, Mycobacterium tuberculosis H37Rv
acucgaaccguuucggga

SEQ ID NO: 1335450 - RNA, 19 nt, Mycobacterium tuberculosis H37Rv
acucuucccauuucggcaa

SEQ ID NO: 1335451 - RNA, 20 nt, Mycobacterium tuberculosis H37Rv
aaucgcugaccgcguagacc

SEQ ID NO: 1335452 - RNA, 16 nt, Mycobacterium tuberculosis H37Rv
aaucggauagccgugc

SEQ ID NO: 1335453 - RNA, 16 nt, Mycobacterium tuberculosis H37Rv
aaucggcaagacgcgg

SEQ ID NO: 1335454 - RNA, 20 nt, Mycobacterium tuberculosis H37Rv
aaucggcaggauucccucga

SEQ ID NO: 1335455 - RNA, 18 nt, Mycobacterium tuberculosis H37Rv
aaucggcaggauucccuc

SEQ ID NO: 1335456 - RNA, 16 nt, Mycobacterium tuberculosis H37Rv
aaucgggauagcccag

SEQ ID NO: 1335457 - RNA, 19 nt, Mycobacterium tuberculosis H37Rv
aaucggcggcguccagcag

SEQ ID NO: 1335458 - RNA, 20 nt, Mycobacterium tuberculosis H37Rv
aaucucgguggugcgcucgc

SEQ ID NO: 1335459 - RNA, 21 nt, Mycobacterium tuberculosis H37Rv
aaucuccggcuggcccaccuc

SEQ ID NO: 1335460 - RNA, 17 nt, Mycobacterium tuberculosis H37Rv
aaucgaccgaacgccag

SEQ ID NO: 1335461 - RNA, 15 nt, Mycobacterium tuberculosis H37Rv
aaucgcccagugugc

SEQ ID NO: 1335462 - RNA, 14 nt, Mycobacterium tuberculosis H37Rv
aaucgccugcgaca

SEQ ID NO: 1335463 - RNA, 21 nt, Mycobacterium tuberculosis H37Rv
aaucagcccgcgcagcggucc

SEQ ID NO: 1335464 - RNA, 13 nt, Mycobacterium tuberculosis H37Rv
aaucagccaggcc

SEQ ID NO: 1335465 - RNA, 18 nt, Mycobacterium tuberculosis H37Rv
aauccaaggcucagcagc

SEQ ID NO: 1335466 - RNA, 19 nt, Mycobacterium tuberculosis H37Rv
aauccaaggcucagcagcg

SEQ ID NO: 1335467 - RNA, 13 nt, Mycobacterium tuberculosis H37Rv
aauccacaaugcc

SEQ ID NO: 1335468 - RNA, 18 nt, Mycobacterium tuberculosis H37Rv
aauggauugcggcacgga

SEQ ID NO: 1335469 - RNA, 22 nt, Mycobacterium tuberculosis H37Rv
aaugggaccgggcguuucccug

SEQ ID NO: 1335470 - RNA, 16 nt, Mycobacterium tuberculosis H37Rv
aaugggcgccacagcc

SEQ ID NO: 1335471 - RNA, 19 nt, Mycobacterium tuberculosis H37Rv
aauggcggccuugcucagc

SEQ ID NO: 1335472 - RNA, 21 nt, Mycobacterium tuberculosis H37Rv
aauggcgcugauggugcugcg

SEQ ID NO: 1335473 - RNA, 16 nt, Mycobacterium tuberculosis H37Rv
aaugaccugcagcgca

SEQ ID NO: 1335474 - RNA, 17 nt, Mycobacterium tuberculosis H37Rv
aauuucgauuucccaug

SEQ ID NO: 1335475 - RNA, 20 nt, Mycobacterium tuberculosis H37Rv
aauuucgauuucccaugcaa

SEQ ID NO: 1335476 - RNA, 22 nt, Mycobacterium tuberculosis H37Rv
aauugcguucgccgcccggcgu

SEQ ID NO: 1335477 - RNA, 11 nt, Mycobacterium tuberculosis H37Rv
aauuugacgac

SEQ ID NO: 1335478 - RNA, 14 nt, Mycobacterium tuberculosis H37Rv
aauuuggugaagug

SEQ ID NO: 1335479 - RNA, 13 nt, Mycobacterium tuberculosis H37Rv
aauguaguccagc

SEQ ID NO: 1335480 - RNA, 22 nt, Mycobacterium tuberculosis H37Rv
aauggucgucgcgaucagaaac

SEQ ID NO: 1335481 - RNA, 15 nt, Mycobacterium tuberculosis H37Rv
aaugggcgccacagc

SEQ ID NO: 1335482 - RNA, 18 nt, Mycobacterium tuberculosis H37Rv
aauuccgcagagaccaag

SEQ ID NO: 1335483 - RNA, 18 nt, Mycobacterium tuberculosis H37Rv
aauuccggcucaccgauc

SEQ ID NO: 1335484 - RNA, 23 nt, Mycobacterium tuberculosis H37Rv
aauucgccaaggccgucgaccca

SEQ ID NO: 1335485 - RNA, 20 nt, Mycobacterium tuberculosis H37Rv
aauucggcacgaaauugggc

SEQ ID NO: 1335486 - RNA, 21 nt, Mycobacterium tuberculosis H37Rv
aauucgggcauggucgccgga

SEQ ID NO: 1335487 - RNA, 16 nt, Mycobacterium tuberculosis H37Rv
acaacuguccugccag

SEQ ID NO: 1335488 - RNA, 22 nt, Mycobacterium tuberculosis H37Rv
acaacuggugggccaucgucag

SEQ ID NO: 1335489 - RNA, 17 nt, Mycobacterium tuberculosis H37Rv
acaacugcgccggugcc

SEQ ID NO: 1335490 - RNA, 17 nt, Mycobacterium tuberculosis H37Rv
acaacuggugggccauc

SEQ ID NO: 1335491 - RNA, 12 nt, Mycobacterium tuberculosis H37Rv
acaacuccagca

SEQ ID NO: 1335492 - RNA, 21 nt, Mycobacterium tuberculosis H37Rv
acaacgggccuucagcucacc

SEQ ID NO: 1335493 - RNA, 17 nt, Mycobacterium tuberculosis H37Rv
acaacgcgacgccgcuc

SEQ ID NO: 1335494 - RNA, 18 nt, Mycobacterium tuberculosis H37Rv
acaacgcgugaccagggc

SEQ ID NO: 1335495 - RNA, 19 nt, Mycobacterium tuberculosis H37Rv
acaacgcgugaccagggcc

SEQ ID NO: 1335496 - RNA, 22 nt, Mycobacterium tuberculosis H37Rv
acaagucaagauugaccgcggc

SEQ ID NO: 1335497 - RNA, 16 nt, Mycobacterium tuberculosis H37Rv
acaauaggcuccagcg

SEQ ID NO: 1335498 - RNA, 21 nt, Mycobacterium tuberculosis H37Rv
acaagccgagcccgucgauca

SEQ ID NO: 1335499 - RNA, 12 nt, Mycobacterium tuberculosis H37Rv
acaagcccagcc

SEQ ID NO: 1335500 - RNA, 22 nt, Mycobacterium tuberculosis H37Rv
acaagaucagacccagcgcggc

SEQ ID NO: 1335501 - RNA, 15 nt, Mycobacterium tuberculosis H37Rv
acacagccgcgcugc

SEQ ID NO: 1335502 - RNA, 14 nt, Mycobacterium tuberculosis H37Rv
acacagccgguggc

SEQ ID NO: 1335503 - RNA, 22 nt, Mycobacterium tuberculosis H37Rv
acacaggacuuguccaucacau

SEQ ID NO: 1335504 - RNA, 14 nt, Mycobacterium tuberculosis H37Rv
acaccagauggcuc

SEQ ID NO: 1335505 - RNA, 14 nt, Mycobacterium tuberculosis H37Rv
acaccagaugcacc

SEQ ID NO: 1335506 - RNA, 19 nt, Mycobacterium tuberculosis H37Rv
acaccaugaucaggcccca

SEQ ID NO: 1335507 - RNA, 22 nt, Mycobacterium tuberculosis H37Rv
acaccagccggucgucgcgcag

SEQ ID NO: 1335508 - RNA, 21 nt, Mycobacterium tuberculosis H37Rv
acaccagcuuguagcgcucgu

SEQ ID NO: 1335509 - RNA, 17 nt, Mycobacterium tuberculosis H37Rv
acaccagcaggcggcuc

SEQ ID NO: 1335510 - RNA, 18 nt, Mycobacterium tuberculosis H37Rv
acagcccacaggcggcgc

SEQ ID NO: 1335511 - RNA, 18 nt, Mycobacterium tuberculosis H37Rv
acagcaugguuagcggug

SEQ ID NO: 1335512 - RNA, 23 nt, Mycobacterium tuberculosis H37Rv
acagccccggcagguagggggca

SEQ ID NO: 1335513 - RNA, 15 nt, Mycobacterium tuberculosis H37Rv
acagccccgcggcca

SEQ ID NO: 1335514 - RNA, 23 nt, Mycobacterium tuberculosis H37Rv
acagcccacgagugcaagaccgu

SEQ ID NO: 1335515 - RNA, 14 nt, Mycobacterium tuberculosis H37Rv
acagcccgaugccg

SEQ ID NO: 1335516 - RNA, 11 nt, Mycobacterium tuberculosis H37Rv
acagcccggcg

SEQ ID NO: 1335517 - RNA, 12 nt, Mycobacterium tuberculosis H37Rv
acagcccggcgg

SEQ ID NO: 1335518 - RNA, 15 nt, Mycobacterium tuberculosis H37Rv
acagcccggcggcgg

SEQ ID NO: 1335519 - RNA, 15 nt, Mycobacterium tuberculosis H37Rv
acagcgggggcagcg

SEQ ID NO: 1335520 - RNA, 20 nt, Mycobacterium tuberculosis H37Rv
acagcggcgauuggcuguga

SEQ ID NO: 1335521 - RNA, 21 nt, Mycobacterium tuberculosis H37Rv
acagcggcgacaugaucugcc

SEQ ID NO: 1335522 - RNA, 12 nt, Mycobacterium tuberculosis H37Rv
acagcggcagcg

SEQ ID NO: 1335523 - RNA, 18 nt, Mycobacterium tuberculosis H37Rv
acagcgcuccagccgcgc

SEQ ID NO: 1335524 - RNA, 17 nt, Mycobacterium tuberculosis H37Rv
acagcgccuuguuggcg

SEQ ID NO: 1335525 - RNA, 18 nt, Mycobacterium tuberculosis H37Rv
acagcuucgcgcagccgg

SEQ ID NO: 1335526 - RNA, 13 nt, Mycobacterium tuberculosis H37Rv
acagcuggcggca

SEQ ID NO: 1335527 - RNA, 16 nt, Mycobacterium tuberculosis H37Rv
acagcuggcggcagcg

SEQ ID NO: 1335528 - RNA, 14 nt, Mycobacterium tuberculosis H37Rv
acagcugcccgcca

SEQ ID NO: 1335529 - RNA, 20 nt, Mycobacterium tuberculosis H37Rv
acaggaccggugggucugcu

SEQ ID NO: 1335530 - RNA, 16 nt, Mycobacterium tuberculosis H37Rv
acagcugcacacagag

SEQ ID NO: 1335531 - RNA, 18 nt, Mycobacterium tuberculosis H37Rv
acagcugacgagccggug

SEQ ID NO: 1335532 - RNA, 18 nt, Mycobacterium tuberculosis H37Rv
acagcggguccuucugcc

SEQ ID NO: 1335533 - RNA, 18 nt, Mycobacterium tuberculosis H37Rv
acagcgguccagccaccg

SEQ ID NO: 1335534 - RNA, 18 nt, Mycobacterium tuberculosis H37Rv
acagcgucauccucgucg

SEQ ID NO: 1335535 - RNA, 14 nt, Mycobacterium tuberculosis H37Rv
acagcgucucggag

SEQ ID NO: 1335536 - RNA, 20 nt, Mycobacterium tuberculosis H37Rv
acagaugcauccagcugcug

SEQ ID NO: 1335537 - RNA, 19 nt, Mycobacterium tuberculosis H37Rv
acagaugcauccagcugcu

SEQ ID NO: 1335538 - RNA, 16 nt, Mycobacterium tuberculosis H37Rv
acagcaccgaacccgc

SEQ ID NO: 1335539 - RNA, 21 nt, Mycobacterium tuberculosis H37Rv
acagcaccacgugcgagggca

SEQ ID NO: 1335540 - RNA, 13 nt, Mycobacterium tuberculosis H37Rv
acagauggcggcc

SEQ ID NO: 1335541 - RNA, 20 nt, Mycobacterium tuberculosis H37Rv
acagauucggugccagcagg

SEQ ID NO: 1335542 - RNA, 22 nt, Mycobacterium tuberculosis H37Rv
acagauucggugccagcaggcc

SEQ ID NO: 1335543 - RNA, 15 nt, Mycobacterium tuberculosis H37Rv
acacucccauccgcc

SEQ ID NO: 1335544 - RNA, 19 nt, Mycobacterium tuberculosis H37Rv
acacuccugagaugcggcc

SEQ ID NO: 1335545 - RNA, 17 nt, Mycobacterium tuberculosis H37Rv
acacuccugcacacagg

SEQ ID NO: 1335546 - RNA, 12 nt, Mycobacterium tuberculosis H37Rv
acacucauuccc

SEQ ID NO: 1335547 - RNA, 17 nt, Mycobacterium tuberculosis H37Rv
acacugugcucgccgga

SEQ ID NO: 1335548 - RNA, 13 nt, Mycobacterium tuberculosis H37Rv
acacccucgggcc

SEQ ID NO: 1335549 - RNA, 15 nt, Mycobacterium tuberculosis H37Rv
acaccgaaagccucu

SEQ ID NO: 1335550 - RNA, 13 nt, Mycobacterium tuberculosis H37Rv
acaccgacacgcc

SEQ ID NO: 1335551 - RNA, 14 nt, Mycobacterium tuberculosis H37Rv
acaccgacacgccg

SEQ ID NO: 1335552 - RNA, 13 nt, Mycobacterium tuberculosis H37Rv
acacccgcucgcc

SEQ ID NO: 1335553 - RNA, 21 nt, Mycobacterium tuberculosis H37Rv
acacccgcuuugcacugugga

SEQ ID NO: 1335554 - RNA, 13 nt, Mycobacterium tuberculosis H37Rv
acacccggcacac

SEQ ID NO: 1335555 - RNA, 19 nt, Mycobacterium tuberculosis H37Rv
acaccgagaagcugugccu

SEQ ID NO: 1335556 - RNA, 20 nt, Mycobacterium tuberculosis H37Rv
acacguucucaccaccagag

SEQ ID NO: 1335557 - RNA, 16 nt, Mycobacterium tuberculosis H37Rv
acagacgcaauagcca

SEQ ID NO: 1335558 - RNA, 16 nt, Mycobacterium tuberculosis H37Rv
acagacccccagacaa

SEQ ID NO: 1335559 - RNA, 19 nt, Mycobacterium tuberculosis H37Rv
acagacccccagacaaaga

SEQ ID NO: 1335560 - RNA, 14 nt, Mycobacterium tuberculosis H37Rv
acauaggccaccuc

SEQ ID NO: 1335561 - RNA, 20 nt, Mycobacterium tuberculosis H37Rv
acaggccgaagcucacacug

SEQ ID NO: 1335562 - RNA, 17 nt, Mycobacterium tuberculosis H37Rv
acaggcccgccagcagg

SEQ ID NO: 1335563 - RNA, 14 nt, Mycobacterium tuberculosis H37Rv
acaggccccacacc

SEQ ID NO: 1335564 - RNA, 21 nt, Mycobacterium tuberculosis H37Rv
acaggccgagcagauacuugu

SEQ ID NO: 1335565 - RNA, 21 nt, Mycobacterium tuberculosis H37Rv
acauaccccgaacauugcgcc

SEQ ID NO: 1335566 - RNA, 23 nt, Mycobacterium tuberculosis H37Rv
acauccagggccgagcagcuccu

SEQ ID NO: 1335567 - RNA, 13 nt, Mycobacterium tuberculosis H37Rv
acauccacaccgc

SEQ ID NO: 1335568 - RNA, 21 nt, Mycobacterium tuberculosis H37Rv
acauucauccaccccugagcu

SEQ ID NO: 1335569 - RNA, 19 nt, Mycobacterium tuberculosis H37Rv
acauucugcagcgucuccu

SEQ ID NO: 1335570 - RNA, 23 nt, Mycobacterium tuberculosis H37Rv
acauucgggcgugcucgccgggu

SEQ ID NO: 1335571 - RNA, 16 nt, Mycobacterium tuberculosis H37Rv
acauuggcuccgaaca

SEQ ID NO: 1335572 - RNA, 23 nt, Mycobacterium tuberculosis H37Rv
acauugguguccaccaccggcac

SEQ ID NO: 1335573 - RNA, 14 nt, Mycobacterium tuberculosis H37Rv
acauuggccgucau

SEQ ID NO: 1335574 - RNA, 21 nt, Mycobacterium tuberculosis H37Rv
acauuggccgucaucgccggg

SEQ ID NO: 1335575 - RNA, 12 nt, Mycobacterium tuberculosis H37Rv
acaugcuggaga

SEQ ID NO: 1335576 - RNA, 18 nt, Mycobacterium tuberculosis H37Rv
acaugcugccgcugcgaa

SEQ ID NO: 1335577 - RNA, 22 nt, Mycobacterium tuberculosis H37Rv
acauccuucaucccccaaauca

SEQ ID NO: 1335578 - RNA, 18 nt, Mycobacterium tuberculosis H37Rv
acaucccagcgaaugcug

SEQ ID NO: 1335579 - RNA, 16 nt, Mycobacterium tuberculosis H37Rv
acaucgaugucggcuc

SEQ ID NO: 1335580 - RNA, 19 nt, Mycobacterium tuberculosis H37Rv
acaucgcacaacugcgcca

SEQ ID NO: 1335581 - RNA, 16 nt, Mycobacterium tuberculosis H37Rv
acaucgaggccacgcc

SEQ ID NO: 1335582 - RNA, 19 nt, Mycobacterium tuberculosis H37Rv
acaucgaggccacgccagc

SEQ ID NO: 1335583 - RNA, 23 nt, Mycobacterium tuberculosis H37Rv
acaucgagccaacgcgcagagcg

SEQ ID NO: 1335584 - RNA, 12 nt, Mycobacterium tuberculosis H37Rv
accacaccuucg

SEQ ID NO: 1335585 - RNA, 13 nt, Mycobacterium tuberculosis H37Rv
accacacuggcag

SEQ ID NO: 1335586 - RNA, 22 nt, Mycobacterium tuberculosis H37Rv
accacagugccaauuccagccc

SEQ ID NO: 1335587 - RNA, 15 nt, Mycobacterium tuberculosis H37Rv
accacagugaaaucc

SEQ ID NO: 1335588 - RNA, 22 nt, Mycobacterium tuberculosis H37Rv
accaccaccgccggugccgcca

SEQ ID NO: 1335589 - RNA, 22 nt, Mycobacterium tuberculosis H37Rv
accaccacuucggcgccgcgcc

SEQ ID NO: 1335590 - RNA, 21 nt, Mycobacterium tuberculosis H37Rv
accaccaagcucggccagcac

SEQ ID NO: 1335591 - RNA, 22 nt, Mycobacterium tuberculosis H37Rv
accaccaagcucggccagcacg

SEQ ID NO: 1335592 - RNA, 21 nt, Mycobacterium tuberculosis H37Rv
accacauuggcgaucagcagc

SEQ ID NO: 1335593 - RNA, 21 nt, Mycobacterium tuberculosis H37Rv
accacaucgguguggcccaac

SEQ ID NO: 1335594 - RNA, 13 nt, Mycobacterium tuberculosis H37Rv
accacaacgccag

SEQ ID NO: 1335595 - RNA, 14 nt, Mycobacterium tuberculosis H37Rv
accacaauccacgc

SEQ ID NO: 1335596 - RNA, 16 nt, Mycobacterium tuberculosis H37Rv
accacaaccgugagca

SEQ ID NO: 1335597 - RNA, 19 nt, Mycobacterium tuberculosis H37Rv
accaaugucagugccccgc

SEQ ID NO: 1335598 - RNA, 16 nt, Mycobacterium tuberculosis H37Rv
accaaugucagugccc

SEQ ID NO: 1335599 - RNA, 16 nt, Mycobacterium tuberculosis H37Rv
accaauuggucgaguc

SEQ ID NO: 1335600 - RNA, 22 nt, Mycobacterium tuberculosis H37Rv
accaaggccgccugcaacaucc

SEQ ID NO: 1335601 - RNA, 19 nt, Mycobacterium tuberculosis H37Rv
accaagguguggccuugcg

SEQ ID NO: 1335602 - RNA, 20 nt, Mycobacterium tuberculosis H37Rv
accaagguacuugcgcaacc

SEQ ID NO: 1335603 - RNA, 12 nt, Mycobacterium tuberculosis H37Rv
accaaggucggc

SEQ ID NO: 1335604 - RNA, 19 nt, Mycobacterium tuberculosis H37Rv
accaaggucuucaggccgc

SEQ ID NO: 1335605 - RNA, 16 nt, Mycobacterium tuberculosis H37Rv
accaaguagucggguu

SEQ ID NO: 1335606 - RNA, 19 nt, Mycobacterium tuberculosis H37Rv
accaaccgggacaaccccu

SEQ ID NO: 1335607 - RNA, 21 nt, Mycobacterium tuberculosis H37Rv
accaaccgggacaaccccuug

SEQ ID NO: 1335608 - RNA, 22 nt, Mycobacterium tuberculosis H37Rv
accaacgcgggaacgaugccgc

SEQ ID NO: 1335609 - RNA, 16 nt, Mycobacterium tuberculosis H37Rv
accaacgcuucugccu

SEQ ID NO: 1335610 - RNA, 20 nt, Mycobacterium tuberculosis H37Rv
accaacgcuucugccugcgc

SEQ ID NO: 1335611 - RNA, 14 nt, Mycobacterium tuberculosis H37Rv
accaauccaggcca

SEQ ID NO: 1335612 - RNA, 15 nt, Mycobacterium tuberculosis H37Rv
accaauccaggccac

SEQ ID NO: 1335613 - RNA, 12 nt, Mycobacterium tuberculosis H37Rv
accaauccacug

SEQ ID NO: 1335614 - RNA, 17 nt, Mycobacterium tuberculosis H37Rv
accaaucgcacgccagc

SEQ ID NO: 1335615 - RNA, 15 nt, Mycobacterium tuberculosis H37Rv
accaaugaccgccag

SEQ ID NO: 1335616 - RNA, 22 nt, Mycobacterium tuberculosis H37Rv
accaaugcuccugguggcagaa

SEQ ID NO: 1335617 - RNA, 20 nt, Mycobacterium tuberculosis H37Rv
accacgcccgacgaggaugu

SEQ ID NO: 1335618 - RNA, 15 nt, Mycobacterium tuberculosis H37Rv
accacgcgcccgcac

SEQ ID NO: 1335619 - RNA, 14 nt, Mycobacterium tuberculosis H37Rv
accacggaccagcg

SEQ ID NO: 1335620 - RNA, 13 nt, Mycobacterium tuberculosis H37Rv
accacgcugugcu

SEQ ID NO: 1335621 - RNA, 16 nt, Mycobacterium tuberculosis H37Rv
accacgcuccccagcg

SEQ ID NO: 1335622 - RNA, 23 nt, Mycobacterium tuberculosis H37Rv
accacgcccgacgaggaugucga

SEQ ID NO: 1335623 - RNA, 23 nt, Mycobacterium tuberculosis H37Rv
accacgaucgcgagcccauggac

SEQ ID NO: 1335624 - RNA, 22 nt, Mycobacterium tuberculosis H37Rv
accacgacgcgauggccgccag

SEQ ID NO: 1335625 - RNA, 21 nt, Mycobacterium tuberculosis H37Rv
accacgaugaccggggacagc

SEQ ID NO: 1335626 - RNA, 13 nt, Mycobacterium tuberculosis H37Rv
accacgaugauca

SEQ ID NO: 1335627 - RNA, 14 nt, Mycobacterium tuberculosis H37Rv
accacgcaccgccc

SEQ ID NO: 1335628 - RNA, 13 nt, Mycobacterium tuberculosis H37Rv
accacguggcccu

SEQ ID NO: 1335629 - RNA, 22 nt, Mycobacterium tuberculosis H37Rv
accacgucgacgaugucgaaga

SEQ ID NO: 1335630 - RNA, 23 nt, Mycobacterium tuberculosis H37Rv
accacggcggcggcguagcagaa

SEQ ID NO: 1335631 - RNA, 14 nt, Mycobacterium tuberculosis H37Rv
accacggccagcgg

SEQ ID NO: 1335632 - RNA, 22 nt, Mycobacterium tuberculosis H37Rv
accacggucagcacgcugacca

SEQ ID NO: 1335633 - RNA, 20 nt, Mycobacterium tuberculosis H37Rv
accacggugacuaccgugca

SEQ ID NO: 1335634 - RNA, 17 nt, Mycobacterium tuberculosis H37Rv
accacuugcagcacaac

SEQ ID NO: 1335635 - RNA, 18 nt, Mycobacterium tuberculosis H37Rv
accacuugcagcacaacg

SEQ ID NO: 1335636 - RNA, 17 nt, Mycobacterium tuberculosis H37Rv
accacuuggguggcgcc

SEQ ID NO: 1335637 - RNA, 19 nt, Mycobacterium tuberculosis H37Rv
accacuucccgcuugagca

SEQ ID NO: 1335638 - RNA, 19 nt, Mycobacterium tuberculosis H37Rv
accacugcgcccgccacgu

SEQ ID NO: 1335639 - RNA, 12 nt, Mycobacterium tuberculosis H37Rv
accacugcggcc

SEQ ID NO: 1335640 - RNA, 16 nt, Mycobacterium tuberculosis H37Rv
accacuggauggcucg

SEQ ID NO: 1335641 - RNA, 23 nt, Mycobacterium tuberculosis H37Rv
accacuguuggugccgccaccac

SEQ ID NO: 1335642 - RNA, 19 nt, Mycobacterium tuberculosis H37Rv
accacuguuggugccgcca

SEQ ID NO: 1335643 - RNA, 17 nt, Mycobacterium tuberculosis H37Rv
accacucggcggccacc

SEQ ID NO: 1335644 - RNA, 22 nt, Mycobacterium tuberculosis H37Rv
accacugcaugaacugcucgcc

SEQ ID NO: 1335645 - RNA, 21 nt, Mycobacterium tuberculosis H37Rv
accacugcaugaacugcucgc

SEQ ID NO: 1335646 - RNA, 22 nt, Mycobacterium tuberculosis H37Rv
accacugaucggcauuccuuga

SEQ ID NO: 1335647 - RNA, 22 nt, Mycobacterium tuberculosis H37Rv
accaccgccgaagcugcggguc

SEQ ID NO: 1335648 - RNA, 20 nt, Mycobacterium tuberculosis H37Rv
accaccggccccaccgacag

SEQ ID NO: 1335649 - RNA, 16 nt, Mycobacterium tuberculosis H37Rv
accaccgggcgcugcu

SEQ ID NO: 1335650 - RNA, 21 nt, Mycobacterium tuberculosis H37Rv
accaccggccgucccgcgagc

SEQ ID NO: 1335651 - RNA, 16 nt, Mycobacterium tuberculosis H37Rv
accaccggccgucccg

SEQ ID NO: 1335652 - RNA, 16 nt, Mycobacterium tuberculosis H37Rv
accaccgucaccgccg

SEQ ID NO: 1335653 - RNA, 14 nt, Mycobacterium tuberculosis H37Rv
accaccucagcugc

SEQ ID NO: 1335654 - RNA, 20 nt, Mycobacterium tuberculosis H37Rv
accaccucggugaccaggcc

SEQ ID NO: 1335655 - RNA, 21 nt, Mycobacterium tuberculosis H37Rv
accaccuuggaugcccugccc

SEQ ID NO: 1335656 - RNA, 22 nt, Mycobacterium tuberculosis H37Rv
accaccucgaugccgccccgca

SEQ ID NO: 1335657 - RNA, 14 nt, Mycobacterium tuberculosis H37Rv
accacgagcagccg

SEQ ID NO: 1335658 - RNA, 17 nt, Mycobacterium tuberculosis H37Rv
accacccgguccugcuc

SEQ ID NO: 1335659 - RNA, 21 nt, Mycobacterium tuberculosis H37Rv
accaccgaaauacccagcgca

SEQ ID NO: 1335660 - RNA, 12 nt, Mycobacterium tuberculosis H37Rv
accaccccagcg

SEQ ID NO: 1335661 - RNA, 13 nt, Mycobacterium tuberculosis H37Rv
accaccccagggc

SEQ ID NO: 1335662 - RNA, 13 nt, Mycobacterium tuberculosis H37Rv
accacccccaccg

SEQ ID NO: 1335663 - RNA, 14 nt, Mycobacterium tuberculosis H37Rv
accacccaggccau

SEQ ID NO: 1335664 - RNA, 13 nt, Mycobacterium tuberculosis H37Rv
accacccgccgca

SEQ ID NO: 1335665 - RNA, 18 nt, Mycobacterium tuberculosis H37Rv
accacccgcaccucaccg

SEQ ID NO: 1335666 - RNA, 21 nt, Mycobacterium tuberculosis H37Rv
accacccggcgaacccagcgg

SEQ ID NO: 1335667 - RNA, 15 nt, Mycobacterium tuberculosis H37Rv
accacccgcaccuca

SEQ ID NO: 1335668 - RNA, 14 nt, Mycobacterium tuberculosis H37Rv
accacccaacagcc

SEQ ID NO: 1335669 - RNA, 19 nt, Mycobacterium tuberculosis H37Rv
accacccaacagcccaccg

SEQ ID NO: 1335670 - RNA, 20 nt, Mycobacterium tuberculosis H37Rv
accaccagcgugcugccgga

SEQ ID NO: 1335671 - RNA, 14 nt, Mycobacterium tuberculosis H37Rv
aauacaccugcugg

SEQ ID NO: 1335672 - RNA, 19 nt, Mycobacterium tuberculosis H37Rv
aauacccagcgcagcagcg

SEQ ID NO: 1335673 - RNA, 21 nt, Mycobacterium tuberculosis H37Rv
aauagcugcgcgaagccacca

SEQ ID NO: 1335674 - RNA, 17 nt, Mycobacterium tuberculosis H37Rv
aauaggccgggcagugc

SEQ ID NO: 1335675 - RNA, 22 nt, Mycobacterium tuberculosis H37Rv
aauaggucugagucuuucccgc

SEQ ID NO: 1335676 - RNA, 21 nt, Mycobacterium tuberculosis H37Rv
aauagggugaguuccaugugc

SEQ ID NO: 1335677 - RNA, 19 nt, Mycobacterium tuberculosis H37Rv
aauauccugcgguugaguu

SEQ ID NO: 1335678 - RNA, 15 nt, Mycobacterium tuberculosis H37Rv
aaguacuccauggca

SEQ ID NO: 1335679 - RNA, 17 nt, Mycobacterium tuberculosis H37Rv
aagggcuugucgccggc

SEQ ID NO: 1335680 - RNA, 17 nt, Mycobacterium tuberculosis H37Rv
aaggggugugugcugcc

SEQ ID NO: 1335681 - RNA, 22 nt, Mycobacterium tuberculosis H37Rv
aaguagguuuucggcggcucua

SEQ ID NO: 1335682 - RNA, 15 nt, Mycobacterium tuberculosis H37Rv
aagucccgggcaccg

SEQ ID NO: 1335683 - RNA, 21 nt, Mycobacterium tuberculosis H37Rv
aaguccgagucggcaaacaac

SEQ ID NO: 1335684 - RNA, 23 nt, Mycobacterium tuberculosis H37Rv
aaguccacgcaccacgagcagcc

SEQ ID NO: 1335685 - RNA, 18 nt, Mycobacterium tuberculosis H37Rv
aagucgcagcgaggagcc

SEQ ID NO: 1335686 - RNA, 15 nt, Mycobacterium tuberculosis H37Rv
aagucgcauggcggc

SEQ ID NO: 1335687 - RNA, 14 nt, Mycobacterium tuberculosis H37Rv
aagucgggcacugu

SEQ ID NO: 1335688 - RNA, 19 nt, Mycobacterium tuberculosis H37Rv
aagucucccggccgcaccc

SEQ ID NO: 1335689 - RNA, 18 nt, Mycobacterium tuberculosis H37Rv
aagugccucgcgggaagu

SEQ ID NO: 1335690 - RNA, 20 nt, Mycobacterium tuberculosis H37Rv
aaguguucgacacccucggg

SEQ ID NO: 1335691 - RNA, 14 nt, Mycobacterium tuberculosis H37Rv
aaguugaagaagcc

SEQ ID NO: 1335692 - RNA, 12 nt, Mycobacterium tuberculosis H37Rv
aaguugaagaag

SEQ ID NO: 1335693 - RNA, 15 nt, Mycobacterium tuberculosis H37Rv
aaguugaagaagcca

SEQ ID NO: 1335694 - RNA, 20 nt, Mycobacterium tuberculosis H37Rv
aaguuccagccgacggcagu

SEQ ID NO: 1335695 - RNA, 22 nt, Mycobacterium tuberculosis H37Rv
aaguuccacggguggugccagg

SEQ ID NO: 1335696 - RNA, 22 nt, Mycobacterium tuberculosis H37Rv
aaggcaggacugaacaguugca

SEQ ID NO: 1335697 - RNA, 16 nt, Mycobacterium tuberculosis H37Rv
aaggccgucgacccag

SEQ ID NO: 1335698 - RNA, 22 nt, Mycobacterium tuberculosis H37Rv
aaggcucagcagcgccgcgcgg

SEQ ID NO: 1335699 - RNA, 15 nt, Mycobacterium tuberculosis H37Rv
aaggaucaacgugcg

SEQ ID NO: 1335700 - RNA, 17 nt, Mycobacterium tuberculosis H37Rv
aagcuucggccuucuug

SEQ ID NO: 1335701 - RNA, 16 nt, Mycobacterium tuberculosis H37Rv
aagcuggcgccgcagg

SEQ ID NO: 1335702 - RNA, 15 nt, Mycobacterium tuberculosis H37Rv
aagcgacgagcagca

SEQ ID NO: 1335703 - RNA, 22 nt, Mycobacterium tuberculosis H37Rv
aagcgacgagcagcaauccaag

SEQ ID NO: 1335704 - RNA, 23 nt, Mycobacterium tuberculosis H37Rv
aagcgagcggucgacguguugga

SEQ ID NO: 1335705 - RNA, 22 nt, Mycobacterium tuberculosis H37Rv
aagccucgauaggugagcgcgg

SEQ ID NO: 1335706 - RNA, 15 nt, Mycobacterium tuberculosis H37Rv
aagccucagccgcuc

SEQ ID NO: 1335707 - RNA, 14 nt, Mycobacterium tuberculosis H37Rv
aagccuggaaaacc

SEQ ID NO: 1335708 - RNA, 20 nt, Mycobacterium tuberculosis H37Rv
aagccuugacccauggcucc

SEQ ID NO: 1335709 - RNA, 22 nt, Mycobacterium tuberculosis H37Rv
aagccuggaaaacccaggucuu

SEQ ID NO: 1335710 - RNA, 23 nt, Mycobacterium tuberculosis H37Rv
aagccugguuccugguagucgcc

SEQ ID NO: 1335711 - RNA, 14 nt, Mycobacterium tuberculosis H37Rv
aagccggccgggaa

SEQ ID NO: 1335712 - RNA, 14 nt, Mycobacterium tuberculosis H37Rv
aagccgucagcuca

SEQ ID NO: 1335713 - RNA, 21 nt, Mycobacterium tuberculosis H37Rv
aagccguaguaguggccgcca

SEQ ID NO: 1335714 - RNA, 17 nt, Mycobacterium tuberculosis H37Rv
aagccguagaccaggcc

SEQ ID NO: 1335715 - RNA, 15 nt, Mycobacterium tuberculosis H37Rv
aagaucagacccagc

SEQ ID NO: 1335716 - RNA, 14 nt, Mycobacterium tuberculosis H37Rv
aagaucgagccgac

SEQ ID NO: 1335717 - RNA, 15 nt, Mycobacterium tuberculosis H37Rv
aagaucggugccagc

SEQ ID NO: 1335718 - RNA, 17 nt, Mycobacterium tuberculosis H37Rv
aagcgggauugccgaga

SEQ ID NO: 1335719 - RNA, 22 nt, Mycobacterium tuberculosis H37Rv
aagcggcugcccgagaucgcgu

SEQ ID NO: 1335720 - RNA, 15 nt, Mycobacterium tuberculosis H37Rv
aagcucacacuggcu

SEQ ID NO: 1335721 - RNA, 16 nt, Mycobacterium tuberculosis H37Rv
aagcgaugccgugcug

SEQ ID NO: 1335722 - RNA, 23 nt, Mycobacterium tuberculosis H37Rv
aagcgcgcgcgugaagaacacgu

SEQ ID NO: 1335723 - RNA, 18 nt, Mycobacterium tuberculosis H37Rv
aacaggcgucccgcccgg

SEQ ID NO: 1335724 - RNA, 11 nt, Mycobacterium tuberculosis H37Rv
aacaggauggu

SEQ ID NO: 1335725 - RNA, 15 nt, Mycobacterium tuberculosis H37Rv
aacaggccggugugc

SEQ ID NO: 1335726 - RNA, 17 nt, Mycobacterium tuberculosis H37Rv
aacaggccgguucccuu

SEQ ID NO: 1335727 - RNA, 12 nt, Mycobacterium tuberculosis H37Rv
aacaggccuagg

SEQ ID NO: 1335728 - RNA, 11 nt, Mycobacterium tuberculosis H37Rv
aacagguugaa

SEQ ID NO: 1335729 - RNA, 21 nt, Mycobacterium tuberculosis H37Rv
aacagguaagcagccagcaac

SEQ ID NO: 1335730 - RNA, 22 nt, Mycobacterium tuberculosis H37Rv
aacagcggcaacgccuccggag

SEQ ID NO: 1335731 - RNA, 23 nt, Mycobacterium tuberculosis H37Rv
aacagcgguggguaggcucccac

SEQ ID NO: 1335732 - RNA, 18 nt, Mycobacterium tuberculosis H37Rv
aacagcggguccuucugc

SEQ ID NO: 1335733 - RNA, 13 nt, Mycobacterium tuberculosis H37Rv
aacaucaccgucg

SEQ ID NO: 1335734 - RNA, 17 nt, Mycobacterium tuberculosis H37Rv
aacaucgacagcaucac

SEQ ID NO: 1335735 - RNA, 20 nt, Mycobacterium tuberculosis H37Rv
aacagucgcagccaggcacg

SEQ ID NO: 1335736 - RNA, 15 nt, Mycobacterium tuberculosis H37Rv
aacagugccucgcgu

SEQ ID NO: 1335737 - RNA, 14 nt, Mycobacterium tuberculosis H37Rv
aacagugccugggu

SEQ ID NO: 1335738 - RNA, 17 nt, Mycobacterium tuberculosis H37Rv
aacaugcucacgaucac

SEQ ID NO: 1335739 - RNA, 21 nt, Mycobacterium tuberculosis H37Rv
aacaugcuggagaaaccacug

SEQ ID NO: 1335740 - RNA, 23 nt, Mycobacterium tuberculosis H37Rv
aacaugcucacgaucacccgcac

SEQ ID NO: 1335741 - RNA, 21 nt, Mycobacterium tuberculosis H37Rv
aaccaaagcgacgagcagcaa

SEQ ID NO: 1335742 - RNA, 15 nt, Mycobacterium tuberculosis H37Rv
aaccacuguuucuga

SEQ ID NO: 1335743 - RNA, 20 nt, Mycobacterium tuberculosis H37Rv
aaccacccaccggccaccag

SEQ ID NO: 1335744 - RNA, 16 nt, Mycobacterium tuberculosis H37Rv
aaccaccggccgcgca

SEQ ID NO: 1335745 - RNA, 14 nt, Mycobacterium tuberculosis H37Rv
aaccccuugccuuc

SEQ ID NO: 1335746 - RNA, 21 nt, Mycobacterium tuberculosis H37Rv
aaccccggccaccagcaugcc

SEQ ID NO: 1335747 - RNA, 22 nt, Mycobacterium tuberculosis H37Rv
aaccccggccaccagcaugccu

SEQ ID NO: 1335748 - RNA, 21 nt, Mycobacterium tuberculosis H37Rv
aacccgauguggcgcuguugu

SEQ ID NO: 1335749 - RNA, 20 nt, Mycobacterium tuberculosis H37Rv
aacccgaaucccacagcagg

SEQ ID NO: 1335750 - RNA, 18 nt, Mycobacterium tuberculosis H37Rv
aaccccaucagaaugccu

SEQ ID NO: 1335751 - RNA, 14 nt, Mycobacterium tuberculosis H37Rv
aaccccgagcugcc

SEQ ID NO: 1335752 - RNA, 17 nt, Mycobacterium tuberculosis H37Rv
aaccccgccaggaucug

SEQ ID NO: 1335753 - RNA, 22 nt, Mycobacterium tuberculosis H37Rv
aaccagcgauggguguugcugg

SEQ ID NO: 1335754 - RNA, 16 nt, Mycobacterium tuberculosis H37Rv
aaccagccaccaccag

SEQ ID NO: 1335755 - RNA, 11 nt, Mycobacterium tuberculosis H37Rv
aaccagcagca

SEQ ID NO: 1335756 - RNA, 18 nt, Mycobacterium tuberculosis H37Rv
aaccagaggucacgcagc

SEQ ID NO: 1335757 - RNA, 19 nt, Mycobacterium tuberculosis H37Rv
aaccucggcuuggccggcg

SEQ ID NO: 1335758 - RNA, 14 nt, Mycobacterium tuberculosis H37Rv
aaccucggacugca

SEQ ID NO: 1335759 - RNA, 19 nt, Mycobacterium tuberculosis H37Rv
aaccucggaucgccaggcc

SEQ ID NO: 1335760 - RNA, 21 nt, Mycobacterium tuberculosis H37Rv
aaccgguccugggauccggcg

SEQ ID NO: 1335761 - RNA, 14 nt, Mycobacterium tuberculosis H37Rv
aaccggucgcagug

SEQ ID NO: 1335762 - RNA, 15 nt, Mycobacterium tuberculosis H37Rv
aaccggucgcagugc

SEQ ID NO: 1335763 - RNA, 20 nt, Mycobacterium tuberculosis H37Rv
aaccgggcaaaucaagcaca

SEQ ID NO: 1335764 - RNA, 20 nt, Mycobacterium tuberculosis H37Rv
aaccguccccggcguccgac

SEQ ID NO: 1335765 - RNA, 15 nt, Mycobacterium tuberculosis H37Rv
aaccgugagcaccag

SEQ ID NO: 1335766 - RNA, 19 nt, Mycobacterium tuberculosis H37Rv
aaccgugagcaccagcagc

SEQ ID NO: 1335767 - RNA, 15 nt, Mycobacterium tuberculosis H37Rv
aaccguuguacccca

SEQ ID NO: 1335768 - RNA, 22 nt, Mycobacterium tuberculosis H37Rv
aaccgugguguacccgccucgg

SEQ ID NO: 1335769 - RNA, 13 nt, Mycobacterium tuberculosis H37Rv
aacgcagccagcg

SEQ ID NO: 1335770 - RNA, 18 nt, Mycobacterium tuberculosis H37Rv
aacgagaugugagcacac

SEQ ID NO: 1335771 - RNA, 22 nt, Mycobacterium tuberculosis H37Rv
aacgacugaucaagugccagcg

SEQ ID NO: 1335772 - RNA, 19 nt, Mycobacterium tuberculosis H37Rv
aacgacgucgccgacccgg

SEQ ID NO: 1335773 - RNA, 14 nt, Mycobacterium tuberculosis H37Rv
aacgacguugaucc

SEQ ID NO: 1335774 - RNA, 21 nt, Mycobacterium tuberculosis H37Rv
aacgacggccgucgccccaaa

SEQ ID NO: 1335775 - RNA, 21 nt, Mycobacterium tuberculosis H37Rv
aacgacaucaccaccgcacgg

SEQ ID NO: 1335776 - RNA, 19 nt, Mycobacterium tuberculosis H37Rv
aacgaccuccacgcccugg

SEQ ID NO: 1335777 - RNA, 13 nt, Mycobacterium tuberculosis H37Rv
aacgacaccagau

SEQ ID NO: 1335778 - RNA, 17 nt, Mycobacterium tuberculosis H37Rv
aacgacaacacccacgu

SEQ ID NO: 1335779 - RNA, 14 nt, Mycobacterium tuberculosis H37Rv
aacgcggccaccac

SEQ ID NO: 1335780 - RNA, 23 nt, Mycobacterium tuberculosis H37Rv
aacgccuugacugaacucaacac

SEQ ID NO: 1335781 - RNA, 17 nt, Mycobacterium tuberculosis H37Rv
aacgcgagcgcuaucac

SEQ ID NO: 1335782 - RNA, 13 nt, Mycobacterium tuberculosis H37Rv
aacgccugcucgu

SEQ ID NO: 1335783 - RNA, 17 nt, Mycobacterium tuberculosis H37Rv
aacggauucccgcccag

SEQ ID NO: 1335784 - RNA, 21 nt, Mycobacterium tuberculosis H37Rv
aacggauucccgcccagcagc

SEQ ID NO: 1335785 - RNA, 23 nt, Mycobacterium tuberculosis H37Rv
aacggauuggugggccagcagca

SEQ ID NO: 1335786 - RNA, 20 nt, Mycobacterium tuberculosis H37Rv
aacggcacccugcggcaccu

SEQ ID NO: 1335787 - RNA, 15 nt, Mycobacterium tuberculosis H37Rv
aacugcgccggugcc

SEQ ID NO: 1335788 - RNA, 21 nt, Mycobacterium tuberculosis H37Rv
aacugcgccagcaacagcgcg

SEQ ID NO: 1335789 - RNA, 19 nt, Mycobacterium tuberculosis H37Rv
aacugccggacuaccgccg

SEQ ID NO: 1335790 - RNA, 12 nt, Mycobacterium tuberculosis H37Rv
aagaaacaccac

SEQ ID NO: 1335791 - RNA, 16 nt, Mycobacterium tuberculosis H37Rv
aacggcggggccggcg

SEQ ID NO: 1335792 - RNA, 22 nt, Mycobacterium tuberculosis H37Rv
aacggcuuggcugccuccauca

SEQ ID NO: 1335793 - RNA, 23 nt, Mycobacterium tuberculosis H37Rv
aacgggcgaacuuguugaccucc

SEQ ID NO: 1335794 - RNA, 14 nt, Mycobacterium tuberculosis H37Rv
aacgggcagguagg

SEQ ID NO: 1335795 - RNA, 22 nt, Mycobacterium tuberculosis H37Rv
aacucgaagcgguguugccgga

SEQ ID NO: 1335796 - RNA, 19 nt, Mycobacterium tuberculosis H37Rv
aacucggcgaccugccgga

SEQ ID NO: 1335797 - RNA, 22 nt, Mycobacterium tuberculosis H37Rv
aacucggugccugucagaagga

SEQ ID NO: 1335798 - RNA, 15 nt, Mycobacterium tuberculosis H37Rv
aacucggccacggcg

SEQ ID NO: 1335799 - RNA, 20 nt, Mycobacterium tuberculosis H37Rv
aagaccuggcggugccggcg

SEQ ID NO: 1335800 - RNA, 15 nt, Mycobacterium tuberculosis H37Rv
aagaccuggccugcg

SEQ ID NO: 1335801 - RNA, 15 nt, Mycobacterium tuberculosis H37Rv
aagacccggcaccca

SEQ ID NO: 1335802 - RNA, 16 nt, Mycobacterium tuberculosis H37Rv
aagaccgacagcggca

SEQ ID NO: 1335803 - RNA, 20 nt, Mycobacterium tuberculosis H37Rv
aagaccgcgucggcggccag

SEQ ID NO: 1335804 - RNA, 22 nt, Mycobacterium tuberculosis H37Rv
aagaccgcguuccgggccggcg

SEQ ID NO: 1335805 - RNA, 22 nt, Mycobacterium tuberculosis H37Rv
aagaccucgucgcgucgccaga

SEQ ID NO: 1335806 - RNA, 20 nt, Mycobacterium tuberculosis H37Rv
aagacgugguagaggaacag

SEQ ID NO: 1335807 - RNA, 18 nt, Mycobacterium tuberculosis H37Rv
aagacugcgccgccggcg

SEQ ID NO: 1335808 - RNA, 23 nt, Mycobacterium tuberculosis H37Rv
aagaccaccgcccacagcaacga

SEQ ID NO: 1335809 - RNA, 12 nt, Mycobacterium tuberculosis H37Rv
aagacaugcuga

SEQ ID NO: 1335810 - RNA, 15 nt, Mycobacterium tuberculosis H37Rv
aagacaugcugaugg

SEQ ID NO: 1335811 - RNA, 11 nt, Mycobacterium tuberculosis H37Rv
aagagaagucu

SEQ ID NO: 1335812 - RNA, 16 nt, Mycobacterium tuberculosis H37Rv
aagagcacgucaacag

SEQ ID NO: 1335813 - RNA, 19 nt, Mycobacterium tuberculosis H37Rv
aagagcacgucaacagcca

SEQ ID NO: 1335814 - RNA, 21 nt, Mycobacterium tuberculosis H37Rv
aagagcacgucaacagccagg

SEQ ID NO: 1335815 - RNA, 11 nt, Mycobacterium tuberculosis H37Rv
aagagccgucc

SEQ ID NO: 1335816 - RNA, 19 nt, Mycobacterium tuberculosis H37Rv
aagagcggagccggcgcau

SEQ ID NO: 1335817 - RNA, 14 nt, Mycobacterium tuberculosis H37Rv
aagaggagaacgag

SEQ ID NO: 1335818 - RNA, 16 nt, Mycobacterium tuberculosis H37Rv
aagaggcgcaccuccu

SEQ ID NO: 1335819 - RNA, 15 nt, Mycobacterium tuberculosis H37Rv
cggcggcgccccggu

SEQ ID NO: 1335820 - RNA, 13 nt, Mycobacterium tuberculosis H37Rv
cggcggcgccgcc

SEQ ID NO: 1335821 - RNA, 17 nt, Mycobacterium tuberculosis H37Rv
cggcggcgcuggcgggc

SEQ ID NO: 1335822 - RNA, 16 nt, Mycobacterium tuberculosis H37Rv
cggcggcgcuggcggg

SEQ ID NO: 1335823 - RNA, 16 nt, Mycobacterium tuberculosis H37Rv
cggcggcgcucgucga

SEQ ID NO: 1335824 - RNA, 12 nt, Mycobacterium tuberculosis H37Rv
cggcggcgcgcc

SEQ ID NO: 1335825 - RNA, 15 nt, Mycobacterium tuberculosis H37Rv
cggcggccugggcca

SEQ ID NO: 1335826 - RNA, 20 nt, Mycobacterium tuberculosis H37Rv
cggcggccugggccagccgc

SEQ ID NO: 1335827 - RNA, 17 nt, Mycobacterium tuberculosis H37Rv
cggcggccgugucgggc

SEQ ID NO: 1335828 - RNA, 16 nt, Mycobacterium tuberculosis H37Rv
cggcggccgugucggg

SEQ ID NO: 1335829 - RNA, 16 nt, Mycobacterium tuberculosis H37Rv
cggcggccgucaccgg

SEQ ID NO: 1335830 - RNA, 15 nt, Mycobacterium tuberculosis H37Rv
cggcggccgcgugcu

SEQ ID NO: 1335831 - RNA, 13 nt, Mycobacterium tuberculosis H37Rv
cggcggccccggc

SEQ ID NO: 1335832 - RNA, 16 nt, Mycobacterium tuberculosis H37Rv
cggcggccccgcgcca

SEQ ID NO: 1335833 - RNA, 16 nt, Mycobacterium tuberculosis H37Rv
cggcggccagcucccg

SEQ ID NO: 1335834 - RNA, 12 nt, Mycobacterium tuberculosis H37Rv
cggcggccagga

SEQ ID NO: 1335835 - RNA, 14 nt, Mycobacterium tuberculosis H37Rv
cggcggcccgcagc

SEQ ID NO: 1335836 - RNA, 15 nt, Mycobacterium tuberculosis H37Rv
cggcggcccuuucca

SEQ ID NO: 1335837 - RNA, 19 nt, Mycobacterium tuberculosis H37Rv
cggcggcccguuugccggu

SEQ ID NO: 1335838 - RNA, 15 nt, Mycobacterium tuberculosis H37Rv
cggcggccgcccaga

SEQ ID NO: 1335839 - RNA, 22 nt, Mycobacterium tuberculosis H37Rv
cggcggccgagcgcaccgcuga

SEQ ID NO: 1335840 - RNA, 14 nt, Mycobacterium tuberculosis H37Rv
cggcggcugccggu

SEQ ID NO: 1335841 - RNA, 12 nt, Mycobacterium tuberculosis H37Rv
cggcggcugccg

SEQ ID NO: 1335842 - RNA, 14 nt, Mycobacterium tuberculosis H37Rv
cggcggcucgggug

SEQ ID NO: 1335843 - RNA, 23 nt, Mycobacterium tuberculosis H37Rv
cggcggcuucguggcggcgcgcg

SEQ ID NO: 1335844 - RNA, 21 nt, Mycobacterium tuberculosis H37Rv
cggcggcuuggccgccccggc

SEQ ID NO: 1335845 - RNA, 22 nt, Mycobacterium tuberculosis H37Rv
cggcggcuuggccgccccggcc

SEQ ID NO: 1335846 - RNA, 12 nt, Mycobacterium tuberculosis H37Rv
cggcggcggccg

SEQ ID NO: 1335847 - RNA, 13 nt, Mycobacterium tuberculosis H37Rv
cggcggcggccgc

SEQ ID NO: 1335848 - RNA, 10 nt, Mycobacterium tuberculosis H37Rv
cggcggcggc

SEQ ID NO: 1335849 - RNA, 16 nt, Mycobacterium tuberculosis H37Rv
cggcggcggccgcagc

SEQ ID NO: 1335850 - RNA, 13 nt, Mycobacterium tuberculosis H37Rv
cggcggcggcgcu

SEQ ID NO: 1335851 - RNA, 14 nt, Mycobacterium tuberculosis H37Rv
cggcggcggcggca

SEQ ID NO: 1335852 - RNA, 22 nt, Mycobacterium tuberculosis H37Rv
cggcgggcacgcacaaguucuu

SEQ ID NO: 1335853 - RNA, 17 nt, Mycobacterium tuberculosis H37Rv
cggcgggcagcgggccc

SEQ ID NO: 1335854 - RNA, 19 nt, Mycobacterium tuberculosis H37Rv
cggcgggcccgccggcccc

SEQ ID NO: 1335855 - RNA, 15 nt, Mycobacterium tuberculosis H37Rv
cggcgggauccucga

SEQ ID NO: 1335856 - RNA, 14 nt, Mycobacterium tuberculosis H37Rv
cggcgggccugccc

SEQ ID NO: 1335857 - RNA, 15 nt, Mycobacterium tuberculosis H37Rv
cggcgggccugcccg

SEQ ID NO: 1335858 - RNA, 20 nt, Mycobacterium tuberculosis H37Rv
cggcgggccgcgcggcgaca

SEQ ID NO: 1335859 - RNA, 15 nt, Mycobacterium tuberculosis H37Rv
cggcgggcgcgggcg

SEQ ID NO: 1335860 - RNA, 13 nt, Mycobacterium tuberculosis H37Rv
cggcgggccugcc

SEQ ID NO: 1335861 - RNA, 14 nt, Mycobacterium tuberculosis H37Rv
cggcgggccgcgcg

SEQ ID NO: 1335862 - RNA, 14 nt, Mycobacterium tuberculosis H37Rv
cggcgggcucgccc

SEQ ID NO: 1335863 - RNA, 18 nt, Mycobacterium tuberculosis H37Rv
cggcgggggcgucgccgc

SEQ ID NO: 1335864 - RNA, 22 nt, Mycobacterium tuberculosis H37Rv
cggcgggggcgucgccgccggg

SEQ ID NO: 1335865 - RNA, 17 nt, Mycobacterium tuberculosis H37Rv
cggcggggccggcggcu

SEQ ID NO: 1335866 - RNA, 15 nt, Mycobacterium tuberculosis H37Rv
cggcggggugcgccc

SEQ ID NO: 1335867 - RNA, 19 nt, Mycobacterium tuberculosis H37Rv
cggcgcuggucgcgguggc

SEQ ID NO: 1335868 - RNA, 21 nt, Mycobacterium tuberculosis H37Rv
cggcgcugacuagggucaccg

SEQ ID NO: 1335869 - RNA, 19 nt, Mycobacterium tuberculosis H37Rv
cggcgcugaucgcgcgcac

SEQ ID NO: 1335870 - RNA, 21 nt, Mycobacterium tuberculosis H37Rv
cggcgcugaucgcgcgcaccg

SEQ ID NO: 1335871 - RNA, 20 nt, Mycobacterium tuberculosis H37Rv
cggcgcugcgcaccgccgcg

SEQ ID NO: 1335872 - RNA, 15 nt, Mycobacterium tuberculosis H37Rv
cggcgcugcgcaccg

SEQ ID NO: 1335873 - RNA, 16 nt, Mycobacterium tuberculosis H37Rv
cggcgcucgcggcggc

SEQ ID NO: 1335874 - RNA, 13 nt, Mycobacterium tuberculosis H37Rv
cggcgcuccccuc

SEQ ID NO: 1335875 - RNA, 14 nt, Mycobacterium tuberculosis H37Rv
cggcgcuccgccag

SEQ ID NO: 1335876 - RNA, 19 nt, Mycobacterium tuberculosis H37Rv
cggcgcuagcgccgcgcuu

SEQ ID NO: 1335877 - RNA, 17 nt, Mycobacterium tuberculosis H37Rv
cggcgcggccggccgcu

SEQ ID NO: 1335878 - RNA, 13 nt, Mycobacterium tuberculosis H37Rv
cggcgcggccgca

SEQ ID NO: 1335879 - RNA, 21 nt, Mycobacterium tuberculosis H37Rv
cggcgcgucggcaccgauccu

SEQ ID NO: 1335880 - RNA, 20 nt, Mycobacterium tuberculosis H37Rv
cggcgcgguggggcgcgccg

SEQ ID NO: 1335881 - RNA, 22 nt, Mycobacterium tuberculosis H37Rv
cggcgcgguggggcgcgccggc

SEQ ID NO: 1335882 - RNA, 19 nt, Mycobacterium tuberculosis H37Rv
cggcggacccggugacccg

SEQ ID NO: 1335883 - RNA, 17 nt, Mycobacterium tuberculosis H37Rv
cggcggaccccucgacc

SEQ ID NO: 1335884 - RNA, 20 nt, Mycobacterium tuberculosis H37Rv
cggcggacaccucgggcgcc

SEQ ID NO: 1335885 - RNA, 19 nt, Mycobacterium tuberculosis H37Rv
cggcggaaggacggcagcc

SEQ ID NO: 1335886 - RNA, 24 nt, Mycobacterium tuberculosis H37Rv
cggcggacugagagauggucgggc

SEQ ID NO: 1335887 - RNA, 17 nt, Mycobacterium tuberculosis H37Rv
cggcggagcgggccagc

SEQ ID NO: 1335888 - RNA, 20 nt, Mycobacterium tuberculosis H37Rv
cggcggacccggugacccgc

SEQ ID NO: 1335889 - RNA, 18 nt, Mycobacterium tuberculosis H37Rv
cggcggacgcccggcgca

SEQ ID NO: 1335890 - RNA, 23 nt, Mycobacterium tuberculosis H37Rv
cggcgcuggcaggcuuagcuucc

SEQ ID NO: 1335891 - RNA, 17 nt, Mycobacterium tuberculosis H37Rv
cggcgcuggcgggcagc

SEQ ID NO: 1335892 - RNA, 18 nt, Mycobacterium tuberculosis H37Rv
cggcggaaggacggcagc

SEQ ID NO: 1335893 - RNA, 20 nt, Mycobacterium tuberculosis H37Rv
cggcggcacuacgcagccgu

SEQ ID NO: 1335894 - RNA, 18 nt, Mycobacterium tuberculosis H37Rv
cggcggcagcggcgccgc

SEQ ID NO: 1335895 - RNA, 23 nt, Mycobacterium tuberculosis H37Rv
cggcggcaucgaguucggcccgc

SEQ ID NO: 1335896 - RNA, 18 nt, Mycobacterium tuberculosis H37Rv
cggcggccaacagcaccc

SEQ ID NO: 1335897 - RNA, 20 nt, Mycobacterium tuberculosis H37Rv
cggcggccaacagcacccgg

SEQ ID NO: 1335898 - RNA, 22 nt, Mycobacterium tuberculosis H37Rv
cggcggccaacagcacccgggc

SEQ ID NO: 1335899 - RNA, 12 nt, Mycobacterium tuberculosis H37Rv
cggcggccaacg

SEQ ID NO: 1335900 - RNA, 15 nt, Mycobacterium tuberculosis H37Rv
cggcggccaccaugu

SEQ ID NO: 1335901 - RNA, 21 nt, Mycobacterium tuberculosis H37Rv
cggcggauucgguaucagggg

SEQ ID NO: 1335902 - RNA, 20 nt, Mycobacterium tuberculosis H37Rv
cggcggcaaagagcagccgg

SEQ ID NO: 1335903 - RNA, 22 nt, Mycobacterium tuberculosis H37Rv
cggcggcaaagagcagccggcc

SEQ ID NO: 1335904 - RNA, 16 nt, Mycobacterium tuberculosis H37Rv
cggcggcacgcugacc

SEQ ID NO: 1335905 - RNA, 16 nt, Mycobacterium tuberculosis H37Rv
cggcggcaaccccgag

SEQ ID NO: 1335906 - RNA, 22 nt, Mycobacterium tuberculosis H37Rv
cggcggcaaccccgagcggagc

SEQ ID NO: 1335907 - RNA, 13 nt, Mycobacterium tuberculosis H37Rv
cggcggagugcau

SEQ ID NO: 1335908 - RNA, 19 nt, Mycobacterium tuberculosis H37Rv
cggcggaucccgaggcgcc

SEQ ID NO: 1335909 - RNA, 23 nt, Mycobacterium tuberculosis H37Rv
cggcgguaaaugccugcccaccu

SEQ ID NO: 1335910 - RNA, 18 nt, Mycobacterium tuberculosis H37Rv
cggcgguaagggcgggcu

SEQ ID NO: 1335911 - RNA, 17 nt, Mycobacterium tuberculosis H37Rv
cggcgguaagggcgggc

SEQ ID NO: 1335912 - RNA, 23 nt, Mycobacterium tuberculosis H37Rv
cggcgguaccggaaucggcggcg

SEQ ID NO: 1335913 - RNA, 16 nt, Mycobacterium tuberculosis H37Rv
cggcggucaccaccga

SEQ ID NO: 1335914 - RNA, 14 nt, Mycobacterium tuberculosis H37Rv
cggcggucugggug

SEQ ID NO: 1335915 - RNA, 20 nt, Mycobacterium tuberculosis H37Rv
cggcggugaaaucgcacagc

SEQ ID NO: 1335916 - RNA, 15 nt, Mycobacterium tuberculosis H37Rv
cggcggucggcuggg

SEQ ID NO: 1335917 - RNA, 14 nt, Mycobacterium tuberculosis H37Rv
cggcggugugcgca

SEQ ID NO: 1335918 - RNA, 14 nt, Mycobacterium tuberculosis H37Rv
cggcggugucgacc

SEQ ID NO: 1335919 - RNA, 23 nt, Mycobacterium tuberculosis H37Rv
cggcgguuggugcagcgugcagc

SEQ ID NO: 1335920 - RNA, 15 nt, Mycobacterium tuberculosis H37Rv
cggcggugacggugc

SEQ ID NO: 1335921 - RNA, 12 nt, Mycobacterium tuberculosis H37Rv
cggcggucuggg

SEQ ID NO: 1335922 - RNA, 19 nt, Mycobacterium tuberculosis H37Rv
cggcggugcagcagggcgc

SEQ ID NO: 1335923 - RNA, 22 nt, Mycobacterium tuberculosis H37Rv
cggcggugcagcagggcgcgca

SEQ ID NO: 1335924 - RNA, 21 nt, Mycobacterium tuberculosis H37Rv
cggcggugccgcggcuaggcc

SEQ ID NO: 1335925 - RNA, 22 nt, Mycobacterium tuberculosis H37Rv
cggcggugccacgaucggcggg

SEQ ID NO: 1335926 - RNA, 19 nt, Mycobacterium tuberculosis H37Rv
cggcggugcccagcagcgc

SEQ ID NO: 1335927 - RNA, 19 nt, Mycobacterium tuberculosis H37Rv
cggcgguggccguuuaggc

SEQ ID NO: 1335928 - RNA, 18 nt, Mycobacterium tuberculosis H37Rv
cggcggugggggcguacu

SEQ ID NO: 1335929 - RNA, 19 nt, Mycobacterium tuberculosis H37Rv
cggcguacaaaccgucggg

SEQ ID NO: 1335930 - RNA, 18 nt, Mycobacterium tuberculosis H37Rv
cggcguacaaaccgucgg

SEQ ID NO: 1335931 - RNA, 24 nt, Mycobacterium tuberculosis H37Rv
cggcguacccguuaugcgccgccc

SEQ ID NO: 1335932 - RNA, 18 nt, Mycobacterium tuberculosis H37Rv
cggcgaucggaggcccgc

SEQ ID NO: 1335933 - RNA, 19 nt, Mycobacterium tuberculosis H37Rv
cggcgauccggucgggggc

SEQ ID NO: 1335934 - RNA, 21 nt, Mycobacterium tuberculosis H37Rv
cggcgauccggucggccaggc

SEQ ID NO: 1335935 - RNA, 20 nt, Mycobacterium tuberculosis H37Rv
cggcgaucgcuccgcggcgc

SEQ ID NO: 1335936 - RNA, 21 nt, Mycobacterium tuberculosis H37Rv
cggcgaugauguugagcugga

SEQ ID NO: 1335937 - RNA, 20 nt, Mycobacterium tuberculosis H37Rv
cggcgaucugcugugucgua

SEQ ID NO: 1335938 - RNA, 20 nt, Mycobacterium tuberculosis H37Rv
cggcgaguuggccguggcga

SEQ ID NO: 1335939 - RNA, 20 nt, Mycobacterium tuberculosis H37Rv
cggcgaucaacucgggcagc

SEQ ID NO: 1335940 - RNA, 18 nt, Mycobacterium tuberculosis H37Rv
cggcgauccggucggcca

SEQ ID NO: 1335941 - RNA, 21 nt, Mycobacterium tuberculosis H37Rv
cggcgagugguccagccagau

SEQ ID NO: 1335942 - RNA, 14 nt, Mycobacterium tuberculosis H37Rv
cggcgagucgguug

SEQ ID NO: 1335943 - RNA, 22 nt, Mycobacterium tuberculosis H37Rv
cggcgagguauaaacgcggcgc

SEQ ID NO: 1335944 - RNA, 18 nt, Mycobacterium tuberculosis H37Rv
cggcgaggucccggccga

SEQ ID NO: 1335945 - RNA, 22 nt, Mycobacterium tuberculosis H37Rv
cggcgagggcggucagcggcca

SEQ ID NO: 1335946 - RNA, 14 nt, Mycobacterium tuberculosis H37Rv
cggcgagggccacg

SEQ ID NO: 1335947 - RNA, 14 nt, Mycobacterium tuberculosis H37Rv
cggcgagggccagu

SEQ ID NO: 1335948 - RNA, 15 nt, Mycobacterium tuberculosis H37Rv
cggcgagcgucgggc

SEQ ID NO: 1335949 - RNA, 17 nt, Mycobacterium tuberculosis H37Rv
cggcgagcgcggcgacg

SEQ ID NO: 1335950 - RNA, 16 nt, Mycobacterium tuberculosis H37Rv
cggcgaggacgcgccc

SEQ ID NO: 1335951 - RNA, 17 nt, Mycobacterium tuberculosis H37Rv
cggcgaggacggcggcc

SEQ ID NO: 1335952 - RNA, 21 nt, Mycobacterium tuberculosis H37Rv
cggcgaggacggcggccagga

SEQ ID NO: 1335953 - RNA, 12 nt, Mycobacterium tuberculosis H37Rv
cggcgagcgccc

SEQ ID NO: 1335954 - RNA, 23 nt, Mycobacterium tuberculosis H37Rv
cggcgagccaaacuacccgccca

SEQ ID NO: 1335955 - RNA, 19 nt, Mycobacterium tuberculosis H37Rv
cggcgagccucgcgcgcca

SEQ ID NO: 1335956 - RNA, 15 nt, Mycobacterium tuberculosis H37Rv
cggcgagcccgcauc

SEQ ID NO: 1335957 - RNA, 17 nt, Mycobacterium tuberculosis H37Rv
cggcgcaggucgcgcag

SEQ ID NO: 1335958 - RNA, 18 nt, Mycobacterium tuberculosis H37Rv
cggcgcaggucgcgcagu

SEQ ID NO: 1335959 - RNA, 21 nt, Mycobacterium tuberculosis H37Rv
cggcgccaauucagcggcaac

SEQ ID NO: 1335960 - RNA, 15 nt, Mycobacterium tuberculosis H37Rv
cggcgcaccugggcu

SEQ ID NO: 1335961 - RNA, 22 nt, Mycobacterium tuberculosis H37Rv
cggcgcaccggagucgcccggu

SEQ ID NO: 1335962 - RNA, 21 nt, Mycobacterium tuberculosis H37Rv
cggcgcagcacggcggccacg

SEQ ID NO: 1335963 - RNA, 13 nt, Mycobacterium tuberculosis H37Rv
cggcgcagcgacc

SEQ ID NO: 1335964 - RNA, 19 nt, Mycobacterium tuberculosis H37Rv
cggcgcaagcgccgcgcuu

SEQ ID NO: 1335965 - RNA, 18 nt, Mycobacterium tuberculosis H37Rv
cggcgcaagcgccgcgcu

SEQ ID NO: 1335966 - RNA, 21 nt, Mycobacterium tuberculosis H37Rv
cggcgcaccaucgcggccgcu

SEQ ID NO: 1335967 - RNA, 17 nt, Mycobacterium tuberculosis H37Rv
cggcgccgugucaccgg

SEQ ID NO: 1335968 - RNA, 21 nt, Mycobacterium tuberculosis H37Rv
cggcgccuagcacgaagcugg

SEQ ID NO: 1335969 - RNA, 12 nt, Mycobacterium tuberculosis H37Rv
cggcgccgucgu

SEQ ID NO: 1335970 - RNA, 13 nt, Mycobacterium tuberculosis H37Rv
cggcgccucguug

SEQ ID NO: 1335971 - RNA, 17 nt, Mycobacterium tuberculosis H37Rv
cggcgccucggaccaga

SEQ ID NO: 1335972 - RNA, 21 nt, Mycobacterium tuberculosis H37Rv
cggcgccugcugcggccaggg

SEQ ID NO: 1335973 - RNA, 19 nt, Mycobacterium tuberculosis H37Rv
cggcgccgucggagccggc

SEQ ID NO: 1335974 - RNA, 14 nt, Mycobacterium tuberculosis H37Rv
cggcgccggggggc

SEQ ID NO: 1335975 - RNA, 22 nt, Mycobacterium tuberculosis H37Rv
cggcgccggggggcugcugcuc

SEQ ID NO: 1335976 - RNA, 15 nt, Mycobacterium tuberculosis H37Rv
cggcgccggcgccuc

SEQ ID NO: 1335977 - RNA, 17 nt, Mycobacterium tuberculosis H37Rv
cggcgccggcccgcagc

SEQ ID NO: 1335978 - RNA, 23 nt, Mycobacterium tuberculosis H37Rv
cggcgccggaguugaagaagccc

SEQ ID NO: 1335979 - RNA, 10 nt, Mycobacterium tuberculosis H37Rv
cggcgccggc

SEQ ID NO: 1335980 - RNA, 16 nt, Mycobacterium tuberculosis H37Rv
cggcgccggagccgcc

SEQ ID NO: 1335981 - RNA, 17 nt, Mycobacterium tuberculosis H37Rv
cggcgccggagccgccc

SEQ ID NO: 1335982 - RNA, 13 nt, Mycobacterium tuberculosis H37Rv
cggcgcccggcgg

SEQ ID NO: 1335983 - RNA, 19 nt, Mycobacterium tuberculosis H37Rv
cggcgcccgcucggccgca

SEQ ID NO: 1335984 - RNA, 14 nt, Mycobacterium tuberculosis H37Rv
cggcgcccgcccga

SEQ ID NO: 1335985 - RNA, 16 nt, Mycobacterium tuberculosis H37Rv
cggcgccacccgcgcc

SEQ ID NO: 1335986 - RNA, 16 nt, Mycobacterium tuberculosis H37Rv
cggcgcgccccaccgc

SEQ ID NO: 1335987 - RNA, 15 nt, Mycobacterium tuberculosis H37Rv
cggcgcgccccgccg

SEQ ID NO: 1335988 - RNA, 19 nt, Mycobacterium tuberculosis H37Rv
cggcgcgagccugcucuuc

SEQ ID NO: 1335989 - RNA, 15 nt, Mycobacterium tuberculosis H37Rv
cggcgcgaggaacgc

SEQ ID NO: 1335990 - RNA, 18 nt, Mycobacterium tuberculosis H37Rv
cggcgcgauccccgcgcu

SEQ ID NO: 1335991 - RNA, 17 nt, Mycobacterium tuberculosis H37Rv
cggcgcgacagccgugg

SEQ ID NO: 1335992 - RNA, 16 nt, Mycobacterium tuberculosis H37Rv
cggcgcgcgcgccggc

SEQ ID NO: 1335993 - RNA, 19 nt, Mycobacterium tuberculosis H37Rv
cggccgccagccccacccg

SEQ ID NO: 1335994 - RNA, 14 nt, Mycobacterium tuberculosis H37Rv
cggccgccagccgg

SEQ ID NO: 1335995 - RNA, 16 nt, Mycobacterium tuberculosis H37Rv
cggccgccagcgcgcc

SEQ ID NO: 1335996 - RNA, 21 nt, Mycobacterium tuberculosis H37Rv
cggccgccaacuucaccaccc

SEQ ID NO: 1335997 - RNA, 13 nt, Mycobacterium tuberculosis H37Rv
cggccgccagccc

SEQ ID NO: 1335998 - RNA, 17 nt, Mycobacterium tuberculosis H37Rv
cggcccccgagaggcac

SEQ ID NO: 1335999 - RNA, 20 nt, Mycobacterium tuberculosis H37Rv
cggccgccacuugcgcacag

SEQ ID NO: 1336000 - RNA, 13 nt, Mycobacterium tuberculosis H37Rv
cggccgccgcggg

SEQ ID NO: 1336001 - RNA, 14 nt, Mycobacterium tuberculosis H37Rv
cggccgccgcggcu

SEQ ID NO: 1336002 - RNA, 15 nt, Mycobacterium tuberculosis H37Rv
cggccgccgcggcuu

SEQ ID NO: 1336003 - RNA, 13 nt, Mycobacterium tuberculosis H37Rv
cggccgccgcagc

SEQ ID NO: 1336004 - RNA, 22 nt, Mycobacterium tuberculosis H37Rv
cggccgccgacuccccgccggg

SEQ ID NO: 1336005 - RNA, 18 nt, Mycobacterium tuberculosis H37Rv
cggccgccgacagggacc

SEQ ID NO: 1336006 - RNA, 20 nt, Mycobacterium tuberculosis H37Rv
cggccgccgaccggagccgc

SEQ ID NO: 1336007 - RNA, 11 nt, Mycobacterium tuberculosis H37Rv
cggccgcccgu

SEQ ID NO: 1336008 - RNA, 18 nt, Mycobacterium tuberculosis H37Rv
cggccauuagcagcaccc

SEQ ID NO: 1336009 - RNA, 16 nt, Mycobacterium tuberculosis H37Rv
cggccauugcccgggc

SEQ ID NO: 1336010 - RNA, 22 nt, Mycobacterium tuberculosis H37Rv
cggccauuagcagcacccgggc

SEQ ID NO: 1336011 - RNA, 18 nt, Mycobacterium tuberculosis H37Rv
cggcccaguucugcagga

SEQ ID NO: 1336012 - RNA, 12 nt, Mycobacterium tuberculosis H37Rv
cggccccagggg

SEQ ID NO: 1336013 - RNA, 23 nt, Mycobacterium tuberculosis H37Rv
cggcccaucuucggacgccagcu

SEQ ID NO: 1336014 - RNA, 22 nt, Mycobacterium tuberculosis H37Rv
cggcccaugggggaacccccuc

SEQ ID NO: 1336015 - RNA, 20 nt, Mycobacterium tuberculosis H37Rv
cggcccauugucgaucaccu

SEQ ID NO: 1336016 - RNA, 22 nt, Mycobacterium tuberculosis H37Rv
cggcccaucuucggacgccagc

SEQ ID NO: 1336017 - RNA, 19 nt, Mycobacterium tuberculosis H37Rv
cggccccaccggcaccccc

SEQ ID NO: 1336018 - RNA, 19 nt, Mycobacterium tuberculosis H37Rv
cggccggaauacccggccc

SEQ ID NO: 1336019 - RNA, 19 nt, Mycobacterium tuberculosis H37Rv
cggccgcugggcccaucgc

SEQ ID NO: 1336020 - RNA, 14 nt, Mycobacterium tuberculosis H37Rv
cggccgcuuggccg

SEQ ID NO: 1336021 - RNA, 18 nt, Mycobacterium tuberculosis H37Rv
cggccggagccgccggcc

SEQ ID NO: 1336022 - RNA, 16 nt, Mycobacterium tuberculosis H37Rv
cggccgcugggcccau

SEQ ID NO: 1336023 - RNA, 17 nt, Mycobacterium tuberculosis H37Rv
cggccgcugccuuggcg

SEQ ID NO: 1336024 - RNA, 12 nt, Mycobacterium tuberculosis H37Rv
cggccgcgcgca

SEQ ID NO: 1336025 - RNA, 17 nt, Mycobacterium tuberculosis H37Rv
cggccgcgaccgcgacc

SEQ ID NO: 1336026 - RNA, 20 nt, Mycobacterium tuberculosis H37Rv
cggccguggcauguugcgga

SEQ ID NO: 1336027 - RNA, 15 nt, Mycobacterium tuberculosis H37Rv
cggccgucgucggcc

SEQ ID NO: 1336028 - RNA, 19 nt, Mycobacterium tuberculosis H37Rv
cggccgugaccgagccgcg

SEQ ID NO: 1336029 - RNA, 16 nt, Mycobacterium tuberculosis H37Rv
cggccgugagcccggc

SEQ ID NO: 1336030 - RNA, 18 nt, Mycobacterium tuberculosis H37Rv
cggccgucccgcgagcag

SEQ ID NO: 1336031 - RNA, 14 nt, Mycobacterium tuberculosis H37Rv
cggccgucgcgcga

SEQ ID NO: 1336032 - RNA, 16 nt, Mycobacterium tuberculosis H37Rv
cggccgucgcgcgacc

SEQ ID NO: 1336033 - RNA, 15 nt, Mycobacterium tuberculosis H37Rv
cggccgucgauugca

SEQ ID NO: 1336034 - RNA, 20 nt, Mycobacterium tuberculosis H37Rv
cggccgguggaaaccgggcg

SEQ ID NO: 1336035 - RNA, 21 nt, Mycobacterium tuberculosis H37Rv
cggccgguuggccagccacag

SEQ ID NO: 1336036 - RNA, 14 nt, Mycobacterium tuberculosis H37Rv
cggccggcaugcug

SEQ ID NO: 1336037 - RNA, 16 nt, Mycobacterium tuberculosis H37Rv
cggccggauacggcga

SEQ ID NO: 1336038 - RNA, 18 nt, Mycobacterium tuberculosis H37Rv
cggccggaguccgucggg

SEQ ID NO: 1336039 - RNA, 16 nt, Mycobacterium tuberculosis H37Rv
cggcgacugcgcaccu

SEQ ID NO: 1336040 - RNA, 15 nt, Mycobacterium tuberculosis H37Rv
cggcgacucugcggg

SEQ ID NO: 1336041 - RNA, 15 nt, Mycobacterium tuberculosis H37Rv
cggcgagcaccaccc

SEQ ID NO: 1336042 - RNA, 14 nt, Mycobacterium tuberculosis H37Rv
cggcgagcacccgc

SEQ ID NO: 1336043 - RNA, 18 nt, Mycobacterium tuberculosis H37Rv
cggcgagagccucggcca

SEQ ID NO: 1336044 - RNA, 17 nt, Mycobacterium tuberculosis H37Rv
cggcgagagccucggcc

SEQ ID NO: 1336045 - RNA, 15 nt, Mycobacterium tuberculosis H37Rv
cggcgagcagcaggu

SEQ ID NO: 1336046 - RNA, 20 nt, Mycobacterium tuberculosis H37Rv
cggcgaccccgaagaugacc

SEQ ID NO: 1336047 - RNA, 18 nt, Mycobacterium tuberculosis H37Rv
cggcgacgucgcgcaggu

SEQ ID NO: 1336048 - RNA, 17 nt, Mycobacterium tuberculosis H37Rv
cggcgacucgaggaccu

SEQ ID NO: 1336049 - RNA, 22 nt, Mycobacterium tuberculosis H37Rv
cggcgacgucguuggccugccg

SEQ ID NO: 1336050 - RNA, 14 nt, Mycobacterium tuberculosis H37Rv
cggcgacguggcgc

SEQ ID NO: 1336051 - RNA, 17 nt, Mycobacterium tuberculosis H37Rv
cggcgaccacggcaccg

SEQ ID NO: 1336052 - RNA, 21 nt, Mycobacterium tuberculosis H37Rv
cggcgaccacgccgccggcgc

SEQ ID NO: 1336053 - RNA, 22 nt, Mycobacterium tuberculosis H37Rv
cggcgaccacgccgccggcgcu

SEQ ID NO: 1336054 - RNA, 14 nt, Mycobacterium tuberculosis H37Rv
cggcgaccaccccg

SEQ ID NO: 1336055 - RNA, 17 nt, Mycobacterium tuberculosis H37Rv
cggcgaccaccccguag

SEQ ID NO: 1336056 - RNA, 20 nt, Mycobacterium tuberculosis H37Rv
cggcgacccggguagacacc

SEQ ID NO: 1336057 - RNA, 21 nt, Mycobacterium tuberculosis H37Rv
cggcgaccagaaucucgccgg

SEQ ID NO: 1336058 - RNA, 20 nt, Mycobacterium tuberculosis H37Rv
cggcgaccagcucagcugcg

SEQ ID NO: 1336059 - RNA, 18 nt, Mycobacterium tuberculosis H37Rv
cggcgaaccggcccaccg

SEQ ID NO: 1336060 - RNA, 17 nt, Mycobacterium tuberculosis H37Rv
cggcgaacaaccgccgc

SEQ ID NO: 1336061 - RNA, 18 nt, Mycobacterium tuberculosis H37Rv
cggcgaaccacggcagcc

SEQ ID NO: 1336062 - RNA, 15 nt, Mycobacterium tuberculosis H37Rv
cggcgaacccaccgc

SEQ ID NO: 1336063 - RNA, 18 nt, Mycobacterium tuberculosis H37Rv
cggcgaacccaccgcauu

SEQ ID NO: 1336064 - RNA, 15 nt, Mycobacterium tuberculosis H37Rv
cggcgaacccgccga

SEQ ID NO: 1336065 - RNA, 14 nt, Mycobacterium tuberculosis H37Rv
cggcgaaccacggc

SEQ ID NO: 1336066 - RNA, 17 nt, Mycobacterium tuberculosis H37Rv
cggcgaaccacggcagc

SEQ ID NO: 1336067 - RNA, 13 nt, Mycobacterium tuberculosis H37Rv
cggcgaacagccc

SEQ ID NO: 1336068 - RNA, 14 nt, Mycobacterium tuberculosis H37Rv
cggcgaacagcccc

SEQ ID NO: 1336069 - RNA, 15 nt, Mycobacterium tuberculosis H37Rv
cggcgaacagcccca

SEQ ID NO: 1336070 - RNA, 15 nt, Mycobacterium tuberculosis H37Rv
cggccugcucggcga

SEQ ID NO: 1336071 - RNA, 15 nt, Mycobacterium tuberculosis H37Rv
cggcgaaaggccagu

SEQ ID NO: 1336072 - RNA, 22 nt, Mycobacterium tuberculosis H37Rv
cggccugcgacgagcccaccgu

SEQ ID NO: 1336073 - RNA, 19 nt, Mycobacterium tuberculosis H37Rv
cggccugcgacgagcccac

SEQ ID NO: 1336074 - RNA, 17 nt, Mycobacterium tuberculosis H37Rv
cggccugcacggcgcug

SEQ ID NO: 1336075 - RNA, 16 nt, Mycobacterium tuberculosis H37Rv
cggccguggcuggacc

SEQ ID NO: 1336076 - RNA, 14 nt, Mycobacterium tuberculosis H37Rv
cggccucgcugggc

SEQ ID NO: 1336077 - RNA, 23 nt, Mycobacterium tuberculosis H37Rv
cggccucgggacucccgcgcggg

SEQ ID NO: 1336078 - RNA, 17 nt, Mycobacterium tuberculosis H37Rv
cggccugagcggccauc

SEQ ID NO: 1336079 - RNA, 21 nt, Mycobacterium tuberculosis H37Rv
cggccugagcgucgucgccgg

SEQ ID NO: 1336080 - RNA, 16 nt, Mycobacterium tuberculosis H37Rv
cggccucugaccagcc

SEQ ID NO: 1336081 - RNA, 22 nt, Mycobacterium tuberculosis H37Rv
cggccucuagcuugacaacccu

SEQ ID NO: 1336082 - RNA, 23 nt, Mycobacterium tuberculosis H37Rv
cggccugaccggcucgccggcgc

SEQ ID NO: 1336083 - RNA, 16 nt, Mycobacterium tuberculosis H37Rv
cggcaggcggccgccg

SEQ ID NO: 1336084 - RNA, 17 nt, Mycobacterium tuberculosis H37Rv
cggcaggauucccucga

SEQ ID NO: 1336085 - RNA, 16 nt, Mycobacterium tuberculosis H37Rv
cggcagcuggcgcagc

SEQ ID NO: 1336086 - RNA, 13 nt, Mycobacterium tuberculosis H37Rv
cggcagcuggggc

SEQ ID NO: 1336087 - RNA, 22 nt, Mycobacterium tuberculosis H37Rv
cggcagcuggggcccggccgcc

SEQ ID NO: 1336088 - RNA, 20 nt, Mycobacterium tuberculosis H37Rv
cggcaggaaugccgcgggga

SEQ ID NO: 1336089 - RNA, 20 nt, Mycobacterium tuberculosis H37Rv
cggcagcggcgccgccugga

SEQ ID NO: 1336090 - RNA, 13 nt, Mycobacterium tuberculosis H37Rv
cggcagcggcgcg

SEQ ID NO: 1336091 - RNA, 18 nt, Mycobacterium tuberculosis H37Rv
cggcagcggaccgcugcc

SEQ ID NO: 1336092 - RNA, 14 nt, Mycobacterium tuberculosis H37Rv
cggcagcggcuggg

SEQ ID NO: 1336093 - RNA, 16 nt, Mycobacterium tuberculosis H37Rv
cggcagcgccggucgg

SEQ ID NO: 1336094 - RNA, 19 nt, Mycobacterium tuberculosis H37Rv
cggcagcgcccuuggacgc

SEQ ID NO: 1336095 - RNA, 19 nt, Mycobacterium tuberculosis H37Rv
cggcagcgccaccgaccga

SEQ ID NO: 1336096 - RNA, 17 nt, Mycobacterium tuberculosis H37Rv
cggcagcggcgcgcugc

SEQ ID NO: 1336097 - RNA, 22 nt, Mycobacterium tuberculosis H37Rv
cggcagcgguggcuugccccgc

SEQ ID NO: 1336098 - RNA, 21 nt, Mycobacterium tuberculosis H37Rv
cggcagcgugcggggcgccug

SEQ ID NO: 1336099 - RNA, 24 nt, Mycobacterium tuberculosis H37Rv
cggcagcuacuaugccaacgacag

SEQ ID NO: 1336100 - RNA, 16 nt, Mycobacterium tuberculosis H37Rv
cggcaguuccugacgc

SEQ ID NO: 1336101 - RNA, 16 nt, Mycobacterium tuberculosis H37Rv
cggcagugagucggug

SEQ ID NO: 1336102 - RNA, 16 nt, Mycobacterium tuberculosis H37Rv
cggcauacaacuggug

SEQ ID NO: 1336103 - RNA, 20 nt, Mycobacterium tuberculosis H37Rv
cggcaggugcggucaaagga

SEQ ID NO: 1336104 - RNA, 23 nt, Mycobacterium tuberculosis H37Rv
cggcaggcuggcgagggcugacg

SEQ ID NO: 1336105 - RNA, 18 nt, Mycobacterium tuberculosis H37Rv
cggcaggcggccgccggg

SEQ ID NO: 1336106 - RNA, 16 nt, Mycobacterium tuberculosis H37Rv
cggcacgcuccagcuc

SEQ ID NO: 1336107 - RNA, 20 nt, Mycobacterium tuberculosis H37Rv
cggcacggucacacgccagc

SEQ ID NO: 1336108 - RNA, 21 nt, Mycobacterium tuberculosis H37Rv
cggcacuuuguagcccgcgau

SEQ ID NO: 1336109 - RNA, 18 nt, Mycobacterium tuberculosis H37Rv
cggcacgcgucuggaacg

SEQ ID NO: 1336110 - RNA, 22 nt, Mycobacterium tuberculosis H37Rv
cggcagaccggugcugucgacg

SEQ ID NO: 1336111 - RNA, 17 nt, Mycobacterium tuberculosis H37Rv
cggcagaccgaccucgg

SEQ ID NO: 1336112 - RNA, 19 nt, Mycobacterium tuberculosis H37Rv
cggcagaccgaccucggcg

SEQ ID NO: 1336113 - RNA, 15 nt, Mycobacterium tuberculosis H37Rv
cggcagaccaugguc

SEQ ID NO: 1336114 - RNA, 17 nt, Mycobacterium tuberculosis H37Rv
cggcagacccgagcgcu

SEQ ID NO: 1336115 - RNA, 14 nt, Mycobacterium tuberculosis H37Rv
cggcagccagggcg

SEQ ID NO: 1336116 - RNA, 16 nt, Mycobacterium tuberculosis H37Rv
cggcagccagggcgcc

SEQ ID NO: 1336117 - RNA, 18 nt, Mycobacterium tuberculosis H37Rv
cggcagaucccacgccag

SEQ ID NO: 1336118 - RNA, 14 nt, Mycobacterium tuberculosis H37Rv
cggcagccaccagc

SEQ ID NO: 1336119 - RNA, 17 nt, Mycobacterium tuberculosis H37Rv
cggcagccaccagcgac

SEQ ID NO: 1336120 - RNA, 20 nt, Mycobacterium tuberculosis H37Rv
cggcagccaccagcgacgac

SEQ ID NO: 1336121 - RNA, 13 nt, Mycobacterium tuberculosis H37Rv
cggcagccggcgg

SEQ ID NO: 1336122 - RNA, 20 nt, Mycobacterium tuberculosis H37Rv
cggcagcccaaagcgccagc

SEQ ID NO: 1336123 - RNA, 16 nt, Mycobacterium tuberculosis H37Rv
cggcagccccugccga

SEQ ID NO: 1336124 - RNA, 14 nt, Mycobacterium tuberculosis H37Rv
cggcagccuggccu

SEQ ID NO: 1336125 - RNA, 19 nt, Mycobacterium tuberculosis H37Rv
cggcagcgacgccggcccg

SEQ ID NO: 1336126 - RNA, 22 nt, Mycobacterium tuberculosis H37Rv
cggcagcgaugcggugucgggc

SEQ ID NO: 1336127 - RNA, 14 nt, Mycobacterium tuberculosis H37Rv
cgcuugcggccgcg

SEQ ID NO: 1336128 - RNA, 18 nt, Mycobacterium tuberculosis H37Rv
cgcuugcgaucggcacuu

SEQ ID NO: 1336129 - RNA, 13 nt, Mycobacterium tuberculosis H37Rv
cgcuugcgcggcu

SEQ ID NO: 1336130 - RNA, 19 nt, Mycobacterium tuberculosis H37Rv
cgcuugcggggccgggcga

SEQ ID NO: 1336131 - RNA, 12 nt, Mycobacterium tuberculosis H37Rv
cgcuugccccgc

SEQ ID NO: 1336132 - RNA, 17 nt, Mycobacterium tuberculosis H37Rv
cgcuugccccgccgagc

SEQ ID NO: 1336133 - RNA, 23 nt, Mycobacterium tuberculosis H37Rv
cgcuugccccgccgagcaccggg

SEQ ID NO: 1336134 - RNA, 12 nt, Mycobacterium tuberculosis H37Rv
cgcuugcauuga

SEQ ID NO: 1336135 - RNA, 22 nt, Mycobacterium tuberculosis H37Rv
cgcuugcaccaggggcgcguca

SEQ ID NO: 1336136 - RNA, 21 nt, Mycobacterium tuberculosis H37Rv
cgcuuggcaaucaucucccga

SEQ ID NO: 1336137 - RNA, 15 nt, Mycobacterium tuberculosis H37Rv
cgcuugcucucgcag

SEQ ID NO: 1336138 - RNA, 18 nt, Mycobacterium tuberculosis H37Rv
cgcuugcucucgcagcau

SEQ ID NO: 1336139 - RNA, 23 nt, Mycobacterium tuberculosis H37Rv
cgcuuggagcggguccccaccgg

SEQ ID NO: 1336140 - RNA, 18 nt, Mycobacterium tuberculosis H37Rv
cggcacgaaauugggcga

SEQ ID NO: 1336141 - RNA, 19 nt, Mycobacterium tuberculosis H37Rv
cggcacgaaauugggcgau

SEQ ID NO: 1336142 - RNA, 18 nt, Mycobacterium tuberculosis H37Rv
cgcuuggcgagccacggc

SEQ ID NO: 1336143 - RNA, 15 nt, Mycobacterium tuberculosis H37Rv
cgcuuggcgcggccc

SEQ ID NO: 1336144 - RNA, 14 nt, Mycobacterium tuberculosis H37Rv
cggcacgccggcgg

SEQ ID NO: 1336145 - RNA, 17 nt, Mycobacterium tuberculosis H37Rv
cggcacgaucgccaacg

SEQ ID NO: 1336146 - RNA, 14 nt, Mycobacterium tuberculosis H37Rv
cggcacgaaucccc

SEQ ID NO: 1336147 - RNA, 19 nt, Mycobacterium tuberculosis H37Rv
cggcacgaaucccccggac

SEQ ID NO: 1336148 - RNA, 15 nt, Mycobacterium tuberculosis H37Rv
cggccagcgcggcgc

SEQ ID NO: 1336149 - RNA, 14 nt, Mycobacterium tuberculosis H37Rv
cggccagccgcggc

SEQ ID NO: 1336150 - RNA, 17 nt, Mycobacterium tuberculosis H37Rv
cggccagcgggaacaca

SEQ ID NO: 1336151 - RNA, 13 nt, Mycobacterium tuberculosis H37Rv
cggccagcggccc

SEQ ID NO: 1336152 - RNA, 13 nt, Mycobacterium tuberculosis H37Rv
cggccagcuuccc

SEQ ID NO: 1336153 - RNA, 21 nt, Mycobacterium tuberculosis H37Rv
cggccagcuguucgagccgcg

SEQ ID NO: 1336154 - RNA, 21 nt, Mycobacterium tuberculosis H37Rv
cggccagcucgggcgcgcggc

SEQ ID NO: 1336155 - RNA, 18 nt, Mycobacterium tuberculosis H37Rv
cggccagcucgugaucuu

SEQ ID NO: 1336156 - RNA, 15 nt, Mycobacterium tuberculosis H37Rv
cggccagcucggcca

SEQ ID NO: 1336157 - RNA, 20 nt, Mycobacterium tuberculosis H37Rv
cggccagcugcguggcgaac

SEQ ID NO: 1336158 - RNA, 14 nt, Mycobacterium tuberculosis H37Rv
cggccagcucccgc

SEQ ID NO: 1336159 - RNA, 18 nt, Mycobacterium tuberculosis H37Rv
cggccagcuccagcgccg

SEQ ID NO: 1336160 - RNA, 15 nt, Mycobacterium tuberculosis H37Rv
cggccagcucccggg

SEQ ID NO: 1336161 - RNA, 17 nt, Mycobacterium tuberculosis H37Rv
cggccagcucgcgggcc

SEQ ID NO: 1336162 - RNA, 13 nt, Mycobacterium tuberculosis H37Rv
cggccacccgcga

SEQ ID NO: 1336163 - RNA, 20 nt, Mycobacterium tuberculosis H37Rv
cggccacccggacauagccg

SEQ ID NO: 1336164 - RNA, 13 nt, Mycobacterium tuberculosis H37Rv
cggccaccaggug

SEQ ID NO: 1336165 - RNA, 17 nt, Mycobacterium tuberculosis H37Rv
cggccaccaucgccccg

SEQ ID NO: 1336166 - RNA, 15 nt, Mycobacterium tuberculosis H37Rv
cggccaccgaggcgu

SEQ ID NO: 1336167 - RNA, 15 nt, Mycobacterium tuberculosis H37Rv
cggccaccgcacgcu

SEQ ID NO: 1336168 - RNA, 16 nt, Mycobacterium tuberculosis H37Rv
cggccaccgccgccgc

SEQ ID NO: 1336169 - RNA, 17 nt, Mycobacterium tuberculosis H37Rv
cggccaccgccgccgcc

SEQ ID NO: 1336170 - RNA, 18 nt, Mycobacterium tuberculosis H37Rv
cggccagccauggcagcg

SEQ ID NO: 1336171 - RNA, 18 nt, Mycobacterium tuberculosis H37Rv
cggccagccgacgcggcg

SEQ ID NO: 1336172 - RNA, 13 nt, Mycobacterium tuberculosis H37Rv
cggccagccgcac

SEQ ID NO: 1336173 - RNA, 14 nt, Mycobacterium tuberculosis H37Rv
cggccagcagugcg

SEQ ID NO: 1336174 - RNA, 19 nt, Mycobacterium tuberculosis H37Rv
cggccaguucggcggccgc

SEQ ID NO: 1336175 - RNA, 18 nt, Mycobacterium tuberculosis H37Rv
cggccagugcgcgcguca

SEQ ID NO: 1336176 - RNA, 15 nt, Mycobacterium tuberculosis H37Rv
cggccagggagcggc

SEQ ID NO: 1336177 - RNA, 14 nt, Mycobacterium tuberculosis H37Rv
cggccaggccgaca

SEQ ID NO: 1336178 - RNA, 16 nt, Mycobacterium tuberculosis H37Rv
cggccaggcgcgacgu

SEQ ID NO: 1336179 - RNA, 19 nt, Mycobacterium tuberculosis H37Rv
cggccaggaucgcuacguc

SEQ ID NO: 1336180 - RNA, 19 nt, Mycobacterium tuberculosis H37Rv
cggccaggaucuguuuggg

SEQ ID NO: 1336181 - RNA, 22 nt, Mycobacterium tuberculosis H37Rv
cggccaggaugccugccacccg

SEQ ID NO: 1336182 - RNA, 23 nt, Mycobacterium tuberculosis H37Rv
cggccaggaugaagacgcggguc

SEQ ID NO: 1336183 - RNA, 17 nt, Mycobacterium tuberculosis H37Rv
cggccaugaugaugaca

SEQ ID NO: 1336184 - RNA, 18 nt, Mycobacterium tuberculosis H37Rv
cggccaugaaaaucggca

SEQ ID NO: 1336185 - RNA, 20 nt, Mycobacterium tuberculosis H37Rv
cggccaugguguucggcagc

SEQ ID NO: 1336186 - RNA, 21 nt, Mycobacterium tuberculosis H37Rv
cggccaucgaguccaccaccu

SEQ ID NO: 1336187 - RNA, 18 nt, Mycobacterium tuberculosis H37Rv
cggccauccggcggcggc

SEQ ID NO: 1336188 - RNA, 22 nt, Mycobacterium tuberculosis H37Rv
cggccaucgccagccugugcug

SEQ ID NO: 1336189 - RNA, 14 nt, Mycobacterium tuberculosis H37Rv
cggccaucgccagc

SEQ ID NO: 1336190 - RNA, 20 nt, Mycobacterium tuberculosis H37Rv
cggccauaucgcccaccacg

SEQ ID NO: 1336191 - RNA, 19 nt, Mycobacterium tuberculosis H37Rv
cggccauccaccgcagauc

SEQ ID NO: 1336192 - RNA, 20 nt, Mycobacterium tuberculosis H37Rv
cggccaucagaaccuccucg

SEQ ID NO: 1336193 - RNA, 19 nt, Mycobacterium tuberculosis H37Rv
cggccauagcgccgcgccc

SEQ ID NO: 1336194 - RNA, 23 nt, Mycobacterium tuberculosis H37Rv
cggcaucugaaaauugacccccu

SEQ ID NO: 1336195 - RNA, 14 nt, Mycobacterium tuberculosis H37Rv
cggcaucuccaccg

SEQ ID NO: 1336196 - RNA, 22 nt, Mycobacterium tuberculosis H37Rv
cggcaucugaaaauugaccccc

SEQ ID NO: 1336197 - RNA, 15 nt, Mycobacterium tuberculosis H37Rv
cggcaucggccaccu

SEQ ID NO: 1336198 - RNA, 17 nt, Mycobacterium tuberculosis H37Rv
cggcaucgccgcgggug

SEQ ID NO: 1336199 - RNA, 14 nt, Mycobacterium tuberculosis H37Rv
cggcaucgccgcgg

SEQ ID NO: 1336200 - RNA, 22 nt, Mycobacterium tuberculosis H37Rv
cggcaucgcgggcggcgcuggc

SEQ ID NO: 1336201 - RNA, 21 nt, Mycobacterium tuberculosis H37Rv
cggcaucggagauacgggcca

SEQ ID NO: 1336202 - RNA, 23 nt, Mycobacterium tuberculosis H37Rv
cggcaucaacgcgggcgcuugcc

SEQ ID NO: 1336203 - RNA, 16 nt, Mycobacterium tuberculosis H37Rv
cggcaucaacgcgggc

SEQ ID NO: 1336204 - RNA, 19 nt, Mycobacterium tuberculosis H37Rv
cggcaucaacgcgggcgcu

SEQ ID NO: 1336205 - RNA, 15 nt, Mycobacterium tuberculosis H37Rv
cggcauccgcgggga

SEQ ID NO: 1336206 - RNA, 13 nt, Mycobacterium tuberculosis H37Rv
cggcaucgaggcc

SEQ ID NO: 1336207 - RNA, 17 nt, Mycobacterium tuberculosis H37Rv
cggcaucgaggccagca

SEQ ID NO: 1336208 - RNA, 13 nt, Mycobacterium tuberculosis H37Rv
cggcauggugacg

SEQ ID NO: 1336209 - RNA, 18 nt, Mycobacterium tuberculosis H37Rv
cggcaugcaaugcuggcg

SEQ ID NO: 1336210 - RNA, 16 nt, Mycobacterium tuberculosis H37Rv
cggcaugggccggcgc

SEQ ID NO: 1336211 - RNA, 21 nt, Mycobacterium tuberculosis H37Rv
cggcaugggucgugcaggcga

SEQ ID NO: 1336212 - RNA, 16 nt, Mycobacterium tuberculosis H37Rv
cggccaccagcgccuu

SEQ ID NO: 1336213 - RNA, 15 nt, Mycobacterium tuberculosis H37Rv
cggccaccagcgccc

SEQ ID NO: 1336214 - RNA, 18 nt, Mycobacterium tuberculosis H37Rv
cggccaccagcgcccggc

SEQ ID NO: 1336215 - RNA, 22 nt, Mycobacterium tuberculosis H37Rv
cggccaccagcgcccggcccgc

SEQ ID NO: 1336216 - RNA, 23 nt, Mycobacterium tuberculosis H37Rv
cggccaccagggccaccgcgccg

SEQ ID NO: 1336217 - RNA, 18 nt, Mycobacterium tuberculosis H37Rv
cggccaccagggccaccg

SEQ ID NO: 1336218 - RNA, 16 nt, Mycobacterium tuberculosis H37Rv
cggccaccagggccac

SEQ ID NO: 1336219 - RNA, 18 nt, Mycobacterium tuberculosis H37Rv
cggccaauccggggcccg

SEQ ID NO: 1336220 - RNA, 15 nt, Mycobacterium tuberculosis H37Rv
cggccaauccggggc

SEQ ID NO: 1336221 - RNA, 14 nt, Mycobacterium tuberculosis H37Rv
cggccaacugggcc

SEQ ID NO: 1336222 - RNA, 22 nt, Mycobacterium tuberculosis H37Rv
cggccaacugggccgagcgcgc

SEQ ID NO: 1336223 - RNA, 18 nt, Mycobacterium tuberculosis H37Rv
cggccaacggcuccgggc

SEQ ID NO: 1336224 - RNA, 17 nt, Mycobacterium tuberculosis H37Rv
cggccaaguugaccccc

SEQ ID NO: 1336225 - RNA, 15 nt, Mycobacterium tuberculosis H37Rv
cggccaacccgggcc

SEQ ID NO: 1336226 - RNA, 14 nt, Mycobacterium tuberculosis H37Rv
cggccaaccaugcu

SEQ ID NO: 1336227 - RNA, 13 nt, Mycobacterium tuberculosis H37Rv
cggccaacccauc

SEQ ID NO: 1336228 - RNA, 19 nt, Mycobacterium tuberculosis H37Rv
cggccaacagucgcagcac

SEQ ID NO: 1336229 - RNA, 22 nt, Mycobacterium tuberculosis H37Rv
cggccaacccgggccgccaggg

SEQ ID NO: 1336230 - RNA, 13 nt, Mycobacterium tuberculosis H37Rv
cgcucguugcguu

SEQ ID NO: 1336231 - RNA, 16 nt, Mycobacterium tuberculosis H37Rv
cgcucguuccggcggu

SEQ ID NO: 1336232 - RNA, 20 nt, Mycobacterium tuberculosis H37Rv
cgcucgguuugcguccuggu

SEQ ID NO: 1336233 - RNA, 18 nt, Mycobacterium tuberculosis H37Rv
cgcucgucgcggcccgcg

SEQ ID NO: 1336234 - RNA, 23 nt, Mycobacterium tuberculosis H37Rv
cgcucggucgccaccgccggcag

SEQ ID NO: 1336235 - RNA, 21 nt, Mycobacterium tuberculosis H37Rv
cgcucggucgccaccgccggc

SEQ ID NO: 1336236 - RNA, 16 nt, Mycobacterium tuberculosis H37Rv
cgcucguagacuuccu

SEQ ID NO: 1336237 - RNA, 22 nt, Mycobacterium tuberculosis H37Rv
cgcucgguccccgcagcucgac

SEQ ID NO: 1336238 - RNA, 18 nt, Mycobacterium tuberculosis H37Rv
cgcucgggguggucggcu

SEQ ID NO: 1336239 - RNA, 17 nt, Mycobacterium tuberculosis H37Rv
cgcucggcguccgccca

SEQ ID NO: 1336240 - RNA, 19 nt, Mycobacterium tuberculosis H37Rv
cgcucgggcaacgccucga

SEQ ID NO: 1336241 - RNA, 17 nt, Mycobacterium tuberculosis H37Rv
cgcucgggcgagaucuu

SEQ ID NO: 1336242 - RNA, 19 nt, Mycobacterium tuberculosis H37Rv
cgcucggccugcugcugca

SEQ ID NO: 1336243 - RNA, 21 nt, Mycobacterium tuberculosis H37Rv
cgcucgcggguucggcugccu

SEQ ID NO: 1336244 - RNA, 14 nt, Mycobacterium tuberculosis H37Rv
cgcucgcugcagca

SEQ ID NO: 1336245 - RNA, 23 nt, Mycobacterium tuberculosis H37Rv
cgcucgcggcuucaguccggccc

SEQ ID NO: 1336246 - RNA, 22 nt, Mycobacterium tuberculosis H37Rv
cgcucgccgguaggcggccagc

SEQ ID NO: 1336247 - RNA, 16 nt, Mycobacterium tuberculosis H37Rv
cgcucgcggcggcgcu

SEQ ID NO: 1336248 - RNA, 12 nt, Mycobacterium tuberculosis H37Rv
cgcucgcggcgg

SEQ ID NO: 1336249 - RNA, 14 nt, Mycobacterium tuberculosis H37Rv
cgcucgcgaaagag

SEQ ID NO: 1336250 - RNA, 12 nt, Mycobacterium tuberculosis H37Rv
cgcucgcgcgcu

SEQ ID NO: 1336251 - RNA, 21 nt, Mycobacterium tuberculosis H37Rv
cgcucgcgcgcugggcgcgcu

SEQ ID NO: 1336252 - RNA, 17 nt, Mycobacterium tuberculosis H37Rv
cgcugaccccggcagcg

SEQ ID NO: 1336253 - RNA, 14 nt, Mycobacterium tuberculosis H37Rv
cgcugacccgccac

SEQ ID NO: 1336254 - RNA, 23 nt, Mycobacterium tuberculosis H37Rv
cgcugaagguggcgaacccgguc

SEQ ID NO: 1336255 - RNA, 17 nt, Mycobacterium tuberculosis H37Rv
cgcugaaguggcacaag

SEQ ID NO: 1336256 - RNA, 18 nt, Mycobacterium tuberculosis H37Rv
cgcugaauuggcgccgau

SEQ ID NO: 1336257 - RNA, 16 nt, Mycobacterium tuberculosis H37Rv
cgcugacacccacggc

SEQ ID NO: 1336258 - RNA, 17 nt, Mycobacterium tuberculosis H37Rv
cgcucucggucaguucc

SEQ ID NO: 1336259 - RNA, 15 nt, Mycobacterium tuberculosis H37Rv
cgcucugcggccacg

SEQ ID NO: 1336260 - RNA, 19 nt, Mycobacterium tuberculosis H37Rv
cgcucugcgccacagcagc

SEQ ID NO: 1336261 - RNA, 12 nt, Mycobacterium tuberculosis H37Rv
cgcucuggcucc

SEQ ID NO: 1336262 - RNA, 16 nt, Mycobacterium tuberculosis H37Rv
cgcuccaccucggcgu

SEQ ID NO: 1336263 - RNA, 13 nt, Mycobacterium tuberculosis H37Rv
cgcuccagauggg

SEQ ID NO: 1336264 - RNA, 14 nt, Mycobacterium tuberculosis H37Rv
cgcuccagaugggg

SEQ ID NO: 1336265 - RNA, 20 nt, Mycobacterium tuberculosis H37Rv
cgcuccaguggcgccagggc

SEQ ID NO: 1336266 - RNA, 23 nt, Mycobacterium tuberculosis H37Rv
cgcuccaguggcgccagggccuu

SEQ ID NO: 1336267 - RNA, 18 nt, Mycobacterium tuberculosis H37Rv
cgcuccaguggcgccagg

SEQ ID NO: 1336268 - RNA, 15 nt, Mycobacterium tuberculosis H37Rv
cgcuccagccgcgcg

SEQ ID NO: 1336269 - RNA, 14 nt, Mycobacterium tuberculosis H37Rv
cgcuccaagcgcgg

SEQ ID NO: 1336270 - RNA, 15 nt, Mycobacterium tuberculosis H37Rv
cgcuccaacaacucc

SEQ ID NO: 1336271 - RNA, 23 nt, Mycobacterium tuberculosis H37Rv
cgcuccaaaagccucagccgcuc

SEQ ID NO: 1336272 - RNA, 18 nt, Mycobacterium tuberculosis H37Rv
cgcucauugcaucugcca

SEQ ID NO: 1336273 - RNA, 21 nt, Mycobacterium tuberculosis H37Rv
cgcucaugggcgccaucccgc

SEQ ID NO: 1336274 - RNA, 22 nt, Mycobacterium tuberculosis H37Rv
cgcucaucuguaaccuccucga

SEQ ID NO: 1336275 - RNA, 15 nt, Mycobacterium tuberculosis H37Rv
cgcucaucgcggcga

SEQ ID NO: 1336276 - RNA, 17 nt, Mycobacterium tuberculosis H37Rv
cgcucaucacccagcgc

SEQ ID NO: 1336277 - RNA, 19 nt, Mycobacterium tuberculosis H37Rv
cgcucgauggcggccacca

SEQ ID NO: 1336278 - RNA, 21 nt, Mycobacterium tuberculosis H37Rv
cgcucgaucacuagcgccccu

SEQ ID NO: 1336279 - RNA, 22 nt, Mycobacterium tuberculosis H37Rv
cgcucgaugucccgagcccgcu

SEQ ID NO: 1336280 - RNA, 16 nt, Mycobacterium tuberculosis H37Rv
cgcucgcaccgcccgc

SEQ ID NO: 1336281 - RNA, 21 nt, Mycobacterium tuberculosis H37Rv
cgcucgacgacgggcgccaac

SEQ ID NO: 1336282 - RNA, 18 nt, Mycobacterium tuberculosis H37Rv
cgcucgacgacgggcgcc

SEQ ID NO: 1336283 - RNA, 17 nt, Mycobacterium tuberculosis H37Rv
cgcucgacgacgggcgc

SEQ ID NO: 1336284 - RNA, 13 nt, Mycobacterium tuberculosis H37Rv
cgcucgaccccgc

SEQ ID NO: 1336285 - RNA, 15 nt, Mycobacterium tuberculosis H37Rv
cgcucgaacuccccg

SEQ ID NO: 1336286 - RNA, 17 nt, Mycobacterium tuberculosis H37Rv
cgcucgaaagagccgcu

SEQ ID NO: 1336287 - RNA, 19 nt, Mycobacterium tuberculosis H37Rv
cgcuccaugacaaaccugc

SEQ ID NO: 1336288 - RNA, 20 nt, Mycobacterium tuberculosis H37Rv
cgcucccccgcuacgcgcgc

SEQ ID NO: 1336289 - RNA, 17 nt, Mycobacterium tuberculosis H37Rv
cgcuccgcggcgcagca

SEQ ID NO: 1336290 - RNA, 15 nt, Mycobacterium tuberculosis H37Rv
cgcuccgcgccgccc

SEQ ID NO: 1336291 - RNA, 21 nt, Mycobacterium tuberculosis H37Rv
cgcuccgccgucgccgccggc

SEQ ID NO: 1336292 - RNA, 17 nt, Mycobacterium tuberculosis H37Rv
cgcucccucuacacccg

SEQ ID NO: 1336293 - RNA, 21 nt, Mycobacterium tuberculosis H37Rv
cgcuccggcccugccgccggc

SEQ ID NO: 1336294 - RNA, 23 nt, Mycobacterium tuberculosis H37Rv
cgcuccggcccugccgccggccc

SEQ ID NO: 1336295 - RNA, 12 nt, Mycobacterium tuberculosis H37Rv
cgcuccuccggc

SEQ ID NO: 1336296 - RNA, 23 nt, Mycobacterium tuberculosis H37Rv
cgcuccgggaauggcgaccaccc

SEQ ID NO: 1336297 - RNA, 19 nt, Mycobacterium tuberculosis H37Rv
cgcucagccguccgggcgg

SEQ ID NO: 1336298 - RNA, 15 nt, Mycobacterium tuberculosis H37Rv
cgcucagggugcgcc

SEQ ID NO: 1336299 - RNA, 14 nt, Mycobacterium tuberculosis H37Rv
cgcucacgaagacc

SEQ ID NO: 1336300 - RNA, 23 nt, Mycobacterium tuberculosis H37Rv
cgcucacccggucgcacuuggcc

SEQ ID NO: 1336301 - RNA, 18 nt, Mycobacterium tuberculosis H37Rv
cgcucaccgacgcugacc

SEQ ID NO: 1336302 - RNA, 15 nt, Mycobacterium tuberculosis H37Rv
cgcucaccccgcgcu

SEQ ID NO: 1336303 - RNA, 14 nt, Mycobacterium tuberculosis H37Rv
cgcucacccgccgc

SEQ ID NO: 1336304 - RNA, 19 nt, Mycobacterium tuberculosis H37Rv
cgcuauggcccgggccgaa

SEQ ID NO: 1336305 - RNA, 18 nt, Mycobacterium tuberculosis H37Rv
cgcuauggcggcuucgac

SEQ ID NO: 1336306 - RNA, 15 nt, Mycobacterium tuberculosis H37Rv
cgcuauccggcggcc

SEQ ID NO: 1336307 - RNA, 21 nt, Mycobacterium tuberculosis H37Rv
cgcuacgcaacgggucggguc

SEQ ID NO: 1336308 - RNA, 13 nt, Mycobacterium tuberculosis H37Rv
cgcuacgcggccg

SEQ ID NO: 1336309 - RNA, 17 nt, Mycobacterium tuberculosis H37Rv
cgcuacgucgaccgacg

SEQ ID NO: 1336310 - RNA, 18 nt, Mycobacterium tuberculosis H37Rv
cgcuaccuucuuggcugc

SEQ ID NO: 1336311 - RNA, 14 nt, Mycobacterium tuberculosis H37Rv
cgcuacgcgcgcuc

SEQ ID NO: 1336312 - RNA, 24 nt, Mycobacterium tuberculosis H37Rv
cgcuaggacggcugccgucagccg

SEQ ID NO: 1336313 - RNA, 15 nt, Mycobacterium tuberculosis H37Rv
cgcuagcgccgcgcu

SEQ ID NO: 1336314 - RNA, 14 nt, Mycobacterium tuberculosis H37Rv
cgcuaggucaggug

SEQ ID NO: 1336315 - RNA, 20 nt, Mycobacterium tuberculosis H37Rv
cgcuaggugacgccgccagc

SEQ ID NO: 1336316 - RNA, 18 nt, Mycobacterium tuberculosis H37Rv
cgcuagccgggcgcgccg

SEQ ID NO: 1336317 - RNA, 19 nt, Mycobacterium tuberculosis H37Rv
cgcuagccggcucaucgca

SEQ ID NO: 1336318 - RNA, 23 nt, Mycobacterium tuberculosis H37Rv
cgcuagccggcucaucgcagccg

SEQ ID NO: 1336319 - RNA, 14 nt, Mycobacterium tuberculosis H37Rv
cgcuagccgacagc

SEQ ID NO: 1336320 - RNA, 20 nt, Mycobacterium tuberculosis H37Rv
cgcgggcgaccaccgcggca

SEQ ID NO: 1336321 - RNA, 17 nt, Mycobacterium tuberculosis H37Rv
cgcgggccaccaccgag

SEQ ID NO: 1336322 - RNA, 22 nt, Mycobacterium tuberculosis H37Rv
cgcgggccaccacgcgccgcac

SEQ ID NO: 1336323 - RNA, 13 nt, Mycobacterium tuberculosis H37Rv
cgcgucaucaccg

SEQ ID NO: 1336324 - RNA, 11 nt, Mycobacterium tuberculosis H37Rv
cgcgucaucaa

SEQ ID NO: 1336325 - RNA, 16 nt, Mycobacterium tuberculosis H37Rv
cgcgucagcggcgagc

SEQ ID NO: 1336326 - RNA, 12 nt, Mycobacterium tuberculosis H37Rv
cgcgucggaccg

SEQ ID NO: 1336327 - RNA, 15 nt, Mycobacterium tuberculosis H37Rv
cgcgucgcgcgcggc

SEQ ID NO: 1336328 - RNA, 23 nt, Mycobacterium tuberculosis H37Rv
cgcgucgcgcgccuuggccagcg

SEQ ID NO: 1336329 - RNA, 13 nt, Mycobacterium tuberculosis H37Rv
cgcgucgcgcgcc

SEQ ID NO: 1336330 - RNA, 14 nt, Mycobacterium tuberculosis H37Rv
cgcgucgccggccu

SEQ ID NO: 1336331 - RNA, 21 nt, Mycobacterium tuberculosis H37Rv
cgcgucgcgaaaggccacgau

SEQ ID NO: 1336332 - RNA, 20 nt, Mycobacterium tuberculosis H37Rv
cgcgucgagcgacccccagc

SEQ ID NO: 1336333 - RNA, 20 nt, Mycobacterium tuberculosis H37Rv
cgcgucgagugccgccaccg

SEQ ID NO: 1336334 - RNA, 14 nt, Mycobacterium tuberculosis H37Rv
cgcgucccgccgca

SEQ ID NO: 1336335 - RNA, 20 nt, Mycobacterium tuberculosis H37Rv
cgcguccccagcgccaccgu

SEQ ID NO: 1336336 - RNA, 22 nt, Mycobacterium tuberculosis H37Rv
cgcgucgagcagcaccacccgc

SEQ ID NO: 1336337 - RNA, 16 nt, Mycobacterium tuberculosis H37Rv
cgcgucgacgagcggc

SEQ ID NO: 1336338 - RNA, 16 nt, Mycobacterium tuberculosis H37Rv
cgcguccaggugcgcc

SEQ ID NO: 1336339 - RNA, 16 nt, Mycobacterium tuberculosis H37Rv
cgcguccagcgcggcc

SEQ ID NO: 1336340 - RNA, 14 nt, Mycobacterium tuberculosis H37Rv
cgcgugccagcgcc

SEQ ID NO: 1336341 - RNA, 13 nt, Mycobacterium tuberculosis H37Rv
cgcgugccacagc

SEQ ID NO: 1336342 - RNA, 14 nt, Mycobacterium tuberculosis H37Rv
cgcgugccacagca

SEQ ID NO: 1336343 - RNA, 17 nt, Mycobacterium tuberculosis H37Rv
cgcgucgcgcgcggcau

SEQ ID NO: 1336344 - RNA, 22 nt, Mycobacterium tuberculosis H37Rv
cgcgugcugccguauccaggcg

SEQ ID NO: 1336345 - RNA, 14 nt, Mycobacterium tuberculosis H37Rv
cgcgugcugcggac

SEQ ID NO: 1336346 - RNA, 17 nt, Mycobacterium tuberculosis H37Rv
cgcgugcucgagcaccu

SEQ ID NO: 1336347 - RNA, 17 nt, Mycobacterium tuberculosis H37Rv
cgcguggcauccagcag

SEQ ID NO: 1336348 - RNA, 20 nt, Mycobacterium tuberculosis H37Rv
cgcguggcauccagcagcgc

SEQ ID NO: 1336349 - RNA, 20 nt, Mycobacterium tuberculosis H37Rv
cgcguggaacuugcgcaggu

SEQ ID NO: 1336350 - RNA, 20 nt, Mycobacterium tuberculosis H37Rv
cgcguuguccgcggccaacg

SEQ ID NO: 1336351 - RNA, 16 nt, Mycobacterium tuberculosis H37Rv
cgcguuguaggcuucc

SEQ ID NO: 1336352 - RNA, 19 nt, Mycobacterium tuberculosis H37Rv
cgcguugcagaccaccagu

SEQ ID NO: 1336353 - RNA, 13 nt, Mycobacterium tuberculosis H37Rv
cgcuaccgccgga

SEQ ID NO: 1336354 - RNA, 13 nt, Mycobacterium tuberculosis H37Rv
cgcuaccgcccgc

SEQ ID NO: 1336355 - RNA, 23 nt, Mycobacterium tuberculosis H37Rv
cgcuaccuguguugagcggcagc

SEQ ID NO: 1336356 - RNA, 15 nt, Mycobacterium tuberculosis H37Rv
cgcuaccuucuuggc

SEQ ID NO: 1336357 - RNA, 16 nt, Mycobacterium tuberculosis H37Rv
cgcuaccuucuuggcu

SEQ ID NO: 1336358 - RNA, 20 nt, Mycobacterium tuberculosis H37Rv
cgcuaccgcccgcgccaccg

SEQ ID NO: 1336359 - RNA, 21 nt, Mycobacterium tuberculosis H37Rv
cgcguuuauaccucgccgccc

SEQ ID NO: 1336360 - RNA, 22 nt, Mycobacterium tuberculosis H37Rv
cgcguuucacgaaacccagucg

SEQ ID NO: 1336361 - RNA, 22 nt, Mycobacterium tuberculosis H37Rv
cgcugccgaagcggccaccgcc

SEQ ID NO: 1336362 - RNA, 15 nt, Mycobacterium tuberculosis H37Rv
cgcugcccgggcugc

SEQ ID NO: 1336363 - RNA, 12 nt, Mycobacterium tuberculosis H37Rv
cgcugcccgcgg

SEQ ID NO: 1336364 - RNA, 22 nt, Mycobacterium tuberculosis H37Rv
cgcugccgcccuugccgcccgc

SEQ ID NO: 1336365 - RNA, 14 nt, Mycobacterium tuberculosis H37Rv
cgcugccgccgccg

SEQ ID NO: 1336366 - RNA, 15 nt, Mycobacterium tuberculosis H37Rv
cgcugccgccgagcu

SEQ ID NO: 1336367 - RNA, 15 nt, Mycobacterium tuberculosis H37Rv
cgcugccgccgccgg

SEQ ID NO: 1336368 - RNA, 16 nt, Mycobacterium tuberculosis H37Rv
cgcugccgccgccggc

SEQ ID NO: 1336369 - RNA, 14 nt, Mycobacterium tuberculosis H37Rv
cgcugccggccgcg

SEQ ID NO: 1336370 - RNA, 14 nt, Mycobacterium tuberculosis H37Rv
cgcugccgcgcggc

SEQ ID NO: 1336371 - RNA, 18 nt, Mycobacterium tuberculosis H37Rv
cgcugccggcgccgccac

SEQ ID NO: 1336372 - RNA, 15 nt, Mycobacterium tuberculosis H37Rv
cgcugccggcgccgc

SEQ ID NO: 1336373 - RNA, 17 nt, Mycobacterium tuberculosis H37Rv
cgcugcggcaccacccg

SEQ ID NO: 1336374 - RNA, 21 nt, Mycobacterium tuberculosis H37Rv
cgcugcggcaccacccggcga

SEQ ID NO: 1336375 - RNA, 14 nt, Mycobacterium tuberculosis H37Rv
cgcugccuucuuug

SEQ ID NO: 1336376 - RNA, 18 nt, Mycobacterium tuberculosis H37Rv
cgcugccuggccgggacc

SEQ ID NO: 1336377 - RNA, 17 nt, Mycobacterium tuberculosis H37Rv
cgcugcgaucacccccu

SEQ ID NO: 1336378 - RNA, 22 nt, Mycobacterium tuberculosis H37Rv
cgcugcgaucacccccuggacu

SEQ ID NO: 1336379 - RNA, 14 nt, Mycobacterium tuberculosis H37Rv
cgcugcuugcgggc

SEQ ID NO: 1336380 - RNA, 22 nt, Mycobacterium tuberculosis H37Rv
cgcugcuugaggucccgugcgc

SEQ ID NO: 1336381 - RNA, 22 nt, Mycobacterium tuberculosis H37Rv
cgcuggaaaccucuucgggugc

SEQ ID NO: 1336382 - RNA, 18 nt, Mycobacterium tuberculosis H37Rv
cgcuggacggcgggccgc

SEQ ID NO: 1336383 - RNA, 20 nt, Mycobacterium tuberculosis H37Rv
cgcuggcaggccgggcacca

SEQ ID NO: 1336384 - RNA, 11 nt, Mycobacterium tuberculosis H37Rv
cgcuggccacg

SEQ ID NO: 1336385 - RNA, 13 nt, Mycobacterium tuberculosis H37Rv
cgcuggccacgau

SEQ ID NO: 1336386 - RNA, 19 nt, Mycobacterium tuberculosis H37Rv
cgcuggcaaguucggccga

SEQ ID NO: 1336387 - RNA, 16 nt, Mycobacterium tuberculosis H37Rv
cgcugcggugggccag

SEQ ID NO: 1336388 - RNA, 18 nt, Mycobacterium tuberculosis H37Rv
cgcugcggugccggcccu

SEQ ID NO: 1336389 - RNA, 16 nt, Mycobacterium tuberculosis H37Rv
cgcugcggugccggcc

SEQ ID NO: 1336390 - RNA, 17 nt, Mycobacterium tuberculosis H37Rv
cgcugcggugccggccc

SEQ ID NO: 1336391 - RNA, 15 nt, Mycobacterium tuberculosis H37Rv
cgcugcgggucccaa

SEQ ID NO: 1336392 - RNA, 19 nt, Mycobacterium tuberculosis H37Rv
cgcugcggcccacaccagc

SEQ ID NO: 1336393 - RNA, 17 nt, Mycobacterium tuberculosis H37Rv
cgcugcuccgcgccgcu

SEQ ID NO: 1336394 - RNA, 13 nt, Mycobacterium tuberculosis H37Rv
cgcugcugccauu

SEQ ID NO: 1336395 - RNA, 15 nt, Mycobacterium tuberculosis H37Rv
cgcugcccaaaagcg

SEQ ID NO: 1336396 - RNA, 14 nt, Mycobacterium tuberculosis H37Rv
cgcugcccaugcgg

SEQ ID NO: 1336397 - RNA, 17 nt, Mycobacterium tuberculosis H37Rv
cgcugcccacgggccgg

SEQ ID NO: 1336398 - RNA, 14 nt, Mycobacterium tuberculosis H37Rv
cgcugccaguucuu

SEQ ID NO: 1336399 - RNA, 15 nt, Mycobacterium tuberculosis H37Rv
cgcugcccgcgcggc

SEQ ID NO: 1336400 - RNA, 16 nt, Mycobacterium tuberculosis H37Rv
cgcugcccgcgcggcc

SEQ ID NO: 1336401 - RNA, 14 nt, Mycobacterium tuberculosis H37Rv
cgcugcccgcgcgg

SEQ ID NO: 1336402 - RNA, 13 nt, Mycobacterium tuberculosis H37Rv
cgcugcccgccgc

SEQ ID NO: 1336403 - RNA, 14 nt, Mycobacterium tuberculosis H37Rv
cgcugcauccgcag

SEQ ID NO: 1336404 - RNA, 13 nt, Mycobacterium tuberculosis H37Rv
cgcugccagccgu

SEQ ID NO: 1336405 - RNA, 17 nt, Mycobacterium tuberculosis H37Rv
cgcugccagccguuccc

SEQ ID NO: 1336406 - RNA, 13 nt, Mycobacterium tuberculosis H37Rv
cgcugccacccau

SEQ ID NO: 1336407 - RNA, 16 nt, Mycobacterium tuberculosis H37Rv
cgcugcacaacguggu

SEQ ID NO: 1336408 - RNA, 14 nt, Mycobacterium tuberculosis H37Rv
cgcugcaccagcug

SEQ ID NO: 1336409 - RNA, 21 nt, Mycobacterium tuberculosis H37Rv
cgcugcaggcggccgagcugg

SEQ ID NO: 1336410 - RNA, 16 nt, Mycobacterium tuberculosis H37Rv
cgcugauggugcugcg

SEQ ID NO: 1336411 - RNA, 20 nt, Mycobacterium tuberculosis H37Rv
cgcugauggugcugcggcgu

SEQ ID NO: 1336412 - RNA, 15 nt, Mycobacterium tuberculosis H37Rv
cgcugcaaccgccgg

SEQ ID NO: 1336413 - RNA, 20 nt, Mycobacterium tuberculosis H37Rv
cgcugauagcggucggucac

SEQ ID NO: 1336414 - RNA, 18 nt, Mycobacterium tuberculosis H37Rv
cgcugaucagauccucga

SEQ ID NO: 1336415 - RNA, 17 nt, Mycobacterium tuberculosis H37Rv
cgcugaucugccgccgc

SEQ ID NO: 1336416 - RNA, 20 nt, Mycobacterium tuberculosis H37Rv
cgcugaugagccgcagaugc

SEQ ID NO: 1336417 - RNA, 18 nt, Mycobacterium tuberculosis H37Rv
cgcugaggaacccuccgg

SEQ ID NO: 1336418 - RNA, 19 nt, Mycobacterium tuberculosis H37Rv
cgcugaggaacccuccgga

SEQ ID NO: 1336419 - RNA, 17 nt, Mycobacterium tuberculosis H37Rv
cgcugagcagcgccgcg

SEQ ID NO: 1336420 - RNA, 18 nt, Mycobacterium tuberculosis H37Rv
cgcugagcagcgccgcgu

SEQ ID NO: 1336421 - RNA, 18 nt, Mycobacterium tuberculosis H37Rv
cgcugaggaagcggcggc

SEQ ID NO: 1336422 - RNA, 19 nt, Mycobacterium tuberculosis H37Rv
cgcugaggaagcggcggca

SEQ ID NO: 1336423 - RNA, 12 nt, Mycobacterium tuberculosis H37Rv
cgcugagcucga

SEQ ID NO: 1336424 - RNA, 21 nt, Mycobacterium tuberculosis H37Rv
cgcugagguaauucgcggccc

SEQ ID NO: 1336425 - RNA, 15 nt, Mycobacterium tuberculosis H37Rv
cgcugacggccaugg

SEQ ID NO: 1336426 - RNA, 14 nt, Mycobacterium tuberculosis H37Rv
cgcugacuccugcg

SEQ ID NO: 1336427 - RNA, 14 nt, Mycobacterium tuberculosis H37Rv
cgcugagcagcgcc

SEQ ID NO: 1336428 - RNA, 16 nt, Mycobacterium tuberculosis H37Rv
cgcugagcagcgccgc

SEQ ID NO: 1336429 - RNA, 13 nt, Mycobacterium tuberculosis H37Rv
cgcugagcacggc

SEQ ID NO: 1336430 - RNA, 15 nt, Mycobacterium tuberculosis H37Rv
cgcugagccccccga

SEQ ID NO: 1336431 - RNA, 19 nt, Mycobacterium tuberculosis H37Rv
cgcugagccccccgagccc

SEQ ID NO: 1336432 - RNA, 23 nt, Mycobacterium tuberculosis H37Rv
cgcugagccccccgagcccgcca

SEQ ID NO: 1336433 - RNA, 22 nt, Mycobacterium tuberculosis H37Rv
cgcugacgcccuccuggcgggu

SEQ ID NO: 1336434 - RNA, 14 nt, Mycobacterium tuberculosis H37Rv
cgcugacgcccucc

SEQ ID NO: 1336435 - RNA, 22 nt, Mycobacterium tuberculosis H37Rv
cgcugaccuuguugaccaccac

SEQ ID NO: 1336436 - RNA, 16 nt, Mycobacterium tuberculosis H37Rv
cgcugggacgggcgcg

SEQ ID NO: 1336437 - RNA, 16 nt, Mycobacterium tuberculosis H37Rv
cgcugggcacucggcc

SEQ ID NO: 1336438 - RNA, 21 nt, Mycobacterium tuberculosis H37Rv
cgcuggguccccucccaccag

SEQ ID NO: 1336439 - RNA, 13 nt, Mycobacterium tuberculosis H37Rv
cgcuggcgccgcc

SEQ ID NO: 1336440 - RNA, 21 nt, Mycobacterium tuberculosis H37Rv
cgcuggcuacccaccggccgg

SEQ ID NO: 1336441 - RNA, 23 nt, Mycobacterium tuberculosis H37Rv
cgcuggcuacgccuccuucguga

SEQ ID NO: 1336442 - RNA, 14 nt, Mycobacterium tuberculosis H37Rv
cgcuggcucaucga

SEQ ID NO: 1336443 - RNA, 19 nt, Mycobacterium tuberculosis H37Rv
cgcuggcuacccaccggcc

SEQ ID NO: 1336444 - RNA, 12 nt, Mycobacterium tuberculosis H37Rv
cgcuggccagca

SEQ ID NO: 1336445 - RNA, 15 nt, Mycobacterium tuberculosis H37Rv
cgcuggcccgccaga

SEQ ID NO: 1336446 - RNA, 14 nt, Mycobacterium tuberculosis H37Rv
cgcuggccuccagc

SEQ ID NO: 1336447 - RNA, 17 nt, Mycobacterium tuberculosis H37Rv
cgcuggccuccuggaag

SEQ ID NO: 1336448 - RNA, 13 nt, Mycobacterium tuberculosis H37Rv
cgcuggccuccug

SEQ ID NO: 1336449 - RNA, 20 nt, Mycobacterium tuberculosis H37Rv
cgcuggccgucgaagacgaa

SEQ ID NO: 1336450 - RNA, 22 nt, Mycobacterium tuberculosis H37Rv
cgcuggcgcccuugccggcgag

SEQ ID NO: 1336451 - RNA, 17 nt, Mycobacterium tuberculosis H37Rv
cgcugugauagcgccgu

SEQ ID NO: 1336452 - RNA, 15 nt, Mycobacterium tuberculosis H37Rv
cgcugucccagcccg

SEQ ID NO: 1336453 - RNA, 21 nt, Mycobacterium tuberculosis H37Rv
cgcuguccgcgugaaucccca

SEQ ID NO: 1336454 - RNA, 15 nt, Mycobacterium tuberculosis H37Rv
cgcuguaggccagcc

SEQ ID NO: 1336455 - RNA, 13 nt, Mycobacterium tuberculosis H37Rv
cgcugguggcggc

SEQ ID NO: 1336456 - RNA, 18 nt, Mycobacterium tuberculosis H37Rv
cgcugguggucagcaccc

SEQ ID NO: 1336457 - RNA, 17 nt, Mycobacterium tuberculosis H37Rv
cgcuggucagccgugcc

SEQ ID NO: 1336458 - RNA, 14 nt, Mycobacterium tuberculosis H37Rv
cgcuggucgagcag

SEQ ID NO: 1336459 - RNA, 18 nt, Mycobacterium tuberculosis H37Rv
cgcuggucgagcagugcc

SEQ ID NO: 1336460 - RNA, 15 nt, Mycobacterium tuberculosis H37Rv
cgcuggguggcgggc

SEQ ID NO: 1336461 - RNA, 19 nt, Mycobacterium tuberculosis H37Rv
cgcuggucggagaccagcg

SEQ ID NO: 1336462 - RNA, 16 nt, Mycobacterium tuberculosis H37Rv
cgcuggucggcggcuu

SEQ ID NO: 1336463 - RNA, 14 nt, Mycobacterium tuberculosis H37Rv
cgcuguuccucgag

SEQ ID NO: 1336464 - RNA, 15 nt, Mycobacterium tuberculosis H37Rv
cgcuguugaagccgc

SEQ ID NO: 1336465 - RNA, 21 nt, Mycobacterium tuberculosis H37Rv
cgcuugaccccuggccgccgg

SEQ ID NO: 1336466 - RNA, 18 nt, Mycobacterium tuberculosis H37Rv
cgcuugaccccuggccgc

SEQ ID NO: 1336467 - RNA, 17 nt, Mycobacterium tuberculosis H37Rv
cgcuugaccccuggccg

SEQ ID NO: 1336468 - RNA, 16 nt, Mycobacterium tuberculosis H37Rv
cgcuucuuccgcgcgc

SEQ ID NO: 1336469 - RNA, 21 nt, Mycobacterium tuberculosis H37Rv
cgcuucggcagcucccgccac

SEQ ID NO: 1336470 - RNA, 22 nt, Mycobacterium tuberculosis H37Rv
cgcuucggcaccgacugcuguc

SEQ ID NO: 1336471 - RNA, 15 nt, Mycobacterium tuberculosis H37Rv
cgcuuccguggccca

SEQ ID NO: 1336472 - RNA, 21 nt, Mycobacterium tuberculosis H37Rv
cgcuucaggcgccacugcuuc

SEQ ID NO: 1336473 - RNA, 15 nt, Mycobacterium tuberculosis H37Rv
cgcgacaccccggaa

SEQ ID NO: 1336474 - RNA, 14 nt, Mycobacterium tuberculosis H37Rv
cgcgacauccgcgg

SEQ ID NO: 1336475 - RNA, 20 nt, Mycobacterium tuberculosis H37Rv
cgcgaccagaaucgggccga

SEQ ID NO: 1336476 - RNA, 18 nt, Mycobacterium tuberculosis H37Rv
cgcgaccacgcaccgccc

SEQ ID NO: 1336477 - RNA, 12 nt, Mycobacterium tuberculosis H37Rv
cgcgaccaccgc

SEQ ID NO: 1336478 - RNA, 18 nt, Mycobacterium tuberculosis H37Rv
cgcgacacacgccgccgg

SEQ ID NO: 1336479 - RNA, 21 nt, Mycobacterium tuberculosis H37Rv
cgcgacagacagcaccgccgg

SEQ ID NO: 1336480 - RNA, 14 nt, Mycobacterium tuberculosis H37Rv
cgcgacacggccau

SEQ ID NO: 1336481 - RNA, 17 nt, Mycobacterium tuberculosis H37Rv
cgcgacagacagcaccg

SEQ ID NO: 1336482 - RNA, 16 nt, Mycobacterium tuberculosis H37Rv
cgcgacuagacgccgc

SEQ ID NO: 1336483 - RNA, 13 nt, Mycobacterium tuberculosis H37Rv
cgcgagcgagcca

SEQ ID NO: 1336484 - RNA, 19 nt, Mycobacterium tuberculosis H37Rv
cgcgacguccaccagccgg

SEQ ID NO: 1336485 - RNA, 19 nt, Mycobacterium tuberculosis H37Rv
cgcgacgucugccaggcgc

SEQ ID NO: 1336486 - RNA, 22 nt, Mycobacterium tuberculosis H37Rv
cgcgacgucugccaggcgcagc

SEQ ID NO: 1336487 - RNA, 18 nt, Mycobacterium tuberculosis H37Rv
cgcgacguacgaguagug

SEQ ID NO: 1336488 - RNA, 19 nt, Mycobacterium tuberculosis H37Rv
cgcgaccauacccgcgcgc

SEQ ID NO: 1336489 - RNA, 13 nt, Mycobacterium tuberculosis H37Rv
cgccuucgccagc

SEQ ID NO: 1336490 - RNA, 16 nt, Mycobacterium tuberculosis H37Rv
cgcgaacaucgccagc

SEQ ID NO: 1336491 - RNA, 13 nt, Mycobacterium tuberculosis H37Rv
cgccuuccaggcg

SEQ ID NO: 1336492 - RNA, 18 nt, Mycobacterium tuberculosis H37Rv
cgcgaagaacgacgccac

SEQ ID NO: 1336493 - RNA, 14 nt, Mycobacterium tuberculosis H37Rv
cgcgaacuccagca

SEQ ID NO: 1336494 - RNA, 18 nt, Mycobacterium tuberculosis H37Rv
cgcgaaaucaccgcugag

SEQ ID NO: 1336495 - RNA, 18 nt, Mycobacterium tuberculosis H37Rv
cgcgaacccgaucgucga

SEQ ID NO: 1336496 - RNA, 16 nt, Mycobacterium tuberculosis H37Rv
cgcgaaccggccaucg

SEQ ID NO: 1336497 - RNA, 21 nt, Mycobacterium tuberculosis H37Rv
cgcgaaccgucucggcgaccg

SEQ ID NO: 1336498 - RNA, 14 nt, Mycobacterium tuberculosis H37Rv
cgcgaacgcggcca

SEQ ID NO: 1336499 - RNA, 15 nt, Mycobacterium tuberculosis H37Rv
cgccuggcggcgccg

SEQ ID NO: 1336500 - RNA, 15 nt, Mycobacterium tuberculosis H37Rv
cgccugggcgacgac

SEQ ID NO: 1336501 - RNA, 23 nt, Mycobacterium tuberculosis H37Rv
cgccugggugagguuggagcgcc

SEQ ID NO: 1336502 - RNA, 18 nt, Mycobacterium tuberculosis H37Rv
cgccuggacgccgccgga

SEQ ID NO: 1336503 - RNA, 16 nt, Mycobacterium tuberculosis H37Rv
cgccugcgccgcccgc

SEQ ID NO: 1336504 - RNA, 14 nt, Mycobacterium tuberculosis H37Rv
cgccugcgccgccc

SEQ ID NO: 1336505 - RNA, 18 nt, Mycobacterium tuberculosis H37Rv
cgccugccucaccgccgc

SEQ ID NO: 1336506 - RNA, 19 nt, Mycobacterium tuberculosis H37Rv
cgccugccaucacgcgcuc

SEQ ID NO: 1336507 - RNA, 13 nt, Mycobacterium tuberculosis H37Rv
cgccugcccggcc

SEQ ID NO: 1336508 - RNA, 16 nt, Mycobacterium tuberculosis H37Rv
cgccugcccggcccgc

SEQ ID NO: 1336509 - RNA, 18 nt, Mycobacterium tuberculosis H37Rv
cgccugccccacccgcgg

SEQ ID NO: 1336510 - RNA, 18 nt, Mycobacterium tuberculosis H37Rv
cgccugaugcggccggcg

SEQ ID NO: 1336511 - RNA, 15 nt, Mycobacterium tuberculosis H37Rv
cgccugcaccgccgc

SEQ ID NO: 1336512 - RNA, 20 nt, Mycobacterium tuberculosis H37Rv
cgccugagcggccucgggac

SEQ ID NO: 1336513 - RNA, 14 nt, Mycobacterium tuberculosis H37Rv
cgccugagccacca

SEQ ID NO: 1336514 - RNA, 13 nt, Mycobacterium tuberculosis H37Rv
cgccugagcgccg

SEQ ID NO: 1336515 - RNA, 17 nt, Mycobacterium tuberculosis H37Rv
cgccugaccgccaccgu

SEQ ID NO: 1336516 - RNA, 17 nt, Mycobacterium tuberculosis H37Rv
cgccugaggugcugcca

SEQ ID NO: 1336517 - RNA, 14 nt, Mycobacterium tuberculosis H37Rv
cgccucuuccuggc

SEQ ID NO: 1336518 - RNA, 16 nt, Mycobacterium tuberculosis H37Rv
cgccugaacgacccgc

SEQ ID NO: 1336519 - RNA, 14 nt, Mycobacterium tuberculosis H37Rv
cgccucugucuuca

SEQ ID NO: 1336520 - RNA, 14 nt, Mycobacterium tuberculosis H37Rv
cgccucgggcaccu

SEQ ID NO: 1336521 - RNA, 22 nt, Mycobacterium tuberculosis H37Rv
cgccucggugacgucgccgggc

SEQ ID NO: 1336522 - RNA, 18 nt, Mycobacterium tuberculosis H37Rv
cgccucgguaaagccgcg

SEQ ID NO: 1336523 - RNA, 20 nt, Mycobacterium tuberculosis H37Rv
cgccucggcaucgccgcggg

SEQ ID NO: 1336524 - RNA, 17 nt, Mycobacterium tuberculosis H37Rv
cgccucggcggccagcu

SEQ ID NO: 1336525 - RNA, 19 nt, Mycobacterium tuberculosis H37Rv
cgccucggacacggcagcc

SEQ ID NO: 1336526 - RNA, 18 nt, Mycobacterium tuberculosis H37Rv
cgccucggaccagaccca

SEQ ID NO: 1336527 - RNA, 16 nt, Mycobacterium tuberculosis H37Rv
cgccucgccggccacc

SEQ ID NO: 1336528 - RNA, 22 nt, Mycobacterium tuberculosis H37Rv
cgccucgagguauucgcgcagc

SEQ ID NO: 1336529 - RNA, 23 nt, Mycobacterium tuberculosis H37Rv
cgccucgccggccacccgcgcga

SEQ ID NO: 1336530 - RNA, 15 nt, Mycobacterium tuberculosis H37Rv
cgccucgccggccgc

SEQ ID NO: 1336531 - RNA, 16 nt, Mycobacterium tuberculosis H37Rv
cgccucgccggccgcc

SEQ ID NO: 1336532 - RNA, 13 nt, Mycobacterium tuberculosis H37Rv
cgccucgccggcc

SEQ ID NO: 1336533 - RNA, 14 nt, Mycobacterium tuberculosis H37Rv
cgccucgccggcca

SEQ ID NO: 1336534 - RNA, 17 nt, Mycobacterium tuberculosis H37Rv
cgccucgcccagcaagg

SEQ ID NO: 1336535 - RNA, 19 nt, Mycobacterium tuberculosis H37Rv
cgccucgacacccagccgc

SEQ ID NO: 1336536 - RNA, 23 nt, Mycobacterium tuberculosis H37Rv
cgccucgacacccagccgcagcc

SEQ ID NO: 1336537 - RNA, 16 nt, Mycobacterium tuberculosis H37Rv
cgccuccguugccccc

SEQ ID NO: 1336538 - RNA, 17 nt, Mycobacterium tuberculosis H37Rv
cgccuccugccgccgcu

SEQ ID NO: 1336539 - RNA, 20 nt, Mycobacterium tuberculosis H37Rv
cgccuccugcggguagaugu

SEQ ID NO: 1336540 - RNA, 15 nt, Mycobacterium tuberculosis H37Rv
cgccuccucgugcag

SEQ ID NO: 1336541 - RNA, 16 nt, Mycobacterium tuberculosis H37Rv
cgccuccagcaccacg

SEQ ID NO: 1336542 - RNA, 22 nt, Mycobacterium tuberculosis H37Rv
cgccuccagcaccacggcgcgc

SEQ ID NO: 1336543 - RNA, 15 nt, Mycobacterium tuberculosis H37Rv
cgccuccaggcgcca

SEQ ID NO: 1336544 - RNA, 13 nt, Mycobacterium tuberculosis H37Rv
cgccuccgcggca

SEQ ID NO: 1336545 - RNA, 21 nt, Mycobacterium tuberculosis H37Rv
cgccucaaugaccaccgggcg

SEQ ID NO: 1336546 - RNA, 16 nt, Mycobacterium tuberculosis H37Rv
cgccucaccggcgcga

SEQ ID NO: 1336547 - RNA, 18 nt, Mycobacterium tuberculosis H37Rv
cgccucaggggcgccuua

SEQ ID NO: 1336548 - RNA, 15 nt, Mycobacterium tuberculosis H37Rv
cgccguuugcgccgu

SEQ ID NO: 1336549 - RNA, 15 nt, Mycobacterium tuberculosis H37Rv
cgccguuguuguaga

SEQ ID NO: 1336550 - RNA, 15 nt, Mycobacterium tuberculosis H37Rv
cgccguugccgccga

SEQ ID NO: 1336551 - RNA, 23 nt, Mycobacterium tuberculosis H37Rv
cgccuaaucggccugccggcagc

SEQ ID NO: 1336552 - RNA, 20 nt, Mycobacterium tuberculosis H37Rv
cgccuaggacuucggugagc

SEQ ID NO: 1336553 - RNA, 16 nt, Mycobacterium tuberculosis H37Rv
cgccguucccacccac

SEQ ID NO: 1336554 - RNA, 15 nt, Mycobacterium tuberculosis H37Rv
cgccguguuccaggu

SEQ ID NO: 1336555 - RNA, 20 nt, Mycobacterium tuberculosis H37Rv
cgccguggcccgcucccugc

SEQ ID NO: 1336556 - RNA, 16 nt, Mycobacterium tuberculosis H37Rv
cgccguugccgccggc

SEQ ID NO: 1336557 - RNA, 18 nt, Mycobacterium tuberculosis H37Rv
cgccguugccgccggcgc

SEQ ID NO: 1336558 - RNA, 13 nt, Mycobacterium tuberculosis H37Rv
cgccguugccgcc

SEQ ID NO: 1336559 - RNA, 15 nt, Mycobacterium tuberculosis H37Rv
cgccguugccgccuu

SEQ ID NO: 1336560 - RNA, 22 nt, Mycobacterium tuberculosis H37Rv
cgccguugccgaucagcccggc

SEQ ID NO: 1336561 - RNA, 22 nt, Mycobacterium tuberculosis H37Rv
cgccguugccauugccucccgc

SEQ ID NO: 1336562 - RNA, 18 nt, Mycobacterium tuberculosis H37Rv
cgccguugaacggcacca

SEQ ID NO: 1336563 - RNA, 23 nt, Mycobacterium tuberculosis H37Rv
cgccguugaacggcaccagcggg

SEQ ID NO: 1336564 - RNA, 15 nt, Mycobacterium tuberculosis H37Rv
cgccguucgggaugc

SEQ ID NO: 1336565 - RNA, 19 nt, Mycobacterium tuberculosis H37Rv
cgccguucgggaugcaagg

SEQ ID NO: 1336566 - RNA, 20 nt, Mycobacterium tuberculosis H37Rv
cgccguugccaccggugccg

SEQ ID NO: 1336567 - RNA, 15 nt, Mycobacterium tuberculosis H37Rv
cgccguccagcaaua

SEQ ID NO: 1336568 - RNA, 16 nt, Mycobacterium tuberculosis H37Rv
cgccgucaucgcagca

SEQ ID NO: 1336569 - RNA, 19 nt, Mycobacterium tuberculosis H37Rv
cgccgucaucgugcccgcg

SEQ ID NO: 1336570 - RNA, 17 nt, Mycobacterium tuberculosis H37Rv
cgccguccagcgccgcg

SEQ ID NO: 1336571 - RNA, 21 nt, Mycobacterium tuberculosis H37Rv
cgccguccagcgccgcggccc

SEQ ID NO: 1336572 - RNA, 23 nt, Mycobacterium tuberculosis H37Rv
cgccguccagcaauaccugagcg

SEQ ID NO: 1336573 - RNA, 14 nt, Mycobacterium tuberculosis H37Rv
cgccguccccgccg

SEQ ID NO: 1336574 - RNA, 15 nt, Mycobacterium tuberculosis H37Rv
cgccguccccgccgc

SEQ ID NO: 1336575 - RNA, 15 nt, Mycobacterium tuberculosis H37Rv
cgccguccggcgccc

SEQ ID NO: 1336576 - RNA, 20 nt, Mycobacterium tuberculosis H37Rv
cgccguggcaucgccuccag

SEQ ID NO: 1336577 - RNA, 14 nt, Mycobacterium tuberculosis H37Rv
cgccgugcuugcga

SEQ ID NO: 1336578 - RNA, 13 nt, Mycobacterium tuberculosis H37Rv
cgccgugcgccgu

SEQ ID NO: 1336579 - RNA, 23 nt, Mycobacterium tuberculosis H37Rv
cgccgugacccauucucggccgg

SEQ ID NO: 1336580 - RNA, 18 nt, Mycobacterium tuberculosis H37Rv
cgccgugaucagcucgcg

SEQ ID NO: 1336581 - RNA, 21 nt, Mycobacterium tuberculosis H37Rv
cgccgugaucagcucgcgcac

SEQ ID NO: 1336582 - RNA, 14 nt, Mycobacterium tuberculosis H37Rv
cgccgucaccgccg

SEQ ID NO: 1336583 - RNA, 15 nt, Mycobacterium tuberculosis H37Rv
cgccgucaccgccga

SEQ ID NO: 1336584 - RNA, 17 nt, Mycobacterium tuberculosis H37Rv
cgccgucaccgcgcggc

SEQ ID NO: 1336585 - RNA, 18 nt, Mycobacterium tuberculosis H37Rv
cgccgucaccgcgcggcu

SEQ ID NO: 1336586 - RNA, 19 nt, Mycobacterium tuberculosis H37Rv
cgccgucaccgcgcggcuc

SEQ ID NO: 1336587 - RNA, 16 nt, Mycobacterium tuberculosis H37Rv
cgccgucacggcagua

SEQ ID NO: 1336588 - RNA, 20 nt, Mycobacterium tuberculosis H37Rv
cgccgucagaacaccggcca

SEQ ID NO: 1336589 - RNA, 17 nt, Mycobacterium tuberculosis H37Rv
cgccgguuccgccggcc

SEQ ID NO: 1336590 - RNA, 22 nt, Mycobacterium tuberculosis H37Rv
cgccgguggcgccggggccgcc

SEQ ID NO: 1336591 - RNA, 18 nt, Mycobacterium tuberculosis H37Rv
cgccgguggcgccggggc

SEQ ID NO: 1336592 - RNA, 19 nt, Mycobacterium tuberculosis H37Rv
cgccgguggcagagccgcc

SEQ ID NO: 1336593 - RNA, 19 nt, Mycobacterium tuberculosis H37Rv
cgccgguggcacggccccu

SEQ ID NO: 1336594 - RNA, 23 nt, Mycobacterium tuberculosis H37Rv
cgccgguggucagguuggcacgc

SEQ ID NO: 1336595 - RNA, 15 nt, Mycobacterium tuberculosis H37Rv
cgccgguggugagga

SEQ ID NO: 1336596 - RNA, 18 nt, Mycobacterium tuberculosis H37Rv
cgccgguguaacccucga

SEQ ID NO: 1336597 - RNA, 15 nt, Mycobacterium tuberculosis H37Rv
cgccggugccggcca

SEQ ID NO: 1336598 - RNA, 13 nt, Mycobacterium tuberculosis H37Rv
cgccgguggcacg

SEQ ID NO: 1336599 - RNA, 13 nt, Mycobacterium tuberculosis H37Rv
cgccggugcgcug

SEQ ID NO: 1336600 - RNA, 21 nt, Mycobacterium tuberculosis H37Rv
cgccggugcgcgcugacccgc

SEQ ID NO: 1336601 - RNA, 22 nt, Mycobacterium tuberculosis H37Rv
cgccggugcgcgcugacccgcc

SEQ ID NO: 1336602 - RNA, 21 nt, Mycobacterium tuberculosis H37Rv
cgccgccgacgccgccggcgc

SEQ ID NO: 1336603 - RNA, 16 nt, Mycobacterium tuberculosis H37Rv
cgccgccgcgagcgcc

SEQ ID NO: 1336604 - RNA, 13 nt, Mycobacterium tuberculosis H37Rv
cgccgccgccggc

SEQ ID NO: 1336605 - RNA, 13 nt, Mycobacterium tuberculosis H37Rv
cgccgccgcgcgu

SEQ ID NO: 1336606 - RNA, 12 nt, Mycobacterium tuberculosis H37Rv
cgccgccgcggg

SEQ ID NO: 1336607 - RNA, 16 nt, Mycobacterium tuberculosis H37Rv
cgccgccgccaucgcc

SEQ ID NO: 1336608 - RNA, 20 nt, Mycobacterium tuberculosis H37Rv
cgccgggucagcccggcgcg

SEQ ID NO: 1336609 - RNA, 13 nt, Mycobacterium tuberculosis H37Rv
cgccggggggcug

SEQ ID NO: 1336610 - RNA, 15 nt, Mycobacterium tuberculosis H37Rv
cgccgggggcgccgc

SEQ ID NO: 1336611 - RNA, 12 nt, Mycobacterium tuberculosis H37Rv
cgccgccggcaa

SEQ ID NO: 1336612 - RNA, 17 nt, Mycobacterium tuberculosis H37Rv
cgccgccggaucgccgg

SEQ ID NO: 1336613 - RNA, 14 nt, Mycobacterium tuberculosis H37Rv
cgccggggccgccg

SEQ ID NO: 1336614 - RNA, 15 nt, Mycobacterium tuberculosis H37Rv
cgccggggccgccgu

SEQ ID NO: 1336615 - RNA, 16 nt, Mycobacterium tuberculosis H37Rv
cgccgccgcugccgcc

SEQ ID NO: 1336616 - RNA, 12 nt, Mycobacterium tuberculosis H37Rv
cgccgccgcguu

SEQ ID NO: 1336617 - RNA, 13 nt, Mycobacterium tuberculosis H37Rv
cgcgcucgcgcaa

SEQ ID NO: 1336618 - RNA, 13 nt, Mycobacterium tuberculosis H37Rv
cgcgcucagccgg

SEQ ID NO: 1336619 - RNA, 16 nt, Mycobacterium tuberculosis H37Rv
cgcgcuacgcggccga

SEQ ID NO: 1336620 - RNA, 14 nt, Mycobacterium tuberculosis H37Rv
cgcgcuacgcggcc

SEQ ID NO: 1336621 - RNA, 19 nt, Mycobacterium tuberculosis H37Rv
cgcgcguuuagucuccggc

SEQ ID NO: 1336622 - RNA, 16 nt, Mycobacterium tuberculosis H37Rv
cgcgcguggucgcccc

SEQ ID NO: 1336623 - RNA, 13 nt, Mycobacterium tuberculosis H37Rv
cgcgcgugcagcc

SEQ ID NO: 1336624 - RNA, 14 nt, Mycobacterium tuberculosis H37Rv
cgcgcgucgcccag

SEQ ID NO: 1336625 - RNA, 22 nt, Mycobacterium tuberculosis H37Rv
cgcgcguccgggcagccgcgcc

SEQ ID NO: 1336626 - RNA, 15 nt, Mycobacterium tuberculosis H37Rv
cgcgcguagcggggg

SEQ ID NO: 1336627 - RNA, 22 nt, Mycobacterium tuberculosis H37Rv
cgcgcgguuuucggcugccgcu

SEQ ID NO: 1336628 - RNA, 15 nt, Mycobacterium tuberculosis H37Rv
cgcgcgguacugcgc

SEQ ID NO: 1336629 - RNA, 19 nt, Mycobacterium tuberculosis H37Rv
cgcgcgggguggcggcgcu

SEQ ID NO: 1336630 - RNA, 16 nt, Mycobacterium tuberculosis H37Rv
cgcgcggggcggcugc

SEQ ID NO: 1336631 - RNA, 19 nt, Mycobacterium tuberculosis H37Rv
cgcgcgggaaguccgucgg

SEQ ID NO: 1336632 - RNA, 16 nt, Mycobacterium tuberculosis H37Rv
cgcgcggggccucgcg

SEQ ID NO: 1336633 - RNA, 19 nt, Mycobacterium tuberculosis H37Rv
cgcgcugcggcccacacca

SEQ ID NO: 1336634 - RNA, 15 nt, Mycobacterium tuberculosis H37Rv
cgcgcugggcgcgcu

SEQ ID NO: 1336635 - RNA, 21 nt, Mycobacterium tuberculosis H37Rv
cgcgcuuuucuccgccgagca

SEQ ID NO: 1336636 - RNA, 13 nt, Mycobacterium tuberculosis H37Rv
cgcggaacccagc

SEQ ID NO: 1336637 - RNA, 20 nt, Mycobacterium tuberculosis H37Rv
cgcggaacucgucgcugccc

SEQ ID NO: 1336638 - RNA, 15 nt, Mycobacterium tuberculosis H37Rv
cgcgcucgcgcaagc

SEQ ID NO: 1336639 - RNA, 16 nt, Mycobacterium tuberculosis H37Rv
cgcgcucgcucaccgg

SEQ ID NO: 1336640 - RNA, 13 nt, Mycobacterium tuberculosis H37Rv
cgcgcucgggccc

SEQ ID NO: 1336641 - RNA, 21 nt, Mycobacterium tuberculosis H37Rv
cgcgcucgggcccagcgcgcg

SEQ ID NO: 1336642 - RNA, 17 nt, Mycobacterium tuberculosis H37Rv
cgcgcucggugccgccc

SEQ ID NO: 1336643 - RNA, 16 nt, Mycobacterium tuberculosis H37Rv
cgcgcugagcgacugc

SEQ ID NO: 1336644 - RNA, 16 nt, Mycobacterium tuberculosis H37Rv
cgcgcugacccgccga

SEQ ID NO: 1336645 - RNA, 15 nt, Mycobacterium tuberculosis H37Rv
cgcgcugaucagccc

SEQ ID NO: 1336646 - RNA, 12 nt, Mycobacterium tuberculosis H37Rv
cgcgcugagcac

SEQ ID NO: 1336647 - RNA, 15 nt, Mycobacterium tuberculosis H37Rv
cgcgcugaaucaccc

SEQ ID NO: 1336648 - RNA, 13 nt, Mycobacterium tuberculosis H37Rv
cgcgcugcggccc

SEQ ID NO: 1336649 - RNA, 12 nt, Mycobacterium tuberculosis H37Rv
cgcgcugcgcag

SEQ ID NO: 1336650 - RNA, 19 nt, Mycobacterium tuberculosis H37Rv
cgcggcgaugauggcgcga

SEQ ID NO: 1336651 - RNA, 13 nt, Mycobacterium tuberculosis H37Rv
cgcggccgcccgu

SEQ ID NO: 1336652 - RNA, 15 nt, Mycobacterium tuberculosis H37Rv
cgcggccgccguccc

SEQ ID NO: 1336653 - RNA, 23 nt, Mycobacterium tuberculosis H37Rv
cgcggcccgcucgaucggcagcc

SEQ ID NO: 1336654 - RNA, 17 nt, Mycobacterium tuberculosis H37Rv
cgcggaugagcucggcc

SEQ ID NO: 1336655 - RNA, 21 nt, Mycobacterium tuberculosis H37Rv
cgcggauggguacgacaccgc

SEQ ID NO: 1336656 - RNA, 16 nt, Mycobacterium tuberculosis H37Rv
cgcggauuucucgccc

SEQ ID NO: 1336657 - RNA, 14 nt, Mycobacterium tuberculosis H37Rv
cgcggcccaccuca

SEQ ID NO: 1336658 - RNA, 18 nt, Mycobacterium tuberculosis H37Rv
cgcggccccgacugccgc

SEQ ID NO: 1336659 - RNA, 18 nt, Mycobacterium tuberculosis H37Rv
cgcggauccgggcguggu

SEQ ID NO: 1336660 - RNA, 22 nt, Mycobacterium tuberculosis H37Rv
cgcggaucaccaucgccgccgc

SEQ ID NO: 1336661 - RNA, 15 nt, Mycobacterium tuberculosis H37Rv
cgcggaucaccaucg

SEQ ID NO: 1336662 - RNA, 21 nt, Mycobacterium tuberculosis H37Rv
cgcggaucagcccgcgcagca

SEQ ID NO: 1336663 - RNA, 23 nt, Mycobacterium tuberculosis H37Rv
cgcggauaggccgcgcggcggcg

SEQ ID NO: 1336664 - RNA, 16 nt, Mycobacterium tuberculosis H37Rv
cgcggacacugcgaag

SEQ ID NO: 1336665 - RNA, 19 nt, Mycobacterium tuberculosis H37Rv
cgcggcgcaggucgcgcag

SEQ ID NO: 1336666 - RNA, 16 nt, Mycobacterium tuberculosis H37Rv
cgcggcgccacccgcg

SEQ ID NO: 1336667 - RNA, 13 nt, Mycobacterium tuberculosis H37Rv
cgcggcgcagcac

SEQ ID NO: 1336668 - RNA, 12 nt, Mycobacterium tuberculosis H37Rv
cgcggcgccgcc

SEQ ID NO: 1336669 - RNA, 14 nt, Mycobacterium tuberculosis H37Rv
cgcggcgccgccau

SEQ ID NO: 1336670 - RNA, 13 nt, Mycobacterium tuberculosis H37Rv
cgcggcgccagau

SEQ ID NO: 1336671 - RNA, 21 nt, Mycobacterium tuberculosis H37Rv
cgcggcgccauagccgcgacc

SEQ ID NO: 1336672 - RNA, 14 nt, Mycobacterium tuberculosis H37Rv
cgcggcgcccagga

SEQ ID NO: 1336673 - RNA, 13 nt, Mycobacterium tuberculosis H37Rv
cgcggcgcggccg

SEQ ID NO: 1336674 - RNA, 14 nt, Mycobacterium tuberculosis H37Rv
cgcggcgcggccgc

SEQ ID NO: 1336675 - RNA, 19 nt, Mycobacterium tuberculosis H37Rv
cgcggcgcggcgggcagcg

SEQ ID NO: 1336676 - RNA, 22 nt, Mycobacterium tuberculosis H37Rv
cgcggcgcguccgggcucgcgc

SEQ ID NO: 1336677 - RNA, 12 nt, Mycobacterium tuberculosis H37Rv
cgcgggccacca

SEQ ID NO: 1336678 - RNA, 20 nt, Mycobacterium tuberculosis H37Rv
cgcggcguucggcuucacug

SEQ ID NO: 1336679 - RNA, 15 nt, Mycobacterium tuberculosis H37Rv
cgcggcgugcgcggu

SEQ ID NO: 1336680 - RNA, 19 nt, Mycobacterium tuberculosis H37Rv
cgcgcaucaucgcccaccg

SEQ ID NO: 1336681 - RNA, 15 nt, Mycobacterium tuberculosis H37Rv
cgcgcauauccgcag

SEQ ID NO: 1336682 - RNA, 15 nt, Mycobacterium tuberculosis H37Rv
cgcgcagcuccaccg

SEQ ID NO: 1336683 - RNA, 17 nt, Mycobacterium tuberculosis H37Rv
cgcgcagccgggcaccg

SEQ ID NO: 1336684 - RNA, 13 nt, Mycobacterium tuberculosis H37Rv
cgcgccagcuccg

SEQ ID NO: 1336685 - RNA, 14 nt, Mycobacterium tuberculosis H37Rv
cgcgccaccagcac

SEQ ID NO: 1336686 - RNA, 18 nt, Mycobacterium tuberculosis H37Rv
cgcgccaccggcaccgcc

SEQ ID NO: 1336687 - RNA, 20 nt, Mycobacterium tuberculosis H37Rv
cgcgccaccggcaccgccug

SEQ ID NO: 1336688 - RNA, 23 nt, Mycobacterium tuberculosis H37Rv
cgcgagcggaauggaggccgccg

SEQ ID NO: 1336689 - RNA, 16 nt, Mycobacterium tuberculosis H37Rv
cgcgaggucggcggcg

SEQ ID NO: 1336690 - RNA, 14 nt, Mycobacterium tuberculosis H37Rv
cgcgaggaugcuga

SEQ ID NO: 1336691 - RNA, 19 nt, Mycobacterium tuberculosis H37Rv
cgcgcaagcggacccgacc

SEQ ID NO: 1336692 - RNA, 19 nt, Mycobacterium tuberculosis H37Rv
cgcgcaacguagccagcag

SEQ ID NO: 1336693 - RNA, 18 nt, Mycobacterium tuberculosis H37Rv
cgcgcaacucgccacggu

SEQ ID NO: 1336694 - RNA, 16 nt, Mycobacterium tuberculosis H37Rv
cgcgagugccaguccg

SEQ ID NO: 1336695 - RNA, 18 nt, Mycobacterium tuberculosis H37Rv
cgcgcaacgccgccagcc

SEQ ID NO: 1336696 - RNA, 15 nt, Mycobacterium tuberculosis H37Rv
cgcgaguccgcugcu

SEQ ID NO: 1336697 - RNA, 13 nt, Mycobacterium tuberculosis H37Rv
cgcgcacccagcc

SEQ ID NO: 1336698 - RNA, 14 nt, Mycobacterium tuberculosis H37Rv
cgcgcacccagccc

SEQ ID NO: 1336699 - RNA, 18 nt, Mycobacterium tuberculosis H37Rv
cgcgcagacucgccaccg

SEQ ID NO: 1336700 - RNA, 16 nt, Mycobacterium tuberculosis H37Rv
cgcgcagauggcauug

SEQ ID NO: 1336701 - RNA, 15 nt, Mycobacterium tuberculosis H37Rv
cgcgcagccgcucga

SEQ ID NO: 1336702 - RNA, 20 nt, Mycobacterium tuberculosis H37Rv
cgcgcgccaucgccuccagc

SEQ ID NO: 1336703 - RNA, 21 nt, Mycobacterium tuberculosis H37Rv
cgcgcggagucaagcagcagc

SEQ ID NO: 1336704 - RNA, 20 nt, Mycobacterium tuberculosis H37Rv
cgcgcggaucggcggccgcg

SEQ ID NO: 1336705 - RNA, 13 nt, Mycobacterium tuberculosis H37Rv
cgcgcgaccuggu

SEQ ID NO: 1336706 - RNA, 18 nt, Mycobacterium tuberculosis H37Rv
cgcgcggacccagcaccc

SEQ ID NO: 1336707 - RNA, 14 nt, Mycobacterium tuberculosis H37Rv
cgcgcggccagccc

SEQ ID NO: 1336708 - RNA, 13 nt, Mycobacterium tuberculosis H37Rv
cgcgcggcgcagc

SEQ ID NO: 1336709 - RNA, 22 nt, Mycobacterium tuberculosis H37Rv
cgcgcgcaagucgauguacacc

SEQ ID NO: 1336710 - RNA, 22 nt, Mycobacterium tuberculosis H37Rv
cgcgcgcacggcgucggccacc

SEQ ID NO: 1336711 - RNA, 13 nt, Mycobacterium tuberculosis H37Rv
cgcgcgacgccgu

SEQ ID NO: 1336712 - RNA, 16 nt, Mycobacterium tuberculosis H37Rv
cgcgcgacaacccggc

SEQ ID NO: 1336713 - RNA, 19 nt, Mycobacterium tuberculosis H37Rv
cgcgccuucacgcuggccu

SEQ ID NO: 1336714 - RNA, 18 nt, Mycobacterium tuberculosis H37Rv
cgcgcgaaccccagccga

SEQ ID NO: 1336715 - RNA, 16 nt, Mycobacterium tuberculosis H37Rv
cgcgcgaccaugagcu

SEQ ID NO: 1336716 - RNA, 15 nt, Mycobacterium tuberculosis H37Rv
cgcgccuuugagccc

SEQ ID NO: 1336717 - RNA, 17 nt, Mycobacterium tuberculosis H37Rv
cgcgccuuugagcccgc

SEQ ID NO: 1336718 - RNA, 17 nt, Mycobacterium tuberculosis H37Rv
cgcgccgagcccgggcc

SEQ ID NO: 1336719 - RNA, 18 nt, Mycobacterium tuberculosis H37Rv
cgcgccgagcccgggccu

SEQ ID NO: 1336720 - RNA, 18 nt, Mycobacterium tuberculosis H37Rv
cgcgccgaguugcccggg

SEQ ID NO: 1336721 - RNA, 12 nt, Mycobacterium tuberculosis H37Rv
cgcgccggcccc

SEQ ID NO: 1336722 - RNA, 17 nt, Mycobacterium tuberculosis H37Rv
cgcgccggcggccaccu

SEQ ID NO: 1336723 - RNA, 13 nt, Mycobacterium tuberculosis H37Rv
cgcgccggcggca

SEQ ID NO: 1336724 - RNA, 13 nt, Mycobacterium tuberculosis H37Rv
cgcgccggccgcu

SEQ ID NO: 1336725 - RNA, 14 nt, Mycobacterium tuberculosis H37Rv
cgcgccaggcgcga

SEQ ID NO: 1336726 - RNA, 15 nt, Mycobacterium tuberculosis H37Rv
cgcgccaggccacgu

SEQ ID NO: 1336727 - RNA, 19 nt, Mycobacterium tuberculosis H37Rv
cgcgccaggcuugcggcac

SEQ ID NO: 1336728 - RNA, 19 nt, Mycobacterium tuberculosis H37Rv
cgcgccaucgccuccagcc

SEQ ID NO: 1336729 - RNA, 21 nt, Mycobacterium tuberculosis H37Rv
cgcgccaucgccuccagccgg

SEQ ID NO: 1336730 - RNA, 21 nt, Mycobacterium tuberculosis H37Rv
cgcgccaguguggugcggcgc

SEQ ID NO: 1336731 - RNA, 18 nt, Mycobacterium tuberculosis H37Rv
cgcgccaguggccaccau

SEQ ID NO: 1336732 - RNA, 16 nt, Mycobacterium tuberculosis H37Rv
cgcgcccuucagcacg

SEQ ID NO: 1336733 - RNA, 15 nt, Mycobacterium tuberculosis H37Rv
cgcgccgagcccggg

SEQ ID NO: 1336734 - RNA, 17 nt, Mycobacterium tuberculosis H37Rv
cgcgccgagccagcacc

SEQ ID NO: 1336735 - RNA, 14 nt, Mycobacterium tuberculosis H37Rv
cgcgccgacgccgc

SEQ ID NO: 1336736 - RNA, 17 nt, Mycobacterium tuberculosis H37Rv
cgcgccgaaucgcgggc

SEQ ID NO: 1336737 - RNA, 19 nt, Mycobacterium tuberculosis H37Rv
cgcgccgaccucaucggca

SEQ ID NO: 1336738 - RNA, 21 nt, Mycobacterium tuberculosis H37Rv
cgccgacauggcggugcgcag

SEQ ID NO: 1336739 - RNA, 22 nt, Mycobacterium tuberculosis H37Rv
cgccgacauggcggugcgcagc

SEQ ID NO: 1336740 - RNA, 14 nt, Mycobacterium tuberculosis H37Rv
cgccgaccacccgg

SEQ ID NO: 1336741 - RNA, 21 nt, Mycobacterium tuberculosis H37Rv
cgccgaccagaacgacgccgc

SEQ ID NO: 1336742 - RNA, 22 nt, Mycobacterium tuberculosis H37Rv
cgccgaccaucucaccgggccc

SEQ ID NO: 1336743 - RNA, 19 nt, Mycobacterium tuberculosis H37Rv
cgccgacuccccgccgggc

SEQ ID NO: 1336744 - RNA, 12 nt, Mycobacterium tuberculosis H37Rv
cgccgaccagaa

SEQ ID NO: 1336745 - RNA, 16 nt, Mycobacterium tuberculosis H37Rv
cgccgacgccgguggg

SEQ ID NO: 1336746 - RNA, 22 nt, Mycobacterium tuberculosis H37Rv
cgccgaucagcgaaccaccggc

SEQ ID NO: 1336747 - RNA, 22 nt, Mycobacterium tuberculosis H37Rv
cgccgacuuccgcgucgccggc

SEQ ID NO: 1336748 - RNA, 21 nt, Mycobacterium tuberculosis H37Rv
cgccgacuuccgcgucgccgg

SEQ ID NO: 1336749 - RNA, 22 nt, Mycobacterium tuberculosis H37Rv
cgccgacucggcaccgcggccg

SEQ ID NO: 1336750 - RNA, 23 nt, Mycobacterium tuberculosis H37Rv
cgccgacucggcaccgcggccgc

SEQ ID NO: 1336751 - RNA, 15 nt, Mycobacterium tuberculosis H37Rv
cgccgagaccgccgc

SEQ ID NO: 1336752 - RNA, 20 nt, Mycobacterium tuberculosis H37Rv
cgccgaugauggacaccagc

SEQ ID NO: 1336753 - RNA, 16 nt, Mycobacterium tuberculosis H37Rv
cgccgaugccgccggc

SEQ ID NO: 1336754 - RNA, 22 nt, Mycobacterium tuberculosis H37Rv
cgccgaugauguuuuccccgcc

SEQ ID NO: 1336755 - RNA, 15 nt, Mycobacterium tuberculosis H37Rv
cgccgaugccaccgc

SEQ ID NO: 1336756 - RNA, 17 nt, Mycobacterium tuberculosis H37Rv
cgccgaugaugcggcgc

SEQ ID NO: 1336757 - RNA, 18 nt, Mycobacterium tuberculosis H37Rv
cgccgaugaacguggcga

SEQ ID NO: 1336758 - RNA, 15 nt, Mycobacterium tuberculosis H37Rv
cgccgaucccgccca

SEQ ID NO: 1336759 - RNA, 22 nt, Mycobacterium tuberculosis H37Rv
cgccgaucgacacccgcucggc

SEQ ID NO: 1336760 - RNA, 16 nt, Mycobacterium tuberculosis H37Rv
cgccgaucccgucggg

SEQ ID NO: 1336761 - RNA, 13 nt, Mycobacterium tuberculosis H37Rv
cgccgauguggcc

SEQ ID NO: 1336762 - RNA, 23 nt, Mycobacterium tuberculosis H37Rv
cgccgauuuggccgucaucuccg

SEQ ID NO: 1336763 - RNA, 18 nt, Mycobacterium tuberculosis H37Rv
cgccgauuccaccgccga

SEQ ID NO: 1336764 - RNA, 19 nt, Mycobacterium tuberculosis H37Rv
cgccgaugcccgacaccgc

SEQ ID NO: 1336765 - RNA, 22 nt, Mycobacterium tuberculosis H37Rv
cgccgccacggaucgcggcggc

SEQ ID NO: 1336766 - RNA, 18 nt, Mycobacterium tuberculosis H37Rv
cgccgccaccggcgccgc

SEQ ID NO: 1336767 - RNA, 12 nt, Mycobacterium tuberculosis H37Rv
cgccgccagcac

SEQ ID NO: 1336768 - RNA, 14 nt, Mycobacterium tuberculosis H37Rv
cgccgccagccugg

SEQ ID NO: 1336769 - RNA, 14 nt, Mycobacterium tuberculosis H37Rv
cgccgccagcgccg

SEQ ID NO: 1336770 - RNA, 16 nt, Mycobacterium tuberculosis H37Rv
cgccgcccuccgacgg

SEQ ID NO: 1336771 - RNA, 17 nt, Mycobacterium tuberculosis H37Rv
cgccgcccuccgacggg

SEQ ID NO: 1336772 - RNA, 17 nt, Mycobacterium tuberculosis H37Rv
cgccgcccuugccgccg

SEQ ID NO: 1336773 - RNA, 18 nt, Mycobacterium tuberculosis H37Rv
cgccgcccuugccgccgg

SEQ ID NO: 1336774 - RNA, 23 nt, Mycobacterium tuberculosis H37Rv
cgccgcccuugccgccggccccg

SEQ ID NO: 1336775 - RNA, 23 nt, Mycobacterium tuberculosis H37Rv
cgccgccagguccgccggugccg

SEQ ID NO: 1336776 - RNA, 19 nt, Mycobacterium tuberculosis H37Rv
cgccgcccgugccgcccuc

SEQ ID NO: 1336777 - RNA, 20 nt, Mycobacterium tuberculosis H37Rv
cgccgccagguguucgccgg

SEQ ID NO: 1336778 - RNA, 13 nt, Mycobacterium tuberculosis H37Rv
cgcccuugugaac

SEQ ID NO: 1336779 - RNA, 14 nt, Mycobacterium tuberculosis H37Rv
cgcccuugccgcag

SEQ ID NO: 1336780 - RNA, 15 nt, Mycobacterium tuberculosis H37Rv
cgccgaaaccgccgg

SEQ ID NO: 1336781 - RNA, 22 nt, Mycobacterium tuberculosis H37Rv
cgccgaaaccgggacaaucucg

SEQ ID NO: 1336782 - RNA, 14 nt, Mycobacterium tuberculosis H37Rv
cgccgaaaaugccg

SEQ ID NO: 1336783 - RNA, 21 nt, Mycobacterium tuberculosis H37Rv
cgccgaaacucaccagcaccc

SEQ ID NO: 1336784 - RNA, 17 nt, Mycobacterium tuberculosis H37Rv
cgccgaaacucaccagc

SEQ ID NO: 1336785 - RNA, 22 nt, Mycobacterium tuberculosis H37Rv
cgccgaaaucaguugcgcucca

SEQ ID NO: 1336786 - RNA, 18 nt, Mycobacterium tuberculosis H37Rv
cgccgaaaucggccagcu

SEQ ID NO: 1336787 - RNA, 18 nt, Mycobacterium tuberculosis H37Rv
cgccgaacaccggcucca

SEQ ID NO: 1336788 - RNA, 14 nt, Mycobacterium tuberculosis H37Rv
cgccgaacagcagc

SEQ ID NO: 1336789 - RNA, 15 nt, Mycobacterium tuberculosis H37Rv
cgccgaacagcagcc

SEQ ID NO: 1336790 - RNA, 23 nt, Mycobacterium tuberculosis H37Rv
cgccgaacagcagcccgcccuga

SEQ ID NO: 1336791 - RNA, 14 nt, Mycobacterium tuberculosis H37Rv
cgccgaacgccacc

SEQ ID NO: 1336792 - RNA, 20 nt, Mycobacterium tuberculosis H37Rv
cgccgacacccccggugccg

SEQ ID NO: 1336793 - RNA, 22 nt, Mycobacterium tuberculosis H37Rv
cgccgacaggccggccaccagu

SEQ ID NO: 1336794 - RNA, 12 nt, Mycobacterium tuberculosis H37Rv
cgccgacagccc

SEQ ID NO: 1336795 - RNA, 15 nt, Mycobacterium tuberculosis H37Rv
cgccgacagcgccuu

SEQ ID NO: 1336796 - RNA, 13 nt, Mycobacterium tuberculosis H37Rv
cgccgacaccggg

SEQ ID NO: 1336797 - RNA, 23 nt, Mycobacterium tuberculosis H37Rv
cgcccugacacaacaccggcgug

SEQ ID NO: 1336798 - RNA, 17 nt, Mycobacterium tuberculosis H37Rv
cgcccuugccgccggcc

SEQ ID NO: 1336799 - RNA, 22 nt, Mycobacterium tuberculosis H37Rv
cgcccuugccuccggcgccgcc

SEQ ID NO: 1336800 - RNA, 23 nt, Mycobacterium tuberculosis H37Rv
cgcccuugccuccggcgccgccc

SEQ ID NO: 1336801 - RNA, 15 nt, Mycobacterium tuberculosis H37Rv
cgcccuugccgccuu

SEQ ID NO: 1336802 - RNA, 17 nt, Mycobacterium tuberculosis H37Rv
cgcccuugccgcccgcu

SEQ ID NO: 1336803 - RNA, 16 nt, Mycobacterium tuberculosis H37Rv
cgcccuugccgcccgc

SEQ ID NO: 1336804 - RNA, 16 nt, Mycobacterium tuberculosis H37Rv
cgcccuugccgccagc

SEQ ID NO: 1336805 - RNA, 18 nt, Mycobacterium tuberculosis H37Rv
cgcccuugccgccagccc

SEQ ID NO: 1336806 - RNA, 19 nt, Mycobacterium tuberculosis H37Rv
cgcccugaagggccgccuc

SEQ ID NO: 1336807 - RNA, 21 nt, Mycobacterium tuberculosis H37Rv
cgcccugaagggccgccucgc

SEQ ID NO: 1336808 - RNA, 13 nt, Mycobacterium tuberculosis H37Rv
cgcccguguugaa

SEQ ID NO: 1336809 - RNA, 23 nt, Mycobacterium tuberculosis H37Rv
cgcccguguugaagaagcccgag

SEQ ID NO: 1336810 - RNA, 15 nt, Mycobacterium tuberculosis H37Rv
cgcccugccauggga

SEQ ID NO: 1336811 - RNA, 13 nt, Mycobacterium tuberculosis H37Rv
cgcccugacaccc

SEQ ID NO: 1336812 - RNA, 23 nt, Mycobacterium tuberculosis H37Rv
cgcccugacccggagccgccagg

SEQ ID NO: 1336813 - RNA, 22 nt, Mycobacterium tuberculosis H37Rv
cgcccgugccgcccgcgccgcc

SEQ ID NO: 1336814 - RNA, 14 nt, Mycobacterium tuberculosis H37Rv
cgcccgugagaucc

SEQ ID NO: 1336815 - RNA, 14 nt, Mycobacterium tuberculosis H37Rv
cgcccgugccgccc

SEQ ID NO: 1336816 - RNA, 15 nt, Mycobacterium tuberculosis H37Rv
cgcccgugccgcccg

SEQ ID NO: 1336817 - RNA, 17 nt, Mycobacterium tuberculosis H37Rv
cgcccgucguagguggc

SEQ ID NO: 1336818 - RNA, 17 nt, Mycobacterium tuberculosis H37Rv
cgcccggcgcaccaucg

SEQ ID NO: 1336819 - RNA, 15 nt, Mycobacterium tuberculosis H37Rv
cgcccggcgagcagg

SEQ ID NO: 1336820 - RNA, 22 nt, Mycobacterium tuberculosis H37Rv
cgcccgcucggagaucgccacu

SEQ ID NO: 1336821 - RNA, 13 nt, Mycobacterium tuberculosis H37Rv
cgcccggccccgc

SEQ ID NO: 1336822 - RNA, 17 nt, Mycobacterium tuberculosis H37Rv
cgcccggccccgcaagc

SEQ ID NO: 1336823 - RNA, 15 nt, Mycobacterium tuberculosis H37Rv
cgcccggcccgccac

SEQ ID NO: 1336824 - RNA, 14 nt, Mycobacterium tuberculosis H37Rv
cgcccggccgcagc

SEQ ID NO: 1336825 - RNA, 13 nt, Mycobacterium tuberculosis H37Rv
cgcccggccagcu

SEQ ID NO: 1336826 - RNA, 22 nt, Mycobacterium tuberculosis H37Rv
cgccccucacguggacugaccu

SEQ ID NO: 1336827 - RNA, 17 nt, Mycobacterium tuberculosis H37Rv
cgcccgaaaaacgaccc

SEQ ID NO: 1336828 - RNA, 20 nt, Mycobacterium tuberculosis H37Rv
cgcccgaaccccgggcggcg

SEQ ID NO: 1336829 - RNA, 18 nt, Mycobacterium tuberculosis H37Rv
cgcccgaagaugccugga

SEQ ID NO: 1336830 - RNA, 14 nt, Mycobacterium tuberculosis H37Rv
cgcccgaagccggg

SEQ ID NO: 1336831 - RNA, 13 nt, Mycobacterium tuberculosis H37Rv
cgcccgcgagcug

SEQ ID NO: 1336832 - RNA, 17 nt, Mycobacterium tuberculosis H37Rv
cgcccgcgagcuguagg

SEQ ID NO: 1336833 - RNA, 22 nt, Mycobacterium tuberculosis H37Rv
cgcccgcgccuccguugccccc

SEQ ID NO: 1336834 - RNA, 13 nt, Mycobacterium tuberculosis H37Rv
cgcccgcgccgcc

SEQ ID NO: 1336835 - RNA, 16 nt, Mycobacterium tuberculosis H37Rv
cgcccgcgcggccacu

SEQ ID NO: 1336836 - RNA, 13 nt, Mycobacterium tuberculosis H37Rv
cgcccccgcccgu

SEQ ID NO: 1336837 - RNA, 14 nt, Mycobacterium tuberculosis H37Rv
cgcccccgcugcca

SEQ ID NO: 1336838 - RNA, 21 nt, Mycobacterium tuberculosis H37Rv
cgccccaugaugaacagcuca

SEQ ID NO: 1336839 - RNA, 22 nt, Mycobacterium tuberculosis H37Rv
cgccccaugaugaacagcucac

SEQ ID NO: 1336840 - RNA, 17 nt, Mycobacterium tuberculosis H37Rv
cgccccaugcaacacac

SEQ ID NO: 1336841 - RNA, 18 nt, Mycobacterium tuberculosis H37Rv
cgccccggggguccaccu

SEQ ID NO: 1336842 - RNA, 18 nt, Mycobacterium tuberculosis H37Rv
cgccccggugaguccgga

SEQ ID NO: 1336843 - RNA, 12 nt, Mycobacterium tuberculosis H37Rv
cgccccggcggc

SEQ ID NO: 1336844 - RNA, 13 nt, Mycobacterium tuberculosis H37Rv
cgcccccgugggg

SEQ ID NO: 1336845 - RNA, 20 nt, Mycobacterium tuberculosis H37Rv
cgcccccgccauugccgccg

SEQ ID NO: 1336846 - RNA, 19 nt, Mycobacterium tuberculosis H37Rv
cgcccaggcauggccuggg

SEQ ID NO: 1336847 - RNA, 22 nt, Mycobacterium tuberculosis H37Rv
cgcccagcgcuagccgggcgcg

SEQ ID NO: 1336848 - RNA, 21 nt, Mycobacterium tuberculosis H37Rv
cgcccagcgugaacugagggc

SEQ ID NO: 1336849 - RNA, 14 nt, Mycobacterium tuberculosis H37Rv
cgcccagcgcccgc

SEQ ID NO: 1336850 - RNA, 16 nt, Mycobacterium tuberculosis H37Rv
cgcccagaucgccgag

SEQ ID NO: 1336851 - RNA, 18 nt, Mycobacterium tuberculosis H37Rv
cgcccaucgcgacggccc

SEQ ID NO: 1336852 - RNA, 15 nt, Mycobacterium tuberculosis H37Rv
cgcccaucucaugca

SEQ ID NO: 1336853 - RNA, 13 nt, Mycobacterium tuberculosis H37Rv
cgcccaugccggg

SEQ ID NO: 1336854 - RNA, 16 nt, Mycobacterium tuberculosis H37Rv
cgcccaagccgccggc

SEQ ID NO: 1336855 - RNA, 14 nt, Mycobacterium tuberculosis H37Rv
cgcccaaagaaaug

SEQ ID NO: 1336856 - RNA, 21 nt, Mycobacterium tuberculosis H37Rv
cgcccagagugaauccggcau

SEQ ID NO: 1336857 - RNA, 19 nt, Mycobacterium tuberculosis H37Rv
cgcccagagccgcugcggc

SEQ ID NO: 1336858 - RNA, 15 nt, Mycobacterium tuberculosis H37Rv
cgcccacuggugauc

SEQ ID NO: 1336859 - RNA, 15 nt, Mycobacterium tuberculosis H37Rv
cgcccaacaccgcgc

SEQ ID NO: 1336860 - RNA, 18 nt, Mycobacterium tuberculosis H37Rv
cgcccaacaccgcgccga

SEQ ID NO: 1336861 - RNA, 17 nt, Mycobacterium tuberculosis H37Rv
cgcccaacaccgcgccg

SEQ ID NO: 1336862 - RNA, 23 nt, Mycobacterium tuberculosis H37Rv
cgccauuuccuggcgcagcgccu

SEQ ID NO: 1336863 - RNA, 22 nt, Mycobacterium tuberculosis H37Rv
cgccauuucgcccgaggcaacg

SEQ ID NO: 1336864 - RNA, 16 nt, Mycobacterium tuberculosis H37Rv
cgccauugccaccaag

SEQ ID NO: 1336865 - RNA, 22 nt, Mycobacterium tuberculosis H37Rv
cgccauugacgccguugccgcc

SEQ ID NO: 1336866 - RNA, 13 nt, Mycobacterium tuberculosis H37Rv
cgccaucagcccu

SEQ ID NO: 1336867 - RNA, 18 nt, Mycobacterium tuberculosis H37Rv
cgccaucagcccuucagc

SEQ ID NO: 1336868 - RNA, 14 nt, Mycobacterium tuberculosis H37Rv
cgccaucagcccgg

SEQ ID NO: 1336869 - RNA, 23 nt, Mycobacterium tuberculosis H37Rv
cgccaggcgcgaucgcgcccgcu

SEQ ID NO: 1336870 - RNA, 17 nt, Mycobacterium tuberculosis H37Rv
cgccaggccgcgcgaca

SEQ ID NO: 1336871 - RNA, 14 nt, Mycobacterium tuberculosis H37Rv
cgccagggccgccg

SEQ ID NO: 1336872 - RNA, 16 nt, Mycobacterium tuberculosis H37Rv
cgccagggucgcgagc

SEQ ID NO: 1336873 - RNA, 22 nt, Mycobacterium tuberculosis H37Rv
cgccagggucgcgagcccgcca

SEQ ID NO: 1336874 - RNA, 23 nt, Mycobacterium tuberculosis H37Rv
cgccagggucgcgagcccgccac

SEQ ID NO: 1336875 - RNA, 21 nt, Mycobacterium tuberculosis H37Rv
cgccagggaucuagaggcggc

SEQ ID NO: 1336876 - RNA, 17 nt, Mycobacterium tuberculosis H37Rv
cgccaguauggccgcca

SEQ ID NO: 1336877 - RNA, 14 nt, Mycobacterium tuberculosis H37Rv
cgccagguugcccg

SEQ ID NO: 1336878 - RNA, 17 nt, Mycobacterium tuberculosis H37Rv
cgccaggugcagcacca

SEQ ID NO: 1336879 - RNA, 19 nt, Mycobacterium tuberculosis H37Rv
cgccaggucggcgggcgcg

SEQ ID NO: 1336880 - RNA, 16 nt, Mycobacterium tuberculosis H37Rv
cgccauaccggccgcc

SEQ ID NO: 1336881 - RNA, 18 nt, Mycobacterium tuberculosis H37Rv
cgccauaccggccgccau

SEQ ID NO: 1336882 - RNA, 19 nt, Mycobacterium tuberculosis H37Rv
cgccauaccggccgccauc

SEQ ID NO: 1336883 - RNA, 16 nt, Mycobacterium tuberculosis H37Rv
cgccauagcagagccg

SEQ ID NO: 1336884 - RNA, 21 nt, Mycobacterium tuberculosis H37Rv
cgccauagccgcgacccgcgc

SEQ ID NO: 1336885 - RNA, 20 nt, Mycobacterium tuberculosis H37Rv
cgccauaauauugccgccuc

SEQ ID NO: 1336886 - RNA, 18 nt, Mycobacterium tuberculosis H37Rv
cgccaguguugcgcugcg

SEQ ID NO: 1336887 - RNA, 15 nt, Mycobacterium tuberculosis H37Rv
cgccaguucgcggcu

SEQ ID NO: 1336888 - RNA, 19 nt, Mycobacterium tuberculosis H37Rv
cgccaguucggcgggcgcg

SEQ ID NO: 1336889 - RNA, 19 nt, Mycobacterium tuberculosis H37Rv
cgccaguucuucgggcggg

SEQ ID NO: 1336890 - RNA, 21 nt, Mycobacterium tuberculosis H37Rv
cgccagugccucgcggggucu

SEQ ID NO: 1336891 - RNA, 22 nt, Mycobacterium tuberculosis H37Rv
cgccagugccucgcggggucug

SEQ ID NO: 1336892 - RNA, 18 nt, Mycobacterium tuberculosis H37Rv
cgccagugcccgcacugc

SEQ ID NO: 1336893 - RNA, 18 nt, Mycobacterium tuberculosis H37Rv
cgccagucccacugggcc

SEQ ID NO: 1336894 - RNA, 17 nt, Mycobacterium tuberculosis H37Rv
cgccagcuuggcaaccu

SEQ ID NO: 1336895 - RNA, 16 nt, Mycobacterium tuberculosis H37Rv
cgccagcuugucgggc

SEQ ID NO: 1336896 - RNA, 14 nt, Mycobacterium tuberculosis H37Rv
cgccaggaacccgu

SEQ ID NO: 1336897 - RNA, 13 nt, Mycobacterium tuberculosis H37Rv
cgccaggaucugg

SEQ ID NO: 1336898 - RNA, 19 nt, Mycobacterium tuberculosis H37Rv
cgccaggaucugguugaac

SEQ ID NO: 1336899 - RNA, 23 nt, Mycobacterium tuberculosis H37Rv
cgccaggcaagccagcacugcca

SEQ ID NO: 1336900 - RNA, 14 nt, Mycobacterium tuberculosis H37Rv
cgccaggcaccacg

SEQ ID NO: 1336901 - RNA, 15 nt, Mycobacterium tuberculosis H37Rv
cgccaggccgagccc

SEQ ID NO: 1336902 - RNA, 18 nt, Mycobacterium tuberculosis H37Rv
cgccaggccgagcccggu

SEQ ID NO: 1336903 - RNA, 14 nt, Mycobacterium tuberculosis H37Rv
cgccaggcaugccg

SEQ ID NO: 1336904 - RNA, 17 nt, Mycobacterium tuberculosis H37Rv
cgccaggcaugccgccc

SEQ ID NO: 1336905 - RNA, 15 nt, Mycobacterium tuberculosis H37Rv
cgccagcucgccggc

SEQ ID NO: 1336906 - RNA, 14 nt, Mycobacterium tuberculosis H37Rv
cgccagcugcccga

SEQ ID NO: 1336907 - RNA, 14 nt, Mycobacterium tuberculosis H37Rv
cgccagcucgccgg

SEQ ID NO: 1336908 - RNA, 13 nt, Mycobacterium tuberculosis H37Rv
cgccagcucgccg

SEQ ID NO: 1336909 - RNA, 17 nt, Mycobacterium tuberculosis H37Rv
cgccagcgccgccaggu

SEQ ID NO: 1336910 - RNA, 19 nt, Mycobacterium tuberculosis H37Rv
cgccagcgccugcgcgcau

SEQ ID NO: 1336911 - RNA, 13 nt, Mycobacterium tuberculosis H37Rv
cgccagcggcagc

SEQ ID NO: 1336912 - RNA, 17 nt, Mycobacterium tuberculosis H37Rv
cgccagcggccgcucca

SEQ ID NO: 1336913 - RNA, 13 nt, Mycobacterium tuberculosis H37Rv
cgccagcggccgc

SEQ ID NO: 1336914 - RNA, 14 nt, Mycobacterium tuberculosis H37Rv
cgccagcggccgcu

SEQ ID NO: 1336915 - RNA, 12 nt, Mycobacterium tuberculosis H37Rv
cgccagcggggc

SEQ ID NO: 1336916 - RNA, 19 nt, Mycobacterium tuberculosis H37Rv
cgccagccuccaccagguc

SEQ ID NO: 1336917 - RNA, 19 nt, Mycobacterium tuberculosis H37Rv
cgccagccugaaccgcccc

SEQ ID NO: 1336918 - RNA, 14 nt, Mycobacterium tuberculosis H37Rv
cgccagccuccacc

SEQ ID NO: 1336919 - RNA, 15 nt, Mycobacterium tuberculosis H37Rv
cgccagccuccacca

SEQ ID NO: 1336920 - RNA, 15 nt, Mycobacterium tuberculosis H37Rv
cgccagccggccgcg

SEQ ID NO: 1336921 - RNA, 22 nt, Mycobacterium tuberculosis H37Rv
cgccagccggcgcacucccgga

SEQ ID NO: 1336922 - RNA, 17 nt, Mycobacterium tuberculosis H37Rv
cgccagccgguccagca

SEQ ID NO: 1336923 - RNA, 13 nt, Mycobacterium tuberculosis H37Rv
cgccagccgcgag

SEQ ID NO: 1336924 - RNA, 17 nt, Mycobacterium tuberculosis H37Rv
cgccagcgccagugccu

SEQ ID NO: 1336925 - RNA, 11 nt, Mycobacterium tuberculosis H37Rv
cgccagcgccg

SEQ ID NO: 1336926 - RNA, 20 nt, Mycobacterium tuberculosis H37Rv
cgccagcgccggucagggcu

SEQ ID NO: 1336927 - RNA, 16 nt, Mycobacterium tuberculosis H37Rv
cgccaccagaccagga

SEQ ID NO: 1336928 - RNA, 13 nt, Mycobacterium tuberculosis H37Rv
cgccaccaucccc

SEQ ID NO: 1336929 - RNA, 19 nt, Mycobacterium tuberculosis H37Rv
cgccaccauccccggcaac

SEQ ID NO: 1336930 - RNA, 15 nt, Mycobacterium tuberculosis H37Rv
cgccaccagcgcacg

SEQ ID NO: 1336931 - RNA, 13 nt, Mycobacterium tuberculosis H37Rv
cgcauaaccggcg

SEQ ID NO: 1336932 - RNA, 18 nt, Mycobacterium tuberculosis H37Rv
cgcauaaccggcgcgccc

SEQ ID NO: 1336933 - RNA, 14 nt, Mycobacterium tuberculosis H37Rv
cgcauaagcccccg

SEQ ID NO: 1336934 - RNA, 15 nt, Mycobacterium tuberculosis H37Rv
cgccacgaccgccga

SEQ ID NO: 1336935 - RNA, 13 nt, Mycobacterium tuberculosis H37Rv
cgccacgacaggu

SEQ ID NO: 1336936 - RNA, 16 nt, Mycobacterium tuberculosis H37Rv
cgccacgcacccggca

SEQ ID NO: 1336937 - RNA, 15 nt, Mycobacterium tuberculosis H37Rv
cgccacgggcggcca

SEQ ID NO: 1336938 - RNA, 20 nt, Mycobacterium tuberculosis H37Rv
cgccaccugacgugcggcgc

SEQ ID NO: 1336939 - RNA, 17 nt, Mycobacterium tuberculosis H37Rv
cgccaccucccacgccg

SEQ ID NO: 1336940 - RNA, 23 nt, Mycobacterium tuberculosis H37Rv
cgccacggugucgucgaccaccu

SEQ ID NO: 1336941 - RNA, 19 nt, Mycobacterium tuberculosis H37Rv
cgccacguaauuccccagg

SEQ ID NO: 1336942 - RNA, 20 nt, Mycobacterium tuberculosis H37Rv
cgccacguaauuccccaggg

SEQ ID NO: 1336943 - RNA, 17 nt, Mycobacterium tuberculosis H37Rv
cgccacgguucgggcag

SEQ ID NO: 1336944 - RNA, 23 nt, Mycobacterium tuberculosis H37Rv
cgccacguacuccaccgcgccgu

SEQ ID NO: 1336945 - RNA, 12 nt, Mycobacterium tuberculosis H37Rv
cgccacugcugg

SEQ ID NO: 1336946 - RNA, 20 nt, Mycobacterium tuberculosis H37Rv
cgccacugccggcagcgccc

SEQ ID NO: 1336947 - RNA, 21 nt, Mycobacterium tuberculosis H37Rv
cgccagaacguggccauccuc

SEQ ID NO: 1336948 - RNA, 17 nt, Mycobacterium tuberculosis H37Rv
cgccagaaucccgcucc

SEQ ID NO: 1336949 - RNA, 16 nt, Mycobacterium tuberculosis H37Rv
cgccagaucucgcgcg

SEQ ID NO: 1336950 - RNA, 20 nt, Mycobacterium tuberculosis H37Rv
cgccagaucucgcgcgcggc

SEQ ID NO: 1336951 - RNA, 21 nt, Mycobacterium tuberculosis H37Rv
cgccagagucggagacccguc

SEQ ID NO: 1336952 - RNA, 14 nt, Mycobacterium tuberculosis H37Rv
cgccagcaccaccg

SEQ ID NO: 1336953 - RNA, 21 nt, Mycobacterium tuberculosis H37Rv
cgccagcaaugcccgcaccgc

SEQ ID NO: 1336954 - RNA, 20 nt, Mycobacterium tuberculosis H37Rv
cgccagcaccucggccagcu

SEQ ID NO: 1336955 - RNA, 23 nt, Mycobacterium tuberculosis H37Rv
cgccagcagcugugguaccaacg

SEQ ID NO: 1336956 - RNA, 21 nt, Mycobacterium tuberculosis H37Rv
cgccagcauugaagaagcccg

SEQ ID NO: 1336957 - RNA, 23 nt, Mycobacterium tuberculosis H37Rv
cgccagcauugaagaagcccgaa

SEQ ID NO: 1336958 - RNA, 20 nt, Mycobacterium tuberculosis H37Rv
cgccagcauugaagaagccc

SEQ ID NO: 1336959 - RNA, 14 nt, Mycobacterium tuberculosis H37Rv
cgccagccaccaca

SEQ ID NO: 1336960 - RNA, 14 nt, Mycobacterium tuberculosis H37Rv
cgccagcaugacac

SEQ ID NO: 1336961 - RNA, 22 nt, Mycobacterium tuberculosis H37Rv
cgccagcaugacaccggccacc

SEQ ID NO: 1336962 - RNA, 14 nt, Mycobacterium tuberculosis H37Rv
cgccagcccagcac

SEQ ID NO: 1336963 - RNA, 15 nt, Mycobacterium tuberculosis H37Rv
cgccagccccgccgg

SEQ ID NO: 1336964 - RNA, 21 nt, Mycobacterium tuberculosis H37Rv
cgccagccccgccggggccgc

SEQ ID NO: 1336965 - RNA, 22 nt, Mycobacterium tuberculosis H37Rv
cgccagcccguccggcccccga

SEQ ID NO: 1336966 - RNA, 16 nt, Mycobacterium tuberculosis H37Rv
cgaucagaaucugccu

SEQ ID NO: 1336967 - RNA, 20 nt, Mycobacterium tuberculosis H37Rv
cgaucacuagcgccccuggc

SEQ ID NO: 1336968 - RNA, 16 nt, Mycobacterium tuberculosis H37Rv
cgaucacggccgucga

SEQ ID NO: 1336969 - RNA, 20 nt, Mycobacterium tuberculosis H37Rv
cgaucaauccgcccuugccg

SEQ ID NO: 1336970 - RNA, 11 nt, Mycobacterium tuberculosis H37Rv
cgaucaaugcg

SEQ ID NO: 1336971 - RNA, 13 nt, Mycobacterium tuberculosis H37Rv
cgaucacaccacg

SEQ ID NO: 1336972 - RNA, 14 nt, Mycobacterium tuberculosis H37Rv
cgaucacccccugg

SEQ ID NO: 1336973 - RNA, 22 nt, Mycobacterium tuberculosis H37Rv
cgaucaccaccggaucgcuccc

SEQ ID NO: 1336974 - RNA, 16 nt, Mycobacterium tuberculosis H37Rv
cgacgucaaacgcaaa

SEQ ID NO: 1336975 - RNA, 20 nt, Mycobacterium tuberculosis H37Rv
cgacgucaggguauccacgc

SEQ ID NO: 1336976 - RNA, 14 nt, Mycobacterium tuberculosis H37Rv
cgacggugaugggg

SEQ ID NO: 1336977 - RNA, 22 nt, Mycobacterium tuberculosis H37Rv
cgacguccaguccaugugccca

SEQ ID NO: 1336978 - RNA, 16 nt, Mycobacterium tuberculosis H37Rv
cgauaccgcaccaaag

SEQ ID NO: 1336979 - RNA, 19 nt, Mycobacterium tuberculosis H37Rv
cgauccaguucaccgcgcu

SEQ ID NO: 1336980 - RNA, 16 nt, Mycobacterium tuberculosis H37Rv
cgauccagucugggac

SEQ ID NO: 1336981 - RNA, 14 nt, Mycobacterium tuberculosis H37Rv
cgaucccggccagc

SEQ ID NO: 1336982 - RNA, 23 nt, Mycobacterium tuberculosis H37Rv
cgaucccgucgggcacaccgacg

SEQ ID NO: 1336983 - RNA, 18 nt, Mycobacterium tuberculosis H37Rv
cgauccgauccgcucacc

SEQ ID NO: 1336984 - RNA, 20 nt, Mycobacterium tuberculosis H37Rv
cgauccgcggcguuccccga

SEQ ID NO: 1336985 - RNA, 18 nt, Mycobacterium tuberculosis H37Rv
cgauccgcacccggccgc

SEQ ID NO: 1336986 - RNA, 14 nt, Mycobacterium tuberculosis H37Rv
cgauccgcgcgcau

SEQ ID NO: 1336987 - RNA, 20 nt, Mycobacterium tuberculosis H37Rv
cgauccggaucccaccaccg

SEQ ID NO: 1336988 - RNA, 22 nt, Mycobacterium tuberculosis H37Rv
cgaucgaggaguuggugcagcg

SEQ ID NO: 1336989 - RNA, 17 nt, Mycobacterium tuberculosis H37Rv
cgaucgacucacacacc

SEQ ID NO: 1336990 - RNA, 18 nt, Mycobacterium tuberculosis H37Rv
cgaucgcguucugcacca

SEQ ID NO: 1336991 - RNA, 22 nt, Mycobacterium tuberculosis H37Rv
cgaucgcggcggccuccaccac

SEQ ID NO: 1336992 - RNA, 14 nt, Mycobacterium tuberculosis H37Rv
cgaucgccaggccg

SEQ ID NO: 1336993 - RNA, 14 nt, Mycobacterium tuberculosis H37Rv
cgaucgccggccgc

SEQ ID NO: 1336994 - RNA, 15 nt, Mycobacterium tuberculosis H37Rv
cgaucgccaggccga

SEQ ID NO: 1336995 - RNA, 15 nt, Mycobacterium tuberculosis H37Rv
cgaucgccggccgcg

SEQ ID NO: 1336996 - RNA, 22 nt, Mycobacterium tuberculosis H37Rv
cgauccagcaggccgucgauca

SEQ ID NO: 1336997 - RNA, 15 nt, Mycobacterium tuberculosis H37Rv
cgauccagcaggccg

SEQ ID NO: 1336998 - RNA, 19 nt, Mycobacterium tuberculosis H37Rv
cgaucaguucguggcuggc

SEQ ID NO: 1336999 - RNA, 20 nt, Mycobacterium tuberculosis H37Rv
cgaucaggccgacgucgacc

SEQ ID NO: 1337000 - RNA, 18 nt, Mycobacterium tuberculosis H37Rv
cgaucagcggcagcaccg

SEQ ID NO: 1337001 - RNA, 21 nt, Mycobacterium tuberculosis H37Rv
cgaucagcugcgcaucgccac

SEQ ID NO: 1337002 - RNA, 14 nt, Mycobacterium tuberculosis H37Rv
cgaucaggccuugg

SEQ ID NO: 1337003 - RNA, 19 nt, Mycobacterium tuberculosis H37Rv
cgaucaggggcccacccga

SEQ ID NO: 1337004 - RNA, 15 nt, Mycobacterium tuberculosis H37Rv
cgaucagguacuccc

SEQ ID NO: 1337005 - RNA, 20 nt, Mycobacterium tuberculosis H37Rv
cgaucagguuggcggcugca

SEQ ID NO: 1337006 - RNA, 21 nt, Mycobacterium tuberculosis H37Rv
cgaucagcaccgacggcgcau

SEQ ID NO: 1337007 - RNA, 12 nt, Mycobacterium tuberculosis H37Rv
cgaucagcagcg

SEQ ID NO: 1337008 - RNA, 16 nt, Mycobacterium tuberculosis H37Rv
cgaucagcagcgccag

SEQ ID NO: 1337009 - RNA, 13 nt, Mycobacterium tuberculosis H37Rv
cgaucagcagccg

SEQ ID NO: 1337010 - RNA, 12 nt, Mycobacterium tuberculosis H37Rv
cgaucagcgccg

SEQ ID NO: 1337011 - RNA, 20 nt, Mycobacterium tuberculosis H37Rv
cgaucagcgcgcacacggcu

SEQ ID NO: 1337012 - RNA, 17 nt, Mycobacterium tuberculosis H37Rv
cgaucagcgaguagccg

SEQ ID NO: 1337013 - RNA, 12 nt, Mycobacterium tuberculosis H37Rv
cgaugccaccgc

SEQ ID NO: 1337014 - RNA, 22 nt, Mycobacterium tuberculosis H37Rv
cgaugcacaaccgcugcugcug

SEQ ID NO: 1337015 - RNA, 13 nt, Mycobacterium tuberculosis H37Rv
cgaugagcgugcc

SEQ ID NO: 1337016 - RNA, 17 nt, Mycobacterium tuberculosis H37Rv
cgaugaggcgcagcgcc

SEQ ID NO: 1337017 - RNA, 21 nt, Mycobacterium tuberculosis H37Rv
cgaugagcgguaccccccagc

SEQ ID NO: 1337018 - RNA, 18 nt, Mycobacterium tuberculosis H37Rv
cgaugacgacgccgucgg

SEQ ID NO: 1337019 - RNA, 17 nt, Mycobacterium tuberculosis H37Rv
cgaucuugguggccuca

SEQ ID NO: 1337020 - RNA, 16 nt, Mycobacterium tuberculosis H37Rv
cgaugaauuucauaaa

SEQ ID NO: 1337021 - RNA, 21 nt, Mycobacterium tuberculosis H37Rv
cgaugaauucuuuggggcgcg

SEQ ID NO: 1337022 - RNA, 12 nt, Mycobacterium tuberculosis H37Rv
cgaugaccgcac

SEQ ID NO: 1337023 - RNA, 14 nt, Mycobacterium tuberculosis H37Rv
cgaugaccgcaacc

SEQ ID NO: 1337024 - RNA, 19 nt, Mycobacterium tuberculosis H37Rv
cgaucuccuccaccagugc

SEQ ID NO: 1337025 - RNA, 19 nt, Mycobacterium tuberculosis H37Rv
cgaucucguggaucugccu

SEQ ID NO: 1337026 - RNA, 13 nt, Mycobacterium tuberculosis H37Rv
cgaucugcccggu

SEQ ID NO: 1337027 - RNA, 14 nt, Mycobacterium tuberculosis H37Rv
cgaucugcagcgcg

SEQ ID NO: 1337028 - RNA, 18 nt, Mycobacterium tuberculosis H37Rv
cgaucugcaggcccaggc

SEQ ID NO: 1337029 - RNA, 13 nt, Mycobacterium tuberculosis H37Rv
cgaucugcagcgc

SEQ ID NO: 1337030 - RNA, 22 nt, Mycobacterium tuberculosis H37Rv
cgaucugcccggugauccacgc

SEQ ID NO: 1337031 - RNA, 15 nt, Mycobacterium tuberculosis H37Rv
cgaucugcugugucg

SEQ ID NO: 1337032 - RNA, 17 nt, Mycobacterium tuberculosis H37Rv
cgaucuggucaagaccc

SEQ ID NO: 1337033 - RNA, 20 nt, Mycobacterium tuberculosis H37Rv
cgaucgugagacgccgucga

SEQ ID NO: 1337034 - RNA, 19 nt, Mycobacterium tuberculosis H37Rv
cgaucguuucagcuagacc

SEQ ID NO: 1337035 - RNA, 17 nt, Mycobacterium tuberculosis H37Rv
cgaucgggcccagcagc

SEQ ID NO: 1337036 - RNA, 20 nt, Mycobacterium tuberculosis H37Rv
cgaucggugcgggcgccgcu

SEQ ID NO: 1337037 - RNA, 18 nt, Mycobacterium tuberculosis H37Rv
cgaucggugacgcgccgu

SEQ ID NO: 1337038 - RNA, 19 nt, Mycobacterium tuberculosis H37Rv
cgaucggcggcgcgccgau

SEQ ID NO: 1337039 - RNA, 22 nt, Mycobacterium tuberculosis H37Rv
cgaucggcagucccagcgccgc

SEQ ID NO: 1337040 - RNA, 17 nt, Mycobacterium tuberculosis H37Rv
cgaucggcacuuagccc

SEQ ID NO: 1337041 - RNA, 12 nt, Mycobacterium tuberculosis H37Rv
cgauucaccaau

SEQ ID NO: 1337042 - RNA, 13 nt, Mycobacterium tuberculosis H37Rv
cgauucagccuga

SEQ ID NO: 1337043 - RNA, 17 nt, Mycobacterium tuberculosis H37Rv
cgauuguggccagcgcu

SEQ ID NO: 1337044 - RNA, 17 nt, Mycobacterium tuberculosis H37Rv
cgauugucgccgcgcuc

SEQ ID NO: 1337045 - RNA, 15 nt, Mycobacterium tuberculosis H37Rv
cgauguuggcagggc

SEQ ID NO: 1337046 - RNA, 17 nt, Mycobacterium tuberculosis H37Rv
cgaugccgccgaagagg

SEQ ID NO: 1337047 - RNA, 15 nt, Mycobacterium tuberculosis H37Rv
cgaugccgaagcccc

SEQ ID NO: 1337048 - RNA, 20 nt, Mycobacterium tuberculosis H37Rv
cgaugcccuggcccaucuug

SEQ ID NO: 1337049 - RNA, 13 nt, Mycobacterium tuberculosis H37Rv
cgauggcaucucg

SEQ ID NO: 1337050 - RNA, 19 nt, Mycobacterium tuberculosis H37Rv
cgauggccaucaucgacgg

SEQ ID NO: 1337051 - RNA, 14 nt, Mycobacterium tuberculosis H37Rv
cgauggcaccgugg

SEQ ID NO: 1337052 - RNA, 14 nt, Mycobacterium tuberculosis H37Rv
cgauggcaggggcg

SEQ ID NO: 1337053 - RNA, 21 nt, Mycobacterium tuberculosis H37Rv
cgaugccgccggcaccgccgg

SEQ ID NO: 1337054 - RNA, 18 nt, Mycobacterium tuberculosis H37Rv
cgauggcaagggccgacg

SEQ ID NO: 1337055 - RNA, 15 nt, Mycobacterium tuberculosis H37Rv
cgauggacgcccagu

SEQ ID NO: 1337056 - RNA, 14 nt, Mycobacterium tuberculosis H37Rv
cgauggugccgacc

SEQ ID NO: 1337057 - RNA, 18 nt, Mycobacterium tuberculosis H37Rv
cgauggugccgacccgcc

SEQ ID NO: 1337058 - RNA, 20 nt, Mycobacterium tuberculosis H37Rv
cgauggugcggcccaaccgg

SEQ ID NO: 1337059 - RNA, 16 nt, Mycobacterium tuberculosis H37Rv
cgauggcggccaccgu

SEQ ID NO: 1337060 - RNA, 16 nt, Mycobacterium tuberculosis H37Rv
cgauguauccgaugcg

SEQ ID NO: 1337061 - RNA, 18 nt, Mycobacterium tuberculosis H37Rv
cgauguacagcgggaucc

SEQ ID NO: 1337062 - RNA, 18 nt, Mycobacterium tuberculosis H37Rv
cgaugguguacugcugcu

SEQ ID NO: 1337063 - RNA, 19 nt, Mycobacterium tuberculosis H37Rv
cgaugguguaacggcggcu

SEQ ID NO: 1337064 - RNA, 18 nt, Mycobacterium tuberculosis H37Rv
cgaugguuauccccuggc

SEQ ID NO: 1337065 - RNA, 16 nt, Mycobacterium tuberculosis H37Rv
cgcaccgagcgagacc

SEQ ID NO: 1337066 - RNA, 16 nt, Mycobacterium tuberculosis H37Rv
cgcacccguccgccgc

SEQ ID NO: 1337067 - RNA, 19 nt, Mycobacterium tuberculosis H37Rv
cgcacccgaucgacggucg

SEQ ID NO: 1337068 - RNA, 22 nt, Mycobacterium tuberculosis H37Rv
cgcaccgaaaccaugccgccga

SEQ ID NO: 1337069 - RNA, 14 nt, Mycobacterium tuberculosis H37Rv
cgcacccugcgcgg

SEQ ID NO: 1337070 - RNA, 22 nt, Mycobacterium tuberculosis H37Rv
cgcacccuggguauccaccgcg

SEQ ID NO: 1337071 - RNA, 18 nt, Mycobacterium tuberculosis H37Rv
cgcaccgaccgcaccgug

SEQ ID NO: 1337072 - RNA, 17 nt, Mycobacterium tuberculosis H37Rv
cgcaccgcggaccggcg

SEQ ID NO: 1337073 - RNA, 13 nt, Mycobacterium tuberculosis H37Rv
cgcaccgccccgc

SEQ ID NO: 1337074 - RNA, 20 nt, Mycobacterium tuberculosis H37Rv
cgcacgggcgaccugcggac

SEQ ID NO: 1337075 - RNA, 22 nt, Mycobacterium tuberculosis H37Rv
cgcacgggaucgaucugcggag

SEQ ID NO: 1337076 - RNA, 19 nt, Mycobacterium tuberculosis H37Rv
cgcacggcgucggccaccg

SEQ ID NO: 1337077 - RNA, 15 nt, Mycobacterium tuberculosis H37Rv
cgcacggccgcagcc

SEQ ID NO: 1337078 - RNA, 18 nt, Mycobacterium tuberculosis H37Rv
cgcacggucagcgcgcac

SEQ ID NO: 1337079 - RNA, 19 nt, Mycobacterium tuberculosis H37Rv
cgcacgcucggcggggacc

SEQ ID NO: 1337080 - RNA, 18 nt, Mycobacterium tuberculosis H37Rv
cgcacgcuggcgggcacu

SEQ ID NO: 1337081 - RNA, 19 nt, Mycobacterium tuberculosis H37Rv
cgcacggaccaucgccagg

SEQ ID NO: 1337082 - RNA, 22 nt, Mycobacterium tuberculosis H37Rv
cgcacggaccaucgccaggccc

SEQ ID NO: 1337083 - RNA, 18 nt, Mycobacterium tuberculosis H37Rv
cgcacggcagacacgcug

SEQ ID NO: 1337084 - RNA, 22 nt, Mycobacterium tuberculosis H37Rv
cgcaccggcuggcccagcgacc

SEQ ID NO: 1337085 - RNA, 16 nt, Mycobacterium tuberculosis H37Rv
cgcaccguggacaccu

SEQ ID NO: 1337086 - RNA, 21 nt, Mycobacterium tuberculosis H37Rv
cgcagagcguacaggucggcc

SEQ ID NO: 1337087 - RNA, 16 nt, Mycobacterium tuberculosis H37Rv
cgcagcaacggcggcg

SEQ ID NO: 1337088 - RNA, 22 nt, Mycobacterium tuberculosis H37Rv
cgcagaccguccagcaacagcg

SEQ ID NO: 1337089 - RNA, 18 nt, Mycobacterium tuberculosis H37Rv
cgcagaccguccagcaac

SEQ ID NO: 1337090 - RNA, 12 nt, Mycobacterium tuberculosis H37Rv
cgcagaccagac

SEQ ID NO: 1337091 - RNA, 15 nt, Mycobacterium tuberculosis H37Rv
cgcagaauccggcaa

SEQ ID NO: 1337092 - RNA, 19 nt, Mycobacterium tuberculosis H37Rv
cgcacugggugcgucgacc

SEQ ID NO: 1337093 - RNA, 17 nt, Mycobacterium tuberculosis H37Rv
cgcacuguugcguagcg

SEQ ID NO: 1337094 - RNA, 15 nt, Mycobacterium tuberculosis H37Rv
cgcacugcgccggcc

SEQ ID NO: 1337095 - RNA, 17 nt, Mycobacterium tuberculosis H37Rv
cgcacugcgccggccgc

SEQ ID NO: 1337096 - RNA, 18 nt, Mycobacterium tuberculosis H37Rv
cgcacugcgccggccgca

SEQ ID NO: 1337097 - RNA, 22 nt, Mycobacterium tuberculosis H37Rv
cgcacugaugucacccgcccga

SEQ ID NO: 1337098 - RNA, 19 nt, Mycobacterium tuberculosis H37Rv
cgcacugaaauggcgugcu

SEQ ID NO: 1337099 - RNA, 19 nt, Mycobacterium tuberculosis H37Rv
cgcacugaugucacccgcc

SEQ ID NO: 1337100 - RNA, 17 nt, Mycobacterium tuberculosis H37Rv
cgcacccggccgcgcac

SEQ ID NO: 1337101 - RNA, 15 nt, Mycobacterium tuberculosis H37Rv
cgcacccguccgccg

SEQ ID NO: 1337102 - RNA, 12 nt, Mycobacterium tuberculosis H37Rv
cgcacccgccgg

SEQ ID NO: 1337103 - RNA, 18 nt, Mycobacterium tuberculosis H37Rv
cgcaccccgcuugcgcgg

SEQ ID NO: 1337104 - RNA, 14 nt, Mycobacterium tuberculosis H37Rv
cgcacccaacucca

SEQ ID NO: 1337105 - RNA, 16 nt, Mycobacterium tuberculosis H37Rv
cgcacccaccacacca

SEQ ID NO: 1337106 - RNA, 14 nt, Mycobacterium tuberculosis H37Rv
cgcaccccggcaua

SEQ ID NO: 1337107 - RNA, 15 nt, Mycobacterium tuberculosis H37Rv
cgcaccccggccgcg

SEQ ID NO: 1337108 - RNA, 18 nt, Mycobacterium tuberculosis H37Rv
cgcaccccggccgcgcgc

SEQ ID NO: 1337109 - RNA, 16 nt, Mycobacterium tuberculosis H37Rv
cgcaccaguccagcgg

SEQ ID NO: 1337110 - RNA, 12 nt, Mycobacterium tuberculosis H37Rv
cgcaccaggguu

SEQ ID NO: 1337111 - RNA, 18 nt, Mycobacterium tuberculosis H37Rv
cgcaccaucgcggccgcu

SEQ ID NO: 1337112 - RNA, 22 nt, Mycobacterium tuberculosis H37Rv
cgcaaugaccgcggauuccggc

SEQ ID NO: 1337113 - RNA, 14 nt, Mycobacterium tuberculosis H37Rv
cgcaaugcguugac

SEQ ID NO: 1337114 - RNA, 20 nt, Mycobacterium tuberculosis H37Rv
cgcaccagcugucgggcagc

SEQ ID NO: 1337115 - RNA, 21 nt, Mycobacterium tuberculosis H37Rv
cgauuucgaugacgaacaaga

SEQ ID NO: 1337116 - RNA, 24 nt, Mycobacterium tuberculosis H37Rv
cgauuucgaugacgaacaagaaaa

SEQ ID NO: 1337117 - RNA, 16 nt, Mycobacterium tuberculosis H37Rv
cgauuucgaugacgaa

SEQ ID NO: 1337118 - RNA, 17 nt, Mycobacterium tuberculosis H37Rv
cgauuuccucugggcug

SEQ ID NO: 1337119 - RNA, 17 nt, Mycobacterium tuberculosis H37Rv
cgcaagugucuccggca

SEQ ID NO: 1337120 - RNA, 19 nt, Mycobacterium tuberculosis H37Rv
cgcaaguugagcagcuugg

SEQ ID NO: 1337121 - RNA, 16 nt, Mycobacterium tuberculosis H37Rv
cgcaauaugccacaga

SEQ ID NO: 1337122 - RNA, 14 nt, Mycobacterium tuberculosis H37Rv
cgcagcacucgccc

SEQ ID NO: 1337123 - RNA, 12 nt, Mycobacterium tuberculosis H37Rv
cgcagcagacca

SEQ ID NO: 1337124 - RNA, 16 nt, Mycobacterium tuberculosis H37Rv
cgcagcaccggcucga

SEQ ID NO: 1337125 - RNA, 20 nt, Mycobacterium tuberculosis H37Rv
cgcagcacccugcgggccga

SEQ ID NO: 1337126 - RNA, 19 nt, Mycobacterium tuberculosis H37Rv
cgcagcaccgucggcacca

SEQ ID NO: 1337127 - RNA, 18 nt, Mycobacterium tuberculosis H37Rv
cgcagcaccgucgggccc

SEQ ID NO: 1337128 - RNA, 22 nt, Mycobacterium tuberculosis H37Rv
cgcagcaccgucgggcccagcc

SEQ ID NO: 1337129 - RNA, 22 nt, Mycobacterium tuberculosis H37Rv
cgcagcaccucgucgaucgccg

SEQ ID NO: 1337130 - RNA, 18 nt, Mycobacterium tuberculosis H37Rv
cgcagccaaguccgcccg

SEQ ID NO: 1337131 - RNA, 14 nt, Mycobacterium tuberculosis H37Rv
cgcagccacgcggg

SEQ ID NO: 1337132 - RNA, 20 nt, Mycobacterium tuberculosis H37Rv
cgcagcauguggccgccguc

SEQ ID NO: 1337133 - RNA, 14 nt, Mycobacterium tuberculosis H37Rv
cgcagcauugacca

SEQ ID NO: 1337134 - RNA, 21 nt, Mycobacterium tuberculosis H37Rv
cgcagcauguccgcagcggug

SEQ ID NO: 1337135 - RNA, 20 nt, Mycobacterium tuberculosis H37Rv
cgcagcaucgucgccacgau

SEQ ID NO: 1337136 - RNA, 22 nt, Mycobacterium tuberculosis H37Rv
cgcagcaggggacgaccaugcc

SEQ ID NO: 1337137 - RNA, 21 nt, Mycobacterium tuberculosis H37Rv
cgcagcaggugagccaguugg

SEQ ID NO: 1337138 - RNA, 18 nt, Mycobacterium tuberculosis H37Rv
cgcagcaggugcaucgcc

SEQ ID NO: 1337139 - RNA, 18 nt, Mycobacterium tuberculosis H37Rv
cgcagcauccccgcagcg

SEQ ID NO: 1337140 - RNA, 20 nt, Mycobacterium tuberculosis H37Rv
cgcagcaucccugguccgga

SEQ ID NO: 1337141 - RNA, 14 nt, Mycobacterium tuberculosis H37Rv
cgcagcaucgccag

SEQ ID NO: 1337142 - RNA, 18 nt, Mycobacterium tuberculosis H37Rv
cgcagcaucgccagcagg

SEQ ID NO: 1337143 - RNA, 22 nt, Mycobacterium tuberculosis H37Rv
cgcagccagcaagucugcccga

SEQ ID NO: 1337144 - RNA, 23 nt, Mycobacterium tuberculosis H37Rv
cgcagccacguuacgcucgcggg

SEQ ID NO: 1337145 - RNA, 18 nt, Mycobacterium tuberculosis H37Rv
cgcagccaggcugcggau

SEQ ID NO: 1337146 - RNA, 22 nt, Mycobacterium tuberculosis H37Rv
cgcagcgccugcggcagcaccc

SEQ ID NO: 1337147 - RNA, 22 nt, Mycobacterium tuberculosis H37Rv
cgcagcugacgucaccacgauc

SEQ ID NO: 1337148 - RNA, 15 nt, Mycobacterium tuberculosis H37Rv
cgcagcggccagccc

SEQ ID NO: 1337149 - RNA, 22 nt, Mycobacterium tuberculosis H37Rv
cgcagcucgcugauaguggcgc

SEQ ID NO: 1337150 - RNA, 19 nt, Mycobacterium tuberculosis H37Rv
cgcagccgcucgacggccc

SEQ ID NO: 1337151 - RNA, 18 nt, Mycobacterium tuberculosis H37Rv
cgcagccgguccagcgcc

SEQ ID NO: 1337152 - RNA, 16 nt, Mycobacterium tuberculosis H37Rv
cgcagcccgucggcgc

SEQ ID NO: 1337153 - RNA, 14 nt, Mycobacterium tuberculosis H37Rv
cgcagccugcagcg

SEQ ID NO: 1337154 - RNA, 16 nt, Mycobacterium tuberculosis H37Rv
cgcagccuggucgcgc

SEQ ID NO: 1337155 - RNA, 14 nt, Mycobacterium tuberculosis H37Rv
cgcagcgaggagcc

SEQ ID NO: 1337156 - RNA, 15 nt, Mycobacterium tuberculosis H37Rv
cgcagcgaggagccc

SEQ ID NO: 1337157 - RNA, 16 nt, Mycobacterium tuberculosis H37Rv
cgcagcgaaucuccaa

SEQ ID NO: 1337158 - RNA, 23 nt, Mycobacterium tuberculosis H37Rv
cgcagcgaagaccagcggcggcg

SEQ ID NO: 1337159 - RNA, 20 nt, Mycobacterium tuberculosis H37Rv
cgcagugcccgaucgcuucc

SEQ ID NO: 1337160 - RNA, 22 nt, Mycobacterium tuberculosis H37Rv
cgcaguggcguuacgcucggcg

SEQ ID NO: 1337161 - RNA, 14 nt, Mycobacterium tuberculosis H37Rv
cgcagugcgacucu

SEQ ID NO: 1337162 - RNA, 12 nt, Mycobacterium tuberculosis H37Rv
cgcagucugacg

SEQ ID NO: 1337163 - RNA, 16 nt, Mycobacterium tuberculosis H37Rv
cgcagugacgggaccc

SEQ ID NO: 1337164 - RNA, 22 nt, Mycobacterium tuberculosis H37Rv
cgcagugacguuccgcucgccg

SEQ ID NO: 1337165 - RNA, 14 nt, Mycobacterium tuberculosis H37Rv
cgcagugagcagcc

SEQ ID NO: 1337166 - RNA, 18 nt, Mycobacterium tuberculosis H37Rv
cgcaguuggcaccagccg

SEQ ID NO: 1337167 - RNA, 22 nt, Mycobacterium tuberculosis H37Rv
cgcaguucaucgggcaccaacc

SEQ ID NO: 1337168 - RNA, 22 nt, Mycobacterium tuberculosis H37Rv
cgcaguacuugaccguccaccg

SEQ ID NO: 1337169 - RNA, 18 nt, Mycobacterium tuberculosis H37Rv
cgcaguagccgaccagga

SEQ ID NO: 1337170 - RNA, 19 nt, Mycobacterium tuberculosis H37Rv
cgcaguagccgaccaggac

SEQ ID NO: 1337171 - RNA, 23 nt, Mycobacterium tuberculosis H37Rv
cgcagucccgaacaauucacgca

SEQ ID NO: 1337172 - RNA, 13 nt, Mycobacterium tuberculosis H37Rv
cgcagcuugcccg

SEQ ID NO: 1337173 - RNA, 22 nt, Mycobacterium tuberculosis H37Rv
cgcagcuuggccagccacuccu

SEQ ID NO: 1337174 - RNA, 14 nt, Mycobacterium tuberculosis H37Rv
cgcaggggguggug

SEQ ID NO: 1337175 - RNA, 16 nt, Mycobacterium tuberculosis H37Rv
cgcagggcgucggcga

SEQ ID NO: 1337176 - RNA, 23 nt, Mycobacterium tuberculosis H37Rv
cgcaggggguggugucgcggccg

SEQ ID NO: 1337177 - RNA, 17 nt, Mycobacterium tuberculosis H37Rv
cgcagguagucgacgac

SEQ ID NO: 1337178 - RNA, 17 nt, Mycobacterium tuberculosis H37Rv
cgcaggucauagccccg

SEQ ID NO: 1337179 - RNA, 22 nt, Mycobacterium tuberculosis H37Rv
cgcagguggucgaucagguacu

SEQ ID NO: 1337180 - RNA, 21 nt, Mycobacterium tuberculosis H37Rv
cgcagguuggcaagcacggcg

SEQ ID NO: 1337181 - RNA, 20 nt, Mycobacterium tuberculosis H37Rv
cgcaggugccuuucggcaga

SEQ ID NO: 1337182 - RNA, 18 nt, Mycobacterium tuberculosis H37Rv
cgcaggucggccaccugc

SEQ ID NO: 1337183 - RNA, 13 nt, Mycobacterium tuberculosis H37Rv
ccagugccacgcc

SEQ ID NO: 1337184 - RNA, 15 nt, Mycobacterium tuberculosis H37Rv
ccagugccaccuggg

SEQ ID NO: 1337185 - RNA, 15 nt, Mycobacterium tuberculosis H37Rv
ccagugccccgccga

SEQ ID NO: 1337186 - RNA, 13 nt, Mycobacterium tuberculosis H37Rv
ccagugccccgcc

SEQ ID NO: 1337187 - RNA, 17 nt, Mycobacterium tuberculosis H37Rv
ccagugccgcccaccac

SEQ ID NO: 1337188 - RNA, 19 nt, Mycobacterium tuberculosis H37Rv
ccagugcccgcacugccgc

SEQ ID NO: 1337189 - RNA, 20 nt, Mycobacterium tuberculosis H37Rv
ccagugcccgcacugccgcc

SEQ ID NO: 1337190 - RNA, 22 nt, Mycobacterium tuberculosis H37Rv
ccagugcgcagaacaccaccgc

SEQ ID NO: 1337191 - RNA, 19 nt, Mycobacterium tuberculosis H37Rv
ccagugcgcaacccagccg

SEQ ID NO: 1337192 - RNA, 17 nt, Mycobacterium tuberculosis H37Rv
ccaguccucgacguggc

SEQ ID NO: 1337193 - RNA, 14 nt, Mycobacterium tuberculosis H37Rv
ccaguccucgggca

SEQ ID NO: 1337194 - RNA, 15 nt, Mycobacterium tuberculosis H37Rv
ccagucgacccagcg

SEQ ID NO: 1337195 - RNA, 23 nt, Mycobacterium tuberculosis H37Rv
ccagucgacgucucuggugcagg

SEQ ID NO: 1337196 - RNA, 16 nt, Mycobacterium tuberculosis H37Rv
ccagucgauguccugc

SEQ ID NO: 1337197 - RNA, 17 nt, Mycobacterium tuberculosis H37Rv
ccaguccgaugggaauc

SEQ ID NO: 1337198 - RNA, 23 nt, Mycobacterium tuberculosis H37Rv
ccaguccgcgcgcaagucgaugu

SEQ ID NO: 1337199 - RNA, 16 nt, Mycobacterium tuberculosis H37Rv
ccaguccguccagguc

SEQ ID NO: 1337200 - RNA, 19 nt, Mycobacterium tuberculosis H37Rv
ccaguccggcggacgugac

SEQ ID NO: 1337201 - RNA, 19 nt, Mycobacterium tuberculosis H37Rv
ccagugaccguauuucguc

SEQ ID NO: 1337202 - RNA, 16 nt, Mycobacterium tuberculosis H37Rv
ccagugaaucggaccg

SEQ ID NO: 1337203 - RNA, 22 nt, Mycobacterium tuberculosis H37Rv
ccagugaccgcagucccagcac

SEQ ID NO: 1337204 - RNA, 19 nt, Mycobacterium tuberculosis H37Rv
ccagugaacucgugacagc

SEQ ID NO: 1337205 - RNA, 20 nt, Mycobacterium tuberculosis H37Rv
ccagucguuccgccgccucg

SEQ ID NO: 1337206 - RNA, 23 nt, Mycobacterium tuberculosis H37Rv
ccaguuggccggccagccauggc

SEQ ID NO: 1337207 - RNA, 14 nt, Mycobacterium tuberculosis H37Rv
ccauacagcacccc

SEQ ID NO: 1337208 - RNA, 14 nt, Mycobacterium tuberculosis H37Rv
ccauagccugcgcc

SEQ ID NO: 1337209 - RNA, 21 nt, Mycobacterium tuberculosis H37Rv
ccauacgcgcugacccgccac

SEQ ID NO: 1337210 - RNA, 21 nt, Mycobacterium tuberculosis H37Rv
ccagggucccgccgccuggaa

SEQ ID NO: 1337211 - RNA, 17 nt, Mycobacterium tuberculosis H37Rv
ccagggucugcucaucc

SEQ ID NO: 1337212 - RNA, 19 nt, Mycobacterium tuberculosis H37Rv
ccagggucgcgagcccgcc

SEQ ID NO: 1337213 - RNA, 15 nt, Mycobacterium tuberculosis H37Rv
ccagggucugcucau

SEQ ID NO: 1337214 - RNA, 19 nt, Mycobacterium tuberculosis H37Rv
ccagccggaaccggacagc

SEQ ID NO: 1337215 - RNA, 12 nt, Mycobacterium tuberculosis H37Rv
ccagggugacca

SEQ ID NO: 1337216 - RNA, 16 nt, Mycobacterium tuberculosis H37Rv
ccagggugucugugau

SEQ ID NO: 1337217 - RNA, 18 nt, Mycobacterium tuberculosis H37Rv
ccagggugucgucuugcg

SEQ ID NO: 1337218 - RNA, 18 nt, Mycobacterium tuberculosis H37Rv
ccaggguguauggccacc

SEQ ID NO: 1337219 - RNA, 20 nt, Mycobacterium tuberculosis H37Rv
ccaggguguauggccaccac

SEQ ID NO: 1337220 - RNA, 15 nt, Mycobacterium tuberculosis H37Rv
ccaggguguccaugu

SEQ ID NO: 1337221 - RNA, 16 nt, Mycobacterium tuberculosis H37Rv
ccagccgcggcccucg

SEQ ID NO: 1337222 - RNA, 17 nt, Mycobacterium tuberculosis H37Rv
ccagccgcugccacagg

SEQ ID NO: 1337223 - RNA, 15 nt, Mycobacterium tuberculosis H37Rv
ccagccgcagcaccu

SEQ ID NO: 1337224 - RNA, 13 nt, Mycobacterium tuberculosis H37Rv
ccagccgcccucg

SEQ ID NO: 1337225 - RNA, 14 nt, Mycobacterium tuberculosis H37Rv
ccagccgccccggc

SEQ ID NO: 1337226 - RNA, 12 nt, Mycobacterium tuberculosis H37Rv
ccagccgccccg

SEQ ID NO: 1337227 - RNA, 15 nt, Mycobacterium tuberculosis H37Rv
ccagccgcccucggg

SEQ ID NO: 1337228 - RNA, 21 nt, Mycobacterium tuberculosis H37Rv
ccagccgcgccagcuccgugu

SEQ ID NO: 1337229 - RNA, 15 nt, Mycobacterium tuberculosis H37Rv
ccagguggccaggcc

SEQ ID NO: 1337230 - RNA, 15 nt, Mycobacterium tuberculosis H37Rv
ccagguggaccggcc

SEQ ID NO: 1337231 - RNA, 11 nt, Mycobacterium tuberculosis H37Rv
ccaggugcagg

SEQ ID NO: 1337232 - RNA, 17 nt, Mycobacterium tuberculosis H37Rv
ccaggugcccaagcagu

SEQ ID NO: 1337233 - RNA, 19 nt, Mycobacterium tuberculosis H37Rv
ccaggugcccaagcagucc

SEQ ID NO: 1337234 - RNA, 13 nt, Mycobacterium tuberculosis H37Rv
ccaggugcccgcc

SEQ ID NO: 1337235 - RNA, 16 nt, Mycobacterium tuberculosis H37Rv
ccaggugaugccgccg

SEQ ID NO: 1337236 - RNA, 19 nt, Mycobacterium tuberculosis H37Rv
ccagguagaccaggugcag

SEQ ID NO: 1337237 - RNA, 21 nt, Mycobacterium tuberculosis H37Rv
ccagguacgcgaucagcgcgc

SEQ ID NO: 1337238 - RNA, 22 nt, Mycobacterium tuberculosis H37Rv
ccagguaauugccgaccgccug

SEQ ID NO: 1337239 - RNA, 15 nt, Mycobacterium tuberculosis H37Rv
ccagguacucagugu

SEQ ID NO: 1337240 - RNA, 23 nt, Mycobacterium tuberculosis H37Rv
ccagguuccgcugucgagccggu

SEQ ID NO: 1337241 - RNA, 14 nt, Mycobacterium tuberculosis H37Rv
ccagguugccaacc

SEQ ID NO: 1337242 - RNA, 22 nt, Mycobacterium tuberculosis H37Rv
ccaggugggcagcaggcccacc

SEQ ID NO: 1337243 - RNA, 21 nt, Mycobacterium tuberculosis H37Rv
ccaggugggccgagagcagcc

SEQ ID NO: 1337244 - RNA, 19 nt, Mycobacterium tuberculosis H37Rv
ccaggugggugaacgccug

SEQ ID NO: 1337245 - RNA, 18 nt, Mycobacterium tuberculosis H37Rv
ccaggugggcagcaggcc

SEQ ID NO: 1337246 - RNA, 13 nt, Mycobacterium tuberculosis H37Rv
ccagguggccgcu

SEQ ID NO: 1337247 - RNA, 14 nt, Mycobacterium tuberculosis H37Rv
ccagguggccaggc

SEQ ID NO: 1337248 - RNA, 20 nt, Mycobacterium tuberculosis H37Rv
ccagguggucaucgccacgc

SEQ ID NO: 1337249 - RNA, 20 nt, Mycobacterium tuberculosis H37Rv
ccagguguccccgcccggcc

SEQ ID NO: 1337250 - RNA, 21 nt, Mycobacterium tuberculosis H37Rv
ccagguguccccgcccggcca

SEQ ID NO: 1337251 - RNA, 22 nt, Mycobacterium tuberculosis H37Rv
ccagguguucgccggagacccg

SEQ ID NO: 1337252 - RNA, 13 nt, Mycobacterium tuberculosis H37Rv
ccaguaggcuucg

SEQ ID NO: 1337253 - RNA, 21 nt, Mycobacterium tuberculosis H37Rv
ccaguaggcuucgaccguggu

SEQ ID NO: 1337254 - RNA, 20 nt, Mycobacterium tuberculosis H37Rv
ccaguagccggugccggcgc

SEQ ID NO: 1337255 - RNA, 16 nt, Mycobacterium tuberculosis H37Rv
ccaguacucggccagc

SEQ ID NO: 1337256 - RNA, 18 nt, Mycobacterium tuberculosis H37Rv
ccaguauggccgccaccg

SEQ ID NO: 1337257 - RNA, 16 nt, Mycobacterium tuberculosis H37Rv
ccagucacgcccacca

SEQ ID NO: 1337258 - RNA, 14 nt, Mycobacterium tuberculosis H37Rv
ccaguccaagcugu

SEQ ID NO: 1337259 - RNA, 16 nt, Mycobacterium tuberculosis H37Rv
ccagguuuugccgcgu

SEQ ID NO: 1337260 - RNA, 21 nt, Mycobacterium tuberculosis H37Rv
ccaguaaaaaggcaggacuga

SEQ ID NO: 1337261 - RNA, 15 nt, Mycobacterium tuberculosis H37Rv
ccaucguccagcagg

SEQ ID NO: 1337262 - RNA, 18 nt, Mycobacterium tuberculosis H37Rv
ccaucuucggacgccagc

SEQ ID NO: 1337263 - RNA, 22 nt, Mycobacterium tuberculosis H37Rv
ccaucgguaucgagggcagccg

SEQ ID NO: 1337264 - RNA, 13 nt, Mycobacterium tuberculosis H37Rv
ccaucgggaccgg

SEQ ID NO: 1337265 - RNA, 15 nt, Mycobacterium tuberculosis H37Rv
ccaucgggucacccc

SEQ ID NO: 1337266 - RNA, 19 nt, Mycobacterium tuberculosis H37Rv
ccaucgcgucgucuucuuc

SEQ ID NO: 1337267 - RNA, 16 nt, Mycobacterium tuberculosis H37Rv
ccaugaaggagauccc

SEQ ID NO: 1337268 - RNA, 13 nt, Mycobacterium tuberculosis H37Rv
ccaugaaaucacc

SEQ ID NO: 1337269 - RNA, 16 nt, Mycobacterium tuberculosis H37Rv
ccaucuugaccaaugu

SEQ ID NO: 1337270 - RNA, 13 nt, Mycobacterium tuberculosis H37Rv
ccauggcagcgcc

SEQ ID NO: 1337271 - RNA, 14 nt, Mycobacterium tuberculosis H37Rv
ccauggccagcgcu

SEQ ID NO: 1337272 - RNA, 16 nt, Mycobacterium tuberculosis H37Rv
ccauggcgccgcgccg

SEQ ID NO: 1337273 - RNA, 18 nt, Mycobacterium tuberculosis H37Rv
ccauggcgcgagcagacg

SEQ ID NO: 1337274 - RNA, 23 nt, Mycobacterium tuberculosis H37Rv
ccaugccgaauaccgguggcagc

SEQ ID NO: 1337275 - RNA, 17 nt, Mycobacterium tuberculosis H37Rv
ccaugccgaucggccug

SEQ ID NO: 1337276 - RNA, 19 nt, Mycobacterium tuberculosis H37Rv
ccaugcacggccgagcagg

SEQ ID NO: 1337277 - RNA, 18 nt, Mycobacterium tuberculosis H37Rv
ccaugccacaacgccucg

SEQ ID NO: 1337278 - RNA, 16 nt, Mycobacterium tuberculosis H37Rv
ccauccggcggcggcc

SEQ ID NO: 1337279 - RNA, 17 nt, Mycobacterium tuberculosis H37Rv
ccaucgccaccgcguca

SEQ ID NO: 1337280 - RNA, 23 nt, Mycobacterium tuberculosis H37Rv
ccaucgccacuguugaagaagcc

SEQ ID NO: 1337281 - RNA, 17 nt, Mycobacterium tuberculosis H37Rv
ccaucgcgacggcccga

SEQ ID NO: 1337282 - RNA, 23 nt, Mycobacterium tuberculosis H37Rv
ccaucgcgacuagacgccgccgc

SEQ ID NO: 1337283 - RNA, 16 nt, Mycobacterium tuberculosis H37Rv
ccaucgccuccagccg

SEQ ID NO: 1337284 - RNA, 23 nt, Mycobacterium tuberculosis H37Rv
ccaucgcccgaugcgccagcgua

SEQ ID NO: 1337285 - RNA, 21 nt, Mycobacterium tuberculosis H37Rv
ccauccacaucgaugucggcu

SEQ ID NO: 1337286 - RNA, 22 nt, Mycobacterium tuberculosis H37Rv
ccauaugggggaaagcuugacc

SEQ ID NO: 1337287 - RNA, 15 nt, Mycobacterium tuberculosis H37Rv
ccaugucggccaccc

SEQ ID NO: 1337288 - RNA, 21 nt, Mycobacterium tuberculosis H37Rv
ccauguauuucucccagccca

SEQ ID NO: 1337289 - RNA, 14 nt, Mycobacterium tuberculosis H37Rv
ccaugugcccaggu

SEQ ID NO: 1337290 - RNA, 17 nt, Mycobacterium tuberculosis H37Rv
ccauguguuugaucacc

SEQ ID NO: 1337291 - RNA, 22 nt, Mycobacterium tuberculosis H37Rv
ccauguugaagcgaagccagau

SEQ ID NO: 1337292 - RNA, 16 nt, Mycobacterium tuberculosis H37Rv
ccauggucgauucguc

SEQ ID NO: 1337293 - RNA, 16 nt, Mycobacterium tuberculosis H37Rv
ccaugguggcgccgac

SEQ ID NO: 1337294 - RNA, 12 nt, Mycobacterium tuberculosis H37Rv
ccauggucacca

SEQ ID NO: 1337295 - RNA, 20 nt, Mycobacterium tuberculosis H37Rv
ccaugguguucggcagcgcg

SEQ ID NO: 1337296 - RNA, 17 nt, Mycobacterium tuberculosis H37Rv
ccauggcgugccccagu

SEQ ID NO: 1337297 - RNA, 18 nt, Mycobacterium tuberculosis H37Rv
ccauggcuccgcccagga

SEQ ID NO: 1337298 - RNA, 19 nt, Mycobacterium tuberculosis H37Rv
ccauggcggguuggguggc

SEQ ID NO: 1337299 - RNA, 17 nt, Mycobacterium tuberculosis H37Rv
ccaugggucuggcaggc

SEQ ID NO: 1337300 - RNA, 22 nt, Mycobacterium tuberculosis H37Rv
ccaugggucuggcaggccagca

SEQ ID NO: 1337301 - RNA, 18 nt, Mycobacterium tuberculosis H37Rv
ccauguuuugcugcaugc

SEQ ID NO: 1337302 - RNA, 23 nt, Mycobacterium tuberculosis H37Rv
cccaacgcgguaaagccccgcuc

SEQ ID NO: 1337303 - RNA, 16 nt, Mycobacterium tuberculosis H37Rv
cccaacgcggugggca

SEQ ID NO: 1337304 - RNA, 17 nt, Mycobacterium tuberculosis H37Rv
cccaagcccgauucagc

SEQ ID NO: 1337305 - RNA, 16 nt, Mycobacterium tuberculosis H37Rv
cccaagcucagggugg

SEQ ID NO: 1337306 - RNA, 20 nt, Mycobacterium tuberculosis H37Rv
cccaagcgugcugccgccuu

SEQ ID NO: 1337307 - RNA, 20 nt, Mycobacterium tuberculosis H37Rv
cccaagcgccugagcggccu

SEQ ID NO: 1337308 - RNA, 18 nt, Mycobacterium tuberculosis H37Rv
cccaagccugccgaaccc

SEQ ID NO: 1337309 - RNA, 13 nt, Mycobacterium tuberculosis H37Rv
cccaaggccagga

SEQ ID NO: 1337310 - RNA, 14 nt, Mycobacterium tuberculosis H37Rv
cccaacgccacugc

SEQ ID NO: 1337311 - RNA, 16 nt, Mycobacterium tuberculosis H37Rv
ccauuuucgccaacuu

SEQ ID NO: 1337312 - RNA, 17 nt, Mycobacterium tuberculosis H37Rv
ccauuucucguacccgg

SEQ ID NO: 1337313 - RNA, 15 nt, Mycobacterium tuberculosis H37Rv
ccauuucgucagcga

SEQ ID NO: 1337314 - RNA, 19 nt, Mycobacterium tuberculosis H37Rv
ccauugccggauuuguauu

SEQ ID NO: 1337315 - RNA, 23 nt, Mycobacterium tuberculosis H37Rv
ccauugccauacagcaccccgcc

SEQ ID NO: 1337316 - RNA, 20 nt, Mycobacterium tuberculosis H37Rv
ccauugccgccggcgccgcc

SEQ ID NO: 1337317 - RNA, 11 nt, Mycobacterium tuberculosis H37Rv
ccauugccaua

SEQ ID NO: 1337318 - RNA, 14 nt, Mycobacterium tuberculosis H37Rv
cccaggcgaacagg

SEQ ID NO: 1337319 - RNA, 19 nt, Mycobacterium tuberculosis H37Rv
cccaggcgaacagggcugc

SEQ ID NO: 1337320 - RNA, 18 nt, Mycobacterium tuberculosis H37Rv
cccaggccgcuugccccg

SEQ ID NO: 1337321 - RNA, 14 nt, Mycobacterium tuberculosis H37Rv
cccaggcgcugccg

SEQ ID NO: 1337322 - RNA, 20 nt, Mycobacterium tuberculosis H37Rv
cccaggcgcucaucacccag

SEQ ID NO: 1337323 - RNA, 20 nt, Mycobacterium tuberculosis H37Rv
cccaggcgaucgcccggccc

SEQ ID NO: 1337324 - RNA, 19 nt, Mycobacterium tuberculosis H37Rv
cccaggcgcucagcgcggc

SEQ ID NO: 1337325 - RNA, 20 nt, Mycobacterium tuberculosis H37Rv
cccaggcugguccgggugcc

SEQ ID NO: 1337326 - RNA, 15 nt, Mycobacterium tuberculosis H37Rv
cccaggcuguccgac

SEQ ID NO: 1337327 - RNA, 22 nt, Mycobacterium tuberculosis H37Rv
cccagggcacaucgggcguggu

SEQ ID NO: 1337328 - RNA, 17 nt, Mycobacterium tuberculosis H37Rv
cccagggcguuggcggc

SEQ ID NO: 1337329 - RNA, 12 nt, Mycobacterium tuberculosis H37Rv
cccagggcugcc

SEQ ID NO: 1337330 - RNA, 14 nt, Mycobacterium tuberculosis H37Rv
cccagggcugccgg

SEQ ID NO: 1337331 - RNA, 12 nt, Mycobacterium tuberculosis H37Rv
cccagggugcgc

SEQ ID NO: 1337332 - RNA, 14 nt, Mycobacterium tuberculosis H37Rv
cccagggugcgcca

SEQ ID NO: 1337333 - RNA, 16 nt, Mycobacterium tuberculosis H37Rv
cccaggucguaggcgc

SEQ ID NO: 1337334 - RNA, 22 nt, Mycobacterium tuberculosis H37Rv
cccaggugcguccaggccaggg

SEQ ID NO: 1337335 - RNA, 19 nt, Mycobacterium tuberculosis H37Rv
cccaggugcguccaggcca

SEQ ID NO: 1337336 - RNA, 15 nt, Mycobacterium tuberculosis H37Rv
cccaguucggcgucu

SEQ ID NO: 1337337 - RNA, 18 nt, Mycobacterium tuberculosis H37Rv
cccaguucguugguguug

SEQ ID NO: 1337338 - RNA, 14 nt, Mycobacterium tuberculosis H37Rv
cccagucgcggcgc

SEQ ID NO: 1337339 - RNA, 16 nt, Mycobacterium tuberculosis H37Rv
cccagucggcgccgcc

SEQ ID NO: 1337340 - RNA, 17 nt, Mycobacterium tuberculosis H37Rv
cccagucggcgccgccg

SEQ ID NO: 1337341 - RNA, 22 nt, Mycobacterium tuberculosis H37Rv
cccagucggcgccgccguccag

SEQ ID NO: 1337342 - RNA, 19 nt, Mycobacterium tuberculosis H37Rv
cccagugcacgcucggcgc

SEQ ID NO: 1337343 - RNA, 20 nt, Mycobacterium tuberculosis H37Rv
cccagugcgcaacccagccg

SEQ ID NO: 1337344 - RNA, 13 nt, Mycobacterium tuberculosis H37Rv
cccagugcggcca

SEQ ID NO: 1337345 - RNA, 17 nt, Mycobacterium tuberculosis H37Rv
cccaguauaauucgaga

SEQ ID NO: 1337346 - RNA, 13 nt, Mycobacterium tuberculosis H37Rv
cccaguccaggac

SEQ ID NO: 1337347 - RNA, 17 nt, Mycobacterium tuberculosis H37Rv
cccagguguguggcggc

SEQ ID NO: 1337348 - RNA, 19 nt, Mycobacterium tuberculosis H37Rv
cccagguguguggcggcgu

SEQ ID NO: 1337349 - RNA, 21 nt, Mycobacterium tuberculosis H37Rv
cccaggugggccgagagcagc

SEQ ID NO: 1337350 - RNA, 18 nt, Mycobacterium tuberculosis H37Rv
cccaggugguucaaccgg

SEQ ID NO: 1337351 - RNA, 17 nt, Mycobacterium tuberculosis H37Rv
cccaguaaguccucgau

SEQ ID NO: 1337352 - RNA, 16 nt, Mycobacterium tuberculosis H37Rv
cccauacgugccgccg

SEQ ID NO: 1337353 - RNA, 23 nt, Mycobacterium tuberculosis H37Rv
cccauaccuucggcgaucuugac

SEQ ID NO: 1337354 - RNA, 18 nt, Mycobacterium tuberculosis H37Rv
cccaucgaccgcccgcca

SEQ ID NO: 1337355 - RNA, 23 nt, Mycobacterium tuberculosis H37Rv
cccaucgcgacuagacgccgccg

SEQ ID NO: 1337356 - RNA, 15 nt, Mycobacterium tuberculosis H37Rv
cccauagcaccucga

SEQ ID NO: 1337357 - RNA, 15 nt, Mycobacterium tuberculosis H37Rv
cccaucaccgccagc

SEQ ID NO: 1337358 - RNA, 14 nt, Mycobacterium tuberculosis H37Rv
cccaucaccagcgg

SEQ ID NO: 1337359 - RNA, 15 nt, Mycobacterium tuberculosis H37Rv
cccaucagcccucgg

SEQ ID NO: 1337360 - RNA, 14 nt, Mycobacterium tuberculosis H37Rv
cccagcgauucagc

SEQ ID NO: 1337361 - RNA, 14 nt, Mycobacterium tuberculosis H37Rv
cccagcgcagcagc

SEQ ID NO: 1337362 - RNA, 22 nt, Mycobacterium tuberculosis H37Rv
cccagcgacucggccaggauga

SEQ ID NO: 1337363 - RNA, 14 nt, Mycobacterium tuberculosis H37Rv
cccagcgagguggg

SEQ ID NO: 1337364 - RNA, 13 nt, Mycobacterium tuberculosis H37Rv
cccagcgccaccg

SEQ ID NO: 1337365 - RNA, 23 nt, Mycobacterium tuberculosis H37Rv
cccagcgcccggccacuccagua

SEQ ID NO: 1337366 - RNA, 13 nt, Mycobacterium tuberculosis H37Rv
cccagcgccucca

SEQ ID NO: 1337367 - RNA, 16 nt, Mycobacterium tuberculosis H37Rv
cccagcgcccccagca

SEQ ID NO: 1337368 - RNA, 17 nt, Mycobacterium tuberculosis H37Rv
cccagcgcccggccacu

SEQ ID NO: 1337369 - RNA, 15 nt, Mycobacterium tuberculosis H37Rv
cccagcgcccggcca

SEQ ID NO: 1337370 - RNA, 23 nt, Mycobacterium tuberculosis H37Rv
cccagcgcuagccgggcgcgccg

SEQ ID NO: 1337371 - RNA, 14 nt, Mycobacterium tuberculosis H37Rv
cccagcgcuagccg

SEQ ID NO: 1337372 - RNA, 15 nt, Mycobacterium tuberculosis H37Rv
cccagcggaaucacc

SEQ ID NO: 1337373 - RNA, 19 nt, Mycobacterium tuberculosis H37Rv
cccagcggagccacucggc

SEQ ID NO: 1337374 - RNA, 15 nt, Mycobacterium tuberculosis H37Rv
cccagcggccgcgau

SEQ ID NO: 1337375 - RNA, 23 nt, Mycobacterium tuberculosis H37Rv
cccagcgggacaaaaucagcagc

SEQ ID NO: 1337376 - RNA, 18 nt, Mycobacterium tuberculosis H37Rv
cccagcgccuccagcacc

SEQ ID NO: 1337377 - RNA, 16 nt, Mycobacterium tuberculosis H37Rv
cccagcgccuccagca

SEQ ID NO: 1337378 - RNA, 14 nt, Mycobacterium tuberculosis H37Rv
cccagcgcccgccg

SEQ ID NO: 1337379 - RNA, 14 nt, Mycobacterium tuberculosis H37Rv
cccagcgcgcggag

SEQ ID NO: 1337380 - RNA, 20 nt, Mycobacterium tuberculosis H37Rv
cccagcgcgcgguggccaac

SEQ ID NO: 1337381 - RNA, 16 nt, Mycobacterium tuberculosis H37Rv
cccagcgcggcaacuc

SEQ ID NO: 1337382 - RNA, 17 nt, Mycobacterium tuberculosis H37Rv
cccagcucccgcggcgc

SEQ ID NO: 1337383 - RNA, 15 nt, Mycobacterium tuberculosis H37Rv
cccagcugggucccg

SEQ ID NO: 1337384 - RNA, 12 nt, Mycobacterium tuberculosis H37Rv
cccagcugcgcc

SEQ ID NO: 1337385 - RNA, 15 nt, Mycobacterium tuberculosis H37Rv
cccagcugaccagcg

SEQ ID NO: 1337386 - RNA, 15 nt, Mycobacterium tuberculosis H37Rv
cccagcugaccugaa

SEQ ID NO: 1337387 - RNA, 19 nt, Mycobacterium tuberculosis H37Rv
cccagcgugcccgccaccg

SEQ ID NO: 1337388 - RNA, 15 nt, Mycobacterium tuberculosis H37Rv
cccagcgugcccgcc

SEQ ID NO: 1337389 - RNA, 18 nt, Mycobacterium tuberculosis H37Rv
cccagcgugcccgccacc

SEQ ID NO: 1337390 - RNA, 19 nt, Mycobacterium tuberculosis H37Rv
cccagcgguaucccccagc

SEQ ID NO: 1337391 - RNA, 20 nt, Mycobacterium tuberculosis H37Rv
cccagcgggucgcgggugcc

SEQ ID NO: 1337392 - RNA, 22 nt, Mycobacterium tuberculosis H37Rv
cccaggcaaguugugagggagg

SEQ ID NO: 1337393 - RNA, 17 nt, Mycobacterium tuberculosis H37Rv
cccaggagcaccucgaa

SEQ ID NO: 1337394 - RNA, 22 nt, Mycobacterium tuberculosis H37Rv
cccagcuugcggugaucccacg

SEQ ID NO: 1337395 - RNA, 18 nt, Mycobacterium tuberculosis H37Rv
cccaggaaggcgacgccg

SEQ ID NO: 1337396 - RNA, 12 nt, Mycobacterium tuberculosis H37Rv
cccaggacaccu

SEQ ID NO: 1337397 - RNA, 14 nt, Mycobacterium tuberculosis H37Rv
cccaggacaccuug

SEQ ID NO: 1337398 - RNA, 17 nt, Mycobacterium tuberculosis H37Rv
cccagcacgcuggcguu

SEQ ID NO: 1337399 - RNA, 14 nt, Mycobacterium tuberculosis H37Rv
cccagcacgcuggc

SEQ ID NO: 1337400 - RNA, 13 nt, Mycobacterium tuberculosis H37Rv
cccagcacccuca

SEQ ID NO: 1337401 - RNA, 21 nt, Mycobacterium tuberculosis H37Rv
cccagcacccuguuccagcgg

SEQ ID NO: 1337402 - RNA, 22 nt, Mycobacterium tuberculosis H37Rv
cccagcaccaccgcggugugcg

SEQ ID NO: 1337403 - RNA, 17 nt, Mycobacterium tuberculosis H37Rv
cccagcacaaccagcug

SEQ ID NO: 1337404 - RNA, 19 nt, Mycobacterium tuberculosis H37Rv
cccagacaauccgccgccg

SEQ ID NO: 1337405 - RNA, 13 nt, Mycobacterium tuberculosis H37Rv
cccagcacgguca

SEQ ID NO: 1337406 - RNA, 21 nt, Mycobacterium tuberculosis H37Rv
cccagcagcaccugcaccgca

SEQ ID NO: 1337407 - RNA, 12 nt, Mycobacterium tuberculosis H37Rv
cccagcccaugu

SEQ ID NO: 1337408 - RNA, 13 nt, Mycobacterium tuberculosis H37Rv
cccagcccagccg

SEQ ID NO: 1337409 - RNA, 17 nt, Mycobacterium tuberculosis H37Rv
cccagccgugcccaagc

SEQ ID NO: 1337410 - RNA, 19 nt, Mycobacterium tuberculosis H37Rv
cccagcgaaucacccgcga

SEQ ID NO: 1337411 - RNA, 15 nt, Mycobacterium tuberculosis H37Rv
cccagcgacucggcc

SEQ ID NO: 1337412 - RNA, 18 nt, Mycobacterium tuberculosis H37Rv
cccagcccuuggcgcgca

SEQ ID NO: 1337413 - RNA, 23 nt, Mycobacterium tuberculosis H37Rv
cccagcccuuggcgcgcagguag

SEQ ID NO: 1337414 - RNA, 15 nt, Mycobacterium tuberculosis H37Rv
cccagccgagcggcg

SEQ ID NO: 1337415 - RNA, 18 nt, Mycobacterium tuberculosis H37Rv
cccagccgagcggcggca

SEQ ID NO: 1337416 - RNA, 18 nt, Mycobacterium tuberculosis H37Rv
cccagccgccagcccguc

SEQ ID NO: 1337417 - RNA, 21 nt, Mycobacterium tuberculosis H37Rv
cccagccggaaccggacagcg

SEQ ID NO: 1337418 - RNA, 14 nt, Mycobacterium tuberculosis H37Rv
cccagccggaaggu

SEQ ID NO: 1337419 - RNA, 16 nt, Mycobacterium tuberculosis H37Rv
cccagccgcggcgcca

SEQ ID NO: 1337420 - RNA, 19 nt, Mycobacterium tuberculosis H37Rv
cccagccgcagcaccucgg

SEQ ID NO: 1337421 - RNA, 19 nt, Mycobacterium tuberculosis H37Rv
cccagccgcgccagcuccg

SEQ ID NO: 1337422 - RNA, 22 nt, Mycobacterium tuberculosis H37Rv
ccccgagcugucggcuuccucc

SEQ ID NO: 1337423 - RNA, 22 nt, Mycobacterium tuberculosis H37Rv
ccccgauagcgaccgcggcccc

SEQ ID NO: 1337424 - RNA, 21 nt, Mycobacterium tuberculosis H37Rv
ccccgauggcgucgccggccc

SEQ ID NO: 1337425 - RNA, 12 nt, Mycobacterium tuberculosis H37Rv
ccccgcggcggu

SEQ ID NO: 1337426 - RNA, 13 nt, Mycobacterium tuberculosis H37Rv
ccccgcgccugcc

SEQ ID NO: 1337427 - RNA, 15 nt, Mycobacterium tuberculosis H37Rv
ccccgcgccggccgc

SEQ ID NO: 1337428 - RNA, 16 nt, Mycobacterium tuberculosis H37Rv
ccccgcgccggccgca

SEQ ID NO: 1337429 - RNA, 12 nt, Mycobacterium tuberculosis H37Rv
ccccgccuuggc

SEQ ID NO: 1337430 - RNA, 17 nt, Mycobacterium tuberculosis H37Rv
ccccgcacgcgggaggu

SEQ ID NO: 1337431 - RNA, 22 nt, Mycobacterium tuberculosis H37Rv
ccccgccggggccgccgucgcc

SEQ ID NO: 1337432 - RNA, 13 nt, Mycobacterium tuberculosis H37Rv
ccccgccgucacc

SEQ ID NO: 1337433 - RNA, 16 nt, Mycobacterium tuberculosis H37Rv
ccccgccgucgccacc

SEQ ID NO: 1337434 - RNA, 13 nt, Mycobacterium tuberculosis H37Rv
ccccgagauccgu

SEQ ID NO: 1337435 - RNA, 16 nt, Mycobacterium tuberculosis H37Rv
ccccgagauccguccg

SEQ ID NO: 1337436 - RNA, 19 nt, Mycobacterium tuberculosis H37Rv
ccccgagcggagccgccga

SEQ ID NO: 1337437 - RNA, 17 nt, Mycobacterium tuberculosis H37Rv
cccccuuuacaccccca

SEQ ID NO: 1337438 - RNA, 18 nt, Mycobacterium tuberculosis H37Rv
cccccguuuacggcccgg

SEQ ID NO: 1337439 - RNA, 15 nt, Mycobacterium tuberculosis H37Rv
cccccguugccgccc

SEQ ID NO: 1337440 - RNA, 22 nt, Mycobacterium tuberculosis H37Rv
cccccguugccgcccgucccgc

SEQ ID NO: 1337441 - RNA, 17 nt, Mycobacterium tuberculosis H37Rv
cccccggugccgcccgc

SEQ ID NO: 1337442 - RNA, 16 nt, Mycobacterium tuberculosis H37Rv
cccccggguccgccgu

SEQ ID NO: 1337443 - RNA, 22 nt, Mycobacterium tuberculosis H37Rv
cccccgggugcgggugggacac

SEQ ID NO: 1337444 - RNA, 16 nt, Mycobacterium tuberculosis H37Rv
cccccgguaccgcccg

SEQ ID NO: 1337445 - RNA, 15 nt, Mycobacterium tuberculosis H37Rv
cccccggugccgccc

SEQ ID NO: 1337446 - RNA, 15 nt, Mycobacterium tuberculosis H37Rv
cccccggggcgcucg

SEQ ID NO: 1337447 - RNA, 16 nt, Mycobacterium tuberculosis H37Rv
ccccauacucggcggc

SEQ ID NO: 1337448 - RNA, 13 nt, Mycobacterium tuberculosis H37Rv
ccccauagcaaga

SEQ ID NO: 1337449 - RNA, 17 nt, Mycobacterium tuberculosis H37Rv
ccccaucaccaccggca

SEQ ID NO: 1337450 - RNA, 21 nt, Mycobacterium tuberculosis H37Rv
ccccaucagaaugccuggccc

SEQ ID NO: 1337451 - RNA, 13 nt, Mycobacterium tuberculosis H37Rv
ccccagcgacggc

SEQ ID NO: 1337452 - RNA, 15 nt, Mycobacterium tuberculosis H37Rv
ccccagcgccgccgc

SEQ ID NO: 1337453 - RNA, 13 nt, Mycobacterium tuberculosis H37Rv
ccccagccaugcu

SEQ ID NO: 1337454 - RNA, 14 nt, Mycobacterium tuberculosis H37Rv
cccccacggcccgu

SEQ ID NO: 1337455 - RNA, 16 nt, Mycobacterium tuberculosis H37Rv
cccccagcacccggcu

SEQ ID NO: 1337456 - RNA, 16 nt, Mycobacterium tuberculosis H37Rv
cccccagcgccgccgc

SEQ ID NO: 1337457 - RNA, 14 nt, Mycobacterium tuberculosis H37Rv
cccccagcgcccgc

SEQ ID NO: 1337458 - RNA, 15 nt, Mycobacterium tuberculosis H37Rv
cccccagcacccggc

SEQ ID NO: 1337459 - RNA, 23 nt, Mycobacterium tuberculosis H37Rv
cccccagugcacgcucggcgccg

SEQ ID NO: 1337460 - RNA, 12 nt, Mycobacterium tuberculosis H37Rv
cccccgggcccg

SEQ ID NO: 1337461 - RNA, 16 nt, Mycobacterium tuberculosis H37Rv
ccccaccgguaccgcc

SEQ ID NO: 1337462 - RNA, 19 nt, Mycobacterium tuberculosis H37Rv
ccccaccgguaccgccacu

SEQ ID NO: 1337463 - RNA, 12 nt, Mycobacterium tuberculosis H37Rv
ccccagagcugg

SEQ ID NO: 1337464 - RNA, 13 nt, Mycobacterium tuberculosis H37Rv
ccccaccggcccg

SEQ ID NO: 1337465 - RNA, 15 nt, Mycobacterium tuberculosis H37Rv
ccccaccgaagcggu

SEQ ID NO: 1337466 - RNA, 19 nt, Mycobacterium tuberculosis H37Rv
ccccagcacauucugcagc

SEQ ID NO: 1337467 - RNA, 14 nt, Mycobacterium tuberculosis H37Rv
ccccagcagggugu

SEQ ID NO: 1337468 - RNA, 14 nt, Mycobacterium tuberculosis H37Rv
cccauggcgccugu

SEQ ID NO: 1337469 - RNA, 17 nt, Mycobacterium tuberculosis H37Rv
cccauggccaccgaacg

SEQ ID NO: 1337470 - RNA, 13 nt, Mycobacterium tuberculosis H37Rv
cccaugucggcgc

SEQ ID NO: 1337471 - RNA, 19 nt, Mycobacterium tuberculosis H37Rv
cccaugucggcgcgccgca

SEQ ID NO: 1337472 - RNA, 17 nt, Mycobacterium tuberculosis H37Rv
cccaucgucgagccgcc

SEQ ID NO: 1337473 - RNA, 15 nt, Mycobacterium tuberculosis H37Rv
cccaucgggcgccca

SEQ ID NO: 1337474 - RNA, 14 nt, Mycobacterium tuberculosis H37Rv
cccaugaaggagau

SEQ ID NO: 1337475 - RNA, 19 nt, Mycobacterium tuberculosis H37Rv
cccaugcaaucggauaggu

SEQ ID NO: 1337476 - RNA, 12 nt, Mycobacterium tuberculosis H37Rv
cccaugccucca

SEQ ID NO: 1337477 - RNA, 17 nt, Mycobacterium tuberculosis H37Rv
cccaugauggccgcggc

SEQ ID NO: 1337478 - RNA, 16 nt, Mycobacterium tuberculosis H37Rv
cccaugauggccgcgg

SEQ ID NO: 1337479 - RNA, 22 nt, Mycobacterium tuberculosis H37Rv
cccaugaucccgcugaccuggg

SEQ ID NO: 1337480 - RNA, 18 nt, Mycobacterium tuberculosis H37Rv
cccgaaaccuguaccgcc

SEQ ID NO: 1337481 - RNA, 18 nt, Mycobacterium tuberculosis H37Rv
cccgaaaacugacccccu

SEQ ID NO: 1337482 - RNA, 14 nt, Mycobacterium tuberculosis H37Rv
cccgacaucgcugc

SEQ ID NO: 1337483 - RNA, 16 nt, Mycobacterium tuberculosis H37Rv
cccgacaguggucccg

SEQ ID NO: 1337484 - RNA, 19 nt, Mycobacterium tuberculosis H37Rv
ccccuuuugccgcagcauc

SEQ ID NO: 1337485 - RNA, 12 nt, Mycobacterium tuberculosis H37Rv
cccgaggcaacg

SEQ ID NO: 1337486 - RNA, 12 nt, Mycobacterium tuberculosis H37Rv
cccgaggcaccc

SEQ ID NO: 1337487 - RNA, 14 nt, Mycobacterium tuberculosis H37Rv
cccgaggcaacaag

SEQ ID NO: 1337488 - RNA, 17 nt, Mycobacterium tuberculosis H37Rv
cccgaggcaacaagcac

SEQ ID NO: 1337489 - RNA, 16 nt, Mycobacterium tuberculosis H37Rv
cccgagccgcugcgac

SEQ ID NO: 1337490 - RNA, 11 nt, Mycobacterium tuberculosis H37Rv
cccgagccugg

SEQ ID NO: 1337491 - RNA, 12 nt, Mycobacterium tuberculosis H37Rv
cccgagcccgcc

SEQ ID NO: 1337492 - RNA, 17 nt, Mycobacterium tuberculosis H37Rv
cccgacgcagcuugccc

SEQ ID NO: 1337493 - RNA, 13 nt, Mycobacterium tuberculosis H37Rv
cccgaccacugau

SEQ ID NO: 1337494 - RNA, 18 nt, Mycobacterium tuberculosis H37Rv
cccgaccagcaccagaac

SEQ ID NO: 1337495 - RNA, 12 nt, Mycobacterium tuberculosis H37Rv
cccgaccgccac

SEQ ID NO: 1337496 - RNA, 15 nt, Mycobacterium tuberculosis H37Rv
cccgaccgccaccgc

SEQ ID NO: 1337497 - RNA, 17 nt, Mycobacterium tuberculosis H37Rv
cccgaccgccgagcggg

SEQ ID NO: 1337498 - RNA, 21 nt, Mycobacterium tuberculosis H37Rv
cccgacgacggcaccgaugca

SEQ ID NO: 1337499 - RNA, 12 nt, Mycobacterium tuberculosis H37Rv
cccgacgagauu

SEQ ID NO: 1337500 - RNA, 18 nt, Mycobacterium tuberculosis H37Rv
ccccggugcagaugcggc

SEQ ID NO: 1337501 - RNA, 15 nt, Mycobacterium tuberculosis H37Rv
ccccgcuacgcgcgc

SEQ ID NO: 1337502 - RNA, 22 nt, Mycobacterium tuberculosis H37Rv
ccccgguugacucgcuccgacc

SEQ ID NO: 1337503 - RNA, 22 nt, Mycobacterium tuberculosis H37Rv
ccccgguugaucuuguccuccg

SEQ ID NO: 1337504 - RNA, 14 nt, Mycobacterium tuberculosis H37Rv
ccccgucgaccucc

SEQ ID NO: 1337505 - RNA, 13 nt, Mycobacterium tuberculosis H37Rv
ccccgucgccacc

SEQ ID NO: 1337506 - RNA, 17 nt, Mycobacterium tuberculosis H37Rv
ccccgucagcgggcagc

SEQ ID NO: 1337507 - RNA, 17 nt, Mycobacterium tuberculosis H37Rv
ccccguaggcgccgaac

SEQ ID NO: 1337508 - RNA, 13 nt, Mycobacterium tuberculosis H37Rv
ccccgucugcgug

SEQ ID NO: 1337509 - RNA, 12 nt, Mycobacterium tuberculosis H37Rv
ccccgucgccac

SEQ ID NO: 1337510 - RNA, 16 nt, Mycobacterium tuberculosis H37Rv
ccccgucgccaccgau

SEQ ID NO: 1337511 - RNA, 15 nt, Mycobacterium tuberculosis H37Rv
ccccuccgggcgcac

SEQ ID NO: 1337512 - RNA, 13 nt, Mycobacterium tuberculosis H37Rv
ccccucggccgcc

SEQ ID NO: 1337513 - RNA, 18 nt, Mycobacterium tuberculosis H37Rv
ccccucuagcgccucgcc

SEQ ID NO: 1337514 - RNA, 14 nt, Mycobacterium tuberculosis H37Rv
ccccucggccgccc

SEQ ID NO: 1337515 - RNA, 19 nt, Mycobacterium tuberculosis H37Rv
ccccugaaucaccggagcg

SEQ ID NO: 1337516 - RNA, 16 nt, Mycobacterium tuberculosis H37Rv
cccgccauugccgccg

SEQ ID NO: 1337517 - RNA, 14 nt, Mycobacterium tuberculosis H37Rv
cccgccaucugccu

SEQ ID NO: 1337518 - RNA, 15 nt, Mycobacterium tuberculosis H37Rv
cccgccaucugccug

SEQ ID NO: 1337519 - RNA, 23 nt, Mycobacterium tuberculosis H37Rv
cccgccauugccgccggcgccgc

SEQ ID NO: 1337520 - RNA, 18 nt, Mycobacterium tuberculosis H37Rv
cccgccauugccgccguc

SEQ ID NO: 1337521 - RNA, 21 nt, Mycobacterium tuberculosis H37Rv
cccgccauugccgccgucgcc

SEQ ID NO: 1337522 - RNA, 17 nt, Mycobacterium tuberculosis H37Rv
cccgccgacgaccgccu

SEQ ID NO: 1337523 - RNA, 14 nt, Mycobacterium tuberculosis H37Rv
cccgccgaccgaca

SEQ ID NO: 1337524 - RNA, 19 nt, Mycobacterium tuberculosis H37Rv
cccgccgaugaugcggcgc

SEQ ID NO: 1337525 - RNA, 16 nt, Mycobacterium tuberculosis H37Rv
cccgccgaucacuguc

SEQ ID NO: 1337526 - RNA, 20 nt, Mycobacterium tuberculosis H37Rv
cccgccgacgccgccggccc

SEQ ID NO: 1337527 - RNA, 16 nt, Mycobacterium tuberculosis H37Rv
cccgccgacgccgccg

SEQ ID NO: 1337528 - RNA, 20 nt, Mycobacterium tuberculosis H37Rv
cccgccgagcgguugccuuc

SEQ ID NO: 1337529 - RNA, 23 nt, Mycobacterium tuberculosis H37Rv
cccgccgaugaugcggcgcagcg

SEQ ID NO: 1337530 - RNA, 17 nt, Mycobacterium tuberculosis H37Rv
cccgccgaugccgccgc

SEQ ID NO: 1337531 - RNA, 17 nt, Mycobacterium tuberculosis H37Rv
cccgccgccaccagcug

SEQ ID NO: 1337532 - RNA, 20 nt, Mycobacterium tuberculosis H37Rv
cccgccaccgcgacaccccg

SEQ ID NO: 1337533 - RNA, 18 nt, Mycobacterium tuberculosis H37Rv
cccgccacguacuccacc

SEQ ID NO: 1337534 - RNA, 20 nt, Mycobacterium tuberculosis H37Rv
cccgccacguacuccaccgc

SEQ ID NO: 1337535 - RNA, 16 nt, Mycobacterium tuberculosis H37Rv
cccgccacgaugucgu

SEQ ID NO: 1337536 - RNA, 21 nt, Mycobacterium tuberculosis H37Rv
cccgccagggcggcaucccca

SEQ ID NO: 1337537 - RNA, 17 nt, Mycobacterium tuberculosis H37Rv
cccgccagcgccgccgc

SEQ ID NO: 1337538 - RNA, 14 nt, Mycobacterium tuberculosis H37Rv
cccgccagcccagc

SEQ ID NO: 1337539 - RNA, 17 nt, Mycobacterium tuberculosis H37Rv
cccgccagcagggccag

SEQ ID NO: 1337540 - RNA, 20 nt, Mycobacterium tuberculosis H37Rv
cccgccagcgauccaccaag

SEQ ID NO: 1337541 - RNA, 16 nt, Mycobacterium tuberculosis H37Rv
cccgccagcgccgccg

SEQ ID NO: 1337542 - RNA, 15 nt, Mycobacterium tuberculosis H37Rv
cccgaguugaagaau

SEQ ID NO: 1337543 - RNA, 22 nt, Mycobacterium tuberculosis H37Rv
cccgaguggccggugggccgcc

SEQ ID NO: 1337544 - RNA, 23 nt, Mycobacterium tuberculosis H37Rv
cccgaguggccggugggccgccc

SEQ ID NO: 1337545 - RNA, 17 nt, Mycobacterium tuberculosis H37Rv
cccgaguuaaacgcagc

SEQ ID NO: 1337546 - RNA, 18 nt, Mycobacterium tuberculosis H37Rv
cccgaguuaaacgcagcg

SEQ ID NO: 1337547 - RNA, 18 nt, Mycobacterium tuberculosis H37Rv
cccgagucgaaaccgccc

SEQ ID NO: 1337548 - RNA, 23 nt, Mycobacterium tuberculosis H37Rv
cccgaguugaaggugccggcguu

SEQ ID NO: 1337549 - RNA, 23 nt, Mycobacterium tuberculosis H37Rv
cccgcaaaaucgucagcgccgcc

SEQ ID NO: 1337550 - RNA, 21 nt, Mycobacterium tuberculosis H37Rv
cccgcaaaaucgucagcgccg

SEQ ID NO: 1337551 - RNA, 23 nt, Mycobacterium tuberculosis H37Rv
cccgcaacgacugaucaagugcc

SEQ ID NO: 1337552 - RNA, 23 nt, Mycobacterium tuberculosis H37Rv
cccgcaacuacggcguccccgac

SEQ ID NO: 1337553 - RNA, 18 nt, Mycobacterium tuberculosis H37Rv
cccgcaccaccggcccca

SEQ ID NO: 1337554 - RNA, 15 nt, Mycobacterium tuberculosis H37Rv
cccgcaccccggccg

SEQ ID NO: 1337555 - RNA, 15 nt, Mycobacterium tuberculosis H37Rv
cccgcacccggccca

SEQ ID NO: 1337556 - RNA, 13 nt, Mycobacterium tuberculosis H37Rv
cccgcaccacacc

SEQ ID NO: 1337557 - RNA, 16 nt, Mycobacterium tuberculosis H37Rv
cccgcaccaccggccc

SEQ ID NO: 1337558 - RNA, 15 nt, Mycobacterium tuberculosis H37Rv
cccgcacugccgccg

SEQ ID NO: 1337559 - RNA, 13 nt, Mycobacterium tuberculosis H37Rv
cccgcagcagcau

SEQ ID NO: 1337560 - RNA, 13 nt, Mycobacterium tuberculosis H37Rv
cccgcaccgcguu

SEQ ID NO: 1337561 - RNA, 21 nt, Mycobacterium tuberculosis H37Rv
cccgcaccgcguucugguugu

SEQ ID NO: 1337562 - RNA, 13 nt, Mycobacterium tuberculosis H37Rv
cccgcacccccga

SEQ ID NO: 1337563 - RNA, 18 nt, Mycobacterium tuberculosis H37Rv
cccgcacgaagccggcuu

SEQ ID NO: 1337564 - RNA, 23 nt, Mycobacterium tuberculosis H37Rv
cccgcacgaguuaccgguggugc

SEQ ID NO: 1337565 - RNA, 15 nt, Mycobacterium tuberculosis H37Rv
cccgccacagcccca

SEQ ID NO: 1337566 - RNA, 16 nt, Mycobacterium tuberculosis H37Rv
cccgccacagccccag

SEQ ID NO: 1337567 - RNA, 14 nt, Mycobacterium tuberculosis H37Rv
cccgccaaccccaa

SEQ ID NO: 1337568 - RNA, 17 nt, Mycobacterium tuberculosis H37Rv
cccgcauugccaacgcc

SEQ ID NO: 1337569 - RNA, 13 nt, Mycobacterium tuberculosis H37Rv
cccgcagaccgcc

SEQ ID NO: 1337570 - RNA, 15 nt, Mycobacterium tuberculosis H37Rv
cccgcagcccgccgg

SEQ ID NO: 1337571 - RNA, 19 nt, Mycobacterium tuberculosis H37Rv
cccgcagcgcuuccagguc

SEQ ID NO: 1337572 - RNA, 18 nt, Mycobacterium tuberculosis H37Rv
cccugacggcaucugaaa

SEQ ID NO: 1337573 - RNA, 14 nt, Mycobacterium tuberculosis H37Rv
cccugagcucccgc

SEQ ID NO: 1337574 - RNA, 19 nt, Mycobacterium tuberculosis H37Rv
cccugagcgaagugucgcu

SEQ ID NO: 1337575 - RNA, 21 nt, Mycobacterium tuberculosis H37Rv
cccugaugugaguccagccgg

SEQ ID NO: 1337576 - RNA, 19 nt, Mycobacterium tuberculosis H37Rv
cccugaugaucguccagcc

SEQ ID NO: 1337577 - RNA, 21 nt, Mycobacterium tuberculosis H37Rv
cccugaugaucguccagccca

SEQ ID NO: 1337578 - RNA, 20 nt, Mycobacterium tuberculosis H37Rv
cccugaagggccgccucgcg

SEQ ID NO: 1337579 - RNA, 16 nt, Mycobacterium tuberculosis H37Rv
cccugaagggccgccu

SEQ ID NO: 1337580 - RNA, 17 nt, Mycobacterium tuberculosis H37Rv
cccugacccggagccgc

SEQ ID NO: 1337581 - RNA, 20 nt, Mycobacterium tuberculosis H37Rv
cccugacccggagccgccag

SEQ ID NO: 1337582 - RNA, 13 nt, Mycobacterium tuberculosis H37Rv
cccugacacccau

SEQ ID NO: 1337583 - RNA, 12 nt, Mycobacterium tuberculosis H37Rv
cccugcccggcc

SEQ ID NO: 1337584 - RNA, 19 nt, Mycobacterium tuberculosis H37Rv
cccugccgccggccccgcc

SEQ ID NO: 1337585 - RNA, 12 nt, Mycobacterium tuberculosis H37Rv
cccugccggcag

SEQ ID NO: 1337586 - RNA, 16 nt, Mycobacterium tuberculosis H37Rv
cccugcggccacggug

SEQ ID NO: 1337587 - RNA, 13 nt, Mycobacterium tuberculosis H37Rv
cccugggcuggcu

SEQ ID NO: 1337588 - RNA, 17 nt, Mycobacterium tuberculosis H37Rv
cccugcucgaacgcuga

SEQ ID NO: 1337589 - RNA, 21 nt, Mycobacterium tuberculosis H37Rv
cccucacguggacugaccucg

SEQ ID NO: 1337590 - RNA, 23 nt, Mycobacterium tuberculosis H37Rv
cccucaccgccugugccgccggc

SEQ ID NO: 1337591 - RNA, 15 nt, Mycobacterium tuberculosis H37Rv
cccucagccgcgccg

SEQ ID NO: 1337592 - RNA, 19 nt, Mycobacterium tuberculosis H37Rv
cccucagcuagcgcgggcu

SEQ ID NO: 1337593 - RNA, 18 nt, Mycobacterium tuberculosis H37Rv
cccucaacgucccagccc

SEQ ID NO: 1337594 - RNA, 14 nt, Mycobacterium tuberculosis H37Rv
cccuccacagcggc

SEQ ID NO: 1337595 - RNA, 21 nt, Mycobacterium tuberculosis H37Rv
cccuccagauaccaccgccgc

SEQ ID NO: 1337596 - RNA, 23 nt, Mycobacterium tuberculosis H37Rv
cccuccgagcacaggaucaccca

SEQ ID NO: 1337597 - RNA, 13 nt, Mycobacterium tuberculosis H37Rv
cccucccaccagc

SEQ ID NO: 1337598 - RNA, 22 nt, Mycobacterium tuberculosis H37Rv
cccuccggacccacccgcaccg

SEQ ID NO: 1337599 - RNA, 18 nt, Mycobacterium tuberculosis H37Rv
cccuccggacccacccgc

SEQ ID NO: 1337600 - RNA, 20 nt, Mycobacterium tuberculosis H37Rv
cccucguuaucgaccgccgc

SEQ ID NO: 1337601 - RNA, 22 nt, Mycobacterium tuberculosis H37Rv
cccucggcggagacggcggcca

SEQ ID NO: 1337602 - RNA, 18 nt, Mycobacterium tuberculosis H37Rv
cccucgucgaucgccgcg

SEQ ID NO: 1337603 - RNA, 21 nt, Mycobacterium tuberculosis H37Rv
cccucgguguacaccgcgccc

SEQ ID NO: 1337604 - RNA, 19 nt, Mycobacterium tuberculosis H37Rv
cccucgggacugcgcggcu

SEQ ID NO: 1337605 - RNA, 14 nt, Mycobacterium tuberculosis H37Rv
cccucggcgaccug

SEQ ID NO: 1337606 - RNA, 24 nt, Mycobacterium tuberculosis H37Rv
cccucgcgaaauaacggagcggcc

SEQ ID NO: 1337607 - RNA, 20 nt, Mycobacterium tuberculosis H37Rv
cccucgaauucggccggcgc

SEQ ID NO: 1337608 - RNA, 18 nt, Mycobacterium tuberculosis H37Rv
cccucgaauucggccggc

SEQ ID NO: 1337609 - RNA, 15 nt, Mycobacterium tuberculosis H37Rv
cccuccggcgcagcg

SEQ ID NO: 1337610 - RNA, 14 nt, Mycobacterium tuberculosis H37Rv
cccucgcaaccggc

SEQ ID NO: 1337611 - RNA, 18 nt, Mycobacterium tuberculosis H37Rv
cccucgaucacggcggcc

SEQ ID NO: 1337612 - RNA, 15 nt, Mycobacterium tuberculosis H37Rv
cccgguggugcugcc

SEQ ID NO: 1337613 - RNA, 23 nt, Mycobacterium tuberculosis H37Rv
cccgguguucaucacgccgccgg

SEQ ID NO: 1337614 - RNA, 20 nt, Mycobacterium tuberculosis H37Rv
cccguaggugcacaacccgu

SEQ ID NO: 1337615 - RNA, 18 nt, Mycobacterium tuberculosis H37Rv
cccguauugaugcugccc

SEQ ID NO: 1337616 - RNA, 20 nt, Mycobacterium tuberculosis H37Rv
cccguauugccaaagcccga

SEQ ID NO: 1337617 - RNA, 17 nt, Mycobacterium tuberculosis H37Rv
cccggugccgcccgcgc

SEQ ID NO: 1337618 - RNA, 22 nt, Mycobacterium tuberculosis H37Rv
cccggugccgcccgcgccuccg

SEQ ID NO: 1337619 - RNA, 22 nt, Mycobacterium tuberculosis H37Rv
cccggugaguccggagacucuc

SEQ ID NO: 1337620 - RNA, 17 nt, Mycobacterium tuberculosis H37Rv
cccggugaugaagcgcg

SEQ ID NO: 1337621 - RNA, 22 nt, Mycobacterium tuberculosis H37Rv
cccggugaugaccggacgcuga

SEQ ID NO: 1337622 - RNA, 13 nt, Mycobacterium tuberculosis H37Rv
cccggugaccacu

SEQ ID NO: 1337623 - RNA, 16 nt, Mycobacterium tuberculosis H37Rv
cccggugacgccgucg

SEQ ID NO: 1337624 - RNA, 14 nt, Mycobacterium tuberculosis H37Rv
cccggugccggcgg

SEQ ID NO: 1337625 - RNA, 18 nt, Mycobacterium tuberculosis H37Rv
cccggugcggaucugcug

SEQ ID NO: 1337626 - RNA, 17 nt, Mycobacterium tuberculosis H37Rv
cccgggugcgcucuucu

SEQ ID NO: 1337627 - RNA, 13 nt, Mycobacterium tuberculosis H37Rv
cccgggcagcccc

SEQ ID NO: 1337628 - RNA, 22 nt, Mycobacterium tuberculosis H37Rv
cccgggccgccagggcccuagc

SEQ ID NO: 1337629 - RNA, 13 nt, Mycobacterium tuberculosis H37Rv
cccgggccgccgc

SEQ ID NO: 1337630 - RNA, 17 nt, Mycobacterium tuberculosis H37Rv
cccgggccaguucgucg

SEQ ID NO: 1337631 - RNA, 21 nt, Mycobacterium tuberculosis H37Rv
cccgggccaucgcauccccag

SEQ ID NO: 1337632 - RNA, 15 nt, Mycobacterium tuberculosis H37Rv
cccgguacgccgcgc

SEQ ID NO: 1337633 - RNA, 14 nt, Mycobacterium tuberculosis H37Rv
cccgguacgccgcg

SEQ ID NO: 1337634 - RNA, 15 nt, Mycobacterium tuberculosis H37Rv
cccgguagccccguc

SEQ ID NO: 1337635 - RNA, 19 nt, Mycobacterium tuberculosis H37Rv
cccgguacgucgaggguga

SEQ ID NO: 1337636 - RNA, 16 nt, Mycobacterium tuberculosis H37Rv
cccgguagcggcggca

SEQ ID NO: 1337637 - RNA, 14 nt, Mycobacterium tuberculosis H37Rv
cccggucaacguga

SEQ ID NO: 1337638 - RNA, 11 nt, Mycobacterium tuberculosis H37Rv
cccgccgcgac

SEQ ID NO: 1337639 - RNA, 17 nt, Mycobacterium tuberculosis H37Rv
cccgccgcgaccacgca

SEQ ID NO: 1337640 - RNA, 21 nt, Mycobacterium tuberculosis H37Rv
cccgccgcgaccacgcaccgc

SEQ ID NO: 1337641 - RNA, 21 nt, Mycobacterium tuberculosis H37Rv
cccgccggccccgccggcccc

SEQ ID NO: 1337642 - RNA, 22 nt, Mycobacterium tuberculosis H37Rv
cccgccggccccgccggccccg

SEQ ID NO: 1337643 - RNA, 15 nt, Mycobacterium tuberculosis H37Rv
cccgccgccccacaa

SEQ ID NO: 1337644 - RNA, 15 nt, Mycobacterium tuberculosis H37Rv
cccgccggguccgcc

SEQ ID NO: 1337645 - RNA, 17 nt, Mycobacterium tuberculosis H37Rv
cccgccggguccgccgg

SEQ ID NO: 1337646 - RNA, 21 nt, Mycobacterium tuberculosis H37Rv
cccgccggguccgccgggccc

SEQ ID NO: 1337647 - RNA, 16 nt, Mycobacterium tuberculosis H37Rv
cccgccggggccgccg

SEQ ID NO: 1337648 - RNA, 17 nt, Mycobacterium tuberculosis H37Rv
cccgccgggaugccucg

SEQ ID NO: 1337649 - RNA, 16 nt, Mycobacterium tuberculosis H37Rv
cccgccggcuccgcca

SEQ ID NO: 1337650 - RNA, 20 nt, Mycobacterium tuberculosis H37Rv
cccgccgucuuggcccgguc

SEQ ID NO: 1337651 - RNA, 18 nt, Mycobacterium tuberculosis H37Rv
cccgccgucaccgccguu

SEQ ID NO: 1337652 - RNA, 18 nt, Mycobacterium tuberculosis H37Rv
cccgccggguuggucuuc

SEQ ID NO: 1337653 - RNA, 15 nt, Mycobacterium tuberculosis H37Rv
cccgccgucaccgcc

SEQ ID NO: 1337654 - RNA, 16 nt, Mycobacterium tuberculosis H37Rv
cccgccgucacccccg

SEQ ID NO: 1337655 - RNA, 16 nt, Mycobacterium tuberculosis H37Rv
cccgggaugaccaccg

SEQ ID NO: 1337656 - RNA, 23 nt, Mycobacterium tuberculosis H37Rv
cccgggauaguuuucggccgcca

SEQ ID NO: 1337657 - RNA, 18 nt, Mycobacterium tuberculosis H37Rv
cccgggcagccugcugca

SEQ ID NO: 1337658 - RNA, 15 nt, Mycobacterium tuberculosis H37Rv
cccgggcagcaccag

SEQ ID NO: 1337659 - RNA, 11 nt, Mycobacterium tuberculosis H37Rv
cccgggcaccg

SEQ ID NO: 1337660 - RNA, 15 nt, Mycobacterium tuberculosis H37Rv
cccggcuucgccgcg

SEQ ID NO: 1337661 - RNA, 16 nt, Mycobacterium tuberculosis H37Rv
cccggcuucgccgcgc

SEQ ID NO: 1337662 - RNA, 17 nt, Mycobacterium tuberculosis H37Rv
cccggcuuucccaccgc

SEQ ID NO: 1337663 - RNA, 12 nt, Mycobacterium tuberculosis H37Rv
cccggcuccagc

SEQ ID NO: 1337664 - RNA, 18 nt, Mycobacterium tuberculosis H37Rv
cccggcucggugcgccag

SEQ ID NO: 1337665 - RNA, 20 nt, Mycobacterium tuberculosis H37Rv
cccggcugccagcgccgccg

SEQ ID NO: 1337666 - RNA, 14 nt, Mycobacterium tuberculosis H37Rv
cccggcugcgccgg

SEQ ID NO: 1337667 - RNA, 16 nt, Mycobacterium tuberculosis H37Rv
cccggcuggggccgcu

SEQ ID NO: 1337668 - RNA, 22 nt, Mycobacterium tuberculosis H37Rv
cccgugagauccuccaauugcg

SEQ ID NO: 1337669 - RNA, 12 nt, Mycobacterium tuberculosis H37Rv
cccgucuuccag

SEQ ID NO: 1337670 - RNA, 21 nt, Mycobacterium tuberculosis H37Rv
cccgugccgcccgcgccgccc

SEQ ID NO: 1337671 - RNA, 12 nt, Mycobacterium tuberculosis H37Rv
cccguccaggcc

SEQ ID NO: 1337672 - RNA, 16 nt, Mycobacterium tuberculosis H37Rv
cccgucgggugcugau

SEQ ID NO: 1337673 - RNA, 14 nt, Mycobacterium tuberculosis H37Rv
cccguuccacgauc

SEQ ID NO: 1337674 - RNA, 22 nt, Mycobacterium tuberculosis H37Rv
cccgugcuuuccuugcgcgcca

SEQ ID NO: 1337675 - RNA, 21 nt, Mycobacterium tuberculosis H37Rv
cccguggcggugagccgccag

SEQ ID NO: 1337676 - RNA, 14 nt, Mycobacterium tuberculosis H37Rv
cccgugcgcgcgca

SEQ ID NO: 1337677 - RNA, 13 nt, Mycobacterium tuberculosis H37Rv
cccuauacgcaac

SEQ ID NO: 1337678 - RNA, 19 nt, Mycobacterium tuberculosis H37Rv
cccuagcuggugcgcccga

SEQ ID NO: 1337679 - RNA, 14 nt, Mycobacterium tuberculosis H37Rv
cccguucgccgucg

SEQ ID NO: 1337680 - RNA, 15 nt, Mycobacterium tuberculosis H37Rv
cccguuggccaagaa

SEQ ID NO: 1337681 - RNA, 16 nt, Mycobacterium tuberculosis H37Rv
cccguucucgcggccg

SEQ ID NO: 1337682 - RNA, 18 nt, Mycobacterium tuberculosis H37Rv
cccuucagcgaagccggg

SEQ ID NO: 1337683 - RNA, 18 nt, Mycobacterium tuberculosis H37Rv
cccuggggccguccggcu

SEQ ID NO: 1337684 - RNA, 23 nt, Mycobacterium tuberculosis H37Rv
cccuggggguggcagcgcggccg

SEQ ID NO: 1337685 - RNA, 15 nt, Mycobacterium tuberculosis H37Rv
cccugguccaggccc

SEQ ID NO: 1337686 - RNA, 21 nt, Mycobacterium tuberculosis H37Rv
cccugguggucagucaccaac

SEQ ID NO: 1337687 - RNA, 13 nt, Mycobacterium tuberculosis H37Rv
ccgaaaacaaccc

SEQ ID NO: 1337688 - RNA, 23 nt, Mycobacterium tuberculosis H37Rv
ccgaaaaccucgccccaccggcc

SEQ ID NO: 1337689 - RNA, 20 nt, Mycobacterium tuberculosis H37Rv
ccgaaaacgacaucaccacc

SEQ ID NO: 1337690 - RNA, 16 nt, Mycobacterium tuberculosis H37Rv
ccgaaaacugaccccc

SEQ ID NO: 1337691 - RNA, 23 nt, Mycobacterium tuberculosis H37Rv
aaacagcauggcgaagaacaaca

SEQ ID NO: 1337692 - RNA, 17 nt, Mycobacterium tuberculosis H37Rv
aaacagcuugcugcgca

SEQ ID NO: 1337693 - RNA, 18 nt, Mycobacterium tuberculosis H37Rv
aaacaucgcacccaccac

SEQ ID NO: 1337694 - RNA, 12 nt, Mycobacterium tuberculosis H37Rv
ccgaagaugccu

SEQ ID NO: 1337695 - RNA, 15 nt, Mycobacterium tuberculosis H37Rv
ccgaagagcgcgcgc

SEQ ID NO: 1337696 - RNA, 11 nt, Mycobacterium tuberculosis H37Rv
ccgaagccccc

SEQ ID NO: 1337697 - RNA, 13 nt, Mycobacterium tuberculosis H37Rv
ccgaagccgcgca

SEQ ID NO: 1337698 - RNA, 14 nt, Mycobacterium tuberculosis H37Rv
ccgaagcagaacag

SEQ ID NO: 1337699 - RNA, 14 nt, Mycobacterium tuberculosis H37Rv
ccgaagcgcccguu

SEQ ID NO: 1337700 - RNA, 20 nt, Mycobacterium tuberculosis H37Rv
ccgaaucugccggccggcgg

SEQ ID NO: 1337701 - RNA, 16 nt, Mycobacterium tuberculosis H37Rv
ccgaauaccgccgcgc

SEQ ID NO: 1337702 - RNA, 17 nt, Mycobacterium tuberculosis H37Rv
ccgaaucagcacggugu

SEQ ID NO: 1337703 - RNA, 18 nt, Mycobacterium tuberculosis H37Rv
ccgaaucgccugccacag

SEQ ID NO: 1337704 - RNA, 16 nt, Mycobacterium tuberculosis H37Rv
ccgaacauucccaugc

SEQ ID NO: 1337705 - RNA, 21 nt, Mycobacterium tuberculosis H37Rv
ccgaacggguagacccacauc

SEQ ID NO: 1337706 - RNA, 14 nt, Mycobacterium tuberculosis H37Rv
ccgaacgcuccagg

SEQ ID NO: 1337707 - RNA, 17 nt, Mycobacterium tuberculosis H37Rv
ccgaacucaacgacacc

SEQ ID NO: 1337708 - RNA, 14 nt, Mycobacterium tuberculosis H37Rv
ccgaaaaugccgcc

SEQ ID NO: 1337709 - RNA, 17 nt, Mycobacterium tuberculosis H37Rv
ccgaaaauucaggcgcc

SEQ ID NO: 1337710 - RNA, 13 nt, Mycobacterium tuberculosis H37Rv
ccgaaagccucuc

SEQ ID NO: 1337711 - RNA, 19 nt, Mycobacterium tuberculosis H37Rv
ccgaaacuucgcccgggcc

SEQ ID NO: 1337712 - RNA, 22 nt, Mycobacterium tuberculosis H37Rv
ccgaaacuucgcccgggccgcg

SEQ ID NO: 1337713 - RNA, 14 nt, Mycobacterium tuberculosis H37Rv
ccgaccggcccgca

SEQ ID NO: 1337714 - RNA, 13 nt, Mycobacterium tuberculosis H37Rv
ccgaccgggccgc

SEQ ID NO: 1337715 - RNA, 23 nt, Mycobacterium tuberculosis H37Rv
ccgaccgggcucuggccaguccg

SEQ ID NO: 1337716 - RNA, 18 nt, Mycobacterium tuberculosis H37Rv
ccgaccggguugauggcg

SEQ ID NO: 1337717 - RNA, 20 nt, Mycobacterium tuberculosis H37Rv
ccgaccugguaugccgcccg

SEQ ID NO: 1337718 - RNA, 21 nt, Mycobacterium tuberculosis H37Rv
ccgaccugguaugccgcccgc

SEQ ID NO: 1337719 - RNA, 22 nt, Mycobacterium tuberculosis H37Rv
ccgaccugguaugccgcccgca

SEQ ID NO: 1337720 - RNA, 18 nt, Mycobacterium tuberculosis H37Rv
ccgaccuaccgucgacca

SEQ ID NO: 1337721 - RNA, 21 nt, Mycobacterium tuberculosis H37Rv
ccgacgacggcgacggcgccc

SEQ ID NO: 1337722 - RNA, 19 nt, Mycobacterium tuberculosis H37Rv
ccgacgacggcgacggcgc

SEQ ID NO: 1337723 - RNA, 21 nt, Mycobacterium tuberculosis H37Rv
ccgacgaacgaaccgccgccg

SEQ ID NO: 1337724 - RNA, 14 nt, Mycobacterium tuberculosis H37Rv
ccgacgaacugcag

SEQ ID NO: 1337725 - RNA, 15 nt, Mycobacterium tuberculosis H37Rv
ccgacgaccagcaga

SEQ ID NO: 1337726 - RNA, 13 nt, Mycobacterium tuberculosis H37Rv
ccgacgaccgccu

SEQ ID NO: 1337727 - RNA, 21 nt, Mycobacterium tuberculosis H37Rv
ccgaccucguucgucaccacg

SEQ ID NO: 1337728 - RNA, 19 nt, Mycobacterium tuberculosis H37Rv
ccgaccuguaugccgcggu

SEQ ID NO: 1337729 - RNA, 15 nt, Mycobacterium tuberculosis H37Rv
ccgaccucgacgccc

SEQ ID NO: 1337730 - RNA, 15 nt, Mycobacterium tuberculosis H37Rv
ccgaccucgccgcgc

SEQ ID NO: 1337731 - RNA, 16 nt, Mycobacterium tuberculosis H37Rv
ccgaccuucggcccgc

SEQ ID NO: 1337732 - RNA, 19 nt, Mycobacterium tuberculosis H37Rv
ccgaccuuuugcggcaagc

SEQ ID NO: 1337733 - RNA, 15 nt, Mycobacterium tuberculosis H37Rv
ccgacgaugccgcgg

SEQ ID NO: 1337734 - RNA, 15 nt, Mycobacterium tuberculosis H37Rv
ccgacgagucgccgc

SEQ ID NO: 1337735 - RNA, 22 nt, Mycobacterium tuberculosis H37Rv
ccgacgagauacggccaccagg

SEQ ID NO: 1337736 - RNA, 15 nt, Mycobacterium tuberculosis H37Rv
ccgacgaggaugucg

SEQ ID NO: 1337737 - RNA, 13 nt, Mycobacterium tuberculosis H37Rv
ccgacgcagguga

SEQ ID NO: 1337738 - RNA, 20 nt, Mycobacterium tuberculosis H37Rv
ccgacgcccaggcauggccu

SEQ ID NO: 1337739 - RNA, 14 nt, Mycobacterium tuberculosis H37Rv
ccgacgccccgauc

SEQ ID NO: 1337740 - RNA, 18 nt, Mycobacterium tuberculosis H37Rv
ccgacgcgcggccagccc

SEQ ID NO: 1337741 - RNA, 20 nt, Mycobacterium tuberculosis H37Rv
ccgacgcgcucggcgaucug

SEQ ID NO: 1337742 - RNA, 16 nt, Mycobacterium tuberculosis H37Rv
ccgacuucuccaggcu

SEQ ID NO: 1337743 - RNA, 18 nt, Mycobacterium tuberculosis H37Rv
ccgacgccugggcacggc

SEQ ID NO: 1337744 - RNA, 16 nt, Mycobacterium tuberculosis H37Rv
ccgacgccgccggcgc

SEQ ID NO: 1337745 - RNA, 21 nt, Mycobacterium tuberculosis H37Rv
ccgacgccgccggcgccaccg

SEQ ID NO: 1337746 - RNA, 12 nt, Mycobacterium tuberculosis H37Rv
ccgacgccgccg

SEQ ID NO: 1337747 - RNA, 12 nt, Mycobacterium tuberculosis H37Rv
ccgacgccgcca

SEQ ID NO: 1337748 - RNA, 19 nt, Mycobacterium tuberculosis H37Rv
ccgacgccaacgccagcgg

SEQ ID NO: 1337749 - RNA, 16 nt, Mycobacterium tuberculosis H37Rv
ccgacgccaacgccag

SEQ ID NO: 1337750 - RNA, 15 nt, Mycobacterium tuberculosis H37Rv
ccgagccgcccgccc

SEQ ID NO: 1337751 - RNA, 17 nt, Mycobacterium tuberculosis H37Rv
ccgagcccuccagggcc

SEQ ID NO: 1337752 - RNA, 14 nt, Mycobacterium tuberculosis H37Rv
ccgagcccaggugg

SEQ ID NO: 1337753 - RNA, 14 nt, Mycobacterium tuberculosis H37Rv
ccgagccagcuccg

SEQ ID NO: 1337754 - RNA, 20 nt, Mycobacterium tuberculosis H37Rv
ccgagcccagcgccuccagc

SEQ ID NO: 1337755 - RNA, 13 nt, Mycobacterium tuberculosis H37Rv
ccgagcagcuccu

SEQ ID NO: 1337756 - RNA, 21 nt, Mycobacterium tuberculosis H37Rv
ccgagcagcuccuugagguca

SEQ ID NO: 1337757 - RNA, 20 nt, Mycobacterium tuberculosis H37Rv
ccgagcagggccggcaccgc

SEQ ID NO: 1337758 - RNA, 14 nt, Mycobacterium tuberculosis H37Rv
ccgagccacgaccc

SEQ ID NO: 1337759 - RNA, 18 nt, Mycobacterium tuberculosis H37Rv
ccgacuucuccaggcuga

SEQ ID NO: 1337760 - RNA, 15 nt, Mycobacterium tuberculosis H37Rv
ccgagaacgcccgag

SEQ ID NO: 1337761 - RNA, 21 nt, Mycobacterium tuberculosis H37Rv
ccgagaacgcccgagugacca

SEQ ID NO: 1337762 - RNA, 13 nt, Mycobacterium tuberculosis H37Rv
ccgagaacaccac

SEQ ID NO: 1337763 - RNA, 14 nt, Mycobacterium tuberculosis H37Rv
ccgagaacaccggc

SEQ ID NO: 1337764 - RNA, 17 nt, Mycobacterium tuberculosis H37Rv
ccgagaagacgcaaaag

SEQ ID NO: 1337765 - RNA, 22 nt, Mycobacterium tuberculosis H37Rv
ccgagaagcguugcacugcugg

SEQ ID NO: 1337766 - RNA, 22 nt, Mycobacterium tuberculosis H37Rv
ccgagcaacaccccuggguuga

SEQ ID NO: 1337767 - RNA, 21 nt, Mycobacterium tuberculosis H37Rv
ccgagcaacaccgucggcagc

SEQ ID NO: 1337768 - RNA, 13 nt, Mycobacterium tuberculosis H37Rv
ccgaccgccaccg

SEQ ID NO: 1337769 - RNA, 20 nt, Mycobacterium tuberculosis H37Rv
ccgaccgcguuguccgcggc

SEQ ID NO: 1337770 - RNA, 19 nt, Mycobacterium tuberculosis H37Rv
ccgaccgcgggucgugcca

SEQ ID NO: 1337771 - RNA, 20 nt, Mycobacterium tuberculosis H37Rv
ccgaccgaaagccgcaccag

SEQ ID NO: 1337772 - RNA, 13 nt, Mycobacterium tuberculosis H37Rv
ccgaccgaaccgu

SEQ ID NO: 1337773 - RNA, 20 nt, Mycobacterium tuberculosis H37Rv
ccgaccgauaacacccgggc

SEQ ID NO: 1337774 - RNA, 22 nt, Mycobacterium tuberculosis H37Rv
ccgaccgauaacacccgggcca

SEQ ID NO: 1337775 - RNA, 16 nt, Mycobacterium tuberculosis H37Rv
ccgaccgacaccacca

SEQ ID NO: 1337776 - RNA, 14 nt, Mycobacterium tuberculosis H37Rv
ccgacccgcccgaa

SEQ ID NO: 1337777 - RNA, 17 nt, Mycobacterium tuberculosis H37Rv
ccgacccgcgcgccggc

SEQ ID NO: 1337778 - RNA, 16 nt, Mycobacterium tuberculosis H37Rv
ccgacccgcuucgccc

SEQ ID NO: 1337779 - RNA, 23 nt, Mycobacterium tuberculosis H37Rv
ccgacccgcuucgcccggcugcg

SEQ ID NO: 1337780 - RNA, 16 nt, Mycobacterium tuberculosis H37Rv
ccgacccgccgcgccc

SEQ ID NO: 1337781 - RNA, 20 nt, Mycobacterium tuberculosis H37Rv
ccgaccaucucaccgggccc

SEQ ID NO: 1337782 - RNA, 14 nt, Mycobacterium tuberculosis H37Rv
ccgacccaacccga

SEQ ID NO: 1337783 - RNA, 13 nt, Mycobacterium tuberculosis H37Rv
ccgacccagaugg

SEQ ID NO: 1337784 - RNA, 17 nt, Mycobacterium tuberculosis H37Rv
ccgacccaucaccagcg

SEQ ID NO: 1337785 - RNA, 19 nt, Mycobacterium tuberculosis H37Rv
ccgacccaucaccagcggc

SEQ ID NO: 1337786 - RNA, 20 nt, Mycobacterium tuberculosis H37Rv
ccgaccaccccgagcggcug

SEQ ID NO: 1337787 - RNA, 14 nt, Mycobacterium tuberculosis H37Rv
ccgaccacuccacg

SEQ ID NO: 1337788 - RNA, 20 nt, Mycobacterium tuberculosis H37Rv
ccgaccagcuugaccgacca

SEQ ID NO: 1337789 - RNA, 19 nt, Mycobacterium tuberculosis H37Rv
ccgaccagcggccgaccgc

SEQ ID NO: 1337790 - RNA, 15 nt, Mycobacterium tuberculosis H37Rv
ccgaccagcacaccg

SEQ ID NO: 1337791 - RNA, 18 nt, Mycobacterium tuberculosis H37Rv
ccgacauggcggugcgca

SEQ ID NO: 1337792 - RNA, 23 nt, Mycobacterium tuberculosis H37Rv
ccgacauggcggugcgcagcuug

SEQ ID NO: 1337793 - RNA, 21 nt, Mycobacterium tuberculosis H37Rv
ccgacaugguccgaccagcgg

SEQ ID NO: 1337794 - RNA, 14 nt, Mycobacterium tuberculosis H37Rv
aaaccacuggaugg

SEQ ID NO: 1337795 - RNA, 23 nt, Mycobacterium tuberculosis H37Rv
ccgacagauggucacccacguug

SEQ ID NO: 1337796 - RNA, 17 nt, Mycobacterium tuberculosis H37Rv
ccgacagauggucgguc

SEQ ID NO: 1337797 - RNA, 14 nt, Mycobacterium tuberculosis H37Rv
ccgacagccccggc

SEQ ID NO: 1337798 - RNA, 19 nt, Mycobacterium tuberculosis H37Rv
ccgacaccguccagcagcu

SEQ ID NO: 1337799 - RNA, 14 nt, Mycobacterium tuberculosis H37Rv
ccgacaccgugccg

SEQ ID NO: 1337800 - RNA, 21 nt, Mycobacterium tuberculosis H37Rv
ccgacacgaacgcugcuccgc

SEQ ID NO: 1337801 - RNA, 23 nt, Mycobacterium tuberculosis H37Rv
ccgacacguugcagcucgauccg

SEQ ID NO: 1337802 - RNA, 17 nt, Mycobacterium tuberculosis H37Rv
ccgacaguggucccggu

SEQ ID NO: 1337803 - RNA, 21 nt, Mycobacterium tuberculosis H37Rv
ccgacaggccggccaccaguc

SEQ ID NO: 1337804 - RNA, 18 nt, Mycobacterium tuberculosis H37Rv
ccgacaggccggccacca

SEQ ID NO: 1337805 - RNA, 12 nt, Mycobacterium tuberculosis H37Rv
ccgacagcccca

SEQ ID NO: 1337806 - RNA, 16 nt, Mycobacterium tuberculosis H37Rv
ccgccguuaccgccgg

SEQ ID NO: 1337807 - RNA, 22 nt, Mycobacterium tuberculosis H37Rv
ccgccgucguugcccgacccgc

SEQ ID NO: 1337808 - RNA, 19 nt, Mycobacterium tuberculosis H37Rv
ccgccgucguugcccgacc

SEQ ID NO: 1337809 - RNA, 21 nt, Mycobacterium tuberculosis H37Rv
ccgccgucguugcccgacccg

SEQ ID NO: 1337810 - RNA, 13 nt, Mycobacterium tuberculosis H37Rv
ccgccgucgccac

SEQ ID NO: 1337811 - RNA, 15 nt, Mycobacterium tuberculosis H37Rv
ccgccgucgccacca

SEQ ID NO: 1337812 - RNA, 22 nt, Mycobacterium tuberculosis H37Rv
ccgccgugcggguucacugccg

SEQ ID NO: 1337813 - RNA, 23 nt, Mycobacterium tuberculosis H37Rv
ccgccgugcugcggcgacgguga

SEQ ID NO: 1337814 - RNA, 15 nt, Mycobacterium tuberculosis H37Rv
ccgccgucaccgcgc

SEQ ID NO: 1337815 - RNA, 15 nt, Mycobacterium tuberculosis H37Rv
ccgccgucacccccg

SEQ ID NO: 1337816 - RNA, 22 nt, Mycobacterium tuberculosis H37Rv
ccgccguaccgaagcggaucug

SEQ ID NO: 1337817 - RNA, 14 nt, Mycobacterium tuberculosis H37Rv
ccgccguccccgcc

SEQ ID NO: 1337818 - RNA, 15 nt, Mycobacterium tuberculosis H37Rv
ccgccguccccgccg

SEQ ID NO: 1337819 - RNA, 16 nt, Mycobacterium tuberculosis H37Rv
ccgccguccccgccgc

SEQ ID NO: 1337820 - RNA, 15 nt, Mycobacterium tuberculosis H37Rv
ccgccgucgaccacg

SEQ ID NO: 1337821 - RNA, 17 nt, Mycobacterium tuberculosis H37Rv
ccgccguccagcgccgc

SEQ ID NO: 1337822 - RNA, 13 nt, Mycobacterium tuberculosis H37Rv
ccgccguccagcg

SEQ ID NO: 1337823 - RNA, 18 nt, Mycobacterium tuberculosis H37Rv
ccgccgucgccggugccg

SEQ ID NO: 1337824 - RNA, 16 nt, Mycobacterium tuberculosis H37Rv
ccgccgucgccgccgc

SEQ ID NO: 1337825 - RNA, 19 nt, Mycobacterium tuberculosis H37Rv
ccgccuaaucggccugccg

SEQ ID NO: 1337826 - RNA, 21 nt, Mycobacterium tuberculosis H37Rv
ccgccuaaucggccugccggc

SEQ ID NO: 1337827 - RNA, 23 nt, Mycobacterium tuberculosis H37Rv
ccgccuccgccugccccacccgc

SEQ ID NO: 1337828 - RNA, 14 nt, Mycobacterium tuberculosis H37Rv
ccgccuccgccgag

SEQ ID NO: 1337829 - RNA, 16 nt, Mycobacterium tuberculosis H37Rv
ccgccguugccgccgg

SEQ ID NO: 1337830 - RNA, 17 nt, Mycobacterium tuberculosis H37Rv
ccgccguugccgccggc

SEQ ID NO: 1337831 - RNA, 19 nt, Mycobacterium tuberculosis H37Rv
ccgccguugccgccggcgc

SEQ ID NO: 1337832 - RNA, 23 nt, Mycobacterium tuberculosis H37Rv
ccgccguugccauugccucccgc

SEQ ID NO: 1337833 - RNA, 16 nt, Mycobacterium tuberculosis H37Rv
ccgccguugccgccau

SEQ ID NO: 1337834 - RNA, 18 nt, Mycobacterium tuberculosis H37Rv
ccgccguugccgccgaag

SEQ ID NO: 1337835 - RNA, 21 nt, Mycobacterium tuberculosis H37Rv
ccgccguugccgccggcgccg

SEQ ID NO: 1337836 - RNA, 18 nt, Mycobacterium tuberculosis H37Rv
ccgccguugccgccgucg

SEQ ID NO: 1337837 - RNA, 21 nt, Mycobacterium tuberculosis H37Rv
ccgccguugccgaucagcccg

SEQ ID NO: 1337838 - RNA, 22 nt, Mycobacterium tuberculosis H37Rv
ccgccguugccauugccucccg

SEQ ID NO: 1337839 - RNA, 21 nt, Mycobacterium tuberculosis H37Rv
ccgccguugccaccggugccg

SEQ ID NO: 1337840 - RNA, 21 nt, Mycobacterium tuberculosis H37Rv
ccgccguucccaccaccaccg

SEQ ID NO: 1337841 - RNA, 22 nt, Mycobacterium tuberculosis H37Rv
ccgccguucccaccaccaccgc

SEQ ID NO: 1337842 - RNA, 21 nt, Mycobacterium tuberculosis H37Rv
ccgccguucccgccggccccg

SEQ ID NO: 1337843 - RNA, 21 nt, Mycobacterium tuberculosis H37Rv
ccgccguucgggaugcaagga

SEQ ID NO: 1337844 - RNA, 20 nt, Mycobacterium tuberculosis H37Rv
ccgccggcuccgccagcgcc

SEQ ID NO: 1337845 - RNA, 21 nt, Mycobacterium tuberculosis H37Rv
ccgccggcuccgccagcgccg

SEQ ID NO: 1337846 - RNA, 22 nt, Mycobacterium tuberculosis H37Rv
ccgccggcuccgccagcgccgc

SEQ ID NO: 1337847 - RNA, 21 nt, Mycobacterium tuberculosis H37Rv
ccgccggcgcugaucgcgaag

SEQ ID NO: 1337848 - RNA, 21 nt, Mycobacterium tuberculosis H37Rv
ccgccggcggggugcgcccac

SEQ ID NO: 1337849 - RNA, 15 nt, Mycobacterium tuberculosis H37Rv
ccgccggcgccaccc

SEQ ID NO: 1337850 - RNA, 15 nt, Mycobacterium tuberculosis H37Rv
ccgccggcgccggag

SEQ ID NO: 1337851 - RNA, 17 nt, Mycobacterium tuberculosis H37Rv
ccgccggcgccgcccgc

SEQ ID NO: 1337852 - RNA, 15 nt, Mycobacterium tuberculosis H37Rv
ccgccggcgccgccg

SEQ ID NO: 1337853 - RNA, 13 nt, Mycobacterium tuberculosis H37Rv
ccgccggcgccca

SEQ ID NO: 1337854 - RNA, 15 nt, Mycobacterium tuberculosis H37Rv
ccgccggcgcccagg

SEQ ID NO: 1337855 - RNA, 16 nt, Mycobacterium tuberculosis H37Rv
ccgccggcgccgcccg

SEQ ID NO: 1337856 - RNA, 19 nt, Mycobacterium tuberculosis H37Rv
ccgccgggauaacccagca

SEQ ID NO: 1337857 - RNA, 19 nt, Mycobacterium tuberculosis H37Rv
ccgccgggcagugugguca

SEQ ID NO: 1337858 - RNA, 14 nt, Mycobacterium tuberculosis H37Rv
ccgccgggccaggc

SEQ ID NO: 1337859 - RNA, 15 nt, Mycobacterium tuberculosis H37Rv
ccgccgggccaggcc

SEQ ID NO: 1337860 - RNA, 12 nt, Mycobacterium tuberculosis H37Rv
ccgccggcugcg

SEQ ID NO: 1337861 - RNA, 16 nt, Mycobacterium tuberculosis H37Rv
ccgccggguccuugcg

SEQ ID NO: 1337862 - RNA, 14 nt, Mycobacterium tuberculosis H37Rv
ccgccgguccaugg

SEQ ID NO: 1337863 - RNA, 15 nt, Mycobacterium tuberculosis H37Rv
ccgccgggcuccacg

SEQ ID NO: 1337864 - RNA, 22 nt, Mycobacterium tuberculosis H37Rv
ccgccgggcucagcugggccgc

SEQ ID NO: 1337865 - RNA, 14 nt, Mycobacterium tuberculosis H37Rv
ccgccggggccgcc

SEQ ID NO: 1337866 - RNA, 16 nt, Mycobacterium tuberculosis H37Rv
ccgccgguuugggggc

SEQ ID NO: 1337867 - RNA, 15 nt, Mycobacterium tuberculosis H37Rv
ccgccggugucgggc

SEQ ID NO: 1337868 - RNA, 16 nt, Mycobacterium tuberculosis H37Rv
ccgccggugccgccgu

SEQ ID NO: 1337869 - RNA, 16 nt, Mycobacterium tuberculosis H37Rv
ccgccggugccgccug

SEQ ID NO: 1337870 - RNA, 17 nt, Mycobacterium tuberculosis H37Rv
ccgccggugccgccugc

SEQ ID NO: 1337871 - RNA, 18 nt, Mycobacterium tuberculosis H37Rv
ccgccggucccgcgugcc

SEQ ID NO: 1337872 - RNA, 15 nt, Mycobacterium tuberculosis H37Rv
ccgccgcugccgccg

SEQ ID NO: 1337873 - RNA, 17 nt, Mycobacterium tuberculosis H37Rv
ccgccgcugccgccgag

SEQ ID NO: 1337874 - RNA, 21 nt, Mycobacterium tuberculosis H37Rv
ccgccgcugccgccggugccg

SEQ ID NO: 1337875 - RNA, 17 nt, Mycobacterium tuberculosis H37Rv
ccgccgcuaccgcccgc

SEQ ID NO: 1337876 - RNA, 12 nt, Mycobacterium tuberculosis H37Rv
ccgccgcggcgc

SEQ ID NO: 1337877 - RNA, 22 nt, Mycobacterium tuberculosis H37Rv
ccgccgcggccaccaccgccgc

SEQ ID NO: 1337878 - RNA, 13 nt, Mycobacterium tuberculosis H37Rv
ccgccgcggcagg

SEQ ID NO: 1337879 - RNA, 17 nt, Mycobacterium tuberculosis H37Rv
ccgccgcggccggcgcu

SEQ ID NO: 1337880 - RNA, 14 nt, Mycobacterium tuberculosis H37Rv
ccgccgcggccgcc

SEQ ID NO: 1337881 - RNA, 15 nt, Mycobacterium tuberculosis H37Rv
ccgccgcggccgccg

SEQ ID NO: 1337882 - RNA, 13 nt, Mycobacterium tuberculosis H37Rv
ccgccgcgccggc

SEQ ID NO: 1337883 - RNA, 16 nt, Mycobacterium tuberculosis H37Rv
ccgccgcgccggcacg

SEQ ID NO: 1337884 - RNA, 23 nt, Mycobacterium tuberculosis H37Rv
ccgccggcaauaccgccagcgcc

SEQ ID NO: 1337885 - RNA, 15 nt, Mycobacterium tuberculosis H37Rv
ccgccggcaccaccg

SEQ ID NO: 1337886 - RNA, 16 nt, Mycobacterium tuberculosis H37Rv
ccgccggcaccgccgg

SEQ ID NO: 1337887 - RNA, 19 nt, Mycobacterium tuberculosis H37Rv
ccgccggcaccgccgcccc

SEQ ID NO: 1337888 - RNA, 14 nt, Mycobacterium tuberculosis H37Rv
ccgccggcaccucc

SEQ ID NO: 1337889 - RNA, 16 nt, Mycobacterium tuberculosis H37Rv
ccgccggcaccucccu

SEQ ID NO: 1337890 - RNA, 17 nt, Mycobacterium tuberculosis H37Rv
ccgccggcaccucccug

SEQ ID NO: 1337891 - RNA, 15 nt, Mycobacterium tuberculosis H37Rv
ccgccggcaccuccg

SEQ ID NO: 1337892 - RNA, 23 nt, Mycobacterium tuberculosis H37Rv
ccgccggcaccuccggcaccgcc

SEQ ID NO: 1337893 - RNA, 15 nt, Mycobacterium tuberculosis H37Rv
ccgccggaaucgaga

SEQ ID NO: 1337894 - RNA, 13 nt, Mycobacterium tuberculosis H37Rv
ccgccggccaguc

SEQ ID NO: 1337895 - RNA, 14 nt, Mycobacterium tuberculosis H37Rv
ccgccggccccgcc

SEQ ID NO: 1337896 - RNA, 15 nt, Mycobacterium tuberculosis H37Rv
ccgccggccccgcca

SEQ ID NO: 1337897 - RNA, 17 nt, Mycobacterium tuberculosis H37Rv
ccgccggccggaacgcc

SEQ ID NO: 1337898 - RNA, 14 nt, Mycobacterium tuberculosis H37Rv
ccgccggcgccagc

SEQ ID NO: 1337899 - RNA, 19 nt, Mycobacterium tuberculosis H37Rv
ccgccggcgccagcgccgc

SEQ ID NO: 1337900 - RNA, 15 nt, Mycobacterium tuberculosis H37Rv
ccgccggccgccagc

SEQ ID NO: 1337901 - RNA, 14 nt, Mycobacterium tuberculosis H37Rv
ccgccgccggcggu

SEQ ID NO: 1337902 - RNA, 16 nt, Mycobacterium tuberculosis H37Rv
ccgccgccgccggcgc

SEQ ID NO: 1337903 - RNA, 21 nt, Mycobacterium tuberculosis H37Rv
ccgccgccgaucuugagccgg

SEQ ID NO: 1337904 - RNA, 16 nt, Mycobacterium tuberculosis H37Rv
ccgccgccugcccggc

SEQ ID NO: 1337905 - RNA, 21 nt, Mycobacterium tuberculosis H37Rv
ccgccgccugcuggagcagcu

SEQ ID NO: 1337906 - RNA, 23 nt, Mycobacterium tuberculosis H37Rv
ccgccgccgucggcgagcagacg

SEQ ID NO: 1337907 - RNA, 16 nt, Mycobacterium tuberculosis H37Rv
ccgccgccgucggcga

SEQ ID NO: 1337908 - RNA, 12 nt, Mycobacterium tuberculosis H37Rv
ccgccgcgcagc

SEQ ID NO: 1337909 - RNA, 21 nt, Mycobacterium tuberculosis H37Rv
ccgccgcgauggccccuguca

SEQ ID NO: 1337910 - RNA, 22 nt, Mycobacterium tuberculosis H37Rv
ccgccgccggaggucgggcggc

SEQ ID NO: 1337911 - RNA, 17 nt, Mycobacterium tuberculosis H37Rv
ccgccgcgagcgccggc

SEQ ID NO: 1337912 - RNA, 21 nt, Mycobacterium tuberculosis H37Rv
ccgccgcgacgcacugccccg

SEQ ID NO: 1337913 - RNA, 15 nt, Mycobacterium tuberculosis H37Rv
ccgccgcgagcagaa

SEQ ID NO: 1337914 - RNA, 23 nt, Mycobacterium tuberculosis H37Rv
ccgccgccguucccgccggcccc

SEQ ID NO: 1337915 - RNA, 22 nt, Mycobacterium tuberculosis H37Rv
ccgccgcgaccacgcaccgccc

SEQ ID NO: 1337916 - RNA, 12 nt, Mycobacterium tuberculosis H37Rv
ccgccgccgaag

SEQ ID NO: 1337917 - RNA, 12 nt, Mycobacterium tuberculosis H37Rv
ccgccgcccccg

SEQ ID NO: 1337918 - RNA, 16 nt, Mycobacterium tuberculosis H37Rv
ccgccgccccggcgcu

SEQ ID NO: 1337919 - RNA, 12 nt, Mycobacterium tuberculosis H37Rv
ccgccgcccgca

SEQ ID NO: 1337920 - RNA, 12 nt, Mycobacterium tuberculosis H37Rv
ccgccgccaccg

SEQ ID NO: 1337921 - RNA, 12 nt, Mycobacterium tuberculosis H37Rv
ccgccgccacca

SEQ ID NO: 1337922 - RNA, 21 nt, Mycobacterium tuberculosis H37Rv
ccgccgcagacgccgacuccg

SEQ ID NO: 1337923 - RNA, 17 nt, Mycobacterium tuberculosis H37Rv
ccgccaucugccugccu

SEQ ID NO: 1337924 - RNA, 16 nt, Mycobacterium tuberculosis H37Rv
ccgccaucgcccgauc

SEQ ID NO: 1337925 - RNA, 20 nt, Mycobacterium tuberculosis H37Rv
ccgccaucgucgaagaccuc

SEQ ID NO: 1337926 - RNA, 18 nt, Mycobacterium tuberculosis H37Rv
ccgccauguacaggcccc

SEQ ID NO: 1337927 - RNA, 19 nt, Mycobacterium tuberculosis H37Rv
ccgccauggccgccguugg

SEQ ID NO: 1337928 - RNA, 18 nt, Mycobacterium tuberculosis H37Rv
ccgccaugcggcgcgucg

SEQ ID NO: 1337929 - RNA, 15 nt, Mycobacterium tuberculosis H37Rv
ccgccauuggcgccg

SEQ ID NO: 1337930 - RNA, 22 nt, Mycobacterium tuberculosis H37Rv
ccgccauugccgccgucgccgc

SEQ ID NO: 1337931 - RNA, 21 nt, Mycobacterium tuberculosis H37Rv
ccgccauugccgccggugccg

SEQ ID NO: 1337932 - RNA, 18 nt, Mycobacterium tuberculosis H37Rv
ccgccauuggcaggcaug

SEQ ID NO: 1337933 - RNA, 16 nt, Mycobacterium tuberculosis H37Rv
ccgccauugccgccgg

SEQ ID NO: 1337934 - RNA, 16 nt, Mycobacterium tuberculosis H37Rv
ccgcccaggagcaccu

SEQ ID NO: 1337935 - RNA, 15 nt, Mycobacterium tuberculosis H37Rv
ccgcccagcccggcg

SEQ ID NO: 1337936 - RNA, 16 nt, Mycobacterium tuberculosis H37Rv
ccgcccagcgaggugg

SEQ ID NO: 1337937 - RNA, 13 nt, Mycobacterium tuberculosis H37Rv
ccgcccagcgagg

SEQ ID NO: 1337938 - RNA, 21 nt, Mycobacterium tuberculosis H37Rv
ccgcccagcggaaucaccgaa

SEQ ID NO: 1337939 - RNA, 13 nt, Mycobacterium tuberculosis H37Rv
ccgcccagugcca

SEQ ID NO: 1337940 - RNA, 12 nt, Mycobacterium tuberculosis H37Rv
ccgcccaugccg

SEQ ID NO: 1337941 - RNA, 17 nt, Mycobacterium tuberculosis H37Rv
ccgcccaugccuccaga

SEQ ID NO: 1337942 - RNA, 13 nt, Mycobacterium tuberculosis H37Rv
ccgccccgcccgc

SEQ ID NO: 1337943 - RNA, 18 nt, Mycobacterium tuberculosis H37Rv
ccgcccccgucggccuug

SEQ ID NO: 1337944 - RNA, 18 nt, Mycobacterium tuberculosis H37Rv
ccgcccccgccggccgcg

SEQ ID NO: 1337945 - RNA, 14 nt, Mycobacterium tuberculosis H37Rv
ccgcccccgugggg

SEQ ID NO: 1337946 - RNA, 14 nt, Mycobacterium tuberculosis H37Rv
ccgcccgcgccucc

SEQ ID NO: 1337947 - RNA, 15 nt, Mycobacterium tuberculosis H37Rv
ccgcccgcgccacca

SEQ ID NO: 1337948 - RNA, 21 nt, Mycobacterium tuberculosis H37Rv
ccgcccgcgccaccagcaccg

SEQ ID NO: 1337949 - RNA, 15 nt, Mycobacterium tuberculosis H37Rv
ccgcccgcgccaccg

SEQ ID NO: 1337950 - RNA, 21 nt, Mycobacterium tuberculosis H37Rv
ccgcccgcgcccccggugccg

SEQ ID NO: 1337951 - RNA, 13 nt, Mycobacterium tuberculosis H37Rv
ccgcccgcccacc

SEQ ID NO: 1337952 - RNA, 14 nt, Mycobacterium tuberculosis H37Rv
ccgccccggccagg

SEQ ID NO: 1337953 - RNA, 14 nt, Mycobacterium tuberculosis H37Rv
ccgcccgacgugaa

SEQ ID NO: 1337954 - RNA, 13 nt, Mycobacterium tuberculosis H37Rv
ccgcccgccagcg

SEQ ID NO: 1337955 - RNA, 17 nt, Mycobacterium tuberculosis H37Rv
ccgcccgcagggccgcc

SEQ ID NO: 1337956 - RNA, 23 nt, Mycobacterium tuberculosis H37Rv
ccgcccgaguuguggacgcccga

SEQ ID NO: 1337957 - RNA, 15 nt, Mycobacterium tuberculosis H37Rv
ccgcccgcacccccg

SEQ ID NO: 1337958 - RNA, 22 nt, Mycobacterium tuberculosis H37Rv
ccgcccgcuccgccgucgccgc

SEQ ID NO: 1337959 - RNA, 18 nt, Mycobacterium tuberculosis H37Rv
ccgccgaagccgcgcauc

SEQ ID NO: 1337960 - RNA, 16 nt, Mycobacterium tuberculosis H37Rv
ccgccgacaaccccgc

SEQ ID NO: 1337961 - RNA, 16 nt, Mycobacterium tuberculosis H37Rv
ccgccgaacagugucg

SEQ ID NO: 1337962 - RNA, 18 nt, Mycobacterium tuberculosis H37Rv
ccgccgacgaccgccugc

SEQ ID NO: 1337963 - RNA, 14 nt, Mycobacterium tuberculosis H37Rv
ccgccgacaggccg

SEQ ID NO: 1337964 - RNA, 17 nt, Mycobacterium tuberculosis H37Rv
ccgccgacaccaccggc

SEQ ID NO: 1337965 - RNA, 17 nt, Mycobacterium tuberculosis H37Rv
ccgccgacaaccccgcc

SEQ ID NO: 1337966 - RNA, 18 nt, Mycobacterium tuberculosis H37Rv
ccgccgacaaucaccaac

SEQ ID NO: 1337967 - RNA, 21 nt, Mycobacterium tuberculosis H37Rv
ccgcccuugccgccagcccca

SEQ ID NO: 1337968 - RNA, 18 nt, Mycobacterium tuberculosis H37Rv
ccgcccuugccgccagcc

SEQ ID NO: 1337969 - RNA, 19 nt, Mycobacterium tuberculosis H37Rv
ccgcccuugccgccagccc

SEQ ID NO: 1337970 - RNA, 20 nt, Mycobacterium tuberculosis H37Rv
ccgcccucccuggggccguc

SEQ ID NO: 1337971 - RNA, 15 nt, Mycobacterium tuberculosis H37Rv
ccgcccuugccuccg

SEQ ID NO: 1337972 - RNA, 18 nt, Mycobacterium tuberculosis H37Rv
ccgcccuugccuccggcg

SEQ ID NO: 1337973 - RNA, 17 nt, Mycobacterium tuberculosis H37Rv
ccgcccuugccgccggc

SEQ ID NO: 1337974 - RNA, 18 nt, Mycobacterium tuberculosis H37Rv
ccgccgaaacucaccagc

SEQ ID NO: 1337975 - RNA, 23 nt, Mycobacterium tuberculosis H37Rv
ccgccgaaagcaucaccaccgca

SEQ ID NO: 1337976 - RNA, 18 nt, Mycobacterium tuberculosis H37Rv
ccgcccgugaucaccacg

SEQ ID NO: 1337977 - RNA, 22 nt, Mycobacterium tuberculosis H37Rv
ccgcccgucuuccagccaggcc

SEQ ID NO: 1337978 - RNA, 21 nt, Mycobacterium tuberculosis H37Rv
ccgcccggcaguucgcggcca

SEQ ID NO: 1337979 - RNA, 24 nt, Mycobacterium tuberculosis H37Rv
ccgcccguagacccacagucgccg

SEQ ID NO: 1337980 - RNA, 17 nt, Mycobacterium tuberculosis H37Rv
ccgcccgcugggcucgc

SEQ ID NO: 1337981 - RNA, 23 nt, Mycobacterium tuberculosis H37Rv
ccgcccggacgcaacacccgggc

SEQ ID NO: 1337982 - RNA, 22 nt, Mycobacterium tuberculosis H37Rv
ccgcccucccuggggccguccg

SEQ ID NO: 1337983 - RNA, 15 nt, Mycobacterium tuberculosis H37Rv
ccgcccugguccagg

SEQ ID NO: 1337984 - RNA, 17 nt, Mycobacterium tuberculosis H37Rv
ccgcccugguccaggcc

SEQ ID NO: 1337985 - RNA, 24 nt, Mycobacterium tuberculosis H37Rv
ccgcccugguccaggcccuggcca

SEQ ID NO: 1337986 - RNA, 21 nt, Mycobacterium tuberculosis H37Rv
ccgcccucucacggcgguagc

SEQ ID NO: 1337987 - RNA, 21 nt, Mycobacterium tuberculosis H37Rv
ccgcccucaccgccugugccg

SEQ ID NO: 1337988 - RNA, 15 nt, Mycobacterium tuberculosis H37Rv
ccgccgaucgacacc

SEQ ID NO: 1337989 - RNA, 18 nt, Mycobacterium tuberculosis H37Rv
ccgccgaucccgucgggc

SEQ ID NO: 1337990 - RNA, 22 nt, Mycobacterium tuberculosis H37Rv
ccgccgauaccgccggccccac

SEQ ID NO: 1337991 - RNA, 16 nt, Mycobacterium tuberculosis H37Rv
ccgccgauaccgccgg

SEQ ID NO: 1337992 - RNA, 20 nt, Mycobacterium tuberculosis H37Rv
ccgccgauaccgccggcccc

SEQ ID NO: 1337993 - RNA, 23 nt, Mycobacterium tuberculosis H37Rv
aaacccggcccagguugccaacc

SEQ ID NO: 1337994 - RNA, 16 nt, Mycobacterium tuberculosis H37Rv
ccgccgaugccgccgc

SEQ ID NO: 1337995 - RNA, 17 nt, Mycobacterium tuberculosis H37Rv
ccgccgaugccgccggc

SEQ ID NO: 1337996 - RNA, 19 nt, Mycobacterium tuberculosis H37Rv
ccgccgaucugcugcagcg

SEQ ID NO: 1337997 - RNA, 20 nt, Mycobacterium tuberculosis H37Rv
aaacccagcgacgcggccag

SEQ ID NO: 1337998 - RNA, 23 nt, Mycobacterium tuberculosis H37Rv
ccgccgaggacacauugaccagg

SEQ ID NO: 1337999 - RNA, 19 nt, Mycobacterium tuberculosis H37Rv
ccgccgagcggaccaccgc

SEQ ID NO: 1338000 - RNA, 14 nt, Mycobacterium tuberculosis H37Rv
ccgccacgccgaag

SEQ ID NO: 1338001 - RNA, 22 nt, Mycobacterium tuberculosis H37Rv
ccgccaccuuggcugggcccgc

SEQ ID NO: 1338002 - RNA, 15 nt, Mycobacterium tuberculosis H37Rv
ccgccacuggcgccg

SEQ ID NO: 1338003 - RNA, 21 nt, Mycobacterium tuberculosis H37Rv
ccgccacuggcgccggugccg

SEQ ID NO: 1338004 - RNA, 15 nt, Mycobacterium tuberculosis H37Rv
ccgccacgucgccgg

SEQ ID NO: 1338005 - RNA, 13 nt, Mycobacterium tuberculosis H37Rv
ccgccacgggcgg

SEQ ID NO: 1338006 - RNA, 21 nt, Mycobacterium tuberculosis H37Rv
ccgccacgggcggccaccgca

SEQ ID NO: 1338007 - RNA, 18 nt, Mycobacterium tuberculosis H37Rv
ccgccagaccgcggcggc

SEQ ID NO: 1338008 - RNA, 20 nt, Mycobacterium tuberculosis H37Rv
ccgccagcaugacaccggcc

SEQ ID NO: 1338009 - RNA, 16 nt, Mycobacterium tuberculosis H37Rv
ccgccagcaugacacc

SEQ ID NO: 1338010 - RNA, 18 nt, Mycobacterium tuberculosis H37Rv
ccgccagcauugaagaag

SEQ ID NO: 1338011 - RNA, 15 nt, Mycobacterium tuberculosis H37Rv
ccgccagcagggcca

SEQ ID NO: 1338012 - RNA, 11 nt, Mycobacterium tuberculosis H37Rv
ccgccagcccc

SEQ ID NO: 1338013 - RNA, 13 nt, Mycobacterium tuberculosis H37Rv
ccgccagccccac

SEQ ID NO: 1338014 - RNA, 14 nt, Mycobacterium tuberculosis H37Rv
ccgccagccccacc

SEQ ID NO: 1338015 - RNA, 14 nt, Mycobacterium tuberculosis H37Rv
ccgccagccggcgc

SEQ ID NO: 1338016 - RNA, 16 nt, Mycobacterium tuberculosis H37Rv
ccgccagccgguccag

SEQ ID NO: 1338017 - RNA, 20 nt, Mycobacterium tuberculosis H37Rv
ccgccagccuggucuuguug

SEQ ID NO: 1338018 - RNA, 17 nt, Mycobacterium tuberculosis H37Rv
ccgccagcaccaccggc

SEQ ID NO: 1338019 - RNA, 22 nt, Mycobacterium tuberculosis H37Rv
ccgccagcaccaccggcucccg

SEQ ID NO: 1338020 - RNA, 17 nt, Mycobacterium tuberculosis H37Rv
ccgccagcaccucggcc

SEQ ID NO: 1338021 - RNA, 13 nt, Mycobacterium tuberculosis H37Rv
ccgccacagcccc

SEQ ID NO: 1338022 - RNA, 14 nt, Mycobacterium tuberculosis H37Rv
ccgccacagcccca

SEQ ID NO: 1338023 - RNA, 18 nt, Mycobacterium tuberculosis H37Rv
ccgccacagccccagggu

SEQ ID NO: 1338024 - RNA, 18 nt, Mycobacterium tuberculosis H37Rv
ccgccaccaccagggcaa

SEQ ID NO: 1338025 - RNA, 14 nt, Mycobacterium tuberculosis H37Rv
ccgccaccaccggc

SEQ ID NO: 1338026 - RNA, 21 nt, Mycobacterium tuberculosis H37Rv
ccgccacacggggccgccagc

SEQ ID NO: 1338027 - RNA, 22 nt, Mycobacterium tuberculosis H37Rv
ccgccaccaccgcugccggcgc

SEQ ID NO: 1338028 - RNA, 11 nt, Mycobacterium tuberculosis H37Rv
ccgccaccauc

SEQ ID NO: 1338029 - RNA, 12 nt, Mycobacterium tuberculosis H37Rv
ccgccacaccgc

SEQ ID NO: 1338030 - RNA, 12 nt, Mycobacterium tuberculosis H37Rv
ccgccaccagac

SEQ ID NO: 1338031 - RNA, 14 nt, Mycobacterium tuberculosis H37Rv
ccgccaccgccagc

SEQ ID NO: 1338032 - RNA, 16 nt, Mycobacterium tuberculosis H37Rv
ccgccaccgccagcgu

SEQ ID NO: 1338033 - RNA, 15 nt, Mycobacterium tuberculosis H37Rv
ccgccaccgccaccg

SEQ ID NO: 1338034 - RNA, 19 nt, Mycobacterium tuberculosis H37Rv
ccgccaccgaagccgccgg

SEQ ID NO: 1338035 - RNA, 19 nt, Mycobacterium tuberculosis H37Rv
ccgccaccgaacgcaccga

SEQ ID NO: 1338036 - RNA, 13 nt, Mycobacterium tuberculosis H37Rv
ccgccacccggcg

SEQ ID NO: 1338037 - RNA, 19 nt, Mycobacterium tuberculosis H37Rv
ccgccaccccggucggagc

SEQ ID NO: 1338038 - RNA, 18 nt, Mycobacterium tuberculosis H37Rv
ccgccaccgucauggcgg

SEQ ID NO: 1338039 - RNA, 21 nt, Mycobacterium tuberculosis H37Rv
ccgccaccggcguccaguccg

SEQ ID NO: 1338040 - RNA, 16 nt, Mycobacterium tuberculosis H37Rv
ccgccaccgcgacacc

SEQ ID NO: 1338041 - RNA, 15 nt, Mycobacterium tuberculosis H37Rv
ccgcauugccgucgg

SEQ ID NO: 1338042 - RNA, 21 nt, Mycobacterium tuberculosis H37Rv
ccgccaaugccaccauugccg

SEQ ID NO: 1338043 - RNA, 14 nt, Mycobacterium tuberculosis H37Rv
ccgccaaggaggcc

SEQ ID NO: 1338044 - RNA, 22 nt, Mycobacterium tuberculosis H37Rv
ccgccaaguacugggccaaagc

SEQ ID NO: 1338045 - RNA, 18 nt, Mycobacterium tuberculosis H37Rv
ccgccaacuccucagccg

SEQ ID NO: 1338046 - RNA, 23 nt, Mycobacterium tuberculosis H37Rv
ccgccagcgcacgauagccaccg

SEQ ID NO: 1338047 - RNA, 19 nt, Mycobacterium tuberculosis H37Rv
ccgccagcgccgccggcgc

SEQ ID NO: 1338048 - RNA, 18 nt, Mycobacterium tuberculosis H37Rv
ccgccagcgccgcugaag

SEQ ID NO: 1338049 - RNA, 17 nt, Mycobacterium tuberculosis H37Rv
ccgccagcgccgccgcg

SEQ ID NO: 1338050 - RNA, 16 nt, Mycobacterium tuberculosis H37Rv
ccgccagcgccgccgg

SEQ ID NO: 1338051 - RNA, 15 nt, Mycobacterium tuberculosis H37Rv
ccgccagcgccgguc

SEQ ID NO: 1338052 - RNA, 19 nt, Mycobacterium tuberculosis H37Rv
ccgccagcggcagcggcgu

SEQ ID NO: 1338053 - RNA, 14 nt, Mycobacterium tuberculosis H37Rv
ccgccaggccgacc

SEQ ID NO: 1338054 - RNA, 21 nt, Mycobacterium tuberculosis H37Rv
ccgccaggccguugccccguc

SEQ ID NO: 1338055 - RNA, 22 nt, Mycobacterium tuberculosis H37Rv
ccgccagggcccuagccggcgc

SEQ ID NO: 1338056 - RNA, 17 nt, Mycobacterium tuberculosis H37Rv
ccgccagucccccgcuc

SEQ ID NO: 1338057 - RNA, 16 nt, Mycobacterium tuberculosis H37Rv
ccgccaucaccgccgu

SEQ ID NO: 1338058 - RNA, 15 nt, Mycobacterium tuberculosis H37Rv
ccgccaucagccgcu

SEQ ID NO: 1338059 - RNA, 21 nt, Mycobacterium tuberculosis H37Rv
ccgccaucaacaaggggcagc

SEQ ID NO: 1338060 - RNA, 19 nt, Mycobacterium tuberculosis H37Rv
ccgccaucauggcggcccg

SEQ ID NO: 1338061 - RNA, 20 nt, Mycobacterium tuberculosis H37Rv
ccgccauccgauggcccggc

SEQ ID NO: 1338062 - RNA, 13 nt, Mycobacterium tuberculosis H37Rv
ccgccaucgccgc

SEQ ID NO: 1338063 - RNA, 16 nt, Mycobacterium tuberculosis H37Rv
ccgccaucgccgccgg

SEQ ID NO: 1338064 - RNA, 12 nt, Mycobacterium tuberculosis H37Rv
ccgcacagcgac

SEQ ID NO: 1338065 - RNA, 15 nt, Mycobacterium tuberculosis H37Rv
ccgcacagcggcccg

SEQ ID NO: 1338066 - RNA, 10 nt, Mycobacterium tuberculosis H37Rv
ccgcaccacc

SEQ ID NO: 1338067 - RNA, 15 nt, Mycobacterium tuberculosis H37Rv
ccgcaccaagcagcg

SEQ ID NO: 1338068 - RNA, 19 nt, Mycobacterium tuberculosis H37Rv
ccgcaccaagcagcgacca

SEQ ID NO: 1338069 - RNA, 16 nt, Mycobacterium tuberculosis H37Rv
ccgcaccaccggcccc

SEQ ID NO: 1338070 - RNA, 14 nt, Mycobacterium tuberculosis H37Rv
ccgcaccaccggcc

SEQ ID NO: 1338071 - RNA, 19 nt, Mycobacterium tuberculosis H37Rv
ccgcaccagaucgucgggc

SEQ ID NO: 1338072 - RNA, 12 nt, Mycobacterium tuberculosis H37Rv
ccgcacuccacg

SEQ ID NO: 1338073 - RNA, 15 nt, Mycobacterium tuberculosis H37Rv
ccgcaccagucgcgc

SEQ ID NO: 1338074 - RNA, 15 nt, Mycobacterium tuberculosis H37Rv
ccgcaccccggccgc

SEQ ID NO: 1338075 - RNA, 21 nt, Mycobacterium tuberculosis H37Rv
ccgcaccagcugucgggcagc

SEQ ID NO: 1338076 - RNA, 18 nt, Mycobacterium tuberculosis H37Rv
ccgcaccagcugucgggc

SEQ ID NO: 1338077 - RNA, 16 nt, Mycobacterium tuberculosis H37Rv
ccgcaccagcugucgg

SEQ ID NO: 1338078 - RNA, 18 nt, Mycobacterium tuberculosis H37Rv
ccgcaaaaucgucagcgc

SEQ ID NO: 1338079 - RNA, 20 nt, Mycobacterium tuberculosis H37Rv
ccgcaaaaucgucagcgccg

SEQ ID NO: 1338080 - RNA, 20 nt, Mycobacterium tuberculosis H37Rv
ccgcaaugacgucgucggcc

SEQ ID NO: 1338081 - RNA, 21 nt, Mycobacterium tuberculosis H37Rv
ccgcaaugacgucgucggcca

SEQ ID NO: 1338082 - RNA, 18 nt, Mycobacterium tuberculosis H37Rv
ccgcaaucaugucagcgc

SEQ ID NO: 1338083 - RNA, 16 nt, Mycobacterium tuberculosis H37Rv
ccgcaauacccgagcg

SEQ ID NO: 1338084 - RNA, 21 nt, Mycobacterium tuberculosis H37Rv
ccgcaaugaccuggccgcccg

SEQ ID NO: 1338085 - RNA, 19 nt, Mycobacterium tuberculosis H37Rv
ccgagcguaaugcugcugc

SEQ ID NO: 1338086 - RNA, 14 nt, Mycobacterium tuberculosis H37Rv
ccgagcggugguga

SEQ ID NO: 1338087 - RNA, 22 nt, Mycobacterium tuberculosis H37Rv
ccgagcggguugucuuucacau

SEQ ID NO: 1338088 - RNA, 22 nt, Mycobacterium tuberculosis H37Rv
ccgagcuccgcggcgagcuccg

SEQ ID NO: 1338089 - RNA, 24 nt, Mycobacterium tuberculosis H37Rv
ccgagcucaggucgacaggugcca

SEQ ID NO: 1338090 - RNA, 15 nt, Mycobacterium tuberculosis H37Rv
ccgagcuggcgcgcg

SEQ ID NO: 1338091 - RNA, 23 nt, Mycobacterium tuberculosis H37Rv
ccgagcucuuggagcuuggccca

SEQ ID NO: 1338092 - RNA, 20 nt, Mycobacterium tuberculosis H37Rv
ccgagcuggcaacgccgcgc

SEQ ID NO: 1338093 - RNA, 14 nt, Mycobacterium tuberculosis H37Rv
ccgagcugccgucg

SEQ ID NO: 1338094 - RNA, 20 nt, Mycobacterium tuberculosis H37Rv
ccgagcugccaacgcccgug

SEQ ID NO: 1338095 - RNA, 15 nt, Mycobacterium tuberculosis H37Rv
ccgagcucggcgccc

SEQ ID NO: 1338096 - RNA, 14 nt, Mycobacterium tuberculosis H37Rv
ccgauuccagcgga

SEQ ID NO: 1338097 - RNA, 22 nt, Mycobacterium tuberculosis H37Rv
ccgauuccggaguucuuguagc

SEQ ID NO: 1338098 - RNA, 16 nt, Mycobacterium tuberculosis H37Rv
ccgauguuggcagggc

SEQ ID NO: 1338099 - RNA, 23 nt, Mycobacterium tuberculosis H37Rv
ccgauguuggcagggccagcggc

SEQ ID NO: 1338100 - RNA, 18 nt, Mycobacterium tuberculosis H37Rv
ccgaugugggcgccgucg

SEQ ID NO: 1338101 - RNA, 23 nt, Mycobacterium tuberculosis H37Rv
ccgauucagcgccccaugcaaca

SEQ ID NO: 1338102 - RNA, 21 nt, Mycobacterium tuberculosis H37Rv
ccgauuuauccggaucggccu

SEQ ID NO: 1338103 - RNA, 12 nt, Mycobacterium tuberculosis H37Rv
ccgauuggccaa

SEQ ID NO: 1338104 - RNA, 18 nt, Mycobacterium tuberculosis H37Rv
ccgauugcguucaucauc

SEQ ID NO: 1338105 - RNA, 17 nt, Mycobacterium tuberculosis H37Rv
ccgauuuggccgucauc

SEQ ID NO: 1338106 - RNA, 19 nt, Mycobacterium tuberculosis H37Rv
ccgcaucgguggggcgccg

SEQ ID NO: 1338107 - RNA, 15 nt, Mycobacterium tuberculosis H37Rv
ccgcaucgcaccagg

SEQ ID NO: 1338108 - RNA, 14 nt, Mycobacterium tuberculosis H37Rv
ccgcaucgccgaac

SEQ ID NO: 1338109 - RNA, 20 nt, Mycobacterium tuberculosis H37Rv
ccgcauucguggagccggcc

SEQ ID NO: 1338110 - RNA, 19 nt, Mycobacterium tuberculosis H37Rv
ccgcauugagcuggcgccc

SEQ ID NO: 1338111 - RNA, 22 nt, Mycobacterium tuberculosis H37Rv
ccgcaugccaccgagcaaacac

SEQ ID NO: 1338112 - RNA, 21 nt, Mycobacterium tuberculosis H37Rv
ccgcauaccaguaccgucauc

SEQ ID NO: 1338113 - RNA, 23 nt, Mycobacterium tuberculosis H37Rv
ccgcauaggccccgccagcgccg

SEQ ID NO: 1338114 - RNA, 19 nt, Mycobacterium tuberculosis H37Rv
ccgcauaggccccgccagc

SEQ ID NO: 1338115 - RNA, 20 nt, Mycobacterium tuberculosis H37Rv
ccgcauaggccccgccagcg

SEQ ID NO: 1338116 - RNA, 13 nt, Mycobacterium tuberculosis H37Rv
ccgcaucacccgg

SEQ ID NO: 1338117 - RNA, 16 nt, Mycobacterium tuberculosis H37Rv
ccgcaucacccgggau

SEQ ID NO: 1338118 - RNA, 18 nt, Mycobacterium tuberculosis H37Rv
ccgcauccgcgacggcgc

SEQ ID NO: 1338119 - RNA, 18 nt, Mycobacterium tuberculosis H37Rv
ccgcauccagccgugcgg

SEQ ID NO: 1338120 - RNA, 15 nt, Mycobacterium tuberculosis H37Rv
ccgcauccggucucg

SEQ ID NO: 1338121 - RNA, 23 nt, Mycobacterium tuberculosis H37Rv
ccgcaguggcaagcugucgucgc

SEQ ID NO: 1338122 - RNA, 15 nt, Mycobacterium tuberculosis H37Rv
ccgcaguucuugauu

SEQ ID NO: 1338123 - RNA, 19 nt, Mycobacterium tuberculosis H37Rv
ccgcaggucgaucugcgcc

SEQ ID NO: 1338124 - RNA, 13 nt, Mycobacterium tuberculosis H37Rv
ccgcaggucggcc

SEQ ID NO: 1338125 - RNA, 22 nt, Mycobacterium tuberculosis H37Rv
ccgcaguacugguagaggcggc

SEQ ID NO: 1338126 - RNA, 22 nt, Mycobacterium tuberculosis H37Rv
ccgcaggccagggucagcucgg

SEQ ID NO: 1338127 - RNA, 17 nt, Mycobacterium tuberculosis H37Rv
ccgcaggcucaccgagc

SEQ ID NO: 1338128 - RNA, 18 nt, Mycobacterium tuberculosis H37Rv
ccgcagggucccgucauc

SEQ ID NO: 1338129 - RNA, 21 nt, Mycobacterium tuberculosis H37Rv
ccgcagaaugucguaggcgcc

SEQ ID NO: 1338130 - RNA, 22 nt, Mycobacterium tuberculosis H37Rv
ccgcacuuucuuccucggggcu

SEQ ID NO: 1338131 - RNA, 19 nt, Mycobacterium tuberculosis H37Rv
ccgcagacgugguagccgg

SEQ ID NO: 1338132 - RNA, 14 nt, Mycobacterium tuberculosis H37Rv
ccgcagaccgccac

SEQ ID NO: 1338133 - RNA, 19 nt, Mycobacterium tuberculosis H37Rv
ccgcacuugaucgacggcc

SEQ ID NO: 1338134 - RNA, 13 nt, Mycobacterium tuberculosis H37Rv
ccgcacugccgcc

SEQ ID NO: 1338135 - RNA, 14 nt, Mycobacterium tuberculosis H37Rv
ccgcagagaccaag

SEQ ID NO: 1338136 - RNA, 15 nt, Mycobacterium tuberculosis H37Rv
ccgcagaucaccgcc

SEQ ID NO: 1338137 - RNA, 17 nt, Mycobacterium tuberculosis H37Rv
ccgcagaucaccgccag

SEQ ID NO: 1338138 - RNA, 22 nt, Mycobacterium tuberculosis H37Rv
ccgcagaugcaguuccuugaga

SEQ ID NO: 1338139 - RNA, 14 nt, Mycobacterium tuberculosis H37Rv
ccgcagcggcggca

SEQ ID NO: 1338140 - RNA, 22 nt, Mycobacterium tuberculosis H37Rv
ccgcagcggcggcaacccugcc

SEQ ID NO: 1338141 - RNA, 15 nt, Mycobacterium tuberculosis H37Rv
ccgcagcgugaucug

SEQ ID NO: 1338142 - RNA, 16 nt, Mycobacterium tuberculosis H37Rv
ccgguauuaccgccgu

SEQ ID NO: 1338143 - RNA, 16 nt, Mycobacterium tuberculosis H37Rv
ccgguaugcgccaucu

SEQ ID NO: 1338144 - RNA, 16 nt, Mycobacterium tuberculosis H37Rv
ccgguaucgucccggc

SEQ ID NO: 1338145 - RNA, 14 nt, Mycobacterium tuberculosis H37Rv
ccgguaguccgcgc

SEQ ID NO: 1338146 - RNA, 15 nt, Mycobacterium tuberculosis H37Rv
ccgguaguccgcgcu

SEQ ID NO: 1338147 - RNA, 14 nt, Mycobacterium tuberculosis H37Rv
ccgguagcacagca

SEQ ID NO: 1338148 - RNA, 18 nt, Mycobacterium tuberculosis H37Rv
ccgguagaucagcgccug

SEQ ID NO: 1338149 - RNA, 22 nt, Mycobacterium tuberculosis H37Rv
ccgguacgcaaccaaccgucgg

SEQ ID NO: 1338150 - RNA, 16 nt, Mycobacterium tuberculosis H37Rv
ccgguaguagcugacc

SEQ ID NO: 1338151 - RNA, 18 nt, Mycobacterium tuberculosis H37Rv
ccgguaggcggccagcgc

SEQ ID NO: 1338152 - RNA, 16 nt, Mycobacterium tuberculosis H37Rv
ccgguaggcggccagc

SEQ ID NO: 1338153 - RNA, 15 nt, Mycobacterium tuberculosis H37Rv
ccgguagcggcggca

SEQ ID NO: 1338154 - RNA, 19 nt, Mycobacterium tuberculosis H37Rv
ccggucaccucgccggcgg

SEQ ID NO: 1338155 - RNA, 16 nt, Mycobacterium tuberculosis H37Rv
ccggucaccgcgcagc

SEQ ID NO: 1338156 - RNA, 18 nt, Mycobacterium tuberculosis H37Rv
ccggucaccucgccggcg

SEQ ID NO: 1338157 - RNA, 16 nt, Mycobacterium tuberculosis H37Rv
ccggucagcgcggcgc

SEQ ID NO: 1338158 - RNA, 12 nt, Mycobacterium tuberculosis H37Rv
ccggucagccgg

SEQ ID NO: 1338159 - RNA, 17 nt, Mycobacterium tuberculosis H37Rv
ccggucagcgcggcgca

SEQ ID NO: 1338160 - RNA, 16 nt, Mycobacterium tuberculosis H37Rv
ccggucaggccgccgc

SEQ ID NO: 1338161 - RNA, 18 nt, Mycobacterium tuberculosis H37Rv
ccggucaggccgccgcgg

SEQ ID NO: 1338162 - RNA, 14 nt, Mycobacterium tuberculosis H37Rv
ccggucgccucacc

SEQ ID NO: 1338163 - RNA, 15 nt, Mycobacterium tuberculosis H37Rv
ccggucgccgcgucu

SEQ ID NO: 1338164 - RNA, 13 nt, Mycobacterium tuberculosis H37Rv
ccggucgccgcgu

SEQ ID NO: 1338165 - RNA, 12 nt, Mycobacterium tuberculosis H37Rv
ccggucgccgcg

SEQ ID NO: 1338166 - RNA, 13 nt, Mycobacterium tuberculosis H37Rv
ccggucgccgcga

SEQ ID NO: 1338167 - RNA, 17 nt, Mycobacterium tuberculosis H37Rv
ccggucgccucaccggc

SEQ ID NO: 1338168 - RNA, 17 nt, Mycobacterium tuberculosis H37Rv
ccggucgaugucggcga

SEQ ID NO: 1338169 - RNA, 18 nt, Mycobacterium tuberculosis H37Rv
ccggucgcacuuggcccc

SEQ ID NO: 1338170 - RNA, 20 nt, Mycobacterium tuberculosis H37Rv
ccggugauggugugcagcag

SEQ ID NO: 1338171 - RNA, 14 nt, Mycobacterium tuberculosis H37Rv
ccggugauggccga

SEQ ID NO: 1338172 - RNA, 18 nt, Mycobacterium tuberculosis H37Rv
ccggugaugaucgcgccg

SEQ ID NO: 1338173 - RNA, 22 nt, Mycobacterium tuberculosis H37Rv
ccggugaugaucgcgccgggcu

SEQ ID NO: 1338174 - RNA, 17 nt, Mycobacterium tuberculosis H37Rv
ccggugccacccuugcc

SEQ ID NO: 1338175 - RNA, 22 nt, Mycobacterium tuberculosis H37Rv
ccggugccacccuugccgccgg

SEQ ID NO: 1338176 - RNA, 21 nt, Mycobacterium tuberculosis H37Rv
ccggucgggggcguccuccug

SEQ ID NO: 1338177 - RNA, 20 nt, Mycobacterium tuberculosis H37Rv
ccggucggguccaacgccgc

SEQ ID NO: 1338178 - RNA, 13 nt, Mycobacterium tuberculosis H37Rv
ccggucggcggca

SEQ ID NO: 1338179 - RNA, 15 nt, Mycobacterium tuberculosis H37Rv
ccggucggccaggcc

SEQ ID NO: 1338180 - RNA, 17 nt, Mycobacterium tuberculosis H37Rv
ccggucggccauccacc

SEQ ID NO: 1338181 - RNA, 13 nt, Mycobacterium tuberculosis H37Rv
ccggucggcacca

SEQ ID NO: 1338182 - RNA, 13 nt, Mycobacterium tuberculosis H37Rv
ccggucggcagcu

SEQ ID NO: 1338183 - RNA, 15 nt, Mycobacterium tuberculosis H37Rv
ccggucggugagccg

SEQ ID NO: 1338184 - RNA, 19 nt, Mycobacterium tuberculosis H37Rv
ccgguggcgccggggccgc

SEQ ID NO: 1338185 - RNA, 20 nt, Mycobacterium tuberculosis H37Rv
ccggugugcgccaaggucug

SEQ ID NO: 1338186 - RNA, 21 nt, Mycobacterium tuberculosis H37Rv
ccgguggccaacaccgccagc

SEQ ID NO: 1338187 - RNA, 15 nt, Mycobacterium tuberculosis H37Rv
ccgguggccaacacc

SEQ ID NO: 1338188 - RNA, 22 nt, Mycobacterium tuberculosis H37Rv
ccgguggcagggaaccauugcc

SEQ ID NO: 1338189 - RNA, 18 nt, Mycobacterium tuberculosis H37Rv
ccggugcgucacagccgg

SEQ ID NO: 1338190 - RNA, 19 nt, Mycobacterium tuberculosis H37Rv
ccggugcucaagcgcgucg

SEQ ID NO: 1338191 - RNA, 22 nt, Mycobacterium tuberculosis H37Rv
ccggugcugcgggaauccggug

SEQ ID NO: 1338192 - RNA, 23 nt, Mycobacterium tuberculosis H37Rv
ccgguggacagaugcauccagcu

SEQ ID NO: 1338193 - RNA, 22 nt, Mycobacterium tuberculosis H37Rv
ccggugcccaccaccgacagca

SEQ ID NO: 1338194 - RNA, 13 nt, Mycobacterium tuberculosis H37Rv
ccggugccgccau

SEQ ID NO: 1338195 - RNA, 17 nt, Mycobacterium tuberculosis H37Rv
ccggugccgccauugac

SEQ ID NO: 1338196 - RNA, 12 nt, Mycobacterium tuberculosis H37Rv
ccggugccgccc

SEQ ID NO: 1338197 - RNA, 22 nt, Mycobacterium tuberculosis H37Rv
ccggugcggccaaugacgucgg

SEQ ID NO: 1338198 - RNA, 14 nt, Mycobacterium tuberculosis H37Rv
ccggugcggcgggc

SEQ ID NO: 1338199 - RNA, 15 nt, Mycobacterium tuberculosis H37Rv
ccggugccgcccgcg

SEQ ID NO: 1338200 - RNA, 13 nt, Mycobacterium tuberculosis H37Rv
ccggugccgcagc

SEQ ID NO: 1338201 - RNA, 18 nt, Mycobacterium tuberculosis H37Rv
ccgguacaacccccaggc

SEQ ID NO: 1338202 - RNA, 21 nt, Mycobacterium tuberculosis H37Rv
ccgguaccgccggcuccgccg

SEQ ID NO: 1338203 - RNA, 15 nt, Mycobacterium tuberculosis H37Rv
ccgguaacgaacagc

SEQ ID NO: 1338204 - RNA, 20 nt, Mycobacterium tuberculosis H37Rv
ccggguugguacccaccagg

SEQ ID NO: 1338205 - RNA, 19 nt, Mycobacterium tuberculosis H37Rv
ccggguugguacccaccag

SEQ ID NO: 1338206 - RNA, 17 nt, Mycobacterium tuberculosis H37Rv
ccggguuggccggcgcu

SEQ ID NO: 1338207 - RNA, 16 nt, Mycobacterium tuberculosis H37Rv
ccggguuggccggcgc

SEQ ID NO: 1338208 - RNA, 16 nt, Mycobacterium tuberculosis H37Rv
ccggguugagccgccg

SEQ ID NO: 1338209 - RNA, 19 nt, Mycobacterium tuberculosis H37Rv
ccggguuggaagccgcacc

SEQ ID NO: 1338210 - RNA, 16 nt, Mycobacterium tuberculosis H37Rv
ccgggugacccgugcg

SEQ ID NO: 1338211 - RNA, 21 nt, Mycobacterium tuberculosis H37Rv
ccgggugaggcgggucgccgc

SEQ ID NO: 1338212 - RNA, 21 nt, Mycobacterium tuberculosis H37Rv
ccgggucgggcaccgcgcgcu

SEQ ID NO: 1338213 - RNA, 13 nt, Mycobacterium tuberculosis H37Rv
ccgggucggccgg

SEQ ID NO: 1338214 - RNA, 13 nt, Mycobacterium tuberculosis H37Rv
ccggguucgccgg

SEQ ID NO: 1338215 - RNA, 22 nt, Mycobacterium tuberculosis H37Rv
ccgggugcugugaacgaaggga

SEQ ID NO: 1338216 - RNA, 21 nt, Mycobacterium tuberculosis H37Rv
ccggguggccacgcccaggca

SEQ ID NO: 1338217 - RNA, 16 nt, Mycobacterium tuberculosis H37Rv
ccggguggcggcggcg

SEQ ID NO: 1338218 - RNA, 23 nt, Mycobacterium tuberculosis H37Rv
ccggguggcggcggcggagcgau

SEQ ID NO: 1338219 - RNA, 18 nt, Mycobacterium tuberculosis H37Rv
ccggguggcgucaccgcc

SEQ ID NO: 1338220 - RNA, 12 nt, Mycobacterium tuberculosis H37Rv
ccggguggcggc

SEQ ID NO: 1338221 - RNA, 17 nt, Mycobacterium tuberculosis H37Rv
ccgggcgcaagcagccc

SEQ ID NO: 1338222 - RNA, 17 nt, Mycobacterium tuberculosis H37Rv
ccgggcgaugcugggcg

SEQ ID NO: 1338223 - RNA, 23 nt, Mycobacterium tuberculosis H37Rv
ccgggcgauucgcaaucagcugg

SEQ ID NO: 1338224 - RNA, 19 nt, Mycobacterium tuberculosis H37Rv
ccgggcgugguaucgccgg

SEQ ID NO: 1338225 - RNA, 16 nt, Mycobacterium tuberculosis H37Rv
ccgggcgugcggcggc

SEQ ID NO: 1338226 - RNA, 17 nt, Mycobacterium tuberculosis H37Rv
ccgggcgugcggcggcc

SEQ ID NO: 1338227 - RNA, 19 nt, Mycobacterium tuberculosis H37Rv
ccgggcugccacggccuuc

SEQ ID NO: 1338228 - RNA, 22 nt, Mycobacterium tuberculosis H37Rv
ccgggcucggcgucgccgccau

SEQ ID NO: 1338229 - RNA, 14 nt, Mycobacterium tuberculosis H37Rv
ccgggcucagcugg

SEQ ID NO: 1338230 - RNA, 18 nt, Mycobacterium tuberculosis H37Rv
ccgggcucagcugggccg

SEQ ID NO: 1338231 - RNA, 19 nt, Mycobacterium tuberculosis H37Rv
ccgggcucagcugggccgc

SEQ ID NO: 1338232 - RNA, 19 nt, Mycobacterium tuberculosis H37Rv
ccgggcucggcgucgccgc

SEQ ID NO: 1338233 - RNA, 14 nt, Mycobacterium tuberculosis H37Rv
ccgggcguuucccu

SEQ ID NO: 1338234 - RNA, 13 nt, Mycobacterium tuberculosis H37Rv
ccggguccgccgg

SEQ ID NO: 1338235 - RNA, 19 nt, Mycobacterium tuberculosis H37Rv
ccgggucacgugggccaug

SEQ ID NO: 1338236 - RNA, 16 nt, Mycobacterium tuberculosis H37Rv
ccgggucagcccagcc

SEQ ID NO: 1338237 - RNA, 14 nt, Mycobacterium tuberculosis H37Rv
ccggguauggcggc

SEQ ID NO: 1338238 - RNA, 19 nt, Mycobacterium tuberculosis H37Rv
ccgggucgcaaccgccgcc

SEQ ID NO: 1338239 - RNA, 22 nt, Mycobacterium tuberculosis H37Rv
ccgggucgaacaggccggccgc

SEQ ID NO: 1338240 - RNA, 22 nt, Mycobacterium tuberculosis H37Rv
ccgggucccauuugccuugagc

SEQ ID NO: 1338241 - RNA, 13 nt, Mycobacterium tuberculosis H37Rv
ccggguccuugcg

SEQ ID NO: 1338242 - RNA, 14 nt, Mycobacterium tuberculosis H37Rv
ccgggucgaacagg

SEQ ID NO: 1338243 - RNA, 20 nt, Mycobacterium tuberculosis H37Rv
ccgggucgacgacgucgcgc

SEQ ID NO: 1338244 - RNA, 23 nt, Mycobacterium tuberculosis H37Rv
ccgggcacgaacaucagaucgcc

SEQ ID NO: 1338245 - RNA, 16 nt, Mycobacterium tuberculosis H37Rv
ccgggcagccgcgccg

SEQ ID NO: 1338246 - RNA, 17 nt, Mycobacterium tuberculosis H37Rv
ccgggcagccgcgccgc

SEQ ID NO: 1338247 - RNA, 19 nt, Mycobacterium tuberculosis H37Rv
ccgggcagccccuccgcgc

SEQ ID NO: 1338248 - RNA, 17 nt, Mycobacterium tuberculosis H37Rv
ccgggcaugaucacacu

SEQ ID NO: 1338249 - RNA, 20 nt, Mycobacterium tuberculosis H37Rv
ccgggcaugaucacacugcc

SEQ ID NO: 1338250 - RNA, 17 nt, Mycobacterium tuberculosis H37Rv
ccgggcaguuuggcggc

SEQ ID NO: 1338251 - RNA, 19 nt, Mycobacterium tuberculosis H37Rv
ccgggcauccuucaccagc

SEQ ID NO: 1338252 - RNA, 14 nt, Mycobacterium tuberculosis H37Rv
ccgggcagcugggc

SEQ ID NO: 1338253 - RNA, 16 nt, Mycobacterium tuberculosis H37Rv
ccgggccugggacggc

SEQ ID NO: 1338254 - RNA, 15 nt, Mycobacterium tuberculosis H37Rv
ccgggccuggccugc

SEQ ID NO: 1338255 - RNA, 22 nt, Mycobacterium tuberculosis H37Rv
ccgggccugggacggcggcagu

SEQ ID NO: 1338256 - RNA, 20 nt, Mycobacterium tuberculosis H37Rv
ccgggccugggacggcggca

SEQ ID NO: 1338257 - RNA, 16 nt, Mycobacterium tuberculosis H37Rv
ccgggcgaccaccacc

SEQ ID NO: 1338258 - RNA, 20 nt, Mycobacterium tuberculosis H37Rv
ccgggcgaguacaggcgcag

SEQ ID NO: 1338259 - RNA, 21 nt, Mycobacterium tuberculosis H37Rv
ccgggcgaguacaggcgcagc

SEQ ID NO: 1338260 - RNA, 22 nt, Mycobacterium tuberculosis H37Rv
ccgggcgaucaaagccagcacc

SEQ ID NO: 1338261 - RNA, 16 nt, Mycobacterium tuberculosis H37Rv
ccgggcccgucggaca

SEQ ID NO: 1338262 - RNA, 17 nt, Mycobacterium tuberculosis H37Rv
ccgggcccgccgucccc

SEQ ID NO: 1338263 - RNA, 17 nt, Mycobacterium tuberculosis H37Rv
ccgggccaggcugcgca

SEQ ID NO: 1338264 - RNA, 21 nt, Mycobacterium tuberculosis H37Rv
ccgggccaucgcauccccagc

SEQ ID NO: 1338265 - RNA, 22 nt, Mycobacterium tuberculosis H37Rv
ccgggccagaucgaagcgcagc

SEQ ID NO: 1338266 - RNA, 21 nt, Mycobacterium tuberculosis H37Rv
ccgggccacgucgagcacccg

SEQ ID NO: 1338267 - RNA, 16 nt, Mycobacterium tuberculosis H37Rv
ccgggcaaaucaagca

SEQ ID NO: 1338268 - RNA, 19 nt, Mycobacterium tuberculosis H37Rv
ccgggcaaaucaagcacag

SEQ ID NO: 1338269 - RNA, 22 nt, Mycobacterium tuberculosis H37Rv
ccggcugguugaccgaguugaa

SEQ ID NO: 1338270 - RNA, 19 nt, Mycobacterium tuberculosis H37Rv
ccggcugggcgccaccauc

SEQ ID NO: 1338271 - RNA, 15 nt, Mycobacterium tuberculosis H37Rv
ccgggcaaggcccgg

SEQ ID NO: 1338272 - RNA, 23 nt, Mycobacterium tuberculosis H37Rv
ccgggcaccaauaccgcacccgc

SEQ ID NO: 1338273 - RNA, 21 nt, Mycobacterium tuberculosis H37Rv
ccgggcaacggcggggccggc

SEQ ID NO: 1338274 - RNA, 12 nt, Mycobacterium tuberculosis H37Rv
ccgggcaccacc

SEQ ID NO: 1338275 - RNA, 24 nt, Mycobacterium tuberculosis H37Rv
ccgggcaacgcgaaccggccaucg

SEQ ID NO: 1338276 - RNA, 23 nt, Mycobacterium tuberculosis H37Rv
ccggcucaggggcuacuaggccc

SEQ ID NO: 1338277 - RNA, 13 nt, Mycobacterium tuberculosis H37Rv
ccggcuccacccc

SEQ ID NO: 1338278 - RNA, 16 nt, Mycobacterium tuberculosis H37Rv
ccggcuccuccccggc

SEQ ID NO: 1338279 - RNA, 21 nt, Mycobacterium tuberculosis H37Rv
ccggcuccuccccggcccgcu

SEQ ID NO: 1338280 - RNA, 20 nt, Mycobacterium tuberculosis H37Rv
ccggcuccgccagcgccgcc

SEQ ID NO: 1338281 - RNA, 18 nt, Mycobacterium tuberculosis H37Rv
ccggcugcaaccagcggc

SEQ ID NO: 1338282 - RNA, 20 nt, Mycobacterium tuberculosis H37Rv
ccggcugcaaccagcggcac

SEQ ID NO: 1338283 - RNA, 16 nt, Mycobacterium tuberculosis H37Rv
ccggcucgacugccac

SEQ ID NO: 1338284 - RNA, 14 nt, Mycobacterium tuberculosis H37Rv
ccggcuggccaggu

SEQ ID NO: 1338285 - RNA, 14 nt, Mycobacterium tuberculosis H37Rv
ccggcucgacugcc

SEQ ID NO: 1338286 - RNA, 20 nt, Mycobacterium tuberculosis H37Rv
ccggcugccagcgccgccgc

SEQ ID NO: 1338287 - RNA, 22 nt, Mycobacterium tuberculosis H37Rv
ccggcugccagcgccgccgccg

SEQ ID NO: 1338288 - RNA, 17 nt, Mycobacterium tuberculosis H37Rv
ccggcugccagcgccgc

SEQ ID NO: 1338289 - RNA, 15 nt, Mycobacterium tuberculosis H37Rv
ccggcugaucuacca

SEQ ID NO: 1338290 - RNA, 22 nt, Mycobacterium tuberculosis H37Rv
ccggcguaggcaggaucgccug

SEQ ID NO: 1338291 - RNA, 18 nt, Mycobacterium tuberculosis H37Rv
ccggcguacgccguaccc

SEQ ID NO: 1338292 - RNA, 19 nt, Mycobacterium tuberculosis H37Rv
ccggcguacucggugaucg

SEQ ID NO: 1338293 - RNA, 19 nt, Mycobacterium tuberculosis H37Rv
ccggcgguucugcggccgc

SEQ ID NO: 1338294 - RNA, 13 nt, Mycobacterium tuberculosis H37Rv
ccggcgguggugu

SEQ ID NO: 1338295 - RNA, 20 nt, Mycobacterium tuberculosis H37Rv
ccggcgguguuggcgccagc

SEQ ID NO: 1338296 - RNA, 22 nt, Mycobacterium tuberculosis H37Rv
ccggcgguguuggcgccagccc

SEQ ID NO: 1338297 - RNA, 17 nt, Mycobacterium tuberculosis H37Rv
ccggcgguggggccggc

SEQ ID NO: 1338298 - RNA, 18 nt, Mycobacterium tuberculosis H37Rv
ccggcgggaugcgcgccc

SEQ ID NO: 1338299 - RNA, 21 nt, Mycobacterium tuberculosis H37Rv
ccggcgggcgagugucagcag

SEQ ID NO: 1338300 - RNA, 13 nt, Mycobacterium tuberculosis H37Rv
ccggcgggcccgc

SEQ ID NO: 1338301 - RNA, 21 nt, Mycobacterium tuberculosis H37Rv
ccggcgggcccgccggccccg

SEQ ID NO: 1338302 - RNA, 19 nt, Mycobacterium tuberculosis H37Rv
ccggcgggcggugggcagc

SEQ ID NO: 1338303 - RNA, 14 nt, Mycobacterium tuberculosis H37Rv
ccggcgggcucgcc

SEQ ID NO: 1338304 - RNA, 20 nt, Mycobacterium tuberculosis H37Rv
ccggcgguagucggccagcu

SEQ ID NO: 1338305 - RNA, 13 nt, Mycobacterium tuberculosis H37Rv
ccggcggccgcgg

SEQ ID NO: 1338306 - RNA, 15 nt, Mycobacterium tuberculosis H37Rv
ccggcggcgaccaga

SEQ ID NO: 1338307 - RNA, 15 nt, Mycobacterium tuberculosis H37Rv
ccggcgcaacaaccg

SEQ ID NO: 1338308 - RNA, 21 nt, Mycobacterium tuberculosis H37Rv
ccggcgcaccaucgcggccgc

SEQ ID NO: 1338309 - RNA, 17 nt, Mycobacterium tuberculosis H37Rv
ccggcgcaccugggcug

SEQ ID NO: 1338310 - RNA, 17 nt, Mycobacterium tuberculosis H37Rv
ccggcuauuagcggcuu

SEQ ID NO: 1338311 - RNA, 22 nt, Mycobacterium tuberculosis H37Rv
ccggcucacagcacagcgcagc

SEQ ID NO: 1338312 - RNA, 23 nt, Mycobacterium tuberculosis H37Rv
ccggcuagggcagcagcccgggc

SEQ ID NO: 1338313 - RNA, 16 nt, Mycobacterium tuberculosis H37Rv
ccggcuacgacggcgc

SEQ ID NO: 1338314 - RNA, 23 nt, Mycobacterium tuberculosis H37Rv
ccggcuacggcgacacgccagcc

SEQ ID NO: 1338315 - RNA, 21 nt, Mycobacterium tuberculosis H37Rv
ccggcguugcguagacgaagg

SEQ ID NO: 1338316 - RNA, 19 nt, Mycobacterium tuberculosis H37Rv
ccggcguugccgccguccc

SEQ ID NO: 1338317 - RNA, 20 nt, Mycobacterium tuberculosis H37Rv
ccggcguugccgccgucccc

SEQ ID NO: 1338318 - RNA, 19 nt, Mycobacterium tuberculosis H37Rv
ccggcguuugggcaucauc

SEQ ID NO: 1338319 - RNA, 13 nt, Mycobacterium tuberculosis H37Rv
ccggcguguucug

SEQ ID NO: 1338320 - RNA, 19 nt, Mycobacterium tuberculosis H37Rv
ccggcgugucgccgccacc

SEQ ID NO: 1338321 - RNA, 21 nt, Mycobacterium tuberculosis H37Rv
ccggcgucugcccgcccagcc

SEQ ID NO: 1338322 - RNA, 13 nt, Mycobacterium tuberculosis H37Rv
ccggcgugcagua

SEQ ID NO: 1338323 - RNA, 18 nt, Mycobacterium tuberculosis H37Rv
ccggcgucgacgucggcc

SEQ ID NO: 1338324 - RNA, 20 nt, Mycobacterium tuberculosis H37Rv
ccggcgucugcccgcccagc

SEQ ID NO: 1338325 - RNA, 17 nt, Mycobacterium tuberculosis H37Rv
ccggcgucugcccgccc

SEQ ID NO: 1338326 - RNA, 18 nt, Mycobacterium tuberculosis H37Rv
ccggcgucggcgcccagc

SEQ ID NO: 1338327 - RNA, 22 nt, Mycobacterium tuberculosis H37Rv
ccggcgaauacgaccgucgcgc

SEQ ID NO: 1338328 - RNA, 18 nt, Mycobacterium tuberculosis H37Rv
ccggccuuauucacccgg

SEQ ID NO: 1338329 - RNA, 23 nt, Mycobacterium tuberculosis H37Rv
ccggccuuuacccgggcggcggc

SEQ ID NO: 1338330 - RNA, 18 nt, Mycobacterium tuberculosis H37Rv
ccggccuucaaggaagcc

SEQ ID NO: 1338331 - RNA, 11 nt, Mycobacterium tuberculosis H37Rv
ccggccuucuc

SEQ ID NO: 1338332 - RNA, 17 nt, Mycobacterium tuberculosis H37Rv
ccggccguugggccacc

SEQ ID NO: 1338333 - RNA, 22 nt, Mycobacterium tuberculosis H37Rv
ccggccggugaugaucggaaag

SEQ ID NO: 1338334 - RNA, 13 nt, Mycobacterium tuberculosis H37Rv
ccggccgucggcc

SEQ ID NO: 1338335 - RNA, 17 nt, Mycobacterium tuberculosis H37Rv
ccggccgguuggccagc

SEQ ID NO: 1338336 - RNA, 23 nt, Mycobacterium tuberculosis H37Rv
ccggccggguguagcucggaccc

SEQ ID NO: 1338337 - RNA, 19 nt, Mycobacterium tuberculosis H37Rv
ccggccgguaguagcugac

SEQ ID NO: 1338338 - RNA, 23 nt, Mycobacterium tuberculosis H37Rv
ccggcccugagcugccgagcggu

SEQ ID NO: 1338339 - RNA, 19 nt, Mycobacterium tuberculosis H37Rv
ccggcccugccgccggccc

SEQ ID NO: 1338340 - RNA, 20 nt, Mycobacterium tuberculosis H37Rv
ccggcccggggacgcccucg

SEQ ID NO: 1338341 - RNA, 19 nt, Mycobacterium tuberculosis H37Rv
ccggcccguagcugcgcag

SEQ ID NO: 1338342 - RNA, 20 nt, Mycobacterium tuberculosis H37Rv
ccggcccguagcugcgcagc

SEQ ID NO: 1338343 - RNA, 16 nt, Mycobacterium tuberculosis H37Rv
ccggcccgccaccccg

SEQ ID NO: 1338344 - RNA, 13 nt, Mycobacterium tuberculosis H37Rv
ccggcccgccacc

SEQ ID NO: 1338345 - RNA, 15 nt, Mycobacterium tuberculosis H37Rv
ccggcccgcauccgc

SEQ ID NO: 1338346 - RNA, 14 nt, Mycobacterium tuberculosis H37Rv
ccggcccgcagcca

SEQ ID NO: 1338347 - RNA, 22 nt, Mycobacterium tuberculosis H37Rv
ccggccaggucgacaccgcggu

SEQ ID NO: 1338348 - RNA, 18 nt, Mycobacterium tuberculosis H37Rv
ccggccauaccgcucgcc

SEQ ID NO: 1338349 - RNA, 24 nt, Mycobacterium tuberculosis H37Rv
ccggccccgccguuuccgccgccg

SEQ ID NO: 1338350 - RNA, 20 nt, Mycobacterium tuberculosis H37Rv
ccggccaggccggcggcggc

SEQ ID NO: 1338351 - RNA, 17 nt, Mycobacterium tuberculosis H37Rv
ccggccaggucgacacc

SEQ ID NO: 1338352 - RNA, 16 nt, Mycobacterium tuberculosis H37Rv
ccggccaggccggcgg

SEQ ID NO: 1338353 - RNA, 15 nt, Mycobacterium tuberculosis H37Rv
ccggccagcggcagg

SEQ ID NO: 1338354 - RNA, 18 nt, Mycobacterium tuberculosis H37Rv
ccggccagcuccucagcc

SEQ ID NO: 1338355 - RNA, 18 nt, Mycobacterium tuberculosis H37Rv
ccggccaacggcacccug

SEQ ID NO: 1338356 - RNA, 21 nt, Mycobacterium tuberculosis H37Rv
ccggccaaaauuuugucggcc

SEQ ID NO: 1338357 - RNA, 20 nt, Mycobacterium tuberculosis H37Rv
ccggcauuccguaggccaca

SEQ ID NO: 1338358 - RNA, 12 nt, Mycobacterium tuberculosis H37Rv
ccggcaugccag

SEQ ID NO: 1338359 - RNA, 19 nt, Mycobacterium tuberculosis H37Rv
ccggcaucggucagcgcgg

SEQ ID NO: 1338360 - RNA, 17 nt, Mycobacterium tuberculosis H37Rv
ccggcaucggucagcgc

SEQ ID NO: 1338361 - RNA, 15 nt, Mycobacterium tuberculosis H37Rv
ccggcauacagccgg

SEQ ID NO: 1338362 - RNA, 17 nt, Mycobacterium tuberculosis H37Rv
ccggcauaccgaacagc

SEQ ID NO: 1338363 - RNA, 21 nt, Mycobacterium tuberculosis H37Rv
ccggcagcguccgaaccaccu

SEQ ID NO: 1338364 - RNA, 13 nt, Mycobacterium tuberculosis H37Rv
ccggcagcgucgg

SEQ ID NO: 1338365 - RNA, 15 nt, Mycobacterium tuberculosis H37Rv
ccggcagcgucggcc

SEQ ID NO: 1338366 - RNA, 19 nt, Mycobacterium tuberculosis H37Rv
ccggcagcuugcagugccg

SEQ ID NO: 1338367 - RNA, 15 nt, Mycobacterium tuberculosis H37Rv
ccggcagcggcuggg

SEQ ID NO: 1338368 - RNA, 19 nt, Mycobacterium tuberculosis H37Rv
ccggcaggcccgacggcgc

SEQ ID NO: 1338369 - RNA, 22 nt, Mycobacterium tuberculosis H37Rv
ccggcagaugcagcgggucgcc

SEQ ID NO: 1338370 - RNA, 16 nt, Mycobacterium tuberculosis H37Rv
ccggcagaugcagcgg

SEQ ID NO: 1338371 - RNA, 17 nt, Mycobacterium tuberculosis H37Rv
ccggcagcagccggcgg

SEQ ID NO: 1338372 - RNA, 20 nt, Mycobacterium tuberculosis H37Rv
ccggcagcgcgaucgauucc

SEQ ID NO: 1338373 - RNA, 16 nt, Mycobacterium tuberculosis H37Rv
ccggcagcggcgcgcu

SEQ ID NO: 1338374 - RNA, 20 nt, Mycobacterium tuberculosis H37Rv
ccggcagcggcgcucggcgc

SEQ ID NO: 1338375 - RNA, 20 nt, Mycobacterium tuberculosis H37Rv
ccggcagcgguggcaagccu

SEQ ID NO: 1338376 - RNA, 13 nt, Mycobacterium tuberculosis H37Rv
ccggcagcggcug

SEQ ID NO: 1338377 - RNA, 22 nt, Mycobacterium tuberculosis H37Rv
ccggcagcaucggcaccccggc

SEQ ID NO: 1338378 - RNA, 19 nt, Mycobacterium tuberculosis H37Rv
ccggcagcgcccccggacu

SEQ ID NO: 1338379 - RNA, 20 nt, Mycobacterium tuberculosis H37Rv
ccggcaccggggcugcccgc

SEQ ID NO: 1338380 - RNA, 14 nt, Mycobacterium tuberculosis H37Rv
ccggcacgcagcca

SEQ ID NO: 1338381 - RNA, 17 nt, Mycobacterium tuberculosis H37Rv
ccggcaccuccagcacc

SEQ ID NO: 1338382 - RNA, 13 nt, Mycobacterium tuberculosis H37Rv
ccggcaccucccu

SEQ ID NO: 1338383 - RNA, 16 nt, Mycobacterium tuberculosis H37Rv
ccggcaccucccuggc

SEQ ID NO: 1338384 - RNA, 17 nt, Mycobacterium tuberculosis H37Rv
ccggcaccucccuggcc

SEQ ID NO: 1338385 - RNA, 18 nt, Mycobacterium tuberculosis H37Rv
ccggcaccucccuggccc

SEQ ID NO: 1338386 - RNA, 14 nt, Mycobacterium tuberculosis H37Rv
ccggcaccuccgcc

SEQ ID NO: 1338387 - RNA, 14 nt, Mycobacterium tuberculosis H37Rv
ccggcaccggggcu

SEQ ID NO: 1338388 - RNA, 18 nt, Mycobacterium tuberculosis H37Rv
ccggcaccggccgugccg

SEQ ID NO: 1338389 - RNA, 13 nt, Mycobacterium tuberculosis H37Rv
ccggcaccgccug

SEQ ID NO: 1338390 - RNA, 13 nt, Mycobacterium tuberculosis H37Rv
ccggcacgggcgu

SEQ ID NO: 1338391 - RNA, 19 nt, Mycobacterium tuberculosis H37Rv
ccggcacgggcgucgucgg

SEQ ID NO: 1338392 - RNA, 16 nt, Mycobacterium tuberculosis H37Rv
ccggcacccgaguuau

SEQ ID NO: 1338393 - RNA, 16 nt, Mycobacterium tuberculosis H37Rv
ccggcaccccacggcc

SEQ ID NO: 1338394 - RNA, 14 nt, Mycobacterium tuberculosis H37Rv
ccggcacccaccag

SEQ ID NO: 1338395 - RNA, 13 nt, Mycobacterium tuberculosis H37Rv
ccggcacccacca

SEQ ID NO: 1338396 - RNA, 14 nt, Mycobacterium tuberculosis H37Rv
ccggcacccgcugg

SEQ ID NO: 1338397 - RNA, 18 nt, Mycobacterium tuberculosis H37Rv
ccggcacccaccagugca

SEQ ID NO: 1338398 - RNA, 19 nt, Mycobacterium tuberculosis H37Rv
ccggcaccgccgguggcgc

SEQ ID NO: 1338399 - RNA, 19 nt, Mycobacterium tuberculosis H37Rv
ccggcaauaccgccagcgc

SEQ ID NO: 1338400 - RNA, 16 nt, Mycobacterium tuberculosis H37Rv
ccggcaaucggcggca

SEQ ID NO: 1338401 - RNA, 23 nt, Mycobacterium tuberculosis H37Rv
ccggaccgcggauuccagcgcgu

SEQ ID NO: 1338402 - RNA, 14 nt, Mycobacterium tuberculosis H37Rv
ccggacgaccggaa

SEQ ID NO: 1338403 - RNA, 22 nt, Mycobacterium tuberculosis H37Rv
ccggaccgggggaagcgguagc

SEQ ID NO: 1338404 - RNA, 16 nt, Mycobacterium tuberculosis H37Rv
ccggaccgaccaccgc

SEQ ID NO: 1338405 - RNA, 14 nt, Mycobacterium tuberculosis H37Rv
ccggaccgaccacc

SEQ ID NO: 1338406 - RNA, 18 nt, Mycobacterium tuberculosis H37Rv
ccggacccacccgcaccg

SEQ ID NO: 1338407 - RNA, 21 nt, Mycobacterium tuberculosis H37Rv
ccggacccuuacccggcgcga

SEQ ID NO: 1338408 - RNA, 11 nt, Mycobacterium tuberculosis H37Rv
ccggacccgcu

SEQ ID NO: 1338409 - RNA, 20 nt, Mycobacterium tuberculosis H37Rv
ccggacccgccggguccgcc

SEQ ID NO: 1338410 - RNA, 23 nt, Mycobacterium tuberculosis H37Rv
ccggacaugcgggcagcacucuu

SEQ ID NO: 1338411 - RNA, 20 nt, Mycobacterium tuberculosis H37Rv
ccggaccaucgacaacgccu

SEQ ID NO: 1338412 - RNA, 22 nt, Mycobacterium tuberculosis H37Rv
ccggaccacuguuggugccgcc

SEQ ID NO: 1338413 - RNA, 17 nt, Mycobacterium tuberculosis H37Rv
ccggacauagccgcgcu

SEQ ID NO: 1338414 - RNA, 20 nt, Mycobacterium tuberculosis H37Rv
ccggacagcguaucucccaa

SEQ ID NO: 1338415 - RNA, 15 nt, Mycobacterium tuberculosis H37Rv
ccggacagggcggcg

SEQ ID NO: 1338416 - RNA, 18 nt, Mycobacterium tuberculosis H37Rv
ccgcuuugcgcggucagc

SEQ ID NO: 1338417 - RNA, 13 nt, Mycobacterium tuberculosis H37Rv
ccgcuuucuuggc

SEQ ID NO: 1338418 - RNA, 17 nt, Mycobacterium tuberculosis H37Rv
ccgcuuucuuggcgggc

SEQ ID NO: 1338419 - RNA, 20 nt, Mycobacterium tuberculosis H37Rv
ccgcuuugaauugcgcgccc

SEQ ID NO: 1338420 - RNA, 21 nt, Mycobacterium tuberculosis H37Rv
ccggacaaagcugcucgucgg

SEQ ID NO: 1338421 - RNA, 23 nt, Mycobacterium tuberculosis H37Rv
ccggacaaccuggggccaccaga

SEQ ID NO: 1338422 - RNA, 16 nt, Mycobacterium tuberculosis H37Rv
ccggacaacugguggc

SEQ ID NO: 1338423 - RNA, 21 nt, Mycobacterium tuberculosis H37Rv
ccgcuuaucgaacgucucggc

SEQ ID NO: 1338424 - RNA, 13 nt, Mycobacterium tuberculosis H37Rv
ccgcuucccccgg

SEQ ID NO: 1338425 - RNA, 15 nt, Mycobacterium tuberculosis H37Rv
ccgcuucgcccggcu

SEQ ID NO: 1338426 - RNA, 23 nt, Mycobacterium tuberculosis H37Rv
ccgcugugauagcgccguacagc

SEQ ID NO: 1338427 - RNA, 21 nt, Mycobacterium tuberculosis H37Rv
ccgccucguacggaccgucgc

SEQ ID NO: 1338428 - RNA, 16 nt, Mycobacterium tuberculosis H37Rv
ccgccucugucuucag

SEQ ID NO: 1338429 - RNA, 18 nt, Mycobacterium tuberculosis H37Rv
ccgccucgaccgccagcc

SEQ ID NO: 1338430 - RNA, 13 nt, Mycobacterium tuberculosis H37Rv
ccgccuccgccug

SEQ ID NO: 1338431 - RNA, 21 nt, Mycobacterium tuberculosis H37Rv
ccgccuccucgauagcggcgc

SEQ ID NO: 1338432 - RNA, 20 nt, Mycobacterium tuberculosis H37Rv
ccggauagcgucgucccagc

SEQ ID NO: 1338433 - RNA, 14 nt, Mycobacterium tuberculosis H37Rv
ccggauacgggcgu

SEQ ID NO: 1338434 - RNA, 15 nt, Mycobacterium tuberculosis H37Rv
ccggacgccaugccc

SEQ ID NO: 1338435 - RNA, 22 nt, Mycobacterium tuberculosis H37Rv
ccggacgcacgauccgcacccg

SEQ ID NO: 1338436 - RNA, 20 nt, Mycobacterium tuberculosis H37Rv
ccggacgauggcgucggcca

SEQ ID NO: 1338437 - RNA, 17 nt, Mycobacterium tuberculosis H37Rv
ccggauccgccagaccg

SEQ ID NO: 1338438 - RNA, 21 nt, Mycobacterium tuberculosis H37Rv
ccggaucccugugccagcagc

SEQ ID NO: 1338439 - RNA, 14 nt, Mycobacterium tuberculosis H37Rv
ccggaucgccacgg

SEQ ID NO: 1338440 - RNA, 18 nt, Mycobacterium tuberculosis H37Rv
ccggaucccaccaccgcu

SEQ ID NO: 1338441 - RNA, 17 nt, Mycobacterium tuberculosis H37Rv
ccggaucccaccaccgc

SEQ ID NO: 1338442 - RNA, 14 nt, Mycobacterium tuberculosis H37Rv
ccggaucccaccac

SEQ ID NO: 1338443 - RNA, 15 nt, Mycobacterium tuberculosis H37Rv
ccggaucccaccacc

SEQ ID NO: 1338444 - RNA, 14 nt, Mycobacterium tuberculosis H37Rv
ccggauaucgacca

SEQ ID NO: 1338445 - RNA, 22 nt, Mycobacterium tuberculosis H37Rv
ccggaucgucgaacagcaccgc

SEQ ID NO: 1338446 - RNA, 21 nt, Mycobacterium tuberculosis H37Rv
ccggaucugacggcgccgucg

SEQ ID NO: 1338447 - RNA, 16 nt, Mycobacterium tuberculosis H37Rv
ccggaucugacggcgc

SEQ ID NO: 1338448 - RNA, 16 nt, Mycobacterium tuberculosis H37Rv
ccggaucggucggcac

SEQ ID NO: 1338449 - RNA, 19 nt, Mycobacterium tuberculosis H37Rv
ccggaucgucgaacagcac

SEQ ID NO: 1338450 - RNA, 21 nt, Mycobacterium tuberculosis H37Rv
ccggaucggucggcaccaggu

SEQ ID NO: 1338451 - RNA, 14 nt, Mycobacterium tuberculosis H37Rv
ccggaucgcucccg

SEQ ID NO: 1338452 - RNA, 17 nt, Mycobacterium tuberculosis H37Rv
ccggaucgcucccgucu

SEQ ID NO: 1338453 - RNA, 17 nt, Mycobacterium tuberculosis H37Rv
ccggcaagcacaccgcc

SEQ ID NO: 1338454 - RNA, 22 nt, Mycobacterium tuberculosis H37Rv
ccggcaagcacaccgccagcgg

SEQ ID NO: 1338455 - RNA, 23 nt, Mycobacterium tuberculosis H37Rv
ccggcaagcacaccgccagcggc

SEQ ID NO: 1338456 - RNA, 11 nt, Mycobacterium tuberculosis H37Rv
ccggcaagcag

SEQ ID NO: 1338457 - RNA, 16 nt, Mycobacterium tuberculosis H37Rv
ccggcaacgugcggug

SEQ ID NO: 1338458 - RNA, 21 nt, Mycobacterium tuberculosis H37Rv
ccggcaaccaccggccgcgca

SEQ ID NO: 1338459 - RNA, 23 nt, Mycobacterium tuberculosis H37Rv
ccggcaacggcgcgccgaccacc

SEQ ID NO: 1338460 - RNA, 15 nt, Mycobacterium tuberculosis H37Rv
ccggcaacgcggccu

SEQ ID NO: 1338461 - RNA, 19 nt, Mycobacterium tuberculosis H37Rv
ccggcaacaucagcaggac

SEQ ID NO: 1338462 - RNA, 21 nt, Mycobacterium tuberculosis H37Rv
ccggcaacaucgagcgccagc

SEQ ID NO: 1338463 - RNA, 14 nt, Mycobacterium tuberculosis H37Rv
ccggcaaacuccag

SEQ ID NO: 1338464 - RNA, 13 nt, Mycobacterium tuberculosis H37Rv
ccggaugcggucc

SEQ ID NO: 1338465 - RNA, 19 nt, Mycobacterium tuberculosis H37Rv
ccggaugcugucagcagcc

SEQ ID NO: 1338466 - RNA, 16 nt, Mycobacterium tuberculosis H37Rv
ccggauuucgucgggc

SEQ ID NO: 1338467 - RNA, 22 nt, Mycobacterium tuberculosis H37Rv
ccggauuucgucgggcaccgcc

SEQ ID NO: 1338468 - RNA, 15 nt, Mycobacterium tuberculosis H37Rv
ccggauucuccgccc

SEQ ID NO: 1338469 - RNA, 15 nt, Mycobacterium tuberculosis H37Rv
ccggauugacgccga

SEQ ID NO: 1338470 - RNA, 15 nt, Mycobacterium tuberculosis H37Rv
ccggauugagcacgc

SEQ ID NO: 1338471 - RNA, 19 nt, Mycobacterium tuberculosis H37Rv
ccggauguauuccaggcgu

SEQ ID NO: 1338472 - RNA, 15 nt, Mycobacterium tuberculosis H37Rv
ccguucugcccaggc

SEQ ID NO: 1338473 - RNA, 16 nt, Mycobacterium tuberculosis H37Rv
ccguucugcccaggca

SEQ ID NO: 1338474 - RNA, 21 nt, Mycobacterium tuberculosis H37Rv
ccguugaacggcaccagcggg

SEQ ID NO: 1338475 - RNA, 21 nt, Mycobacterium tuberculosis H37Rv
ccguugccgccgacgccgccg

SEQ ID NO: 1338476 - RNA, 15 nt, Mycobacterium tuberculosis H37Rv
ccguugccgccgccu

SEQ ID NO: 1338477 - RNA, 23 nt, Mycobacterium tuberculosis H37Rv
ccguugccgccguuaccgagccc

SEQ ID NO: 1338478 - RNA, 16 nt, Mycobacterium tuberculosis H37Rv
ccguugccgccgucgc

SEQ ID NO: 1338479 - RNA, 17 nt, Mycobacterium tuberculosis H37Rv
ccguugccgaucgcucc

SEQ ID NO: 1338480 - RNA, 12 nt, Mycobacterium tuberculosis H37Rv
ccguugcccccg

SEQ ID NO: 1338481 - RNA, 24 nt, Mycobacterium tuberculosis H37Rv
ccguugccgaaccacgcgcccgca

SEQ ID NO: 1338482 - RNA, 17 nt, Mycobacterium tuberculosis H37Rv
ccguugccgaucagucc

SEQ ID NO: 1338483 - RNA, 16 nt, Mycobacterium tuberculosis H37Rv
ccguucuggaaccccg

SEQ ID NO: 1338484 - RNA, 18 nt, Mycobacterium tuberculosis H37Rv
ccguugagcauaugacgu

SEQ ID NO: 1338485 - RNA, 19 nt, Mycobacterium tuberculosis H37Rv
ccguugaguguguuugagu

SEQ ID NO: 1338486 - RNA, 20 nt, Mycobacterium tuberculosis H37Rv
ccguuggugccgccugugcc

SEQ ID NO: 1338487 - RNA, 14 nt, Mycobacterium tuberculosis H37Rv
ccguugggccgacu

SEQ ID NO: 1338488 - RNA, 20 nt, Mycobacterium tuberculosis H37Rv
ccguugcucccacggcaccc

SEQ ID NO: 1338489 - RNA, 15 nt, Mycobacterium tuberculosis H37Rv
ccguuguccagcgcg

SEQ ID NO: 1338490 - RNA, 19 nt, Mycobacterium tuberculosis H37Rv
ccguuguucuugucggagc

SEQ ID NO: 1338491 - RNA, 21 nt, Mycobacterium tuberculosis H37Rv
ccguuguggccgccuucgccg

SEQ ID NO: 1338492 - RNA, 18 nt, Mycobacterium tuberculosis H37Rv
ccguucccgccggccccg

SEQ ID NO: 1338493 - RNA, 14 nt, Mycobacterium tuberculosis H37Rv
ccguucgccgucgg

SEQ ID NO: 1338494 - RNA, 19 nt, Mycobacterium tuberculosis H37Rv
ccguucgaccguguaacca

SEQ ID NO: 1338495 - RNA, 14 nt, Mycobacterium tuberculosis H37Rv
ccguucgcuccccc

SEQ ID NO: 1338496 - RNA, 17 nt, Mycobacterium tuberculosis H37Rv
ccguucgcucagggugu

SEQ ID NO: 1338497 - RNA, 20 nt, Mycobacterium tuberculosis H37Rv
ccguucggcugccgcgcgcu

SEQ ID NO: 1338498 - RNA, 18 nt, Mycobacterium tuberculosis H37Rv
ccguucggcgcccgcucg

SEQ ID NO: 1338499 - RNA, 16 nt, Mycobacterium tuberculosis H37Rv
ccguucggcuaagccu

SEQ ID NO: 1338500 - RNA, 21 nt, Mycobacterium tuberculosis H37Rv
ccguucacccagcggaaccga

SEQ ID NO: 1338501 - RNA, 13 nt, Mycobacterium tuberculosis H37Rv
ccguuaccgccaa

SEQ ID NO: 1338502 - RNA, 22 nt, Mycobacterium tuberculosis H37Rv
ccguuagcuuagcugccgucgg

SEQ ID NO: 1338503 - RNA, 15 nt, Mycobacterium tuberculosis H37Rv
ccguuuccgccgccg

SEQ ID NO: 1338504 - RNA, 16 nt, Mycobacterium tuberculosis H37Rv
ccguuuccgccgccgc

SEQ ID NO: 1338505 - RNA, 19 nt, Mycobacterium tuberculosis H37Rv
ccuaaaccggcgcuaaacc

SEQ ID NO: 1338506 - RNA, 20 nt, Mycobacterium tuberculosis H37Rv
ccuaaaccggcgcuaaaccg

SEQ ID NO: 1338507 - RNA, 18 nt, Mycobacterium tuberculosis H37Rv
ccuaaaccagccaccacc

SEQ ID NO: 1338508 - RNA, 18 nt, Mycobacterium tuberculosis H37Rv
ccuaaggcucaccaggcg

SEQ ID NO: 1338509 - RNA, 14 nt, Mycobacterium tuberculosis H37Rv
ccuaacucgccugc

SEQ ID NO: 1338510 - RNA, 21 nt, Mycobacterium tuberculosis H37Rv
ccgucguugccggcgaccaug

SEQ ID NO: 1338511 - RNA, 17 nt, Mycobacterium tuberculosis H37Rv
ccgucguugugccgguc

SEQ ID NO: 1338512 - RNA, 22 nt, Mycobacterium tuberculosis H37Rv
ccgucgucguuucgccagccgg

SEQ ID NO: 1338513 - RNA, 22 nt, Mycobacterium tuberculosis H37Rv
ccgucucgaagcucagcuucuu

SEQ ID NO: 1338514 - RNA, 17 nt, Mycobacterium tuberculosis H37Rv
ccgucucgucggcaaca

SEQ ID NO: 1338515 - RNA, 19 nt, Mycobacterium tuberculosis H37Rv
ccgucuccggcgccaccgc

SEQ ID NO: 1338516 - RNA, 14 nt, Mycobacterium tuberculosis H37Rv
ccgucucgccgugg

SEQ ID NO: 1338517 - RNA, 15 nt, Mycobacterium tuberculosis H37Rv
ccgucucggcgaccg

SEQ ID NO: 1338518 - RNA, 15 nt, Mycobacterium tuberculosis H37Rv
ccgucucgccgcgca

SEQ ID NO: 1338519 - RNA, 18 nt, Mycobacterium tuberculosis H37Rv
ccgugcaccuccagguag

SEQ ID NO: 1338520 - RNA, 23 nt, Mycobacterium tuberculosis H37Rv
ccgucugacagcauccuucgcgu

SEQ ID NO: 1338521 - RNA, 19 nt, Mycobacterium tuberculosis H37Rv
ccgucugacccaccgcccc

SEQ ID NO: 1338522 - RNA, 16 nt, Mycobacterium tuberculosis H37Rv
ccgucugacagcaucc

SEQ ID NO: 1338523 - RNA, 18 nt, Mycobacterium tuberculosis H37Rv
ccgucugcgacccgggcc

SEQ ID NO: 1338524 - RNA, 15 nt, Mycobacterium tuberculosis H37Rv
ccgucugcgacccgg

SEQ ID NO: 1338525 - RNA, 14 nt, Mycobacterium tuberculosis H37Rv
ccgugcccggugcg

SEQ ID NO: 1338526 - RNA, 14 nt, Mycobacterium tuberculosis H37Rv
ccgugccgaccacc

SEQ ID NO: 1338527 - RNA, 15 nt, Mycobacterium tuberculosis H37Rv
ccgugccgaccacca

SEQ ID NO: 1338528 - RNA, 16 nt, Mycobacterium tuberculosis H37Rv
ccgugccgaccaccag

SEQ ID NO: 1338529 - RNA, 17 nt, Mycobacterium tuberculosis H37Rv
ccgugccgaccaccagc

SEQ ID NO: 1338530 - RNA, 13 nt, Mycobacterium tuberculosis H37Rv
ccguguccagcau

SEQ ID NO: 1338531 - RNA, 15 nt, Mycobacterium tuberculosis H37Rv
ccgugugccacgggg

SEQ ID NO: 1338532 - RNA, 19 nt, Mycobacterium tuberculosis H37Rv
ccgugugcuucgagcaccg

SEQ ID NO: 1338533 - RNA, 19 nt, Mycobacterium tuberculosis H37Rv
ccgugugugcgauccaggg

SEQ ID NO: 1338534 - RNA, 16 nt, Mycobacterium tuberculosis H37Rv
ccgugucgagaucuca

SEQ ID NO: 1338535 - RNA, 16 nt, Mycobacterium tuberculosis H37Rv
ccgugguguacccgcc

SEQ ID NO: 1338536 - RNA, 23 nt, Mycobacterium tuberculosis H37Rv
ccguggugguugaucagccagac

SEQ ID NO: 1338537 - RNA, 20 nt, Mycobacterium tuberculosis H37Rv
ccguggugcuagcgccgcca

SEQ ID NO: 1338538 - RNA, 15 nt, Mycobacterium tuberculosis H37Rv
ccgugguggucgggc

SEQ ID NO: 1338539 - RNA, 21 nt, Mycobacterium tuberculosis H37Rv
ccgugucacgcgaccaccgcc

SEQ ID NO: 1338540 - RNA, 13 nt, Mycobacterium tuberculosis H37Rv
ccguguaggccau

SEQ ID NO: 1338541 - RNA, 12 nt, Mycobacterium tuberculosis H37Rv
ccguggugauca

SEQ ID NO: 1338542 - RNA, 14 nt, Mycobacterium tuberculosis H37Rv
ccguggucgaggug

SEQ ID NO: 1338543 - RNA, 23 nt, Mycobacterium tuberculosis H37Rv
ccguggguguugaugggcagccg

SEQ ID NO: 1338544 - RNA, 20 nt, Mycobacterium tuberculosis H37Rv
ccgugggcagcgcgcccgac

SEQ ID NO: 1338545 - RNA, 19 nt, Mycobacterium tuberculosis H37Rv
ccguggccaaacuuucggg

SEQ ID NO: 1338546 - RNA, 18 nt, Mycobacterium tuberculosis H37Rv
ccguggacaagcacagcg

SEQ ID NO: 1338547 - RNA, 22 nt, Mycobacterium tuberculosis H37Rv
ccguggaagauguugccgccgg

SEQ ID NO: 1338548 - RNA, 20 nt, Mycobacterium tuberculosis H37Rv
ccgugcgucgauggcgucgg

SEQ ID NO: 1338549 - RNA, 17 nt, Mycobacterium tuberculosis H37Rv
ccgugcugggccgacgg

SEQ ID NO: 1338550 - RNA, 21 nt, Mycobacterium tuberculosis H37Rv
ccgugcuuuccuugcgcgcca

SEQ ID NO: 1338551 - RNA, 14 nt, Mycobacterium tuberculosis H37Rv
ccguggaaagugcg

SEQ ID NO: 1338552 - RNA, 19 nt, Mycobacterium tuberculosis H37Rv
ccguggcgccggucgccgg

SEQ ID NO: 1338553 - RNA, 21 nt, Mycobacterium tuberculosis H37Rv
ccguggccggacccauuggac

SEQ ID NO: 1338554 - RNA, 19 nt, Mycobacterium tuberculosis H37Rv
ccguggccugaaacggcug

SEQ ID NO: 1338555 - RNA, 11 nt, Mycobacterium tuberculosis H37Rv
ccguggcccaa

SEQ ID NO: 1338556 - RNA, 13 nt, Mycobacterium tuberculosis H37Rv
ccgguucagcgcu

SEQ ID NO: 1338557 - RNA, 22 nt, Mycobacterium tuberculosis H37Rv
ccgguuccgcaaugaccuggcc

SEQ ID NO: 1338558 - RNA, 22 nt, Mycobacterium tuberculosis H37Rv
ccgguguuuccgaaacccgccg

SEQ ID NO: 1338559 - RNA, 15 nt, Mycobacterium tuberculosis H37Rv
ccgguguugccgccg

SEQ ID NO: 1338560 - RNA, 21 nt, Mycobacterium tuberculosis H37Rv
ccgguguugagcgaacccgcg

SEQ ID NO: 1338561 - RNA, 19 nt, Mycobacterium tuberculosis H37Rv
ccgguguuagugaggcccg

SEQ ID NO: 1338562 - RNA, 20 nt, Mycobacterium tuberculosis H37Rv
ccgguuccgccggccccacc

SEQ ID NO: 1338563 - RNA, 16 nt, Mycobacterium tuberculosis H37Rv
ccgguuccgccggccc

SEQ ID NO: 1338564 - RNA, 13 nt, Mycobacterium tuberculosis H37Rv
ccgguuccucagc

SEQ ID NO: 1338565 - RNA, 14 nt, Mycobacterium tuberculosis H37Rv
ccgguuccucagcg

SEQ ID NO: 1338566 - RNA, 21 nt, Mycobacterium tuberculosis H37Rv
ccgguucggggggcaggucga

SEQ ID NO: 1338567 - RNA, 14 nt, Mycobacterium tuberculosis H37Rv
ccgguuggacugac

SEQ ID NO: 1338568 - RNA, 24 nt, Mycobacterium tuberculosis H37Rv
ccgguugcggucagacgccggccg

SEQ ID NO: 1338569 - RNA, 20 nt, Mycobacterium tuberculosis H37Rv
ccgguugugcgcgcgcccga

SEQ ID NO: 1338570 - RNA, 18 nt, Mycobacterium tuberculosis H37Rv
ccgguugugcgcgcgccc

SEQ ID NO: 1338571 - RNA, 17 nt, Mycobacterium tuberculosis H37Rv
ccgguugucgcagcgca

SEQ ID NO: 1338572 - RNA, 23 nt, Mycobacterium tuberculosis H37Rv
ccgucgacagucaacagggccag

SEQ ID NO: 1338573 - RNA, 20 nt, Mycobacterium tuberculosis H37Rv
ccgucgacaacaaacccggc

SEQ ID NO: 1338574 - RNA, 21 nt, Mycobacterium tuberculosis H37Rv
ccgucgacaacaaacccggcc

SEQ ID NO: 1338575 - RNA, 20 nt, Mycobacterium tuberculosis H37Rv
ccgucgacaccgcggacccg

SEQ ID NO: 1338576 - RNA, 20 nt, Mycobacterium tuberculosis H37Rv
ccgucgccggauagcgcagc

SEQ ID NO: 1338577 - RNA, 16 nt, Mycobacterium tuberculosis H37Rv
ccgucgcgucgaccgg

SEQ ID NO: 1338578 - RNA, 21 nt, Mycobacterium tuberculosis H37Rv
ccgucgcugacgcccuccugg

SEQ ID NO: 1338579 - RNA, 15 nt, Mycobacterium tuberculosis H37Rv
ccgucggagccggcc

SEQ ID NO: 1338580 - RNA, 13 nt, Mycobacterium tuberculosis H37Rv
ccgucggaacuga

SEQ ID NO: 1338581 - RNA, 21 nt, Mycobacterium tuberculosis H37Rv
ccgucgcugggaggcgcgguc

SEQ ID NO: 1338582 - RNA, 17 nt, Mycobacterium tuberculosis H37Rv
ccgucgcgaaucugcgc

SEQ ID NO: 1338583 - RNA, 15 nt, Mycobacterium tuberculosis H37Rv
ccgucggccaggcca

SEQ ID NO: 1338584 - RNA, 15 nt, Mycobacterium tuberculosis H37Rv
ccgucgucgaccacg

SEQ ID NO: 1338585 - RNA, 19 nt, Mycobacterium tuberculosis H37Rv
ccgucgucaccuucaccgg

SEQ ID NO: 1338586 - RNA, 23 nt, Mycobacterium tuberculosis H37Rv
ccgucgucgagcaccacccgggc

SEQ ID NO: 1338587 - RNA, 21 nt, Mycobacterium tuberculosis H37Rv
ccgucgucgagcaccacccgg

SEQ ID NO: 1338588 - RNA, 16 nt, Mycobacterium tuberculosis H37Rv
ccgucgucgugcacga

SEQ ID NO: 1338589 - RNA, 14 nt, Mycobacterium tuberculosis H37Rv
ccgucgccgcccgu

SEQ ID NO: 1338590 - RNA, 15 nt, Mycobacterium tuberculosis H37Rv
ccgucgaguccaggc

SEQ ID NO: 1338591 - RNA, 16 nt, Mycobacterium tuberculosis H37Rv
ccgucgaucaagugcg

SEQ ID NO: 1338592 - RNA, 15 nt, Mycobacterium tuberculosis H37Rv
ccgucgaucagcggc

SEQ ID NO: 1338593 - RNA, 19 nt, Mycobacterium tuberculosis H37Rv
aaacgacagcccuaucagc

SEQ ID NO: 1338594 - RNA, 18 nt, Mycobacterium tuberculosis H37Rv
ccuaccguacgcagcgug

SEQ ID NO: 1338595 - RNA, 15 nt, Mycobacterium tuberculosis H37Rv
ccuacgaugacguuu

SEQ ID NO: 1338596 - RNA, 19 nt, Mycobacterium tuberculosis H37Rv
ccuacugcggucgcccagg

SEQ ID NO: 1338597 - RNA, 14 nt, Mycobacterium tuberculosis H37Rv
ccuacggugcaguc

SEQ ID NO: 1338598 - RNA, 16 nt, Mycobacterium tuberculosis H37Rv
ccuagcaugaggcccg

SEQ ID NO: 1338599 - RNA, 13 nt, Mycobacterium tuberculosis H37Rv
ccuagccgcagcc

SEQ ID NO: 1338600 - RNA, 14 nt, Mycobacterium tuberculosis H37Rv
ccuagccgcggcac

SEQ ID NO: 1338601 - RNA, 16 nt, Mycobacterium tuberculosis H37Rv
ccuagccggcgcgccc

SEQ ID NO: 1338602 - RNA, 17 nt, Mycobacterium tuberculosis H37Rv
ccucacccacccgcggu

SEQ ID NO: 1338603 - RNA, 13 nt, Mycobacterium tuberculosis H37Rv
ccucaccagucag

SEQ ID NO: 1338604 - RNA, 18 nt, Mycobacterium tuberculosis H37Rv
ccucaccgaacggcaggg

SEQ ID NO: 1338605 - RNA, 21 nt, Mycobacterium tuberculosis H37Rv
ccucaccgaugugaccgaaca

SEQ ID NO: 1338606 - RNA, 19 nt, Mycobacterium tuberculosis H37Rv
ccucaccgacgucgccaag

SEQ ID NO: 1338607 - RNA, 13 nt, Mycobacterium tuberculosis H37Rv
ccucagccgccug

SEQ ID NO: 1338608 - RNA, 20 nt, Mycobacterium tuberculosis H37Rv
ccucagccaccgggcgugcg

SEQ ID NO: 1338609 - RNA, 22 nt, Mycobacterium tuberculosis H37Rv
ccuaggccgaggccgcugccag

SEQ ID NO: 1338610 - RNA, 16 nt, Mycobacterium tuberculosis H37Rv
ccuagggaaaggcgcc

SEQ ID NO: 1338611 - RNA, 15 nt, Mycobacterium tuberculosis H37Rv
ccuaggucgacgccg

SEQ ID NO: 1338612 - RNA, 16 nt, Mycobacterium tuberculosis H37Rv
ccuaguacgccgagca

SEQ ID NO: 1338613 - RNA, 14 nt, Mycobacterium tuberculosis H37Rv
ccuagucgcggccg

SEQ ID NO: 1338614 - RNA, 18 nt, Mycobacterium tuberculosis H37Rv
ccuaucagugagccgcca

SEQ ID NO: 1338615 - RNA, 19 nt, Mycobacterium tuberculosis H37Rv
ccuaucagugagccgccau

SEQ ID NO: 1338616 - RNA, 20 nt, Mycobacterium tuberculosis H37Rv
ccuauccaaagaccccuacc

SEQ ID NO: 1338617 - RNA, 16 nt, Mycobacterium tuberculosis H37Rv
ccuaucccgaaucuca

SEQ ID NO: 1338618 - RNA, 16 nt, Mycobacterium tuberculosis H37Rv
ccuauugaacccgugu

SEQ ID NO: 1338619 - RNA, 21 nt, Mycobacterium tuberculosis H37Rv
ccucaucacugaucaaccgga

SEQ ID NO: 1338620 - RNA, 14 nt, Mycobacterium tuberculosis H37Rv
ccucaucgagcgcg

SEQ ID NO: 1338621 - RNA, 20 nt, Mycobacterium tuberculosis H37Rv
ccucaucgcagacggcugcc

SEQ ID NO: 1338622 - RNA, 15 nt, Mycobacterium tuberculosis H37Rv
ccucaucggacagcg

SEQ ID NO: 1338623 - RNA, 17 nt, Mycobacterium tuberculosis H37Rv
ccuccagauccgggcau

SEQ ID NO: 1338624 - RNA, 22 nt, Mycobacterium tuberculosis H37Rv
ccuccagauacaggaacaacgc

SEQ ID NO: 1338625 - RNA, 23 nt, Mycobacterium tuberculosis H37Rv
ccuccacugcgagcgccggcuuc

SEQ ID NO: 1338626 - RNA, 19 nt, Mycobacterium tuberculosis H37Rv
ccuccacuuuuccgccggc

SEQ ID NO: 1338627 - RNA, 21 nt, Mycobacterium tuberculosis H37Rv
ccuccagaaccgaagccucgg

SEQ ID NO: 1338628 - RNA, 19 nt, Mycobacterium tuberculosis H37Rv
ccuccacucuucgggcggc

SEQ ID NO: 1338629 - RNA, 15 nt, Mycobacterium tuberculosis H37Rv
ccuccacgcccuggc

SEQ ID NO: 1338630 - RNA, 22 nt, Mycobacterium tuberculosis H37Rv
ccuccaagcccgccggacccgc

SEQ ID NO: 1338631 - RNA, 17 nt, Mycobacterium tuberculosis H37Rv
ccuccaccagugccccg

SEQ ID NO: 1338632 - RNA, 24 nt, Mycobacterium tuberculosis H37Rv
ccuccaauugcgaaccggccgucg

SEQ ID NO: 1338633 - RNA, 22 nt, Mycobacterium tuberculosis H37Rv
ccuccggauccucggccgccau

SEQ ID NO: 1338634 - RNA, 15 nt, Mycobacterium tuberculosis H37Rv
ccuccggacccaccc

SEQ ID NO: 1338635 - RNA, 23 nt, Mycobacterium tuberculosis H37Rv
ccuccauuucgucggagaacgcc

SEQ ID NO: 1338636 - RNA, 15 nt, Mycobacterium tuberculosis H37Rv
ccucccacagguaga

SEQ ID NO: 1338637 - RNA, 15 nt, Mycobacterium tuberculosis H37Rv
ccuccgcugccgccc

SEQ ID NO: 1338638 - RNA, 12 nt, Mycobacterium tuberculosis H37Rv
ccuccggcagca

SEQ ID NO: 1338639 - RNA, 22 nt, Mycobacterium tuberculosis H37Rv
ccuccggcaccaacgccaccgu

SEQ ID NO: 1338640 - RNA, 17 nt, Mycobacterium tuberculosis H37Rv
ccuccauaucgcagcgu

SEQ ID NO: 1338641 - RNA, 15 nt, Mycobacterium tuberculosis H37Rv
ccucccacgccgccg

SEQ ID NO: 1338642 - RNA, 19 nt, Mycobacterium tuberculosis H37Rv
ccuccugccgccgcuccau

SEQ ID NO: 1338643 - RNA, 17 nt, Mycobacterium tuberculosis H37Rv
ccuccguaacgccaagc

SEQ ID NO: 1338644 - RNA, 14 nt, Mycobacterium tuberculosis H37Rv
ccuccugcgccgca

SEQ ID NO: 1338645 - RNA, 13 nt, Mycobacterium tuberculosis H37Rv
ccuccugccgccg

SEQ ID NO: 1338646 - RNA, 20 nt, Mycobacterium tuberculosis H37Rv
ccuccgguaucggcgaccag

SEQ ID NO: 1338647 - RNA, 12 nt, Mycobacterium tuberculosis H37Rv
ccuccggcgccg

SEQ ID NO: 1338648 - RNA, 15 nt, Mycobacterium tuberculosis H37Rv
ccuccggcgccgccc

SEQ ID NO: 1338649 - RNA, 16 nt, Mycobacterium tuberculosis H37Rv
ccuccggcgccgcccg

SEQ ID NO: 1338650 - RNA, 16 nt, Mycobacterium tuberculosis H37Rv
ccucggacugcagcgc

SEQ ID NO: 1338651 - RNA, 19 nt, Mycobacterium tuberculosis H37Rv
ccucgcgcaccggcuggcc

SEQ ID NO: 1338652 - RNA, 14 nt, Mycobacterium tuberculosis H37Rv
ccucggccacccgc

SEQ ID NO: 1338653 - RNA, 17 nt, Mycobacterium tuberculosis H37Rv
ccucggcaugcagcccc

SEQ ID NO: 1338654 - RNA, 20 nt, Mycobacterium tuberculosis H37Rv
ccucggagaucgagaucacc

SEQ ID NO: 1338655 - RNA, 23 nt, Mycobacterium tuberculosis H37Rv
ccucggcaagucgacgccgcagc

SEQ ID NO: 1338656 - RNA, 14 nt, Mycobacterium tuberculosis H37Rv
ccucgccgcggcgg

SEQ ID NO: 1338657 - RNA, 12 nt, Mycobacterium tuberculosis H37Rv
ccucgcccuccc

SEQ ID NO: 1338658 - RNA, 16 nt, Mycobacterium tuberculosis H37Rv
ccucgcccuggccgcu

SEQ ID NO: 1338659 - RNA, 19 nt, Mycobacterium tuberculosis H37Rv
ccucgccggucagcgugca

SEQ ID NO: 1338660 - RNA, 22 nt, Mycobacterium tuberculosis H37Rv
ccucgaugaggcgcagcgccag

SEQ ID NO: 1338661 - RNA, 12 nt, Mycobacterium tuberculosis H37Rv
ccucgaugaccg

SEQ ID NO: 1338662 - RNA, 18 nt, Mycobacterium tuberculosis H37Rv
ccucgauggucucccggc

SEQ ID NO: 1338663 - RNA, 15 nt, Mycobacterium tuberculosis H37Rv
ccucgauggaccgcc

SEQ ID NO: 1338664 - RNA, 21 nt, Mycobacterium tuberculosis H37Rv
ccucgaugaggcgcagcgcca

SEQ ID NO: 1338665 - RNA, 15 nt, Mycobacterium tuberculosis H37Rv
ccucgaugccgcccg

SEQ ID NO: 1338666 - RNA, 15 nt, Mycobacterium tuberculosis H37Rv
ccucgagccagcucc

SEQ ID NO: 1338667 - RNA, 16 nt, Mycobacterium tuberculosis H37Rv
ccucgagccagcuccg

SEQ ID NO: 1338668 - RNA, 21 nt, Mycobacterium tuberculosis H37Rv
ccucgagguauucgcgcagca

SEQ ID NO: 1338669 - RNA, 16 nt, Mycobacterium tuberculosis H37Rv
ccucgagguccucguc

SEQ ID NO: 1338670 - RNA, 22 nt, Mycobacterium tuberculosis H37Rv
ccucgauaaccgcaguucuuga

SEQ ID NO: 1338671 - RNA, 20 nt, Mycobacterium tuberculosis H37Rv
ccucgaguucgaccggcggg

SEQ ID NO: 1338672 - RNA, 14 nt, Mycobacterium tuberculosis H37Rv
ccucgauaucgucg

SEQ ID NO: 1338673 - RNA, 15 nt, Mycobacterium tuberculosis H37Rv
ccucgacgucggcga

SEQ ID NO: 1338674 - RNA, 14 nt, Mycobacterium tuberculosis H37Rv
ccucgacgcggcag

SEQ ID NO: 1338675 - RNA, 15 nt, Mycobacterium tuberculosis H37Rv
ccucgagcagugccg

SEQ ID NO: 1338676 - RNA, 16 nt, Mycobacterium tuberculosis H37Rv
ccucgacgcccgcccu

SEQ ID NO: 1338677 - RNA, 15 nt, Mycobacterium tuberculosis H37Rv
ccucgacgccgcgca

SEQ ID NO: 1338678 - RNA, 19 nt, Mycobacterium tuberculosis H37Rv
ccucgacguccaucccggc

SEQ ID NO: 1338679 - RNA, 23 nt, Mycobacterium tuberculosis H37Rv
ccucgaacgggaaggcauugccc

SEQ ID NO: 1338680 - RNA, 17 nt, Mycobacterium tuberculosis H37Rv
ccucgaagcccagcacc

SEQ ID NO: 1338681 - RNA, 22 nt, Mycobacterium tuberculosis H37Rv
ccucgaccuggauugccaccag

SEQ ID NO: 1338682 - RNA, 13 nt, Mycobacterium tuberculosis H37Rv
ccucgaccgccag

SEQ ID NO: 1338683 - RNA, 21 nt, Mycobacterium tuberculosis H37Rv
ccucgaccgcggccuuggcgg

SEQ ID NO: 1338684 - RNA, 13 nt, Mycobacterium tuberculosis H37Rv
ccucgacccggcg

SEQ ID NO: 1338685 - RNA, 16 nt, Mycobacterium tuberculosis H37Rv
ccucgacacccauccu

SEQ ID NO: 1338686 - RNA, 16 nt, Mycobacterium tuberculosis H37Rv
ccucgacacccagccg

SEQ ID NO: 1338687 - RNA, 15 nt, Mycobacterium tuberculosis H37Rv
ccugcacccgacccg

SEQ ID NO: 1338688 - RNA, 22 nt, Mycobacterium tuberculosis H37Rv
ccugcaccacggcggccaccug

SEQ ID NO: 1338689 - RNA, 13 nt, Mycobacterium tuberculosis H37Rv
ccugcacagcagc

SEQ ID NO: 1338690 - RNA, 17 nt, Mycobacterium tuberculosis H37Rv
ccucgggguuacguugu

SEQ ID NO: 1338691 - RNA, 16 nt, Mycobacterium tuberculosis H37Rv
ccucgggguagccaac

SEQ ID NO: 1338692 - RNA, 18 nt, Mycobacterium tuberculosis H37Rv
ccucgggcaggcggccag

SEQ ID NO: 1338693 - RNA, 23 nt, Mycobacterium tuberculosis H37Rv
ccucgggcccguucucgcggccg

SEQ ID NO: 1338694 - RNA, 16 nt, Mycobacterium tuberculosis H37Rv
ccucgggacggccgcc

SEQ ID NO: 1338695 - RNA, 16 nt, Mycobacterium tuberculosis H37Rv
ccucggcuuggccggc

SEQ ID NO: 1338696 - RNA, 19 nt, Mycobacterium tuberculosis H37Rv
ccucggcguaggcgauggc

SEQ ID NO: 1338697 - RNA, 15 nt, Mycobacterium tuberculosis H37Rv
ccucggcggccagcu

SEQ ID NO: 1338698 - RNA, 15 nt, Mycobacterium tuberculosis H37Rv
ccugccauaggccca

SEQ ID NO: 1338699 - RNA, 14 nt, Mycobacterium tuberculosis H37Rv
ccugcccccggcgc

SEQ ID NO: 1338700 - RNA, 18 nt, Mycobacterium tuberculosis H37Rv
ccugccgacgcuccaggg

SEQ ID NO: 1338701 - RNA, 12 nt, Mycobacterium tuberculosis H37Rv
ccugcccuccgu

SEQ ID NO: 1338702 - RNA, 13 nt, Mycobacterium tuberculosis H37Rv
ccugcccggcccg

SEQ ID NO: 1338703 - RNA, 19 nt, Mycobacterium tuberculosis H37Rv
ccugcccggcccgcccgua

SEQ ID NO: 1338704 - RNA, 19 nt, Mycobacterium tuberculosis H37Rv
ccugcagguuuccggccug

SEQ ID NO: 1338705 - RNA, 14 nt, Mycobacterium tuberculosis H37Rv
ccugcgaaacgcug

SEQ ID NO: 1338706 - RNA, 17 nt, Mycobacterium tuberculosis H37Rv
ccugcgaggugccgggg

SEQ ID NO: 1338707 - RNA, 16 nt, Mycobacterium tuberculosis H37Rv
ccugccucaccgccgc

SEQ ID NO: 1338708 - RNA, 19 nt, Mycobacterium tuberculosis H37Rv
ccugccucggcgagccgcu

SEQ ID NO: 1338709 - RNA, 20 nt, Mycobacterium tuberculosis H37Rv
ccugcggcaccucauugccg

SEQ ID NO: 1338710 - RNA, 15 nt, Mycobacterium tuberculosis H37Rv
ccugcgggaggcagc

SEQ ID NO: 1338711 - RNA, 16 nt, Mycobacterium tuberculosis H37Rv
ccugcgggaacgcggc

SEQ ID NO: 1338712 - RNA, 14 nt, Mycobacterium tuberculosis H37Rv
ccugcugggaggga

SEQ ID NO: 1338713 - RNA, 20 nt, Mycobacterium tuberculosis H37Rv
ccugcucgaaaucgcacagc

SEQ ID NO: 1338714 - RNA, 17 nt, Mycobacterium tuberculosis H37Rv
ccugcuccgcugucacc

SEQ ID NO: 1338715 - RNA, 16 nt, Mycobacterium tuberculosis H37Rv
ccugcucauccaccuc

SEQ ID NO: 1338716 - RNA, 23 nt, Mycobacterium tuberculosis H37Rv
ccugcucagcuaaaaaccgcugc

SEQ ID NO: 1338717 - RNA, 16 nt, Mycobacterium tuberculosis H37Rv
ccugcugcggccaggg

SEQ ID NO: 1338718 - RNA, 20 nt, Mycobacterium tuberculosis H37Rv
ccugcucgcacagcaccacg

SEQ ID NO: 1338719 - RNA, 14 nt, Mycobacterium tuberculosis H37Rv
ccugcucgcacagc

SEQ ID NO: 1338720 - RNA, 13 nt, Mycobacterium tuberculosis H37Rv
ccuggugugcggg

SEQ ID NO: 1338721 - RNA, 21 nt, Mycobacterium tuberculosis H37Rv
ccugguguucgggcagcuggc

SEQ ID NO: 1338722 - RNA, 13 nt, Mycobacterium tuberculosis H37Rv
ccugguguaccag

SEQ ID NO: 1338723 - RNA, 17 nt, Mycobacterium tuberculosis H37Rv
ccugguguaccagacga

SEQ ID NO: 1338724 - RNA, 18 nt, Mycobacterium tuberculosis H37Rv
ccugguggcagacauggc

SEQ ID NO: 1338725 - RNA, 17 nt, Mycobacterium tuberculosis H37Rv
ccuggugcaaccgugcc

SEQ ID NO: 1338726 - RNA, 19 nt, Mycobacterium tuberculosis H37Rv
ccuggucggugacugugcg

SEQ ID NO: 1338727 - RNA, 15 nt, Mycobacterium tuberculosis H37Rv
ccuggucggccaggu

SEQ ID NO: 1338728 - RNA, 15 nt, Mycobacterium tuberculosis H37Rv
ccuggggugcucggg

SEQ ID NO: 1338729 - RNA, 21 nt, Mycobacterium tuberculosis H37Rv
ccuggggugucaaucacccag

SEQ ID NO: 1338730 - RNA, 17 nt, Mycobacterium tuberculosis H37Rv
ccugggcgacuaccggc

SEQ ID NO: 1338731 - RNA, 23 nt, Mycobacterium tuberculosis H37Rv
ccugggcggcgcgaagucuugac

SEQ ID NO: 1338732 - RNA, 16 nt, Mycobacterium tuberculosis H37Rv
ccugggcggccgggcu

SEQ ID NO: 1338733 - RNA, 15 nt, Mycobacterium tuberculosis H37Rv
ccugggcgccccagg

SEQ ID NO: 1338734 - RNA, 12 nt, Mycobacterium tuberculosis H37Rv
ccuggggccgca

SEQ ID NO: 1338735 - RNA, 13 nt, Mycobacterium tuberculosis H37Rv
ccuggggcagccg

SEQ ID NO: 1338736 - RNA, 18 nt, Mycobacterium tuberculosis H37Rv
ccuggggguggcagcgcg

SEQ ID NO: 1338737 - RNA, 21 nt, Mycobacterium tuberculosis H37Rv
ccuggcguagaucaucuggcu

SEQ ID NO: 1338738 - RNA, 18 nt, Mycobacterium tuberculosis H37Rv
ccuggcgugucgccgcca

SEQ ID NO: 1338739 - RNA, 19 nt, Mycobacterium tuberculosis H37Rv
ccuggcgugucgccgccac

SEQ ID NO: 1338740 - RNA, 17 nt, Mycobacterium tuberculosis H37Rv
ccuggcggcugcagccg

SEQ ID NO: 1338741 - RNA, 19 nt, Mycobacterium tuberculosis H37Rv
ccuggcggcccggguuggc

SEQ ID NO: 1338742 - RNA, 17 nt, Mycobacterium tuberculosis H37Rv
ccuggccgccggcgccg

SEQ ID NO: 1338743 - RNA, 16 nt, Mycobacterium tuberculosis H37Rv
ccuggcccuuguuggc

SEQ ID NO: 1338744 - RNA, 15 nt, Mycobacterium tuberculosis H37Rv
ccuggcccccgguac

SEQ ID NO: 1338745 - RNA, 23 nt, Mycobacterium tuberculosis H37Rv
ccuggcccccgguaccgcccgca

SEQ ID NO: 1338746 - RNA, 23 nt, Mycobacterium tuberculosis H37Rv
ccuggcccgccacgaugucgucg

SEQ ID NO: 1338747 - RNA, 17 nt, Mycobacterium tuberculosis H37Rv
ccuggccaccugguuua

SEQ ID NO: 1338748 - RNA, 16 nt, Mycobacterium tuberculosis H37Rv
ccuggccacucccagc

SEQ ID NO: 1338749 - RNA, 12 nt, Mycobacterium tuberculosis H37Rv
ccuggccaucga

SEQ ID NO: 1338750 - RNA, 14 nt, Mycobacterium tuberculosis H37Rv
ccuggccaccuggu

SEQ ID NO: 1338751 - RNA, 18 nt, Mycobacterium tuberculosis H37Rv
ccuggacauaccggcccg

SEQ ID NO: 1338752 - RNA, 12 nt, Mycobacterium tuberculosis H37Rv
ccuggaccucgu

SEQ ID NO: 1338753 - RNA, 21 nt, Mycobacterium tuberculosis H37Rv
ccuggagguguuugacgcgcu

SEQ ID NO: 1338754 - RNA, 21 nt, Mycobacterium tuberculosis H37Rv
ccuggaguccagcucgggcau

SEQ ID NO: 1338755 - RNA, 14 nt, Mycobacterium tuberculosis H37Rv
ccugcuugcaggcg

SEQ ID NO: 1338756 - RNA, 20 nt, Mycobacterium tuberculosis H37Rv
ccugcuuguagcgcaucgcc

SEQ ID NO: 1338757 - RNA, 22 nt, Mycobacterium tuberculosis H37Rv
ccugcuuguagcgcaucgccaa

SEQ ID NO: 1338758 - RNA, 14 nt, Mycobacterium tuberculosis H37Rv
ccuggaaggaggcc

SEQ ID NO: 1338759 - RNA, 16 nt, Mycobacterium tuberculosis H37Rv
ccuggaaagggccgcc

SEQ ID NO: 1338760 - RNA, 23 nt, Mycobacterium tuberculosis H37Rv
ccuucacgcuggccuccagcuug

SEQ ID NO: 1338761 - RNA, 15 nt, Mycobacterium tuberculosis H37Rv
ccuucaccagcugcg

SEQ ID NO: 1338762 - RNA, 17 nt, Mycobacterium tuberculosis H37Rv
ccuucaccgccguucca

SEQ ID NO: 1338763 - RNA, 13 nt, Mycobacterium tuberculosis H37Rv
ccuuauuggacug

SEQ ID NO: 1338764 - RNA, 21 nt, Mycobacterium tuberculosis H37Rv
ccuucaaagcggccucgaccu

SEQ ID NO: 1338765 - RNA, 14 nt, Mycobacterium tuberculosis H37Rv
ccuucaaagcggcc

SEQ ID NO: 1338766 - RNA, 19 nt, Mycobacterium tuberculosis H37Rv
ccuuaccccgcagcucacc

SEQ ID NO: 1338767 - RNA, 18 nt, Mycobacterium tuberculosis H37Rv
ccuguaccgccacggcgg

SEQ ID NO: 1338768 - RNA, 19 nt, Mycobacterium tuberculosis H37Rv
ccuucggccgaccgggcuc

SEQ ID NO: 1338769 - RNA, 22 nt, Mycobacterium tuberculosis H37Rv
ccuucuuggcaggugccuucuu

SEQ ID NO: 1338770 - RNA, 15 nt, Mycobacterium tuberculosis H37Rv
ccuucgccggcgcca

SEQ ID NO: 1338771 - RNA, 12 nt, Mycobacterium tuberculosis H37Rv
ccuucgccgccg

SEQ ID NO: 1338772 - RNA, 19 nt, Mycobacterium tuberculosis H37Rv
ccuucgaguuuggugucga

SEQ ID NO: 1338773 - RNA, 23 nt, Mycobacterium tuberculosis H37Rv
ccuucagggcgucgaacucaucu

SEQ ID NO: 1338774 - RNA, 19 nt, Mycobacterium tuberculosis H37Rv
ccuucagcgaagccggguc

SEQ ID NO: 1338775 - RNA, 15 nt, Mycobacterium tuberculosis H37Rv
ccuucagcguccagg

SEQ ID NO: 1338776 - RNA, 22 nt, Mycobacterium tuberculosis H37Rv
ccuugaccucggguaacguguu

SEQ ID NO: 1338777 - RNA, 19 nt, Mycobacterium tuberculosis H37Rv
ccuugacgcggccacauac

SEQ ID NO: 1338778 - RNA, 21 nt, Mycobacterium tuberculosis H37Rv
ccuugaccgcggucuucuuca

SEQ ID NO: 1338779 - RNA, 18 nt, Mycobacterium tuberculosis H37Rv
ccuugaccgcugcccagu

SEQ ID NO: 1338780 - RNA, 12 nt, Mycobacterium tuberculosis H37Rv
ccuugacccucc

SEQ ID NO: 1338781 - RNA, 13 nt, Mycobacterium tuberculosis H37Rv
ccuugacccgcaa

SEQ ID NO: 1338782 - RNA, 20 nt, Mycobacterium tuberculosis H37Rv
ccuugcgguccaggccggca

SEQ ID NO: 1338783 - RNA, 19 nt, Mycobacterium tuberculosis H37Rv
ccuugcguguaccagccca

SEQ ID NO: 1338784 - RNA, 17 nt, Mycobacterium tuberculosis H37Rv
ccuuggacugucccacc

SEQ ID NO: 1338785 - RNA, 16 nt, Mycobacterium tuberculosis H37Rv
ccuugcucagccggcc

SEQ ID NO: 1338786 - RNA, 17 nt, Mycobacterium tuberculosis H37Rv
ccuugcucagccggccc

SEQ ID NO: 1338787 - RNA, 18 nt, Mycobacterium tuberculosis H37Rv
ccuugcucagccggcccu

SEQ ID NO: 1338788 - RNA, 15 nt, Mycobacterium tuberculosis H37Rv
ccuugcucguccagg

SEQ ID NO: 1338789 - RNA, 15 nt, Mycobacterium tuberculosis H37Rv
ccuuggcccagcggu

SEQ ID NO: 1338790 - RNA, 21 nt, Mycobacterium tuberculosis H37Rv
ccuuggccaccaucgccgccg

SEQ ID NO: 1338791 - RNA, 19 nt, Mycobacterium tuberculosis H37Rv
ccuuggccaggaagucccg

SEQ ID NO: 1338792 - RNA, 16 nt, Mycobacterium tuberculosis H37Rv
ccuuguucuuggccac

SEQ ID NO: 1338793 - RNA, 14 nt, Mycobacterium tuberculosis H37Rv
ccuuguugccgccg

SEQ ID NO: 1338794 - RNA, 20 nt, Mycobacterium tuberculosis H37Rv
ccuuguuggcgcccgggccc

SEQ ID NO: 1338795 - RNA, 21 nt, Mycobacterium tuberculosis H37Rv
ccuuguuggcgcccgggccca

SEQ ID NO: 1338796 - RNA, 20 nt, Mycobacterium tuberculosis H37Rv
ccuuguggucugccagcacc

SEQ ID NO: 1338797 - RNA, 15 nt, Mycobacterium tuberculosis H37Rv
ccuuguucccgaaac

SEQ ID NO: 1338798 - RNA, 20 nt, Mycobacterium tuberculosis H37Rv
ccuugguuagccgcggcccg

SEQ ID NO: 1338799 - RNA, 20 nt, Mycobacterium tuberculosis H37Rv
ccuuggccagacccaccacc

SEQ ID NO: 1338800 - RNA, 18 nt, Mycobacterium tuberculosis H37Rv
ccuugguguggggcggcu

SEQ ID NO: 1338801 - RNA, 12 nt, Mycobacterium tuberculosis H37Rv
ccuuggugggca

SEQ ID NO: 1338802 - RNA, 23 nt, Mycobacterium tuberculosis H37Rv
ccuugguugccaacgaaccgcuc

SEQ ID NO: 1338803 - RNA, 14 nt, Mycobacterium tuberculosis H37Rv
ccuuggcgcggcac

SEQ ID NO: 1338804 - RNA, 14 nt, Mycobacterium tuberculosis H37Rv
ccuuggccuucuga

SEQ ID NO: 1338805 - RNA, 22 nt, Mycobacterium tuberculosis H37Rv
ccuuggccguucggcgcccgcu

SEQ ID NO: 1338806 - RNA, 19 nt, Mycobacterium tuberculosis H37Rv
ccuugucaaaggugcacug

SEQ ID NO: 1338807 - RNA, 12 nt, Mycobacterium tuberculosis H37Rv
ccuugugacccc

SEQ ID NO: 1338808 - RNA, 21 nt, Mycobacterium tuberculosis H37Rv
ccuugucggccccggccgcgu

SEQ ID NO: 1338809 - RNA, 16 nt, Mycobacterium tuberculosis H37Rv
ccuuugcacgguggca

SEQ ID NO: 1338810 - RNA, 13 nt, Mycobacterium tuberculosis H37Rv
ccuuugccgccga

SEQ ID NO: 1338811 - RNA, 20 nt, Mycobacterium tuberculosis H37Rv
ccuuuggcucccuuuuccaa

SEQ ID NO: 1338812 - RNA, 21 nt, Mycobacterium tuberculosis H37Rv
cgacgccgcuggagaucacgc

SEQ ID NO: 1338813 - RNA, 19 nt, Mycobacterium tuberculosis H37Rv
cgacgccgaucgcggcggc

SEQ ID NO: 1338814 - RNA, 13 nt, Mycobacterium tuberculosis H37Rv
cgacgccgcagcg

SEQ ID NO: 1338815 - RNA, 13 nt, Mycobacterium tuberculosis H37Rv
cgacgccgcgcag

SEQ ID NO: 1338816 - RNA, 16 nt, Mycobacterium tuberculosis H37Rv
cgacgccccaggacac

SEQ ID NO: 1338817 - RNA, 13 nt, Mycobacterium tuberculosis H37Rv
cgacgcccgccuu

SEQ ID NO: 1338818 - RNA, 18 nt, Mycobacterium tuberculosis H37Rv
cgacgccgagaccgccgc

SEQ ID NO: 1338819 - RNA, 19 nt, Mycobacterium tuberculosis H37Rv
cgacgcgauggccgccagu

SEQ ID NO: 1338820 - RNA, 21 nt, Mycobacterium tuberculosis H37Rv
cgacgccggugucggcugguc

SEQ ID NO: 1338821 - RNA, 20 nt, Mycobacterium tuberculosis H37Rv
cgacgcgcauucgccgggcg

SEQ ID NO: 1338822 - RNA, 15 nt, Mycobacterium tuberculosis H37Rv
cgacgcgcucgggcg

SEQ ID NO: 1338823 - RNA, 16 nt, Mycobacterium tuberculosis H37Rv
cgacgcucgcugcagc

SEQ ID NO: 1338824 - RNA, 17 nt, Mycobacterium tuberculosis H37Rv
cgacgcucgcugcagca

SEQ ID NO: 1338825 - RNA, 22 nt, Mycobacterium tuberculosis H37Rv
cgacgcggucaucgagcugacc

SEQ ID NO: 1338826 - RNA, 22 nt, Mycobacterium tuberculosis H37Rv
cgacgcguggcauccagcagcg

SEQ ID NO: 1338827 - RNA, 23 nt, Mycobacterium tuberculosis H37Rv
cgacgcugccgccaggcucgagg

SEQ ID NO: 1338828 - RNA, 18 nt, Mycobacterium tuberculosis H37Rv
cgacgcuggucggcggcu

SEQ ID NO: 1338829 - RNA, 18 nt, Mycobacterium tuberculosis H37Rv
cgacgcuguggcucgacg

SEQ ID NO: 1338830 - RNA, 16 nt, Mycobacterium tuberculosis H37Rv
cgacggacacccuggg

SEQ ID NO: 1338831 - RNA, 12 nt, Mycobacterium tuberculosis H37Rv
cgacggcugacc

SEQ ID NO: 1338832 - RNA, 12 nt, Mycobacterium tuberculosis H37Rv
cgacggcggccg

SEQ ID NO: 1338833 - RNA, 15 nt, Mycobacterium tuberculosis H37Rv
cgacggcuccuccgg

SEQ ID NO: 1338834 - RNA, 21 nt, Mycobacterium tuberculosis H37Rv
cgacggcgccgucguugugcc

SEQ ID NO: 1338835 - RNA, 17 nt, Mycobacterium tuberculosis H37Rv
cgacggccggcaagcag

SEQ ID NO: 1338836 - RNA, 20 nt, Mycobacterium tuberculosis H37Rv
cgacggccgcucgggccagc

SEQ ID NO: 1338837 - RNA, 20 nt, Mycobacterium tuberculosis H37Rv
cgacggccacgguggagcgc

SEQ ID NO: 1338838 - RNA, 18 nt, Mycobacterium tuberculosis H37Rv
cgacggcaaugcggggca

SEQ ID NO: 1338839 - RNA, 22 nt, Mycobacterium tuberculosis H37Rv
cgacggcauuucagcgcgccgc

SEQ ID NO: 1338840 - RNA, 16 nt, Mycobacterium tuberculosis H37Rv
cgacggcagugcugca

SEQ ID NO: 1338841 - RNA, 20 nt, Mycobacterium tuberculosis H37Rv
cgacggcaucaacgcgggcg

SEQ ID NO: 1338842 - RNA, 21 nt, Mycobacterium tuberculosis H37Rv
cgacgggcacccgagccgcac

SEQ ID NO: 1338843 - RNA, 18 nt, Mycobacterium tuberculosis H37Rv
cgacggucagguccuggg

SEQ ID NO: 1338844 - RNA, 20 nt, Mycobacterium tuberculosis H37Rv
cgacggucaaggugcgccgc

SEQ ID NO: 1338845 - RNA, 22 nt, Mycobacterium tuberculosis H37Rv
cgacggucaaggugcgccgcca

SEQ ID NO: 1338846 - RNA, 22 nt, Mycobacterium tuberculosis H37Rv
cgacggucagauggccacccgc

SEQ ID NO: 1338847 - RNA, 18 nt, Mycobacterium tuberculosis H37Rv
cgacggucaaggugcgcc

SEQ ID NO: 1338848 - RNA, 18 nt, Mycobacterium tuberculosis H37Rv
cgacgguucccagcuucc

SEQ ID NO: 1338849 - RNA, 14 nt, Mycobacterium tuberculosis H37Rv
cgacgguguccgga

SEQ ID NO: 1338850 - RNA, 17 nt, Mycobacterium tuberculosis H37Rv
cgacggugaaccaccac

SEQ ID NO: 1338851 - RNA, 17 nt, Mycobacterium tuberculosis H37Rv
cgacggucuggcccgcg

SEQ ID NO: 1338852 - RNA, 14 nt, Mycobacterium tuberculosis H37Rv
cgacgacggccugc

SEQ ID NO: 1338853 - RNA, 14 nt, Mycobacterium tuberculosis H37Rv
cgacgacgggcgcc

SEQ ID NO: 1338854 - RNA, 21 nt, Mycobacterium tuberculosis H37Rv
cgacgagauacggccaccagg

SEQ ID NO: 1338855 - RNA, 14 nt, Mycobacterium tuberculosis H37Rv
cgacgagauccagc

SEQ ID NO: 1338856 - RNA, 18 nt, Mycobacterium tuberculosis H37Rv
cgacgaccgccugcaaca

SEQ ID NO: 1338857 - RNA, 13 nt, Mycobacterium tuberculosis H37Rv
cgacgaccagcag

SEQ ID NO: 1338858 - RNA, 23 nt, Mycobacterium tuberculosis H37Rv
cgacgaccaccuucugacgcggc

SEQ ID NO: 1338859 - RNA, 14 nt, Mycobacterium tuberculosis H37Rv
cgacgaccagcaga

SEQ ID NO: 1338860 - RNA, 18 nt, Mycobacterium tuberculosis H37Rv
cgacgagcaccgcgccgc

SEQ ID NO: 1338861 - RNA, 15 nt, Mycobacterium tuberculosis H37Rv
cgacgaucagcgagu

SEQ ID NO: 1338862 - RNA, 16 nt, Mycobacterium tuberculosis H37Rv
cgacgaucagcgagua

SEQ ID NO: 1338863 - RNA, 14 nt, Mycobacterium tuberculosis H37Rv
cgacgaugcgggcg

SEQ ID NO: 1338864 - RNA, 11 nt, Mycobacterium tuberculosis H37Rv
cgacgaugccg

SEQ ID NO: 1338865 - RNA, 17 nt, Mycobacterium tuberculosis H37Rv
cgacgaugccgcgggac

SEQ ID NO: 1338866 - RNA, 12 nt, Mycobacterium tuberculosis H37Rv
cgacgcacaccc

SEQ ID NO: 1338867 - RNA, 12 nt, Mycobacterium tuberculosis H37Rv
cgacgcacugcc

SEQ ID NO: 1338868 - RNA, 23 nt, Mycobacterium tuberculosis H37Rv
cgacgcagaccguccagcaacag

SEQ ID NO: 1338869 - RNA, 15 nt, Mycobacterium tuberculosis H37Rv
cgacgccaacgccag

SEQ ID NO: 1338870 - RNA, 20 nt, Mycobacterium tuberculosis H37Rv
cgacgcauaaccggcgcgcc

SEQ ID NO: 1338871 - RNA, 22 nt, Mycobacterium tuberculosis H37Rv
cgacgccaucugcuggcuggga

SEQ ID NO: 1338872 - RNA, 12 nt, Mycobacterium tuberculosis H37Rv
cgacgccaccgc

SEQ ID NO: 1338873 - RNA, 21 nt, Mycobacterium tuberculosis H37Rv
cgacgccaaugccgcggaggc

SEQ ID NO: 1338874 - RNA, 16 nt, Mycobacterium tuberculosis H37Rv
cgaccucgucggccga

SEQ ID NO: 1338875 - RNA, 21 nt, Mycobacterium tuberculosis H37Rv
cgaccuccgcgaucaccgacg

SEQ ID NO: 1338876 - RNA, 16 nt, Mycobacterium tuberculosis H37Rv
cgaccucgcgcggggc

SEQ ID NO: 1338877 - RNA, 22 nt, Mycobacterium tuberculosis H37Rv
cgaccuccucgaugaccggcga

SEQ ID NO: 1338878 - RNA, 21 nt, Mycobacterium tuberculosis H37Rv
cgaccuccucgaugaccggcg

SEQ ID NO: 1338879 - RNA, 15 nt, Mycobacterium tuberculosis H37Rv
cgaccuccaccaaug

SEQ ID NO: 1338880 - RNA, 17 nt, Mycobacterium tuberculosis H37Rv
cgaccucacccacccgc

SEQ ID NO: 1338881 - RNA, 19 nt, Mycobacterium tuberculosis H37Rv
cgaccucacccacccgcgg

SEQ ID NO: 1338882 - RNA, 20 nt, Mycobacterium tuberculosis H37Rv
cgaccucguucgucaccacg

SEQ ID NO: 1338883 - RNA, 16 nt, Mycobacterium tuberculosis H37Rv
cgaccugcucauccac

SEQ ID NO: 1338884 - RNA, 18 nt, Mycobacterium tuberculosis H37Rv
cgaccugguaugccgccc

SEQ ID NO: 1338885 - RNA, 18 nt, Mycobacterium tuberculosis H37Rv
cgacgaacaccccgggcg

SEQ ID NO: 1338886 - RNA, 20 nt, Mycobacterium tuberculosis H37Rv
cgacgaacaccccgggcgcc

SEQ ID NO: 1338887 - RNA, 22 nt, Mycobacterium tuberculosis H37Rv
cgaccuuggacacuugaagugu

SEQ ID NO: 1338888 - RNA, 23 nt, Mycobacterium tuberculosis H37Rv
cgacgaagaucgcgugccacagc

SEQ ID NO: 1338889 - RNA, 23 nt, Mycobacterium tuberculosis H37Rv
cgacgaagaucuucaccggccgg

SEQ ID NO: 1338890 - RNA, 16 nt, Mycobacterium tuberculosis H37Rv
cgacgaacuccgcguu

SEQ ID NO: 1338891 - RNA, 22 nt, Mycobacterium tuberculosis H37Rv
cgacgaccacaccacgauggcg

SEQ ID NO: 1338892 - RNA, 13 nt, Mycobacterium tuberculosis H37Rv
cgacgacauuggu

SEQ ID NO: 1338893 - RNA, 19 nt, Mycobacterium tuberculosis H37Rv
cgacgacaaggugugguga

SEQ ID NO: 1338894 - RNA, 16 nt, Mycobacterium tuberculosis H37Rv
cgacgacaccgcgcag

SEQ ID NO: 1338895 - RNA, 16 nt, Mycobacterium tuberculosis H37Rv
cgacgacaaggugugg

SEQ ID NO: 1338896 - RNA, 20 nt, Mycobacterium tuberculosis H37Rv
cgaccaggaccggcugcagg

SEQ ID NO: 1338897 - RNA, 13 nt, Mycobacterium tuberculosis H37Rv
cgaccagcgcggc

SEQ ID NO: 1338898 - RNA, 22 nt, Mycobacterium tuberculosis H37Rv
cgaccagaaucggguucuuuug

SEQ ID NO: 1338899 - RNA, 22 nt, Mycobacterium tuberculosis H37Rv
cgaccagcugugaacaggccga

SEQ ID NO: 1338900 - RNA, 22 nt, Mycobacterium tuberculosis H37Rv
cgaccagccccgcuggucgacc

SEQ ID NO: 1338901 - RNA, 14 nt, Mycobacterium tuberculosis H37Rv
cgaccagcagacca

SEQ ID NO: 1338902 - RNA, 22 nt, Mycobacterium tuberculosis H37Rv
cgaccagaggcgugucgacucc

SEQ ID NO: 1338903 - RNA, 15 nt, Mycobacterium tuberculosis H37Rv
cgaccaugcuccuau

SEQ ID NO: 1338904 - RNA, 13 nt, Mycobacterium tuberculosis H37Rv
cgaccaugaugcc

SEQ ID NO: 1338905 - RNA, 16 nt, Mycobacterium tuberculosis H37Rv
cgaccaucgggacgcc

SEQ ID NO: 1338906 - RNA, 13 nt, Mycobacterium tuberculosis H37Rv
cgaccaggccacu

SEQ ID NO: 1338907 - RNA, 20 nt, Mycobacterium tuberculosis H37Rv
cgaccaggccagagccgccc

SEQ ID NO: 1338908 - RNA, 20 nt, Mycobacterium tuberculosis H37Rv
cgaccaaaccgacgcgggcc

SEQ ID NO: 1338909 - RNA, 23 nt, Mycobacterium tuberculosis H37Rv
cgaccaaguugaccuucaccugg

SEQ ID NO: 1338910 - RNA, 20 nt, Mycobacterium tuberculosis H37Rv
cgacaugaaccggucgaucc

SEQ ID NO: 1338911 - RNA, 16 nt, Mycobacterium tuberculosis H37Rv
cgacaugacgcggcca

SEQ ID NO: 1338912 - RNA, 19 nt, Mycobacterium tuberculosis H37Rv
cgaccaaggccgaccugua

SEQ ID NO: 1338913 - RNA, 12 nt, Mycobacterium tuberculosis H37Rv
cgaccaccaccg

SEQ ID NO: 1338914 - RNA, 18 nt, Mycobacterium tuberculosis H37Rv
cgaccaccagcgccgacc

SEQ ID NO: 1338915 - RNA, 16 nt, Mycobacterium tuberculosis H37Rv
cgaccaccaccgccgc

SEQ ID NO: 1338916 - RNA, 15 nt, Mycobacterium tuberculosis H37Rv
cgaccaccaccaacg

SEQ ID NO: 1338917 - RNA, 19 nt, Mycobacterium tuberculosis H37Rv
cgaccaccuucugacgcgg

SEQ ID NO: 1338918 - RNA, 14 nt, Mycobacterium tuberculosis H37Rv
cgaccaccugagcc

SEQ ID NO: 1338919 - RNA, 13 nt, Mycobacterium tuberculosis H37Rv
cgaccaccgccga

SEQ ID NO: 1338920 - RNA, 18 nt, Mycobacterium tuberculosis H37Rv
cgaccacgccgccggcgc

SEQ ID NO: 1338921 - RNA, 14 nt, Mycobacterium tuberculosis H37Rv
cgaccacugcccgg

SEQ ID NO: 1338922 - RNA, 15 nt, Mycobacterium tuberculosis H37Rv
cgaccgaaccgucag

SEQ ID NO: 1338923 - RNA, 12 nt, Mycobacterium tuberculosis H37Rv
cgacccuccagc

SEQ ID NO: 1338924 - RNA, 13 nt, Mycobacterium tuberculosis H37Rv
cgacccuccagca

SEQ ID NO: 1338925 - RNA, 23 nt, Mycobacterium tuberculosis H37Rv
cgaccgcauccggucucggccga

SEQ ID NO: 1338926 - RNA, 18 nt, Mycobacterium tuberculosis H37Rv
cgaccgcauugaacagcg

SEQ ID NO: 1338927 - RNA, 19 nt, Mycobacterium tuberculosis H37Rv
cgacccuaguucagcgccg

SEQ ID NO: 1338928 - RNA, 21 nt, Mycobacterium tuberculosis H37Rv
cgacccgggucggcacgaccc

SEQ ID NO: 1338929 - RNA, 23 nt, Mycobacterium tuberculosis H37Rv
cgacccgggccgcggcggccagc

SEQ ID NO: 1338930 - RNA, 17 nt, Mycobacterium tuberculosis H37Rv
cgacccgggaaggaacc

SEQ ID NO: 1338931 - RNA, 18 nt, Mycobacterium tuberculosis H37Rv
cgacccgggaaggaaccg

SEQ ID NO: 1338932 - RNA, 15 nt, Mycobacterium tuberculosis H37Rv
cgacccggccagcgg

SEQ ID NO: 1338933 - RNA, 16 nt, Mycobacterium tuberculosis H37Rv
cgacccggcgcagcaa

SEQ ID NO: 1338934 - RNA, 18 nt, Mycobacterium tuberculosis H37Rv
cgacccgcuucgcccggc

SEQ ID NO: 1338935 - RNA, 17 nt, Mycobacterium tuberculosis H37Rv
cgaccccggcugcgcuu

SEQ ID NO: 1338936 - RNA, 22 nt, Mycobacterium tuberculosis H37Rv
cgacccgaucaccuucggccga

SEQ ID NO: 1338937 - RNA, 12 nt, Mycobacterium tuberculosis H37Rv
cgacccgcgcaa

SEQ ID NO: 1338938 - RNA, 18 nt, Mycobacterium tuberculosis H37Rv
cgacccgcagaccgccac

SEQ ID NO: 1338939 - RNA, 17 nt, Mycobacterium tuberculosis H37Rv
cgacccaucaccagcgg

SEQ ID NO: 1338940 - RNA, 17 nt, Mycobacterium tuberculosis H37Rv
cgaccccgccgagcggu

SEQ ID NO: 1338941 - RNA, 20 nt, Mycobacterium tuberculosis H37Rv
cgaccccgaacauccgccgc

SEQ ID NO: 1338942 - RNA, 22 nt, Mycobacterium tuberculosis H37Rv
cgaccccgaacauccgccgccc

SEQ ID NO: 1338943 - RNA, 12 nt, Mycobacterium tuberculosis H37Rv
cgaccccgcgcu

SEQ ID NO: 1338944 - RNA, 14 nt, Mycobacterium tuberculosis H37Rv
cgaccgccagccgc

SEQ ID NO: 1338945 - RNA, 11 nt, Mycobacterium tuberculosis H37Rv
cgaccgcccgc

SEQ ID NO: 1338946 - RNA, 18 nt, Mycobacterium tuberculosis H37Rv
cgaccgccgcgagcagaa

SEQ ID NO: 1338947 - RNA, 14 nt, Mycobacterium tuberculosis H37Rv
cgaccgccugcaac

SEQ ID NO: 1338948 - RNA, 18 nt, Mycobacterium tuberculosis H37Rv
cgaccgcgacccggccca

SEQ ID NO: 1338949 - RNA, 14 nt, Mycobacterium tuberculosis H37Rv
cgaccgcggucgcu

SEQ ID NO: 1338950 - RNA, 15 nt, Mycobacterium tuberculosis H37Rv
cgaccgcggccccgc

SEQ ID NO: 1338951 - RNA, 14 nt, Mycobacterium tuberculosis H37Rv
cgaccgcucccggu

SEQ ID NO: 1338952 - RNA, 14 nt, Mycobacterium tuberculosis H37Rv
cgaccggacacucc

SEQ ID NO: 1338953 - RNA, 15 nt, Mycobacterium tuberculosis H37Rv
cgaccggacgaucag

SEQ ID NO: 1338954 - RNA, 15 nt, Mycobacterium tuberculosis H37Rv
cgaccggaccggggg

SEQ ID NO: 1338955 - RNA, 18 nt, Mycobacterium tuberculosis H37Rv
cgaccgugguggucgggc

SEQ ID NO: 1338956 - RNA, 18 nt, Mycobacterium tuberculosis H37Rv
cgaccgugucaccgccgg

SEQ ID NO: 1338957 - RNA, 15 nt, Mycobacterium tuberculosis H37Rv
cgaccgugcugggcg

SEQ ID NO: 1338958 - RNA, 21 nt, Mycobacterium tuberculosis H37Rv
cgaccguccgggucaccagcg

SEQ ID NO: 1338959 - RNA, 18 nt, Mycobacterium tuberculosis H37Rv
cgaccgguccagccaacg

SEQ ID NO: 1338960 - RNA, 19 nt, Mycobacterium tuberculosis H37Rv
cgaccgucgggacggccaa

SEQ ID NO: 1338961 - RNA, 22 nt, Mycobacterium tuberculosis H37Rv
cgaccgucguccagacgccacu

SEQ ID NO: 1338962 - RNA, 16 nt, Mycobacterium tuberculosis H37Rv
cgaccgucgcgcugcc

SEQ ID NO: 1338963 - RNA, 19 nt, Mycobacterium tuberculosis H37Rv
cgaccgucgcgcugccggc

SEQ ID NO: 1338964 - RNA, 18 nt, Mycobacterium tuberculosis H37Rv
cgaccgucacugaugggc

SEQ ID NO: 1338965 - RNA, 16 nt, Mycobacterium tuberculosis H37Rv
cgaccgucccagcgcc

SEQ ID NO: 1338966 - RNA, 21 nt, Mycobacterium tuberculosis H37Rv
cgaccgggucgcaaccgccgc

SEQ ID NO: 1338967 - RNA, 18 nt, Mycobacterium tuberculosis H37Rv
cgaccggucuggcgauga

SEQ ID NO: 1338968 - RNA, 15 nt, Mycobacterium tuberculosis H37Rv
cgaccggcuaccggc

SEQ ID NO: 1338969 - RNA, 16 nt, Mycobacterium tuberculosis H37Rv
cgaccggcuaccggcg

SEQ ID NO: 1338970 - RNA, 18 nt, Mycobacterium tuberculosis H37Rv
cgaccggcuaccggcgug

SEQ ID NO: 1338971 - RNA, 19 nt, Mycobacterium tuberculosis H37Rv
cgaagcaucgcguuguagg

SEQ ID NO: 1338972 - RNA, 23 nt, Mycobacterium tuberculosis H37Rv
cgaagcccgacuguagaaaaccc

SEQ ID NO: 1338973 - RNA, 19 nt, Mycobacterium tuberculosis H37Rv
cgaagccccgguggcaggg

SEQ ID NO: 1338974 - RNA, 14 nt, Mycobacterium tuberculosis H37Rv
cgaagcccacguuu

SEQ ID NO: 1338975 - RNA, 11 nt, Mycobacterium tuberculosis H37Rv
cgaagcccacg

SEQ ID NO: 1338976 - RNA, 21 nt, Mycobacterium tuberculosis H37Rv
cgaagcuacgucggcucgucg

SEQ ID NO: 1338977 - RNA, 15 nt, Mycobacterium tuberculosis H37Rv
cgaagcugcgggucu

SEQ ID NO: 1338978 - RNA, 20 nt, Mycobacterium tuberculosis H37Rv
cgaagcugcugcugcuugac

SEQ ID NO: 1338979 - RNA, 22 nt, Mycobacterium tuberculosis H37Rv
cgaagcccggacaacuucuuua

SEQ ID NO: 1338980 - RNA, 21 nt, Mycobacterium tuberculosis H37Rv
cgaagcgggcggaaacaagca

SEQ ID NO: 1338981 - RNA, 17 nt, Mycobacterium tuberculosis H37Rv
cgaagaagaacucggcg

SEQ ID NO: 1338982 - RNA, 12 nt, Mycobacterium tuberculosis H37Rv
cgaagaacaaca

SEQ ID NO: 1338983 - RNA, 23 nt, Mycobacterium tuberculosis H37Rv
cgaagaaugggauggcaccaccc

SEQ ID NO: 1338984 - RNA, 17 nt, Mycobacterium tuberculosis H37Rv
cgaagauggccagcgcg

SEQ ID NO: 1338985 - RNA, 23 nt, Mycobacterium tuberculosis H37Rv
cgaaccucggcgggauccucgaa

SEQ ID NO: 1338986 - RNA, 22 nt, Mycobacterium tuberculosis H37Rv
cgaaccugucgaucacggccgu

SEQ ID NO: 1338987 - RNA, 20 nt, Mycobacterium tuberculosis H37Rv
cgaaccgguguagcagcgcc

SEQ ID NO: 1338988 - RNA, 14 nt, Mycobacterium tuberculosis H37Rv
cgaacgacagcaga

SEQ ID NO: 1338989 - RNA, 22 nt, Mycobacterium tuberculosis H37Rv
cgaacgcaccgaaacgccgacc

SEQ ID NO: 1338990 - RNA, 16 nt, Mycobacterium tuberculosis H37Rv
cgaaccugcggcagcg

SEQ ID NO: 1338991 - RNA, 19 nt, Mycobacterium tuberculosis H37Rv
cgaacgugcaaccauggcg

SEQ ID NO: 1338992 - RNA, 15 nt, Mycobacterium tuberculosis H37Rv
cgaacucgcgggcga

SEQ ID NO: 1338993 - RNA, 20 nt, Mycobacterium tuberculosis H37Rv
cgaacucggcggccagcgcg

SEQ ID NO: 1338994 - RNA, 20 nt, Mycobacterium tuberculosis H37Rv
cgaacucaucgugguaacca

SEQ ID NO: 1338995 - RNA, 14 nt, Mycobacterium tuberculosis H37Rv
cgaacgccaccacc

SEQ ID NO: 1338996 - RNA, 15 nt, Mycobacterium tuberculosis H37Rv
cgaacgcagccagcg

SEQ ID NO: 1338997 - RNA, 15 nt, Mycobacterium tuberculosis H37Rv
cgaacgccagcagcu

SEQ ID NO: 1338998 - RNA, 18 nt, Mycobacterium tuberculosis H37Rv
cgaacgucgcggccagca

SEQ ID NO: 1338999 - RNA, 15 nt, Mycobacterium tuberculosis H37Rv
cgaacgucaccaucg

SEQ ID NO: 1339000 - RNA, 18 nt, Mycobacterium tuberculosis H37Rv
cgaacgguagcacggucu

SEQ ID NO: 1339001 - RNA, 19 nt, Mycobacterium tuberculosis H37Rv
cgaacgggucggcgaccac

SEQ ID NO: 1339002 - RNA, 21 nt, Mycobacterium tuberculosis H37Rv
cgaacgggucggcgaccaccc

SEQ ID NO: 1339003 - RNA, 12 nt, Mycobacterium tuberculosis H37Rv
cgaaggcacugc

SEQ ID NO: 1339004 - RNA, 12 nt, Mycobacterium tuberculosis H37Rv
cgaaggccaccc

SEQ ID NO: 1339005 - RNA, 15 nt, Mycobacterium tuberculosis H37Rv
cgaagcuggcgugca

SEQ ID NO: 1339006 - RNA, 17 nt, Mycobacterium tuberculosis H37Rv
cgaaggcaaagcgagca

SEQ ID NO: 1339007 - RNA, 23 nt, Mycobacterium tuberculosis H37Rv
cgaagcuugacguugccgggcuu

SEQ ID NO: 1339008 - RNA, 18 nt, Mycobacterium tuberculosis H37Rv
cgaagcuucggccuucuu

SEQ ID NO: 1339009 - RNA, 20 nt, Mycobacterium tuberculosis H37Rv
cgaagcuggcgugcagcagg

SEQ ID NO: 1339010 - RNA, 22 nt, Mycobacterium tuberculosis H37Rv
cgaaggaugcugucagacggcg

SEQ ID NO: 1339011 - RNA, 17 nt, Mycobacterium tuberculosis H37Rv
cgaaggaccggcaccug

SEQ ID NO: 1339012 - RNA, 16 nt, Mycobacterium tuberculosis H37Rv
cgaaucaacaggaccg

SEQ ID NO: 1339013 - RNA, 17 nt, Mycobacterium tuberculosis H37Rv
cgaaucccacagcagga

SEQ ID NO: 1339014 - RNA, 14 nt, Mycobacterium tuberculosis H37Rv
cgaauccaucgaga

SEQ ID NO: 1339015 - RNA, 12 nt, Mycobacterium tuberculosis H37Rv
cgaaucagcucg

SEQ ID NO: 1339016 - RNA, 14 nt, Mycobacterium tuberculosis H37Rv
cgaaucgucacgga

SEQ ID NO: 1339017 - RNA, 23 nt, Mycobacterium tuberculosis H37Rv
cgaaucggcaguugaacucgacc

SEQ ID NO: 1339018 - RNA, 19 nt, Mycobacterium tuberculosis H37Rv
cgaaucuucugagacugcc

SEQ ID NO: 1339019 - RNA, 21 nt, Mycobacterium tuberculosis H37Rv
cgaauccucgcgaaaccgccg

SEQ ID NO: 1339020 - RNA, 16 nt, Mycobacterium tuberculosis H37Rv
cgaaucgccugccaca

SEQ ID NO: 1339021 - RNA, 15 nt, Mycobacterium tuberculosis H37Rv
cgaaugucgccgccu

SEQ ID NO: 1339022 - RNA, 18 nt, Mycobacterium tuberculosis H37Rv
cgaauggccgaaccguuc

SEQ ID NO: 1339023 - RNA, 14 nt, Mycobacterium tuberculosis H37Rv
cgaaugcgggugga

SEQ ID NO: 1339024 - RNA, 16 nt, Mycobacterium tuberculosis H37Rv
cgaaugcgguccucga

SEQ ID NO: 1339025 - RNA, 18 nt, Mycobacterium tuberculosis H37Rv
cgaaugcgggccuccugc

SEQ ID NO: 1339026 - RNA, 22 nt, Mycobacterium tuberculosis H37Rv
cgaaugccauaaccggugggga

SEQ ID NO: 1339027 - RNA, 15 nt, Mycobacterium tuberculosis H37Rv
cgacaguggcucacc

SEQ ID NO: 1339028 - RNA, 18 nt, Mycobacterium tuberculosis H37Rv
cgacaggugccagaccag

SEQ ID NO: 1339029 - RNA, 15 nt, Mycobacterium tuberculosis H37Rv
cgacaggugaaggug

SEQ ID NO: 1339030 - RNA, 18 nt, Mycobacterium tuberculosis H37Rv
cgacaggcgcccacaaau

SEQ ID NO: 1339031 - RNA, 17 nt, Mycobacterium tuberculosis H37Rv
cgacaggacgucggcga

SEQ ID NO: 1339032 - RNA, 14 nt, Mycobacterium tuberculosis H37Rv
cgacaggccggcca

SEQ ID NO: 1339033 - RNA, 21 nt, Mycobacterium tuberculosis H37Rv
cgacaguuuaccgugccgccc

SEQ ID NO: 1339034 - RNA, 16 nt, Mycobacterium tuberculosis H37Rv
cgacauaggccaccuc

SEQ ID NO: 1339035 - RNA, 15 nt, Mycobacterium tuberculosis H37Rv
cgacauaggccaccu

SEQ ID NO: 1339036 - RNA, 15 nt, Mycobacterium tuberculosis H37Rv
cgacaucaccgaacg

SEQ ID NO: 1339037 - RNA, 15 nt, Mycobacterium tuberculosis H37Rv
cgacaucaccaccgc

SEQ ID NO: 1339038 - RNA, 20 nt, Mycobacterium tuberculosis H37Rv
cgacaucauggugaaggcaa

SEQ ID NO: 1339039 - RNA, 14 nt, Mycobacterium tuberculosis H37Rv
cgacagcgcggcgc

SEQ ID NO: 1339040 - RNA, 17 nt, Mycobacterium tuberculosis H37Rv
cgacagcgcugggccca

SEQ ID NO: 1339041 - RNA, 19 nt, Mycobacterium tuberculosis H37Rv
cgacagcggcgacaugauc

SEQ ID NO: 1339042 - RNA, 12 nt, Mycobacterium tuberculosis H37Rv
cgacagcccgcc

SEQ ID NO: 1339043 - RNA, 21 nt, Mycobacterium tuberculosis H37Rv
cgacagcccuaucagccgaga

SEQ ID NO: 1339044 - RNA, 19 nt, Mycobacterium tuberculosis H37Rv
cgacagccccaucaccacc

SEQ ID NO: 1339045 - RNA, 20 nt, Mycobacterium tuberculosis H37Rv
cgacagccccaucaccaccg

SEQ ID NO: 1339046 - RNA, 16 nt, Mycobacterium tuberculosis H37Rv
cgacagcaucacgccc

SEQ ID NO: 1339047 - RNA, 13 nt, Mycobacterium tuberculosis H37Rv
cgacagccaccgc

SEQ ID NO: 1339048 - RNA, 23 nt, Mycobacterium tuberculosis H37Rv
cgacagcagccggugccggucga

SEQ ID NO: 1339049 - RNA, 16 nt, Mycobacterium tuberculosis H37Rv
cgacagacaaacuccg

SEQ ID NO: 1339050 - RNA, 15 nt, Mycobacterium tuberculosis H37Rv
cgacacgccagguga

SEQ ID NO: 1339051 - RNA, 15 nt, Mycobacterium tuberculosis H37Rv
cgacacgccggcggg

SEQ ID NO: 1339052 - RNA, 15 nt, Mycobacterium tuberculosis H37Rv
cgacacgcggcccga

SEQ ID NO: 1339053 - RNA, 19 nt, Mycobacterium tuberculosis H37Rv
cgacacggcucgccggcuc

SEQ ID NO: 1339054 - RNA, 18 nt, Mycobacterium tuberculosis H37Rv
cgacacgugcaucuguga

SEQ ID NO: 1339055 - RNA, 14 nt, Mycobacterium tuberculosis H37Rv
cgacacggugaucu

SEQ ID NO: 1339056 - RNA, 21 nt, Mycobacterium tuberculosis H37Rv
cgacaacacccacgugcugcc

SEQ ID NO: 1339057 - RNA, 15 nt, Mycobacterium tuberculosis H37Rv
cgacaacaccacggu

SEQ ID NO: 1339058 - RNA, 13 nt, Mycobacterium tuberculosis H37Rv
cgacaacaccacg

SEQ ID NO: 1339059 - RNA, 13 nt, Mycobacterium tuberculosis H37Rv
cgacaacacgccg

SEQ ID NO: 1339060 - RNA, 17 nt, Mycobacterium tuberculosis H37Rv
cgacaacacgccgucga

SEQ ID NO: 1339061 - RNA, 14 nt, Mycobacterium tuberculosis H37Rv
cgacaacagccagc

SEQ ID NO: 1339062 - RNA, 21 nt, Mycobacterium tuberculosis H37Rv
cgacaacaugcccgucagcgg

SEQ ID NO: 1339063 - RNA, 14 nt, Mycobacterium tuberculosis H37Rv
cgacaccggccgcg

SEQ ID NO: 1339064 - RNA, 18 nt, Mycobacterium tuberculosis H37Rv
cgacaccguccagcagcu

SEQ ID NO: 1339065 - RNA, 20 nt, Mycobacterium tuberculosis H37Rv
cgacaccggcugaccgaccc

SEQ ID NO: 1339066 - RNA, 16 nt, Mycobacterium tuberculosis H37Rv
cgacaccgcccgaccc

SEQ ID NO: 1339067 - RNA, 11 nt, Mycobacterium tuberculosis H37Rv
cgacaccgccg

SEQ ID NO: 1339068 - RNA, 16 nt, Mycobacterium tuberculosis H37Rv
cgacaccgccaccacg

SEQ ID NO: 1339069 - RNA, 20 nt, Mycobacterium tuberculosis H37Rv
cgacaccgcaggugccgugg

SEQ ID NO: 1339070 - RNA, 19 nt, Mycobacterium tuberculosis H37Rv
cgacaccgcggugccccgg

SEQ ID NO: 1339071 - RNA, 16 nt, Mycobacterium tuberculosis H37Rv
cgacaccgcggugccc

SEQ ID NO: 1339072 - RNA, 13 nt, Mycobacterium tuberculosis H37Rv
cgacaccgcccga

SEQ ID NO: 1339073 - RNA, 15 nt, Mycobacterium tuberculosis H37Rv
cgacaccgcgcagcg

SEQ ID NO: 1339074 - RNA, 20 nt, Mycobacterium tuberculosis H37Rv
cgacaccgcggacccgcagc

SEQ ID NO: 1339075 - RNA, 20 nt, Mycobacterium tuberculosis H37Rv
cgacaccgagccacgaccca

SEQ ID NO: 1339076 - RNA, 14 nt, Mycobacterium tuberculosis H37Rv
cgacacccugggug

SEQ ID NO: 1339077 - RNA, 22 nt, Mycobacterium tuberculosis H37Rv
cgacacccugggugccggcagc

SEQ ID NO: 1339078 - RNA, 20 nt, Mycobacterium tuberculosis H37Rv
cgacacccgaugugcccggc

SEQ ID NO: 1339079 - RNA, 12 nt, Mycobacterium tuberculosis H37Rv
cgacaccaccag

SEQ ID NO: 1339080 - RNA, 21 nt, Mycobacterium tuberculosis H37Rv
cgacacauagugcggcaccgc

SEQ ID NO: 1339081 - RNA, 14 nt, Mycobacterium tuberculosis H37Rv
cgacaccaccggcg

SEQ ID NO: 1339082 - RNA, 20 nt, Mycobacterium tuberculosis H37Rv
cgacaccacggcgcgcagcg

SEQ ID NO: 1339083 - RNA, 21 nt, Mycobacterium tuberculosis H37Rv
cgacaccagaucguuccaggc

SEQ ID NO: 1339084 - RNA, 14 nt, Mycobacterium tuberculosis H37Rv
cgacaagccgucgg

SEQ ID NO: 1339085 - RNA, 17 nt, Mycobacterium tuberculosis H37Rv
cgacaagaauggccgcc

SEQ ID NO: 1339086 - RNA, 14 nt, Mycobacterium tuberculosis H37Rv
cgacaagaccggcg

SEQ ID NO: 1339087 - RNA, 16 nt, Mycobacterium tuberculosis H37Rv
cgacaacgcugggcgg

SEQ ID NO: 1339088 - RNA, 12 nt, Mycobacterium tuberculosis H37Rv
cgacacacccac

SEQ ID NO: 1339089 - RNA, 16 nt, Mycobacterium tuberculosis H37Rv
cauagacagggccgcu

SEQ ID NO: 1339090 - RNA, 22 nt, Mycobacterium tuberculosis H37Rv
cauagcaccucgaugaugcgcu

SEQ ID NO: 1339091 - RNA, 16 nt, Mycobacterium tuberculosis H37Rv
cauagagcggcaccag

SEQ ID NO: 1339092 - RNA, 12 nt, Mycobacterium tuberculosis H37Rv
cagugcaggcgg

SEQ ID NO: 1339093 - RNA, 16 nt, Mycobacterium tuberculosis H37Rv
cagugcagacaggcgg

SEQ ID NO: 1339094 - RNA, 15 nt, Mycobacterium tuberculosis H37Rv
cagugcaucggucag

SEQ ID NO: 1339095 - RNA, 19 nt, Mycobacterium tuberculosis H37Rv
cagugccaccugggcgggc

SEQ ID NO: 1339096 - RNA, 19 nt, Mycobacterium tuberculosis H37Rv
cauacucugcgacaccacg

SEQ ID NO: 1339097 - RNA, 15 nt, Mycobacterium tuberculosis H37Rv
cauagccgcgacccg

SEQ ID NO: 1339098 - RNA, 17 nt, Mycobacterium tuberculosis H37Rv
cauagccccgcagaguc

SEQ ID NO: 1339099 - RNA, 15 nt, Mycobacterium tuberculosis H37Rv
cauagccgaacagcg

SEQ ID NO: 1339100 - RNA, 18 nt, Mycobacterium tuberculosis H37Rv
cauagcugccggcccacc

SEQ ID NO: 1339101 - RNA, 17 nt, Mycobacterium tuberculosis H37Rv
cauauccgccccagcug

SEQ ID NO: 1339102 - RNA, 13 nt, Mycobacterium tuberculosis H37Rv
cauaucaaccccg

SEQ ID NO: 1339103 - RNA, 14 nt, Mycobacterium tuberculosis H37Rv
caucaaggccaccu

SEQ ID NO: 1339104 - RNA, 22 nt, Mycobacterium tuberculosis H37Rv
caucaccacuggacccgcccag

SEQ ID NO: 1339105 - RNA, 17 nt, Mycobacterium tuberculosis H37Rv
caucaccccggccuugg

SEQ ID NO: 1339106 - RNA, 16 nt, Mycobacterium tuberculosis H37Rv
caucagcagagccccg

SEQ ID NO: 1339107 - RNA, 19 nt, Mycobacterium tuberculosis H37Rv
caucagauucgcgcuggcc

SEQ ID NO: 1339108 - RNA, 14 nt, Mycobacterium tuberculosis H37Rv
caucacucgcgcca

SEQ ID NO: 1339109 - RNA, 16 nt, Mycobacterium tuberculosis H37Rv
caucaccgcagcaccg

SEQ ID NO: 1339110 - RNA, 20 nt, Mycobacterium tuberculosis H37Rv
caucaccgccagccccgcgc

SEQ ID NO: 1339111 - RNA, 20 nt, Mycobacterium tuberculosis H37Rv
caucaccggcggccccaggg

SEQ ID NO: 1339112 - RNA, 13 nt, Mycobacterium tuberculosis H37Rv
caucaccgcgcuc

SEQ ID NO: 1339113 - RNA, 19 nt, Mycobacterium tuberculosis H37Rv
caucggcugcgacaggacg

SEQ ID NO: 1339114 - RNA, 15 nt, Mycobacterium tuberculosis H37Rv
caucggcucugaugg

SEQ ID NO: 1339115 - RNA, 23 nt, Mycobacterium tuberculosis H37Rv
caucggcuaucgcuagccggcuc

SEQ ID NO: 1339116 - RNA, 21 nt, Mycobacterium tuberculosis H37Rv
caucggcgugcuugcccaggu

SEQ ID NO: 1339117 - RNA, 21 nt, Mycobacterium tuberculosis H37Rv
caucggcggcgucgacgucca

SEQ ID NO: 1339118 - RNA, 14 nt, Mycobacterium tuberculosis H37Rv
caucgggagccgca

SEQ ID NO: 1339119 - RNA, 13 nt, Mycobacterium tuberculosis H37Rv
caucgggagccgc

SEQ ID NO: 1339120 - RNA, 20 nt, Mycobacterium tuberculosis H37Rv
caucggcuuugaggcgugca

SEQ ID NO: 1339121 - RNA, 19 nt, Mycobacterium tuberculosis H37Rv
caucgggcgagcucgucga

SEQ ID NO: 1339122 - RNA, 22 nt, Mycobacterium tuberculosis H37Rv
caucggugaauguugccgccgc

SEQ ID NO: 1339123 - RNA, 20 nt, Mycobacterium tuberculosis H37Rv
caucggugagcccguugacc

SEQ ID NO: 1339124 - RNA, 14 nt, Mycobacterium tuberculosis H37Rv
caucggucccacug

SEQ ID NO: 1339125 - RNA, 18 nt, Mycobacterium tuberculosis H37Rv
caucggucagcgccgacu

SEQ ID NO: 1339126 - RNA, 17 nt, Mycobacterium tuberculosis H37Rv
caucggucccacugccg

SEQ ID NO: 1339127 - RNA, 19 nt, Mycobacterium tuberculosis H37Rv
caucgucguggugaugucc

SEQ ID NO: 1339128 - RNA, 17 nt, Mycobacterium tuberculosis H37Rv
caucggugcagcccgcc

SEQ ID NO: 1339129 - RNA, 20 nt, Mycobacterium tuberculosis H37Rv
caucggugcgcacggcggcc

SEQ ID NO: 1339130 - RNA, 19 nt, Mycobacterium tuberculosis H37Rv
caucgguguggcccaacac

SEQ ID NO: 1339131 - RNA, 21 nt, Mycobacterium tuberculosis H37Rv
caucggugucuuccuccucga

SEQ ID NO: 1339132 - RNA, 15 nt, Mycobacterium tuberculosis H37Rv
caucgucugguggca

SEQ ID NO: 1339133 - RNA, 18 nt, Mycobacterium tuberculosis H37Rv
caucggcaucgacugcca

SEQ ID NO: 1339134 - RNA, 19 nt, Mycobacterium tuberculosis H37Rv
caucggcaucgacugccag

SEQ ID NO: 1339135 - RNA, 16 nt, Mycobacterium tuberculosis H37Rv
caucggcagcagcgca

SEQ ID NO: 1339136 - RNA, 19 nt, Mycobacterium tuberculosis H37Rv
caucggcacaggcggccag

SEQ ID NO: 1339137 - RNA, 21 nt, Mycobacterium tuberculosis H37Rv
caucggcacaggcggccagca

SEQ ID NO: 1339138 - RNA, 18 nt, Mycobacterium tuberculosis H37Rv
caucggccaucucgucga

SEQ ID NO: 1339139 - RNA, 14 nt, Mycobacterium tuberculosis H37Rv
caucggccagccgu

SEQ ID NO: 1339140 - RNA, 23 nt, Mycobacterium tuberculosis H37Rv
caucggccggcgucagccccgac

SEQ ID NO: 1339141 - RNA, 22 nt, Mycobacterium tuberculosis H37Rv
caucggccgucucggcaugcuc

SEQ ID NO: 1339142 - RNA, 16 nt, Mycobacterium tuberculosis H37Rv
caucggccucugacca

SEQ ID NO: 1339143 - RNA, 13 nt, Mycobacterium tuberculosis H37Rv
caucggccucuga

SEQ ID NO: 1339144 - RNA, 16 nt, Mycobacterium tuberculosis H37Rv
caucggcgaccgccug

SEQ ID NO: 1339145 - RNA, 11 nt, Mycobacterium tuberculosis H37Rv
caucggacagg

SEQ ID NO: 1339146 - RNA, 20 nt, Mycobacterium tuberculosis H37Rv
caucgcccgaugcgccagcg

SEQ ID NO: 1339147 - RNA, 17 nt, Mycobacterium tuberculosis H37Rv
caucgccgagguggaca

SEQ ID NO: 1339148 - RNA, 23 nt, Mycobacterium tuberculosis H37Rv
caucgccgaugauguuuuccccg

SEQ ID NO: 1339149 - RNA, 16 nt, Mycobacterium tuberculosis H37Rv
caucgcccaccgcaac

SEQ ID NO: 1339150 - RNA, 13 nt, Mycobacterium tuberculosis H37Rv
caucgccaggccc

SEQ ID NO: 1339151 - RNA, 21 nt, Mycobacterium tuberculosis H37Rv
caucgccauaccggccgccau

SEQ ID NO: 1339152 - RNA, 15 nt, Mycobacterium tuberculosis H37Rv
caucgccagccugug

SEQ ID NO: 1339153 - RNA, 21 nt, Mycobacterium tuberculosis H37Rv
caucgccagccugugcugcca

SEQ ID NO: 1339154 - RNA, 15 nt, Mycobacterium tuberculosis H37Rv
caucgccaacaccaa

SEQ ID NO: 1339155 - RNA, 16 nt, Mycobacterium tuberculosis H37Rv
caucgacguuccagca

SEQ ID NO: 1339156 - RNA, 15 nt, Mycobacterium tuberculosis H37Rv
caucgaaggugcugg

SEQ ID NO: 1339157 - RNA, 18 nt, Mycobacterium tuberculosis H37Rv
caucgacguuccagcagu

SEQ ID NO: 1339158 - RNA, 17 nt, Mycobacterium tuberculosis H37Rv
caucgacuugccgccgc

SEQ ID NO: 1339159 - RNA, 23 nt, Mycobacterium tuberculosis H37Rv
caucgagcaccuccacugggucg

SEQ ID NO: 1339160 - RNA, 20 nt, Mycobacterium tuberculosis H37Rv
caucgagcccggacgagugc

SEQ ID NO: 1339161 - RNA, 23 nt, Mycobacterium tuberculosis H37Rv
caucgagucgaagaaccugagca

SEQ ID NO: 1339162 - RNA, 17 nt, Mycobacterium tuberculosis H37Rv
caucgaguccaccaccu

SEQ ID NO: 1339163 - RNA, 19 nt, Mycobacterium tuberculosis H37Rv
caucgagcugaccugguuc

SEQ ID NO: 1339164 - RNA, 17 nt, Mycobacterium tuberculosis H37Rv
caucgagcgccagccgg

SEQ ID NO: 1339165 - RNA, 14 nt, Mycobacterium tuberculosis H37Rv
caucgaacucugga

SEQ ID NO: 1339166 - RNA, 21 nt, Mycobacterium tuberculosis H37Rv
caucgaaaaaccucgacgccc

SEQ ID NO: 1339167 - RNA, 12 nt, Mycobacterium tuberculosis H37Rv
cauccuucacca

SEQ ID NO: 1339168 - RNA, 16 nt, Mycobacterium tuberculosis H37Rv
cauccuucaccagcug

SEQ ID NO: 1339169 - RNA, 16 nt, Mycobacterium tuberculosis H37Rv
cauccuugacgcggcc

SEQ ID NO: 1339170 - RNA, 15 nt, Mycobacterium tuberculosis H37Rv
cauccgccccgcccg

SEQ ID NO: 1339171 - RNA, 16 nt, Mycobacterium tuberculosis H37Rv
cauccgcgacggcgcc

SEQ ID NO: 1339172 - RNA, 14 nt, Mycobacterium tuberculosis H37Rv
cauccgccgccccc

SEQ ID NO: 1339173 - RNA, 21 nt, Mycobacterium tuberculosis H37Rv
cauccggccgucggcgggcau

SEQ ID NO: 1339174 - RNA, 19 nt, Mycobacterium tuberculosis H37Rv
cauccccagcacaaccagc

SEQ ID NO: 1339175 - RNA, 22 nt, Mycobacterium tuberculosis H37Rv
caucccagcgaaugcugacaug

SEQ ID NO: 1339176 - RNA, 14 nt, Mycobacterium tuberculosis H37Rv
cauccgaucgccgc

SEQ ID NO: 1339177 - RNA, 13 nt, Mycobacterium tuberculosis H37Rv
caucccgccgccc

SEQ ID NO: 1339178 - RNA, 23 nt, Mycobacterium tuberculosis H37Rv
caucccgaaguagaagcccagga

SEQ ID NO: 1339179 - RNA, 22 nt, Mycobacterium tuberculosis H37Rv
cauccaugauggccgucagcca

SEQ ID NO: 1339180 - RNA, 20 nt, Mycobacterium tuberculosis H37Rv
cauccauucggcggcggcgu

SEQ ID NO: 1339181 - RNA, 18 nt, Mycobacterium tuberculosis H37Rv
cauccauucggcggcggc

SEQ ID NO: 1339182 - RNA, 21 nt, Mycobacterium tuberculosis H37Rv
cauccaggcugucgcgggcca

SEQ ID NO: 1339183 - RNA, 22 nt, Mycobacterium tuberculosis H37Rv
caucauggccgugaacugcgua

SEQ ID NO: 1339184 - RNA, 21 nt, Mycobacterium tuberculosis H37Rv
cauccaacgaccuccacgccc

SEQ ID NO: 1339185 - RNA, 15 nt, Mycobacterium tuberculosis H37Rv
cauccaacgcggcgc

SEQ ID NO: 1339186 - RNA, 23 nt, Mycobacterium tuberculosis H37Rv
cauccaacgcggcgcgagccugc

SEQ ID NO: 1339187 - RNA, 16 nt, Mycobacterium tuberculosis H37Rv
caucauuugcaguccc

SEQ ID NO: 1339188 - RNA, 14 nt, Mycobacterium tuberculosis H37Rv
caucaugucggcgc

SEQ ID NO: 1339189 - RNA, 20 nt, Mycobacterium tuberculosis H37Rv
caucaugucggcgcaggcgu

SEQ ID NO: 1339190 - RNA, 18 nt, Mycobacterium tuberculosis H37Rv
cauccacgcacucacuac

SEQ ID NO: 1339191 - RNA, 18 nt, Mycobacterium tuberculosis H37Rv
cauccacaccgcggcggc

SEQ ID NO: 1339192 - RNA, 15 nt, Mycobacterium tuberculosis H37Rv
cauccacaccgaccg

SEQ ID NO: 1339193 - RNA, 13 nt, Mycobacterium tuberculosis H37Rv
cauccagccagca

SEQ ID NO: 1339194 - RNA, 22 nt, Mycobacterium tuberculosis H37Rv
cauccagaucggauugccuccg

SEQ ID NO: 1339195 - RNA, 19 nt, Mycobacterium tuberculosis H37Rv
cauccagagacaugucgcu

SEQ ID NO: 1339196 - RNA, 12 nt, Mycobacterium tuberculosis H37Rv
caugacggcucc

SEQ ID NO: 1339197 - RNA, 22 nt, Mycobacterium tuberculosis H37Rv
caugagcuugguggccaccacg

SEQ ID NO: 1339198 - RNA, 14 nt, Mycobacterium tuberculosis H37Rv
caugaggugagcug

SEQ ID NO: 1339199 - RNA, 20 nt, Mycobacterium tuberculosis H37Rv
caugacaccggccaccagcc

SEQ ID NO: 1339200 - RNA, 19 nt, Mycobacterium tuberculosis H37Rv
caugacagccccgccgccc

SEQ ID NO: 1339201 - RNA, 17 nt, Mycobacterium tuberculosis H37Rv
caugacaccggccacca

SEQ ID NO: 1339202 - RNA, 23 nt, Mycobacterium tuberculosis H37Rv
caugaccgggcuggccagcgcgc

SEQ ID NO: 1339203 - RNA, 21 nt, Mycobacterium tuberculosis H37Rv
caugaccaccgaaauacccag

SEQ ID NO: 1339204 - RNA, 13 nt, Mycobacterium tuberculosis H37Rv
caugaagauccag

SEQ ID NO: 1339205 - RNA, 15 nt, Mycobacterium tuberculosis H37Rv
caugaauccacugaa

SEQ ID NO: 1339206 - RNA, 19 nt, Mycobacterium tuberculosis H37Rv
caugaacucgaacuggguc

SEQ ID NO: 1339207 - RNA, 17 nt, Mycobacterium tuberculosis H37Rv
caugaacaucggccggg

SEQ ID NO: 1339208 - RNA, 19 nt, Mycobacterium tuberculosis H37Rv
caugaaccggucgaucccc

SEQ ID NO: 1339209 - RNA, 13 nt, Mycobacterium tuberculosis H37Rv
caugaacgccagc

SEQ ID NO: 1339210 - RNA, 16 nt, Mycobacterium tuberculosis H37Rv
caugaacgccagcagc

SEQ ID NO: 1339211 - RNA, 19 nt, Mycobacterium tuberculosis H37Rv
caugaacgccagcagcgcg

SEQ ID NO: 1339212 - RNA, 20 nt, Mycobacterium tuberculosis H37Rv
caugaaaucgaugaccgcag

SEQ ID NO: 1339213 - RNA, 14 nt, Mycobacterium tuberculosis H37Rv
caucuugccaccgc

SEQ ID NO: 1339214 - RNA, 18 nt, Mycobacterium tuberculosis H37Rv
caucuugucgaucugccc

SEQ ID NO: 1339215 - RNA, 21 nt, Mycobacterium tuberculosis H37Rv
caucguggggaucgaccaugg

SEQ ID NO: 1339216 - RNA, 15 nt, Mycobacterium tuberculosis H37Rv
caucguggccgcacc

SEQ ID NO: 1339217 - RNA, 17 nt, Mycobacterium tuberculosis H37Rv
caugccuucggccaacc

SEQ ID NO: 1339218 - RNA, 17 nt, Mycobacterium tuberculosis H37Rv
caugcgcaccaguccag

SEQ ID NO: 1339219 - RNA, 17 nt, Mycobacterium tuberculosis H37Rv
caugccgacgacaacag

SEQ ID NO: 1339220 - RNA, 15 nt, Mycobacterium tuberculosis H37Rv
caugccgaucggccu

SEQ ID NO: 1339221 - RNA, 15 nt, Mycobacterium tuberculosis H37Rv
caugcccgggaugac

SEQ ID NO: 1339222 - RNA, 18 nt, Mycobacterium tuberculosis H37Rv
caugccgcccgcgccgcc

SEQ ID NO: 1339223 - RNA, 19 nt, Mycobacterium tuberculosis H37Rv
caugccggcgcaccacacc

SEQ ID NO: 1339224 - RNA, 22 nt, Mycobacterium tuberculosis H37Rv
caugcccaggugcguccaggcc

SEQ ID NO: 1339225 - RNA, 17 nt, Mycobacterium tuberculosis H37Rv
caugcccaucuccaaca

SEQ ID NO: 1339226 - RNA, 16 nt, Mycobacterium tuberculosis H37Rv
caugcccuuguaggcc

SEQ ID NO: 1339227 - RNA, 21 nt, Mycobacterium tuberculosis H37Rv
caugccgaacaauaaggccgc

SEQ ID NO: 1339228 - RNA, 13 nt, Mycobacterium tuberculosis H37Rv
caugccagccguc

SEQ ID NO: 1339229 - RNA, 13 nt, Mycobacterium tuberculosis H37Rv
caugccacacacu

SEQ ID NO: 1339230 - RNA, 24 nt, Mycobacterium tuberculosis H37Rv
caugccacaacgccucgauggcgg

SEQ ID NO: 1339231 - RNA, 17 nt, Mycobacterium tuberculosis H37Rv
caugaugaacagcucac

SEQ ID NO: 1339232 - RNA, 18 nt, Mycobacterium tuberculosis H37Rv
caugaucccgcugaccug

SEQ ID NO: 1339233 - RNA, 18 nt, Mycobacterium tuberculosis H37Rv
caugaucacaccgcugcu

SEQ ID NO: 1339234 - RNA, 21 nt, Mycobacterium tuberculosis H37Rv
caugauggccgucagccaggu

SEQ ID NO: 1339235 - RNA, 21 nt, Mycobacterium tuberculosis H37Rv
caugcacgucaucggcuggcc

SEQ ID NO: 1339236 - RNA, 16 nt, Mycobacterium tuberculosis H37Rv
caugcacgccguagca

SEQ ID NO: 1339237 - RNA, 20 nt, Mycobacterium tuberculosis H37Rv
caugcacgucaucggcuggc

SEQ ID NO: 1339238 - RNA, 19 nt, Mycobacterium tuberculosis H37Rv
caugcaucugaucaggcca

SEQ ID NO: 1339239 - RNA, 14 nt, Mycobacterium tuberculosis H37Rv
caugcaccgaugcc

SEQ ID NO: 1339240 - RNA, 23 nt, Mycobacterium tuberculosis H37Rv
caugcaccgaugccgaagccccc

SEQ ID NO: 1339241 - RNA, 20 nt, Mycobacterium tuberculosis H37Rv
caugcaagucaaacgccguc

SEQ ID NO: 1339242 - RNA, 21 nt, Mycobacterium tuberculosis H37Rv
cauggcgcggguccagccacc

SEQ ID NO: 1339243 - RNA, 14 nt, Mycobacterium tuberculosis H37Rv
cauggcgccgcgcc

SEQ ID NO: 1339244 - RNA, 21 nt, Mycobacterium tuberculosis H37Rv
caugggaucaggcugggcaga

SEQ ID NO: 1339245 - RNA, 19 nt, Mycobacterium tuberculosis H37Rv
caugggagcgggauucugg

SEQ ID NO: 1339246 - RNA, 17 nt, Mycobacterium tuberculosis H37Rv
caugggccggcgccgca

SEQ ID NO: 1339247 - RNA, 16 nt, Mycobacterium tuberculosis H37Rv
caugggcgcugccaau

SEQ ID NO: 1339248 - RNA, 14 nt, Mycobacterium tuberculosis H37Rv
cauggggucagcuc

SEQ ID NO: 1339249 - RNA, 19 nt, Mycobacterium tuberculosis H37Rv
caugguggcgccgaccugg

SEQ ID NO: 1339250 - RNA, 19 nt, Mycobacterium tuberculosis H37Rv
cauggugggaaaugaagug

SEQ ID NO: 1339251 - RNA, 18 nt, Mycobacterium tuberculosis H37Rv
cauggccucccacucacc

SEQ ID NO: 1339252 - RNA, 15 nt, Mycobacterium tuberculosis H37Rv
caugcuaggccaccg

SEQ ID NO: 1339253 - RNA, 21 nt, Mycobacterium tuberculosis H37Rv
caugcucaccgaaacgaugcg

SEQ ID NO: 1339254 - RNA, 21 nt, Mycobacterium tuberculosis H37Rv
caugcucacgaucacccgcac

SEQ ID NO: 1339255 - RNA, 18 nt, Mycobacterium tuberculosis H37Rv
caugcucacgaucugcgc

SEQ ID NO: 1339256 - RNA, 22 nt, Mycobacterium tuberculosis H37Rv
caugcuaggaccaccagcgcuc

SEQ ID NO: 1339257 - RNA, 22 nt, Mycobacterium tuberculosis H37Rv
caugcgccgagauccacgccag

SEQ ID NO: 1339258 - RNA, 23 nt, Mycobacterium tuberculosis H37Rv
caugcggaauuugcuugggcccc

SEQ ID NO: 1339259 - RNA, 22 nt, Mycobacterium tuberculosis H37Rv
caugcggcugccucccuuccgc

SEQ ID NO: 1339260 - RNA, 18 nt, Mycobacterium tuberculosis H37Rv
caugcgcgcgccggugcu

SEQ ID NO: 1339261 - RNA, 13 nt, Mycobacterium tuberculosis H37Rv
caugcgcuccggc

SEQ ID NO: 1339262 - RNA, 17 nt, Mycobacterium tuberculosis H37Rv
caugcgccaacccggcc

SEQ ID NO: 1339263 - RNA, 16 nt, Mycobacterium tuberculosis H37Rv
caugcgccguagccga

SEQ ID NO: 1339264 - RNA, 20 nt, Mycobacterium tuberculosis H37Rv
cauguucuccacgccgaucu

SEQ ID NO: 1339265 - RNA, 12 nt, Mycobacterium tuberculosis H37Rv
cauguugaccuc

SEQ ID NO: 1339266 - RNA, 14 nt, Mycobacterium tuberculosis H37Rv
cauguugcccugca

SEQ ID NO: 1339267 - RNA, 21 nt, Mycobacterium tuberculosis H37Rv
cauguucggccaccagaacca

SEQ ID NO: 1339268 - RNA, 13 nt, Mycobacterium tuberculosis H37Rv
caugucacaccca

SEQ ID NO: 1339269 - RNA, 14 nt, Mycobacterium tuberculosis H37Rv
caugucacacccac

SEQ ID NO: 1339270 - RNA, 20 nt, Mycobacterium tuberculosis H37Rv
caugucaaguucgccagcaa

SEQ ID NO: 1339271 - RNA, 17 nt, Mycobacterium tuberculosis H37Rv
cauguauuuguuguaaa

SEQ ID NO: 1339272 - RNA, 17 nt, Mycobacterium tuberculosis H37Rv
cauuccagaucaacgcg

SEQ ID NO: 1339273 - RNA, 19 nt, Mycobacterium tuberculosis H37Rv
cauucugcagcgucuccuu

SEQ ID NO: 1339274 - RNA, 20 nt, Mycobacterium tuberculosis H37Rv
cauucucggccggcggcgcc

SEQ ID NO: 1339275 - RNA, 16 nt, Mycobacterium tuberculosis H37Rv
cauucccaacacagcc

SEQ ID NO: 1339276 - RNA, 16 nt, Mycobacterium tuberculosis H37Rv
cauucccgaguugccc

SEQ ID NO: 1339277 - RNA, 21 nt, Mycobacterium tuberculosis H37Rv
cauucccgaguugcccucugg

SEQ ID NO: 1339278 - RNA, 18 nt, Mycobacterium tuberculosis H37Rv
cauucuucgaucagcggc

SEQ ID NO: 1339279 - RNA, 21 nt, Mycobacterium tuberculosis H37Rv
cauugaucgacggccagccca

SEQ ID NO: 1339280 - RNA, 20 nt, Mycobacterium tuberculosis H37Rv
cauugaucgacggccagccc

SEQ ID NO: 1339281 - RNA, 17 nt, Mycobacterium tuberculosis H37Rv
ccaaacuaacggcagcc

SEQ ID NO: 1339282 - RNA, 21 nt, Mycobacterium tuberculosis H37Rv
ccaaacuaacggcagccaccg

SEQ ID NO: 1339283 - RNA, 15 nt, Mycobacterium tuberculosis H37Rv
ccaaacuacccgccc

SEQ ID NO: 1339284 - RNA, 16 nt, Mycobacterium tuberculosis H37Rv
ccaaacgcugcuggca

SEQ ID NO: 1339285 - RNA, 17 nt, Mycobacterium tuberculosis H37Rv
ccaaaccggcccgcagc

SEQ ID NO: 1339286 - RNA, 21 nt, Mycobacterium tuberculosis H37Rv
ccaaaccggcccgcagcagca

SEQ ID NO: 1339287 - RNA, 18 nt, Mycobacterium tuberculosis H37Rv
ccaaacaccccggccuug

SEQ ID NO: 1339288 - RNA, 21 nt, Mycobacterium tuberculosis H37Rv
ccaaaauuuugucggccgccu

SEQ ID NO: 1339289 - RNA, 14 nt, Mycobacterium tuberculosis H37Rv
ccaaaaacggcagc

SEQ ID NO: 1339290 - RNA, 14 nt, Mycobacterium tuberculosis H37Rv
ccaagggcuguguc

SEQ ID NO: 1339291 - RNA, 15 nt, Mycobacterium tuberculosis H37Rv
ccaagguggccacca

SEQ ID NO: 1339292 - RNA, 21 nt, Mycobacterium tuberculosis H37Rv
ccaaggucuucaggccgcgca

SEQ ID NO: 1339293 - RNA, 14 nt, Mycobacterium tuberculosis H37Rv
ccaagcucagggug

SEQ ID NO: 1339294 - RNA, 14 nt, Mycobacterium tuberculosis H37Rv
ccaagcguccgcug

SEQ ID NO: 1339295 - RNA, 18 nt, Mycobacterium tuberculosis H37Rv
ccaaggcucagcagcgcc

SEQ ID NO: 1339296 - RNA, 16 nt, Mycobacterium tuberculosis H37Rv
ccaagcucggccagca

SEQ ID NO: 1339297 - RNA, 19 nt, Mycobacterium tuberculosis H37Rv
ccaagcucggccaccagcg

SEQ ID NO: 1339298 - RNA, 21 nt, Mycobacterium tuberculosis H37Rv
ccaaggcguugguagccaggg

SEQ ID NO: 1339299 - RNA, 14 nt, Mycobacterium tuberculosis H37Rv
ccaaggcuuccucc

SEQ ID NO: 1339300 - RNA, 13 nt, Mycobacterium tuberculosis H37Rv
ccaagcccgccgg

SEQ ID NO: 1339301 - RNA, 12 nt, Mycobacterium tuberculosis H37Rv
ccaagccgcggc

SEQ ID NO: 1339302 - RNA, 21 nt, Mycobacterium tuberculosis H37Rv
ccaagccgcggcuaggccagc

SEQ ID NO: 1339303 - RNA, 18 nt, Mycobacterium tuberculosis H37Rv
ccaagccgggugggagca

SEQ ID NO: 1339304 - RNA, 15 nt, Mycobacterium tuberculosis H37Rv
ccaagacgucggcgu

SEQ ID NO: 1339305 - RNA, 21 nt, Mycobacterium tuberculosis H37Rv
ccaacuuggcggccagccgcu

SEQ ID NO: 1339306 - RNA, 17 nt, Mycobacterium tuberculosis H37Rv
ccaacuuggcggccagc

SEQ ID NO: 1339307 - RNA, 21 nt, Mycobacterium tuberculosis H37Rv
ccaaccgcauauucaccccgc

SEQ ID NO: 1339308 - RNA, 14 nt, Mycobacterium tuberculosis H37Rv
ccaaccgcuuccaa

SEQ ID NO: 1339309 - RNA, 14 nt, Mycobacterium tuberculosis H37Rv
ccaacccgggccgc

SEQ ID NO: 1339310 - RNA, 22 nt, Mycobacterium tuberculosis H37Rv
ccaacccgucuuaucggcgucg

SEQ ID NO: 1339311 - RNA, 15 nt, Mycobacterium tuberculosis H37Rv
ccaacccguguggca

SEQ ID NO: 1339312 - RNA, 17 nt, Mycobacterium tuberculosis H37Rv
ccaacccugcggcgucg

SEQ ID NO: 1339313 - RNA, 19 nt, Mycobacterium tuberculosis H37Rv
ccaaccgguacuccugggu

SEQ ID NO: 1339314 - RNA, 15 nt, Mycobacterium tuberculosis H37Rv
ccaaccgggccggcu

SEQ ID NO: 1339315 - RNA, 14 nt, Mycobacterium tuberculosis H37Rv
ccaaccgggccggc

SEQ ID NO: 1339316 - RNA, 21 nt, Mycobacterium tuberculosis H37Rv
ccaaccgggccgccuggagcu

SEQ ID NO: 1339317 - RNA, 14 nt, Mycobacterium tuberculosis H37Rv
ccaaccuacccuga

SEQ ID NO: 1339318 - RNA, 21 nt, Mycobacterium tuberculosis H37Rv
ccaaccgggacaaccccuugc

SEQ ID NO: 1339319 - RNA, 18 nt, Mycobacterium tuberculosis H37Rv
ccaacguugcgccagcgg

SEQ ID NO: 1339320 - RNA, 16 nt, Mycobacterium tuberculosis H37Rv
ccaacguugugccgcu

SEQ ID NO: 1339321 - RNA, 19 nt, Mycobacterium tuberculosis H37Rv
ccaacucaagcaauggugc

SEQ ID NO: 1339322 - RNA, 13 nt, Mycobacterium tuberculosis H37Rv
ccaacuccaccca

SEQ ID NO: 1339323 - RNA, 14 nt, Mycobacterium tuberculosis H37Rv
ccaacucggccagc

SEQ ID NO: 1339324 - RNA, 18 nt, Mycobacterium tuberculosis H37Rv
ccaacucggcggccagcg

SEQ ID NO: 1339325 - RNA, 17 nt, Mycobacterium tuberculosis H37Rv
ccaacucgguucgcccc

SEQ ID NO: 1339326 - RNA, 18 nt, Mycobacterium tuberculosis H37Rv
ccaacucgguucgccccu

SEQ ID NO: 1339327 - RNA, 22 nt, Mycobacterium tuberculosis H37Rv
ccaaagccgggauugccgccac

SEQ ID NO: 1339328 - RNA, 18 nt, Mycobacterium tuberculosis H37Rv
ccaaagcgacgagcagca

SEQ ID NO: 1339329 - RNA, 16 nt, Mycobacterium tuberculosis H37Rv
ccaacacgucgagcag

SEQ ID NO: 1339330 - RNA, 15 nt, Mycobacterium tuberculosis H37Rv
ccaacaccaggucau

SEQ ID NO: 1339331 - RNA, 13 nt, Mycobacterium tuberculosis H37Rv
ccaacaccgccag

SEQ ID NO: 1339332 - RNA, 23 nt, Mycobacterium tuberculosis H37Rv
ccaacacagcguaugcacaugau

SEQ ID NO: 1339333 - RNA, 15 nt, Mycobacterium tuberculosis H37Rv
ccaaccagugcagcu

SEQ ID NO: 1339334 - RNA, 15 nt, Mycobacterium tuberculosis H37Rv
ccaacccacccccca

SEQ ID NO: 1339335 - RNA, 21 nt, Mycobacterium tuberculosis H37Rv
ccaaccaugcugucggugccg

SEQ ID NO: 1339336 - RNA, 14 nt, Mycobacterium tuberculosis H37Rv
ccaaccccgccggc

SEQ ID NO: 1339337 - RNA, 23 nt, Mycobacterium tuberculosis H37Rv
ccaacauguugucgucgccgccg

SEQ ID NO: 1339338 - RNA, 15 nt, Mycobacterium tuberculosis H37Rv
ccaccggcgccuccg

SEQ ID NO: 1339339 - RNA, 16 nt, Mycobacterium tuberculosis H37Rv
ccaccgucaccgccgg

SEQ ID NO: 1339340 - RNA, 19 nt, Mycobacterium tuberculosis H37Rv
ccaccgucgccgccggucc

SEQ ID NO: 1339341 - RNA, 15 nt, Mycobacterium tuberculosis H37Rv
ccaccggcguccagu

SEQ ID NO: 1339342 - RNA, 13 nt, Mycobacterium tuberculosis H37Rv
ccaccgucccugu

SEQ ID NO: 1339343 - RNA, 17 nt, Mycobacterium tuberculosis H37Rv
ccaccgucccugugucg

SEQ ID NO: 1339344 - RNA, 22 nt, Mycobacterium tuberculosis H37Rv
ccaccgucgaaccaugguugau

SEQ ID NO: 1339345 - RNA, 16 nt, Mycobacterium tuberculosis H37Rv
ccaccggcgccgccgu

SEQ ID NO: 1339346 - RNA, 15 nt, Mycobacterium tuberculosis H37Rv
ccaccggcgccgccg

SEQ ID NO: 1339347 - RNA, 17 nt, Mycobacterium tuberculosis H37Rv
ccaccggcaccgccugc

SEQ ID NO: 1339348 - RNA, 19 nt, Mycobacterium tuberculosis H37Rv
ccaccggcgccaccggcgc

SEQ ID NO: 1339349 - RNA, 13 nt, Mycobacterium tuberculosis H37Rv
ccaccggccgcgc

SEQ ID NO: 1339350 - RNA, 14 nt, Mycobacterium tuberculosis H37Rv
ccaccggccggcgc

SEQ ID NO: 1339351 - RNA, 14 nt, Mycobacterium tuberculosis H37Rv
ccaccggccguccc

SEQ ID NO: 1339352 - RNA, 20 nt, Mycobacterium tuberculosis H37Rv
ccaccguugggccgacuggg

SEQ ID NO: 1339353 - RNA, 22 nt, Mycobacterium tuberculosis H37Rv
ccaccgugguggacgaccgcgc

SEQ ID NO: 1339354 - RNA, 18 nt, Mycobacterium tuberculosis H37Rv
ccaccguuagccaggucg

SEQ ID NO: 1339355 - RNA, 20 nt, Mycobacterium tuberculosis H37Rv
ccaccgugaccgagaagccc

SEQ ID NO: 1339356 - RNA, 13 nt, Mycobacterium tuberculosis H37Rv
ccaccgcuuccag

SEQ ID NO: 1339357 - RNA, 21 nt, Mycobacterium tuberculosis H37Rv
ccaccggccccaccggcaccc

SEQ ID NO: 1339358 - RNA, 13 nt, Mycobacterium tuberculosis H37Rv
ccaccggcccucg

SEQ ID NO: 1339359 - RNA, 21 nt, Mycobacterium tuberculosis H37Rv
ccaccgcugccggcagcgucc

SEQ ID NO: 1339360 - RNA, 16 nt, Mycobacterium tuberculosis H37Rv
ccaccgcugccggcgc

SEQ ID NO: 1339361 - RNA, 16 nt, Mycobacterium tuberculosis H37Rv
ccaccgcuugaccccu

SEQ ID NO: 1339362 - RNA, 22 nt, Mycobacterium tuberculosis H37Rv
ccaccggaauccgggccgccgc

SEQ ID NO: 1339363 - RNA, 18 nt, Mycobacterium tuberculosis H37Rv
ccaccgcauaacgccagu

SEQ ID NO: 1339364 - RNA, 14 nt, Mycobacterium tuberculosis H37Rv
ccaccgcggccgcg

SEQ ID NO: 1339365 - RNA, 19 nt, Mycobacterium tuberculosis H37Rv
ccaccgcggucaccgacgc

SEQ ID NO: 1339366 - RNA, 20 nt, Mycobacterium tuberculosis H37Rv
ccaccgcggucaccgacgca

SEQ ID NO: 1339367 - RNA, 14 nt, Mycobacterium tuberculosis H37Rv
ccaccgcggcgucg

SEQ ID NO: 1339368 - RNA, 14 nt, Mycobacterium tuberculosis H37Rv
ccaccguugccgcc

SEQ ID NO: 1339369 - RNA, 23 nt, Mycobacterium tuberculosis H37Rv
ccaccuguuggcaugccgcccgc

SEQ ID NO: 1339370 - RNA, 17 nt, Mycobacterium tuberculosis H37Rv
ccaccuguucacccacu

SEQ ID NO: 1339371 - RNA, 18 nt, Mycobacterium tuberculosis H37Rv
ccaccuucugguccagca

SEQ ID NO: 1339372 - RNA, 21 nt, Mycobacterium tuberculosis H37Rv
ccaccuuggcugggcccgccg

SEQ ID NO: 1339373 - RNA, 23 nt, Mycobacterium tuberculosis H37Rv
ccaccuuggcguugaccagcacg

SEQ ID NO: 1339374 - RNA, 17 nt, Mycobacterium tuberculosis H37Rv
ccaccuugugcaggccc

SEQ ID NO: 1339375 - RNA, 14 nt, Mycobacterium tuberculosis H37Rv
ccacgcaugggcca

SEQ ID NO: 1339376 - RNA, 15 nt, Mycobacterium tuberculosis H37Rv
ccacgcagcacggca

SEQ ID NO: 1339377 - RNA, 19 nt, Mycobacterium tuberculosis H37Rv
ccacgaaccgugcugggca

SEQ ID NO: 1339378 - RNA, 17 nt, Mycobacterium tuberculosis H37Rv
ccaccgacguggccagc

SEQ ID NO: 1339379 - RNA, 20 nt, Mycobacterium tuberculosis H37Rv
ccaccgaccgcguaaaggcc

SEQ ID NO: 1339380 - RNA, 18 nt, Mycobacterium tuberculosis H37Rv
ccaccgaucgacugcagc

SEQ ID NO: 1339381 - RNA, 21 nt, Mycobacterium tuberculosis H37Rv
ccaccgauaccgucagcgccg

SEQ ID NO: 1339382 - RNA, 16 nt, Mycobacterium tuberculosis H37Rv
ccaccgcaagaaucag

SEQ ID NO: 1339383 - RNA, 13 nt, Mycobacterium tuberculosis H37Rv
ccaccgcaccugc

SEQ ID NO: 1339384 - RNA, 23 nt, Mycobacterium tuberculosis H37Rv
ccaccgcaucggugucuuccucc

SEQ ID NO: 1339385 - RNA, 21 nt, Mycobacterium tuberculosis H37Rv
ccaccgcauaacgccaguccc

SEQ ID NO: 1339386 - RNA, 15 nt, Mycobacterium tuberculosis H37Rv
ccaccgcagcauccc

SEQ ID NO: 1339387 - RNA, 17 nt, Mycobacterium tuberculosis H37Rv
ccaccgcagcaucccug

SEQ ID NO: 1339388 - RNA, 13 nt, Mycobacterium tuberculosis H37Rv
ccaccgcgagcag

SEQ ID NO: 1339389 - RNA, 15 nt, Mycobacterium tuberculosis H37Rv
ccaccgcgagcagag

SEQ ID NO: 1339390 - RNA, 14 nt, Mycobacterium tuberculosis H37Rv
ccaccgcgcaaccc

SEQ ID NO: 1339391 - RNA, 22 nt, Mycobacterium tuberculosis H37Rv
ccaccccagcggccaccgaggc

SEQ ID NO: 1339392 - RNA, 19 nt, Mycobacterium tuberculosis H37Rv
ccacccgacaugcgccgag

SEQ ID NO: 1339393 - RNA, 20 nt, Mycobacterium tuberculosis H37Rv
ccaccccgcguaugccagga

SEQ ID NO: 1339394 - RNA, 23 nt, Mycobacterium tuberculosis H37Rv
ccaccccggucggagcggugccg

SEQ ID NO: 1339395 - RNA, 18 nt, Mycobacterium tuberculosis H37Rv
ccaccccgagcucaccaa

SEQ ID NO: 1339396 - RNA, 19 nt, Mycobacterium tuberculosis H37Rv
ccacccgcaccaccggccc

SEQ ID NO: 1339397 - RNA, 18 nt, Mycobacterium tuberculosis H37Rv
ccacccgauuggccaacc

SEQ ID NO: 1339398 - RNA, 15 nt, Mycobacterium tuberculosis H37Rv
ccacccgagcacuga

SEQ ID NO: 1339399 - RNA, 14 nt, Mycobacterium tuberculosis H37Rv
ccacccgccgcagc

SEQ ID NO: 1339400 - RNA, 23 nt, Mycobacterium tuberculosis H37Rv
ccacccgcggcgccguugccgcc

SEQ ID NO: 1339401 - RNA, 21 nt, Mycobacterium tuberculosis H37Rv
ccacccgcgccgccagcgccg

SEQ ID NO: 1339402 - RNA, 15 nt, Mycobacterium tuberculosis H37Rv
ccacccgcgccgccc

SEQ ID NO: 1339403 - RNA, 21 nt, Mycobacterium tuberculosis H37Rv
ccaccaaacgcugcuggcaug

SEQ ID NO: 1339404 - RNA, 20 nt, Mycobacterium tuberculosis H37Rv
ccaccaacgagucagugcca

SEQ ID NO: 1339405 - RNA, 13 nt, Mycobacterium tuberculosis H37Rv
ccaccaacacccg

SEQ ID NO: 1339406 - RNA, 20 nt, Mycobacterium tuberculosis H37Rv
ccaccaagguguggccuugc

SEQ ID NO: 1339407 - RNA, 14 nt, Mycobacterium tuberculosis H37Rv
ccaccaagcucgca

SEQ ID NO: 1339408 - RNA, 15 nt, Mycobacterium tuberculosis H37Rv
ccaccacacagccgc

SEQ ID NO: 1339409 - RNA, 23 nt, Mycobacterium tuberculosis H37Rv
ccaccacaacgccaggaacccgu

SEQ ID NO: 1339410 - RNA, 12 nt, Mycobacterium tuberculosis H37Rv
ccaccacacagc

SEQ ID NO: 1339411 - RNA, 12 nt, Mycobacterium tuberculosis H37Rv
ccaccagcgccu

SEQ ID NO: 1339412 - RNA, 18 nt, Mycobacterium tuberculosis H37Rv
ccaccagcgcccggcccg

SEQ ID NO: 1339413 - RNA, 15 nt, Mycobacterium tuberculosis H37Rv
ccaccagcgcuccag

SEQ ID NO: 1339414 - RNA, 16 nt, Mycobacterium tuberculosis H37Rv
ccaccagcggcggccc

SEQ ID NO: 1339415 - RNA, 18 nt, Mycobacterium tuberculosis H37Rv
ccaccaggacguggucgg

SEQ ID NO: 1339416 - RNA, 16 nt, Mycobacterium tuberculosis H37Rv
ccaccagcgccuugac

SEQ ID NO: 1339417 - RNA, 19 nt, Mycobacterium tuberculosis H37Rv
ccacccacauggcggcccg

SEQ ID NO: 1339418 - RNA, 13 nt, Mycobacterium tuberculosis H37Rv
ccacccaccacag

SEQ ID NO: 1339419 - RNA, 13 nt, Mycobacterium tuberculosis H37Rv
ccacccaccgaca

SEQ ID NO: 1339420 - RNA, 16 nt, Mycobacterium tuberculosis H37Rv
ccacccagaugcagcg

SEQ ID NO: 1339421 - RNA, 12 nt, Mycobacterium tuberculosis H37Rv
ccacccaggccg

SEQ ID NO: 1339422 - RNA, 14 nt, Mycobacterium tuberculosis H37Rv
ccaccccacccagc

SEQ ID NO: 1339423 - RNA, 20 nt, Mycobacterium tuberculosis H37Rv
ccaaugcccuuggccagcag

SEQ ID NO: 1339424 - RNA, 15 nt, Mycobacterium tuberculosis H37Rv
ccaaugcccaggugu

SEQ ID NO: 1339425 - RNA, 19 nt, Mycobacterium tuberculosis H37Rv
ccaaugcccuuggccagca

SEQ ID NO: 1339426 - RNA, 15 nt, Mycobacterium tuberculosis H37Rv
ccaaguacugggcca

SEQ ID NO: 1339427 - RNA, 13 nt, Mycobacterium tuberculosis H37Rv
ccacaacgccucg

SEQ ID NO: 1339428 - RNA, 17 nt, Mycobacterium tuberculosis H37Rv
ccacaaccgaauccauc

SEQ ID NO: 1339429 - RNA, 17 nt, Mycobacterium tuberculosis H37Rv
ccacaaggguuggccga

SEQ ID NO: 1339430 - RNA, 21 nt, Mycobacterium tuberculosis H37Rv
ccacauuggcgaucagcagcc

SEQ ID NO: 1339431 - RNA, 18 nt, Mycobacterium tuberculosis H37Rv
ccacauuccgcagucccg

SEQ ID NO: 1339432 - RNA, 21 nt, Mycobacterium tuberculosis H37Rv
ccacaugaucgagcaguucca

SEQ ID NO: 1339433 - RNA, 19 nt, Mycobacterium tuberculosis H37Rv
ccacaugggagccguucgg

SEQ ID NO: 1339434 - RNA, 17 nt, Mycobacterium tuberculosis H37Rv
ccacaugguacggacgc

SEQ ID NO: 1339435 - RNA, 19 nt, Mycobacterium tuberculosis H37Rv
ccacaucgccagcagcaaa

SEQ ID NO: 1339436 - RNA, 15 nt, Mycobacterium tuberculosis H37Rv
ccacaucaugccagc

SEQ ID NO: 1339437 - RNA, 16 nt, Mycobacterium tuberculosis H37Rv
ccacaucaugccagcc

SEQ ID NO: 1339438 - RNA, 19 nt, Mycobacterium tuberculosis H37Rv
ccacaucagccgcaccagu

SEQ ID NO: 1339439 - RNA, 16 nt, Mycobacterium tuberculosis H37Rv
ccacaccgaccgcggg

SEQ ID NO: 1339440 - RNA, 22 nt, Mycobacterium tuberculosis H37Rv
ccacaccuaccguacgcagcgu

SEQ ID NO: 1339441 - RNA, 16 nt, Mycobacterium tuberculosis H37Rv
ccacaccugcggcugc

SEQ ID NO: 1339442 - RNA, 14 nt, Mycobacterium tuberculosis H37Rv
ccacacuggcagug

SEQ ID NO: 1339443 - RNA, 20 nt, Mycobacterium tuberculosis H37Rv
ccacacgcccucgacgccgc

SEQ ID NO: 1339444 - RNA, 11 nt, Mycobacterium tuberculosis H37Rv
ccacacgcugc

SEQ ID NO: 1339445 - RNA, 20 nt, Mycobacterium tuberculosis H37Rv
ccacacggggccgccagcug

SEQ ID NO: 1339446 - RNA, 23 nt, Mycobacterium tuberculosis H37Rv
ccacagugccaauuccagccccc

SEQ ID NO: 1339447 - RNA, 17 nt, Mycobacterium tuberculosis H37Rv
ccacauacgcggcggcc

SEQ ID NO: 1339448 - RNA, 15 nt, Mycobacterium tuberculosis H37Rv
ccacagguuugcgcc

SEQ ID NO: 1339449 - RNA, 22 nt, Mycobacterium tuberculosis H37Rv
ccacagugaaauccgagccgcg

SEQ ID NO: 1339450 - RNA, 17 nt, Mycobacterium tuberculosis H37Rv
ccacagucgucgagcgc

SEQ ID NO: 1339451 - RNA, 17 nt, Mycobacterium tuberculosis H37Rv
ccacgccagcucgccgg

SEQ ID NO: 1339452 - RNA, 12 nt, Mycobacterium tuberculosis H37Rv
ccacugcccgcc

SEQ ID NO: 1339453 - RNA, 15 nt, Mycobacterium tuberculosis H37Rv
ccacugccacuccug

SEQ ID NO: 1339454 - RNA, 21 nt, Mycobacterium tuberculosis H37Rv
ccacugccgcgcgcccgccuc

SEQ ID NO: 1339455 - RNA, 14 nt, Mycobacterium tuberculosis H37Rv
ccacugccggcagc

SEQ ID NO: 1339456 - RNA, 20 nt, Mycobacterium tuberculosis H37Rv
ccacugccgugccggugugu

SEQ ID NO: 1339457 - RNA, 21 nt, Mycobacterium tuberculosis H37Rv
ccacugccgugccgguguguc

SEQ ID NO: 1339458 - RNA, 20 nt, Mycobacterium tuberculosis H37Rv
ccacugcccgccgacgccag

SEQ ID NO: 1339459 - RNA, 16 nt, Mycobacterium tuberculosis H37Rv
ccacugccgcgcgccc

SEQ ID NO: 1339460 - RNA, 22 nt, Mycobacterium tuberculosis H37Rv
ccacgcaugggccaggucagcc

SEQ ID NO: 1339461 - RNA, 22 nt, Mycobacterium tuberculosis H37Rv
ccacgcacucgucgggguugau

SEQ ID NO: 1339462 - RNA, 22 nt, Mycobacterium tuberculosis H37Rv
ccacgccacguccaacucggcc

SEQ ID NO: 1339463 - RNA, 15 nt, Mycobacterium tuberculosis H37Rv
ccacgccacguccaa

SEQ ID NO: 1339464 - RNA, 13 nt, Mycobacterium tuberculosis H37Rv
ccacugcgcgucg

SEQ ID NO: 1339465 - RNA, 18 nt, Mycobacterium tuberculosis H37Rv
ccacugcuuccggaacaa

SEQ ID NO: 1339466 - RNA, 18 nt, Mycobacterium tuberculosis H37Rv
ccacugcgccgugaccca

SEQ ID NO: 1339467 - RNA, 12 nt, Mycobacterium tuberculosis H37Rv
ccacuggauggc

SEQ ID NO: 1339468 - RNA, 15 nt, Mycobacterium tuberculosis H37Rv
ccacuggaccaccgc

SEQ ID NO: 1339469 - RNA, 21 nt, Mycobacterium tuberculosis H37Rv
ccacuggacccgcccaggcgu

SEQ ID NO: 1339470 - RNA, 21 nt, Mycobacterium tuberculosis H37Rv
ccacuggcgccggugccgccg

SEQ ID NO: 1339471 - RNA, 18 nt, Mycobacterium tuberculosis H37Rv
ccacuguagggccgguga

SEQ ID NO: 1339472 - RNA, 14 nt, Mycobacterium tuberculosis H37Rv
ccacuggugcagcg

SEQ ID NO: 1339473 - RNA, 18 nt, Mycobacterium tuberculosis H37Rv
ccacuguugaagaagccc

SEQ ID NO: 1339474 - RNA, 17 nt, Mycobacterium tuberculosis H37Rv
ccacuucggcgccgcgc

SEQ ID NO: 1339475 - RNA, 13 nt, Mycobacterium tuberculosis H37Rv
ccacuucuucacu

SEQ ID NO: 1339476 - RNA, 18 nt, Mycobacterium tuberculosis H37Rv
ccacuucuucacuggcga

SEQ ID NO: 1339477 - RNA, 17 nt, Mycobacterium tuberculosis H37Rv
ccacuugugacccggcg

SEQ ID NO: 1339478 - RNA, 18 nt, Mycobacterium tuberculosis H37Rv
ccagaagucgucauauuc

SEQ ID NO: 1339479 - RNA, 18 nt, Mycobacterium tuberculosis H37Rv
ccagaaggccgcaccgcc

SEQ ID NO: 1339480 - RNA, 22 nt, Mycobacterium tuberculosis H37Rv
ccagaaggccgcaccgccaccc

SEQ ID NO: 1339481 - RNA, 19 nt, Mycobacterium tuberculosis H37Rv
ccagacacaaccgcuuuga

SEQ ID NO: 1339482 - RNA, 15 nt, Mycobacterium tuberculosis H37Rv
ccagacacaaccgcu

SEQ ID NO: 1339483 - RNA, 21 nt, Mycobacterium tuberculosis H37Rv
ccagaaucucgccgggcugca

SEQ ID NO: 1339484 - RNA, 15 nt, Mycobacterium tuberculosis H37Rv
ccagaauccaggugg

SEQ ID NO: 1339485 - RNA, 19 nt, Mycobacterium tuberculosis H37Rv
ccagaacggcgaucaccga

SEQ ID NO: 1339486 - RNA, 22 nt, Mycobacterium tuberculosis H37Rv
ccagaacgguggcgcggugccg

SEQ ID NO: 1339487 - RNA, 15 nt, Mycobacterium tuberculosis H37Rv
ccagaacgacgccgc

SEQ ID NO: 1339488 - RNA, 18 nt, Mycobacterium tuberculosis H37Rv
ccagaaaugguucgcaca

SEQ ID NO: 1339489 - RNA, 21 nt, Mycobacterium tuberculosis H37Rv
ccagaaaugguucgcacaccu

SEQ ID NO: 1339490 - RNA, 22 nt, Mycobacterium tuberculosis H37Rv
ccagaaaacauugcggcccucg

SEQ ID NO: 1339491 - RNA, 14 nt, Mycobacterium tuberculosis H37Rv
ccagaaaaccgccg

SEQ ID NO: 1339492 - RNA, 21 nt, Mycobacterium tuberculosis H37Rv
ccacuuuucgguggcggcagc

SEQ ID NO: 1339493 - RNA, 13 nt, Mycobacterium tuberculosis H37Rv
ccagaugcaggcu

SEQ ID NO: 1339494 - RNA, 14 nt, Mycobacterium tuberculosis H37Rv
ccagaugcagcggu

SEQ ID NO: 1339495 - RNA, 12 nt, Mycobacterium tuberculosis H37Rv
ccagaugcacgu

SEQ ID NO: 1339496 - RNA, 21 nt, Mycobacterium tuberculosis H37Rv
ccagaugccgguaacgaacag

SEQ ID NO: 1339497 - RNA, 14 nt, Mycobacterium tuberculosis H37Rv
ccagaugcccagca

SEQ ID NO: 1339498 - RNA, 16 nt, Mycobacterium tuberculosis H37Rv
ccagaugcccagcagg

SEQ ID NO: 1339499 - RNA, 13 nt, Mycobacterium tuberculosis H37Rv
ccagaucggcggg

SEQ ID NO: 1339500 - RNA, 22 nt, Mycobacterium tuberculosis H37Rv
ccagaucgguugaucggccacg

SEQ ID NO: 1339501 - RNA, 17 nt, Mycobacterium tuberculosis H37Rv
ccagaucuugcagugcg

SEQ ID NO: 1339502 - RNA, 17 nt, Mycobacterium tuberculosis H37Rv
ccagauggcucucggug

SEQ ID NO: 1339503 - RNA, 15 nt, Mycobacterium tuberculosis H37Rv
ccagauucgccgccc

SEQ ID NO: 1339504 - RNA, 22 nt, Mycobacterium tuberculosis H37Rv
ccagauugaggcuggucugcag

SEQ ID NO: 1339505 - RNA, 16 nt, Mycobacterium tuberculosis H37Rv
ccagaguucggccagc

SEQ ID NO: 1339506 - RNA, 16 nt, Mycobacterium tuberculosis H37Rv
ccagaguucccgaaac

SEQ ID NO: 1339507 - RNA, 12 nt, Mycobacterium tuberculosis H37Rv
ccagaguggugg

SEQ ID NO: 1339508 - RNA, 13 nt, Mycobacterium tuberculosis H37Rv
ccagagucggaga

SEQ ID NO: 1339509 - RNA, 13 nt, Mycobacterium tuberculosis H37Rv
ccagaucagcacc

SEQ ID NO: 1339510 - RNA, 18 nt, Mycobacterium tuberculosis H37Rv
ccagauaucguacuggcu

SEQ ID NO: 1339511 - RNA, 19 nt, Mycobacterium tuberculosis H37Rv
ccagauaucguacuggcua

SEQ ID NO: 1339512 - RNA, 19 nt, Mycobacterium tuberculosis H37Rv
ccagauagagcuggugcag

SEQ ID NO: 1339513 - RNA, 17 nt, Mycobacterium tuberculosis H37Rv
ccagaucgcacaccaac

SEQ ID NO: 1339514 - RNA, 18 nt, Mycobacterium tuberculosis H37Rv
ccagaucgaagcgcagca

SEQ ID NO: 1339515 - RNA, 16 nt, Mycobacterium tuberculosis H37Rv
ccagaucgcacaccaa

SEQ ID NO: 1339516 - RNA, 18 nt, Mycobacterium tuberculosis H37Rv
ccagaucgaacgcagcca

SEQ ID NO: 1339517 - RNA, 14 nt, Mycobacterium tuberculosis H37Rv
ccagauccacgccg

SEQ ID NO: 1339518 - RNA, 19 nt, Mycobacterium tuberculosis H37Rv
ccagacgccacugccagcc

SEQ ID NO: 1339519 - RNA, 19 nt, Mycobacterium tuberculosis H37Rv
ccagacgauggccagguug

SEQ ID NO: 1339520 - RNA, 12 nt, Mycobacterium tuberculosis H37Rv
ccagaccgccga

SEQ ID NO: 1339521 - RNA, 14 nt, Mycobacterium tuberculosis H37Rv
ccagacccagcucg

SEQ ID NO: 1339522 - RNA, 15 nt, Mycobacterium tuberculosis H37Rv
ccagacccagcucgu

SEQ ID NO: 1339523 - RNA, 14 nt, Mycobacterium tuberculosis H37Rv
ccagacccaccacc

SEQ ID NO: 1339524 - RNA, 14 nt, Mycobacterium tuberculosis H37Rv
ccagaccagggcag

SEQ ID NO: 1339525 - RNA, 13 nt, Mycobacterium tuberculosis H37Rv
ccagagccgcgcg

SEQ ID NO: 1339526 - RNA, 13 nt, Mycobacterium tuberculosis H37Rv
ccagagccgcccu

SEQ ID NO: 1339527 - RNA, 13 nt, Mycobacterium tuberculosis H37Rv
ccagagcagcuca

SEQ ID NO: 1339528 - RNA, 21 nt, Mycobacterium tuberculosis H37Rv
ccagaggcgcuucgccacacc

SEQ ID NO: 1339529 - RNA, 17 nt, Mycobacterium tuberculosis H37Rv
ccagagcuucgccgcgc

SEQ ID NO: 1339530 - RNA, 16 nt, Mycobacterium tuberculosis H37Rv
ccagagucggagaccc

SEQ ID NO: 1339531 - RNA, 15 nt, Mycobacterium tuberculosis H37Rv
ccagaggcccgcggu

SEQ ID NO: 1339532 - RNA, 18 nt, Mycobacterium tuberculosis H37Rv
ccagacggugcagcuccc

SEQ ID NO: 1339533 - RNA, 16 nt, Mycobacterium tuberculosis H37Rv
ccagacgcucuugaau

SEQ ID NO: 1339534 - RNA, 19 nt, Mycobacterium tuberculosis H37Rv
ccagagaaaucgguggugc

SEQ ID NO: 1339535 - RNA, 16 nt, Mycobacterium tuberculosis H37Rv
ccagcagcaaccgcca

SEQ ID NO: 1339536 - RNA, 16 nt, Mycobacterium tuberculosis H37Rv
ccagcagccagcccag

SEQ ID NO: 1339537 - RNA, 23 nt, Mycobacterium tuberculosis H37Rv
ccagcagccacccgacaacgcug

SEQ ID NO: 1339538 - RNA, 14 nt, Mycobacterium tuberculosis H37Rv
ccagcagcaggcca

SEQ ID NO: 1339539 - RNA, 19 nt, Mycobacterium tuberculosis H37Rv
ccagcagcgacuccagcgc

SEQ ID NO: 1339540 - RNA, 14 nt, Mycobacterium tuberculosis H37Rv
ccagcagccaggag

SEQ ID NO: 1339541 - RNA, 18 nt, Mycobacterium tuberculosis H37Rv
ccagcagcgcgggaucug

SEQ ID NO: 1339542 - RNA, 14 nt, Mycobacterium tuberculosis H37Rv
ccagcagcugcucc

SEQ ID NO: 1339543 - RNA, 19 nt, Mycobacterium tuberculosis H37Rv
ccagcagaucagguccuag

SEQ ID NO: 1339544 - RNA, 17 nt, Mycobacterium tuberculosis H37Rv
ccagcagauccaggcgu

SEQ ID NO: 1339545 - RNA, 20 nt, Mycobacterium tuberculosis H37Rv
ccagcacuccaccgcuggcc

SEQ ID NO: 1339546 - RNA, 14 nt, Mycobacterium tuberculosis H37Rv
ccagcacgcccucg

SEQ ID NO: 1339547 - RNA, 14 nt, Mycobacterium tuberculosis H37Rv
ccagcacgccgccg

SEQ ID NO: 1339548 - RNA, 20 nt, Mycobacterium tuberculosis H37Rv
ccagcacccuguuccagcgg

SEQ ID NO: 1339549 - RNA, 16 nt, Mycobacterium tuberculosis H37Rv
ccagcacccggcuucg

SEQ ID NO: 1339550 - RNA, 16 nt, Mycobacterium tuberculosis H37Rv
ccagcaccccgagguc

SEQ ID NO: 1339551 - RNA, 23 nt, Mycobacterium tuberculosis H37Rv
ccagcaccgccgcugccaucugg

SEQ ID NO: 1339552 - RNA, 21 nt, Mycobacterium tuberculosis H37Rv
ccagcaccgccgcgccggcgg

SEQ ID NO: 1339553 - RNA, 23 nt, Mycobacterium tuberculosis H37Rv
ccagcaccucggccagcuccgcc

SEQ ID NO: 1339554 - RNA, 17 nt, Mycobacterium tuberculosis H37Rv
ccagcaccucgaccgcc

SEQ ID NO: 1339555 - RNA, 15 nt, Mycobacterium tuberculosis H37Rv
ccagcaaggccagca

SEQ ID NO: 1339556 - RNA, 16 nt, Mycobacterium tuberculosis H37Rv
ccagcaaggcccgaaa

SEQ ID NO: 1339557 - RNA, 19 nt, Mycobacterium tuberculosis H37Rv
ccagcaccacggcgcgcgc

SEQ ID NO: 1339558 - RNA, 15 nt, Mycobacterium tuberculosis H37Rv
ccagcaccaccggcu

SEQ ID NO: 1339559 - RNA, 16 nt, Mycobacterium tuberculosis H37Rv
ccagcaaaugcggcgc

SEQ ID NO: 1339560 - RNA, 21 nt, Mycobacterium tuberculosis H37Rv
ccagcaaaggggugugugcug

SEQ ID NO: 1339561 - RNA, 19 nt, Mycobacterium tuberculosis H37Rv
ccagauuuaggagcuuuug

SEQ ID NO: 1339562 - RNA, 14 nt, Mycobacterium tuberculosis H37Rv
ccagcaacaccaga

SEQ ID NO: 1339563 - RNA, 16 nt, Mycobacterium tuberculosis H37Rv
ccagcaagacgaugac

SEQ ID NO: 1339564 - RNA, 14 nt, Mycobacterium tuberculosis H37Rv
ccagccaccgaccc

SEQ ID NO: 1339565 - RNA, 16 nt, Mycobacterium tuberculosis H37Rv
ccagccacagcccggc

SEQ ID NO: 1339566 - RNA, 14 nt, Mycobacterium tuberculosis H37Rv
ccagccagaugccg

SEQ ID NO: 1339567 - RNA, 14 nt, Mycobacterium tuberculosis H37Rv
ccagccagccgccc

SEQ ID NO: 1339568 - RNA, 20 nt, Mycobacterium tuberculosis H37Rv
ccagccagcagcggcgagcc

SEQ ID NO: 1339569 - RNA, 13 nt, Mycobacterium tuberculosis H37Rv
ccagccagcgggc

SEQ ID NO: 1339570 - RNA, 16 nt, Mycobacterium tuberculosis H37Rv
ccagccagcgggcgau

SEQ ID NO: 1339571 - RNA, 21 nt, Mycobacterium tuberculosis H37Rv
ccagccaggugauuaccuggu

SEQ ID NO: 1339572 - RNA, 18 nt, Mycobacterium tuberculosis H37Rv
ccagccauggcagcgccg

SEQ ID NO: 1339573 - RNA, 17 nt, Mycobacterium tuberculosis H37Rv
ccagccccgacugacag

SEQ ID NO: 1339574 - RNA, 20 nt, Mycobacterium tuberculosis H37Rv
ccagccccgcgcccaccccg

SEQ ID NO: 1339575 - RNA, 16 nt, Mycobacterium tuberculosis H37Rv
ccagccccaucgcugg

SEQ ID NO: 1339576 - RNA, 20 nt, Mycobacterium tuberculosis H37Rv
ccagccccaucgcuggucga

SEQ ID NO: 1339577 - RNA, 14 nt, Mycobacterium tuberculosis H37Rv
ccagcccgagcaga

SEQ ID NO: 1339578 - RNA, 21 nt, Mycobacterium tuberculosis H37Rv
ccagcccgaugaucccgccac

SEQ ID NO: 1339579 - RNA, 12 nt, Mycobacterium tuberculosis H37Rv
ccagcccgccga

SEQ ID NO: 1339580 - RNA, 14 nt, Mycobacterium tuberculosis H37Rv
ccagccccacccgc

SEQ ID NO: 1339581 - RNA, 19 nt, Mycobacterium tuberculosis H37Rv
ccagcccaacucggccagc

SEQ ID NO: 1339582 - RNA, 13 nt, Mycobacterium tuberculosis H37Rv
ccagcccagccgg

SEQ ID NO: 1339583 - RNA, 13 nt, Mycobacterium tuberculosis H37Rv
ccagcccagcggc

SEQ ID NO: 1339584 - RNA, 15 nt, Mycobacterium tuberculosis H37Rv
ccagcccgccgucgg

SEQ ID NO: 1339585 - RNA, 20 nt, Mycobacterium tuberculosis H37Rv
ccagcccgcccgguguguuc

SEQ ID NO: 1339586 - RNA, 13 nt, Mycobacterium tuberculosis H37Rv
ccagcccggccgc

SEQ ID NO: 1339587 - RNA, 24 nt, Mycobacterium tuberculosis H37Rv
ccagcccguccggcccccgaggcu

SEQ ID NO: 1339588 - RNA, 16 nt, Mycobacterium tuberculosis H37Rv
ccagccgcaucgggca

SEQ ID NO: 1339589 - RNA, 16 nt, Mycobacterium tuberculosis H37Rv
ccagccgagcggcggc

SEQ ID NO: 1339590 - RNA, 16 nt, Mycobacterium tuberculosis H37Rv
ccagccgacgccuucc

SEQ ID NO: 1339591 - RNA, 23 nt, Mycobacterium tuberculosis H37Rv
ccagcaugacaccggccaccagc

SEQ ID NO: 1339592 - RNA, 16 nt, Mycobacterium tuberculosis H37Rv
ccagcaugaagucccg

SEQ ID NO: 1339593 - RNA, 19 nt, Mycobacterium tuberculosis H37Rv
ccagcauucucgccgacgg

SEQ ID NO: 1339594 - RNA, 17 nt, Mycobacterium tuberculosis H37Rv
ccagcauugaagaagcc

SEQ ID NO: 1339595 - RNA, 22 nt, Mycobacterium tuberculosis H37Rv
ccagcauggggucagcucgcca

SEQ ID NO: 1339596 - RNA, 14 nt, Mycobacterium tuberculosis H37Rv
ccagcauugacccg

SEQ ID NO: 1339597 - RNA, 15 nt, Mycobacterium tuberculosis H37Rv
ccagcaugcccgcca

SEQ ID NO: 1339598 - RNA, 14 nt, Mycobacterium tuberculosis H37Rv
ccagcagggccaga

SEQ ID NO: 1339599 - RNA, 12 nt, Mycobacterium tuberculosis H37Rv
ccagcagggugu

SEQ ID NO: 1339600 - RNA, 18 nt, Mycobacterium tuberculosis H37Rv
ccagcaggguuccccaua

SEQ ID NO: 1339601 - RNA, 19 nt, Mycobacterium tuberculosis H37Rv
ccagcaggcccuggccacc

SEQ ID NO: 1339602 - RNA, 23 nt, Mycobacterium tuberculosis H37Rv
ccagcaggaugaugaccgccauc

SEQ ID NO: 1339603 - RNA, 21 nt, Mycobacterium tuberculosis H37Rv
ccagcaggcccuggccaccca

SEQ ID NO: 1339604 - RNA, 16 nt, Mycobacterium tuberculosis H37Rv
ccagcaggccgaagaa

SEQ ID NO: 1339605 - RNA, 21 nt, Mycobacterium tuberculosis H37Rv
ccagcagguuggucaccaccu

SEQ ID NO: 1339606 - RNA, 17 nt, Mycobacterium tuberculosis H37Rv
ccagcaguacaccgccc

SEQ ID NO: 1339607 - RNA, 19 nt, Mycobacterium tuberculosis H37Rv
ccagcaguacaccgcccgg

SEQ ID NO: 1339608 - RNA, 16 nt, Mycobacterium tuberculosis H37Rv
ccagcaguacaccgcc

SEQ ID NO: 1339609 - RNA, 16 nt, Mycobacterium tuberculosis H37Rv
ccagcagguccgcggc

SEQ ID NO: 1339610 - RNA, 20 nt, Mycobacterium tuberculosis H37Rv
ccagcagguccgcggccgcg

SEQ ID NO: 1339611 - RNA, 21 nt, Mycobacterium tuberculosis H37Rv
ccagcagguccgcggccgcgg

SEQ ID NO: 1339612 - RNA, 20 nt, Mycobacterium tuberculosis H37Rv
ccagcaggucgucggcgucg

SEQ ID NO: 1339613 - RNA, 16 nt, Mycobacterium tuberculosis H37Rv
cagcucggccagugcc

SEQ ID NO: 1339614 - RNA, 15 nt, Mycobacterium tuberculosis H37Rv
cagcucgcgcucgcu

SEQ ID NO: 1339615 - RNA, 19 nt, Mycobacterium tuberculosis H37Rv
cagcucgcgcacccagccc

SEQ ID NO: 1339616 - RNA, 16 nt, Mycobacterium tuberculosis H37Rv
cagcucgcgcacccag

SEQ ID NO: 1339617 - RNA, 18 nt, Mycobacterium tuberculosis H37Rv
cagcucgcgcacccagcc

SEQ ID NO: 1339618 - RNA, 14 nt, Mycobacterium tuberculosis H37Rv
cagcucgccgugac

SEQ ID NO: 1339619 - RNA, 17 nt, Mycobacterium tuberculosis H37Rv
cagcucgaacagcucga

SEQ ID NO: 1339620 - RNA, 16 nt, Mycobacterium tuberculosis H37Rv
cagcucgcacucguug

SEQ ID NO: 1339621 - RNA, 15 nt, Mycobacterium tuberculosis H37Rv
cagcucgccagccug

SEQ ID NO: 1339622 - RNA, 18 nt, Mycobacterium tuberculosis H37Rv
cagcuccucagccaccgc

SEQ ID NO: 1339623 - RNA, 21 nt, Mycobacterium tuberculosis H37Rv
cagcuccuguaacugcuccug

SEQ ID NO: 1339624 - RNA, 21 nt, Mycobacterium tuberculosis H37Rv
cagcuccuuggcuaacaccgc

SEQ ID NO: 1339625 - RNA, 17 nt, Mycobacterium tuberculosis H37Rv
cagcuccagcgccgcgg

SEQ ID NO: 1339626 - RNA, 13 nt, Mycobacterium tuberculosis H37Rv
cagcuccgccugc

SEQ ID NO: 1339627 - RNA, 22 nt, Mycobacterium tuberculosis H37Rv
cagcucccggcuucuugaccac

SEQ ID NO: 1339628 - RNA, 19 nt, Mycobacterium tuberculosis H37Rv
cagcucccgggcggcggcc

SEQ ID NO: 1339629 - RNA, 16 nt, Mycobacterium tuberculosis H37Rv
cagcucccgcgagcgg

SEQ ID NO: 1339630 - RNA, 21 nt, Mycobacterium tuberculosis H37Rv
cagcucccgcggcgccacccg

SEQ ID NO: 1339631 - RNA, 19 nt, Mycobacterium tuberculosis H37Rv
aaaauugcuccaccacuga

SEQ ID NO: 1339632 - RNA, 23 nt, Mycobacterium tuberculosis H37Rv
cagcucaccacccgcacuccaag

SEQ ID NO: 1339633 - RNA, 22 nt, Mycobacterium tuberculosis H37Rv
cagcucagugaugcgccccgga

SEQ ID NO: 1339634 - RNA, 15 nt, Mycobacterium tuberculosis H37Rv
cagcucacgacuggc

SEQ ID NO: 1339635 - RNA, 20 nt, Mycobacterium tuberculosis H37Rv
cagcuaucccaggggcaccg

SEQ ID NO: 1339636 - RNA, 16 nt, Mycobacterium tuberculosis H37Rv
cagcuaugucaccugg

SEQ ID NO: 1339637 - RNA, 17 nt, Mycobacterium tuberculosis H37Rv
cagcuagaccgaucacc

SEQ ID NO: 1339638 - RNA, 18 nt, Mycobacterium tuberculosis H37Rv
cagcgcuucgucggccgg

SEQ ID NO: 1339639 - RNA, 15 nt, Mycobacterium tuberculosis H37Rv
cagcuaacccgccac

SEQ ID NO: 1339640 - RNA, 17 nt, Mycobacterium tuberculosis H37Rv
cagcuaacccgccacgu

SEQ ID NO: 1339641 - RNA, 20 nt, Mycobacterium tuberculosis H37Rv
cagcgcuggcaggccgggca

SEQ ID NO: 1339642 - RNA, 21 nt, Mycobacterium tuberculosis H37Rv
cagcgcugccaccgcgguggc

SEQ ID NO: 1339643 - RNA, 21 nt, Mycobacterium tuberculosis H37Rv
cagcgcgguguucgcggcauc

SEQ ID NO: 1339644 - RNA, 15 nt, Mycobacterium tuberculosis H37Rv
cagcgcugagccgcu

SEQ ID NO: 1339645 - RNA, 12 nt, Mycobacterium tuberculosis H37Rv
cagcgcugccac

SEQ ID NO: 1339646 - RNA, 20 nt, Mycobacterium tuberculosis H37Rv
cagcgcguacuugguggugg

SEQ ID NO: 1339647 - RNA, 15 nt, Mycobacterium tuberculosis H37Rv
cagcugguugugcug

SEQ ID NO: 1339648 - RNA, 16 nt, Mycobacterium tuberculosis H37Rv
cagcugguugugcugg

SEQ ID NO: 1339649 - RNA, 22 nt, Mycobacterium tuberculosis H37Rv
cagcugugaacaggccgaggcg

SEQ ID NO: 1339650 - RNA, 16 nt, Mycobacterium tuberculosis H37Rv
cagcuguucgagccgc

SEQ ID NO: 1339651 - RNA, 22 nt, Mycobacterium tuberculosis H37Rv
cagcuguucggccaacccgggc

SEQ ID NO: 1339652 - RNA, 14 nt, Mycobacterium tuberculosis H37Rv
cagcuugcgcagcc

SEQ ID NO: 1339653 - RNA, 16 nt, Mycobacterium tuberculosis H37Rv
cagcuuugacgcccuc

SEQ ID NO: 1339654 - RNA, 15 nt, Mycobacterium tuberculosis H37Rv
cagcuuugagucccg

SEQ ID NO: 1339655 - RNA, 18 nt, Mycobacterium tuberculosis H37Rv
caggaaaaagggcuucca

SEQ ID NO: 1339656 - RNA, 20 nt, Mycobacterium tuberculosis H37Rv
cagcuugcggagccgccgcu

SEQ ID NO: 1339657 - RNA, 17 nt, Mycobacterium tuberculosis H37Rv
cagcuugcugcgcacca

SEQ ID NO: 1339658 - RNA, 22 nt, Mycobacterium tuberculosis H37Rv
cagcuugcccgagcccagccgg

SEQ ID NO: 1339659 - RNA, 23 nt, Mycobacterium tuberculosis H37Rv
caggacuggcaccgccagccacc

SEQ ID NO: 1339660 - RNA, 14 nt, Mycobacterium tuberculosis H37Rv
caggacgugucggu

SEQ ID NO: 1339661 - RNA, 23 nt, Mycobacterium tuberculosis H37Rv
caggacgugucgguacugacagu

SEQ ID NO: 1339662 - RNA, 23 nt, Mycobacterium tuberculosis H37Rv
caggacggugaucuugccggcca

SEQ ID NO: 1339663 - RNA, 18 nt, Mycobacterium tuberculosis H37Rv
caggacgcccacaugcuc

SEQ ID NO: 1339664 - RNA, 21 nt, Mycobacterium tuberculosis H37Rv
caggagauccaccgguccagg

SEQ ID NO: 1339665 - RNA, 19 nt, Mycobacterium tuberculosis H37Rv
caggagacgguacgccagu

SEQ ID NO: 1339666 - RNA, 21 nt, Mycobacterium tuberculosis H37Rv
caggauaccgaaaucaccuca

SEQ ID NO: 1339667 - RNA, 20 nt, Mycobacterium tuberculosis H37Rv
caggagcgccgucaucgcag

SEQ ID NO: 1339668 - RNA, 22 nt, Mycobacterium tuberculosis H37Rv
caggaacacucgcgaauaaccu

SEQ ID NO: 1339669 - RNA, 20 nt, Mycobacterium tuberculosis H37Rv
caggaaccacccaccggcca

SEQ ID NO: 1339670 - RNA, 21 nt, Mycobacterium tuberculosis H37Rv
caggcugcggauacuguucug

SEQ ID NO: 1339671 - RNA, 22 nt, Mycobacterium tuberculosis H37Rv
caggcugcggcuuggccaucac

SEQ ID NO: 1339672 - RNA, 19 nt, Mycobacterium tuberculosis H37Rv
caggcugccuccggaaggc

SEQ ID NO: 1339673 - RNA, 23 nt, Mycobacterium tuberculosis H37Rv
caggcucgagguguagcccuccg

SEQ ID NO: 1339674 - RNA, 15 nt, Mycobacterium tuberculosis H37Rv
caggcucgcaccgug

SEQ ID NO: 1339675 - RNA, 11 nt, Mycobacterium tuberculosis H37Rv
caggcucgccg

SEQ ID NO: 1339676 - RNA, 16 nt, Mycobacterium tuberculosis H37Rv
caggcucgccgaugcu

SEQ ID NO: 1339677 - RNA, 15 nt, Mycobacterium tuberculosis H37Rv
caggcugucgcgggc

SEQ ID NO: 1339678 - RNA, 15 nt, Mycobacterium tuberculosis H37Rv
caggcuuagcuuccg

SEQ ID NO: 1339679 - RNA, 18 nt, Mycobacterium tuberculosis H37Rv
caggcuuccagccacagc

SEQ ID NO: 1339680 - RNA, 16 nt, Mycobacterium tuberculosis H37Rv
caggcuugacugcaca

SEQ ID NO: 1339681 - RNA, 15 nt, Mycobacterium tuberculosis H37Rv
caggcuugacugcac

SEQ ID NO: 1339682 - RNA, 19 nt, Mycobacterium tuberculosis H37Rv
cagggaagccugcgggccg

SEQ ID NO: 1339683 - RNA, 14 nt, Mycobacterium tuberculosis H37Rv
caggcgcagcuggg

SEQ ID NO: 1339684 - RNA, 14 nt, Mycobacterium tuberculosis H37Rv
caggcgcauagggc

SEQ ID NO: 1339685 - RNA, 14 nt, Mycobacterium tuberculosis H37Rv
caggcguccaucag

SEQ ID NO: 1339686 - RNA, 16 nt, Mycobacterium tuberculosis H37Rv
caggcggugacguggu

SEQ ID NO: 1339687 - RNA, 14 nt, Mycobacterium tuberculosis H37Rv
caggcgucccagcc

SEQ ID NO: 1339688 - RNA, 16 nt, Mycobacterium tuberculosis H37Rv
caggcguccaucagag

SEQ ID NO: 1339689 - RNA, 22 nt, Mycobacterium tuberculosis H37Rv
caggcucacacucggccgggcu

SEQ ID NO: 1339690 - RNA, 18 nt, Mycobacterium tuberculosis H37Rv
caggcucauccgccgggc

SEQ ID NO: 1339691 - RNA, 23 nt, Mycobacterium tuberculosis H37Rv
caggcucauccgccgggccaggc

SEQ ID NO: 1339692 - RNA, 17 nt, Mycobacterium tuberculosis H37Rv
cagggccacuggccggu

SEQ ID NO: 1339693 - RNA, 14 nt, Mycobacterium tuberculosis H37Rv
cagggccagcggca

SEQ ID NO: 1339694 - RNA, 18 nt, Mycobacterium tuberculosis H37Rv
cagggccaccaccacggc

SEQ ID NO: 1339695 - RNA, 20 nt, Mycobacterium tuberculosis H37Rv
cagggccaccaccacggcca

SEQ ID NO: 1339696 - RNA, 12 nt, Mycobacterium tuberculosis H37Rv
cagggccaccgc

SEQ ID NO: 1339697 - RNA, 16 nt, Mycobacterium tuberculosis H37Rv
cagggccagcggcagc

SEQ ID NO: 1339698 - RNA, 15 nt, Mycobacterium tuberculosis H37Rv
cagggccagcggcag

SEQ ID NO: 1339699 - RNA, 17 nt, Mycobacterium tuberculosis H37Rv
cagggcccuagccggcg

SEQ ID NO: 1339700 - RNA, 17 nt, Mycobacterium tuberculosis H37Rv
cagggcagcggccaggg

SEQ ID NO: 1339701 - RNA, 20 nt, Mycobacterium tuberculosis H37Rv
cagggcagcccggcgaugag

SEQ ID NO: 1339702 - RNA, 12 nt, Mycobacterium tuberculosis H37Rv
cagggcagcggc

SEQ ID NO: 1339703 - RNA, 17 nt, Mycobacterium tuberculosis H37Rv
cagggcaucagcagagc

SEQ ID NO: 1339704 - RNA, 14 nt, Mycobacterium tuberculosis H37Rv
cagggccaccacca

SEQ ID NO: 1339705 - RNA, 23 nt, Mycobacterium tuberculosis H37Rv
cagggccaauuccaugacgggua

SEQ ID NO: 1339706 - RNA, 21 nt, Mycobacterium tuberculosis H37Rv
cagggagccguucaacgugga

SEQ ID NO: 1339707 - RNA, 14 nt, Mycobacterium tuberculosis H37Rv
cagggcagcggcca

SEQ ID NO: 1339708 - RNA, 20 nt, Mycobacterium tuberculosis H37Rv
cagggcacguucggcgcaca

SEQ ID NO: 1339709 - RNA, 18 nt, Mycobacterium tuberculosis H37Rv
cagggacccgagaucacc

SEQ ID NO: 1339710 - RNA, 22 nt, Mycobacterium tuberculosis H37Rv
cagggcggcguuaccaccguca

SEQ ID NO: 1339711 - RNA, 18 nt, Mycobacterium tuberculosis H37Rv
cagggcgucgaacucauc

SEQ ID NO: 1339712 - RNA, 22 nt, Mycobacterium tuberculosis H37Rv
cagggcgucgaccgcggcccgg

SEQ ID NO: 1339713 - RNA, 17 nt, Mycobacterium tuberculosis H37Rv
caggggcagcgcggcca

SEQ ID NO: 1339714 - RNA, 13 nt, Mycobacterium tuberculosis H37Rv
caggggcagcgcg

SEQ ID NO: 1339715 - RNA, 20 nt, Mycobacterium tuberculosis H37Rv
cagggcgguggccacccggc

SEQ ID NO: 1339716 - RNA, 15 nt, Mycobacterium tuberculosis H37Rv
cagggcucggcggcc

SEQ ID NO: 1339717 - RNA, 20 nt, Mycobacterium tuberculosis H37Rv
caggggccagcgcgccacga

SEQ ID NO: 1339718 - RNA, 22 nt, Mycobacterium tuberculosis H37Rv
cagggccucgaccgccagccgc

SEQ ID NO: 1339719 - RNA, 13 nt, Mycobacterium tuberculosis H37Rv
cagggccucaagg

SEQ ID NO: 1339720 - RNA, 15 nt, Mycobacterium tuberculosis H37Rv
cagggccuccacccg

SEQ ID NO: 1339721 - RNA, 23 nt, Mycobacterium tuberculosis H37Rv
cagggcccugcuggcccaacauc

SEQ ID NO: 1339722 - RNA, 16 nt, Mycobacterium tuberculosis H37Rv
cagggccgacgcgaac

SEQ ID NO: 1339723 - RNA, 12 nt, Mycobacterium tuberculosis H37Rv
cagggccgagca

SEQ ID NO: 1339724 - RNA, 15 nt, Mycobacterium tuberculosis H37Rv
cagggcccugcuggc

SEQ ID NO: 1339725 - RNA, 18 nt, Mycobacterium tuberculosis H37Rv
cagggcccugcuggccca

SEQ ID NO: 1339726 - RNA, 18 nt, Mycobacterium tuberculosis H37Rv
caggccgggacagcgccg

SEQ ID NO: 1339727 - RNA, 19 nt, Mycobacterium tuberculosis H37Rv
caggccgggcaccaauacc

SEQ ID NO: 1339728 - RNA, 24 nt, Mycobacterium tuberculosis H37Rv
caggccgggcgcaagcagcccggg

SEQ ID NO: 1339729 - RNA, 21 nt, Mycobacterium tuberculosis H37Rv
caggccgguuugcacgcacca

SEQ ID NO: 1339730 - RNA, 15 nt, Mycobacterium tuberculosis H37Rv
caggccgguucccuu

SEQ ID NO: 1339731 - RNA, 14 nt, Mycobacterium tuberculosis H37Rv
caggcgaugcgcca

SEQ ID NO: 1339732 - RNA, 19 nt, Mycobacterium tuberculosis H37Rv
caggccuugaccucgggua

SEQ ID NO: 1339733 - RNA, 17 nt, Mycobacterium tuberculosis H37Rv
caggccgacgaugugcc

SEQ ID NO: 1339734 - RNA, 14 nt, Mycobacterium tuberculosis H37Rv
caggccgagcagau

SEQ ID NO: 1339735 - RNA, 14 nt, Mycobacterium tuberculosis H37Rv
caggccgaccauaa

SEQ ID NO: 1339736 - RNA, 18 nt, Mycobacterium tuberculosis H37Rv
caggcccuggccacccag

SEQ ID NO: 1339737 - RNA, 20 nt, Mycobacterium tuberculosis H37Rv
caggcccgggcggaugcugu

SEQ ID NO: 1339738 - RNA, 20 nt, Mycobacterium tuberculosis H37Rv
caggcccggcggugugcgca

SEQ ID NO: 1339739 - RNA, 20 nt, Mycobacterium tuberculosis H37Rv
caggcccgugccuggccggu

SEQ ID NO: 1339740 - RNA, 16 nt, Mycobacterium tuberculosis H37Rv
caggccgaugcggguc

SEQ ID NO: 1339741 - RNA, 18 nt, Mycobacterium tuberculosis H37Rv
caggccgaugcgggucuc

SEQ ID NO: 1339742 - RNA, 17 nt, Mycobacterium tuberculosis H37Rv
caggccgcacagcacca

SEQ ID NO: 1339743 - RNA, 13 nt, Mycobacterium tuberculosis H37Rv
caggccgccaccg

SEQ ID NO: 1339744 - RNA, 23 nt, Mycobacterium tuberculosis H37Rv
caggccgcgcgacaacccggcgu

SEQ ID NO: 1339745 - RNA, 18 nt, Mycobacterium tuberculosis H37Rv
caggccgcuugccccgcc

SEQ ID NO: 1339746 - RNA, 19 nt, Mycobacterium tuberculosis H37Rv
caggccgcuugccccgccu

SEQ ID NO: 1339747 - RNA, 19 nt, Mycobacterium tuberculosis H37Rv
caggcauucccgcggcaac

SEQ ID NO: 1339748 - RNA, 21 nt, Mycobacterium tuberculosis H37Rv
caggcaucggaggaaccccgc

SEQ ID NO: 1339749 - RNA, 20 nt, Mycobacterium tuberculosis H37Rv
caggcaucggaggaaccccg

SEQ ID NO: 1339750 - RNA, 17 nt, Mycobacterium tuberculosis H37Rv
caggaucucuucucggc

SEQ ID NO: 1339751 - RNA, 20 nt, Mycobacterium tuberculosis H37Rv
caggaucuguuugggcaucu

SEQ ID NO: 1339752 - RNA, 16 nt, Mycobacterium tuberculosis H37Rv
caggaucacacuggcc

SEQ ID NO: 1339753 - RNA, 17 nt, Mycobacterium tuberculosis H37Rv
caggcccauaccgaugg

SEQ ID NO: 1339754 - RNA, 18 nt, Mycobacterium tuberculosis H37Rv
caggcccauaccgauggu

SEQ ID NO: 1339755 - RNA, 19 nt, Mycobacterium tuberculosis H37Rv
caggccccggugccgaccg

SEQ ID NO: 1339756 - RNA, 16 nt, Mycobacterium tuberculosis H37Rv
caggcccggcaccgcg

SEQ ID NO: 1339757 - RNA, 14 nt, Mycobacterium tuberculosis H37Rv
caggcccacccggg

SEQ ID NO: 1339758 - RNA, 12 nt, Mycobacterium tuberculosis H37Rv
caggcccacccg

SEQ ID NO: 1339759 - RNA, 13 nt, Mycobacterium tuberculosis H37Rv
caggcccacccgg

SEQ ID NO: 1339760 - RNA, 17 nt, Mycobacterium tuberculosis H37Rv
caggcccagccgagcgg

SEQ ID NO: 1339761 - RNA, 13 nt, Mycobacterium tuberculosis H37Rv
caggcccagcgga

SEQ ID NO: 1339762 - RNA, 17 nt, Mycobacterium tuberculosis H37Rv
caggccagagccgcccu

SEQ ID NO: 1339763 - RNA, 23 nt, Mycobacterium tuberculosis H37Rv
caggccagaguuugcgaugccca

SEQ ID NO: 1339764 - RNA, 12 nt, Mycobacterium tuberculosis H37Rv
caggccacgggc

SEQ ID NO: 1339765 - RNA, 16 nt, Mycobacterium tuberculosis H37Rv
caggccagugccaccu

SEQ ID NO: 1339766 - RNA, 18 nt, Mycobacterium tuberculosis H37Rv
caguacaccgcccggccc

SEQ ID NO: 1339767 - RNA, 22 nt, Mycobacterium tuberculosis H37Rv
cagguugcccgguggaaugcca

SEQ ID NO: 1339768 - RNA, 20 nt, Mycobacterium tuberculosis H37Rv
cagguugcccucaccgaugu

SEQ ID NO: 1339769 - RNA, 23 nt, Mycobacterium tuberculosis H37Rv
cagguuccgcacgaucagggaag

SEQ ID NO: 1339770 - RNA, 15 nt, Mycobacterium tuberculosis H37Rv
cagguuccgcugucg

SEQ ID NO: 1339771 - RNA, 17 nt, Mycobacterium tuberculosis H37Rv
cagguucuugaccagca

SEQ ID NO: 1339772 - RNA, 17 nt, Mycobacterium tuberculosis H37Rv
cagguucuucuccacca

SEQ ID NO: 1339773 - RNA, 14 nt, Mycobacterium tuberculosis H37Rv
cagguuggcacgcu

SEQ ID NO: 1339774 - RNA, 13 nt, Mycobacterium tuberculosis H37Rv
cagguuggcacgc

SEQ ID NO: 1339775 - RNA, 17 nt, Mycobacterium tuberculosis H37Rv
cagguuggccccggccc

SEQ ID NO: 1339776 - RNA, 17 nt, Mycobacterium tuberculosis H37Rv
cagguuggucaccaccu

SEQ ID NO: 1339777 - RNA, 20 nt, Mycobacterium tuberculosis H37Rv
cagguuggcggcugcacgcu

SEQ ID NO: 1339778 - RNA, 20 nt, Mycobacterium tuberculosis H37Rv
cagguugcguugcaggaaag

SEQ ID NO: 1339779 - RNA, 13 nt, Mycobacterium tuberculosis H37Rv
cagguuggcaagc

SEQ ID NO: 1339780 - RNA, 19 nt, Mycobacterium tuberculosis H37Rv
cagguuggugcucagcggc

SEQ ID NO: 1339781 - RNA, 14 nt, Mycobacterium tuberculosis H37Rv
cagguuuccggccu

SEQ ID NO: 1339782 - RNA, 22 nt, Mycobacterium tuberculosis H37Rv
caggucguuugugaacaccccu

SEQ ID NO: 1339783 - RNA, 15 nt, Mycobacterium tuberculosis H37Rv
caggucgugcuccca

SEQ ID NO: 1339784 - RNA, 20 nt, Mycobacterium tuberculosis H37Rv
caggucguccaucgcgucgu

SEQ ID NO: 1339785 - RNA, 23 nt, Mycobacterium tuberculosis H37Rv
caggucggcgaacaaccgccgcu

SEQ ID NO: 1339786 - RNA, 16 nt, Mycobacterium tuberculosis H37Rv
caggucggcauccucu

SEQ ID NO: 1339787 - RNA, 19 nt, Mycobacterium tuberculosis H37Rv
caggucggcggacgcgggu

SEQ ID NO: 1339788 - RNA, 19 nt, Mycobacterium tuberculosis H37Rv
caggucggcgggcgcgggu

SEQ ID NO: 1339789 - RNA, 17 nt, Mycobacterium tuberculosis H37Rv
caggucggugggcggcg

SEQ ID NO: 1339790 - RNA, 16 nt, Mycobacterium tuberculosis H37Rv
caggucgggcagcacu

SEQ ID NO: 1339791 - RNA, 19 nt, Mycobacterium tuberculosis H37Rv
caggucggaacuagccagu

SEQ ID NO: 1339792 - RNA, 16 nt, Mycobacterium tuberculosis H37Rv
caggucggccgccucg

SEQ ID NO: 1339793 - RNA, 14 nt, Mycobacterium tuberculosis H37Rv
caggucggccaccg

SEQ ID NO: 1339794 - RNA, 22 nt, Mycobacterium tuberculosis H37Rv
caggucggcgaacaaccgccgc

SEQ ID NO: 1339795 - RNA, 22 nt, Mycobacterium tuberculosis H37Rv
caggucggcccacggugucccg

SEQ ID NO: 1339796 - RNA, 15 nt, Mycobacterium tuberculosis H37Rv
caggucgaucugcgc

SEQ ID NO: 1339797 - RNA, 17 nt, Mycobacterium tuberculosis H37Rv
caggucgaugcgggcga

SEQ ID NO: 1339798 - RNA, 16 nt, Mycobacterium tuberculosis H37Rv
caggucgacggccacg

SEQ ID NO: 1339799 - RNA, 21 nt, Mycobacterium tuberculosis H37Rv
caggucgacauaggccaccuc

SEQ ID NO: 1339800 - RNA, 18 nt, Mycobacterium tuberculosis H37Rv
caggucgacaccgcggug

SEQ ID NO: 1339801 - RNA, 23 nt, Mycobacterium tuberculosis H37Rv
caggucgcagaccagacugcagu

SEQ ID NO: 1339802 - RNA, 15 nt, Mycobacterium tuberculosis H37Rv
caggucgaugcugcc

SEQ ID NO: 1339803 - RNA, 22 nt, Mycobacterium tuberculosis H37Rv
caggucgaugcugccagccaug

SEQ ID NO: 1339804 - RNA, 16 nt, Mycobacterium tuberculosis H37Rv
caggucgcccaacacc

SEQ ID NO: 1339805 - RNA, 15 nt, Mycobacterium tuberculosis H37Rv
caggucgccuuccca

SEQ ID NO: 1339806 - RNA, 20 nt, Mycobacterium tuberculosis H37Rv
caggucgcgauagccgccgc

SEQ ID NO: 1339807 - RNA, 21 nt, Mycobacterium tuberculosis H37Rv
caggucacuacuccggucccg

SEQ ID NO: 1339808 - RNA, 18 nt, Mycobacterium tuberculosis H37Rv
caggggcgcagcgcggca

SEQ ID NO: 1339809 - RNA, 18 nt, Mycobacterium tuberculosis H37Rv
cagggguggcgcgggccg

SEQ ID NO: 1339810 - RNA, 18 nt, Mycobacterium tuberculosis H37Rv
caggucauugcacgccug

SEQ ID NO: 1339811 - RNA, 13 nt, Mycobacterium tuberculosis H37Rv
cagguccaccccg

SEQ ID NO: 1339812 - RNA, 16 nt, Mycobacterium tuberculosis H37Rv
cagguccaccgcugcc

SEQ ID NO: 1339813 - RNA, 15 nt, Mycobacterium tuberculosis H37Rv
cagguccaccgcugc

SEQ ID NO: 1339814 - RNA, 18 nt, Mycobacterium tuberculosis H37Rv
cagguccggguuggccac

SEQ ID NO: 1339815 - RNA, 17 nt, Mycobacterium tuberculosis H37Rv
cagguccgcgugcugcc

SEQ ID NO: 1339816 - RNA, 14 nt, Mycobacterium tuberculosis H37Rv
cagguccgccggug

SEQ ID NO: 1339817 - RNA, 22 nt, Mycobacterium tuberculosis H37Rv
caggugacguucgaugcccugg

SEQ ID NO: 1339818 - RNA, 15 nt, Mycobacterium tuberculosis H37Rv
caggugagcgacgcu

SEQ ID NO: 1339819 - RNA, 16 nt, Mycobacterium tuberculosis H37Rv
caggugagugcggcgu

SEQ ID NO: 1339820 - RNA, 15 nt, Mycobacterium tuberculosis H37Rv
caggugacgcccgcu

SEQ ID NO: 1339821 - RNA, 20 nt, Mycobacterium tuberculosis H37Rv
caggugauucgcgcagcgcg

SEQ ID NO: 1339822 - RNA, 16 nt, Mycobacterium tuberculosis H37Rv
caggucuucgcugucg

SEQ ID NO: 1339823 - RNA, 15 nt, Mycobacterium tuberculosis H37Rv
caggucuccuugggc

SEQ ID NO: 1339824 - RNA, 19 nt, Mycobacterium tuberculosis H37Rv
caggucuucgauggccaug

SEQ ID NO: 1339825 - RNA, 15 nt, Mycobacterium tuberculosis H37Rv
caggugaacgccggu

SEQ ID NO: 1339826 - RNA, 23 nt, Mycobacterium tuberculosis H37Rv
caggugaacgccggugcgcugga

SEQ ID NO: 1339827 - RNA, 15 nt, Mycobacterium tuberculosis H37Rv
caggugcgggccggu

SEQ ID NO: 1339828 - RNA, 21 nt, Mycobacterium tuberculosis H37Rv
caggugcugggcgaggugagg

SEQ ID NO: 1339829 - RNA, 20 nt, Mycobacterium tuberculosis H37Rv
caggugcccggccaaaaugg

SEQ ID NO: 1339830 - RNA, 18 nt, Mycobacterium tuberculosis H37Rv
caggugccagaccagggc

SEQ ID NO: 1339831 - RNA, 15 nt, Mycobacterium tuberculosis H37Rv
caggugcccaagcag

SEQ ID NO: 1339832 - RNA, 13 nt, Mycobacterium tuberculosis H37Rv
caggugcagcacc

SEQ ID NO: 1339833 - RNA, 20 nt, Mycobacterium tuberculosis H37Rv
caggugccagaccagggcag

SEQ ID NO: 1339834 - RNA, 15 nt, Mycobacterium tuberculosis H37Rv
caggugccaggaugu

SEQ ID NO: 1339835 - RNA, 18 nt, Mycobacterium tuberculosis H37Rv
caggugcccggccaaaau

SEQ ID NO: 1339836 - RNA, 14 nt, Mycobacterium tuberculosis H37Rv
caggugcccgcccc

SEQ ID NO: 1339837 - RNA, 17 nt, Mycobacterium tuberculosis H37Rv
cagguggaagugcaccu

SEQ ID NO: 1339838 - RNA, 13 nt, Mycobacterium tuberculosis H37Rv
cagguggccaggc

SEQ ID NO: 1339839 - RNA, 20 nt, Mycobacterium tuberculosis H37Rv
cagguguaggugccccacuc

SEQ ID NO: 1339840 - RNA, 12 nt, Mycobacterium tuberculosis H37Rv
caggugggcagc

SEQ ID NO: 1339841 - RNA, 15 nt, Mycobacterium tuberculosis H37Rv
caggugggcagcagg

SEQ ID NO: 1339842 - RNA, 20 nt, Mycobacterium tuberculosis H37Rv
caggugucgcugcugaacaa

SEQ ID NO: 1339843 - RNA, 22 nt, Mycobacterium tuberculosis H37Rv
caggugucgcugcugaacaacc

SEQ ID NO: 1339844 - RNA, 23 nt, Mycobacterium tuberculosis H37Rv
cagguguugcacgagcaucauug

SEQ ID NO: 1339845 - RNA, 17 nt, Mycobacterium tuberculosis H37Rv
cagguuaggguccaggu

SEQ ID NO: 1339846 - RNA, 21 nt, Mycobacterium tuberculosis H37Rv
cagugacgccucgacacccag

SEQ ID NO: 1339847 - RNA, 14 nt, Mycobacterium tuberculosis H37Rv
cagugacgccucga

SEQ ID NO: 1339848 - RNA, 18 nt, Mycobacterium tuberculosis H37Rv
cagugaccgcuggugugu

SEQ ID NO: 1339849 - RNA, 14 nt, Mycobacterium tuberculosis H37Rv
cagugacgccacga

SEQ ID NO: 1339850 - RNA, 22 nt, Mycobacterium tuberculosis H37Rv
cagugaccugggcgccccaggg

SEQ ID NO: 1339851 - RNA, 19 nt, Mycobacterium tuberculosis H37Rv
cagugaccgcagucccagc

SEQ ID NO: 1339852 - RNA, 15 nt, Mycobacterium tuberculosis H37Rv
cagugaccgcagucc

SEQ ID NO: 1339853 - RNA, 17 nt, Mycobacterium tuberculosis H37Rv
cagugcacccgggccgc

SEQ ID NO: 1339854 - RNA, 16 nt, Mycobacterium tuberculosis H37Rv
cagugcaccgcgucgu

SEQ ID NO: 1339855 - RNA, 16 nt, Mycobacterium tuberculosis H37Rv
cagugauugagcagca

SEQ ID NO: 1339856 - RNA, 15 nt, Mycobacterium tuberculosis H37Rv
cagugaagacaccag

SEQ ID NO: 1339857 - RNA, 17 nt, Mycobacterium tuberculosis H37Rv
cagugaagacaccaggc

SEQ ID NO: 1339858 - RNA, 22 nt, Mycobacterium tuberculosis H37Rv
cagugaagacaccaggcccggu

SEQ ID NO: 1339859 - RNA, 12 nt, Mycobacterium tuberculosis H37Rv
cagugacagcag

SEQ ID NO: 1339860 - RNA, 14 nt, Mycobacterium tuberculosis H37Rv
cagucugcgacugg

SEQ ID NO: 1339861 - RNA, 12 nt, Mycobacterium tuberculosis H37Rv
cagucgcggcgu

SEQ ID NO: 1339862 - RNA, 14 nt, Mycobacterium tuberculosis H37Rv
cagucggcgccgcc

SEQ ID NO: 1339863 - RNA, 12 nt, Mycobacterium tuberculosis H37Rv
cagucgggcagc

SEQ ID NO: 1339864 - RNA, 14 nt, Mycobacterium tuberculosis H37Rv
cagucgcugggugg

SEQ ID NO: 1339865 - RNA, 23 nt, Mycobacterium tuberculosis H37Rv
cagucgcuggguggcgggccgga

SEQ ID NO: 1339866 - RNA, 12 nt, Mycobacterium tuberculosis H37Rv
cagucgcgcgcu

SEQ ID NO: 1339867 - RNA, 18 nt, Mycobacterium tuberculosis H37Rv
cagucgcgcgcucgcggc

SEQ ID NO: 1339868 - RNA, 18 nt, Mycobacterium tuberculosis H37Rv
cagucgcuaaagcccccg

SEQ ID NO: 1339869 - RNA, 20 nt, Mycobacterium tuberculosis H37Rv
cagucgcuaaagcccccgac

SEQ ID NO: 1339870 - RNA, 17 nt, Mycobacterium tuberculosis H37Rv
cagucgugggcugugcg

SEQ ID NO: 1339871 - RNA, 15 nt, Mycobacterium tuberculosis H37Rv
cagucgggcagcgcu

SEQ ID NO: 1339872 - RNA, 20 nt, Mycobacterium tuberculosis H37Rv
cagucguacucccaggccgc

SEQ ID NO: 1339873 - RNA, 21 nt, Mycobacterium tuberculosis H37Rv
cagucgaccggacacuccugc

SEQ ID NO: 1339874 - RNA, 20 nt, Mycobacterium tuberculosis H37Rv
cagucgaacaagaccgcggc

SEQ ID NO: 1339875 - RNA, 16 nt, Mycobacterium tuberculosis H37Rv
cagucgagcaucucgu

SEQ ID NO: 1339876 - RNA, 21 nt, Mycobacterium tuberculosis H37Rv
cagucgaugagugacgguccg

SEQ ID NO: 1339877 - RNA, 19 nt, Mycobacterium tuberculosis H37Rv
caguccucaucgagcgcgc

SEQ ID NO: 1339878 - RNA, 14 nt, Mycobacterium tuberculosis H37Rv
caguccucgggcag

SEQ ID NO: 1339879 - RNA, 17 nt, Mycobacterium tuberculosis H37Rv
caguccucgacguggcc

SEQ ID NO: 1339880 - RNA, 14 nt, Mycobacterium tuberculosis H37Rv
cagucccggcgcac

SEQ ID NO: 1339881 - RNA, 21 nt, Mycobacterium tuberculosis H37Rv
caguccggggcgcaggucguc

SEQ ID NO: 1339882 - RNA, 15 nt, Mycobacterium tuberculosis H37Rv
caguccgcagcgucc

SEQ ID NO: 1339883 - RNA, 12 nt, Mycobacterium tuberculosis H37Rv
caguccggcccc

SEQ ID NO: 1339884 - RNA, 15 nt, Mycobacterium tuberculosis H37Rv
caguccggccccccg

SEQ ID NO: 1339885 - RNA, 22 nt, Mycobacterium tuberculosis H37Rv
caguccggccccccgacuccgg

SEQ ID NO: 1339886 - RNA, 13 nt, Mycobacterium tuberculosis H37Rv
cagucaggaaacc

SEQ ID NO: 1339887 - RNA, 21 nt, Mycobacterium tuberculosis H37Rv
cagucaggccuagcgcggcga

SEQ ID NO: 1339888 - RNA, 12 nt, Mycobacterium tuberculosis H37Rv
caguccagccgg

SEQ ID NO: 1339889 - RNA, 21 nt, Mycobacterium tuberculosis H37Rv
caguccaggacggucgccagg

SEQ ID NO: 1339890 - RNA, 24 nt, Mycobacterium tuberculosis H37Rv
caguccaccgcgcggcgcagcacc

SEQ ID NO: 1339891 - RNA, 18 nt, Mycobacterium tuberculosis H37Rv
caguccaccgcgcggcgc

SEQ ID NO: 1339892 - RNA, 19 nt, Mycobacterium tuberculosis H37Rv
caguccaaucuucucgagc

SEQ ID NO: 1339893 - RNA, 22 nt, Mycobacterium tuberculosis H37Rv
caguccaaucuucucgagccgc

SEQ ID NO: 1339894 - RNA, 18 nt, Mycobacterium tuberculosis H37Rv
cagucccacugggccggu

SEQ ID NO: 1339895 - RNA, 16 nt, Mycobacterium tuberculosis H37Rv
cagucccagcgccgca

SEQ ID NO: 1339896 - RNA, 23 nt, Mycobacterium tuberculosis H37Rv
cagucccagcgccgcacagaaaa

SEQ ID NO: 1339897 - RNA, 15 nt, Mycobacterium tuberculosis H37Rv
cagucccaguucguu

SEQ ID NO: 1339898 - RNA, 12 nt, Mycobacterium tuberculosis H37Rv
caguccccagac

SEQ ID NO: 1339899 - RNA, 15 nt, Mycobacterium tuberculosis H37Rv
cagucaacagggcca

SEQ ID NO: 1339900 - RNA, 13 nt, Mycobacterium tuberculosis H37Rv
cagucaacagggc

SEQ ID NO: 1339901 - RNA, 18 nt, Mycobacterium tuberculosis H37Rv
cagucacgcccaccacug

SEQ ID NO: 1339902 - RNA, 20 nt, Mycobacterium tuberculosis H37Rv
caguagcacguugacgucca

SEQ ID NO: 1339903 - RNA, 14 nt, Mycobacterium tuberculosis H37Rv
caguagccacgccc

SEQ ID NO: 1339904 - RNA, 15 nt, Mycobacterium tuberculosis H37Rv
caguagccacgccca

SEQ ID NO: 1339905 - RNA, 19 nt, Mycobacterium tuberculosis H37Rv
caguacucggccagcgccu

SEQ ID NO: 1339906 - RNA, 16 nt, Mycobacterium tuberculosis H37Rv
caguacggugguaaga

SEQ ID NO: 1339907 - RNA, 23 nt, Mycobacterium tuberculosis H37Rv
caguacgucgaucaacaggucua

SEQ ID NO: 1339908 - RNA, 20 nt, Mycobacterium tuberculosis H37Rv
cagcgcgaucugcucgcccc

SEQ ID NO: 1339909 - RNA, 18 nt, Mycobacterium tuberculosis H37Rv
cagcgcgacguccaccag

SEQ ID NO: 1339910 - RNA, 16 nt, Mycobacterium tuberculosis H37Rv
cagcgcgaacgccugc

SEQ ID NO: 1339911 - RNA, 22 nt, Mycobacterium tuberculosis H37Rv
cagcgccuuguggcacacccgc

SEQ ID NO: 1339912 - RNA, 22 nt, Mycobacterium tuberculosis H37Rv
cagcgcgaacaccaugaucagg

SEQ ID NO: 1339913 - RNA, 15 nt, Mycobacterium tuberculosis H37Rv
cagcgcgccacccag

SEQ ID NO: 1339914 - RNA, 13 nt, Mycobacterium tuberculosis H37Rv
cagcgcgccggcg

SEQ ID NO: 1339915 - RNA, 14 nt, Mycobacterium tuberculosis H37Rv
cagcgcgcgcgggu

SEQ ID NO: 1339916 - RNA, 14 nt, Mycobacterium tuberculosis H37Rv
cagcgcgcgccgcu

SEQ ID NO: 1339917 - RNA, 14 nt, Mycobacterium tuberculosis H37Rv
cagcgcggcgcgcg

SEQ ID NO: 1339918 - RNA, 15 nt, Mycobacterium tuberculosis H37Rv
cagcgcggcgcgaca

SEQ ID NO: 1339919 - RNA, 18 nt, Mycobacterium tuberculosis H37Rv
cagcgccgagagcaccgc

SEQ ID NO: 1339920 - RNA, 20 nt, Mycobacterium tuberculosis H37Rv
cagcgccgagagcaccgcuc

SEQ ID NO: 1339921 - RNA, 20 nt, Mycobacterium tuberculosis H37Rv
cagcgcccggcccgccaccc

SEQ ID NO: 1339922 - RNA, 17 nt, Mycobacterium tuberculosis H37Rv
cagcgcccggcccgcca

SEQ ID NO: 1339923 - RNA, 18 nt, Mycobacterium tuberculosis H37Rv
cagcgcccggucacgcug

SEQ ID NO: 1339924 - RNA, 13 nt, Mycobacterium tuberculosis H37Rv
cagcgccgccacc

SEQ ID NO: 1339925 - RNA, 15 nt, Mycobacterium tuberculosis H37Rv
cagcgccgcgcccca

SEQ ID NO: 1339926 - RNA, 13 nt, Mycobacterium tuberculosis H37Rv
cagcgccgcgcgc

SEQ ID NO: 1339927 - RNA, 17 nt, Mycobacterium tuberculosis H37Rv
cagcgccgcgcgggugc

SEQ ID NO: 1339928 - RNA, 16 nt, Mycobacterium tuberculosis H37Rv
cagcgccgccggcgcc

SEQ ID NO: 1339929 - RNA, 17 nt, Mycobacterium tuberculosis H37Rv
cagcgccgccggcaccu

SEQ ID NO: 1339930 - RNA, 24 nt, Mycobacterium tuberculosis H37Rv
cagcgccgccggcaccucccuggc

SEQ ID NO: 1339931 - RNA, 11 nt, Mycobacterium tuberculosis H37Rv
cagcgccucca

SEQ ID NO: 1339932 - RNA, 18 nt, Mycobacterium tuberculosis H37Rv
cagcgccuaccagcaccg

SEQ ID NO: 1339933 - RNA, 17 nt, Mycobacterium tuberculosis H37Rv
cagcgccuccacucuuc

SEQ ID NO: 1339934 - RNA, 14 nt, Mycobacterium tuberculosis H37Rv
cagcgccuccagca

SEQ ID NO: 1339935 - RNA, 18 nt, Mycobacterium tuberculosis H37Rv
cagcgccuccagcaccac

SEQ ID NO: 1339936 - RNA, 23 nt, Mycobacterium tuberculosis H37Rv
cagcgccggccaagaccgcggcc

SEQ ID NO: 1339937 - RNA, 18 nt, Mycobacterium tuberculosis H37Rv
cagcgccggccauaccgc

SEQ ID NO: 1339938 - RNA, 20 nt, Mycobacterium tuberculosis H37Rv
cagcgccgcugacuccugcg

SEQ ID NO: 1339939 - RNA, 14 nt, Mycobacterium tuberculosis H37Rv
cagcgccgcguggc

SEQ ID NO: 1339940 - RNA, 16 nt, Mycobacterium tuberculosis H37Rv
cagcgccacccgaucg

SEQ ID NO: 1339941 - RNA, 16 nt, Mycobacterium tuberculosis H37Rv
cagcgccagcgccugc

SEQ ID NO: 1339942 - RNA, 14 nt, Mycobacterium tuberculosis H37Rv
cagcgccagcagcu

SEQ ID NO: 1339943 - RNA, 22 nt, Mycobacterium tuberculosis H37Rv
cagcgccagugccucgcggggu

SEQ ID NO: 1339944 - RNA, 18 nt, Mycobacterium tuberculosis H37Rv
cagcgccaucaucuuggc

SEQ ID NO: 1339945 - RNA, 16 nt, Mycobacterium tuberculosis H37Rv
cagcgccccaugcaac

SEQ ID NO: 1339946 - RNA, 14 nt, Mycobacterium tuberculosis H37Rv
cagcgcccccggac

SEQ ID NO: 1339947 - RNA, 22 nt, Mycobacterium tuberculosis H37Rv
cagcgcccccggacugcggaac

SEQ ID NO: 1339948 - RNA, 15 nt, Mycobacterium tuberculosis H37Rv
cagcgcccggcccgc

SEQ ID NO: 1339949 - RNA, 17 nt, Mycobacterium tuberculosis H37Rv
cagcgacuccagcgccc

SEQ ID NO: 1339950 - RNA, 22 nt, Mycobacterium tuberculosis H37Rv
cagcgacgucgcaauaugccac

SEQ ID NO: 1339951 - RNA, 19 nt, Mycobacterium tuberculosis H37Rv
cagcgacgggaaagccacc

SEQ ID NO: 1339952 - RNA, 21 nt, Mycobacterium tuberculosis H37Rv
cagcgacuuggcaucgcgagc

SEQ ID NO: 1339953 - RNA, 20 nt, Mycobacterium tuberculosis H37Rv
cagcgcaagguugccaacgc

SEQ ID NO: 1339954 - RNA, 22 nt, Mycobacterium tuberculosis H37Rv
cagcgccaacucgagaguggcc

SEQ ID NO: 1339955 - RNA, 20 nt, Mycobacterium tuberculosis H37Rv
cagcgccacauacaccggcc

SEQ ID NO: 1339956 - RNA, 14 nt, Mycobacterium tuberculosis H37Rv
cagcgcacugcccg

SEQ ID NO: 1339957 - RNA, 11 nt, Mycobacterium tuberculosis H37Rv
cagcgcagcag

SEQ ID NO: 1339958 - RNA, 13 nt, Mycobacterium tuberculosis H37Rv
cagcgcagcagcg

SEQ ID NO: 1339959 - RNA, 19 nt, Mycobacterium tuberculosis H37Rv
cagcgccaacgcccccauc

SEQ ID NO: 1339960 - RNA, 22 nt, Mycobacterium tuberculosis H37Rv
cagcgcaaugcaucgcggcggc

SEQ ID NO: 1339961 - RNA, 20 nt, Mycobacterium tuberculosis H37Rv
cagcgcacggaccaucgcca

SEQ ID NO: 1339962 - RNA, 18 nt, Mycobacterium tuberculosis H37Rv
cagccgcauaggccccgc

SEQ ID NO: 1339963 - RNA, 13 nt, Mycobacterium tuberculosis H37Rv
cagccgccaugcg

SEQ ID NO: 1339964 - RNA, 14 nt, Mycobacterium tuberculosis H37Rv
cagccgcgagccgg

SEQ ID NO: 1339965 - RNA, 13 nt, Mycobacterium tuberculosis H37Rv
cagccgccgacuu

SEQ ID NO: 1339966 - RNA, 21 nt, Mycobacterium tuberculosis H37Rv
cagccgcgacacgugcaucug

SEQ ID NO: 1339967 - RNA, 19 nt, Mycobacterium tuberculosis H37Rv
cagccgcgaccgcagcugg

SEQ ID NO: 1339968 - RNA, 21 nt, Mycobacterium tuberculosis H37Rv
cagccgaucgucucggccacg

SEQ ID NO: 1339969 - RNA, 15 nt, Mycobacterium tuberculosis H37Rv
cagccgacgcggcgg

SEQ ID NO: 1339970 - RNA, 13 nt, Mycobacterium tuberculosis H37Rv
cagccgaugcucg

SEQ ID NO: 1339971 - RNA, 15 nt, Mycobacterium tuberculosis H37Rv
cagccgcaccccgcc

SEQ ID NO: 1339972 - RNA, 14 nt, Mycobacterium tuberculosis H37Rv
cagccgcaccccgc

SEQ ID NO: 1339973 - RNA, 23 nt, Mycobacterium tuberculosis H37Rv
cagccaugcgguuugccggugcg

SEQ ID NO: 1339974 - RNA, 18 nt, Mycobacterium tuberculosis H37Rv
cagccauggugggccuuc

SEQ ID NO: 1339975 - RNA, 20 nt, Mycobacterium tuberculosis H37Rv
cagccauggugggccuuccu

SEQ ID NO: 1339976 - RNA, 15 nt, Mycobacterium tuberculosis H37Rv
cagcccgugacuggu

SEQ ID NO: 1339977 - RNA, 19 nt, Mycobacterium tuberculosis H37Rv
cagcccgugacuggugaac

SEQ ID NO: 1339978 - RNA, 22 nt, Mycobacterium tuberculosis H37Rv
cagcccucugguggcgcugaag

SEQ ID NO: 1339979 - RNA, 12 nt, Mycobacterium tuberculosis H37Rv
cagcccucuggu

SEQ ID NO: 1339980 - RNA, 13 nt, Mycobacterium tuberculosis H37Rv
cagcccuucagcg

SEQ ID NO: 1339981 - RNA, 14 nt, Mycobacterium tuberculosis H37Rv
cagcccuucagcgu

SEQ ID NO: 1339982 - RNA, 17 nt, Mycobacterium tuberculosis H37Rv
cagccgaaccggcacca

SEQ ID NO: 1339983 - RNA, 16 nt, Mycobacterium tuberculosis H37Rv
cagccgaaccggcacc

SEQ ID NO: 1339984 - RNA, 14 nt, Mycobacterium tuberculosis H37Rv
cagccgaagcgccc

SEQ ID NO: 1339985 - RNA, 13 nt, Mycobacterium tuberculosis H37Rv
cagccugcagcga

SEQ ID NO: 1339986 - RNA, 23 nt, Mycobacterium tuberculosis H37Rv
cagccugcagcgaaacaccggcc

SEQ ID NO: 1339987 - RNA, 20 nt, Mycobacterium tuberculosis H37Rv
cagccugcaacgucuugcug

SEQ ID NO: 1339988 - RNA, 23 nt, Mycobacterium tuberculosis H37Rv
cagccugcaacgucuugcugguc

SEQ ID NO: 1339989 - RNA, 14 nt, Mycobacterium tuberculosis H37Rv
cagccugcgccgcg

SEQ ID NO: 1339990 - RNA, 16 nt, Mycobacterium tuberculosis H37Rv
cagccugaaccgcccc

SEQ ID NO: 1339991 - RNA, 17 nt, Mycobacterium tuberculosis H37Rv
cagccucgcgggcaggg

SEQ ID NO: 1339992 - RNA, 23 nt, Mycobacterium tuberculosis H37Rv
cagccggccaauggccugcagcg

SEQ ID NO: 1339993 - RNA, 15 nt, Mycobacterium tuberculosis H37Rv
cagccggaccaccag

SEQ ID NO: 1339994 - RNA, 19 nt, Mycobacterium tuberculosis H37Rv
cagccggaaccggacagcg

SEQ ID NO: 1339995 - RNA, 20 nt, Mycobacterium tuberculosis H37Rv
cagccggaaccggacagcgu

SEQ ID NO: 1339996 - RNA, 12 nt, Mycobacterium tuberculosis H37Rv
cagccuccacca

SEQ ID NO: 1339997 - RNA, 18 nt, Mycobacterium tuberculosis H37Rv
cagccggcccugcggcca

SEQ ID NO: 1339998 - RNA, 15 nt, Mycobacterium tuberculosis H37Rv
cagccggccgcgacc

SEQ ID NO: 1339999 - RNA, 19 nt, Mycobacterium tuberculosis H37Rv
cagcgaaaugccggugccg

SEQ ID NO: 1340000 - RNA, 24 nt, Mycobacterium tuberculosis H37Rv
cagccugcuggccgcggccucgua

SEQ ID NO: 1340001 - RNA, 20 nt, Mycobacterium tuberculosis H37Rv
cagccugcuggccgcggccu

SEQ ID NO: 1340002 - RNA, 17 nt, Mycobacterium tuberculosis H37Rv
cagccugcuggccgcgg

SEQ ID NO: 1340003 - RNA, 14 nt, Mycobacterium tuberculosis H37Rv
cagccuggccaucg

SEQ ID NO: 1340004 - RNA, 21 nt, Mycobacterium tuberculosis H37Rv
cagcgaaccggcugggcgcca

SEQ ID NO: 1340005 - RNA, 14 nt, Mycobacterium tuberculosis H37Rv
cagcgaaccgccgg

SEQ ID NO: 1340006 - RNA, 18 nt, Mycobacterium tuberculosis H37Rv
cagcgaagacuagcugcu

SEQ ID NO: 1340007 - RNA, 13 nt, Mycobacterium tuberculosis H37Rv
cagcgaauccagc

SEQ ID NO: 1340008 - RNA, 17 nt, Mycobacterium tuberculosis H37Rv
cagcagcgggcgcgcua

SEQ ID NO: 1340009 - RNA, 16 nt, Mycobacterium tuberculosis H37Rv
cagcagcgggcgcgcu

SEQ ID NO: 1340010 - RNA, 15 nt, Mycobacterium tuberculosis H37Rv
cagcagcggcgagcc

SEQ ID NO: 1340011 - RNA, 18 nt, Mycobacterium tuberculosis H37Rv
cagcagcgguugaugcgg

SEQ ID NO: 1340012 - RNA, 14 nt, Mycobacterium tuberculosis H37Rv
cagcagcgguugau

SEQ ID NO: 1340013 - RNA, 23 nt, Mycobacterium tuberculosis H37Rv
cagcagcgucggugccaccacgc

SEQ ID NO: 1340014 - RNA, 15 nt, Mycobacterium tuberculosis H37Rv
cagcagcgcacugcc

SEQ ID NO: 1340015 - RNA, 14 nt, Mycobacterium tuberculosis H37Rv
cagcagcgccgcgu

SEQ ID NO: 1340016 - RNA, 13 nt, Mycobacterium tuberculosis H37Rv
cagcagagcggca

SEQ ID NO: 1340017 - RNA, 19 nt, Mycobacterium tuberculosis H37Rv
cagcagcgcacugcccggg

SEQ ID NO: 1340018 - RNA, 15 nt, Mycobacterium tuberculosis H37Rv
cagcagcgccacccg

SEQ ID NO: 1340019 - RNA, 15 nt, Mycobacterium tuberculosis H37Rv
cagcagaccaagucc

SEQ ID NO: 1340020 - RNA, 22 nt, Mycobacterium tuberculosis H37Rv
cagcaggacacucuuuugcugg

SEQ ID NO: 1340021 - RNA, 21 nt, Mycobacterium tuberculosis H37Rv
cagcaggaaguaccccuugga

SEQ ID NO: 1340022 - RNA, 20 nt, Mycobacterium tuberculosis H37Rv
cagcagcuucggacuggggc

SEQ ID NO: 1340023 - RNA, 23 nt, Mycobacterium tuberculosis H37Rv
cagcagcuuguuuuccaccagcg

SEQ ID NO: 1340024 - RNA, 14 nt, Mycobacterium tuberculosis H37Rv
cagcagcuccacug

SEQ ID NO: 1340025 - RNA, 20 nt, Mycobacterium tuberculosis H37Rv
cagcagcuccacuggcgucu

SEQ ID NO: 1340026 - RNA, 20 nt, Mycobacterium tuberculosis H37Rv
cagcagcucgccggcacgca

SEQ ID NO: 1340027 - RNA, 14 nt, Mycobacterium tuberculosis H37Rv
cagcaggaugauga

SEQ ID NO: 1340028 - RNA, 18 nt, Mycobacterium tuberculosis H37Rv
cagcaggcccuucaguuc

SEQ ID NO: 1340029 - RNA, 14 nt, Mycobacterium tuberculosis H37Rv
cagcaggccuccaa

SEQ ID NO: 1340030 - RNA, 15 nt, Mycobacterium tuberculosis H37Rv
cagcaggccgggcgc

SEQ ID NO: 1340031 - RNA, 16 nt, Mycobacterium tuberculosis H37Rv
cagcaggccgggacag

SEQ ID NO: 1340032 - RNA, 20 nt, Mycobacterium tuberculosis H37Rv
cagcaggccgcgcucgucga

SEQ ID NO: 1340033 - RNA, 19 nt, Mycobacterium tuberculosis H37Rv
cagcaggcccuggccaccc

SEQ ID NO: 1340034 - RNA, 12 nt, Mycobacterium tuberculosis H37Rv
cagcaggcggcu

SEQ ID NO: 1340035 - RNA, 14 nt, Mycobacterium tuberculosis H37Rv
cagcaggcggcuga

SEQ ID NO: 1340036 - RNA, 17 nt, Mycobacterium tuberculosis H37Rv
cagcaggucgucggcgu

SEQ ID NO: 1340037 - RNA, 18 nt, Mycobacterium tuberculosis H37Rv
cagcagguuccacggcca

SEQ ID NO: 1340038 - RNA, 17 nt, Mycobacterium tuberculosis H37Rv
cagcagguuggcgagcu

SEQ ID NO: 1340039 - RNA, 20 nt, Mycobacterium tuberculosis H37Rv
cagcagguuggucaccaccu

SEQ ID NO: 1340040 - RNA, 17 nt, Mycobacterium tuberculosis H37Rv
cagcagggccaccacca

SEQ ID NO: 1340041 - RNA, 14 nt, Mycobacterium tuberculosis H37Rv
cagcagggcgcgca

SEQ ID NO: 1340042 - RNA, 20 nt, Mycobacterium tuberculosis H37Rv
cagcagggcgcgcaucugcu

SEQ ID NO: 1340043 - RNA, 20 nt, Mycobacterium tuberculosis H37Rv
cagcagggcuucgugcacca

SEQ ID NO: 1340044 - RNA, 23 nt, Mycobacterium tuberculosis H37Rv
cagcaggggacgggcggccagga

SEQ ID NO: 1340045 - RNA, 23 nt, Mycobacterium tuberculosis H37Rv
cagcagggcgcgcaucugcucgg

SEQ ID NO: 1340046 - RNA, 19 nt, Mycobacterium tuberculosis H37Rv
cagcagugccgugcugaac

SEQ ID NO: 1340047 - RNA, 15 nt, Mycobacterium tuberculosis H37Rv
cagccacagcccggc

SEQ ID NO: 1340048 - RNA, 18 nt, Mycobacterium tuberculosis H37Rv
cagccacagcccggcggc

SEQ ID NO: 1340049 - RNA, 19 nt, Mycobacterium tuberculosis H37Rv
cagccacagccgaccucga

SEQ ID NO: 1340050 - RNA, 23 nt, Mycobacterium tuberculosis H37Rv
cagccacauacaggcccgccagc

SEQ ID NO: 1340051 - RNA, 21 nt, Mycobacterium tuberculosis H37Rv
cagccaccagcgacgaccaca

SEQ ID NO: 1340052 - RNA, 18 nt, Mycobacterium tuberculosis H37Rv
cagccaccaucuggaugg

SEQ ID NO: 1340053 - RNA, 15 nt, Mycobacterium tuberculosis H37Rv
cagccaccagcgacg

SEQ ID NO: 1340054 - RNA, 13 nt, Mycobacterium tuberculosis H37Rv
cagccaccaccag

SEQ ID NO: 1340055 - RNA, 12 nt, Mycobacterium tuberculosis H37Rv
cagccaccacca

SEQ ID NO: 1340056 - RNA, 21 nt, Mycobacterium tuberculosis H37Rv
cagccaccacaucgcgggcgu

SEQ ID NO: 1340057 - RNA, 17 nt, Mycobacterium tuberculosis H37Rv
cagccacccgacaacgc

SEQ ID NO: 1340058 - RNA, 16 nt, Mycobacterium tuberculosis H37Rv
cagccaccgcgcguca

SEQ ID NO: 1340059 - RNA, 19 nt, Mycobacterium tuberculosis H37Rv
cagccaccgcggucagcuc

SEQ ID NO: 1340060 - RNA, 15 nt, Mycobacterium tuberculosis H37Rv
cagccaccgcaugug

SEQ ID NO: 1340061 - RNA, 18 nt, Mycobacterium tuberculosis H37Rv
cagccacgauccuuggcg

SEQ ID NO: 1340062 - RNA, 16 nt, Mycobacterium tuberculosis H37Rv
cagccaccgucaugcc

SEQ ID NO: 1340063 - RNA, 17 nt, Mycobacterium tuberculosis H37Rv
cagccaccgucaugccg

SEQ ID NO: 1340064 - RNA, 15 nt, Mycobacterium tuberculosis H37Rv
cagccacgcacaaua

SEQ ID NO: 1340065 - RNA, 23 nt, Mycobacterium tuberculosis H37Rv
cagccaccugccgacucaucggc

SEQ ID NO: 1340066 - RNA, 15 nt, Mycobacterium tuberculosis H37Rv
cagccacgccacguc

SEQ ID NO: 1340067 - RNA, 14 nt, Mycobacterium tuberculosis H37Rv
cagcauugaagaag

SEQ ID NO: 1340068 - RNA, 18 nt, Mycobacterium tuberculosis H37Rv
cagccaggccgcaaugcg

SEQ ID NO: 1340069 - RNA, 20 nt, Mycobacterium tuberculosis H37Rv
cagccaggccuuggugcggc

SEQ ID NO: 1340070 - RNA, 22 nt, Mycobacterium tuberculosis H37Rv
cagccagcuggacuccggucag

SEQ ID NO: 1340071 - RNA, 16 nt, Mycobacterium tuberculosis H37Rv
cagccaggagccgauc

SEQ ID NO: 1340072 - RNA, 12 nt, Mycobacterium tuberculosis H37Rv
cagccaggaagc

SEQ ID NO: 1340073 - RNA, 17 nt, Mycobacterium tuberculosis H37Rv
cagccaggcgugcacag

SEQ ID NO: 1340074 - RNA, 20 nt, Mycobacterium tuberculosis H37Rv
cagccaggcgugcacagguc

SEQ ID NO: 1340075 - RNA, 12 nt, Mycobacterium tuberculosis H37Rv
cagccaggcugc

SEQ ID NO: 1340076 - RNA, 16 nt, Mycobacterium tuberculosis H37Rv
cagccagggcaacacu

SEQ ID NO: 1340077 - RNA, 21 nt, Mycobacterium tuberculosis H37Rv
cagccaggugcccaagcaguc

SEQ ID NO: 1340078 - RNA, 15 nt, Mycobacterium tuberculosis H37Rv
cagccaggugcccaa

SEQ ID NO: 1340079 - RNA, 22 nt, Mycobacterium tuberculosis H37Rv
cagccaggugauuaccugguuc

SEQ ID NO: 1340080 - RNA, 14 nt, Mycobacterium tuberculosis H37Rv
cagccagccugcug

SEQ ID NO: 1340081 - RNA, 12 nt, Mycobacterium tuberculosis H37Rv
cagccagccugc

SEQ ID NO: 1340082 - RNA, 17 nt, Mycobacterium tuberculosis H37Rv
cagcaucggcaccccgg

SEQ ID NO: 1340083 - RNA, 18 nt, Mycobacterium tuberculosis H37Rv
cagcaucggcaccccggc

SEQ ID NO: 1340084 - RNA, 15 nt, Mycobacterium tuberculosis H37Rv
cagcaucggcacccc

SEQ ID NO: 1340085 - RNA, 20 nt, Mycobacterium tuberculosis H37Rv
cagcaucuccgucggccagg

SEQ ID NO: 1340086 - RNA, 15 nt, Mycobacterium tuberculosis H37Rv
cagcaucuccgucgg

SEQ ID NO: 1340087 - RNA, 22 nt, Mycobacterium tuberculosis H37Rv
cagcaucugcgggucggcaucg

SEQ ID NO: 1340088 - RNA, 21 nt, Mycobacterium tuberculosis H37Rv
cagcauccggccgucaucugg

SEQ ID NO: 1340089 - RNA, 19 nt, Mycobacterium tuberculosis H37Rv
cagcauccccgcagcgucc

SEQ ID NO: 1340090 - RNA, 13 nt, Mycobacterium tuberculosis H37Rv
cagcaucagcgcc

SEQ ID NO: 1340091 - RNA, 20 nt, Mycobacterium tuberculosis H37Rv
cagcaucaaccguccccggc

SEQ ID NO: 1340092 - RNA, 20 nt, Mycobacterium tuberculosis H37Rv
cagcaucagcgccagcgagc

SEQ ID NO: 1340093 - RNA, 23 nt, Mycobacterium tuberculosis H37Rv
cagcaugucgacggucagauggc

SEQ ID NO: 1340094 - RNA, 18 nt, Mycobacterium tuberculosis H37Rv
cagcaugacaccggccac

SEQ ID NO: 1340095 - RNA, 13 nt, Mycobacterium tuberculosis H37Rv
cagcaugacaccg

SEQ ID NO: 1340096 - RNA, 15 nt, Mycobacterium tuberculosis H37Rv
cagcaugacaccggc

SEQ ID NO: 1340097 - RNA, 14 nt, Mycobacterium tuberculosis H37Rv
cagcaugcccgcca

SEQ ID NO: 1340098 - RNA, 16 nt, Mycobacterium tuberculosis H37Rv
cagcaugcccgccauc

SEQ ID NO: 1340099 - RNA, 18 nt, Mycobacterium tuberculosis H37Rv
cacgucgcccaggguguc

SEQ ID NO: 1340100 - RNA, 23 nt, Mycobacterium tuberculosis H37Rv
cacgucgacaccgaggaccucgu

SEQ ID NO: 1340101 - RNA, 19 nt, Mycobacterium tuberculosis H37Rv
cacgucgcgccaggcgcga

SEQ ID NO: 1340102 - RNA, 18 nt, Mycobacterium tuberculosis H37Rv
cacgucggauccgcccgc

SEQ ID NO: 1340103 - RNA, 18 nt, Mycobacterium tuberculosis H37Rv
cacgucgggaugcccgcu

SEQ ID NO: 1340104 - RNA, 16 nt, Mycobacterium tuberculosis H37Rv
cacgucgucgcccagg

SEQ ID NO: 1340105 - RNA, 22 nt, Mycobacterium tuberculosis H37Rv
cacuuucagaucgaucugcggg

SEQ ID NO: 1340106 - RNA, 18 nt, Mycobacterium tuberculosis H37Rv
cacuuuccgaggagggcc

SEQ ID NO: 1340107 - RNA, 17 nt, Mycobacterium tuberculosis H37Rv
cagaaacgcgauggugg

SEQ ID NO: 1340108 - RNA, 19 nt, Mycobacterium tuberculosis H37Rv
cagaaaccccaaacaaccc

SEQ ID NO: 1340109 - RNA, 23 nt, Mycobacterium tuberculosis H37Rv
cagacaccggcuauaucccgccc

SEQ ID NO: 1340110 - RNA, 14 nt, Mycobacterium tuberculosis H37Rv
cagacaggauugcc

SEQ ID NO: 1340111 - RNA, 14 nt, Mycobacterium tuberculosis H37Rv
cagacagcugcaca

SEQ ID NO: 1340112 - RNA, 17 nt, Mycobacterium tuberculosis H37Rv
cagaauugugugcagca

SEQ ID NO: 1340113 - RNA, 12 nt, Mycobacterium tuberculosis H37Rv
cagaacaccacc

SEQ ID NO: 1340114 - RNA, 14 nt, Mycobacterium tuberculosis H37Rv
cagaacaccaccgc

SEQ ID NO: 1340115 - RNA, 20 nt, Mycobacterium tuberculosis H37Rv
cagaaaugguucgcacaccu

SEQ ID NO: 1340116 - RNA, 15 nt, Mycobacterium tuberculosis H37Rv
cagaauguucuccac

SEQ ID NO: 1340117 - RNA, 23 nt, Mycobacterium tuberculosis H37Rv
cagagcacgggcucgcugcacca

SEQ ID NO: 1340118 - RNA, 17 nt, Mycobacterium tuberculosis H37Rv
cagagcacgcgcggcgu

SEQ ID NO: 1340119 - RNA, 16 nt, Mycobacterium tuberculosis H37Rv
cagagacgaucaucuc

SEQ ID NO: 1340120 - RNA, 19 nt, Mycobacterium tuberculosis H37Rv
aaaaucaucugcacauuca

SEQ ID NO: 1340121 - RNA, 13 nt, Mycobacterium tuberculosis H37Rv
cagagccaacgcg

SEQ ID NO: 1340122 - RNA, 16 nt, Mycobacterium tuberculosis H37Rv
cagagccgcccuugcc

SEQ ID NO: 1340123 - RNA, 17 nt, Mycobacterium tuberculosis H37Rv
cagagcuucgccgcgca

SEQ ID NO: 1340124 - RNA, 17 nt, Mycobacterium tuberculosis H37Rv
cagaguucccgaaaccc

SEQ ID NO: 1340125 - RNA, 14 nt, Mycobacterium tuberculosis H37Rv
cagaguucccugau

SEQ ID NO: 1340126 - RNA, 20 nt, Mycobacterium tuberculosis H37Rv
cagagaacuccgccaccauc

SEQ ID NO: 1340127 - RNA, 14 nt, Mycobacterium tuberculosis H37Rv
cagagacagcgcca

SEQ ID NO: 1340128 - RNA, 16 nt, Mycobacterium tuberculosis H37Rv
cagaccaccgccugga

SEQ ID NO: 1340129 - RNA, 12 nt, Mycobacterium tuberculosis H37Rv
cagaccacaacg

SEQ ID NO: 1340130 - RNA, 12 nt, Mycobacterium tuberculosis H37Rv
cagaccaccgug

SEQ ID NO: 1340131 - RNA, 12 nt, Mycobacterium tuberculosis H37Rv
cagaccagacug

SEQ ID NO: 1340132 - RNA, 18 nt, Mycobacterium tuberculosis H37Rv
cagaccagggcagcggcc

SEQ ID NO: 1340133 - RNA, 18 nt, Mycobacterium tuberculosis H37Rv
cagacgcaaaaucgccca

SEQ ID NO: 1340134 - RNA, 22 nt, Mycobacterium tuberculosis H37Rv
cagacgcggaaucgcaccgugu

SEQ ID NO: 1340135 - RNA, 20 nt, Mycobacterium tuberculosis H37Rv
cagacgcucuugaauaggaa

SEQ ID NO: 1340136 - RNA, 19 nt, Mycobacterium tuberculosis H37Rv
cagacgcugccaagcgacc

SEQ ID NO: 1340137 - RNA, 18 nt, Mycobacterium tuberculosis H37Rv
cagacgccgcguuucccg

SEQ ID NO: 1340138 - RNA, 15 nt, Mycobacterium tuberculosis H37Rv
cagacgccccuuccc

SEQ ID NO: 1340139 - RNA, 13 nt, Mycobacterium tuberculosis H37Rv
cagacgauucggc

SEQ ID NO: 1340140 - RNA, 24 nt, Mycobacterium tuberculosis H37Rv
cagacguuccaucacggaccaggc

SEQ ID NO: 1340141 - RNA, 23 nt, Mycobacterium tuberculosis H37Rv
cagcaagccagcaucggcagcag

SEQ ID NO: 1340142 - RNA, 14 nt, Mycobacterium tuberculosis H37Rv
cagcacaaacccag

SEQ ID NO: 1340143 - RNA, 11 nt, Mycobacterium tuberculosis H37Rv
cagcaagccgc

SEQ ID NO: 1340144 - RNA, 15 nt, Mycobacterium tuberculosis H37Rv
cagcaacgcggugcc

SEQ ID NO: 1340145 - RNA, 20 nt, Mycobacterium tuberculosis H37Rv
aaaaugacccacacaccgag

SEQ ID NO: 1340146 - RNA, 16 nt, Mycobacterium tuberculosis H37Rv
cagcaacgacauccag

SEQ ID NO: 1340147 - RNA, 16 nt, Mycobacterium tuberculosis H37Rv
cagcacccggccaccg

SEQ ID NO: 1340148 - RNA, 16 nt, Mycobacterium tuberculosis H37Rv
cagcacccgggccacg

SEQ ID NO: 1340149 - RNA, 15 nt, Mycobacterium tuberculosis H37Rv
cagcaccgcgacgac

SEQ ID NO: 1340150 - RNA, 18 nt, Mycobacterium tuberculosis H37Rv
cagcacccgggccuggga

SEQ ID NO: 1340151 - RNA, 16 nt, Mycobacterium tuberculosis H37Rv
cagcaccccauggcca

SEQ ID NO: 1340152 - RNA, 19 nt, Mycobacterium tuberculosis H37Rv
cagcaccccauggccaccg

SEQ ID NO: 1340153 - RNA, 13 nt, Mycobacterium tuberculosis H37Rv
cagcacccacauc

SEQ ID NO: 1340154 - RNA, 16 nt, Mycobacterium tuberculosis H37Rv
cagcacccacaucagc

SEQ ID NO: 1340155 - RNA, 22 nt, Mycobacterium tuberculosis H37Rv
cagcacccacgccgguggcacg

SEQ ID NO: 1340156 - RNA, 13 nt, Mycobacterium tuberculosis H37Rv
cagcacccgcagc

SEQ ID NO: 1340157 - RNA, 14 nt, Mycobacterium tuberculosis H37Rv
cagcacccgcagcc

SEQ ID NO: 1340158 - RNA, 20 nt, Mycobacterium tuberculosis H37Rv
cagcacacugucgauuugau

SEQ ID NO: 1340159 - RNA, 21 nt, Mycobacterium tuberculosis H37Rv
cagcacagcauuguccggcgu

SEQ ID NO: 1340160 - RNA, 16 nt, Mycobacterium tuberculosis H37Rv
cagcacagcgcagccu

SEQ ID NO: 1340161 - RNA, 19 nt, Mycobacterium tuberculosis H37Rv
cagcacagcgcagccugca

SEQ ID NO: 1340162 - RNA, 13 nt, Mycobacterium tuberculosis H37Rv
cagcacaggcugg

SEQ ID NO: 1340163 - RNA, 14 nt, Mycobacterium tuberculosis H37Rv
cagcacaggcuggc

SEQ ID NO: 1340164 - RNA, 16 nt, Mycobacterium tuberculosis H37Rv
cagcacaggcuggcga

SEQ ID NO: 1340165 - RNA, 20 nt, Mycobacterium tuberculosis H37Rv
cagcacaggcuggcgauggc

SEQ ID NO: 1340166 - RNA, 17 nt, Mycobacterium tuberculosis H37Rv
cagcacccaacccggcg

SEQ ID NO: 1340167 - RNA, 18 nt, Mycobacterium tuberculosis H37Rv
cagcacccaaugccaccg

SEQ ID NO: 1340168 - RNA, 20 nt, Mycobacterium tuberculosis H37Rv
cagcacccaaugccaccgcg

SEQ ID NO: 1340169 - RNA, 16 nt, Mycobacterium tuberculosis H37Rv
cagcacgauccagcug

SEQ ID NO: 1340170 - RNA, 13 nt, Mycobacterium tuberculosis H37Rv
cagcacgccaggc

SEQ ID NO: 1340171 - RNA, 22 nt, Mycobacterium tuberculosis H37Rv
cagcaccgucggcaccagcagc

SEQ ID NO: 1340172 - RNA, 20 nt, Mycobacterium tuberculosis H37Rv
cagcaccgucggcaccagca

SEQ ID NO: 1340173 - RNA, 22 nt, Mycobacterium tuberculosis H37Rv
cagcaccgucgggcccagccgg

SEQ ID NO: 1340174 - RNA, 14 nt, Mycobacterium tuberculosis H37Rv
cagcaccguccucg

SEQ ID NO: 1340175 - RNA, 22 nt, Mycobacterium tuberculosis H37Rv
cagcaccggcgcgggcacgccc

SEQ ID NO: 1340176 - RNA, 19 nt, Mycobacterium tuberculosis H37Rv
cagcacuuccaagccgacc

SEQ ID NO: 1340177 - RNA, 15 nt, Mycobacterium tuberculosis H37Rv
cagcagaaacaucga

SEQ ID NO: 1340178 - RNA, 18 nt, Mycobacterium tuberculosis H37Rv
cagcacuuggacccggcc

SEQ ID NO: 1340179 - RNA, 22 nt, Mycobacterium tuberculosis H37Rv
cagcacuuggacccggccggcc

SEQ ID NO: 1340180 - RNA, 14 nt, Mycobacterium tuberculosis H37Rv
cagaucgaggggga

SEQ ID NO: 1340181 - RNA, 14 nt, Mycobacterium tuberculosis H37Rv
cagaucgccccagc

SEQ ID NO: 1340182 - RNA, 18 nt, Mycobacterium tuberculosis H37Rv
cagaucgcgguccgagcg

SEQ ID NO: 1340183 - RNA, 14 nt, Mycobacterium tuberculosis H37Rv
cagaucguccaccg

SEQ ID NO: 1340184 - RNA, 22 nt, Mycobacterium tuberculosis H37Rv
cagaucggccggauacgggcug

SEQ ID NO: 1340185 - RNA, 20 nt, Mycobacterium tuberculosis H37Rv
cagaucgacgcauuccucga

SEQ ID NO: 1340186 - RNA, 20 nt, Mycobacterium tuberculosis H37Rv
cagaucgaagcgcagcaccu

SEQ ID NO: 1340187 - RNA, 16 nt, Mycobacterium tuberculosis H37Rv
cagauaaggaucagaa

SEQ ID NO: 1340188 - RNA, 12 nt, Mycobacterium tuberculosis H37Rv
cagagugaaucc

SEQ ID NO: 1340189 - RNA, 18 nt, Mycobacterium tuberculosis H37Rv
cagaugccgggcugaggc

SEQ ID NO: 1340190 - RNA, 15 nt, Mycobacterium tuberculosis H37Rv
cagaugcccagcagg

SEQ ID NO: 1340191 - RNA, 22 nt, Mycobacterium tuberculosis H37Rv
cagaugcaccucgcccugcaga

SEQ ID NO: 1340192 - RNA, 17 nt, Mycobacterium tuberculosis H37Rv
cagaucuuucuugcugu

SEQ ID NO: 1340193 - RNA, 21 nt, Mycobacterium tuberculosis H37Rv
cagaucuccagguuccagguc

SEQ ID NO: 1340194 - RNA, 17 nt, Mycobacterium tuberculosis H37Rv
cagaugcggcccgggcu

SEQ ID NO: 1340195 - RNA, 17 nt, Mycobacterium tuberculosis H37Rv
cagaugcauccagcugc

SEQ ID NO: 1340196 - RNA, 14 nt, Mycobacterium tuberculosis H37Rv
cagauggccacccg

SEQ ID NO: 1340197 - RNA, 12 nt, Mycobacterium tuberculosis H37Rv
cagauggugaac

SEQ ID NO: 1340198 - RNA, 21 nt, Mycobacterium tuberculosis H37Rv
cagcaaaacccgagccuggau

SEQ ID NO: 1340199 - RNA, 20 nt, Mycobacterium tuberculosis H37Rv
cagcaaaacccgagccugga

SEQ ID NO: 1340200 - RNA, 15 nt, Mycobacterium tuberculosis H37Rv
cagauuugcuccagc

SEQ ID NO: 1340201 - RNA, 16 nt, Mycobacterium tuberculosis H37Rv
cagauugucgcugaau

SEQ ID NO: 1340202 - RNA, 15 nt, Mycobacterium tuberculosis H37Rv
cagauuucauugucc

SEQ ID NO: 1340203 - RNA, 13 nt, Mycobacterium tuberculosis H37Rv
uuugugucugcuc

SEQ ID NO: 1340204 - RNA, 16 nt, Mycobacterium tuberculosis H37Rv
uuugucgccuucuugg

SEQ ID NO: 1340205 - RNA, 15 nt, Mycobacterium tuberculosis H37Rv
uuugucgccuucuug

SEQ ID NO: 1340206 - RNA, 14 nt, Mycobacterium tuberculosis H37Rv
uuuggcgccgccga

SEQ ID NO: 1340207 - RNA, 15 nt, Mycobacterium tuberculosis H37Rv
uuuggccgccguggc

SEQ ID NO: 1340208 - RNA, 20 nt, Mycobacterium tuberculosis H37Rv
uuuggcgaguucguguugcu

SEQ ID NO: 1340209 - RNA, 12 nt, Mycobacterium tuberculosis H37Rv
uuugguggcugg

SEQ ID NO: 1340210 - RNA, 23 nt, Mycobacterium tuberculosis H37Rv
uuuggugguuucacauuuuuguu

SEQ ID NO: 1340211 - RNA, 22 nt, Mycobacterium tuberculosis H37Rv
uuugguugcccgcauugccaac

SEQ ID NO: 1340212 - RNA, 15 nt, Mycobacterium tuberculosis H37Rv
uuuucggcggcucua

SEQ ID NO: 1340213 - RNA, 15 nt, Mycobacterium tuberculosis H37Rv
uuuuacgucugcucg

SEQ ID NO: 1340214 - RNA, 15 nt, Mycobacterium tuberculosis H37Rv
uuucgucgucgcagu

SEQ ID NO: 1340215 - RNA, 23 nt, Mycobacterium tuberculosis H37Rv
uuucguugggagaguguugaucu

SEQ ID NO: 1340216 - RNA, 12 nt, Mycobacterium tuberculosis H37Rv
uuucggcugccg

SEQ ID NO: 1340217 - RNA, 19 nt, Mycobacterium tuberculosis H37Rv
uuucgcgugcggcugccag

SEQ ID NO: 1340218 - RNA, 19 nt, Mycobacterium tuberculosis H37Rv
uuuccgccggccaggugac

SEQ ID NO: 1340219 - RNA, 20 nt, Mycobacterium tuberculosis H37Rv
uuucgccagcugacacccgc

SEQ ID NO: 1340220 - RNA, 16 nt, Mycobacterium tuberculosis H37Rv
uuucgauauagccgcc

SEQ ID NO: 1340221 - RNA, 16 nt, Mycobacterium tuberculosis H37Rv
uuuccuugcgcgccau

SEQ ID NO: 1340222 - RNA, 14 nt, Mycobacterium tuberculosis H37Rv
uuuccuugcgcgcc

SEQ ID NO: 1340223 - RNA, 21 nt, Mycobacterium tuberculosis H37Rv
uuugcacgcaccacaauccac

SEQ ID NO: 1340224 - RNA, 22 nt, Mycobacterium tuberculosis H37Rv
uuugccggaggaucgcugguug

SEQ ID NO: 1340225 - RNA, 11 nt, Mycobacterium tuberculosis H37Rv
uuugccgccgg

SEQ ID NO: 1340226 - RNA, 13 nt, Mycobacterium tuberculosis H37Rv
uuugagaacaacg

SEQ ID NO: 1340227 - RNA, 20 nt, Mycobacterium tuberculosis H37Rv
uuugacguccagggccacga

SEQ ID NO: 1340228 - RNA, 16 nt, Mycobacterium tuberculosis H37Rv
uuugaccaccugguuu

SEQ ID NO: 1340229 - RNA, 16 nt, Mycobacterium tuberculosis H37Rv
uuucaccaccguggcc

SEQ ID NO: 1340230 - RNA, 19 nt, Mycobacterium tuberculosis H37Rv
uuuccacaccagcuuguag

SEQ ID NO: 1340231 - RNA, 19 nt, Mycobacterium tuberculosis H37Rv
uuuagcaacuacucaucca

SEQ ID NO: 1340232 - RNA, 15 nt, Mycobacterium tuberculosis H37Rv
uugcgcgcugagcuc

SEQ ID NO: 1340233 - RNA, 21 nt, Mycobacterium tuberculosis H37Rv
uugcgcuacuacugcaguccc

SEQ ID NO: 1340234 - RNA, 13 nt, Mycobacterium tuberculosis H37Rv
uugcgcucauccg

SEQ ID NO: 1340235 - RNA, 19 nt, Mycobacterium tuberculosis H37Rv
uugcgagugagcucagcaa

SEQ ID NO: 1340236 - RNA, 12 nt, Mycobacterium tuberculosis H37Rv
uugcgccgccaa

SEQ ID NO: 1340237 - RNA, 13 nt, Mycobacterium tuberculosis H37Rv
uugcgaagcccac

SEQ ID NO: 1340238 - RNA, 17 nt, Mycobacterium tuberculosis H37Rv
uugccuuguuccagcgc

SEQ ID NO: 1340239 - RNA, 15 nt, Mycobacterium tuberculosis H37Rv
uugccgccagcccca

SEQ ID NO: 1340240 - RNA, 23 nt, Mycobacterium tuberculosis H37Rv
uugccgccgucgccgccguugcc

SEQ ID NO: 1340241 - RNA, 15 nt, Mycobacterium tuberculosis H37Rv
uugccgccuuggccc

SEQ ID NO: 1340242 - RNA, 19 nt, Mycobacterium tuberculosis H37Rv
uugccgccggucaucccaa

SEQ ID NO: 1340243 - RNA, 10 nt, Mycobacterium tuberculosis H37Rv
uugccgccgu

SEQ ID NO: 1340244 - RNA, 18 nt, Mycobacterium tuberculosis H37Rv
uugccgccgucaccgccg

SEQ ID NO: 1340245 - RNA, 23 nt, Mycobacterium tuberculosis H37Rv
uugccgccgucaccgccguugcc

SEQ ID NO: 1340246 - RNA, 10 nt, Mycobacterium tuberculosis H37Rv
uugccgccgc

SEQ ID NO: 1340247 - RNA, 13 nt, Mycobacterium tuberculosis H37Rv
uugccgccgacgc

SEQ ID NO: 1340248 - RNA, 17 nt, Mycobacterium tuberculosis H37Rv
uugccgccaucaccgcc

SEQ ID NO: 1340249 - RNA, 14 nt, Mycobacterium tuberculosis H37Rv
uugccaaagcccac

SEQ ID NO: 1340250 - RNA, 20 nt, Mycobacterium tuberculosis H37Rv
uugccaacgaaccgcucagc

SEQ ID NO: 1340251 - RNA, 13 nt, Mycobacterium tuberculosis H37Rv
uugccaaagccca

SEQ ID NO: 1340252 - RNA, 22 nt, Mycobacterium tuberculosis H37Rv
uugccgaaguuuuggaagcccg

SEQ ID NO: 1340253 - RNA, 13 nt, Mycobacterium tuberculosis H37Rv
uugccgaagcccg

SEQ ID NO: 1340254 - RNA, 17 nt, Mycobacterium tuberculosis H37Rv
uugccgagcccaggugg

SEQ ID NO: 1340255 - RNA, 17 nt, Mycobacterium tuberculosis H37Rv
uugccgaccgucacuga

SEQ ID NO: 1340256 - RNA, 22 nt, Mycobacterium tuberculosis H37Rv
uugccgaucaaccccccgggcc

SEQ ID NO: 1340257 - RNA, 15 nt, Mycobacterium tuberculosis H37Rv
uugccgauccccagg

SEQ ID NO: 1340258 - RNA, 21 nt, Mycobacterium tuberculosis H37Rv
uugccgcaccagucgcgcagc

SEQ ID NO: 1340259 - RNA, 23 nt, Mycobacterium tuberculosis H37Rv
uugcccguguuaaagaagccuga

SEQ ID NO: 1340260 - RNA, 23 nt, Mycobacterium tuberculosis H37Rv
uugcccgguuguggaaccacggc

SEQ ID NO: 1340261 - RNA, 13 nt, Mycobacterium tuberculosis H37Rv
uugcaucaugccg

SEQ ID NO: 1340262 - RNA, 16 nt, Mycobacterium tuberculosis H37Rv
uugcacugcugguuga

SEQ ID NO: 1340263 - RNA, 17 nt, Mycobacterium tuberculosis H37Rv
uugcacuguggaagaac

SEQ ID NO: 1340264 - RNA, 11 nt, Mycobacterium tuberculosis H37Rv
uugcagcagca

SEQ ID NO: 1340265 - RNA, 16 nt, Mycobacterium tuberculosis H37Rv
uugcugcgcagcggca

SEQ ID NO: 1340266 - RNA, 22 nt, Mycobacterium tuberculosis H37Rv
uugcugaucagagcguucuuca

SEQ ID NO: 1340267 - RNA, 16 nt, Mycobacterium tuberculosis H37Rv
uuggcagggccagcgg

SEQ ID NO: 1340268 - RNA, 18 nt, Mycobacterium tuberculosis H37Rv
uuggcagggccagcggca

SEQ ID NO: 1340269 - RNA, 23 nt, Mycobacterium tuberculosis H37Rv
uuggcagcaaaaacgcugccgcc

SEQ ID NO: 1340270 - RNA, 15 nt, Mycobacterium tuberculosis H37Rv
uuggcagcccucugg

SEQ ID NO: 1340271 - RNA, 13 nt, Mycobacterium tuberculosis H37Rv
uuggccaccgccg

SEQ ID NO: 1340272 - RNA, 14 nt, Mycobacterium tuberculosis H37Rv
uuggcgaagcccga

SEQ ID NO: 1340273 - RNA, 13 nt, Mycobacterium tuberculosis H37Rv
uuggcgaucucga

SEQ ID NO: 1340274 - RNA, 15 nt, Mycobacterium tuberculosis H37Rv
uuggcgcgcagguag

SEQ ID NO: 1340275 - RNA, 13 nt, Mycobacterium tuberculosis H37Rv
uuggcgaucagca

SEQ ID NO: 1340276 - RNA, 18 nt, Mycobacterium tuberculosis H37Rv
uuggcucccuuuuccaaa

SEQ ID NO: 1340277 - RNA, 16 nt, Mycobacterium tuberculosis H37Rv
uuggcguugaccagca

SEQ ID NO: 1340278 - RNA, 19 nt, Mycobacterium tuberculosis H37Rv
uuggcguagcaacccagga

SEQ ID NO: 1340279 - RNA, 18 nt, Mycobacterium tuberculosis H37Rv
uuggcgggagcaccgacc

SEQ ID NO: 1340280 - RNA, 23 nt, Mycobacterium tuberculosis H37Rv
uuggcgucacguaauuccccagg

SEQ ID NO: 1340281 - RNA, 19 nt, Mycobacterium tuberculosis H37Rv
uuggcgguaaaccacucgc

SEQ ID NO: 1340282 - RNA, 18 nt, Mycobacterium tuberculosis H37Rv
uuggcggugaacaccgcc

SEQ ID NO: 1340283 - RNA, 22 nt, Mycobacterium tuberculosis H37Rv
uuggcggcggugcagcagggcg

SEQ ID NO: 1340284 - RNA, 18 nt, Mycobacterium tuberculosis H37Rv
uuggugggccagcagcaa

SEQ ID NO: 1340285 - RNA, 16 nt, Mycobacterium tuberculosis H37Rv
uugguaguccugcuug

SEQ ID NO: 1340286 - RNA, 22 nt, Mycobacterium tuberculosis H37Rv
uugggcuuagggcgcccgcccc

SEQ ID NO: 1340287 - RNA, 21 nt, Mycobacterium tuberculosis H37Rv
uugggcgcgggugcgccggcg

SEQ ID NO: 1340288 - RNA, 16 nt, Mycobacterium tuberculosis H37Rv
uuguuuuugcacugaa

SEQ ID NO: 1340289 - RNA, 14 nt, Mycobacterium tuberculosis H37Rv
uugugcugggugcc

SEQ ID NO: 1340290 - RNA, 18 nt, Mycobacterium tuberculosis H37Rv
uugugcgggcuccaugcc

SEQ ID NO: 1340291 - RNA, 14 nt, Mycobacterium tuberculosis H37Rv
uuguggccagcgcu

SEQ ID NO: 1340292 - RNA, 15 nt, Mycobacterium tuberculosis H37Rv
uuguggcguguggcu

SEQ ID NO: 1340293 - RNA, 18 nt, Mycobacterium tuberculosis H37Rv
uugugcgcacucuuuccu

SEQ ID NO: 1340294 - RNA, 20 nt, Mycobacterium tuberculosis H37Rv
uugucgguaggugucaauga

SEQ ID NO: 1340295 - RNA, 21 nt, Mycobacterium tuberculosis H37Rv
uugucuagcggucgcuugcug

SEQ ID NO: 1340296 - RNA, 17 nt, Mycobacterium tuberculosis H37Rv
uugucucgcaucggccu

SEQ ID NO: 1340297 - RNA, 23 nt, Mycobacterium tuberculosis H37Rv
uugucgccggcauacaccgugac

SEQ ID NO: 1340298 - RNA, 13 nt, Mycobacterium tuberculosis H37Rv
uugucgcgcagca

SEQ ID NO: 1340299 - RNA, 16 nt, Mycobacterium tuberculosis H37Rv
uuguaugcugcgcgcc

SEQ ID NO: 1340300 - RNA, 19 nt, Mycobacterium tuberculosis H37Rv
uugucaggauauuucuaaa

SEQ ID NO: 1340301 - RNA, 13 nt, Mycobacterium tuberculosis H37Rv
uuguccagcgucu

SEQ ID NO: 1340302 - RNA, 11 nt, Mycobacterium tuberculosis H37Rv
uugaccaccag

SEQ ID NO: 1340303 - RNA, 13 nt, Mycobacterium tuberculosis H37Rv
uugacagacacag

SEQ ID NO: 1340304 - RNA, 15 nt, Mycobacterium tuberculosis H37Rv
uucuuuaaaccccug

SEQ ID NO: 1340305 - RNA, 17 nt, Mycobacterium tuberculosis H37Rv
uugaaaacgcccggcac

SEQ ID NO: 1340306 - RNA, 15 nt, Mycobacterium tuberculosis H37Rv
uugacugcugggggu

SEQ ID NO: 1340307 - RNA, 21 nt, Mycobacterium tuberculosis H37Rv
uugaccgccgacaccacggcg

SEQ ID NO: 1340308 - RNA, 15 nt, Mycobacterium tuberculosis H37Rv
uugacguccagggcc

SEQ ID NO: 1340309 - RNA, 15 nt, Mycobacterium tuberculosis H37Rv
uugaccgauacgcgg

SEQ ID NO: 1340310 - RNA, 13 nt, Mycobacterium tuberculosis H37Rv
uugacccacagca

SEQ ID NO: 1340311 - RNA, 11 nt, Mycobacterium tuberculosis H37Rv
uugacugaacu

SEQ ID NO: 1340312 - RNA, 13 nt, Mycobacterium tuberculosis H37Rv
uugaggaagcccg

SEQ ID NO: 1340313 - RNA, 14 nt, Mycobacterium tuberculosis H37Rv
uugaggccggugaa

SEQ ID NO: 1340314 - RNA, 13 nt, Mycobacterium tuberculosis H37Rv
uugcacagcggca

SEQ ID NO: 1340315 - RNA, 19 nt, Mycobacterium tuberculosis H37Rv
uugcacaccggcacugccc

SEQ ID NO: 1340316 - RNA, 20 nt, Mycobacterium tuberculosis H37Rv
uugcacaccggcacugccca

SEQ ID NO: 1340317 - RNA, 16 nt, Mycobacterium tuberculosis H37Rv
uugaucaccguggugg

SEQ ID NO: 1340318 - RNA, 18 nt, Mycobacterium tuberculosis H37Rv
uucugcgucugcucgcca

SEQ ID NO: 1340319 - RNA, 13 nt, Mycobacterium tuberculosis H37Rv
uucugccuuggcc

SEQ ID NO: 1340320 - RNA, 14 nt, Mycobacterium tuberculosis H37Rv
uucuucggacagca

SEQ ID NO: 1340321 - RNA, 24 nt, Mycobacterium tuberculosis H37Rv
uucuucgcgaagaacgacgccacc

SEQ ID NO: 1340322 - RNA, 17 nt, Mycobacterium tuberculosis H37Rv
uucuucgcuaccuucuu

SEQ ID NO: 1340323 - RNA, 12 nt, Mycobacterium tuberculosis H37Rv
uucuccaggcug

SEQ ID NO: 1340324 - RNA, 17 nt, Mycobacterium tuberculosis H37Rv
uucuccagauccacgcc

SEQ ID NO: 1340325 - RNA, 22 nt, Mycobacterium tuberculosis H37Rv
uucggucagggugggcucguug

SEQ ID NO: 1340326 - RNA, 17 nt, Mycobacterium tuberculosis H37Rv
uucggguugggcaucag

SEQ ID NO: 1340327 - RNA, 21 nt, Mycobacterium tuberculosis H37Rv
uucggguccagcggccgccgc

SEQ ID NO: 1340328 - RNA, 15 nt, Mycobacterium tuberculosis H37Rv
uucggggugcgccca

SEQ ID NO: 1340329 - RNA, 18 nt, Mycobacterium tuberculosis H37Rv
uucgggcucguccagcaa

SEQ ID NO: 1340330 - RNA, 17 nt, Mycobacterium tuberculosis H37Rv
uucgggcugccaggagc

SEQ ID NO: 1340331 - RNA, 14 nt, Mycobacterium tuberculosis H37Rv
uuaucagcaagagc

SEQ ID NO: 1340332 - RNA, 14 nt, Mycobacterium tuberculosis H37Rv
uucggcggcugcca

SEQ ID NO: 1340333 - RNA, 17 nt, Mycobacterium tuberculosis H37Rv
uucggcgccucguugcc

SEQ ID NO: 1340334 - RNA, 22 nt, Mycobacterium tuberculosis H37Rv
uucggcgaccggccggccgcgg

SEQ ID NO: 1340335 - RNA, 23 nt, Mycobacterium tuberculosis H37Rv
uucggcgaggacggcggccagga

SEQ ID NO: 1340336 - RNA, 20 nt, Mycobacterium tuberculosis H37Rv
uucggucgggggcagcgccu

SEQ ID NO: 1340337 - RNA, 21 nt, Mycobacterium tuberculosis H37Rv
uucguauggacgaggagcuca

SEQ ID NO: 1340338 - RNA, 14 nt, Mycobacterium tuberculosis H37Rv
uucguugagaacau

SEQ ID NO: 1340339 - RNA, 13 nt, Mycobacterium tuberculosis H37Rv
ugaauugcgcgcc

SEQ ID NO: 1340340 - RNA, 14 nt, Mycobacterium tuberculosis H37Rv
ugacacccaccucg

SEQ ID NO: 1340341 - RNA, 17 nt, Mycobacterium tuberculosis H37Rv
ugacacccaccucgcca

SEQ ID NO: 1340342 - RNA, 21 nt, Mycobacterium tuberculosis H37Rv
ugaaucgcgucgagagaacgu

SEQ ID NO: 1340343 - RNA, 13 nt, Mycobacterium tuberculosis H37Rv
ugacaguccccag

SEQ ID NO: 1340344 - RNA, 22 nt, Mycobacterium tuberculosis H37Rv
ugaccaacgucgcuccgaugug

SEQ ID NO: 1340345 - RNA, 21 nt, Mycobacterium tuberculosis H37Rv
ugaccacaaccgugagcacca

SEQ ID NO: 1340346 - RNA, 20 nt, Mycobacterium tuberculosis H37Rv
ugaccaccgggcgcugcuug

SEQ ID NO: 1340347 - RNA, 22 nt, Mycobacterium tuberculosis H37Rv
ugaccacgaacgcgcgcagccg

SEQ ID NO: 1340348 - RNA, 17 nt, Mycobacterium tuberculosis H37Rv
ugaccacgcugcuggug

SEQ ID NO: 1340349 - RNA, 23 nt, Mycobacterium tuberculosis H37Rv
ugacagggcggcaaccucaugca

SEQ ID NO: 1340350 - RNA, 17 nt, Mycobacterium tuberculosis H37Rv
ugacagcccgcuggccg

SEQ ID NO: 1340351 - RNA, 21 nt, Mycobacterium tuberculosis H37Rv
ugacaccgaaccgccgcugcc

SEQ ID NO: 1340352 - RNA, 20 nt, Mycobacterium tuberculosis H37Rv
ugacaccgaggucggccagc

SEQ ID NO: 1340353 - RNA, 20 nt, Mycobacterium tuberculosis H37Rv
ugacacgacgugcaggaaca

SEQ ID NO: 1340354 - RNA, 24 nt, Mycobacterium tuberculosis H37Rv
ugaccggcgauuccaccuuggcca

SEQ ID NO: 1340355 - RNA, 14 nt, Mycobacterium tuberculosis H37Rv
ugaccgggcaggua

SEQ ID NO: 1340356 - RNA, 18 nt, Mycobacterium tuberculosis H37Rv
ugaccgguucccgggcag

SEQ ID NO: 1340357 - RNA, 21 nt, Mycobacterium tuberculosis H37Rv
ugacccacgagagcgcugucc

SEQ ID NO: 1340358 - RNA, 17 nt, Mycobacterium tuberculosis H37Rv
ugacccauucucggccg

SEQ ID NO: 1340359 - RNA, 19 nt, Mycobacterium tuberculosis H37Rv
ugacccauggucaccagcu

SEQ ID NO: 1340360 - RNA, 15 nt, Mycobacterium tuberculosis H37Rv
ugacccacugcaggc

SEQ ID NO: 1340361 - RNA, 21 nt, Mycobacterium tuberculosis H37Rv
ugaccucuucgggcagcgcgu

SEQ ID NO: 1340362 - RNA, 19 nt, Mycobacterium tuberculosis H37Rv
ugaccucgugguucugcag

SEQ ID NO: 1340363 - RNA, 15 nt, Mycobacterium tuberculosis H37Rv
ugaccucggugaaga

SEQ ID NO: 1340364 - RNA, 15 nt, Mycobacterium tuberculosis H37Rv
ugaccugcagcgcau

SEQ ID NO: 1340365 - RNA, 12 nt, Mycobacterium tuberculosis H37Rv
ugacgaugccgc

SEQ ID NO: 1340366 - RNA, 21 nt, Mycobacterium tuberculosis H37Rv
ugacgaugguguacugcugcu

SEQ ID NO: 1340367 - RNA, 19 nt, Mycobacterium tuberculosis H37Rv
ugacgaucagcgugaucug

SEQ ID NO: 1340368 - RNA, 19 nt, Mycobacterium tuberculosis H37Rv
ugacgaguucgcgcaucaa

SEQ ID NO: 1340369 - RNA, 21 nt, Mycobacterium tuberculosis H37Rv
ugacucgaucaccaugaugua

SEQ ID NO: 1340370 - RNA, 14 nt, Mycobacterium tuberculosis H37Rv
ugacuccgcgcgcg

SEQ ID NO: 1340371 - RNA, 17 nt, Mycobacterium tuberculosis H37Rv
ugacucggccuccgccg

SEQ ID NO: 1340372 - RNA, 17 nt, Mycobacterium tuberculosis H37Rv
ugagccggucuugcauc

SEQ ID NO: 1340373 - RNA, 15 nt, Mycobacterium tuberculosis H37Rv
ugagccgguggcccg

SEQ ID NO: 1340374 - RNA, 16 nt, Mycobacterium tuberculosis H37Rv
ugagccgggaucgaag

SEQ ID NO: 1340375 - RNA, 17 nt, Mycobacterium tuberculosis H37Rv
ugagcagcuuagucagg

SEQ ID NO: 1340376 - RNA, 15 nt, Mycobacterium tuberculosis H37Rv
ugagccaugccgcuc

SEQ ID NO: 1340377 - RNA, 15 nt, Mycobacterium tuberculosis H37Rv
ugagccgcagcaccu

SEQ ID NO: 1340378 - RNA, 21 nt, Mycobacterium tuberculosis H37Rv
ugagcccgggauaccgcucag

SEQ ID NO: 1340379 - RNA, 16 nt, Mycobacterium tuberculosis H37Rv
ugagccccccgagccc

SEQ ID NO: 1340380 - RNA, 20 nt, Mycobacterium tuberculosis H37Rv
ugagccccccgagcccgcca

SEQ ID NO: 1340381 - RNA, 12 nt, Mycobacterium tuberculosis H37Rv
ugagcaccagca

SEQ ID NO: 1340382 - RNA, 15 nt, Mycobacterium tuberculosis H37Rv
ugagcaccagcagca

SEQ ID NO: 1340383 - RNA, 18 nt, Mycobacterium tuberculosis H37Rv
ugagcaaaauggccaccg

SEQ ID NO: 1340384 - RNA, 22 nt, Mycobacterium tuberculosis H37Rv
ugagcacgcgcaacucgccacg

SEQ ID NO: 1340385 - RNA, 16 nt, Mycobacterium tuberculosis H37Rv
ugagcaccagcagcac

SEQ ID NO: 1340386 - RNA, 20 nt, Mycobacterium tuberculosis H37Rv
ugagcaccagcagcaccaac

SEQ ID NO: 1340387 - RNA, 19 nt, Mycobacterium tuberculosis H37Rv
ugagcagcgggacauccag

SEQ ID NO: 1340388 - RNA, 18 nt, Mycobacterium tuberculosis H37Rv
ugagcagacgcaaaagaa

SEQ ID NO: 1340389 - RNA, 20 nt, Mycobacterium tuberculosis H37Rv
ugagaucgcccgaguugaag

SEQ ID NO: 1340390 - RNA, 18 nt, Mycobacterium tuberculosis H37Rv
ugagauugguggcccggg

SEQ ID NO: 1340391 - RNA, 13 nt, Mycobacterium tuberculosis H37Rv
ugagaagaagccc

SEQ ID NO: 1340392 - RNA, 12 nt, Mycobacterium tuberculosis H37Rv
ugagaagaagcc

SEQ ID NO: 1340393 - RNA, 19 nt, Mycobacterium tuberculosis H37Rv
ugagaucaugaggugagcu

SEQ ID NO: 1340394 - RNA, 20 nt, Mycobacterium tuberculosis H37Rv
ugagaucaugaggugagcug

SEQ ID NO: 1340395 - RNA, 22 nt, Mycobacterium tuberculosis H37Rv
ugaggccggugaacggcagcac

SEQ ID NO: 1340396 - RNA, 20 nt, Mycobacterium tuberculosis H37Rv
ugagggugagccgagccagc

SEQ ID NO: 1340397 - RNA, 20 nt, Mycobacterium tuberculosis H37Rv
ugagguaauucgcggcccga

SEQ ID NO: 1340398 - RNA, 15 nt, Mycobacterium tuberculosis H37Rv
ugagguagccgaggu

SEQ ID NO: 1340399 - RNA, 18 nt, Mycobacterium tuberculosis H37Rv
ugagguaggugagcgcgc

SEQ ID NO: 1340400 - RNA, 16 nt, Mycobacterium tuberculosis H37Rv
ugagguaggggcaggc

SEQ ID NO: 1340401 - RNA, 18 nt, Mycobacterium tuberculosis H37Rv
ugagguagccgaggucgc

SEQ ID NO: 1340402 - RNA, 21 nt, Mycobacterium tuberculosis H37Rv
ugagggcgucgucgaguuggc

SEQ ID NO: 1340403 - RNA, 17 nt, Mycobacterium tuberculosis H37Rv
ugaggugaucggaagaa

SEQ ID NO: 1340404 - RNA, 21 nt, Mycobacterium tuberculosis H37Rv
ugagucuuucccgccaccaaa

SEQ ID NO: 1340405 - RNA, 14 nt, Mycobacterium tuberculosis H37Rv
ugaguagguccacg

SEQ ID NO: 1340406 - RNA, 14 nt, Mycobacterium tuberculosis H37Rv
ugaggaucagcgug

SEQ ID NO: 1340407 - RNA, 19 nt, Mycobacterium tuberculosis H37Rv
ugaggaucccggccggguc

SEQ ID NO: 1340408 - RNA, 21 nt, Mycobacterium tuberculosis H37Rv
ugaggaucccggccgggucga

SEQ ID NO: 1340409 - RNA, 16 nt, Mycobacterium tuberculosis H37Rv
ugagcuuccgcgcgca

SEQ ID NO: 1340410 - RNA, 16 nt, Mycobacterium tuberculosis H37Rv
ugagcuuuaucugcau

SEQ ID NO: 1340411 - RNA, 19 nt, Mycobacterium tuberculosis H37Rv
ugagcuugguggccaccac

SEQ ID NO: 1340412 - RNA, 16 nt, Mycobacterium tuberculosis H37Rv
ugagcgugagcgccgc

SEQ ID NO: 1340413 - RNA, 17 nt, Mycobacterium tuberculosis H37Rv
ugagcgguaccccccag

SEQ ID NO: 1340414 - RNA, 19 nt, Mycobacterium tuberculosis H37Rv
ugagcguaguaggcagccu

SEQ ID NO: 1340415 - RNA, 19 nt, Mycobacterium tuberculosis H37Rv
ugagcgggcaacugcagca

SEQ ID NO: 1340416 - RNA, 22 nt, Mycobacterium tuberculosis H37Rv
ugagcgggcaacugcagcaugg

SEQ ID NO: 1340417 - RNA, 22 nt, Mycobacterium tuberculosis H37Rv
ugagcggagcaauuccacgauc

SEQ ID NO: 1340418 - RNA, 21 nt, Mycobacterium tuberculosis H37Rv
ugagcggccaccguagccagc

SEQ ID NO: 1340419 - RNA, 24 nt, Mycobacterium tuberculosis H37Rv
ugagcggccggcaugcuggcgauc

SEQ ID NO: 1340420 - RNA, 21 nt, Mycobacterium tuberculosis H37Rv
ugagcgcggguggcagcggcg

SEQ ID NO: 1340421 - RNA, 20 nt, Mycobacterium tuberculosis H37Rv
ugagcgcucgaaagagccgc

SEQ ID NO: 1340422 - RNA, 17 nt, Mycobacterium tuberculosis H37Rv
ugagcgcugcgccgaag

SEQ ID NO: 1340423 - RNA, 17 nt, Mycobacterium tuberculosis H37Rv
ugagcgcgcuggccagc

SEQ ID NO: 1340424 - RNA, 20 nt, Mycobacterium tuberculosis H37Rv
ugagcgcgaaguacgacgac

SEQ ID NO: 1340425 - RNA, 13 nt, Mycobacterium tuberculosis H37Rv
ugagcgaccuggg

SEQ ID NO: 1340426 - RNA, 21 nt, Mycobacterium tuberculosis H37Rv
ugagcgccggcaucgcgcaac

SEQ ID NO: 1340427 - RNA, 19 nt, Mycobacterium tuberculosis H37Rv
ugagcgccaggccgcacag

SEQ ID NO: 1340428 - RNA, 19 nt, Mycobacterium tuberculosis H37Rv
ugauccccagcuccggguc

SEQ ID NO: 1340429 - RNA, 15 nt, Mycobacterium tuberculosis H37Rv
ugauccgcaccccau

SEQ ID NO: 1340430 - RNA, 14 nt, Mycobacterium tuberculosis H37Rv
ugaucaccgucgua

SEQ ID NO: 1340431 - RNA, 19 nt, Mycobacterium tuberculosis H37Rv
ugaucaccgugguggcgua

SEQ ID NO: 1340432 - RNA, 12 nt, Mycobacterium tuberculosis H37Rv
ugaucagcgcau

SEQ ID NO: 1340433 - RNA, 16 nt, Mycobacterium tuberculosis H37Rv
ugaucagcucggucuu

SEQ ID NO: 1340434 - RNA, 23 nt, Mycobacterium tuberculosis H37Rv
ugagugcgucucgguggcugcgc

SEQ ID NO: 1340435 - RNA, 21 nt, Mycobacterium tuberculosis H37Rv
ugagugacgguccguucgaug

SEQ ID NO: 1340436 - RNA, 21 nt, Mycobacterium tuberculosis H37Rv
ugagugccggcgugcgcgaga

SEQ ID NO: 1340437 - RNA, 19 nt, Mycobacterium tuberculosis H37Rv
ugaguguggagacguuuug

SEQ ID NO: 1340438 - RNA, 12 nt, Mycobacterium tuberculosis H37Rv
ugauauccgcgg

SEQ ID NO: 1340439 - RNA, 14 nt, Mycobacterium tuberculosis H37Rv
ugauauccggaacc

SEQ ID NO: 1340440 - RNA, 21 nt, Mycobacterium tuberculosis H37Rv
ugaugcaagcgggcaugaucc

SEQ ID NO: 1340441 - RNA, 19 nt, Mycobacterium tuberculosis H37Rv
ugaugcaacgccaaaaugg

SEQ ID NO: 1340442 - RNA, 16 nt, Mycobacterium tuberculosis H37Rv
ugaugcaacgccaaaa

SEQ ID NO: 1340443 - RNA, 17 nt, Mycobacterium tuberculosis H37Rv
ugaugcaacgccaaaau

SEQ ID NO: 1340444 - RNA, 14 nt, Mycobacterium tuberculosis H37Rv
ugaugcggcgcagc

SEQ ID NO: 1340445 - RNA, 14 nt, Mycobacterium tuberculosis H37Rv
ugaugcggccgcgg

SEQ ID NO: 1340446 - RNA, 14 nt, Mycobacterium tuberculosis H37Rv
ugauggacagcugc

SEQ ID NO: 1340447 - RNA, 15 nt, Mycobacterium tuberculosis H37Rv
ugauggacaccagcc

SEQ ID NO: 1340448 - RNA, 20 nt, Mycobacterium tuberculosis H37Rv
ugaugcucgacaaccacggc

SEQ ID NO: 1340449 - RNA, 18 nt, Mycobacterium tuberculosis H37Rv
ugaucgaauacaccugcu

SEQ ID NO: 1340450 - RNA, 16 nt, Mycobacterium tuberculosis H37Rv
ugaucgaccgccuccu

SEQ ID NO: 1340451 - RNA, 14 nt, Mycobacterium tuberculosis H37Rv
ugaucgagcaguuc

SEQ ID NO: 1340452 - RNA, 21 nt, Mycobacterium tuberculosis H37Rv
ugaucgagcaguuccagcucg

SEQ ID NO: 1340453 - RNA, 14 nt, Mycobacterium tuberculosis H37Rv
ugaucgccauggug

SEQ ID NO: 1340454 - RNA, 17 nt, Mycobacterium tuberculosis H37Rv
ugaucgccgaggccucg

SEQ ID NO: 1340455 - RNA, 23 nt, Mycobacterium tuberculosis H37Rv
ugaucgccggcuucgcccagagc

SEQ ID NO: 1340456 - RNA, 13 nt, Mycobacterium tuberculosis H37Rv
ugaucgcgccggg

SEQ ID NO: 1340457 - RNA, 19 nt, Mycobacterium tuberculosis H37Rv
ugaucgcgccgggcucggc

SEQ ID NO: 1340458 - RNA, 21 nt, Mycobacterium tuberculosis H37Rv
ugaucggguacccaucugcuc

SEQ ID NO: 1340459 - RNA, 15 nt, Mycobacterium tuberculosis H37Rv
ugaucggcgcggccg

SEQ ID NO: 1340460 - RNA, 18 nt, Mycobacterium tuberculosis H37Rv
ugaugacguugcagccgg

SEQ ID NO: 1340461 - RNA, 21 nt, Mycobacterium tuberculosis H37Rv
ugaugacguugcagccggcau

SEQ ID NO: 1340462 - RNA, 19 nt, Mycobacterium tuberculosis H37Rv
ugauuguguuccaccagcg

SEQ ID NO: 1340463 - RNA, 14 nt, Mycobacterium tuberculosis H37Rv
ugauggccagcacc

SEQ ID NO: 1340464 - RNA, 16 nt, Mycobacterium tuberculosis H37Rv
ugauggccgucagcca

SEQ ID NO: 1340465 - RNA, 18 nt, Mycobacterium tuberculosis H37Rv
ugauggccaucuggccgc

SEQ ID NO: 1340466 - RNA, 16 nt, Mycobacterium tuberculosis H37Rv
ugaugguucaugaaca

SEQ ID NO: 1340467 - RNA, 17 nt, Mycobacterium tuberculosis H37Rv
ugauggugugcagcagc

SEQ ID NO: 1340468 - RNA, 17 nt, Mycobacterium tuberculosis H37Rv
ugauguagggcugcucc

SEQ ID NO: 1340469 - RNA, 18 nt, Mycobacterium tuberculosis H37Rv
ugauggucagcuggccgc

SEQ ID NO: 1340470 - RNA, 13 nt, Mycobacterium tuberculosis H37Rv
ugauggugccauc

SEQ ID NO: 1340471 - RNA, 22 nt, Mycobacterium tuberculosis H37Rv
ugauggucacggcgucgacugg

SEQ ID NO: 1340472 - RNA, 23 nt, Mycobacterium tuberculosis H37Rv
ugaugggggugcacgccuugagc

SEQ ID NO: 1340473 - RNA, 22 nt, Mycobacterium tuberculosis H37Rv
ugauggcguauagcaugccgcg

SEQ ID NO: 1340474 - RNA, 19 nt, Mycobacterium tuberculosis H37Rv
ugaugggggagccggugac

SEQ ID NO: 1340475 - RNA, 15 nt, Mycobacterium tuberculosis H37Rv
ugcaggaucaaaacc

SEQ ID NO: 1340476 - RNA, 15 nt, Mycobacterium tuberculosis H37Rv
ugcaggauggacucg

SEQ ID NO: 1340477 - RNA, 22 nt, Mycobacterium tuberculosis H37Rv
ugcaggacgcccacaugcucag

SEQ ID NO: 1340478 - RNA, 13 nt, Mycobacterium tuberculosis H37Rv
ugcaggcggccgc

SEQ ID NO: 1340479 - RNA, 20 nt, Mycobacterium tuberculosis H37Rv
ugcagggcugcuacucugca

SEQ ID NO: 1340480 - RNA, 19 nt, Mycobacterium tuberculosis H37Rv
ugcagcucgggcagggacc

SEQ ID NO: 1340481 - RNA, 14 nt, Mycobacterium tuberculosis H37Rv
ugcaggaacaccca

SEQ ID NO: 1340482 - RNA, 15 nt, Mycobacterium tuberculosis H37Rv
ugcaggaaaguggcc

SEQ ID NO: 1340483 - RNA, 13 nt, Mycobacterium tuberculosis H37Rv
ugcaggaaggcuu

SEQ ID NO: 1340484 - RNA, 15 nt, Mycobacterium tuberculosis H37Rv
ugcaggaccagaacu

SEQ ID NO: 1340485 - RNA, 13 nt, Mycobacterium tuberculosis H37Rv
ugcaggaccagca

SEQ ID NO: 1340486 - RNA, 16 nt, Mycobacterium tuberculosis H37Rv
ugcagcggcgccgcca

SEQ ID NO: 1340487 - RNA, 21 nt, Mycobacterium tuberculosis H37Rv
ugcagcgcaggauucugcuga

SEQ ID NO: 1340488 - RNA, 15 nt, Mycobacterium tuberculosis H37Rv
ugcagcgcacgcagc

SEQ ID NO: 1340489 - RNA, 19 nt, Mycobacterium tuberculosis H37Rv
ugcagcgauaucacaacug

SEQ ID NO: 1340490 - RNA, 16 nt, Mycobacterium tuberculosis H37Rv
ugcagcgauaucacaa

SEQ ID NO: 1340491 - RNA, 21 nt, Mycobacterium tuberculosis H37Rv
ugcagcgaaacaccggccagc

SEQ ID NO: 1340492 - RNA, 17 nt, Mycobacterium tuberculosis H37Rv
ugcagcccgggcagcac

SEQ ID NO: 1340493 - RNA, 14 nt, Mycobacterium tuberculosis H37Rv
ugcagcccugcgca

SEQ ID NO: 1340494 - RNA, 17 nt, Mycobacterium tuberculosis H37Rv
ugcagccgcaggugggc

SEQ ID NO: 1340495 - RNA, 19 nt, Mycobacterium tuberculosis H37Rv
ugcagcccgggcagcacca

SEQ ID NO: 1340496 - RNA, 20 nt, Mycobacterium tuberculosis H37Rv
ugcagcccgggcagcaccag

SEQ ID NO: 1340497 - RNA, 12 nt, Mycobacterium tuberculosis H37Rv
ugcagccgggaa

SEQ ID NO: 1340498 - RNA, 23 nt, Mycobacterium tuberculosis H37Rv
ugcagccagauucauuggccugg

SEQ ID NO: 1340499 - RNA, 13 nt, Mycobacterium tuberculosis H37Rv
ugcagccacauac

SEQ ID NO: 1340500 - RNA, 13 nt, Mycobacterium tuberculosis H37Rv
ugcagccccacuu

SEQ ID NO: 1340501 - RNA, 23 nt, Mycobacterium tuberculosis H37Rv
ugcagcccgccggauccgccaga

SEQ ID NO: 1340502 - RNA, 18 nt, Mycobacterium tuberculosis H37Rv
ugcagcacuuggccagcu

SEQ ID NO: 1340503 - RNA, 13 nt, Mycobacterium tuberculosis H37Rv
ugcagcacggcuu

SEQ ID NO: 1340504 - RNA, 12 nt, Mycobacterium tuberculosis H37Rv
ugcagcacgcgu

SEQ ID NO: 1340505 - RNA, 20 nt, Mycobacterium tuberculosis H37Rv
ugcagcaggucgaugcugcc

SEQ ID NO: 1340506 - RNA, 21 nt, Mycobacterium tuberculosis H37Rv
ugcagcacuuccaagccgacc

SEQ ID NO: 1340507 - RNA, 15 nt, Mycobacterium tuberculosis H37Rv
ugcagaucacgggug

SEQ ID NO: 1340508 - RNA, 20 nt, Mycobacterium tuberculosis H37Rv
ugcagaucguagugcgcgcc

SEQ ID NO: 1340509 - RNA, 15 nt, Mycobacterium tuberculosis H37Rv
ugcagaucggccgga

SEQ ID NO: 1340510 - RNA, 19 nt, Mycobacterium tuberculosis H37Rv
ugcagaucgccccagccau

SEQ ID NO: 1340511 - RNA, 18 nt, Mycobacterium tuberculosis H37Rv
ugcagaucgccccagcca

SEQ ID NO: 1340512 - RNA, 21 nt, Mycobacterium tuberculosis H37Rv
ugcagacaggcggcggccugg

SEQ ID NO: 1340513 - RNA, 13 nt, Mycobacterium tuberculosis H37Rv
ugcagacgggugg

SEQ ID NO: 1340514 - RNA, 16 nt, Mycobacterium tuberculosis H37Rv
ugcaagcuaagcgccu

SEQ ID NO: 1340515 - RNA, 15 nt, Mycobacterium tuberculosis H37Rv
ugcacaacgcccacc

SEQ ID NO: 1340516 - RNA, 22 nt, Mycobacterium tuberculosis H37Rv
ugcacaaaauacuccgcgagcc

SEQ ID NO: 1340517 - RNA, 14 nt, Mycobacterium tuberculosis H37Rv
ugcaaugcuggcgg

SEQ ID NO: 1340518 - RNA, 18 nt, Mycobacterium tuberculosis H37Rv
ugcaaugcuggcggcgcg

SEQ ID NO: 1340519 - RNA, 20 nt, Mycobacterium tuberculosis H37Rv
ugcacggccgagcagguucc

SEQ ID NO: 1340520 - RNA, 21 nt, Mycobacterium tuberculosis H37Rv
ugcacggccaugaucacaccg

SEQ ID NO: 1340521 - RNA, 19 nt, Mycobacterium tuberculosis H37Rv
ugcacggggaccuuggcga

SEQ ID NO: 1340522 - RNA, 21 nt, Mycobacterium tuberculosis H37Rv
ugcacggucaugccgccgccg

SEQ ID NO: 1340523 - RNA, 16 nt, Mycobacterium tuberculosis H37Rv
ugcacggucaugccgc

SEQ ID NO: 1340524 - RNA, 15 nt, Mycobacterium tuberculosis H37Rv
ugcacggugcccagg

SEQ ID NO: 1340525 - RNA, 20 nt, Mycobacterium tuberculosis H37Rv
ugcacguggccacggcauuc

SEQ ID NO: 1340526 - RNA, 14 nt, Mycobacterium tuberculosis H37Rv
ugcacagcagcggu

SEQ ID NO: 1340527 - RNA, 15 nt, Mycobacterium tuberculosis H37Rv
ugcacagacagacag

SEQ ID NO: 1340528 - RNA, 14 nt, Mycobacterium tuberculosis H37Rv
ugcacaggauuggc

SEQ ID NO: 1340529 - RNA, 17 nt, Mycobacterium tuberculosis H37Rv
ugcacaggauuggccgc

SEQ ID NO: 1340530 - RNA, 19 nt, Mycobacterium tuberculosis H37Rv
ugcacgagcggacagggag

SEQ ID NO: 1340531 - RNA, 15 nt, Mycobacterium tuberculosis H37Rv
ugccaccagaaacac

SEQ ID NO: 1340532 - RNA, 14 nt, Mycobacterium tuberculosis H37Rv
ugccacaggugacc

SEQ ID NO: 1340533 - RNA, 18 nt, Mycobacterium tuberculosis H37Rv
ugccacaggcguuuccgc

SEQ ID NO: 1340534 - RNA, 18 nt, Mycobacterium tuberculosis H37Rv
ugccacaucccacggugg

SEQ ID NO: 1340535 - RNA, 13 nt, Mycobacterium tuberculosis H37Rv
ugccaaucugcac

SEQ ID NO: 1340536 - RNA, 14 nt, Mycobacterium tuberculosis H37Rv
ugccacccagcacg

SEQ ID NO: 1340537 - RNA, 21 nt, Mycobacterium tuberculosis H37Rv
ugccacuccaggagccgagga

SEQ ID NO: 1340538 - RNA, 17 nt, Mycobacterium tuberculosis H37Rv
ugccacucgaugcuuuc

SEQ ID NO: 1340539 - RNA, 19 nt, Mycobacterium tuberculosis H37Rv
ugccacugccguugccgcc

SEQ ID NO: 1340540 - RNA, 21 nt, Mycobacterium tuberculosis H37Rv
ugccagaacccggacagggug

SEQ ID NO: 1340541 - RNA, 17 nt, Mycobacterium tuberculosis H37Rv
ugcaggugaugagugcg

SEQ ID NO: 1340542 - RNA, 19 nt, Mycobacterium tuberculosis H37Rv
ugcaggugaugagugcgga

SEQ ID NO: 1340543 - RNA, 16 nt, Mycobacterium tuberculosis H37Rv
ugcaggucggcccagg

SEQ ID NO: 1340544 - RNA, 16 nt, Mycobacterium tuberculosis H37Rv
ugcagguugccaagaa

SEQ ID NO: 1340545 - RNA, 13 nt, Mycobacterium tuberculosis H37Rv
ugcagguggccgu

SEQ ID NO: 1340546 - RNA, 23 nt, Mycobacterium tuberculosis H37Rv
ugccaagcagcugggcaucaccg

SEQ ID NO: 1340547 - RNA, 17 nt, Mycobacterium tuberculosis H37Rv
ugccaaccgcgggaacc

SEQ ID NO: 1340548 - RNA, 23 nt, Mycobacterium tuberculosis H37Rv
ugcagucuuucccggggcugggg

SEQ ID NO: 1340549 - RNA, 14 nt, Mycobacterium tuberculosis H37Rv
ugccaacgggcagg

SEQ ID NO: 1340550 - RNA, 14 nt, Mycobacterium tuberculosis H37Rv
ugccaaccugggcc

SEQ ID NO: 1340551 - RNA, 16 nt, Mycobacterium tuberculosis H37Rv
ugcaguaguagcgcaa

SEQ ID NO: 1340552 - RNA, 22 nt, Mycobacterium tuberculosis H37Rv
ugcagucggugcggugcacacu

SEQ ID NO: 1340553 - RNA, 20 nt, Mycobacterium tuberculosis H37Rv
ugccagugccgcccaccaca

SEQ ID NO: 1340554 - RNA, 23 nt, Mycobacterium tuberculosis H37Rv
ugccagugccgcccaccacacag

SEQ ID NO: 1340555 - RNA, 21 nt, Mycobacterium tuberculosis H37Rv
ugccauacagcaccccgccgg

SEQ ID NO: 1340556 - RNA, 15 nt, Mycobacterium tuberculosis H37Rv
ugccauacagcaccc

SEQ ID NO: 1340557 - RNA, 19 nt, Mycobacterium tuberculosis H37Rv
ugcccaaaaggaagaccuc

SEQ ID NO: 1340558 - RNA, 18 nt, Mycobacterium tuberculosis H37Rv
ugcccacgcacagcaacg

SEQ ID NO: 1340559 - RNA, 20 nt, Mycobacterium tuberculosis H37Rv
ugcccaccuucgaguuuggu

SEQ ID NO: 1340560 - RNA, 12 nt, Mycobacterium tuberculosis H37Rv
ugcccaagcccu

SEQ ID NO: 1340561 - RNA, 16 nt, Mycobacterium tuberculosis H37Rv
ugccagcagcaaucag

SEQ ID NO: 1340562 - RNA, 17 nt, Mycobacterium tuberculosis H37Rv
ugccagccacgaacuga

SEQ ID NO: 1340563 - RNA, 14 nt, Mycobacterium tuberculosis H37Rv
ugccagcagcagcg

SEQ ID NO: 1340564 - RNA, 16 nt, Mycobacterium tuberculosis H37Rv
ugccagcuguugcggg

SEQ ID NO: 1340565 - RNA, 18 nt, Mycobacterium tuberculosis H37Rv
ugccaguacucggccagc

SEQ ID NO: 1340566 - RNA, 22 nt, Mycobacterium tuberculosis H37Rv
ugccaguacucggccagcgccu

SEQ ID NO: 1340567 - RNA, 19 nt, Mycobacterium tuberculosis H37Rv
ugccagucgaucgcggccc

SEQ ID NO: 1340568 - RNA, 23 nt, Mycobacterium tuberculosis H37Rv
ugccaguagucgccgggcggccg

SEQ ID NO: 1340569 - RNA, 18 nt, Mycobacterium tuberculosis H37Rv
ugcccagcaugaaguccc

SEQ ID NO: 1340570 - RNA, 12 nt, Mycobacterium tuberculosis H37Rv
ugcccagcaccc

SEQ ID NO: 1340571 - RNA, 19 nt, Mycobacterium tuberculosis H37Rv
ugcccagcagaccaagucc

SEQ ID NO: 1340572 - RNA, 13 nt, Mycobacterium tuberculosis H37Rv
ugcccagcaccac

SEQ ID NO: 1340573 - RNA, 22 nt, Mycobacterium tuberculosis H37Rv
ugcccacggugccggcacccga

SEQ ID NO: 1340574 - RNA, 19 nt, Mycobacterium tuberculosis H37Rv
ugcccacguuggccaggcc

SEQ ID NO: 1340575 - RNA, 21 nt, Mycobacterium tuberculosis H37Rv
ugcccacgggccggccgagcg

SEQ ID NO: 1340576 - RNA, 20 nt, Mycobacterium tuberculosis H37Rv
ugcccacggagggcaggaga

SEQ ID NO: 1340577 - RNA, 16 nt, Mycobacterium tuberculosis H37Rv
ugcccaucggcaugau

SEQ ID NO: 1340578 - RNA, 13 nt, Mycobacterium tuberculosis H37Rv
ugcccaucaccag

SEQ ID NO: 1340579 - RNA, 16 nt, Mycobacterium tuberculosis H37Rv
ugcccaucacgcccca

SEQ ID NO: 1340580 - RNA, 17 nt, Mycobacterium tuberculosis H37Rv
ugcccaggcucgcaccg

SEQ ID NO: 1340581 - RNA, 14 nt, Mycobacterium tuberculosis H37Rv
ugcccaggccaccg

SEQ ID NO: 1340582 - RNA, 23 nt, Mycobacterium tuberculosis H37Rv
ugcccaggaaggcgacgccgaaa

SEQ ID NO: 1340583 - RNA, 15 nt, Mycobacterium tuberculosis H37Rv
ugccccggagccaga

SEQ ID NO: 1340584 - RNA, 16 nt, Mycobacterium tuberculosis H37Rv
ugccccgccuuggcca

SEQ ID NO: 1340585 - RNA, 13 nt, Mycobacterium tuberculosis H37Rv
ugccccgccgcca

SEQ ID NO: 1340586 - RNA, 20 nt, Mycobacterium tuberculosis H37Rv
ugccccgguugaucuugucc

SEQ ID NO: 1340587 - RNA, 20 nt, Mycobacterium tuberculosis H37Rv
ugcccaugauggucacggcg

SEQ ID NO: 1340588 - RNA, 14 nt, Mycobacterium tuberculosis H37Rv
ugcccccggugccg

SEQ ID NO: 1340589 - RNA, 21 nt, Mycobacterium tuberculosis H37Rv
ugcccccguugccgcccgucc

SEQ ID NO: 1340590 - RNA, 13 nt, Mycobacterium tuberculosis H37Rv
ugcccgccagucc

SEQ ID NO: 1340591 - RNA, 13 nt, Mycobacterium tuberculosis H37Rv
ugcccgcccagcc

SEQ ID NO: 1340592 - RNA, 15 nt, Mycobacterium tuberculosis H37Rv
ugcccgccagcgccg

SEQ ID NO: 1340593 - RNA, 18 nt, Mycobacterium tuberculosis H37Rv
ugcccgccguagaccagc

SEQ ID NO: 1340594 - RNA, 14 nt, Mycobacterium tuberculosis H37Rv
ugccccuccgggcg

SEQ ID NO: 1340595 - RNA, 22 nt, Mycobacterium tuberculosis H37Rv
ugcccgcaacgccaacacgcgu

SEQ ID NO: 1340596 - RNA, 14 nt, Mycobacterium tuberculosis H37Rv
ugcccgcaccgcgu

SEQ ID NO: 1340597 - RNA, 16 nt, Mycobacterium tuberculosis H37Rv
ugcccgcaccacaccg

SEQ ID NO: 1340598 - RNA, 14 nt, Mycobacterium tuberculosis H37Rv
ugcccgcauugcca

SEQ ID NO: 1340599 - RNA, 17 nt, Mycobacterium tuberculosis H37Rv
ugccgaaguugaagaag

SEQ ID NO: 1340600 - RNA, 19 nt, Mycobacterium tuberculosis H37Rv
ugccgaaguugaagaagcc

SEQ ID NO: 1340601 - RNA, 20 nt, Mycobacterium tuberculosis H37Rv
ugccgaagcugcccaaccgg

SEQ ID NO: 1340602 - RNA, 13 nt, Mycobacterium tuberculosis H37Rv
ugccgaaguugaa

SEQ ID NO: 1340603 - RNA, 18 nt, Mycobacterium tuberculosis H37Rv
ugccgaacgucgcggcca

SEQ ID NO: 1340604 - RNA, 18 nt, Mycobacterium tuberculosis H37Rv
ugccgaacuccgcggaac

SEQ ID NO: 1340605 - RNA, 19 nt, Mycobacterium tuberculosis H37Rv
ugccgacgcgcggccagcc

SEQ ID NO: 1340606 - RNA, 23 nt, Mycobacterium tuberculosis H37Rv
ugccgacgaacgaaccgccgccg

SEQ ID NO: 1340607 - RNA, 21 nt, Mycobacterium tuberculosis H37Rv
ugccgacgaucgacgccgcca

SEQ ID NO: 1340608 - RNA, 23 nt, Mycobacterium tuberculosis H37Rv
ugccgacucaucggccgcggucg

SEQ ID NO: 1340609 - RNA, 16 nt, Mycobacterium tuberculosis H37Rv
ugccgacggugauggg

SEQ ID NO: 1340610 - RNA, 13 nt, Mycobacterium tuberculosis H37Rv
ugccgaccagcau

SEQ ID NO: 1340611 - RNA, 21 nt, Mycobacterium tuberculosis H37Rv
ugccgacccgccgcgcccggc

SEQ ID NO: 1340612 - RNA, 22 nt, Mycobacterium tuberculosis H37Rv
ugccgacccgcuucgcccggcu

SEQ ID NO: 1340613 - RNA, 22 nt, Mycobacterium tuberculosis H37Rv
ugccgauggugaugggggagcc

SEQ ID NO: 1340614 - RNA, 21 nt, Mycobacterium tuberculosis H37Rv
ugccgaugucaacgcccagcu

SEQ ID NO: 1340615 - RNA, 18 nt, Mycobacterium tuberculosis H37Rv
ugccgauuacggugaucg

SEQ ID NO: 1340616 - RNA, 15 nt, Mycobacterium tuberculosis H37Rv
ugccgccaccggcgu

SEQ ID NO: 1340617 - RNA, 18 nt, Mycobacterium tuberculosis H37Rv
ugccgcaccaaggccgcc

SEQ ID NO: 1340618 - RNA, 23 nt, Mycobacterium tuberculosis H37Rv
ugccgccaccgccaccgcggccu

SEQ ID NO: 1340619 - RNA, 16 nt, Mycobacterium tuberculosis H37Rv
ugccgauggugauggg

SEQ ID NO: 1340620 - RNA, 21 nt, Mycobacterium tuberculosis H37Rv
ugccgaccggcacccgcggcg

SEQ ID NO: 1340621 - RNA, 17 nt, Mycobacterium tuberculosis H37Rv
ugccgagcacucggcca

SEQ ID NO: 1340622 - RNA, 12 nt, Mycobacterium tuberculosis H37Rv
ugccgagcagac

SEQ ID NO: 1340623 - RNA, 23 nt, Mycobacterium tuberculosis H37Rv
ugccgagaauuccccagccgcau

SEQ ID NO: 1340624 - RNA, 15 nt, Mycobacterium tuberculosis H37Rv
ugccgagaucccagc

SEQ ID NO: 1340625 - RNA, 12 nt, Mycobacterium tuberculosis H37Rv
ugcccuugggac

SEQ ID NO: 1340626 - RNA, 20 nt, Mycobacterium tuberculosis H37Rv
ugcccuuguaggccaucguc

SEQ ID NO: 1340627 - RNA, 21 nt, Mycobacterium tuberculosis H37Rv
ugcccuugcggaagaagugcu

SEQ ID NO: 1340628 - RNA, 18 nt, Mycobacterium tuberculosis H37Rv
ugccgaaccacgcgcccg

SEQ ID NO: 1340629 - RNA, 16 nt, Mycobacterium tuberculosis H37Rv
ugccgaacgccagacc

SEQ ID NO: 1340630 - RNA, 19 nt, Mycobacterium tuberculosis H37Rv
ugcccggcccgcucagccg

SEQ ID NO: 1340631 - RNA, 22 nt, Mycobacterium tuberculosis H37Rv
ugcccggcuccuccccggcccg

SEQ ID NO: 1340632 - RNA, 20 nt, Mycobacterium tuberculosis H37Rv
ugcccgggugacccgugcgg

SEQ ID NO: 1340633 - RNA, 23 nt, Mycobacterium tuberculosis H37Rv
ugccggcgccuuggucgccgccu

SEQ ID NO: 1340634 - RNA, 22 nt, Mycobacterium tuberculosis H37Rv
ugccggcgugcggcgaggacgc

SEQ ID NO: 1340635 - RNA, 14 nt, Mycobacterium tuberculosis H37Rv
ugccggcaacagcu

SEQ ID NO: 1340636 - RNA, 16 nt, Mycobacterium tuberculosis H37Rv
ugccggcguugccgcc

SEQ ID NO: 1340637 - RNA, 20 nt, Mycobacterium tuberculosis H37Rv
ugccggcguugccgaaaccc

SEQ ID NO: 1340638 - RNA, 15 nt, Mycobacterium tuberculosis H37Rv
ugccggcgccuuggu

SEQ ID NO: 1340639 - RNA, 18 nt, Mycobacterium tuberculosis H37Rv
ugccggcgccgcccuugc

SEQ ID NO: 1340640 - RNA, 14 nt, Mycobacterium tuberculosis H37Rv
ugccggcgccgccc

SEQ ID NO: 1340641 - RNA, 24 nt, Mycobacterium tuberculosis H37Rv
ugccggcgccgccagcaccaccgg

SEQ ID NO: 1340642 - RNA, 14 nt, Mycobacterium tuberculosis H37Rv
ugccggcgccgcca

SEQ ID NO: 1340643 - RNA, 12 nt, Mycobacterium tuberculosis H37Rv
ugccggcagcgg

SEQ ID NO: 1340644 - RNA, 13 nt, Mycobacterium tuberculosis H37Rv
ugccggcagcgcc

SEQ ID NO: 1340645 - RNA, 17 nt, Mycobacterium tuberculosis H37Rv
ugccggcacgcaugccg

SEQ ID NO: 1340646 - RNA, 14 nt, Mycobacterium tuberculosis H37Rv
ugccguccggcgcu

SEQ ID NO: 1340647 - RNA, 15 nt, Mycobacterium tuberculosis H37Rv
ugccguccccggccg

SEQ ID NO: 1340648 - RNA, 18 nt, Mycobacterium tuberculosis H37Rv
ugccgucgaguccaggcc

SEQ ID NO: 1340649 - RNA, 16 nt, Mycobacterium tuberculosis H37Rv
ugccgucagggucagc

SEQ ID NO: 1340650 - RNA, 17 nt, Mycobacterium tuberculosis H37Rv
ugccgucagggucagcu

SEQ ID NO: 1340651 - RNA, 15 nt, Mycobacterium tuberculosis H37Rv
ugccguauccaggcg

SEQ ID NO: 1340652 - RNA, 22 nt, Mycobacterium tuberculosis H37Rv
ugccgccaccggcguccagucc

SEQ ID NO: 1340653 - RNA, 20 nt, Mycobacterium tuberculosis H37Rv
ugccgccaccuuggcugggc

SEQ ID NO: 1340654 - RNA, 19 nt, Mycobacterium tuberculosis H37Rv
ugccgccagccccagcguu

SEQ ID NO: 1340655 - RNA, 14 nt, Mycobacterium tuberculosis H37Rv
ugccgccagcgcca

SEQ ID NO: 1340656 - RNA, 16 nt, Mycobacterium tuberculosis H37Rv
ugccgccagcgccacc

SEQ ID NO: 1340657 - RNA, 20 nt, Mycobacterium tuberculosis H37Rv
ugccgccacgggcggccacc

SEQ ID NO: 1340658 - RNA, 17 nt, Mycobacterium tuberculosis H37Rv
ugccgccaucgccgccg

SEQ ID NO: 1340659 - RNA, 20 nt, Mycobacterium tuberculosis H37Rv
ugccgcccaccacacagccg

SEQ ID NO: 1340660 - RNA, 19 nt, Mycobacterium tuberculosis H37Rv
ugccgcccaccacacagcc

SEQ ID NO: 1340661 - RNA, 17 nt, Mycobacterium tuberculosis H37Rv
ugccgcccacgcugccc

SEQ ID NO: 1340662 - RNA, 14 nt, Mycobacterium tuberculosis H37Rv
ugccgccgccgccg

SEQ ID NO: 1340663 - RNA, 23 nt, Mycobacterium tuberculosis H37Rv
ugccgccgccuccgccgaggccg

SEQ ID NO: 1340664 - RNA, 16 nt, Mycobacterium tuberculosis H37Rv
ugccgccgcggccaca

SEQ ID NO: 1340665 - RNA, 19 nt, Mycobacterium tuberculosis H37Rv
ugccgccgcggccacaacc

SEQ ID NO: 1340666 - RNA, 13 nt, Mycobacterium tuberculosis H37Rv
ugccgccgcgccg

SEQ ID NO: 1340667 - RNA, 17 nt, Mycobacterium tuberculosis H37Rv
ugccgccggcgccggca

SEQ ID NO: 1340668 - RNA, 13 nt, Mycobacterium tuberculosis H37Rv
ugccggaguugaa

SEQ ID NO: 1340669 - RNA, 19 nt, Mycobacterium tuberculosis H37Rv
ugccggaggaucgcugguu

SEQ ID NO: 1340670 - RNA, 21 nt, Mycobacterium tuberculosis H37Rv
ugccgccgcggcgcccggcgg

SEQ ID NO: 1340671 - RNA, 14 nt, Mycobacterium tuberculosis H37Rv
ugccgccggcgcca

SEQ ID NO: 1340672 - RNA, 16 nt, Mycobacterium tuberculosis H37Rv
ugccgccggcgccacc

SEQ ID NO: 1340673 - RNA, 16 nt, Mycobacterium tuberculosis H37Rv
ugccgccggccagucc

SEQ ID NO: 1340674 - RNA, 17 nt, Mycobacterium tuberculosis H37Rv
ugccgccggcagcgcgg

SEQ ID NO: 1340675 - RNA, 17 nt, Mycobacterium tuberculosis H37Rv
ugccgccggcgccgccg

SEQ ID NO: 1340676 - RNA, 14 nt, Mycobacterium tuberculosis H37Rv
ugccgccggcgccg

SEQ ID NO: 1340677 - RNA, 17 nt, Mycobacterium tuberculosis H37Rv
ugccgccggcgccaccc

SEQ ID NO: 1340678 - RNA, 20 nt, Mycobacterium tuberculosis H37Rv
ugccgccggccccgccgcua

SEQ ID NO: 1340679 - RNA, 16 nt, Mycobacterium tuberculosis H37Rv
ugccggacgccaugcc

SEQ ID NO: 1340680 - RNA, 13 nt, Mycobacterium tuberculosis H37Rv
ugccuugagcaaa

SEQ ID NO: 1340681 - RNA, 19 nt, Mycobacterium tuberculosis H37Rv
ugccuugagccgccccggc

SEQ ID NO: 1340682 - RNA, 13 nt, Mycobacterium tuberculosis H37Rv
ugccuuagcccgg

SEQ ID NO: 1340683 - RNA, 14 nt, Mycobacterium tuberculosis H37Rv
ugccugaccggcgg

SEQ ID NO: 1340684 - RNA, 21 nt, Mycobacterium tuberculosis H37Rv
ugccgucggcguacagcgccu

SEQ ID NO: 1340685 - RNA, 23 nt, Mycobacterium tuberculosis H37Rv
ugccgucggcgugcagcagcuug

SEQ ID NO: 1340686 - RNA, 19 nt, Mycobacterium tuberculosis H37Rv
ugccgucgccggucaggcc

SEQ ID NO: 1340687 - RNA, 19 nt, Mycobacterium tuberculosis H37Rv
ugccgucgccuccagcagg

SEQ ID NO: 1340688 - RNA, 14 nt, Mycobacterium tuberculosis H37Rv
ugcgcacucccggc

SEQ ID NO: 1340689 - RNA, 20 nt, Mycobacterium tuberculosis H37Rv
ugcgcagaacaccaccgcca

SEQ ID NO: 1340690 - RNA, 16 nt, Mycobacterium tuberculosis H37Rv
ugcgcagauuugcucc

SEQ ID NO: 1340691 - RNA, 20 nt, Mycobacterium tuberculosis H37Rv
ugcgcagauuugcuccagcg

SEQ ID NO: 1340692 - RNA, 21 nt, Mycobacterium tuberculosis H37Rv
ugcgcaauagcgacagcagcg

SEQ ID NO: 1340693 - RNA, 19 nt, Mycobacterium tuberculosis H37Rv
ugcgcaauagcgacagcag

SEQ ID NO: 1340694 - RNA, 18 nt, Mycobacterium tuberculosis H37Rv
ugcgcacaccgacccgcu

SEQ ID NO: 1340695 - RNA, 12 nt, Mycobacterium tuberculosis H37Rv
ugcgcaccagca

SEQ ID NO: 1340696 - RNA, 15 nt, Mycobacterium tuberculosis H37Rv
ugcgcaccagcaccu

SEQ ID NO: 1340697 - RNA, 13 nt, Mycobacterium tuberculosis H37Rv
ugcgcaccaaggc

SEQ ID NO: 1340698 - RNA, 17 nt, Mycobacterium tuberculosis H37Rv
ugcgcaccaccgagccg

SEQ ID NO: 1340699 - RNA, 19 nt, Mycobacterium tuberculosis H37Rv
ugcgcaccaguccagcggg

SEQ ID NO: 1340700 - RNA, 23 nt, Mycobacterium tuberculosis H37Rv
ugcgcaccaugggucuggcaggc

SEQ ID NO: 1340701 - RNA, 17 nt, Mycobacterium tuberculosis H37Rv
ugcgcagugcaccgcgu

SEQ ID NO: 1340702 - RNA, 18 nt, Mycobacterium tuberculosis H37Rv
ugcgcagugacgccucga

SEQ ID NO: 1340703 - RNA, 17 nt, Mycobacterium tuberculosis H37Rv
ugcgcauaauauuuucc

SEQ ID NO: 1340704 - RNA, 21 nt, Mycobacterium tuberculosis H37Rv
ugcgcagcggcauccacaccg

SEQ ID NO: 1340705 - RNA, 17 nt, Mycobacterium tuberculosis H37Rv
ugcgcagcuuggccagc

SEQ ID NO: 1340706 - RNA, 12 nt, Mycobacterium tuberculosis H37Rv
ugcgcagcgcaa

SEQ ID NO: 1340707 - RNA, 21 nt, Mycobacterium tuberculosis H37Rv
ugcgcaacuucuucagcagcg

SEQ ID NO: 1340708 - RNA, 22 nt, Mycobacterium tuberculosis H37Rv
ugcgcaacaccgugcaccagcu

SEQ ID NO: 1340709 - RNA, 22 nt, Mycobacterium tuberculosis H37Rv
ugcgcaacccagccgcgccagc

SEQ ID NO: 1340710 - RNA, 14 nt, Mycobacterium tuberculosis H37Rv
ugcgcaacccagcc

SEQ ID NO: 1340711 - RNA, 16 nt, Mycobacterium tuberculosis H37Rv
ugcgcaacgcgucguc

SEQ ID NO: 1340712 - RNA, 16 nt, Mycobacterium tuberculosis H37Rv
ugcgauugcgcacacc

SEQ ID NO: 1340713 - RNA, 21 nt, Mycobacterium tuberculosis H37Rv
ugcgcaacaccgugcaccagc

SEQ ID NO: 1340714 - RNA, 19 nt, Mycobacterium tuberculosis H37Rv
ugcgcaaacacgcguucca

SEQ ID NO: 1340715 - RNA, 15 nt, Mycobacterium tuberculosis H37Rv
ugcgaucccacccuc

SEQ ID NO: 1340716 - RNA, 15 nt, Mycobacterium tuberculosis H37Rv
ugcgauccccaacac

SEQ ID NO: 1340717 - RNA, 14 nt, Mycobacterium tuberculosis H37Rv
ugcgaucccacccu

SEQ ID NO: 1340718 - RNA, 18 nt, Mycobacterium tuberculosis H37Rv
ugcgaucggugcgaucag

SEQ ID NO: 1340719 - RNA, 14 nt, Mycobacterium tuberculosis H37Rv
ugcgaugcacaacc

SEQ ID NO: 1340720 - RNA, 14 nt, Mycobacterium tuberculosis H37Rv
ugcgaggggcggca

SEQ ID NO: 1340721 - RNA, 23 nt, Mycobacterium tuberculosis H37Rv
ugcgaggcguaaucaagcagcgu

SEQ ID NO: 1340722 - RNA, 20 nt, Mycobacterium tuberculosis H37Rv
ugcgagccggcgaagugcuc

SEQ ID NO: 1340723 - RNA, 22 nt, Mycobacterium tuberculosis H37Rv
ugcgagccggcgaagugcucca

SEQ ID NO: 1340724 - RNA, 21 nt, Mycobacterium tuberculosis H37Rv
ugcgaccggcuccggacaccc

SEQ ID NO: 1340725 - RNA, 14 nt, Mycobacterium tuberculosis H37Rv
ugcgacgaaccgga

SEQ ID NO: 1340726 - RNA, 21 nt, Mycobacterium tuberculosis H37Rv
ugcgacgcagaccguccagca

SEQ ID NO: 1340727 - RNA, 18 nt, Mycobacterium tuberculosis H37Rv
ugcgacggccggcaagca

SEQ ID NO: 1340728 - RNA, 15 nt, Mycobacterium tuberculosis H37Rv
ugcgacugugaaucu

SEQ ID NO: 1340729 - RNA, 19 nt, Mycobacterium tuberculosis H37Rv
ugcgaccgcgccaacagau

SEQ ID NO: 1340730 - RNA, 14 nt, Mycobacterium tuberculosis H37Rv
ugcgaccacaucau

SEQ ID NO: 1340731 - RNA, 18 nt, Mycobacterium tuberculosis H37Rv
ugcgaccacaucaugcca

SEQ ID NO: 1340732 - RNA, 23 nt, Mycobacterium tuberculosis H37Rv
ugcgacauuggucaccugcugca

SEQ ID NO: 1340733 - RNA, 19 nt, Mycobacterium tuberculosis H37Rv
ugcgaaacgcuggccacuc

SEQ ID NO: 1340734 - RNA, 19 nt, Mycobacterium tuberculosis H37Rv
ugcgaacagcgaagcaacg

SEQ ID NO: 1340735 - RNA, 19 nt, Mycobacterium tuberculosis H37Rv
ugcgaacaaguggccagcg

SEQ ID NO: 1340736 - RNA, 17 nt, Mycobacterium tuberculosis H37Rv
ugcgaacaaguggccag

SEQ ID NO: 1340737 - RNA, 20 nt, Mycobacterium tuberculosis H37Rv
ugcgaacucaucgugguaac

SEQ ID NO: 1340738 - RNA, 23 nt, Mycobacterium tuberculosis H37Rv
ugcgaacucggccgugugcucga

SEQ ID NO: 1340739 - RNA, 14 nt, Mycobacterium tuberculosis H37Rv
ugcgaaugcugggc

SEQ ID NO: 1340740 - RNA, 17 nt, Mycobacterium tuberculosis H37Rv
ugcgaaucaucuuggug

SEQ ID NO: 1340741 - RNA, 20 nt, Mycobacterium tuberculosis H37Rv
ugcgaaggaccagagcucga

SEQ ID NO: 1340742 - RNA, 14 nt, Mycobacterium tuberculosis H37Rv
ugcgaagggcaccg

SEQ ID NO: 1340743 - RNA, 22 nt, Mycobacterium tuberculosis H37Rv
ugcgaagcauucaggccgagga

SEQ ID NO: 1340744 - RNA, 24 nt, Mycobacterium tuberculosis H37Rv
ugcucgcgaggcucgcguggccgc

SEQ ID NO: 1340745 - RNA, 20 nt, Mycobacterium tuberculosis H37Rv
ugcucgcgccggugaggcga

SEQ ID NO: 1340746 - RNA, 23 nt, Mycobacterium tuberculosis H37Rv
ugcucgccguugaugucggcagg

SEQ ID NO: 1340747 - RNA, 16 nt, Mycobacterium tuberculosis H37Rv
ugcucgccguggugga

SEQ ID NO: 1340748 - RNA, 21 nt, Mycobacterium tuberculosis H37Rv
ugcucagccguucgcagcuga

SEQ ID NO: 1340749 - RNA, 21 nt, Mycobacterium tuberculosis H37Rv
ugcuccaggcgcgccgcaccc

SEQ ID NO: 1340750 - RNA, 16 nt, Mycobacterium tuberculosis H37Rv
ugcuccaggcgcgccg

SEQ ID NO: 1340751 - RNA, 14 nt, Mycobacterium tuberculosis H37Rv
ugcucucgcagcau

SEQ ID NO: 1340752 - RNA, 13 nt, Mycobacterium tuberculosis H37Rv
ugcuauggccgca

SEQ ID NO: 1340753 - RNA, 14 nt, Mycobacterium tuberculosis H37Rv
ugcuagcagcagcc

SEQ ID NO: 1340754 - RNA, 16 nt, Mycobacterium tuberculosis H37Rv
ugcuagcagcagcccg

SEQ ID NO: 1340755 - RNA, 14 nt, Mycobacterium tuberculosis H37Rv
ugcuagcgccgcca

SEQ ID NO: 1340756 - RNA, 19 nt, Mycobacterium tuberculosis H37Rv
ugcuagcuuggcggccagc

SEQ ID NO: 1340757 - RNA, 20 nt, Mycobacterium tuberculosis H37Rv
ugcgucguucggagcccuga

SEQ ID NO: 1340758 - RNA, 19 nt, Mycobacterium tuberculosis H37Rv
ugcguuccaucgccgacgc

SEQ ID NO: 1340759 - RNA, 14 nt, Mycobacterium tuberculosis H37Rv
ugcguucgccgccc

SEQ ID NO: 1340760 - RNA, 14 nt, Mycobacterium tuberculosis H37Rv
ugcguucggccggg

SEQ ID NO: 1340761 - RNA, 16 nt, Mycobacterium tuberculosis H37Rv
ugcguaucgacccgcg

SEQ ID NO: 1340762 - RNA, 16 nt, Mycobacterium tuberculosis H37Rv
ugcguccaggccaggg

SEQ ID NO: 1340763 - RNA, 14 nt, Mycobacterium tuberculosis H37Rv
ugcgggaaccccag

SEQ ID NO: 1340764 - RNA, 22 nt, Mycobacterium tuberculosis H37Rv
ugcggcuucggcagaccggcau

SEQ ID NO: 1340765 - RNA, 17 nt, Mycobacterium tuberculosis H37Rv
ugcggcuuggccaucac

SEQ ID NO: 1340766 - RNA, 15 nt, Mycobacterium tuberculosis H37Rv
ugcgggguuggccgu

SEQ ID NO: 1340767 - RNA, 12 nt, Mycobacterium tuberculosis H37Rv
ugcgggcagcac

SEQ ID NO: 1340768 - RNA, 18 nt, Mycobacterium tuberculosis H37Rv
ugcgggcagccgcccgcc

SEQ ID NO: 1340769 - RNA, 18 nt, Mycobacterium tuberculosis H37Rv
ugcgggucggcaucggag

SEQ ID NO: 1340770 - RNA, 21 nt, Mycobacterium tuberculosis H37Rv
ugcgggucguccgccugcacc

SEQ ID NO: 1340771 - RNA, 17 nt, Mycobacterium tuberculosis H37Rv
ugcgggugucgggcagc

SEQ ID NO: 1340772 - RNA, 18 nt, Mycobacterium tuberculosis H37Rv
ugcgguauugcccgggcg

SEQ ID NO: 1340773 - RNA, 20 nt, Mycobacterium tuberculosis H37Rv
ugcguagacauuggcuccga

SEQ ID NO: 1340774 - RNA, 19 nt, Mycobacterium tuberculosis H37Rv
ugcggcagcuggcgcagcc

SEQ ID NO: 1340775 - RNA, 14 nt, Mycobacterium tuberculosis H37Rv
ugcggcguggauca

SEQ ID NO: 1340776 - RNA, 19 nt, Mycobacterium tuberculosis H37Rv
ugcggcguauugcggccug

SEQ ID NO: 1340777 - RNA, 14 nt, Mycobacterium tuberculosis H37Rv
ugcggcgggcucgc

SEQ ID NO: 1340778 - RNA, 21 nt, Mycobacterium tuberculosis H37Rv
ugcggcugguguccagccagg

SEQ ID NO: 1340779 - RNA, 22 nt, Mycobacterium tuberculosis H37Rv
ugcggcugguguccagccaggc

SEQ ID NO: 1340780 - RNA, 13 nt, Mycobacterium tuberculosis H37Rv
ugcggcagcgcgg

SEQ ID NO: 1340781 - RNA, 16 nt, Mycobacterium tuberculosis H37Rv
ugcggcacgccggccg

SEQ ID NO: 1340782 - RNA, 15 nt, Mycobacterium tuberculosis H37Rv
ugcggcaacagcgcc

SEQ ID NO: 1340783 - RNA, 19 nt, Mycobacterium tuberculosis H37Rv
ugcgcuuccaacaccaacg

SEQ ID NO: 1340784 - RNA, 14 nt, Mycobacterium tuberculosis H37Rv
ugcgcugcagcuga

SEQ ID NO: 1340785 - RNA, 17 nt, Mycobacterium tuberculosis H37Rv
ugcgcugggugaugagc

SEQ ID NO: 1340786 - RNA, 15 nt, Mycobacterium tuberculosis H37Rv
ugcgcuggcacacuc

SEQ ID NO: 1340787 - RNA, 15 nt, Mycobacterium tuberculosis H37Rv
ugcgcaucgccacca

SEQ ID NO: 1340788 - RNA, 17 nt, Mycobacterium tuberculosis H37Rv
ugcgcaucgccaccauc

SEQ ID NO: 1340789 - RNA, 15 nt, Mycobacterium tuberculosis H37Rv
ugcgccacagcagcg

SEQ ID NO: 1340790 - RNA, 22 nt, Mycobacterium tuberculosis H37Rv
ugcgcuccaacaacuccagcag

SEQ ID NO: 1340791 - RNA, 12 nt, Mycobacterium tuberculosis H37Rv
ugcgcucauccg

SEQ ID NO: 1340792 - RNA, 19 nt, Mycobacterium tuberculosis H37Rv
ugcugguaccgggcuccaa

SEQ ID NO: 1340793 - RNA, 13 nt, Mycobacterium tuberculosis H37Rv
ugcuggccgaacc

SEQ ID NO: 1340794 - RNA, 14 nt, Mycobacterium tuberculosis H37Rv
ugcuggcagcggcc

SEQ ID NO: 1340795 - RNA, 15 nt, Mycobacterium tuberculosis H37Rv
ugcuggucgugccgc

SEQ ID NO: 1340796 - RNA, 18 nt, Mycobacterium tuberculosis H37Rv
ugcuggucagcggcgcga

SEQ ID NO: 1340797 - RNA, 17 nt, Mycobacterium tuberculosis H37Rv
ugcugucgaagugguag

SEQ ID NO: 1340798 - RNA, 17 nt, Mycobacterium tuberculosis H37Rv
ugcuggcagcggccucc

SEQ ID NO: 1340799 - RNA, 20 nt, Mycobacterium tuberculosis H37Rv
ugcugcgcggugccggccgu

SEQ ID NO: 1340800 - RNA, 20 nt, Mycobacterium tuberculosis H37Rv
ugcugcgcaauagcgacagc

SEQ ID NO: 1340801 - RNA, 14 nt, Mycobacterium tuberculosis H37Rv
ugcugcgcugucuu

SEQ ID NO: 1340802 - RNA, 16 nt, Mycobacterium tuberculosis H37Rv
ugcugacauuuccacc

SEQ ID NO: 1340803 - RNA, 17 nt, Mycobacterium tuberculosis H37Rv
ugcuuggccacuugcuc

SEQ ID NO: 1340804 - RNA, 13 nt, Mycobacterium tuberculosis H37Rv
ugcuuggccgcgc

SEQ ID NO: 1340805 - RNA, 22 nt, Mycobacterium tuberculosis H37Rv
ugcuugggcagcucguccagcg

SEQ ID NO: 1340806 - RNA, 15 nt, Mycobacterium tuberculosis H37Rv
ugcuugcgcagcacc

SEQ ID NO: 1340807 - RNA, 15 nt, Mycobacterium tuberculosis H37Rv
ugcuuggucgcccag

SEQ ID NO: 1340808 - RNA, 18 nt, Mycobacterium tuberculosis H37Rv
ugcuuggucgcccagcca

SEQ ID NO: 1340809 - RNA, 13 nt, Mycobacterium tuberculosis H37Rv
uggaacaccgcgg

SEQ ID NO: 1340810 - RNA, 16 nt, Mycobacterium tuberculosis H37Rv
uggaacugaugaacca

SEQ ID NO: 1340811 - RNA, 15 nt, Mycobacterium tuberculosis H37Rv
uggaacucacccuau

SEQ ID NO: 1340812 - RNA, 23 nt, Mycobacterium tuberculosis H37Rv
uggaagcggcgacuacccagcca

SEQ ID NO: 1340813 - RNA, 21 nt, Mycobacterium tuberculosis H37Rv
uggaagccgacgaccagcaga

SEQ ID NO: 1340814 - RNA, 18 nt, Mycobacterium tuberculosis H37Rv
uggaagccgacgaccagc

SEQ ID NO: 1340815 - RNA, 16 nt, Mycobacterium tuberculosis H37Rv
uggaaggcggccaggu

SEQ ID NO: 1340816 - RNA, 16 nt, Mycobacterium tuberculosis H37Rv
uggaccgcacugacaa

SEQ ID NO: 1340817 - RNA, 13 nt, Mycobacterium tuberculosis H37Rv
uggaccgccgccg

SEQ ID NO: 1340818 - RNA, 16 nt, Mycobacterium tuberculosis H37Rv
uggaccagcgggcggc

SEQ ID NO: 1340819 - RNA, 21 nt, Mycobacterium tuberculosis H37Rv
uggaccagcgccccggcgcgu

SEQ ID NO: 1340820 - RNA, 15 nt, Mycobacterium tuberculosis H37Rv
uggacgccuugcaca

SEQ ID NO: 1340821 - RNA, 21 nt, Mycobacterium tuberculosis H37Rv
uggacgccuugcacaagcuga

SEQ ID NO: 1340822 - RNA, 15 nt, Mycobacterium tuberculosis H37Rv
uggacgcgaacagcu

SEQ ID NO: 1340823 - RNA, 18 nt, Mycobacterium tuberculosis H37Rv
uggacgcgaacagcucgu

SEQ ID NO: 1340824 - RNA, 21 nt, Mycobacterium tuberculosis H37Rv
uggacgcccgaguugaagaau

SEQ ID NO: 1340825 - RNA, 20 nt, Mycobacterium tuberculosis H37Rv
uggacgcccgaguugaagaa

SEQ ID NO: 1340826 - RNA, 16 nt, Mycobacterium tuberculosis H37Rv
uggacgacccgggccg

SEQ ID NO: 1340827 - RNA, 14 nt, Mycobacterium tuberculosis H37Rv
uggacaaccucguc

SEQ ID NO: 1340828 - RNA, 16 nt, Mycobacterium tuberculosis H37Rv
uggacaccaccucguc

SEQ ID NO: 1340829 - RNA, 13 nt, Mycobacterium tuberculosis H37Rv
uggacaacagcuu

SEQ ID NO: 1340830 - RNA, 14 nt, Mycobacterium tuberculosis H37Rv
uggacaagcacagc

SEQ ID NO: 1340831 - RNA, 21 nt, Mycobacterium tuberculosis H37Rv
uggacaggucgcccaacaccg

SEQ ID NO: 1340832 - RNA, 14 nt, Mycobacterium tuberculosis H37Rv
uuaggcgcaguuaa

SEQ ID NO: 1340833 - RNA, 22 nt, Mycobacterium tuberculosis H37Rv
uuaggcguggcccaguccgcug

SEQ ID NO: 1340834 - RNA, 17 nt, Mycobacterium tuberculosis H37Rv
uuagucgccgcaguccg

SEQ ID NO: 1340835 - RNA, 13 nt, Mycobacterium tuberculosis H37Rv
uuagacuggcagg

SEQ ID NO: 1340836 - RNA, 15 nt, Mycobacterium tuberculosis H37Rv
uuagcagcacccggg

SEQ ID NO: 1340837 - RNA, 19 nt, Mycobacterium tuberculosis H37Rv
uuagcaccaguucccuaca

SEQ ID NO: 1340838 - RNA, 11 nt, Mycobacterium tuberculosis H37Rv
uuagccagguc

SEQ ID NO: 1340839 - RNA, 18 nt, Mycobacterium tuberculosis H37Rv
uuagcggcuugaacagcu

SEQ ID NO: 1340840 - RNA, 14 nt, Mycobacterium tuberculosis H37Rv
uuagcgguguggga

SEQ ID NO: 1340841 - RNA, 21 nt, Mycobacterium tuberculosis H37Rv
uuagcgcuugccgcugagccc

SEQ ID NO: 1340842 - RNA, 20 nt, Mycobacterium tuberculosis H37Rv
uuagcgcaugggccuuguug

SEQ ID NO: 1340843 - RNA, 18 nt, Mycobacterium tuberculosis H37Rv
uuaggccgccagccggcg

SEQ ID NO: 1340844 - RNA, 15 nt, Mycobacterium tuberculosis H37Rv
uuaccgauuggcccg

SEQ ID NO: 1340845 - RNA, 17 nt, Mycobacterium tuberculosis H37Rv
uuaccgccguugccgcc

SEQ ID NO: 1340846 - RNA, 15 nt, Mycobacterium tuberculosis H37Rv
uuaccauauccggac

SEQ ID NO: 1340847 - RNA, 18 nt, Mycobacterium tuberculosis H37Rv
uguguccgcucgccgcca

SEQ ID NO: 1340848 - RNA, 14 nt, Mycobacterium tuberculosis H37Rv
uguggucaccaggc

SEQ ID NO: 1340849 - RNA, 15 nt, Mycobacterium tuberculosis H37Rv
uguggucaccaggcc

SEQ ID NO: 1340850 - RNA, 18 nt, Mycobacterium tuberculosis H37Rv
uguggucgaguugaagaa

SEQ ID NO: 1340851 - RNA, 19 nt, Mycobacterium tuberculosis H37Rv
uguggucgaguugaagaau

SEQ ID NO: 1340852 - RNA, 13 nt, Mycobacterium tuberculosis H37Rv
ugugucggccugg

SEQ ID NO: 1340853 - RNA, 20 nt, Mycobacterium tuberculosis H37Rv
ugugugcaagccgaacaccg

SEQ ID NO: 1340854 - RNA, 12 nt, Mycobacterium tuberculosis H37Rv
ugugugcagcag

SEQ ID NO: 1340855 - RNA, 16 nt, Mycobacterium tuberculosis H37Rv
ugugugcagcagcauc

SEQ ID NO: 1340856 - RNA, 17 nt, Mycobacterium tuberculosis H37Rv
uguuaaccgggcacgga

SEQ ID NO: 1340857 - RNA, 13 nt, Mycobacterium tuberculosis H37Rv
uguggcccgucau

SEQ ID NO: 1340858 - RNA, 17 nt, Mycobacterium tuberculosis H37Rv
ugugcgugucacccaau

SEQ ID NO: 1340859 - RNA, 17 nt, Mycobacterium tuberculosis H37Rv
ugugcgucuccagcugg

SEQ ID NO: 1340860 - RNA, 16 nt, Mycobacterium tuberculosis H37Rv
ugugggugguuguguc

SEQ ID NO: 1340861 - RNA, 16 nt, Mycobacterium tuberculosis H37Rv
ugugguaccagcccgc

SEQ ID NO: 1340862 - RNA, 20 nt, Mycobacterium tuberculosis H37Rv
ugugggccauguggacggca

SEQ ID NO: 1340863 - RNA, 13 nt, Mycobacterium tuberculosis H37Rv
uguggggcggcuu

SEQ ID NO: 1340864 - RNA, 13 nt, Mycobacterium tuberculosis H37Rv
uguggggccgggc

SEQ ID NO: 1340865 - RNA, 17 nt, Mycobacterium tuberculosis H37Rv
uguggcggcguccagaa

SEQ ID NO: 1340866 - RNA, 21 nt, Mycobacterium tuberculosis H37Rv
uguggcugaucccggccaggc

SEQ ID NO: 1340867 - RNA, 17 nt, Mycobacterium tuberculosis H37Rv
ugucagcgcugagccgc

SEQ ID NO: 1340868 - RNA, 21 nt, Mycobacterium tuberculosis H37Rv
ugugaccgaacaacagcggca

SEQ ID NO: 1340869 - RNA, 14 nt, Mycobacterium tuberculosis H37Rv
ugucagccaccggu

SEQ ID NO: 1340870 - RNA, 14 nt, Mycobacterium tuberculosis H37Rv
ugucagccgucgcc

SEQ ID NO: 1340871 - RNA, 21 nt, Mycobacterium tuberculosis H37Rv
ugucagcgaacggccaggaca

SEQ ID NO: 1340872 - RNA, 14 nt, Mycobacterium tuberculosis H37Rv
ugucagcagcccau

SEQ ID NO: 1340873 - RNA, 21 nt, Mycobacterium tuberculosis H37Rv
ugugagcacaccgacagcacc

SEQ ID NO: 1340874 - RNA, 13 nt, Mycobacterium tuberculosis H37Rv
ugugaccgucagc

SEQ ID NO: 1340875 - RNA, 17 nt, Mycobacterium tuberculosis H37Rv
ugucacuguaccgggcg

SEQ ID NO: 1340876 - RNA, 17 nt, Mycobacterium tuberculosis H37Rv
ugucacccaauggagcc

SEQ ID NO: 1340877 - RNA, 20 nt, Mycobacterium tuberculosis H37Rv
ugucaccggcgucgcugccu

SEQ ID NO: 1340878 - RNA, 11 nt, Mycobacterium tuberculosis H37Rv
ugugagcgcgc

SEQ ID NO: 1340879 - RNA, 14 nt, Mycobacterium tuberculosis H37Rv
ugugcggccaggcg

SEQ ID NO: 1340880 - RNA, 13 nt, Mycobacterium tuberculosis H37Rv
ugugcggccaggc

SEQ ID NO: 1340881 - RNA, 13 nt, Mycobacterium tuberculosis H37Rv
ugugcggcagccc

SEQ ID NO: 1340882 - RNA, 17 nt, Mycobacterium tuberculosis H37Rv
ugugcgccgcagccugc

SEQ ID NO: 1340883 - RNA, 21 nt, Mycobacterium tuberculosis H37Rv
ugugcgauccagggccgacgc

SEQ ID NO: 1340884 - RNA, 17 nt, Mycobacterium tuberculosis H37Rv
ugugcgauccagggccg

SEQ ID NO: 1340885 - RNA, 20 nt, Mycobacterium tuberculosis H37Rv
ugugccgggcgaugcugggc

SEQ ID NO: 1340886 - RNA, 18 nt, Mycobacterium tuberculosis H37Rv
ugugccgcugcauccgca

SEQ ID NO: 1340887 - RNA, 14 nt, Mycobacterium tuberculosis H37Rv
uguucacgccgccg

SEQ ID NO: 1340888 - RNA, 19 nt, Mycobacterium tuberculosis H37Rv
uguuaucgaagcccgaguu

SEQ ID NO: 1340889 - RNA, 19 nt, Mycobacterium tuberculosis H37Rv
uguuccgugcgggucgucc

SEQ ID NO: 1340890 - RNA, 19 nt, Mycobacterium tuberculosis H37Rv
uguuccgggugccgcgccg

SEQ ID NO: 1340891 - RNA, 15 nt, Mycobacterium tuberculosis H37Rv
uguucgacugcagaa

SEQ ID NO: 1340892 - RNA, 18 nt, Mycobacterium tuberculosis H37Rv
uguuccagaaggccgcac

SEQ ID NO: 1340893 - RNA, 22 nt, Mycobacterium tuberculosis H37Rv
uguucagcuucgccagguggcc

SEQ ID NO: 1340894 - RNA, 18 nt, Mycobacterium tuberculosis H37Rv
uguugauugaccugcugg

SEQ ID NO: 1340895 - RNA, 19 nt, Mycobacterium tuberculosis H37Rv
uguugcugucgaaguuggu

SEQ ID NO: 1340896 - RNA, 14 nt, Mycobacterium tuberculosis H37Rv
uguugcugcugccg

SEQ ID NO: 1340897 - RNA, 18 nt, Mycobacterium tuberculosis H37Rv
uguugucgucgagcgcgc

SEQ ID NO: 1340898 - RNA, 15 nt, Mycobacterium tuberculosis H37Rv
uguugucggugucgg

SEQ ID NO: 1340899 - RNA, 17 nt, Mycobacterium tuberculosis H37Rv
uguuggcgcccgggccc

SEQ ID NO: 1340900 - RNA, 16 nt, Mycobacterium tuberculosis H37Rv
uguuggcguggaucuu

SEQ ID NO: 1340901 - RNA, 19 nt, Mycobacterium tuberculosis H37Rv
uguuggcguggaucuuggc

SEQ ID NO: 1340902 - RNA, 16 nt, Mycobacterium tuberculosis H37Rv
uguuggccaccaaacc

SEQ ID NO: 1340903 - RNA, 23 nt, Mycobacterium tuberculosis H37Rv
uguugguggauucgaucaggccu

SEQ ID NO: 1340904 - RNA, 16 nt, Mycobacterium tuberculosis H37Rv
uguuggugccagccgg

SEQ ID NO: 1340905 - RNA, 19 nt, Mycobacterium tuberculosis H37Rv
uguuuuuguauguucggcg

SEQ ID NO: 1340906 - RNA, 14 nt, Mycobacterium tuberculosis H37Rv
uguuuuugcacuga

SEQ ID NO: 1340907 - RNA, 12 nt, Mycobacterium tuberculosis H37Rv
uguuugacugcg

SEQ ID NO: 1340908 - RNA, 24 nt, Mycobacterium tuberculosis H37Rv
uguuugccggcuuugagccgcucg

SEQ ID NO: 1340909 - RNA, 17 nt, Mycobacterium tuberculosis H37Rv
uggaguauccggcagac

SEQ ID NO: 1340910 - RNA, 16 nt, Mycobacterium tuberculosis H37Rv
uggaguauccggcaga

SEQ ID NO: 1340911 - RNA, 21 nt, Mycobacterium tuberculosis H37Rv
uggagcuaugucauagcgcac

SEQ ID NO: 1340912 - RNA, 24 nt, Mycobacterium tuberculosis H37Rv
uggagcgccagccgcugccacagg

SEQ ID NO: 1340913 - RNA, 21 nt, Mycobacterium tuberculosis H37Rv
uggagcgcgccucgcccagca

SEQ ID NO: 1340914 - RNA, 11 nt, Mycobacterium tuberculosis H37Rv
uggagauggca

SEQ ID NO: 1340915 - RNA, 21 nt, Mycobacterium tuberculosis H37Rv
uggagauuggguccagcgagg

SEQ ID NO: 1340916 - RNA, 17 nt, Mycobacterium tuberculosis H37Rv
uggagcacagcacggca

SEQ ID NO: 1340917 - RNA, 19 nt, Mycobacterium tuberculosis H37Rv
uggagccgccaccgaggcc

SEQ ID NO: 1340918 - RNA, 20 nt, Mycobacterium tuberculosis H37Rv
uggagaaguuagccaccuug

SEQ ID NO: 1340919 - RNA, 20 nt, Mycobacterium tuberculosis H37Rv
uggacuuuauggcuagugcu

SEQ ID NO: 1340920 - RNA, 20 nt, Mycobacterium tuberculosis H37Rv
uggacgugucaucacgguca

SEQ ID NO: 1340921 - RNA, 23 nt, Mycobacterium tuberculosis H37Rv
uggacgugucaucacggucagcc

SEQ ID NO: 1340922 - RNA, 21 nt, Mycobacterium tuberculosis H37Rv
uggacugagucguaguaggcg

SEQ ID NO: 1340923 - RNA, 15 nt, Mycobacterium tuberculosis H37Rv
uggacggcagccagc

SEQ ID NO: 1340924 - RNA, 16 nt, Mycobacterium tuberculosis H37Rv
uggacgcgcaugcccc

SEQ ID NO: 1340925 - RNA, 16 nt, Mycobacterium tuberculosis H37Rv
uggacgcgaugaucau

SEQ ID NO: 1340926 - RNA, 12 nt, Mycobacterium tuberculosis H37Rv
uggacggccucc

SEQ ID NO: 1340927 - RNA, 22 nt, Mycobacterium tuberculosis H37Rv
uggauagcuuuucgcaagucuc

SEQ ID NO: 1340928 - RNA, 16 nt, Mycobacterium tuberculosis H37Rv
uggagugaggcugugc

SEQ ID NO: 1340929 - RNA, 22 nt, Mycobacterium tuberculosis H37Rv
uggauaauccaugacacugggg

SEQ ID NO: 1340930 - RNA, 18 nt, Mycobacterium tuberculosis H37Rv
uggaguuuccgaagcccg

SEQ ID NO: 1340931 - RNA, 11 nt, Mycobacterium tuberculosis H37Rv
uggauggacca

SEQ ID NO: 1340932 - RNA, 15 nt, Mycobacterium tuberculosis H37Rv
uggauggcgcccugc

SEQ ID NO: 1340933 - RNA, 21 nt, Mycobacterium tuberculosis H37Rv
uggaugaccgaaccuggucuu

SEQ ID NO: 1340934 - RNA, 18 nt, Mycobacterium tuberculosis H37Rv
uggaucccacgaguuggc

SEQ ID NO: 1340935 - RNA, 19 nt, Mycobacterium tuberculosis H37Rv
uggaucgucgcuguggcuu

SEQ ID NO: 1340936 - RNA, 16 nt, Mycobacterium tuberculosis H37Rv
uggauccggccaccac

SEQ ID NO: 1340937 - RNA, 17 nt, Mycobacterium tuberculosis H37Rv
uggaucgucgcuguggc

SEQ ID NO: 1340938 - RNA, 18 nt, Mycobacterium tuberculosis H37Rv
uggcaggugccuucuucg

SEQ ID NO: 1340939 - RNA, 22 nt, Mycobacterium tuberculosis H37Rv
uggcaggugaucccgaugguca

SEQ ID NO: 1340940 - RNA, 14 nt, Mycobacterium tuberculosis H37Rv
uggcagccccagcu

SEQ ID NO: 1340941 - RNA, 13 nt, Mycobacterium tuberculosis H37Rv
uggcagcgcggcc

SEQ ID NO: 1340942 - RNA, 19 nt, Mycobacterium tuberculosis H37Rv
uggcagcgccgauggccgc

SEQ ID NO: 1340943 - RNA, 20 nt, Mycobacterium tuberculosis H37Rv
uggcagcggccuccgggcca

SEQ ID NO: 1340944 - RNA, 22 nt, Mycobacterium tuberculosis H37Rv
uggcagcggccuccgggccaug

SEQ ID NO: 1340945 - RNA, 13 nt, Mycobacterium tuberculosis H37Rv
uggcagccugcug

SEQ ID NO: 1340946 - RNA, 12 nt, Mycobacterium tuberculosis H37Rv
uggcaggccagc

SEQ ID NO: 1340947 - RNA, 15 nt, Mycobacterium tuberculosis H37Rv
uggcaggcagguugg

SEQ ID NO: 1340948 - RNA, 20 nt, Mycobacterium tuberculosis H37Rv
uggcagcugcucuccgucgc

SEQ ID NO: 1340949 - RNA, 22 nt, Mycobacterium tuberculosis H37Rv
uggcagggccagcggcagccug

SEQ ID NO: 1340950 - RNA, 15 nt, Mycobacterium tuberculosis H37Rv
uggcaggccggcguc

SEQ ID NO: 1340951 - RNA, 20 nt, Mycobacterium tuberculosis H37Rv
uggcagaccggugagcaccg

SEQ ID NO: 1340952 - RNA, 15 nt, Mycobacterium tuberculosis H37Rv
uggcagcacgaccug

SEQ ID NO: 1340953 - RNA, 20 nt, Mycobacterium tuberculosis H37Rv
uggcagcaaaaacgcugccg

SEQ ID NO: 1340954 - RNA, 21 nt, Mycobacterium tuberculosis H37Rv
uggcagccagcggcgaagguc

SEQ ID NO: 1340955 - RNA, 20 nt, Mycobacterium tuberculosis H37Rv
uggcacgugaaagccgacca

SEQ ID NO: 1340956 - RNA, 22 nt, Mycobacterium tuberculosis H37Rv
uggcacgugaaagccgaccagc

SEQ ID NO: 1340957 - RNA, 24 nt, Mycobacterium tuberculosis H37Rv
uggcaaacgcacccaucgugcuga

SEQ ID NO: 1340958 - RNA, 15 nt, Mycobacterium tuberculosis H37Rv
uggauucgaucaggc

SEQ ID NO: 1340959 - RNA, 21 nt, Mycobacterium tuberculosis H37Rv
uggcaacgccgcgccguucca

SEQ ID NO: 1340960 - RNA, 17 nt, Mycobacterium tuberculosis H37Rv
uggcaacggcaucccgg

SEQ ID NO: 1340961 - RNA, 23 nt, Mycobacterium tuberculosis H37Rv
uggcaaccgaauugaacugagga

SEQ ID NO: 1340962 - RNA, 15 nt, Mycobacterium tuberculosis H37Rv
uggcaagcugucguc

SEQ ID NO: 1340963 - RNA, 22 nt, Mycobacterium tuberculosis H37Rv
uggcaagucaacaccgcggccg

SEQ ID NO: 1340964 - RNA, 17 nt, Mycobacterium tuberculosis H37Rv
uggcaagucaacaccgc

SEQ ID NO: 1340965 - RNA, 17 nt, Mycobacterium tuberculosis H37Rv
uggcccgaccgggaacc

SEQ ID NO: 1340966 - RNA, 20 nt, Mycobacterium tuberculosis H37Rv
uggccccgguggugcugccg

SEQ ID NO: 1340967 - RNA, 19 nt, Mycobacterium tuberculosis H37Rv
uggccccuuucugaagcug

SEQ ID NO: 1340968 - RNA, 17 nt, Mycobacterium tuberculosis H37Rv
uggccccgguggugcug

SEQ ID NO: 1340969 - RNA, 12 nt, Mycobacterium tuberculosis H37Rv
uggccccgggcg

SEQ ID NO: 1340970 - RNA, 22 nt, Mycobacterium tuberculosis H37Rv
uggcccccgacggugaaccacc

SEQ ID NO: 1340971 - RNA, 17 nt, Mycobacterium tuberculosis H37Rv
uggcccggugcagcagu

SEQ ID NO: 1340972 - RNA, 15 nt, Mycobacterium tuberculosis H37Rv
uggcccgggccgaag

SEQ ID NO: 1340973 - RNA, 17 nt, Mycobacterium tuberculosis H37Rv
uggcccgccggcaguga

SEQ ID NO: 1340974 - RNA, 22 nt, Mycobacterium tuberculosis H37Rv
uggcccgcggugacgcaacauc

SEQ ID NO: 1340975 - RNA, 22 nt, Mycobacterium tuberculosis H37Rv
uggcccgcucccugcacccagc

SEQ ID NO: 1340976 - RNA, 20 nt, Mycobacterium tuberculosis H37Rv
uggcccggaacaccgacguc

SEQ ID NO: 1340977 - RNA, 17 nt, Mycobacterium tuberculosis H37Rv
uggcccaucuugaccaa

SEQ ID NO: 1340978 - RNA, 13 nt, Mycobacterium tuberculosis H37Rv
uggcccagcgugu

SEQ ID NO: 1340979 - RNA, 18 nt, Mycobacterium tuberculosis H37Rv
uggccaugcuggucagcg

SEQ ID NO: 1340980 - RNA, 15 nt, Mycobacterium tuberculosis H37Rv
uggccaugguggaga

SEQ ID NO: 1340981 - RNA, 16 nt, Mycobacterium tuberculosis H37Rv
uggccauguccaccag

SEQ ID NO: 1340982 - RNA, 21 nt, Mycobacterium tuberculosis H37Rv
uggccauguccaccagcgugu

SEQ ID NO: 1340983 - RNA, 16 nt, Mycobacterium tuberculosis H37Rv
uggccgcaucgccuca

SEQ ID NO: 1340984 - RNA, 17 nt, Mycobacterium tuberculosis H37Rv
uggccgauuccgcgcgu

SEQ ID NO: 1340985 - RNA, 20 nt, Mycobacterium tuberculosis H37Rv
uggccgauuccgcgcguccg

SEQ ID NO: 1340986 - RNA, 16 nt, Mycobacterium tuberculosis H37Rv
uggccgccaccuccca

SEQ ID NO: 1340987 - RNA, 17 nt, Mycobacterium tuberculosis H37Rv
uggccgcccuggccgcc

SEQ ID NO: 1340988 - RNA, 22 nt, Mycobacterium tuberculosis H37Rv
uggccgccgcagcuccccgacc

SEQ ID NO: 1340989 - RNA, 20 nt, Mycobacterium tuberculosis H37Rv
uggccgccgaauccgacguc

SEQ ID NO: 1340990 - RNA, 16 nt, Mycobacterium tuberculosis H37Rv
uggccgcgagguaccc

SEQ ID NO: 1340991 - RNA, 14 nt, Mycobacterium tuberculosis H37Rv
uggccgccgucgac

SEQ ID NO: 1340992 - RNA, 13 nt, Mycobacterium tuberculosis H37Rv
uggccgccgcgag

SEQ ID NO: 1340993 - RNA, 21 nt, Mycobacterium tuberculosis H37Rv
uggccgccgcgaggaugcuga

SEQ ID NO: 1340994 - RNA, 15 nt, Mycobacterium tuberculosis H37Rv
uggccgccggcgccg

SEQ ID NO: 1340995 - RNA, 17 nt, Mycobacterium tuberculosis H37Rv
uggccgccggcgcuggc

SEQ ID NO: 1340996 - RNA, 13 nt, Mycobacterium tuberculosis H37Rv
uggcccugcuccu

SEQ ID NO: 1340997 - RNA, 17 nt, Mycobacterium tuberculosis H37Rv
uggccgaacauucccau

SEQ ID NO: 1340998 - RNA, 18 nt, Mycobacterium tuberculosis H37Rv
uggccgacagccaccgcg

SEQ ID NO: 1340999 - RNA, 22 nt, Mycobacterium tuberculosis H37Rv
uggccgacgucugguuggcugg

SEQ ID NO: 1341000 - RNA, 16 nt, Mycobacterium tuberculosis H37Rv
uggccgagcagggccg

SEQ ID NO: 1341001 - RNA, 16 nt, Mycobacterium tuberculosis H37Rv
uggcaucggccaucuc

SEQ ID NO: 1341002 - RNA, 17 nt, Mycobacterium tuberculosis H37Rv
uggcaucgcgagccagc

SEQ ID NO: 1341003 - RNA, 19 nt, Mycobacterium tuberculosis H37Rv
uggcaucgaacgcccugac

SEQ ID NO: 1341004 - RNA, 22 nt, Mycobacterium tuberculosis H37Rv
uggccaauagaagcacgucguc

SEQ ID NO: 1341005 - RNA, 17 nt, Mycobacterium tuberculosis H37Rv
uggccaaccccauggcc

SEQ ID NO: 1341006 - RNA, 16 nt, Mycobacterium tuberculosis H37Rv
uggcauugcgcccacc

SEQ ID NO: 1341007 - RNA, 13 nt, Mycobacterium tuberculosis H37Rv
uggccacccccgu

SEQ ID NO: 1341008 - RNA, 19 nt, Mycobacterium tuberculosis H37Rv
uggccacccggccgcgcgg

SEQ ID NO: 1341009 - RNA, 16 nt, Mycobacterium tuberculosis H37Rv
uggccaccagcuggcg

SEQ ID NO: 1341010 - RNA, 23 nt, Mycobacterium tuberculosis H37Rv
uggccagaccgcgcgcauaccua

SEQ ID NO: 1341011 - RNA, 23 nt, Mycobacterium tuberculosis H37Rv
uggccagaucgaacgcagccagc

SEQ ID NO: 1341012 - RNA, 16 nt, Mycobacterium tuberculosis H37Rv
uggccacuugcucggc

SEQ ID NO: 1341013 - RNA, 15 nt, Mycobacterium tuberculosis H37Rv
uggccacgcccaggc

SEQ ID NO: 1341014 - RNA, 19 nt, Mycobacterium tuberculosis H37Rv
uggccaguucggugagccg

SEQ ID NO: 1341015 - RNA, 17 nt, Mycobacterium tuberculosis H37Rv
uggccaucagcucgcca

SEQ ID NO: 1341016 - RNA, 23 nt, Mycobacterium tuberculosis H37Rv
uggccaucagcucgccagggucg

SEQ ID NO: 1341017 - RNA, 15 nt, Mycobacterium tuberculosis H37Rv
uggccagcagcgcgg

SEQ ID NO: 1341018 - RNA, 21 nt, Mycobacterium tuberculosis H37Rv
uggccagcaacugccgcaccc

SEQ ID NO: 1341019 - RNA, 19 nt, Mycobacterium tuberculosis H37Rv
uggccagcaccacggccag

SEQ ID NO: 1341020 - RNA, 12 nt, Mycobacterium tuberculosis H37Rv
uggccagcgcgu

SEQ ID NO: 1341021 - RNA, 13 nt, Mycobacterium tuberculosis H37Rv
uggccagcagccg

SEQ ID NO: 1341022 - RNA, 23 nt, Mycobacterium tuberculosis H37Rv
uggccggaauacccgcuggcccg

SEQ ID NO: 1341023 - RNA, 14 nt, Mycobacterium tuberculosis H37Rv
uggccgcugugggc

SEQ ID NO: 1341024 - RNA, 14 nt, Mycobacterium tuberculosis H37Rv
uggccgcugccagc

SEQ ID NO: 1341025 - RNA, 15 nt, Mycobacterium tuberculosis H37Rv
uggccgcugccagcc

SEQ ID NO: 1341026 - RNA, 22 nt, Mycobacterium tuberculosis H37Rv
uggccgcggcggucugggugag

SEQ ID NO: 1341027 - RNA, 14 nt, Mycobacterium tuberculosis H37Rv
uggccgcgcggucg

SEQ ID NO: 1341028 - RNA, 17 nt, Mycobacterium tuberculosis H37Rv
uggccgcgccucggucu

SEQ ID NO: 1341029 - RNA, 19 nt, Mycobacterium tuberculosis H37Rv
uggccgcgcaggggcggcg

SEQ ID NO: 1341030 - RNA, 23 nt, Mycobacterium tuberculosis H37Rv
uggccgggaccgccccggccagg

SEQ ID NO: 1341031 - RNA, 22 nt, Mycobacterium tuberculosis H37Rv
uggccggcgguaagcccagaca

SEQ ID NO: 1341032 - RNA, 20 nt, Mycobacterium tuberculosis H37Rv
uggccguaccggugaucgug

SEQ ID NO: 1341033 - RNA, 22 nt, Mycobacterium tuberculosis H37Rv
uggccgucagccaggugcccaa

SEQ ID NO: 1341034 - RNA, 17 nt, Mycobacterium tuberculosis H37Rv
uggccggugggccgccc

SEQ ID NO: 1341035 - RNA, 18 nt, Mycobacterium tuberculosis H37Rv
uggccgugcccgaaggaa

SEQ ID NO: 1341036 - RNA, 17 nt, Mycobacterium tuberculosis H37Rv
uggccgucgggugcagc

SEQ ID NO: 1341037 - RNA, 21 nt, Mycobacterium tuberculosis H37Rv
uggccggcgcugcccgggcug

SEQ ID NO: 1341038 - RNA, 15 nt, Mycobacterium tuberculosis H37Rv
uggccguccgguccg

SEQ ID NO: 1341039 - RNA, 19 nt, Mycobacterium tuberculosis H37Rv
uggccuuguuguccuucag

SEQ ID NO: 1341040 - RNA, 23 nt, Mycobacterium tuberculosis H37Rv
uggccuguuuguuugcugcggcg

SEQ ID NO: 1341041 - RNA, 23 nt, Mycobacterium tuberculosis H37Rv
uggccugcagcgcgacccguagc

SEQ ID NO: 1341042 - RNA, 21 nt, Mycobacterium tuberculosis H37Rv
uggccuugacagcuuucuugg

SEQ ID NO: 1341043 - RNA, 18 nt, Mycobacterium tuberculosis H37Rv
uggccucccacucaccca

SEQ ID NO: 1341044 - RNA, 19 nt, Mycobacterium tuberculosis H37Rv
uggccguggucgagguggg

SEQ ID NO: 1341045 - RNA, 13 nt, Mycobacterium tuberculosis H37Rv
uggccucauccac

SEQ ID NO: 1341046 - RNA, 21 nt, Mycobacterium tuberculosis H37Rv
uggccugauuccacugggccu

SEQ ID NO: 1341047 - RNA, 14 nt, Mycobacterium tuberculosis H37Rv
uggccucgaagggc

SEQ ID NO: 1341048 - RNA, 16 nt, Mycobacterium tuberculosis H37Rv
uggccugcccagcacc

SEQ ID NO: 1341049 - RNA, 19 nt, Mycobacterium tuberculosis H37Rv
uggcgauaaccgacgauca

SEQ ID NO: 1341050 - RNA, 21 nt, Mycobacterium tuberculosis H37Rv
uggcgagggcuaccggcgccg

SEQ ID NO: 1341051 - RNA, 15 nt, Mycobacterium tuberculosis H37Rv
uggcgaucagcagcc

SEQ ID NO: 1341052 - RNA, 17 nt, Mycobacterium tuberculosis H37Rv
uggcgaucaugagcagc

SEQ ID NO: 1341053 - RNA, 18 nt, Mycobacterium tuberculosis H37Rv
uggcgaucaugagcagca

SEQ ID NO: 1341054 - RNA, 16 nt, Mycobacterium tuberculosis H37Rv
uggcgauccaggccag

SEQ ID NO: 1341055 - RNA, 15 nt, Mycobacterium tuberculosis H37Rv
uggcgaccaccgcgu

SEQ ID NO: 1341056 - RNA, 22 nt, Mycobacterium tuberculosis H37Rv
uggcgaccaccgcgucgggccg

SEQ ID NO: 1341057 - RNA, 18 nt, Mycobacterium tuberculosis H37Rv
uggcgaaggccgcaauac

SEQ ID NO: 1341058 - RNA, 19 nt, Mycobacterium tuberculosis H37Rv
uggcgaaggacaacagccg

SEQ ID NO: 1341059 - RNA, 22 nt, Mycobacterium tuberculosis H37Rv
uggcgaaccgcagacccucguc

SEQ ID NO: 1341060 - RNA, 18 nt, Mycobacterium tuberculosis H37Rv
uggcgccggggccgccga

SEQ ID NO: 1341061 - RNA, 15 nt, Mycobacterium tuberculosis H37Rv
uggcgccccaggugg

SEQ ID NO: 1341062 - RNA, 22 nt, Mycobacterium tuberculosis H37Rv
uggcgccaugaagccgggcgcu

SEQ ID NO: 1341063 - RNA, 21 nt, Mycobacterium tuberculosis H37Rv
uggcgccaguucggcgggcgc

SEQ ID NO: 1341064 - RNA, 14 nt, Mycobacterium tuberculosis H37Rv
uggcgccagggccu

SEQ ID NO: 1341065 - RNA, 12 nt, Mycobacterium tuberculosis H37Rv
uggcgccagguc

SEQ ID NO: 1341066 - RNA, 21 nt, Mycobacterium tuberculosis H37Rv
uggcgccaggucggcgggcgc

SEQ ID NO: 1341067 - RNA, 15 nt, Mycobacterium tuberculosis H37Rv
uggcgccgaccugga

SEQ ID NO: 1341068 - RNA, 14 nt, Mycobacterium tuberculosis H37Rv
uggcgcccgggccc

SEQ ID NO: 1341069 - RNA, 18 nt, Mycobacterium tuberculosis H37Rv
uggcgcccgucuccagca

SEQ ID NO: 1341070 - RNA, 14 nt, Mycobacterium tuberculosis H37Rv
uggcgcccgugccg

SEQ ID NO: 1341071 - RNA, 13 nt, Mycobacterium tuberculosis H37Rv
uggcgcagcgccu

SEQ ID NO: 1341072 - RNA, 15 nt, Mycobacterium tuberculosis H37Rv
uggcgccacggcagc

SEQ ID NO: 1341073 - RNA, 14 nt, Mycobacterium tuberculosis H37Rv
uggcgauguagccu

SEQ ID NO: 1341074 - RNA, 20 nt, Mycobacterium tuberculosis H37Rv
uggcggaauucaggaagggc

SEQ ID NO: 1341075 - RNA, 20 nt, Mycobacterium tuberculosis H37Rv
uggcggaucgcgagcgccgc

SEQ ID NO: 1341076 - RNA, 20 nt, Mycobacterium tuberculosis H37Rv
uggcggcaggugcggcggca

SEQ ID NO: 1341077 - RNA, 16 nt, Mycobacterium tuberculosis H37Rv
uggcggccagcgcacc

SEQ ID NO: 1341078 - RNA, 19 nt, Mycobacterium tuberculosis H37Rv
uggcggccagcgcaccgcc

SEQ ID NO: 1341079 - RNA, 22 nt, Mycobacterium tuberculosis H37Rv
uggcggccaacggcuccgggcg

SEQ ID NO: 1341080 - RNA, 14 nt, Mycobacterium tuberculosis H37Rv
uggcggccgggucg

SEQ ID NO: 1341081 - RNA, 18 nt, Mycobacterium tuberculosis H37Rv
uggcggccuugcucagca

SEQ ID NO: 1341082 - RNA, 24 nt, Mycobacterium tuberculosis H37Rv
ugggauccgguggugggccguggg

SEQ ID NO: 1341083 - RNA, 19 nt, Mycobacterium tuberculosis H37Rv
ugggaucaggcugggcaga

SEQ ID NO: 1341084 - RNA, 21 nt, Mycobacterium tuberculosis H37Rv
ugggauagcgcgguuggcuga

SEQ ID NO: 1341085 - RNA, 19 nt, Mycobacterium tuberculosis H37Rv
ugggcagccagaucuccag

SEQ ID NO: 1341086 - RNA, 20 nt, Mycobacterium tuberculosis H37Rv
ugggcagaaucggugggcgg

SEQ ID NO: 1341087 - RNA, 20 nt, Mycobacterium tuberculosis H37Rv
ugggcagaccgaucggcagg

SEQ ID NO: 1341088 - RNA, 15 nt, Mycobacterium tuberculosis H37Rv
ugggcagcaggccca

SEQ ID NO: 1341089 - RNA, 19 nt, Mycobacterium tuberculosis H37Rv
ugggcaccuuggccaggaa

SEQ ID NO: 1341090 - RNA, 23 nt, Mycobacterium tuberculosis H37Rv
ugggcaauuccgccgagcgcaac

SEQ ID NO: 1341091 - RNA, 19 nt, Mycobacterium tuberculosis H37Rv
ugggcacuugcccgucggc

SEQ ID NO: 1341092 - RNA, 16 nt, Mycobacterium tuberculosis H37Rv
ugggcacguugugauc

SEQ ID NO: 1341093 - RNA, 15 nt, Mycobacterium tuberculosis H37Rv
ugggcaucaggccgc

SEQ ID NO: 1341094 - RNA, 23 nt, Mycobacterium tuberculosis H37Rv
ugggcaugcggauucgcgcuguc

SEQ ID NO: 1341095 - RNA, 20 nt, Mycobacterium tuberculosis H37Rv
ugggcaccacccgauuggcc

SEQ ID NO: 1341096 - RNA, 21 nt, Mycobacterium tuberculosis H37Rv
ugggcaauccggucagcgcgg

SEQ ID NO: 1341097 - RNA, 19 nt, Mycobacterium tuberculosis H37Rv
ugggauugaagcuggccac

SEQ ID NO: 1341098 - RNA, 18 nt, Mycobacterium tuberculosis H37Rv
ugggaucggauuuuccgc

SEQ ID NO: 1341099 - RNA, 16 nt, Mycobacterium tuberculosis H37Rv
uggggcuauggcgcag

SEQ ID NO: 1341100 - RNA, 17 nt, Mycobacterium tuberculosis H37Rv
uggggcuauggcgcagc

SEQ ID NO: 1341101 - RNA, 13 nt, Mycobacterium tuberculosis H37Rv
uggggcucgagug

SEQ ID NO: 1341102 - RNA, 19 nt, Mycobacterium tuberculosis H37Rv
uggggcgcgugggcgugca

SEQ ID NO: 1341103 - RNA, 16 nt, Mycobacterium tuberculosis H37Rv
uggguaugcacccagg

SEQ ID NO: 1341104 - RNA, 21 nt, Mycobacterium tuberculosis H37Rv
ugggugaaguguucgacaccc

SEQ ID NO: 1341105 - RNA, 17 nt, Mycobacterium tuberculosis H37Rv
ugggucuggcaggccag

SEQ ID NO: 1341106 - RNA, 20 nt, Mycobacterium tuberculosis H37Rv
uggguccccucccaccagcg

SEQ ID NO: 1341107 - RNA, 18 nt, Mycobacterium tuberculosis H37Rv
ugggugccggcagcggcg

SEQ ID NO: 1341108 - RNA, 21 nt, Mycobacterium tuberculosis H37Rv
ugggugcgccgucagcccagg

SEQ ID NO: 1341109 - RNA, 19 nt, Mycobacterium tuberculosis H37Rv
ugggugacguaggcgcuga

SEQ ID NO: 1341110 - RNA, 15 nt, Mycobacterium tuberculosis H37Rv
ugggugaucugcccu

SEQ ID NO: 1341111 - RNA, 14 nt, Mycobacterium tuberculosis H37Rv
ugggucagguuguc

SEQ ID NO: 1341112 - RNA, 20 nt, Mycobacterium tuberculosis H37Rv
ugggucggcuuccggugccg

SEQ ID NO: 1341113 - RNA, 21 nt, Mycobacterium tuberculosis H37Rv
ugggucaucgagucgaagaac

SEQ ID NO: 1341114 - RNA, 23 nt, Mycobacterium tuberculosis H37Rv
ugggccuccaccgcguccaggug

SEQ ID NO: 1341115 - RNA, 15 nt, Mycobacterium tuberculosis H37Rv
ugggccugccagucc

SEQ ID NO: 1341116 - RNA, 16 nt, Mycobacterium tuberculosis H37Rv
ugggccgguuccucag

SEQ ID NO: 1341117 - RNA, 18 nt, Mycobacterium tuberculosis H37Rv
ugggccgguuccucagcg

SEQ ID NO: 1341118 - RNA, 20 nt, Mycobacterium tuberculosis H37Rv
ugggccguacaacagcgcgc

SEQ ID NO: 1341119 - RNA, 21 nt, Mycobacterium tuberculosis H37Rv
ugggcauugcggcgcgggugc

SEQ ID NO: 1341120 - RNA, 19 nt, Mycobacterium tuberculosis H37Rv
ugggccgcccaaagaaaug

SEQ ID NO: 1341121 - RNA, 17 nt, Mycobacterium tuberculosis H37Rv
ugggccggucgaggccc

SEQ ID NO: 1341122 - RNA, 21 nt, Mycobacterium tuberculosis H37Rv
ugggccgggaugaagccaccc

SEQ ID NO: 1341123 - RNA, 19 nt, Mycobacterium tuberculosis H37Rv
ugggccgagagcagccagc

SEQ ID NO: 1341124 - RNA, 20 nt, Mycobacterium tuberculosis H37Rv
ugggcgagaccgcgagcagc

SEQ ID NO: 1341125 - RNA, 22 nt, Mycobacterium tuberculosis H37Rv
ugggcgaagcccagaucuugca

SEQ ID NO: 1341126 - RNA, 23 nt, Mycobacterium tuberculosis H37Rv
ugggcguucccccggcaccgccg

SEQ ID NO: 1341127 - RNA, 21 nt, Mycobacterium tuberculosis H37Rv
ugggcuaccgagauugggcug

SEQ ID NO: 1341128 - RNA, 24 nt, Mycobacterium tuberculosis H37Rv
ugggcuaccgagauugggcuggga

SEQ ID NO: 1341129 - RNA, 20 nt, Mycobacterium tuberculosis H37Rv
ugggcuguccuccugaacga

SEQ ID NO: 1341130 - RNA, 23 nt, Mycobacterium tuberculosis H37Rv
ugggcugcgcgucgagcagcacc

SEQ ID NO: 1341131 - RNA, 18 nt, Mycobacterium tuberculosis H37Rv
uggggccggaugucgacg

SEQ ID NO: 1341132 - RNA, 21 nt, Mycobacterium tuberculosis H37Rv
uggggcagccgggcgucgcug

SEQ ID NO: 1341133 - RNA, 18 nt, Mycobacterium tuberculosis H37Rv
uggucgacgaaucugcgg

SEQ ID NO: 1341134 - RNA, 16 nt, Mycobacterium tuberculosis H37Rv
uggucgacgccgagac

SEQ ID NO: 1341135 - RNA, 17 nt, Mycobacterium tuberculosis H37Rv
uggucgaguugaagaau

SEQ ID NO: 1341136 - RNA, 16 nt, Mycobacterium tuberculosis H37Rv
uggucgaucagguacu

SEQ ID NO: 1341137 - RNA, 16 nt, Mycobacterium tuberculosis H37Rv
uggucgaguugaagaa

SEQ ID NO: 1341138 - RNA, 15 nt, Mycobacterium tuberculosis H37Rv
uggucgagggcggcg

SEQ ID NO: 1341139 - RNA, 18 nt, Mycobacterium tuberculosis H37Rv
uggucgcaccgccggccu

SEQ ID NO: 1341140 - RNA, 16 nt, Mycobacterium tuberculosis H37Rv
uggucggugacugugc

SEQ ID NO: 1341141 - RNA, 19 nt, Mycobacterium tuberculosis H37Rv
uggucagugugaacugucc

SEQ ID NO: 1341142 - RNA, 20 nt, Mycobacterium tuberculosis H37Rv
uggucagugugaacuguccc

SEQ ID NO: 1341143 - RNA, 16 nt, Mycobacterium tuberculosis H37Rv
uggucagucaccaacc

SEQ ID NO: 1341144 - RNA, 17 nt, Mycobacterium tuberculosis H37Rv
ugguccgaccagcggcc

SEQ ID NO: 1341145 - RNA, 19 nt, Mycobacterium tuberculosis H37Rv
uggucccguucgcccgccc

SEQ ID NO: 1341146 - RNA, 20 nt, Mycobacterium tuberculosis H37Rv
uggucgaagaucgccugggg

SEQ ID NO: 1341147 - RNA, 22 nt, Mycobacterium tuberculosis H37Rv
uggucgaaacgguacgccgccg

SEQ ID NO: 1341148 - RNA, 23 nt, Mycobacterium tuberculosis H37Rv
ugguccugauguucugcgggggu

SEQ ID NO: 1341149 - RNA, 14 nt, Mycobacterium tuberculosis H37Rv
uggugaccugacgc

SEQ ID NO: 1341150 - RNA, 20 nt, Mycobacterium tuberculosis H37Rv
uggucucuagcaaagccagc

SEQ ID NO: 1341151 - RNA, 15 nt, Mycobacterium tuberculosis H37Rv
uggucucgguaggcg

SEQ ID NO: 1341152 - RNA, 16 nt, Mycobacterium tuberculosis H37Rv
uggucucuagcaaagc

SEQ ID NO: 1341153 - RNA, 17 nt, Mycobacterium tuberculosis H37Rv
uggucgugggccaccac

SEQ ID NO: 1341154 - RNA, 14 nt, Mycobacterium tuberculosis H37Rv
uggugaggcccccc

SEQ ID NO: 1341155 - RNA, 22 nt, Mycobacterium tuberculosis H37Rv
uggugaguaccaauccaggcca

SEQ ID NO: 1341156 - RNA, 21 nt, Mycobacterium tuberculosis H37Rv
ugguggccaugacggcuccga

SEQ ID NO: 1341157 - RNA, 15 nt, Mycobacterium tuberculosis H37Rv
ugguggcagcgcacc

SEQ ID NO: 1341158 - RNA, 13 nt, Mycobacterium tuberculosis H37Rv
ugguggcccggcu

SEQ ID NO: 1341159 - RNA, 13 nt, Mycobacterium tuberculosis H37Rv
ugguggcccgggc

SEQ ID NO: 1341160 - RNA, 23 nt, Mycobacterium tuberculosis H37Rv
ugguggagcggcgcggggguggg

SEQ ID NO: 1341161 - RNA, 19 nt, Mycobacterium tuberculosis H37Rv
ugguggaguucgcgcuggc

SEQ ID NO: 1341162 - RNA, 17 nt, Mycobacterium tuberculosis H37Rv
uggugugacgaucccca

SEQ ID NO: 1341163 - RNA, 16 nt, Mycobacterium tuberculosis H37Rv
ugguguuucaggcagc

SEQ ID NO: 1341164 - RNA, 22 nt, Mycobacterium tuberculosis H37Rv
ugguggcgaucaucggccccga

SEQ ID NO: 1341165 - RNA, 15 nt, Mycobacterium tuberculosis H37Rv
ugguggcgaccccgc

SEQ ID NO: 1341166 - RNA, 18 nt, Mycobacterium tuberculosis H37Rv
ugguggcguaucgggccc

SEQ ID NO: 1341167 - RNA, 16 nt, Mycobacterium tuberculosis H37Rv
uggugauccgagacca

SEQ ID NO: 1341168 - RNA, 16 nt, Mycobacterium tuberculosis H37Rv
ugguguccaccaccgg

SEQ ID NO: 1341169 - RNA, 14 nt, Mycobacterium tuberculosis H37Rv
ugguguauucgcgg

SEQ ID NO: 1341170 - RNA, 22 nt, Mycobacterium tuberculosis H37Rv
uggugucagcugauuaccgaca

SEQ ID NO: 1341171 - RNA, 14 nt, Mycobacterium tuberculosis H37Rv
uggugucgcggccg

SEQ ID NO: 1341172 - RNA, 15 nt, Mycobacterium tuberculosis H37Rv
uggugucgcucaguu

SEQ ID NO: 1341173 - RNA, 20 nt, Mycobacterium tuberculosis H37Rv
uggucagccgcggcggcagc

SEQ ID NO: 1341174 - RNA, 18 nt, Mycobacterium tuberculosis H37Rv
ugguaugccgcccgcagc

SEQ ID NO: 1341175 - RNA, 16 nt, Mycobacterium tuberculosis H37Rv
ugguauggguccucga

SEQ ID NO: 1341176 - RNA, 15 nt, Mycobacterium tuberculosis H37Rv
uggucaccugcugca

SEQ ID NO: 1341177 - RNA, 23 nt, Mycobacterium tuberculosis H37Rv
uggucacggcgucgacuggccgu

SEQ ID NO: 1341178 - RNA, 20 nt, Mycobacterium tuberculosis H37Rv
uggucacgcagucgggcagc

SEQ ID NO: 1341179 - RNA, 19 nt, Mycobacterium tuberculosis H37Rv
uggguguugcuggccgcga

SEQ ID NO: 1341180 - RNA, 22 nt, Mycobacterium tuberculosis H37Rv
ugggugcgccgucagcccaggu

SEQ ID NO: 1341181 - RNA, 20 nt, Mycobacterium tuberculosis H37Rv
uggguugaaaacgcccggca

SEQ ID NO: 1341182 - RNA, 19 nt, Mycobacterium tuberculosis H37Rv
uggguugauuggccccggc

SEQ ID NO: 1341183 - RNA, 24 nt, Mycobacterium tuberculosis H37Rv
uggguugcgaacucggccgugugc

SEQ ID NO: 1341184 - RNA, 23 nt, Mycobacterium tuberculosis H37Rv
uggguuucaaagcgacagcgcgg

SEQ ID NO: 1341185 - RNA, 15 nt, Mycobacterium tuberculosis H37Rv
ugguacccagcgcgg

SEQ ID NO: 1341186 - RNA, 16 nt, Mycobacterium tuberculosis H37Rv
ugguacccagcgcggc

SEQ ID NO: 1341187 - RNA, 18 nt, Mycobacterium tuberculosis H37Rv
ugguacccgcgccgcgca

SEQ ID NO: 1341188 - RNA, 18 nt, Mycobacterium tuberculosis H37Rv
ugguaccagcccgccguc

SEQ ID NO: 1341189 - RNA, 15 nt, Mycobacterium tuberculosis H37Rv
uguaggcuuccagcu

SEQ ID NO: 1341190 - RNA, 14 nt, Mycobacterium tuberculosis H37Rv
uguaggggcgccuu

SEQ ID NO: 1341191 - RNA, 14 nt, Mycobacterium tuberculosis H37Rv
uguaguacagcgca

SEQ ID NO: 1341192 - RNA, 16 nt, Mycobacterium tuberculosis H37Rv
uguagcucggacccuc

SEQ ID NO: 1341193 - RNA, 20 nt, Mycobacterium tuberculosis H37Rv
uguagccgagcacgggcaga

SEQ ID NO: 1341194 - RNA, 13 nt, Mycobacterium tuberculosis H37Rv
uguagcagcgcgg

SEQ ID NO: 1341195 - RNA, 20 nt, Mycobacterium tuberculosis H37Rv
uguagccaaccguguaggcc

SEQ ID NO: 1341196 - RNA, 20 nt, Mycobacterium tuberculosis H37Rv
uguagccagcggcugcccau

SEQ ID NO: 1341197 - RNA, 15 nt, Mycobacterium tuberculosis H37Rv
uguagacggcggcau

SEQ ID NO: 1341198 - RNA, 13 nt, Mycobacterium tuberculosis H37Rv
uguagaucagcaa

SEQ ID NO: 1341199 - RNA, 12 nt, Mycobacterium tuberculosis H37Rv
uguagcacaccg

SEQ ID NO: 1341200 - RNA, 23 nt, Mycobacterium tuberculosis H37Rv
ugucacaacgcgugaccagggcc

SEQ ID NO: 1341201 - RNA, 22 nt, Mycobacterium tuberculosis H37Rv
uguacugcggugccacggugac

SEQ ID NO: 1341202 - RNA, 18 nt, Mycobacterium tuberculosis H37Rv
uguacccgaccagcacca

SEQ ID NO: 1341203 - RNA, 18 nt, Mycobacterium tuberculosis H37Rv
uguaccccagcgccacca

SEQ ID NO: 1341204 - RNA, 23 nt, Mycobacterium tuberculosis H37Rv
ucuucagguccaccgcugccggc

SEQ ID NO: 1341205 - RNA, 18 nt, Mycobacterium tuberculosis H37Rv
ucuucgcuaccuucuugg

SEQ ID NO: 1341206 - RNA, 17 nt, Mycobacterium tuberculosis H37Rv
ucuucgcgauguccucg

SEQ ID NO: 1341207 - RNA, 20 nt, Mycobacterium tuberculosis H37Rv
ucuucgccgaugaauuucau

SEQ ID NO: 1341208 - RNA, 20 nt, Mycobacterium tuberculosis H37Rv
ucuucgguuaaggugcgauc

SEQ ID NO: 1341209 - RNA, 19 nt, Mycobacterium tuberculosis H37Rv
ucuucgggcucguccagca

SEQ ID NO: 1341210 - RNA, 15 nt, Mycobacterium tuberculosis H37Rv
ucuucggccagcucc

SEQ ID NO: 1341211 - RNA, 14 nt, Mycobacterium tuberculosis H37Rv
ucuucucggcuacu

SEQ ID NO: 1341212 - RNA, 14 nt, Mycobacterium tuberculosis H37Rv
ucuucuucuugacc

SEQ ID NO: 1341213 - RNA, 16 nt, Mycobacterium tuberculosis H37Rv
ucugggguccggugac

SEQ ID NO: 1341214 - RNA, 18 nt, Mycobacterium tuberculosis H37Rv
ucugggguuggcucggcg

SEQ ID NO: 1341215 - RNA, 14 nt, Mycobacterium tuberculosis H37Rv
ucuggguaacaccu

SEQ ID NO: 1341216 - RNA, 11 nt, Mycobacterium tuberculosis H37Rv
ucugggcuguc

SEQ ID NO: 1341217 - RNA, 22 nt, Mycobacterium tuberculosis H37Rv
ucugggcuuucgcgugcggcug

SEQ ID NO: 1341218 - RNA, 18 nt, Mycobacterium tuberculosis H37Rv
ucuggcacaugcucaguc

SEQ ID NO: 1341219 - RNA, 21 nt, Mycobacterium tuberculosis H37Rv
ucuggcgacucgugucugccu

SEQ ID NO: 1341220 - RNA, 24 nt, Mycobacterium tuberculosis H37Rv
ucuggcgagggcuaccggcgccgc

SEQ ID NO: 1341221 - RNA, 13 nt, Mycobacterium tuberculosis H37Rv
ucugcgccaggcg

SEQ ID NO: 1341222 - RNA, 19 nt, Mycobacterium tuberculosis H37Rv
ucugcgccaggggcaccau

SEQ ID NO: 1341223 - RNA, 18 nt, Mycobacterium tuberculosis H37Rv
ucuguugacucugcgucc

SEQ ID NO: 1341224 - RNA, 14 nt, Mycobacterium tuberculosis H37Rv
ucuggucgggucgc

SEQ ID NO: 1341225 - RNA, 22 nt, Mycobacterium tuberculosis H37Rv
ucuggucggcuacggccagugc

SEQ ID NO: 1341226 - RNA, 18 nt, Mycobacterium tuberculosis H37Rv
ucugugcgcggacaccuu

SEQ ID NO: 1341227 - RNA, 15 nt, Mycobacterium tuberculosis H37Rv
ucugauucaggcgcc

SEQ ID NO: 1341228 - RNA, 23 nt, Mycobacterium tuberculosis H37Rv
ucugagcgcggguggcagcggcg

SEQ ID NO: 1341229 - RNA, 21 nt, Mycobacterium tuberculosis H37Rv
ucugagcgcggguggcagcgg

SEQ ID NO: 1341230 - RNA, 15 nt, Mycobacterium tuberculosis H37Rv
ucugacccaccgccc

SEQ ID NO: 1341231 - RNA, 14 nt, Mycobacterium tuberculosis H37Rv
ucucgcgcgcggcg

SEQ ID NO: 1341232 - RNA, 20 nt, Mycobacterium tuberculosis H37Rv
ucucgcgaagaucagcggau

SEQ ID NO: 1341233 - RNA, 20 nt, Mycobacterium tuberculosis H37Rv
ucucgccgaccuuggcgucg

SEQ ID NO: 1341234 - RNA, 18 nt, Mycobacterium tuberculosis H37Rv
ucucgcaucggccucgag

SEQ ID NO: 1341235 - RNA, 14 nt, Mycobacterium tuberculosis H37Rv
ucucgcccacccgc

SEQ ID NO: 1341236 - RNA, 22 nt, Mycobacterium tuberculosis H37Rv
ucuccuugggcgacgcggcgcc

SEQ ID NO: 1341237 - RNA, 18 nt, Mycobacterium tuberculosis H37Rv
ucucgaaagccgcggccg

SEQ ID NO: 1341238 - RNA, 14 nt, Mycobacterium tuberculosis H37Rv
ucugaaccugcuga

SEQ ID NO: 1341239 - RNA, 23 nt, Mycobacterium tuberculosis H37Rv
ucugccgccgcggccacaaccuc

SEQ ID NO: 1341240 - RNA, 20 nt, Mycobacterium tuberculosis H37Rv
ucugcccgauacccggugau

SEQ ID NO: 1341241 - RNA, 20 nt, Mycobacterium tuberculosis H37Rv
ucugcccgcccagcccggcg

SEQ ID NO: 1341242 - RNA, 15 nt, Mycobacterium tuberculosis H37Rv
ucugcccugcacuuc

SEQ ID NO: 1341243 - RNA, 14 nt, Mycobacterium tuberculosis H37Rv
ucugccuuaccaac

SEQ ID NO: 1341244 - RNA, 14 nt, Mycobacterium tuberculosis H37Rv
ucugccgggagacg

SEQ ID NO: 1341245 - RNA, 17 nt, Mycobacterium tuberculosis H37Rv
ucugccagcacccugau

SEQ ID NO: 1341246 - RNA, 18 nt, Mycobacterium tuberculosis H37Rv
ucugccacguugaucccg

SEQ ID NO: 1341247 - RNA, 14 nt, Mycobacterium tuberculosis H37Rv
ucugcagugcagcg

SEQ ID NO: 1341248 - RNA, 17 nt, Mycobacterium tuberculosis H37Rv
ucugcaggcccaggcug

SEQ ID NO: 1341249 - RNA, 16 nt, Mycobacterium tuberculosis H37Rv
ucgugccggcguugcc

SEQ ID NO: 1341250 - RNA, 19 nt, Mycobacterium tuberculosis H37Rv
ucgugcacggcggccaggg

SEQ ID NO: 1341251 - RNA, 12 nt, Mycobacterium tuberculosis H37Rv
ucgugcacggcg

SEQ ID NO: 1341252 - RNA, 21 nt, Mycobacterium tuberculosis H37Rv
ucgugcacgacgacaucgagc

SEQ ID NO: 1341253 - RNA, 14 nt, Mycobacterium tuberculosis H37Rv
ucgugcagcccaag

SEQ ID NO: 1341254 - RNA, 13 nt, Mycobacterium tuberculosis H37Rv
ucgugccgggcca

SEQ ID NO: 1341255 - RNA, 16 nt, Mycobacterium tuberculosis H37Rv
ucgugccggggcugcc

SEQ ID NO: 1341256 - RNA, 15 nt, Mycobacterium tuberculosis H37Rv
ucgugcggcacuccc

SEQ ID NO: 1341257 - RNA, 20 nt, Mycobacterium tuberculosis H37Rv
ucguguccaccggaccgacc

SEQ ID NO: 1341258 - RNA, 22 nt, Mycobacterium tuberculosis H37Rv
ucguggugagaucaugagguga

SEQ ID NO: 1341259 - RNA, 16 nt, Mycobacterium tuberculosis H37Rv
ucguggggaccucggc

SEQ ID NO: 1341260 - RNA, 15 nt, Mycobacterium tuberculosis H37Rv
ucguggcgcucggcg

SEQ ID NO: 1341261 - RNA, 12 nt, Mycobacterium tuberculosis H37Rv
ucguggagcuca

SEQ ID NO: 1341262 - RNA, 20 nt, Mycobacterium tuberculosis H37Rv
ucguggauccagccaugcgg

SEQ ID NO: 1341263 - RNA, 16 nt, Mycobacterium tuberculosis H37Rv
ucguggaucugccucu

SEQ ID NO: 1341264 - RNA, 16 nt, Mycobacterium tuberculosis H37Rv
ucgucgaguuggccau

SEQ ID NO: 1341265 - RNA, 15 nt, Mycobacterium tuberculosis H37Rv
ucgucgaucuugccg

SEQ ID NO: 1341266 - RNA, 21 nt, Mycobacterium tuberculosis H37Rv
ucgucgagguccucgucgucg

SEQ ID NO: 1341267 - RNA, 19 nt, Mycobacterium tuberculosis H37Rv
ucgucgagcaccacccggg

SEQ ID NO: 1341268 - RNA, 21 nt, Mycobacterium tuberculosis H37Rv
ucgucgagcaccacccgggcc

SEQ ID NO: 1341269 - RNA, 18 nt, Mycobacterium tuberculosis H37Rv
ucgucgagaagaucucgu

SEQ ID NO: 1341270 - RNA, 17 nt, Mycobacterium tuberculosis H37Rv
ucgucgaacauggcacg

SEQ ID NO: 1341271 - RNA, 14 nt, Mycobacterium tuberculosis H37Rv
ucgucgaccaggcc

SEQ ID NO: 1341272 - RNA, 14 nt, Mycobacterium tuberculosis H37Rv
ucgucucggccacg

SEQ ID NO: 1341273 - RNA, 22 nt, Mycobacterium tuberculosis H37Rv
ucggcaggguggccagcaggcg

SEQ ID NO: 1341274 - RNA, 12 nt, Mycobacterium tuberculosis H37Rv
ucggcagcagcg

SEQ ID NO: 1341275 - RNA, 13 nt, Mycobacterium tuberculosis H37Rv
ucggcauccgcgg

SEQ ID NO: 1341276 - RNA, 21 nt, Mycobacterium tuberculosis H37Rv
ucgucaaaucuggcuggacca

SEQ ID NO: 1341277 - RNA, 20 nt, Mycobacterium tuberculosis H37Rv
ucguagcgcgcauagggcug

SEQ ID NO: 1341278 - RNA, 15 nt, Mycobacterium tuberculosis H37Rv
ucgucagucaacuca

SEQ ID NO: 1341279 - RNA, 23 nt, Mycobacterium tuberculosis H37Rv
ucgucacgcggguugcgcggcuu

SEQ ID NO: 1341280 - RNA, 16 nt, Mycobacterium tuberculosis H37Rv
ucguuuggcgccgccg

SEQ ID NO: 1341281 - RNA, 19 nt, Mycobacterium tuberculosis H37Rv
ucguugcuggcggccagca

SEQ ID NO: 1341282 - RNA, 19 nt, Mycobacterium tuberculosis H37Rv
ucguugccggacaaccugg

SEQ ID NO: 1341283 - RNA, 16 nt, Mycobacterium tuberculosis H37Rv
ucguugaccggccgga

SEQ ID NO: 1341284 - RNA, 22 nt, Mycobacterium tuberculosis H37Rv
ucguugaggccggugaacggca

SEQ ID NO: 1341285 - RNA, 13 nt, Mycobacterium tuberculosis H37Rv
ucuaccuccgcca

SEQ ID NO: 1341286 - RNA, 18 nt, Mycobacterium tuberculosis H37Rv
ucuaccagccgccccggc

SEQ ID NO: 1341287 - RNA, 21 nt, Mycobacterium tuberculosis H37Rv
ucuaccaccuugccgaacacu

SEQ ID NO: 1341288 - RNA, 22 nt, Mycobacterium tuberculosis H37Rv
ucuagcgccucgccggccaccc

SEQ ID NO: 1341289 - RNA, 12 nt, Mycobacterium tuberculosis H37Rv
ucuccaugcucg

SEQ ID NO: 1341290 - RNA, 12 nt, Mycobacterium tuberculosis H37Rv
ucuccaccuucu

SEQ ID NO: 1341291 - RNA, 17 nt, Mycobacterium tuberculosis H37Rv
ucuccaccgucgccgcc

SEQ ID NO: 1341292 - RNA, 23 nt, Mycobacterium tuberculosis H37Rv
ucuccccagagcugguccuccaa

SEQ ID NO: 1341293 - RNA, 23 nt, Mycobacterium tuberculosis H37Rv
ucuccgggucgaugucggggccg

SEQ ID NO: 1341294 - RNA, 19 nt, Mycobacterium tuberculosis H37Rv
ucuccaccccgucugcagg

SEQ ID NO: 1341295 - RNA, 13 nt, Mycobacterium tuberculosis H37Rv
ucucaccgggccc

SEQ ID NO: 1341296 - RNA, 21 nt, Mycobacterium tuberculosis H37Rv
ucucaagggcaucaaccaacu

SEQ ID NO: 1341297 - RNA, 23 nt, Mycobacterium tuberculosis H37Rv
ucgcuaaagcuaaacccccaccg

SEQ ID NO: 1341298 - RNA, 14 nt, Mycobacterium tuberculosis H37Rv
ucgcguuguaggcu

SEQ ID NO: 1341299 - RNA, 15 nt, Mycobacterium tuberculosis H37Rv
ucgcuaauugcggcc

SEQ ID NO: 1341300 - RNA, 17 nt, Mycobacterium tuberculosis H37Rv
ucgcuaccuucuuggcu

SEQ ID NO: 1341301 - RNA, 14 nt, Mycobacterium tuberculosis H37Rv
ucgcggugguuggg

SEQ ID NO: 1341302 - RNA, 21 nt, Mycobacterium tuberculosis H37Rv
ucgcggucccacggccggccg

SEQ ID NO: 1341303 - RNA, 16 nt, Mycobacterium tuberculosis H37Rv
ucgcgucgagagaacg

SEQ ID NO: 1341304 - RNA, 18 nt, Mycobacterium tuberculosis H37Rv
ucgcguucugcaccagcu

SEQ ID NO: 1341305 - RNA, 15 nt, Mycobacterium tuberculosis H37Rv
ucgcgugccacagca

SEQ ID NO: 1341306 - RNA, 17 nt, Mycobacterium tuberculosis H37Rv
ucgcgucugggugcagg

SEQ ID NO: 1341307 - RNA, 16 nt, Mycobacterium tuberculosis H37Rv
ucgcugcaccagcugc

SEQ ID NO: 1341308 - RNA, 15 nt, Mycobacterium tuberculosis H37Rv
ucgcugagcacggcg

SEQ ID NO: 1341309 - RNA, 13 nt, Mycobacterium tuberculosis H37Rv
ucgcugagcagcg

SEQ ID NO: 1341310 - RNA, 18 nt, Mycobacterium tuberculosis H37Rv
ucgcugacggcaaacgac

SEQ ID NO: 1341311 - RNA, 19 nt, Mycobacterium tuberculosis H37Rv
ucgcugaccgcguagacca

SEQ ID NO: 1341312 - RNA, 16 nt, Mycobacterium tuberculosis H37Rv
ucgcucugugucgccg

SEQ ID NO: 1341313 - RNA, 13 nt, Mycobacterium tuberculosis H37Rv
ucgcucccccgcu

SEQ ID NO: 1341314 - RNA, 14 nt, Mycobacterium tuberculosis H37Rv
ucgcucgcugaugc

SEQ ID NO: 1341315 - RNA, 15 nt, Mycobacterium tuberculosis H37Rv
ucgcucgccgagcug

SEQ ID NO: 1341316 - RNA, 13 nt, Mycobacterium tuberculosis H37Rv
ucgcuucgcaagu

SEQ ID NO: 1341317 - RNA, 23 nt, Mycobacterium tuberculosis H37Rv
ucggaaacggaccuccucgccca

SEQ ID NO: 1341318 - RNA, 19 nt, Mycobacterium tuberculosis H37Rv
ucggaacgaucauuccugc

SEQ ID NO: 1341319 - RNA, 20 nt, Mycobacterium tuberculosis H37Rv
ucggaaucggcggaugaugc

SEQ ID NO: 1341320 - RNA, 15 nt, Mycobacterium tuberculosis H37Rv
ucggacaacacggcg

SEQ ID NO: 1341321 - RNA, 21 nt, Mycobacterium tuberculosis H37Rv
ucggaagaaacgucugccacg

SEQ ID NO: 1341322 - RNA, 23 nt, Mycobacterium tuberculosis H37Rv
ucggaacuagccaguuacguugu

SEQ ID NO: 1341323 - RNA, 18 nt, Mycobacterium tuberculosis H37Rv
ucggcagccaugcggcug

SEQ ID NO: 1341324 - RNA, 15 nt, Mycobacterium tuberculosis H37Rv
ucggcagcagcgcaa

SEQ ID NO: 1341325 - RNA, 20 nt, Mycobacterium tuberculosis H37Rv
ucggcacgccauaccggcug

SEQ ID NO: 1341326 - RNA, 17 nt, Mycobacterium tuberculosis H37Rv
ucggcacgacccgggaa

SEQ ID NO: 1341327 - RNA, 20 nt, Mycobacterium tuberculosis H37Rv
ucggcacgacccgggaagga

SEQ ID NO: 1341328 - RNA, 22 nt, Mycobacterium tuberculosis H37Rv
ucggcacgacccgggaaggaac

SEQ ID NO: 1341329 - RNA, 18 nt, Mycobacterium tuberculosis H37Rv
ucggcacggauuuucgca

SEQ ID NO: 1341330 - RNA, 16 nt, Mycobacterium tuberculosis H37Rv
ucggcacgucguuggg

SEQ ID NO: 1341331 - RNA, 22 nt, Mycobacterium tuberculosis H37Rv
ucggcacccggcagagcacgcg

SEQ ID NO: 1341332 - RNA, 12 nt, Mycobacterium tuberculosis H37Rv
ucggcaccccac

SEQ ID NO: 1341333 - RNA, 19 nt, Mycobacterium tuberculosis H37Rv
ucggcaccccacgccugcc

SEQ ID NO: 1341334 - RNA, 16 nt, Mycobacterium tuberculosis H37Rv
ucggcaccgcggccgc

SEQ ID NO: 1341335 - RNA, 15 nt, Mycobacterium tuberculosis H37Rv
ucggcaccgcggccg

SEQ ID NO: 1341336 - RNA, 15 nt, Mycobacterium tuberculosis H37Rv
ucggcaccagcagcc

SEQ ID NO: 1341337 - RNA, 22 nt, Mycobacterium tuberculosis H37Rv
ucggcaacgacccgccgcccca

SEQ ID NO: 1341338 - RNA, 15 nt, Mycobacterium tuberculosis H37Rv
ucggcaacggcggcg

SEQ ID NO: 1341339 - RNA, 20 nt, Mycobacterium tuberculosis H37Rv
ucggcaaggacguggcgcug

SEQ ID NO: 1341340 - RNA, 12 nt, Mycobacterium tuberculosis H37Rv
ucggaccacauc

SEQ ID NO: 1341341 - RNA, 14 nt, Mycobacterium tuberculosis H37Rv
ucggacagcgccug

SEQ ID NO: 1341342 - RNA, 14 nt, Mycobacterium tuberculosis H37Rv
ucgccgccgggcag

SEQ ID NO: 1341343 - RNA, 20 nt, Mycobacterium tuberculosis H37Rv
ucgccgccguugccgccguc

SEQ ID NO: 1341344 - RNA, 17 nt, Mycobacterium tuberculosis H37Rv
ucgccgccguugccgcc

SEQ ID NO: 1341345 - RNA, 23 nt, Mycobacterium tuberculosis H37Rv
ucgccgccguugccgccgguguu

SEQ ID NO: 1341346 - RNA, 23 nt, Mycobacterium tuberculosis H37Rv
ucgccgccguugccgccgucguu

SEQ ID NO: 1341347 - RNA, 14 nt, Mycobacterium tuberculosis H37Rv
ucgccgcgcagccu

SEQ ID NO: 1341348 - RNA, 19 nt, Mycobacterium tuberculosis H37Rv
ucgccggccaacugggccg

SEQ ID NO: 1341349 - RNA, 15 nt, Mycobacterium tuberculosis H37Rv
ucgccgccggcgccg

SEQ ID NO: 1341350 - RNA, 23 nt, Mycobacterium tuberculosis H37Rv
ucgccggcacacccaucagcccu

SEQ ID NO: 1341351 - RNA, 14 nt, Mycobacterium tuberculosis H37Rv
ucgccggccggccc

SEQ ID NO: 1341352 - RNA, 15 nt, Mycobacterium tuberculosis H37Rv
ucgccggccggcccg

SEQ ID NO: 1341353 - RNA, 23 nt, Mycobacterium tuberculosis H37Rv
ucgccggcgcgccgggcggcgcg

SEQ ID NO: 1341354 - RNA, 17 nt, Mycobacterium tuberculosis H37Rv
ucgccggcgaaguuggu

SEQ ID NO: 1341355 - RNA, 22 nt, Mycobacterium tuberculosis H37Rv
ucgccggggacgccgcggcgcc

SEQ ID NO: 1341356 - RNA, 21 nt, Mycobacterium tuberculosis H37Rv
ucgccgggcggccgcggcgcg

SEQ ID NO: 1341357 - RNA, 13 nt, Mycobacterium tuberculosis H37Rv
ucgccgcccggcg

SEQ ID NO: 1341358 - RNA, 15 nt, Mycobacterium tuberculosis H37Rv
ucgccgcccgugccg

SEQ ID NO: 1341359 - RNA, 21 nt, Mycobacterium tuberculosis H37Rv
ucgccgccgaaaaccucgccc

SEQ ID NO: 1341360 - RNA, 22 nt, Mycobacterium tuberculosis H37Rv
ucgccgcccccguuuacggccc

SEQ ID NO: 1341361 - RNA, 18 nt, Mycobacterium tuberculosis H37Rv
ucgccgcccgcagggccg

SEQ ID NO: 1341362 - RNA, 23 nt, Mycobacterium tuberculosis H37Rv
ucgccaggccuaggccgaggccg

SEQ ID NO: 1341363 - RNA, 12 nt, Mycobacterium tuberculosis H37Rv
ucgccagcggcc

SEQ ID NO: 1341364 - RNA, 13 nt, Mycobacterium tuberculosis H37Rv
ucgccuccaggcg

SEQ ID NO: 1341365 - RNA, 11 nt, Mycobacterium tuberculosis H37Rv
ucgccuccgcu

SEQ ID NO: 1341366 - RNA, 24 nt, Mycobacterium tuberculosis H37Rv
ucgccucgauggcguagggcuguc

SEQ ID NO: 1341367 - RNA, 24 nt, Mycobacterium tuberculosis H37Rv
ucgccuccagcagguccgcggccg

SEQ ID NO: 1341368 - RNA, 15 nt, Mycobacterium tuberculosis H37Rv
ucgcgaagcugugcc

SEQ ID NO: 1341369 - RNA, 21 nt, Mycobacterium tuberculosis H37Rv
ucgcgaagucguccagaauga

SEQ ID NO: 1341370 - RNA, 18 nt, Mycobacterium tuberculosis H37Rv
ucgcgacagugcgcauca

SEQ ID NO: 1341371 - RNA, 18 nt, Mycobacterium tuberculosis H37Rv
ucgcgaacgaagucgacg

SEQ ID NO: 1341372 - RNA, 16 nt, Mycobacterium tuberculosis H37Rv
ucgcgagcgagccaac

SEQ ID NO: 1341373 - RNA, 14 nt, Mycobacterium tuberculosis H37Rv
ucgcgccgggcucg

SEQ ID NO: 1341374 - RNA, 21 nt, Mycobacterium tuberculosis H37Rv
ucgcgcccgcuaacuggcccg

SEQ ID NO: 1341375 - RNA, 16 nt, Mycobacterium tuberculosis H37Rv
ucgcgcgcaccggguu

SEQ ID NO: 1341376 - RNA, 18 nt, Mycobacterium tuberculosis H37Rv
ucgcgcgccuuggccagc

SEQ ID NO: 1341377 - RNA, 20 nt, Mycobacterium tuberculosis H37Rv
ucgcgcgccuuggccagcgc

SEQ ID NO: 1341378 - RNA, 21 nt, Mycobacterium tuberculosis H37Rv
ucgcgcgucgucgcgcugaac

SEQ ID NO: 1341379 - RNA, 22 nt, Mycobacterium tuberculosis H37Rv
ucgcgcuaaggugggcacagcg

SEQ ID NO: 1341380 - RNA, 16 nt, Mycobacterium tuberculosis H37Rv
ucgcgcucgcaccacc

SEQ ID NO: 1341381 - RNA, 22 nt, Mycobacterium tuberculosis H37Rv
ucgcgcucccacgcuucggccu

SEQ ID NO: 1341382 - RNA, 14 nt, Mycobacterium tuberculosis H37Rv
ucgcgccaggcgcg

SEQ ID NO: 1341383 - RNA, 15 nt, Mycobacterium tuberculosis H37Rv
ucgcgccaggccacg

SEQ ID NO: 1341384 - RNA, 15 nt, Mycobacterium tuberculosis H37Rv
ucgcgcaaccgggcg

SEQ ID NO: 1341385 - RNA, 23 nt, Mycobacterium tuberculosis H37Rv
ucgcgacgcgcgagaacacccgu

SEQ ID NO: 1341386 - RNA, 20 nt, Mycobacterium tuberculosis H37Rv
ucgcggcuauggcgccgcgg

SEQ ID NO: 1341387 - RNA, 19 nt, Mycobacterium tuberculosis H37Rv
ucgcgggacaacagcaugg

SEQ ID NO: 1341388 - RNA, 20 nt, Mycobacterium tuberculosis H37Rv
ucgcggggcgcaccgcggac

SEQ ID NO: 1341389 - RNA, 19 nt, Mycobacterium tuberculosis H37Rv
ucgcggccgagacggcguu

SEQ ID NO: 1341390 - RNA, 17 nt, Mycobacterium tuberculosis H37Rv
ucgcggccgagacggcg

SEQ ID NO: 1341391 - RNA, 23 nt, Mycobacterium tuberculosis H37Rv
ucgcggcgacccggucgcggaac

SEQ ID NO: 1341392 - RNA, 23 nt, Mycobacterium tuberculosis H37Rv
ucgcggcggucccugaagccagc

SEQ ID NO: 1341393 - RNA, 11 nt, Mycobacterium tuberculosis H37Rv
ucgcggcggcg

SEQ ID NO: 1341394 - RNA, 22 nt, Mycobacterium tuberculosis H37Rv
ucgcggcggcgauccggucggg

SEQ ID NO: 1341395 - RNA, 18 nt, Mycobacterium tuberculosis H37Rv
ucgcggagccaggacgac

SEQ ID NO: 1341396 - RNA, 19 nt, Mycobacterium tuberculosis H37Rv
ucgcggagccgucgcauca

SEQ ID NO: 1341397 - RNA, 16 nt, Mycobacterium tuberculosis H37Rv
ucgcggcacgcccaca

SEQ ID NO: 1341398 - RNA, 21 nt, Mycobacterium tuberculosis H37Rv
ucgcggauuucucgcccugag

SEQ ID NO: 1341399 - RNA, 22 nt, Mycobacterium tuberculosis H37Rv
ucgcgcuugcgccgcccaugcc

SEQ ID NO: 1341400 - RNA, 20 nt, Mycobacterium tuberculosis H37Rv
ucgcggaacucgucgcugcc

SEQ ID NO: 1341401 - RNA, 14 nt, Mycobacterium tuberculosis H37Rv
ucgcgcuugaaacu

SEQ ID NO: 1341402 - RNA, 14 nt, Mycobacterium tuberculosis H37Rv
ucgcgcuggccaug

SEQ ID NO: 1341403 - RNA, 15 nt, Mycobacterium tuberculosis H37Rv
ucgcgcugcgggaac

SEQ ID NO: 1341404 - RNA, 15 nt, Mycobacterium tuberculosis H37Rv
ucgcgcugccggccg

SEQ ID NO: 1341405 - RNA, 19 nt, Mycobacterium tuberculosis H37Rv
ucgcgcugcggcccacacc

SEQ ID NO: 1341406 - RNA, 12 nt, Mycobacterium tuberculosis H37Rv
ucgagccagcgg

SEQ ID NO: 1341407 - RNA, 13 nt, Mycobacterium tuberculosis H37Rv
ucgagcaccaccc

SEQ ID NO: 1341408 - RNA, 15 nt, Mycobacterium tuberculosis H37Rv
ucgagcaccacccgg

SEQ ID NO: 1341409 - RNA, 12 nt, Mycobacterium tuberculosis H37Rv
ucgagcacaccg

SEQ ID NO: 1341410 - RNA, 19 nt, Mycobacterium tuberculosis H37Rv
ucgagcaccgacaccggcc

SEQ ID NO: 1341411 - RNA, 15 nt, Mycobacterium tuberculosis H37Rv
ucgagcaccgcgaac

SEQ ID NO: 1341412 - RNA, 15 nt, Mycobacterium tuberculosis H37Rv
ucgagcagcaccacc

SEQ ID NO: 1341413 - RNA, 18 nt, Mycobacterium tuberculosis H37Rv
ucgagcaggcuggcugcc

SEQ ID NO: 1341414 - RNA, 14 nt, Mycobacterium tuberculosis H37Rv
ucgagcagcauguc

SEQ ID NO: 1341415 - RNA, 22 nt, Mycobacterium tuberculosis H37Rv
ucgagcaacggacgaagcaccu

SEQ ID NO: 1341416 - RNA, 18 nt, Mycobacterium tuberculosis H37Rv
ucgagagccucuaaacca

SEQ ID NO: 1341417 - RNA, 17 nt, Mycobacterium tuberculosis H37Rv
ucgagagggaucacgcc

SEQ ID NO: 1341418 - RNA, 17 nt, Mycobacterium tuberculosis H37Rv
ucgagauaaccaccauc

SEQ ID NO: 1341419 - RNA, 16 nt, Mycobacterium tuberculosis H37Rv
ucgagaaucggcauuc

SEQ ID NO: 1341420 - RNA, 16 nt, Mycobacterium tuberculosis H37Rv
ucgagacgagccacgg

SEQ ID NO: 1341421 - RNA, 21 nt, Mycobacterium tuberculosis H37Rv
ucgagaccccgacgaugcgca

SEQ ID NO: 1341422 - RNA, 22 nt, Mycobacterium tuberculosis H37Rv
ucgagaagaucucguagccgcc

SEQ ID NO: 1341423 - RNA, 13 nt, Mycobacterium tuberculosis H37Rv
ucgacgagcaccg

SEQ ID NO: 1341424 - RNA, 22 nt, Mycobacterium tuberculosis H37Rv
ucgacgaagaucuucaccggcc

SEQ ID NO: 1341425 - RNA, 19 nt, Mycobacterium tuberculosis H37Rv
ucgacgagcgccucaagcu

SEQ ID NO: 1341426 - RNA, 19 nt, Mycobacterium tuberculosis H37Rv
ucgacgaacaccccgggcg

SEQ ID NO: 1341427 - RNA, 16 nt, Mycobacterium tuberculosis H37Rv
ucgacggugaucaggu

SEQ ID NO: 1341428 - RNA, 14 nt, Mycobacterium tuberculosis H37Rv
ucgacggucauccc

SEQ ID NO: 1341429 - RNA, 17 nt, Mycobacterium tuberculosis H37Rv
ucgacggccagugcgca

SEQ ID NO: 1341430 - RNA, 15 nt, Mycobacterium tuberculosis H37Rv
ucgacuucagcggcc

SEQ ID NO: 1341431 - RNA, 13 nt, Mycobacterium tuberculosis H37Rv
ucgacucacacac

SEQ ID NO: 1341432 - RNA, 15 nt, Mycobacterium tuberculosis H37Rv
ucgacucacacaccg

SEQ ID NO: 1341433 - RNA, 16 nt, Mycobacterium tuberculosis H37Rv
ucgacuccagcaccag

SEQ ID NO: 1341434 - RNA, 16 nt, Mycobacterium tuberculosis H37Rv
ucgacguaagugugcc

SEQ ID NO: 1341435 - RNA, 16 nt, Mycobacterium tuberculosis H37Rv
ucgacgucaugcaggg

SEQ ID NO: 1341436 - RNA, 18 nt, Mycobacterium tuberculosis H37Rv
ucgacguaggacugccag

SEQ ID NO: 1341437 - RNA, 14 nt, Mycobacterium tuberculosis H37Rv
ucgacguuccagca

SEQ ID NO: 1341438 - RNA, 16 nt, Mycobacterium tuberculosis H37Rv
ucgacaaagcggcugc

SEQ ID NO: 1341439 - RNA, 15 nt, Mycobacterium tuberculosis H37Rv
ucgacagguuucccg

SEQ ID NO: 1341440 - RNA, 18 nt, Mycobacterium tuberculosis H37Rv
ucgaccaucaucucggug

SEQ ID NO: 1341441 - RNA, 23 nt, Mycobacterium tuberculosis H37Rv
ucgaccagcgccgauaccagcca

SEQ ID NO: 1341442 - RNA, 20 nt, Mycobacterium tuberculosis H37Rv
ucgaccaagguguccagcac

SEQ ID NO: 1341443 - RNA, 13 nt, Mycobacterium tuberculosis H37Rv
ucgaccaccgccg

SEQ ID NO: 1341444 - RNA, 17 nt, Mycobacterium tuberculosis H37Rv
uccuguugaucugcccu

SEQ ID NO: 1341445 - RNA, 12 nt, Mycobacterium tuberculosis H37Rv
ucgaagaauaug

SEQ ID NO: 1341446 - RNA, 16 nt, Mycobacterium tuberculosis H37Rv
ucgaaugucacaccgg

SEQ ID NO: 1341447 - RNA, 14 nt, Mycobacterium tuberculosis H37Rv
ucgcauggcggcug

SEQ ID NO: 1341448 - RNA, 16 nt, Mycobacterium tuberculosis H37Rv
ucgcagccgguccagc

SEQ ID NO: 1341449 - RNA, 22 nt, Mycobacterium tuberculosis H37Rv
ucgcauuuguacugguuagaga

SEQ ID NO: 1341450 - RNA, 20 nt, Mycobacterium tuberculosis H37Rv
ucgcaggauucccaguccag

SEQ ID NO: 1341451 - RNA, 14 nt, Mycobacterium tuberculosis H37Rv
ucgcagagguauuc

SEQ ID NO: 1341452 - RNA, 22 nt, Mycobacterium tuberculosis H37Rv
ucgcaaacagauucggugccag

SEQ ID NO: 1341453 - RNA, 13 nt, Mycobacterium tuberculosis H37Rv
ucgcaaaagcccc

SEQ ID NO: 1341454 - RNA, 22 nt, Mycobacterium tuberculosis H37Rv
ucgccacuguugaagaagcccg

SEQ ID NO: 1341455 - RNA, 18 nt, Mycobacterium tuberculosis H37Rv
ucgccacggucgccgacc

SEQ ID NO: 1341456 - RNA, 18 nt, Mycobacterium tuberculosis H37Rv
ucgccacuguugaagaag

SEQ ID NO: 1341457 - RNA, 21 nt, Mycobacterium tuberculosis H37Rv
ucgccaccgccggcagcaucg

SEQ ID NO: 1341458 - RNA, 15 nt, Mycobacterium tuberculosis H37Rv
ucgccacaccaugau

SEQ ID NO: 1341459 - RNA, 23 nt, Mycobacterium tuberculosis H37Rv
ucgccaaaaguacuggcguugcc

SEQ ID NO: 1341460 - RNA, 14 nt, Mycobacterium tuberculosis H37Rv
ucgccagccugugc

SEQ ID NO: 1341461 - RNA, 18 nt, Mycobacterium tuberculosis H37Rv
ucgccagcgccggccagg

SEQ ID NO: 1341462 - RNA, 22 nt, Mycobacterium tuberculosis H37Rv
ucgccagcaggaagccgaagau

SEQ ID NO: 1341463 - RNA, 15 nt, Mycobacterium tuberculosis H37Rv
ucgccagaccgcacc

SEQ ID NO: 1341464 - RNA, 13 nt, Mycobacterium tuberculosis H37Rv
ucgccagauggcc

SEQ ID NO: 1341465 - RNA, 21 nt, Mycobacterium tuberculosis H37Rv
ucgagcgccgcggacucgggc

SEQ ID NO: 1341466 - RNA, 22 nt, Mycobacterium tuberculosis H37Rv
ucgagcgacguuguuuuugcac

SEQ ID NO: 1341467 - RNA, 13 nt, Mycobacterium tuberculosis H37Rv
ucgagcgugcgca

SEQ ID NO: 1341468 - RNA, 12 nt, Mycobacterium tuberculosis H37Rv
ucgagcgcugcu

SEQ ID NO: 1341469 - RNA, 16 nt, Mycobacterium tuberculosis H37Rv
ucgauacccaggaugu

SEQ ID NO: 1341470 - RNA, 17 nt, Mycobacterium tuberculosis H37Rv
ucgaucaggggcccacc

SEQ ID NO: 1341471 - RNA, 18 nt, Mycobacterium tuberculosis H37Rv
ucgaucaggggcccaccc

SEQ ID NO: 1341472 - RNA, 15 nt, Mycobacterium tuberculosis H37Rv
ucgaucaggccuugg

SEQ ID NO: 1341473 - RNA, 13 nt, Mycobacterium tuberculosis H37Rv
ucgaucagcuccu

SEQ ID NO: 1341474 - RNA, 17 nt, Mycobacterium tuberculosis H37Rv
ucgauagcccgccaccc

SEQ ID NO: 1341475 - RNA, 17 nt, Mycobacterium tuberculosis H37Rv
ucgaugcgcgccggcuu

SEQ ID NO: 1341476 - RNA, 13 nt, Mycobacterium tuberculosis H37Rv
ucgaugcgcugcu

SEQ ID NO: 1341477 - RNA, 16 nt, Mycobacterium tuberculosis H37Rv
ucgauggcaugggcua

SEQ ID NO: 1341478 - RNA, 20 nt, Mycobacterium tuberculosis H37Rv
ucgaugccgcguagcugguc

SEQ ID NO: 1341479 - RNA, 14 nt, Mycobacterium tuberculosis H37Rv
ucgaugaucugcuu

SEQ ID NO: 1341480 - RNA, 21 nt, Mycobacterium tuberculosis H37Rv
ucgauccggcuccacccccac

SEQ ID NO: 1341481 - RNA, 17 nt, Mycobacterium tuberculosis H37Rv
ucgaugagugacggucc

SEQ ID NO: 1341482 - RNA, 20 nt, Mycobacterium tuberculosis H37Rv
ucgauugaugcgugguuggc

SEQ ID NO: 1341483 - RNA, 13 nt, Mycobacterium tuberculosis H37Rv
ucgauggugugcc

SEQ ID NO: 1341484 - RNA, 15 nt, Mycobacterium tuberculosis H37Rv
ucgauggugugcccg

SEQ ID NO: 1341485 - RNA, 17 nt, Mycobacterium tuberculosis H37Rv
ucgaugugaucaccgau

SEQ ID NO: 1341486 - RNA, 18 nt, Mycobacterium tuberculosis H37Rv
ucgauggcguacagcacc

SEQ ID NO: 1341487 - RNA, 16 nt, Mycobacterium tuberculosis H37Rv
uccggcgccaccgccg

SEQ ID NO: 1341488 - RNA, 22 nt, Mycobacterium tuberculosis H37Rv
uccggcgacgcguagcacggcg

SEQ ID NO: 1341489 - RNA, 22 nt, Mycobacterium tuberculosis H37Rv
uccggccacacucgccagggcc

SEQ ID NO: 1341490 - RNA, 19 nt, Mycobacterium tuberculosis H37Rv
uccggccgguccgggaagu

SEQ ID NO: 1341491 - RNA, 19 nt, Mycobacterium tuberculosis H37Rv
uccggcccguagcugcgca

SEQ ID NO: 1341492 - RNA, 17 nt, Mycobacterium tuberculosis H37Rv
uccggccgaugcgaccc

SEQ ID NO: 1341493 - RNA, 18 nt, Mycobacterium tuberculosis H37Rv
uccggcucgucagguucc

SEQ ID NO: 1341494 - RNA, 17 nt, Mycobacterium tuberculosis H37Rv
uccggcgugcagcaccc

SEQ ID NO: 1341495 - RNA, 14 nt, Mycobacterium tuberculosis H37Rv
uccggcggcaggaa

SEQ ID NO: 1341496 - RNA, 14 nt, Mycobacterium tuberculosis H37Rv
uccggcggcagcgg

SEQ ID NO: 1341497 - RNA, 15 nt, Mycobacterium tuberculosis H37Rv
uccggcggcagguag

SEQ ID NO: 1341498 - RNA, 23 nt, Mycobacterium tuberculosis H37Rv
uccggcggcgaagaagccggcaa

SEQ ID NO: 1341499 - RNA, 15 nt, Mycobacterium tuberculosis H37Rv
uccggcgccauucgc

SEQ ID NO: 1341500 - RNA, 21 nt, Mycobacterium tuberculosis H37Rv
uccggagacucucugaucuga

SEQ ID NO: 1341501 - RNA, 23 nt, Mycobacterium tuberculosis H37Rv
uccggaucacuuucgaagaaccg

SEQ ID NO: 1341502 - RNA, 16 nt, Mycobacterium tuberculosis H37Rv
uccggaucccaccacc

SEQ ID NO: 1341503 - RNA, 20 nt, Mycobacterium tuberculosis H37Rv
uccggaucccaccaccgcuc

SEQ ID NO: 1341504 - RNA, 15 nt, Mycobacterium tuberculosis H37Rv
uccggaugcagugac

SEQ ID NO: 1341505 - RNA, 16 nt, Mycobacterium tuberculosis H37Rv
uccggcaagcacaccg

SEQ ID NO: 1341506 - RNA, 17 nt, Mycobacterium tuberculosis H37Rv
uccggcaacagcaccag

SEQ ID NO: 1341507 - RNA, 18 nt, Mycobacterium tuberculosis H37Rv
uccggauugaagucgucg

SEQ ID NO: 1341508 - RNA, 14 nt, Mycobacterium tuberculosis H37Rv
uccggccacuccgg

SEQ ID NO: 1341509 - RNA, 22 nt, Mycobacterium tuberculosis H37Rv
uccggcauaccgaacagcaccu

SEQ ID NO: 1341510 - RNA, 15 nt, Mycobacterium tuberculosis H37Rv
uccggcauaccgaac

SEQ ID NO: 1341511 - RNA, 19 nt, Mycobacterium tuberculosis H37Rv
uccggcacugcggccaguc

SEQ ID NO: 1341512 - RNA, 13 nt, Mycobacterium tuberculosis H37Rv
uccgggcagcugg

SEQ ID NO: 1341513 - RNA, 20 nt, Mycobacterium tuberculosis H37Rv
uccgggccgagcgcaccacg

SEQ ID NO: 1341514 - RNA, 20 nt, Mycobacterium tuberculosis H37Rv
uccgggccauguggggaccu

SEQ ID NO: 1341515 - RNA, 16 nt, Mycobacterium tuberculosis H37Rv
uccgggaccaggccaa

SEQ ID NO: 1341516 - RNA, 17 nt, Mycobacterium tuberculosis H37Rv
uccggcuggaagcggcg

SEQ ID NO: 1341517 - RNA, 23 nt, Mycobacterium tuberculosis H37Rv
uccggcuggaagcggcgacuacc

SEQ ID NO: 1341518 - RNA, 22 nt, Mycobacterium tuberculosis H37Rv
uccggcuggugggacgcggccg

SEQ ID NO: 1341519 - RNA, 23 nt, Mycobacterium tuberculosis H37Rv
uccggcuucggcgaacccuccgc

SEQ ID NO: 1341520 - RNA, 16 nt, Mycobacterium tuberculosis H37Rv
uccggcuucguccacc

SEQ ID NO: 1341521 - RNA, 15 nt, Mycobacterium tuberculosis H37Rv
uccgggccgccgccc

SEQ ID NO: 1341522 - RNA, 17 nt, Mycobacterium tuberculosis H37Rv
uccgggccuggccugcc

SEQ ID NO: 1341523 - RNA, 16 nt, Mycobacterium tuberculosis H37Rv
uccgggcggccucccg

SEQ ID NO: 1341524 - RNA, 14 nt, Mycobacterium tuberculosis H37Rv
uccgggguggacgg

SEQ ID NO: 1341525 - RNA, 14 nt, Mycobacterium tuberculosis H37Rv
uccggguccaggaa

SEQ ID NO: 1341526 - RNA, 19 nt, Mycobacterium tuberculosis H37Rv
uccggguuuugcgcggcca

SEQ ID NO: 1341527 - RNA, 22 nt, Mycobacterium tuberculosis H37Rv
uccgguaaacaagacaugcuga

SEQ ID NO: 1341528 - RNA, 14 nt, Mycobacterium tuberculosis H37Rv
uccgguggaccgcc

SEQ ID NO: 1341529 - RNA, 20 nt, Mycobacterium tuberculosis H37Rv
uccggugcgaucccacccuc

SEQ ID NO: 1341530 - RNA, 17 nt, Mycobacterium tuberculosis H37Rv
uccgguggugcucgucg

SEQ ID NO: 1341531 - RNA, 12 nt, Mycobacterium tuberculosis H37Rv
uccggugucgcg

SEQ ID NO: 1341532 - RNA, 15 nt, Mycobacterium tuberculosis H37Rv
uccgguucugggccu

SEQ ID NO: 1341533 - RNA, 16 nt, Mycobacterium tuberculosis H37Rv
uccggucggccaggcc

SEQ ID NO: 1341534 - RNA, 14 nt, Mycobacterium tuberculosis H37Rv
uccggucgccaagu

SEQ ID NO: 1341535 - RNA, 21 nt, Mycobacterium tuberculosis H37Rv
uccggucggccagcaagugcg

SEQ ID NO: 1341536 - RNA, 17 nt, Mycobacterium tuberculosis H37Rv
uccggucaacacccgcc

SEQ ID NO: 1341537 - RNA, 16 nt, Mycobacterium tuberculosis H37Rv
uccguacuugccaccc

SEQ ID NO: 1341538 - RNA, 16 nt, Mycobacterium tuberculosis H37Rv
uccguaggccacagcc

SEQ ID NO: 1341539 - RNA, 21 nt, Mycobacterium tuberculosis H37Rv
uccgcaccggcggcgccgaaa

SEQ ID NO: 1341540 - RNA, 23 nt, Mycobacterium tuberculosis H37Rv
uccgcacgaucagggaagccugc

SEQ ID NO: 1341541 - RNA, 14 nt, Mycobacterium tuberculosis H37Rv
uccgcaccacgccc

SEQ ID NO: 1341542 - RNA, 22 nt, Mycobacterium tuberculosis H37Rv
uccgcaccacgcccgacgagga

SEQ ID NO: 1341543 - RNA, 18 nt, Mycobacterium tuberculosis H37Rv
uccgcacagguccggguu

SEQ ID NO: 1341544 - RNA, 18 nt, Mycobacterium tuberculosis H37Rv
uccgcaaugaccuggccg

SEQ ID NO: 1341545 - RNA, 20 nt, Mycobacterium tuberculosis H37Rv
uccgcagcguccagcgccug

SEQ ID NO: 1341546 - RNA, 23 nt, Mycobacterium tuberculosis H37Rv
uccgcagugagcaaugccaacgg

SEQ ID NO: 1341547 - RNA, 20 nt, Mycobacterium tuberculosis H37Rv
uccgccacggcgggcgaccc

SEQ ID NO: 1341548 - RNA, 15 nt, Mycobacterium tuberculosis H37Rv
uccgccagaucucgc

SEQ ID NO: 1341549 - RNA, 21 nt, Mycobacterium tuberculosis H37Rv
uccgccagaauugccggcgau

SEQ ID NO: 1341550 - RNA, 20 nt, Mycobacterium tuberculosis H37Rv
uccgcccauucccagaggcc

SEQ ID NO: 1341551 - RNA, 16 nt, Mycobacterium tuberculosis H37Rv
uccgccagcgccgccg

SEQ ID NO: 1341552 - RNA, 19 nt, Mycobacterium tuberculosis H37Rv
uccgccaggccgaccgcgc

SEQ ID NO: 1341553 - RNA, 13 nt, Mycobacterium tuberculosis H37Rv
uccgccgccgccg

SEQ ID NO: 1341554 - RNA, 14 nt, Mycobacterium tuberculosis H37Rv
uccgccccagcugc

SEQ ID NO: 1341555 - RNA, 17 nt, Mycobacterium tuberculosis H37Rv
uccgccccgcccgcacc

SEQ ID NO: 1341556 - RNA, 13 nt, Mycobacterium tuberculosis H37Rv
uccgccgaacacc

SEQ ID NO: 1341557 - RNA, 11 nt, Mycobacterium tuberculosis H37Rv
uccgccggcaa

SEQ ID NO: 1341558 - RNA, 18 nt, Mycobacterium tuberculosis H37Rv
uccgccggcaccuccggc

SEQ ID NO: 1341559 - RNA, 16 nt, Mycobacterium tuberculosis H37Rv
uccgccgggccaggcc

SEQ ID NO: 1341560 - RNA, 17 nt, Mycobacterium tuberculosis H37Rv
uccgccgucgccgccgg

SEQ ID NO: 1341561 - RNA, 22 nt, Mycobacterium tuberculosis H37Rv
uccgccuaagcauucagcgcgc

SEQ ID NO: 1341562 - RNA, 14 nt, Mycobacterium tuberculosis H37Rv
uccgcucgccgcca

SEQ ID NO: 1341563 - RNA, 16 nt, Mycobacterium tuberculosis H37Rv
uccgcucguucgugca

SEQ ID NO: 1341564 - RNA, 14 nt, Mycobacterium tuberculosis H37Rv
uccgcugacccgcc

SEQ ID NO: 1341565 - RNA, 15 nt, Mycobacterium tuberculosis H37Rv
uccgcugcaggucca

SEQ ID NO: 1341566 - RNA, 17 nt, Mycobacterium tuberculosis H37Rv
uccgcuaggucagguga

SEQ ID NO: 1341567 - RNA, 16 nt, Mycobacterium tuberculosis H37Rv
uccgcguugggcaccu

SEQ ID NO: 1341568 - RNA, 13 nt, Mycobacterium tuberculosis H37Rv
uccgcgucgccgg

SEQ ID NO: 1341569 - RNA, 19 nt, Mycobacterium tuberculosis H37Rv
uccgcguagagcagcagcg

SEQ ID NO: 1341570 - RNA, 23 nt, Mycobacterium tuberculosis H37Rv
uccgcguggugcugaccgcgccg

SEQ ID NO: 1341571 - RNA, 17 nt, Mycobacterium tuberculosis H37Rv
uccgcguguacggcggc

SEQ ID NO: 1341572 - RNA, 16 nt, Mycobacterium tuberculosis H37Rv
uccgcguggugcugac

SEQ ID NO: 1341573 - RNA, 21 nt, Mycobacterium tuberculosis H37Rv
uccggaaccgguaucgccaaa

SEQ ID NO: 1341574 - RNA, 20 nt, Mycobacterium tuberculosis H37Rv
uccggaauagcaacgcugca

SEQ ID NO: 1341575 - RNA, 20 nt, Mycobacterium tuberculosis H37Rv
uccgcuugcccgaagagcac

SEQ ID NO: 1341576 - RNA, 23 nt, Mycobacterium tuberculosis H37Rv
uccgcgcaacuuccauuuucgcc

SEQ ID NO: 1341577 - RNA, 15 nt, Mycobacterium tuberculosis H37Rv
uccgcgccgccgaug

SEQ ID NO: 1341578 - RNA, 14 nt, Mycobacterium tuberculosis H37Rv
uccgcgcgccggcg

SEQ ID NO: 1341579 - RNA, 16 nt, Mycobacterium tuberculosis H37Rv
uccgcgcgccggcggu

SEQ ID NO: 1341580 - RNA, 24 nt, Mycobacterium tuberculosis H37Rv
uccgcgcgcaagucgauguacacc

SEQ ID NO: 1341581 - RNA, 19 nt, Mycobacterium tuberculosis H37Rv
uccgcggcgcagcacggcg

SEQ ID NO: 1341582 - RNA, 23 nt, Mycobacterium tuberculosis H37Rv
uccgcgguguuggacgcgggccg

SEQ ID NO: 1341583 - RNA, 21 nt, Mycobacterium tuberculosis H37Rv
uccgcggguuugaucuccacc

SEQ ID NO: 1341584 - RNA, 23 nt, Mycobacterium tuberculosis H37Rv
uccgcggaucaccaucgccgccg

SEQ ID NO: 1341585 - RNA, 12 nt, Mycobacterium tuberculosis H37Rv
uccgcggaaccc

SEQ ID NO: 1341586 - RNA, 18 nt, Mycobacterium tuberculosis H37Rv
uccgcggcauuggcgucg

SEQ ID NO: 1341587 - RNA, 19 nt, Mycobacterium tuberculosis H37Rv
uccgcgacguaguggaagc

SEQ ID NO: 1341588 - RNA, 15 nt, Mycobacterium tuberculosis H37Rv
uccgcgacagcggcg

SEQ ID NO: 1341589 - RNA, 19 nt, Mycobacterium tuberculosis H37Rv
uccgcgaucugcagcgcgg

SEQ ID NO: 1341590 - RNA, 13 nt, Mycobacterium tuberculosis H37Rv
uccgcgaaauagc

SEQ ID NO: 1341591 - RNA, 19 nt, Mycobacterium tuberculosis H37Rv
uccugcacacaggacuugu

SEQ ID NO: 1341592 - RNA, 17 nt, Mycobacterium tuberculosis H37Rv
uccugccagaagaccug

SEQ ID NO: 1341593 - RNA, 14 nt, Mycobacterium tuberculosis H37Rv
uccuggguugugcc

SEQ ID NO: 1341594 - RNA, 19 nt, Mycobacterium tuberculosis H37Rv
uccugggauccggcggcag

SEQ ID NO: 1341595 - RNA, 17 nt, Mycobacterium tuberculosis H37Rv
uccugguaggugucgug

SEQ ID NO: 1341596 - RNA, 17 nt, Mycobacterium tuberculosis H37Rv
uccuggcguagugcagc

SEQ ID NO: 1341597 - RNA, 21 nt, Mycobacterium tuberculosis H37Rv
uccuggccggugguagcggac

SEQ ID NO: 1341598 - RNA, 23 nt, Mycobacterium tuberculosis H37Rv
uccuggcgcagcgccucgguaaa

SEQ ID NO: 1341599 - RNA, 15 nt, Mycobacterium tuberculosis H37Rv
uccucggcaggaagg

SEQ ID NO: 1341600 - RNA, 19 nt, Mycobacterium tuberculosis H37Rv
uccucggcgguaaaugccu

SEQ ID NO: 1341601 - RNA, 13 nt, Mycobacterium tuberculosis H37Rv
uccucggucagcu

SEQ ID NO: 1341602 - RNA, 20 nt, Mycobacterium tuberculosis H37Rv
uccucguagacgaaacggcc

SEQ ID NO: 1341603 - RNA, 15 nt, Mycobacterium tuberculosis H37Rv
uccucgucuucgucg

SEQ ID NO: 1341604 - RNA, 13 nt, Mycobacterium tuberculosis H37Rv
uccucgugcagca

SEQ ID NO: 1341605 - RNA, 22 nt, Mycobacterium tuberculosis H37Rv
uccucgcgguaguugucccgcc

SEQ ID NO: 1341606 - RNA, 20 nt, Mycobacterium tuberculosis H37Rv
uccucgcccauuggccaggu

SEQ ID NO: 1341607 - RNA, 19 nt, Mycobacterium tuberculosis H37Rv
uccucgccgcacgccggca

SEQ ID NO: 1341608 - RNA, 17 nt, Mycobacterium tuberculosis H37Rv
uccucgagugccgccgu

SEQ ID NO: 1341609 - RNA, 22 nt, Mycobacterium tuberculosis H37Rv
uccucgagugccgccgucgcca

SEQ ID NO: 1341610 - RNA, 17 nt, Mycobacterium tuberculosis H37Rv
uccucgagccagcuccg

SEQ ID NO: 1341611 - RNA, 16 nt, Mycobacterium tuberculosis H37Rv
uccucgagguccucgu

SEQ ID NO: 1341612 - RNA, 19 nt, Mycobacterium tuberculosis H37Rv
uccucgauauggguugcca

SEQ ID NO: 1341613 - RNA, 17 nt, Mycobacterium tuberculosis H37Rv
uccucgauagcggcgcc

SEQ ID NO: 1341614 - RNA, 14 nt, Mycobacterium tuberculosis H37Rv
uccucgacacccau

SEQ ID NO: 1341615 - RNA, 16 nt, Mycobacterium tuberculosis H37Rv
uccucgacgaggagcc

SEQ ID NO: 1341616 - RNA, 14 nt, Mycobacterium tuberculosis H37Rv
uccugaccagccag

SEQ ID NO: 1341617 - RNA, 16 nt, Mycobacterium tuberculosis H37Rv
uccucacgggucggca

SEQ ID NO: 1341618 - RNA, 21 nt, Mycobacterium tuberculosis H37Rv
uccucagccaccgcggucagc

SEQ ID NO: 1341619 - RNA, 20 nt, Mycobacterium tuberculosis H37Rv
uccuccagagacagcgccau

SEQ ID NO: 1341620 - RNA, 22 nt, Mycobacterium tuberculosis H37Rv
uccuccaaggcggucaccaccg

SEQ ID NO: 1341621 - RNA, 18 nt, Mycobacterium tuberculosis H37Rv
uccuccggguuggcgacg

SEQ ID NO: 1341622 - RNA, 16 nt, Mycobacterium tuberculosis H37Rv
uccuccugcgccgcag

SEQ ID NO: 1341623 - RNA, 15 nt, Mycobacterium tuberculosis H37Rv
uccuccugcgccgca

SEQ ID NO: 1341624 - RNA, 17 nt, Mycobacterium tuberculosis H37Rv
uccuccggaaagcucuc

SEQ ID NO: 1341625 - RNA, 16 nt, Mycobacterium tuberculosis H37Rv
uccucccaucccaugu

SEQ ID NO: 1341626 - RNA, 14 nt, Mycobacterium tuberculosis H37Rv
uccgucggccaggc

SEQ ID NO: 1341627 - RNA, 17 nt, Mycobacterium tuberculosis H37Rv
uccgugaauggcagcac

SEQ ID NO: 1341628 - RNA, 23 nt, Mycobacterium tuberculosis H37Rv
uccgugaauggcagcacgaccug

SEQ ID NO: 1341629 - RNA, 24 nt, Mycobacterium tuberculosis H37Rv
uccgugccgagcuucagcgcgcug

SEQ ID NO: 1341630 - RNA, 15 nt, Mycobacterium tuberculosis H37Rv
uccgugccagcugcc

SEQ ID NO: 1341631 - RNA, 19 nt, Mycobacterium tuberculosis H37Rv
uccgucggccaggccacgg

SEQ ID NO: 1341632 - RNA, 13 nt, Mycobacterium tuberculosis H37Rv
uccgucgcggccg

SEQ ID NO: 1341633 - RNA, 22 nt, Mycobacterium tuberculosis H37Rv
uccgucggucgccgguggccua

SEQ ID NO: 1341634 - RNA, 13 nt, Mycobacterium tuberculosis H37Rv
uccguugccccca

SEQ ID NO: 1341635 - RNA, 20 nt, Mycobacterium tuberculosis H37Rv
ucccgcaggcucaccgagcc

SEQ ID NO: 1341636 - RNA, 21 nt, Mycobacterium tuberculosis H37Rv
ucccgcaggcucaccgagccg

SEQ ID NO: 1341637 - RNA, 18 nt, Mycobacterium tuberculosis H37Rv
ucccgcacggccgggucg

SEQ ID NO: 1341638 - RNA, 23 nt, Mycobacterium tuberculosis H37Rv
ucccgcaugcacgucaucggcug

SEQ ID NO: 1341639 - RNA, 22 nt, Mycobacterium tuberculosis H37Rv
ucccgccguugccgccgucacc

SEQ ID NO: 1341640 - RNA, 15 nt, Mycobacterium tuberculosis H37Rv
ucccgccguugccgc

SEQ ID NO: 1341641 - RNA, 16 nt, Mycobacterium tuberculosis H37Rv
ucccgccguugccgcc

SEQ ID NO: 1341642 - RNA, 15 nt, Mycobacterium tuberculosis H37Rv
ucccgcgagcggaug

SEQ ID NO: 1341643 - RNA, 21 nt, Mycobacterium tuberculosis H37Rv
ucccgccggcagcgucggccg

SEQ ID NO: 1341644 - RNA, 17 nt, Mycobacterium tuberculosis H37Rv
ucccgccggcuccgcca

SEQ ID NO: 1341645 - RNA, 14 nt, Mycobacterium tuberculosis H37Rv
ucccgccgcugccg

SEQ ID NO: 1341646 - RNA, 19 nt, Mycobacterium tuberculosis H37Rv
ucccgaguugcccucuggc

SEQ ID NO: 1341647 - RNA, 15 nt, Mycobacterium tuberculosis H37Rv
ucccgacgucggccu

SEQ ID NO: 1341648 - RNA, 13 nt, Mycobacterium tuberculosis H37Rv
ucccgagccacaa

SEQ ID NO: 1341649 - RNA, 20 nt, Mycobacterium tuberculosis H37Rv
ucccgagcccgucagcuccc

SEQ ID NO: 1341650 - RNA, 18 nt, Mycobacterium tuberculosis H37Rv
uccccguccugccagucc

SEQ ID NO: 1341651 - RNA, 13 nt, Mycobacterium tuberculosis H37Rv
uccccucggccgc

SEQ ID NO: 1341652 - RNA, 16 nt, Mycobacterium tuberculosis H37Rv
uccccugcgcugcagc

SEQ ID NO: 1341653 - RNA, 21 nt, Mycobacterium tuberculosis H37Rv
ucccgaacacuuugcgcacua

SEQ ID NO: 1341654 - RNA, 19 nt, Mycobacterium tuberculosis H37Rv
ucccgaaucucacccacau

SEQ ID NO: 1341655 - RNA, 17 nt, Mycobacterium tuberculosis H37Rv
ucccggauauugccauc

SEQ ID NO: 1341656 - RNA, 13 nt, Mycobacterium tuberculosis H37Rv
ucccgcucgcagg

SEQ ID NO: 1341657 - RNA, 20 nt, Mycobacterium tuberculosis H37Rv
ucccgcggucgaucaggccg

SEQ ID NO: 1341658 - RNA, 15 nt, Mycobacterium tuberculosis H37Rv
ucccgcgccggcguu

SEQ ID NO: 1341659 - RNA, 12 nt, Mycobacterium tuberculosis H37Rv
ucccgcgcggcg

SEQ ID NO: 1341660 - RNA, 13 nt, Mycobacterium tuberculosis H37Rv
ucccgcgcgggcg

SEQ ID NO: 1341661 - RNA, 12 nt, Mycobacterium tuberculosis H37Rv
ucccggccaggg

SEQ ID NO: 1341662 - RNA, 23 nt, Mycobacterium tuberculosis H37Rv
ucccggccucgaugucgcggucg

SEQ ID NO: 1341663 - RNA, 18 nt, Mycobacterium tuberculosis H37Rv
ucccggcgaccggguccg

SEQ ID NO: 1341664 - RNA, 13 nt, Mycobacterium tuberculosis H37Rv
ucccggccaggcc

SEQ ID NO: 1341665 - RNA, 20 nt, Mycobacterium tuberculosis H37Rv
ucccggccgucgcgcgaccg

SEQ ID NO: 1341666 - RNA, 14 nt, Mycobacterium tuberculosis H37Rv
ucccggcgccgcgg

SEQ ID NO: 1341667 - RNA, 14 nt, Mycobacterium tuberculosis H37Rv
ucccggcuggggcc

SEQ ID NO: 1341668 - RNA, 14 nt, Mycobacterium tuberculosis H37Rv
ucccggcggucagc

SEQ ID NO: 1341669 - RNA, 19 nt, Mycobacterium tuberculosis H37Rv
ucccggcggucagcggcuc

SEQ ID NO: 1341670 - RNA, 23 nt, Mycobacterium tuberculosis H37Rv
ucccggcggucagcggcucggcg

SEQ ID NO: 1341671 - RNA, 14 nt, Mycobacterium tuberculosis H37Rv
ucccgggccgccgc

SEQ ID NO: 1341672 - RNA, 18 nt, Mycobacterium tuberculosis H37Rv
ucccgggcaguccaggca

SEQ ID NO: 1341673 - RNA, 19 nt, Mycobacterium tuberculosis H37Rv
ucccggcucgagcucggcg

SEQ ID NO: 1341674 - RNA, 19 nt, Mycobacterium tuberculosis H37Rv
ucccgggcggcggccuggg

SEQ ID NO: 1341675 - RNA, 15 nt, Mycobacterium tuberculosis H37Rv
ucccgguguccagcc

SEQ ID NO: 1341676 - RNA, 20 nt, Mycobacterium tuberculosis H37Rv
ucccgggugcgacgcgaccg

SEQ ID NO: 1341677 - RNA, 17 nt, Mycobacterium tuberculosis H37Rv
ucccgggggcacuccgg

SEQ ID NO: 1341678 - RNA, 21 nt, Mycobacterium tuberculosis H37Rv
ucccggucgguguggacuggg

SEQ ID NO: 1341679 - RNA, 14 nt, Mycobacterium tuberculosis H37Rv
ucccgguccagccc

SEQ ID NO: 1341680 - RNA, 14 nt, Mycobacterium tuberculosis H37Rv
ucccgucgccgccc

SEQ ID NO: 1341681 - RNA, 20 nt, Mycobacterium tuberculosis H37Rv
ucccuggggccguccggcuu

SEQ ID NO: 1341682 - RNA, 13 nt, Mycobacterium tuberculosis H37Rv
ucccuccgccaag

SEQ ID NO: 1341683 - RNA, 23 nt, Mycobacterium tuberculosis H37Rv
ucccucgguguacaccgcgcccg

SEQ ID NO: 1341684 - RNA, 15 nt, Mycobacterium tuberculosis H37Rv
ucccuugccgaccgg

SEQ ID NO: 1341685 - RNA, 13 nt, Mycobacterium tuberculosis H37Rv
ucccuuguucccg

SEQ ID NO: 1341686 - RNA, 16 nt, Mycobacterium tuberculosis H37Rv
ucccuuguucccgaaa

SEQ ID NO: 1341687 - RNA, 11 nt, Mycobacterium tuberculosis H37Rv
ucccuuuucca

SEQ ID NO: 1341688 - RNA, 23 nt, Mycobacterium tuberculosis H37Rv
ucccuuguggucugccagcaccc

SEQ ID NO: 1341689 - RNA, 18 nt, Mycobacterium tuberculosis H37Rv
uccgaggaauacagcuug

SEQ ID NO: 1341690 - RNA, 15 nt, Mycobacterium tuberculosis H37Rv
uccgaggccgccauc

SEQ ID NO: 1341691 - RNA, 22 nt, Mycobacterium tuberculosis H37Rv
uccgagcgcggcggcggaggcu

SEQ ID NO: 1341692 - RNA, 20 nt, Mycobacterium tuberculosis H37Rv
uccgagcuuggccgccgcca

SEQ ID NO: 1341693 - RNA, 13 nt, Mycobacterium tuberculosis H37Rv
uccgagccgcgau

SEQ ID NO: 1341694 - RNA, 17 nt, Mycobacterium tuberculosis H37Rv
uccgacuggccccgcca

SEQ ID NO: 1341695 - RNA, 19 nt, Mycobacterium tuberculosis H37Rv
uccgagggcgucgccgccg

SEQ ID NO: 1341696 - RNA, 14 nt, Mycobacterium tuberculosis H37Rv
uccgauuccgaacu

SEQ ID NO: 1341697 - RNA, 22 nt, Mycobacterium tuberculosis H37Rv
uccgauggcccggcucacagca

SEQ ID NO: 1341698 - RNA, 20 nt, Mycobacterium tuberculosis H37Rv
uccgaugcaucggugcagcc

SEQ ID NO: 1341699 - RNA, 17 nt, Mycobacterium tuberculosis H37Rv
uccgacacccgaagccu

SEQ ID NO: 1341700 - RNA, 20 nt, Mycobacterium tuberculosis H37Rv
uccgaacucgcgggcgacca

SEQ ID NO: 1341701 - RNA, 21 nt, Mycobacterium tuberculosis H37Rv
uccgaacuggucgacgccgag

SEQ ID NO: 1341702 - RNA, 17 nt, Mycobacterium tuberculosis H37Rv
uccgaagagccagcaac

SEQ ID NO: 1341703 - RNA, 18 nt, Mycobacterium tuberculosis H37Rv
uccgaaggccgccagucc

SEQ ID NO: 1341704 - RNA, 18 nt, Mycobacterium tuberculosis H37Rv
uccgaacauggccagcau

SEQ ID NO: 1341705 - RNA, 15 nt, Mycobacterium tuberculosis H37Rv
uccgacgucggugac

SEQ ID NO: 1341706 - RNA, 24 nt, Mycobacterium tuberculosis H37Rv
uccgacuggccccgccagcggcag

SEQ ID NO: 1341707 - RNA, 13 nt, Mycobacterium tuberculosis H37Rv
uccgacaugaacc

SEQ ID NO: 1341708 - RNA, 12 nt, Mycobacterium tuberculosis H37Rv
uccgacaguccg

SEQ ID NO: 1341709 - RNA, 17 nt, Mycobacterium tuberculosis H37Rv
uccgacccaacgaccac

SEQ ID NO: 1341710 - RNA, 21 nt, Mycobacterium tuberculosis H37Rv
uccgacccaacgaccaccacc

SEQ ID NO: 1341711 - RNA, 15 nt, Mycobacterium tuberculosis H37Rv
uccgaccgguacccg

SEQ ID NO: 1341712 - RNA, 14 nt, Mycobacterium tuberculosis H37Rv
uccccgcagcgccu

SEQ ID NO: 1341713 - RNA, 22 nt, Mycobacterium tuberculosis H37Rv
uccccgacaacgaaaccgaccu

SEQ ID NO: 1341714 - RNA, 16 nt, Mycobacterium tuberculosis H37Rv
uccccgcgcugagcac

SEQ ID NO: 1341715 - RNA, 13 nt, Mycobacterium tuberculosis H37Rv
uccccgccgccgu

SEQ ID NO: 1341716 - RNA, 14 nt, Mycobacterium tuberculosis H37Rv
uccccgcccuugcc

SEQ ID NO: 1341717 - RNA, 22 nt, Mycobacterium tuberculosis H37Rv
uccccgcccuugccgccagccc

SEQ ID NO: 1341718 - RNA, 21 nt, Mycobacterium tuberculosis H37Rv
uccccgccggcggguuuugau

SEQ ID NO: 1341719 - RNA, 16 nt, Mycobacterium tuberculosis H37Rv
uccccgaccgcgcccg

SEQ ID NO: 1341720 - RNA, 18 nt, Mycobacterium tuberculosis H37Rv
ucccccggguccgccguu

SEQ ID NO: 1341721 - RNA, 16 nt, Mycobacterium tuberculosis H37Rv
uccccccguugccgcc

SEQ ID NO: 1341722 - RNA, 19 nt, Mycobacterium tuberculosis H37Rv
uccccccguugccgccguu

SEQ ID NO: 1341723 - RNA, 15 nt, Mycobacterium tuberculosis H37Rv
uccccagacagaccc

SEQ ID NO: 1341724 - RNA, 15 nt, Mycobacterium tuberculosis H37Rv
uccccacauggcccg

SEQ ID NO: 1341725 - RNA, 18 nt, Mycobacterium tuberculosis H37Rv
ucccccagccgcggcgcc

SEQ ID NO: 1341726 - RNA, 22 nt, Mycobacterium tuberculosis H37Rv
ucccccagaugcugguguugau

SEQ ID NO: 1341727 - RNA, 23 nt, Mycobacterium tuberculosis H37Rv
uccccaugcagcgcgucgccgaa

SEQ ID NO: 1341728 - RNA, 16 nt, Mycobacterium tuberculosis H37Rv
ucccagaggcccgcgg

SEQ ID NO: 1341729 - RNA, 14 nt, Mycobacterium tuberculosis H37Rv
ucccagccaacccg

SEQ ID NO: 1341730 - RNA, 13 nt, Mycobacterium tuberculosis H37Rv
ucccagccaaccc

SEQ ID NO: 1341731 - RNA, 19 nt, Mycobacterium tuberculosis H37Rv
ucccagcgccgcacagaaa

SEQ ID NO: 1341732 - RNA, 11 nt, Mycobacterium tuberculosis H37Rv
ucccagcgccg

SEQ ID NO: 1341733 - RNA, 19 nt, Mycobacterium tuberculosis H37Rv
ucccaggcguuuggcgugc

SEQ ID NO: 1341734 - RNA, 17 nt, Mycobacterium tuberculosis H37Rv
ucccagcucccgcggcg

SEQ ID NO: 1341735 - RNA, 19 nt, Mycobacterium tuberculosis H37Rv
ucccagcucccgcggcgcc

SEQ ID NO: 1341736 - RNA, 14 nt, Mycobacterium tuberculosis H37Rv
ucccauucccaaca

SEQ ID NO: 1341737 - RNA, 12 nt, Mycobacterium tuberculosis H37Rv
ucccauuugccu

SEQ ID NO: 1341738 - RNA, 17 nt, Mycobacterium tuberculosis H37Rv
uccccacaaucagcccg

SEQ ID NO: 1341739 - RNA, 22 nt, Mycobacterium tuberculosis H37Rv
uccaugauggccgucagccagg

SEQ ID NO: 1341740 - RNA, 21 nt, Mycobacterium tuberculosis H37Rv
uccauggacggccaggugcag

SEQ ID NO: 1341741 - RNA, 17 nt, Mycobacterium tuberculosis H37Rv
uccauggacggccaggu

SEQ ID NO: 1341742 - RNA, 17 nt, Mycobacterium tuberculosis H37Rv
uccauucauggccgcga

SEQ ID NO: 1341743 - RNA, 23 nt, Mycobacterium tuberculosis H37Rv
uccauuagcacaucgccggcguc

SEQ ID NO: 1341744 - RNA, 19 nt, Mycobacterium tuberculosis H37Rv
uccauguuuugcugcaugc

SEQ ID NO: 1341745 - RNA, 13 nt, Mycobacterium tuberculosis H37Rv
uccaugucgucga

SEQ ID NO: 1341746 - RNA, 12 nt, Mycobacterium tuberculosis H37Rv
uccaugucgucg

SEQ ID NO: 1341747 - RNA, 15 nt, Mycobacterium tuberculosis H37Rv
ucccaacgccacugc

SEQ ID NO: 1341748 - RNA, 22 nt, Mycobacterium tuberculosis H37Rv
ucccaaucgggaucgcugccag

SEQ ID NO: 1341749 - RNA, 18 nt, Mycobacterium tuberculosis H37Rv
ucccaaucgucggccagc

SEQ ID NO: 1341750 - RNA, 17 nt, Mycobacterium tuberculosis H37Rv
uccauugugggacgcga

SEQ ID NO: 1341751 - RNA, 19 nt, Mycobacterium tuberculosis H37Rv
ucccacggcgguugccccg

SEQ ID NO: 1341752 - RNA, 23 nt, Mycobacterium tuberculosis H37Rv
ucccacggccggccgcugccacu

SEQ ID NO: 1341753 - RNA, 15 nt, Mycobacterium tuberculosis H37Rv
ucccacgccgccguu

SEQ ID NO: 1341754 - RNA, 22 nt, Mycobacterium tuberculosis H37Rv
ucccacggccggccgcugccac

SEQ ID NO: 1341755 - RNA, 16 nt, Mycobacterium tuberculosis H37Rv
ucccacgccagcgcga

SEQ ID NO: 1341756 - RNA, 14 nt, Mycobacterium tuberculosis H37Rv
ucccacucacccag

SEQ ID NO: 1341757 - RNA, 14 nt, Mycobacterium tuberculosis H37Rv
ucccacucgucguc

SEQ ID NO: 1341758 - RNA, 22 nt, Mycobacterium tuberculosis H37Rv
ucccaccaccgcucgucguccg

SEQ ID NO: 1341759 - RNA, 20 nt, Mycobacterium tuberculosis H37Rv
ucccaccagcggcggcccuu

SEQ ID NO: 1341760 - RNA, 13 nt, Mycobacterium tuberculosis H37Rv
uccauaccugaau

SEQ ID NO: 1341761 - RNA, 14 nt, Mycobacterium tuberculosis H37Rv
uccauaccugaaug

SEQ ID NO: 1341762 - RNA, 19 nt, Mycobacterium tuberculosis H37Rv
uccaucagagacagcagcg

SEQ ID NO: 1341763 - RNA, 13 nt, Mycobacterium tuberculosis H37Rv
uccaucaugugcg

SEQ ID NO: 1341764 - RNA, 14 nt, Mycobacterium tuberculosis H37Rv
uccaucagggccuu

SEQ ID NO: 1341765 - RNA, 19 nt, Mycobacterium tuberculosis H37Rv
uccaucacggaccaggccu

SEQ ID NO: 1341766 - RNA, 13 nt, Mycobacterium tuberculosis H37Rv
uccaucacaucca

SEQ ID NO: 1341767 - RNA, 21 nt, Mycobacterium tuberculosis H37Rv
uccagguucuucuccaccacc

SEQ ID NO: 1341768 - RNA, 17 nt, Mycobacterium tuberculosis H37Rv
uccaguccaugugccca

SEQ ID NO: 1341769 - RNA, 12 nt, Mycobacterium tuberculosis H37Rv
uccaggucuggg

SEQ ID NO: 1341770 - RNA, 14 nt, Mycobacterium tuberculosis H37Rv
uccagggccacgau

SEQ ID NO: 1341771 - RNA, 18 nt, Mycobacterium tuberculosis H37Rv
uccaguggcagccagcgg

SEQ ID NO: 1341772 - RNA, 18 nt, Mycobacterium tuberculosis H37Rv
uccaguggcgccagggcc

SEQ ID NO: 1341773 - RNA, 14 nt, Mycobacterium tuberculosis H37Rv
uccagugcggccuu

SEQ ID NO: 1341774 - RNA, 20 nt, Mycobacterium tuberculosis H37Rv
uccagugcgguggccagugc

SEQ ID NO: 1341775 - RNA, 23 nt, Mycobacterium tuberculosis H37Rv
uccaguccuaucagugagccgcc

SEQ ID NO: 1341776 - RNA, 12 nt, Mycobacterium tuberculosis H37Rv
uccagucuggga

SEQ ID NO: 1341777 - RNA, 22 nt, Mycobacterium tuberculosis H37Rv
uccagccgacggcagugcugca

SEQ ID NO: 1341778 - RNA, 22 nt, Mycobacterium tuberculosis H37Rv
uccagccgacguaccagggugu

SEQ ID NO: 1341779 - RNA, 22 nt, Mycobacterium tuberculosis H37Rv
uccagccgcgcguccgggcagc

SEQ ID NO: 1341780 - RNA, 15 nt, Mycobacterium tuberculosis H37Rv
uccagccgcgcgccg

SEQ ID NO: 1341781 - RNA, 16 nt, Mycobacterium tuberculosis H37Rv
uccagccgcgcguccg

SEQ ID NO: 1341782 - RNA, 21 nt, Mycobacterium tuberculosis H37Rv
uccagccccaucgcuggucga

SEQ ID NO: 1341783 - RNA, 20 nt, Mycobacterium tuberculosis H37Rv
uccagcccaacucggccagc

SEQ ID NO: 1341784 - RNA, 12 nt, Mycobacterium tuberculosis H37Rv
uccagccaggcc

SEQ ID NO: 1341785 - RNA, 21 nt, Mycobacterium tuberculosis H37Rv
uccagcagcgacgcugccgcc

SEQ ID NO: 1341786 - RNA, 19 nt, Mycobacterium tuberculosis H37Rv
uccagcagguccgcggccg

SEQ ID NO: 1341787 - RNA, 21 nt, Mycobacterium tuberculosis H37Rv
uccagccgguccagacccagc

SEQ ID NO: 1341788 - RNA, 13 nt, Mycobacterium tuberculosis H37Rv
uccagccguggcg

SEQ ID NO: 1341789 - RNA, 18 nt, Mycobacterium tuberculosis H37Rv
uccagccgucggcgcugc

SEQ ID NO: 1341790 - RNA, 21 nt, Mycobacterium tuberculosis H37Rv
uccagccgugcggcggcugcc

SEQ ID NO: 1341791 - RNA, 20 nt, Mycobacterium tuberculosis H37Rv
uccagcgaggagcagggcuc

SEQ ID NO: 1341792 - RNA, 13 nt, Mycobacterium tuberculosis H37Rv
uccagcgcaccgg

SEQ ID NO: 1341793 - RNA, 13 nt, Mycobacterium tuberculosis H37Rv
uccagcgcgcgcc

SEQ ID NO: 1341794 - RNA, 17 nt, Mycobacterium tuberculosis H37Rv
uccagcgcgcgccgcag

SEQ ID NO: 1341795 - RNA, 14 nt, Mycobacterium tuberculosis H37Rv
uccagcgcggccuu

SEQ ID NO: 1341796 - RNA, 16 nt, Mycobacterium tuberculosis H37Rv
uccagcgccgcggccc

SEQ ID NO: 1341797 - RNA, 22 nt, Mycobacterium tuberculosis H37Rv
uccagcgcgacguccaccagcc

SEQ ID NO: 1341798 - RNA, 21 nt, Mycobacterium tuberculosis H37Rv
uccagcgcgccacccagcacc

SEQ ID NO: 1341799 - RNA, 19 nt, Mycobacterium tuberculosis H37Rv
uccagcgggaucugaccca

SEQ ID NO: 1341800 - RNA, 16 nt, Mycobacterium tuberculosis H37Rv
uccagcugcgcgggcg

SEQ ID NO: 1341801 - RNA, 17 nt, Mycobacterium tuberculosis H37Rv
uccagcucggccagugc

SEQ ID NO: 1341802 - RNA, 15 nt, Mycobacterium tuberculosis H37Rv
uccaggaauucccca

SEQ ID NO: 1341803 - RNA, 16 nt, Mycobacterium tuberculosis H37Rv
uccagcuugccgaccu

SEQ ID NO: 1341804 - RNA, 21 nt, Mycobacterium tuberculosis H37Rv
uccaggcccauacgugccgcc

SEQ ID NO: 1341805 - RNA, 19 nt, Mycobacterium tuberculosis H37Rv
uccaggauggccaucagcu

SEQ ID NO: 1341806 - RNA, 23 nt, Mycobacterium tuberculosis H37Rv
uccaggauggccaucagcucgcc

SEQ ID NO: 1341807 - RNA, 21 nt, Mycobacterium tuberculosis H37Rv
uccaggaggcauugguguagc

SEQ ID NO: 1341808 - RNA, 17 nt, Mycobacterium tuberculosis H37Rv
uccaggcgcgcaccacc

SEQ ID NO: 1341809 - RNA, 21 nt, Mycobacterium tuberculosis H37Rv
uccaggcguuggaucccagcc

SEQ ID NO: 1341810 - RNA, 16 nt, Mycobacterium tuberculosis H37Rv
uccagggcccugcugg

SEQ ID NO: 1341811 - RNA, 16 nt, Mycobacterium tuberculosis H37Rv
uccaggcgcgcaccac

SEQ ID NO: 1341812 - RNA, 20 nt, Mycobacterium tuberculosis H37Rv
uccaggcgcgccgcacccgg

SEQ ID NO: 1341813 - RNA, 16 nt, Mycobacterium tuberculosis H37Rv
uccagauacaggaaca

SEQ ID NO: 1341814 - RNA, 15 nt, Mycobacterium tuberculosis H37Rv
uccagaugcccagca

SEQ ID NO: 1341815 - RNA, 15 nt, Mycobacterium tuberculosis H37Rv
uccagcaccaccgga

SEQ ID NO: 1341816 - RNA, 16 nt, Mycobacterium tuberculosis H37Rv
uccagcaaccucgguu

SEQ ID NO: 1341817 - RNA, 13 nt, Mycobacterium tuberculosis H37Rv
uccagcaccagca

SEQ ID NO: 1341818 - RNA, 19 nt, Mycobacterium tuberculosis H37Rv
uccagaaggccgcaccgcc

SEQ ID NO: 1341819 - RNA, 21 nt, Mycobacterium tuberculosis H37Rv
uccagacgccacugccagccg

SEQ ID NO: 1341820 - RNA, 22 nt, Mycobacterium tuberculosis H37Rv
uccagaggccggcgggcucgcc

SEQ ID NO: 1341821 - RNA, 15 nt, Mycobacterium tuberculosis H37Rv
uccagagacagcgcc

SEQ ID NO: 1341822 - RNA, 15 nt, Mycobacterium tuberculosis H37Rv
uccagaucaacgcgu

SEQ ID NO: 1341823 - RNA, 15 nt, Mycobacterium tuberculosis H37Rv
uccacugaccagguc

SEQ ID NO: 1341824 - RNA, 16 nt, Mycobacterium tuberculosis H37Rv
uccacucgaccugaug

SEQ ID NO: 1341825 - RNA, 21 nt, Mycobacterium tuberculosis H37Rv
uccacuggucaacgggaugcc

SEQ ID NO: 1341826 - RNA, 23 nt, Mycobacterium tuberculosis H37Rv
uccaccuuggccagacccaccac

SEQ ID NO: 1341827 - RNA, 16 nt, Mycobacterium tuberculosis H37Rv
uccaccguuagccagg

SEQ ID NO: 1341828 - RNA, 16 nt, Mycobacterium tuberculosis H37Rv
uccacgaucacccgga

SEQ ID NO: 1341829 - RNA, 23 nt, Mycobacterium tuberculosis H37Rv
uccacgcacucgucgggguugau

SEQ ID NO: 1341830 - RNA, 13 nt, Mycobacterium tuberculosis H37Rv
uccacgcaccacg

SEQ ID NO: 1341831 - RNA, 15 nt, Mycobacterium tuberculosis H37Rv
uccacgucgcggcgu

SEQ ID NO: 1341832 - RNA, 16 nt, Mycobacterium tuberculosis H37Rv
uccacggacggucggg

SEQ ID NO: 1341833 - RNA, 18 nt, Mycobacterium tuberculosis H37Rv
uccacgccgggcaaggcc

SEQ ID NO: 1341834 - RNA, 13 nt, Mycobacterium tuberculosis H37Rv
uccaccgccacca

SEQ ID NO: 1341835 - RNA, 22 nt, Mycobacterium tuberculosis H37Rv
uccaccgcgcggcgcagcaccg

SEQ ID NO: 1341836 - RNA, 22 nt, Mycobacterium tuberculosis H37Rv
uccaccgaaaaguccgccgccu

SEQ ID NO: 1341837 - RNA, 21 nt, Mycobacterium tuberculosis H37Rv
uccaccgacguggccagcccg

SEQ ID NO: 1341838 - RNA, 16 nt, Mycobacterium tuberculosis H37Rv
uccaccgggcgucguc

SEQ ID NO: 1341839 - RNA, 17 nt, Mycobacterium tuberculosis H37Rv
uccaccgggcccgccgu

SEQ ID NO: 1341840 - RNA, 18 nt, Mycobacterium tuberculosis H37Rv
uccaccgggcccgccguc

SEQ ID NO: 1341841 - RNA, 23 nt, Mycobacterium tuberculosis H37Rv
uccaccgcugccggcagcguccg

SEQ ID NO: 1341842 - RNA, 17 nt, Mycobacterium tuberculosis H37Rv
uccaccguuagccaggu

SEQ ID NO: 1341843 - RNA, 18 nt, Mycobacterium tuberculosis H37Rv
uccaccguuagccagguc

SEQ ID NO: 1341844 - RNA, 18 nt, Mycobacterium tuberculosis H37Rv
uccaccgucgcaccagcg

SEQ ID NO: 1341845 - RNA, 17 nt, Mycobacterium tuberculosis H37Rv
uccaccagccgguagcc

SEQ ID NO: 1341846 - RNA, 19 nt, Mycobacterium tuberculosis H37Rv
uccacccacgaucagcagc

SEQ ID NO: 1341847 - RNA, 23 nt, Mycobacterium tuberculosis H37Rv
uccacccaggccgaugugucgau

SEQ ID NO: 1341848 - RNA, 13 nt, Mycobacterium tuberculosis H37Rv
uccacaccaggcc

SEQ ID NO: 1341849 - RNA, 13 nt, Mycobacterium tuberculosis H37Rv
uccacaucaaaac

SEQ ID NO: 1341850 - RNA, 20 nt, Mycobacterium tuberculosis H37Rv
uccaagcucgacaacugccc

SEQ ID NO: 1341851 - RNA, 14 nt, Mycobacterium tuberculosis H37Rv
uccaagucacagcu

SEQ ID NO: 1341852 - RNA, 17 nt, Mycobacterium tuberculosis H37Rv
uccaaggcucagcagcg

SEQ ID NO: 1341853 - RNA, 16 nt, Mycobacterium tuberculosis H37Rv
uccaagcaauuccacc

SEQ ID NO: 1341854 - RNA, 13 nt, Mycobacterium tuberculosis H37Rv
uccaacucggcca

SEQ ID NO: 1341855 - RNA, 14 nt, Mycobacterium tuberculosis H37Rv
uccacaacagcccg

SEQ ID NO: 1341856 - RNA, 19 nt, Mycobacterium tuberculosis H37Rv
uccaauugcgaaccggccg

SEQ ID NO: 1341857 - RNA, 23 nt, Mycobacterium tuberculosis H37Rv
uccaauugcgcugaagcccaugg

SEQ ID NO: 1341858 - RNA, 17 nt, Mycobacterium tuberculosis H37Rv
uccaauugcggccgcgc

SEQ ID NO: 1341859 - RNA, 22 nt, Mycobacterium tuberculosis H37Rv
uccaauaucgcuuucgaagaac

SEQ ID NO: 1341860 - RNA, 17 nt, Mycobacterium tuberculosis H37Rv
uccaaugcuguggcccg

SEQ ID NO: 1341861 - RNA, 15 nt, Mycobacterium tuberculosis H37Rv
ucaggucaccggccg

SEQ ID NO: 1341862 - RNA, 19 nt, Mycobacterium tuberculosis H37Rv
ucagguccuggguguagca

SEQ ID NO: 1341863 - RNA, 16 nt, Mycobacterium tuberculosis H37Rv
ucaggucggggucaga

SEQ ID NO: 1341864 - RNA, 20 nt, Mycobacterium tuberculosis H37Rv
ucaggucgucacgccccuca

SEQ ID NO: 1341865 - RNA, 20 nt, Mycobacterium tuberculosis H37Rv
ucaggucguuugugaacacc

SEQ ID NO: 1341866 - RNA, 20 nt, Mycobacterium tuberculosis H37Rv
ucaggucuucgauggccaug

SEQ ID NO: 1341867 - RNA, 22 nt, Mycobacterium tuberculosis H37Rv
ucaggggcuacuaggcccagca

SEQ ID NO: 1341868 - RNA, 22 nt, Mycobacterium tuberculosis H37Rv
ucaggggaucccccgcgcgaac

SEQ ID NO: 1341869 - RNA, 21 nt, Mycobacterium tuberculosis H37Rv
ucaggccgaugcgggucucga

SEQ ID NO: 1341870 - RNA, 12 nt, Mycobacterium tuberculosis H37Rv
ucaggccgagga

SEQ ID NO: 1341871 - RNA, 22 nt, Mycobacterium tuberculosis H37Rv
ucaggccgacgucuaggccaaa

SEQ ID NO: 1341872 - RNA, 13 nt, Mycobacterium tuberculosis H37Rv
ucaggccagggug

SEQ ID NO: 1341873 - RNA, 21 nt, Mycobacterium tuberculosis H37Rv
ucaggcccugccgacgcucca

SEQ ID NO: 1341874 - RNA, 14 nt, Mycobacterium tuberculosis H37Rv
ucaggccagcgcuc

SEQ ID NO: 1341875 - RNA, 13 nt, Mycobacterium tuberculosis H37Rv
ucagcgggcagca

SEQ ID NO: 1341876 - RNA, 17 nt, Mycobacterium tuberculosis H37Rv
ucagcggccaacccauc

SEQ ID NO: 1341877 - RNA, 16 nt, Mycobacterium tuberculosis H37Rv
ucagcggccagcagug

SEQ ID NO: 1341878 - RNA, 17 nt, Mycobacterium tuberculosis H37Rv
ucagcggccagcagugc

SEQ ID NO: 1341879 - RNA, 14 nt, Mycobacterium tuberculosis H37Rv
ucagcggccaaccc

SEQ ID NO: 1341880 - RNA, 15 nt, Mycobacterium tuberculosis H37Rv
ucagcggccaaccca

SEQ ID NO: 1341881 - RNA, 21 nt, Mycobacterium tuberculosis H37Rv
ucagcggcccgcugcgcggcc

SEQ ID NO: 1341882 - RNA, 13 nt, Mycobacterium tuberculosis H37Rv
ucagcgcugagcc

SEQ ID NO: 1341883 - RNA, 16 nt, Mycobacterium tuberculosis H37Rv
ucagcgcguagccaau

SEQ ID NO: 1341884 - RNA, 18 nt, Mycobacterium tuberculosis H37Rv
ucagcggauccagaaacu

SEQ ID NO: 1341885 - RNA, 23 nt, Mycobacterium tuberculosis H37Rv
ucagcguauuggacgcugccgca

SEQ ID NO: 1341886 - RNA, 19 nt, Mycobacterium tuberculosis H37Rv
ucagcguggcgcccgugcc

SEQ ID NO: 1341887 - RNA, 15 nt, Mycobacterium tuberculosis H37Rv
ucagcgugcgcuggc

SEQ ID NO: 1341888 - RNA, 22 nt, Mycobacterium tuberculosis H37Rv
ucagcgucaggccuccaaaauc

SEQ ID NO: 1341889 - RNA, 21 nt, Mycobacterium tuberculosis H37Rv
ucagcgcgaccgucaggguca

SEQ ID NO: 1341890 - RNA, 16 nt, Mycobacterium tuberculosis H37Rv
ucagcgcggcacggug

SEQ ID NO: 1341891 - RNA, 23 nt, Mycobacterium tuberculosis H37Rv
ucagcgcggcacggugugcggca

SEQ ID NO: 1341892 - RNA, 22 nt, Mycobacterium tuberculosis H37Rv
ucagcgccgcauucgcgacaac

SEQ ID NO: 1341893 - RNA, 22 nt, Mycobacterium tuberculosis H37Rv
ucagcgcaucgccgcuggccag

SEQ ID NO: 1341894 - RNA, 13 nt, Mycobacterium tuberculosis H37Rv
ucagcgccagcga

SEQ ID NO: 1341895 - RNA, 14 nt, Mycobacterium tuberculosis H37Rv
ucagcgccagcgcc

SEQ ID NO: 1341896 - RNA, 20 nt, Mycobacterium tuberculosis H37Rv
ucagcgcaucgccgcuggcc

SEQ ID NO: 1341897 - RNA, 14 nt, Mycobacterium tuberculosis H37Rv
ucaggacaugcagg

SEQ ID NO: 1341898 - RNA, 20 nt, Mycobacterium tuberculosis H37Rv
ucaggaaccacccaccggcc

SEQ ID NO: 1341899 - RNA, 20 nt, Mycobacterium tuberculosis H37Rv
ucaggaaaccggcgcggaac

SEQ ID NO: 1341900 - RNA, 13 nt, Mycobacterium tuberculosis H37Rv
ucagcugcugcca

SEQ ID NO: 1341901 - RNA, 14 nt, Mycobacterium tuberculosis H37Rv
ucagcugcugccac

SEQ ID NO: 1341902 - RNA, 18 nt, Mycobacterium tuberculosis H37Rv
ucagcugugcgacccgca

SEQ ID NO: 1341903 - RNA, 15 nt, Mycobacterium tuberculosis H37Rv
ucagcugcggauaca

SEQ ID NO: 1341904 - RNA, 12 nt, Mycobacterium tuberculosis H37Rv
ucagcucaccac

SEQ ID NO: 1341905 - RNA, 18 nt, Mycobacterium tuberculosis H37Rv
ucagcucggcagcaucuc

SEQ ID NO: 1341906 - RNA, 22 nt, Mycobacterium tuberculosis H37Rv
ucagcucgucggcgauggccag

SEQ ID NO: 1341907 - RNA, 19 nt, Mycobacterium tuberculosis H37Rv
ucagcucgaggaccaccug

SEQ ID NO: 1341908 - RNA, 15 nt, Mycobacterium tuberculosis H37Rv
ucagcucgccagccu

SEQ ID NO: 1341909 - RNA, 13 nt, Mycobacterium tuberculosis H37Rv
ucagcucgccagg

SEQ ID NO: 1341910 - RNA, 13 nt, Mycobacterium tuberculosis H37Rv
ucagguuggcacg

SEQ ID NO: 1341911 - RNA, 14 nt, Mycobacterium tuberculosis H37Rv
ucaguauggcgacg

SEQ ID NO: 1341912 - RNA, 15 nt, Mycobacterium tuberculosis H37Rv
ucaguagccacgccc

SEQ ID NO: 1341913 - RNA, 22 nt, Mycobacterium tuberculosis H37Rv
ucaguagccacgcccacagggg

SEQ ID NO: 1341914 - RNA, 20 nt, Mycobacterium tuberculosis H37Rv
ucagugaagacaccaggccc

SEQ ID NO: 1341915 - RNA, 16 nt, Mycobacterium tuberculosis H37Rv
ucagugaucaccaacc

SEQ ID NO: 1341916 - RNA, 15 nt, Mycobacterium tuberculosis H37Rv
ucaguugcacaccga

SEQ ID NO: 1341917 - RNA, 23 nt, Mycobacterium tuberculosis H37Rv
ucaguugcgcuccaacaacucca

SEQ ID NO: 1341918 - RNA, 20 nt, Mycobacterium tuberculosis H37Rv
ucaguucggugugcggcgca

SEQ ID NO: 1341919 - RNA, 13 nt, Mycobacterium tuberculosis H37Rv
ucaguugugcguu

SEQ ID NO: 1341920 - RNA, 19 nt, Mycobacterium tuberculosis H37Rv
ucaguucgacggugccguc

SEQ ID NO: 1341921 - RNA, 13 nt, Mycobacterium tuberculosis H37Rv
ucaguucccgaac

SEQ ID NO: 1341922 - RNA, 22 nt, Mycobacterium tuberculosis H37Rv
ucauaggcccgcacgaucucgu

SEQ ID NO: 1341923 - RNA, 12 nt, Mycobacterium tuberculosis H37Rv
ucauagugcagg

SEQ ID NO: 1341924 - RNA, 23 nt, Mycobacterium tuberculosis H37Rv
ucauagccccgcagagucgccga

SEQ ID NO: 1341925 - RNA, 20 nt, Mycobacterium tuberculosis H37Rv
ucauagcgcaccaccgucuc

SEQ ID NO: 1341926 - RNA, 16 nt, Mycobacterium tuberculosis H37Rv
ucaucgcgcacgcccu

SEQ ID NO: 1341927 - RNA, 22 nt, Mycobacterium tuberculosis H37Rv
ucaucgcggcgaacaucaccgu

SEQ ID NO: 1341928 - RNA, 18 nt, Mycobacterium tuberculosis H37Rv
ucaucgccgacccgccac

SEQ ID NO: 1341929 - RNA, 16 nt, Mycobacterium tuberculosis H37Rv
ucaucgagcugaccug

SEQ ID NO: 1341930 - RNA, 15 nt, Mycobacterium tuberculosis H37Rv
ucaucgaccuggcca

SEQ ID NO: 1341931 - RNA, 18 nt, Mycobacterium tuberculosis H37Rv
ucaucgaccuggccacgg

SEQ ID NO: 1341932 - RNA, 16 nt, Mycobacterium tuberculosis H37Rv
ucaucgacgccugcgg

SEQ ID NO: 1341933 - RNA, 19 nt, Mycobacterium tuberculosis H37Rv
ucauccuggucaccagcca

SEQ ID NO: 1341934 - RNA, 21 nt, Mycobacterium tuberculosis H37Rv
ucaucccaagcguccgcugca

SEQ ID NO: 1341935 - RNA, 17 nt, Mycobacterium tuberculosis H37Rv
ucauccauccgggccgc

SEQ ID NO: 1341936 - RNA, 15 nt, Mycobacterium tuberculosis H37Rv
ucauccaccccugag

SEQ ID NO: 1341937 - RNA, 13 nt, Mycobacterium tuberculosis H37Rv
ucauccagccagc

SEQ ID NO: 1341938 - RNA, 19 nt, Mycobacterium tuberculosis H37Rv
ucauccgggcgaccaccac

SEQ ID NO: 1341939 - RNA, 16 nt, Mycobacterium tuberculosis H37Rv
ucaucccgaccagcag

SEQ ID NO: 1341940 - RNA, 17 nt, Mycobacterium tuberculosis H37Rv
ucauccgacaagcuguc

SEQ ID NO: 1341941 - RNA, 17 nt, Mycobacterium tuberculosis H37Rv
ucaucaccggcgcaccg

SEQ ID NO: 1341942 - RNA, 19 nt, Mycobacterium tuberculosis H37Rv
ucauccaccccugagcucc

SEQ ID NO: 1341943 - RNA, 19 nt, Mycobacterium tuberculosis H37Rv
ucaucauauccgccccagc

SEQ ID NO: 1341944 - RNA, 16 nt, Mycobacterium tuberculosis H37Rv
ucaucgugguaaccau

SEQ ID NO: 1341945 - RNA, 15 nt, Mycobacterium tuberculosis H37Rv
ucaucggcuggccgc

SEQ ID NO: 1341946 - RNA, 20 nt, Mycobacterium tuberculosis H37Rv
ucaucgggguggccaccagc

SEQ ID NO: 1341947 - RNA, 21 nt, Mycobacterium tuberculosis H37Rv
ucaucuuggcgcgguccucca

SEQ ID NO: 1341948 - RNA, 15 nt, Mycobacterium tuberculosis H37Rv
ucaugccgcggaccc

SEQ ID NO: 1341949 - RNA, 20 nt, Mycobacterium tuberculosis H37Rv
ucaugcccaugauggccgcg

SEQ ID NO: 1341950 - RNA, 23 nt, Mycobacterium tuberculosis H37Rv
ucaugccgacgacaacagccagc

SEQ ID NO: 1341951 - RNA, 20 nt, Mycobacterium tuberculosis H37Rv
ucaugcacgccguagcaucg

SEQ ID NO: 1341952 - RNA, 13 nt, Mycobacterium tuberculosis H37Rv
ucaugcuggaagu

SEQ ID NO: 1341953 - RNA, 21 nt, Mycobacterium tuberculosis H37Rv
ucaugcuggaaguugugcgca

SEQ ID NO: 1341954 - RNA, 18 nt, Mycobacterium tuberculosis H37Rv
ucaugacgagccgagccu

SEQ ID NO: 1341955 - RNA, 18 nt, Mycobacterium tuberculosis H37Rv
ucaugaacgccagcagcg

SEQ ID NO: 1341956 - RNA, 23 nt, Mycobacterium tuberculosis H37Rv
ucauuggccuggcuaguugggug

SEQ ID NO: 1341957 - RNA, 16 nt, Mycobacterium tuberculosis H37Rv
uccaaaaaguagcugc

SEQ ID NO: 1341958 - RNA, 17 nt, Mycobacterium tuberculosis H37Rv
uccaaaagccucagccg

SEQ ID NO: 1341959 - RNA, 21 nt, Mycobacterium tuberculosis H37Rv
uccaacccaggguggcgacgu

SEQ ID NO: 1341960 - RNA, 13 nt, Mycobacterium tuberculosis H37Rv
uccaaccccagcg

SEQ ID NO: 1341961 - RNA, 13 nt, Mycobacterium tuberculosis H37Rv
uccaacgaucagu

SEQ ID NO: 1341962 - RNA, 15 nt, Mycobacterium tuberculosis H37Rv
uccaaccgggccggc

SEQ ID NO: 1341963 - RNA, 19 nt, Mycobacterium tuberculosis H37Rv
uccaacaacuccagcaggu

SEQ ID NO: 1341964 - RNA, 19 nt, Mycobacterium tuberculosis H37Rv
uccaacacaaacgccgccg

SEQ ID NO: 1341965 - RNA, 17 nt, Mycobacterium tuberculosis H37Rv
uccaaagaccccuaccg

SEQ ID NO: 1341966 - RNA, 15 nt, Mycobacterium tuberculosis H37Rv
ucauugcccuugacc

SEQ ID NO: 1341967 - RNA, 12 nt, Mycobacterium tuberculosis H37Rv
ucaugggaucag

SEQ ID NO: 1341968 - RNA, 14 nt, Mycobacterium tuberculosis H37Rv
ucauggucagcaga

SEQ ID NO: 1341969 - RNA, 14 nt, Mycobacterium tuberculosis H37Rv
ggaccggcugcagg

SEQ ID NO: 1341970 - RNA, 18 nt, Mycobacterium tuberculosis H37Rv
ggaccgcgaacccguggg

SEQ ID NO: 1341971 - RNA, 14 nt, Mycobacterium tuberculosis H37Rv
ggaccgccagggcu

SEQ ID NO: 1341972 - RNA, 22 nt, Mycobacterium tuberculosis H37Rv
ggaccgaugacgaucggcggcg

SEQ ID NO: 1341973 - RNA, 14 nt, Mycobacterium tuberculosis H37Rv
ggacccagccagcu

SEQ ID NO: 1341974 - RNA, 15 nt, Mycobacterium tuberculosis H37Rv
ggacccgcagcugcg

SEQ ID NO: 1341975 - RNA, 14 nt, Mycobacterium tuberculosis H37Rv
ggacccgcccaggc

SEQ ID NO: 1341976 - RNA, 12 nt, Mycobacterium tuberculosis H37Rv
ggacccgcagcu

SEQ ID NO: 1341977 - RNA, 22 nt, Mycobacterium tuberculosis H37Rv
ggaccuuggcgaccaugcuccu

SEQ ID NO: 1341978 - RNA, 23 nt, Mycobacterium tuberculosis H37Rv
ggacgaacaacgcgacgaagcag

SEQ ID NO: 1341979 - RNA, 19 nt, Mycobacterium tuberculosis H37Rv
ggacgaccgcgcggcacuu

SEQ ID NO: 1341980 - RNA, 15 nt, Mycobacterium tuberculosis H37Rv
ggaccuggcggcggu

SEQ ID NO: 1341981 - RNA, 20 nt, Mycobacterium tuberculosis H37Rv
ggaccgugacguaucgccgc

SEQ ID NO: 1341982 - RNA, 14 nt, Mycobacterium tuberculosis H37Rv
ggaccguggcagcu

SEQ ID NO: 1341983 - RNA, 19 nt, Mycobacterium tuberculosis H37Rv
ggaccguuaccggacccgc

SEQ ID NO: 1341984 - RNA, 20 nt, Mycobacterium tuberculosis H37Rv
ggaccguuaccggacccgcu

SEQ ID NO: 1341985 - RNA, 19 nt, Mycobacterium tuberculosis H37Rv
ggaccgucuuuggugccga

SEQ ID NO: 1341986 - RNA, 22 nt, Mycobacterium tuberculosis H37Rv
ggaccgucuuuggugccgagca

SEQ ID NO: 1341987 - RNA, 16 nt, Mycobacterium tuberculosis H37Rv
ggaccgucgccgguga

SEQ ID NO: 1341988 - RNA, 21 nt, Mycobacterium tuberculosis H37Rv
ggaccggugugcacgcgggcg

SEQ ID NO: 1341989 - RNA, 23 nt, Mycobacterium tuberculosis H37Rv
ggaccacuaguucgagcugccag

SEQ ID NO: 1341990 - RNA, 13 nt, Mycobacterium tuberculosis H37Rv
ggaccaucgccag

SEQ ID NO: 1341991 - RNA, 16 nt, Mycobacterium tuberculosis H37Rv
ggaccaucgccaggcc

SEQ ID NO: 1341992 - RNA, 17 nt, Mycobacterium tuberculosis H37Rv
ggaccauagccugcgcc

SEQ ID NO: 1341993 - RNA, 22 nt, Mycobacterium tuberculosis H37Rv
ggaccagugcgguggcagguga

SEQ ID NO: 1341994 - RNA, 20 nt, Mycobacterium tuberculosis H37Rv
ggacaugcgggcagcacucu

SEQ ID NO: 1341995 - RNA, 15 nt, Mycobacterium tuberculosis H37Rv
ggacaucgggcggca

SEQ ID NO: 1341996 - RNA, 21 nt, Mycobacterium tuberculosis H37Rv
ggaccaccacuaggucgccgg

SEQ ID NO: 1341997 - RNA, 17 nt, Mycobacterium tuberculosis H37Rv
ggaccaccagcgcucca

SEQ ID NO: 1341998 - RNA, 20 nt, Mycobacterium tuberculosis H37Rv
ggaccaccgcauaacgccag

SEQ ID NO: 1341999 - RNA, 17 nt, Mycobacterium tuberculosis H37Rv
ggaccaacgccaacgcc

SEQ ID NO: 1342000 - RNA, 24 nt, Mycobacterium tuberculosis H37Rv
ggacagcccggacgcgcggauggc

SEQ ID NO: 1342001 - RNA, 15 nt, Mycobacterium tuberculosis H37Rv
ggacagcagcagauc

SEQ ID NO: 1342002 - RNA, 20 nt, Mycobacterium tuberculosis H37Rv
ggacagaugcauccagcugc

SEQ ID NO: 1342003 - RNA, 15 nt, Mycobacterium tuberculosis H37Rv
ggacaagcuccucgc

SEQ ID NO: 1342004 - RNA, 20 nt, Mycobacterium tuberculosis H37Rv
ggacaaggucaucggcaucc

SEQ ID NO: 1342005 - RNA, 17 nt, Mycobacterium tuberculosis H37Rv
gcucggugcacggcgcu

SEQ ID NO: 1342006 - RNA, 20 nt, Mycobacterium tuberculosis H37Rv
gcucggugcugcgccgauac

SEQ ID NO: 1342007 - RNA, 22 nt, Mycobacterium tuberculosis H37Rv
gcucggugacaagcggcccgcu

SEQ ID NO: 1342008 - RNA, 16 nt, Mycobacterium tuberculosis H37Rv
gcucgggucgugcgug

SEQ ID NO: 1342009 - RNA, 16 nt, Mycobacterium tuberculosis H37Rv
gcucgguccagccggu

SEQ ID NO: 1342010 - RNA, 17 nt, Mycobacterium tuberculosis H37Rv
gcucggcgucgccgcca

SEQ ID NO: 1342011 - RNA, 19 nt, Mycobacterium tuberculosis H37Rv
gcucggcgucgccgccauu

SEQ ID NO: 1342012 - RNA, 23 nt, Mycobacterium tuberculosis H37Rv
gcucggcgggggaccccgccagc

SEQ ID NO: 1342013 - RNA, 15 nt, Mycobacterium tuberculosis H37Rv
gcucggcgguacaca

SEQ ID NO: 1342014 - RNA, 15 nt, Mycobacterium tuberculosis H37Rv
ggaagugcaccugga

SEQ ID NO: 1342015 - RNA, 17 nt, Mycobacterium tuberculosis H37Rv
ggaaguugcccagguga

SEQ ID NO: 1342016 - RNA, 17 nt, Mycobacterium tuberculosis H37Rv
ggaaguuggcugagcag

SEQ ID NO: 1342017 - RNA, 19 nt, Mycobacterium tuberculosis H37Rv
ggaaguacuuuuggguucg

SEQ ID NO: 1342018 - RNA, 19 nt, Mycobacterium tuberculosis H37Rv
ggaaguaaggcacgggugu

SEQ ID NO: 1342019 - RNA, 17 nt, Mycobacterium tuberculosis H37Rv
ggaaguacacggcggcc

SEQ ID NO: 1342020 - RNA, 22 nt, Mycobacterium tuberculosis H37Rv
gcucgguggcaucggcggccug

SEQ ID NO: 1342021 - RNA, 15 nt, Mycobacterium tuberculosis H37Rv
ggaaguagccgagcc

SEQ ID NO: 1342022 - RNA, 20 nt, Mycobacterium tuberculosis H37Rv
ggacaagcacagcgaacaga

SEQ ID NO: 1342023 - RNA, 16 nt, Mycobacterium tuberculosis H37Rv
ggacaaccccuugccu

SEQ ID NO: 1342024 - RNA, 14 nt, Mycobacterium tuberculosis H37Rv
ggacaaagcugcuc

SEQ ID NO: 1342025 - RNA, 15 nt, Mycobacterium tuberculosis H37Rv
ggaaucgucgcggcc

SEQ ID NO: 1342026 - RNA, 20 nt, Mycobacterium tuberculosis H37Rv
ggacaaaaucagcagccccc

SEQ ID NO: 1342027 - RNA, 22 nt, Mycobacterium tuberculosis H37Rv
ggacaaacaucgcacccaccac

SEQ ID NO: 1342028 - RNA, 15 nt, Mycobacterium tuberculosis H37Rv
ggaaucgguuucgac

SEQ ID NO: 1342029 - RNA, 18 nt, Mycobacterium tuberculosis H37Rv
ggaauccggugaugaccg

SEQ ID NO: 1342030 - RNA, 19 nt, Mycobacterium tuberculosis H37Rv
ggaauccgaacgcgauccg

SEQ ID NO: 1342031 - RNA, 13 nt, Mycobacterium tuberculosis H37Rv
ggaauacagcuug

SEQ ID NO: 1342032 - RNA, 20 nt, Mycobacterium tuberculosis H37Rv
ggaauagcaacgcugcagca

SEQ ID NO: 1342033 - RNA, 15 nt, Mycobacterium tuberculosis H37Rv
ggacgacgccgacga

SEQ ID NO: 1342034 - RNA, 15 nt, Mycobacterium tuberculosis H37Rv
ggacgacggcaagaa

SEQ ID NO: 1342035 - RNA, 23 nt, Mycobacterium tuberculosis H37Rv
ggacgaucagggugucgaagagc

SEQ ID NO: 1342036 - RNA, 20 nt, Mycobacterium tuberculosis H37Rv
ggacgggaugcuuggucucg

SEQ ID NO: 1342037 - RNA, 21 nt, Mycobacterium tuberculosis H37Rv
ggacggcuaccaccgcaccug

SEQ ID NO: 1342038 - RNA, 20 nt, Mycobacterium tuberculosis H37Rv
ggacggcguugagcaggugc

SEQ ID NO: 1342039 - RNA, 15 nt, Mycobacterium tuberculosis H37Rv
ggacggcggccagga

SEQ ID NO: 1342040 - RNA, 13 nt, Mycobacterium tuberculosis H37Rv
ggacugaagagca

SEQ ID NO: 1342041 - RNA, 17 nt, Mycobacterium tuberculosis H37Rv
ggacucgggcaggcccc

SEQ ID NO: 1342042 - RNA, 22 nt, Mycobacterium tuberculosis H37Rv
ggacgugcccgguguucaucac

SEQ ID NO: 1342043 - RNA, 17 nt, Mycobacterium tuberculosis H37Rv
ggacucugccacccagc

SEQ ID NO: 1342044 - RNA, 22 nt, Mycobacterium tuberculosis H37Rv
ggacgugacgucguggcgcucg

SEQ ID NO: 1342045 - RNA, 13 nt, Mycobacterium tuberculosis H37Rv
ggacggugaaacc

SEQ ID NO: 1342046 - RNA, 20 nt, Mycobacterium tuberculosis H37Rv
ggacgggguacugcggcucg

SEQ ID NO: 1342047 - RNA, 18 nt, Mycobacterium tuberculosis H37Rv
ggacggucgcucggcaug

SEQ ID NO: 1342048 - RNA, 22 nt, Mycobacterium tuberculosis H37Rv
ggagaacacgucgacaccgagg

SEQ ID NO: 1342049 - RNA, 14 nt, Mycobacterium tuberculosis H37Rv
ggagagugguugcg

SEQ ID NO: 1342050 - RNA, 20 nt, Mycobacterium tuberculosis H37Rv
ggagccuugguagccggccg

SEQ ID NO: 1342051 - RNA, 21 nt, Mycobacterium tuberculosis H37Rv
ggagauuggguccagcgagga

SEQ ID NO: 1342052 - RNA, 16 nt, Mycobacterium tuberculosis H37Rv
ggagauccagggccuu

SEQ ID NO: 1342053 - RNA, 13 nt, Mycobacterium tuberculosis H37Rv
ggagauccagggc

SEQ ID NO: 1342054 - RNA, 21 nt, Mycobacterium tuberculosis H37Rv
ggagaugaucaugugguggcg

SEQ ID NO: 1342055 - RNA, 24 nt, Mycobacterium tuberculosis H37Rv
ggagauggcauuggggggcuggca

SEQ ID NO: 1342056 - RNA, 20 nt, Mycobacterium tuberculosis H37Rv
ggacugcgaagaguccuuaa

SEQ ID NO: 1342057 - RNA, 17 nt, Mycobacterium tuberculosis H37Rv
ggacuggcaccgccagc

SEQ ID NO: 1342058 - RNA, 21 nt, Mycobacterium tuberculosis H37Rv
ggacuggcaccgccagccacc

SEQ ID NO: 1342059 - RNA, 15 nt, Mycobacterium tuberculosis H37Rv
ggaguagccgcagcu

SEQ ID NO: 1342060 - RNA, 16 nt, Mycobacterium tuberculosis H37Rv
ggaguaguggugggcg

SEQ ID NO: 1342061 - RNA, 20 nt, Mycobacterium tuberculosis H37Rv
ggaggcggaccaggccgcgc

SEQ ID NO: 1342062 - RNA, 14 nt, Mycobacterium tuberculosis H37Rv
ggagguggcgcggg

SEQ ID NO: 1342063 - RNA, 22 nt, Mycobacterium tuberculosis H37Rv
ggaggcaagcaaccggugcgca

SEQ ID NO: 1342064 - RNA, 15 nt, Mycobacterium tuberculosis H37Rv
ggaggccaucauccc

SEQ ID NO: 1342065 - RNA, 14 nt, Mycobacterium tuberculosis H37Rv
ggaggccgccgcgc

SEQ ID NO: 1342066 - RNA, 17 nt, Mycobacterium tuberculosis H37Rv
ggagcgggccagcaccc

SEQ ID NO: 1342067 - RNA, 16 nt, Mycobacterium tuberculosis H37Rv
ggagcggcgcgggggu

SEQ ID NO: 1342068 - RNA, 21 nt, Mycobacterium tuberculosis H37Rv
ggagcgcaccugaaggcggcg

SEQ ID NO: 1342069 - RNA, 23 nt, Mycobacterium tuberculosis H37Rv
ggagcgcaaguugagcagcuugg

SEQ ID NO: 1342070 - RNA, 12 nt, Mycobacterium tuberculosis H37Rv
ggagcggcugca

SEQ ID NO: 1342071 - RNA, 17 nt, Mycobacterium tuberculosis H37Rv
ggagcggcugcacgccu

SEQ ID NO: 1342072 - RNA, 15 nt, Mycobacterium tuberculosis H37Rv
ggagcggcugcggca

SEQ ID NO: 1342073 - RNA, 18 nt, Mycobacterium tuberculosis H37Rv
ggagcggcuugcgguggc

SEQ ID NO: 1342074 - RNA, 19 nt, Mycobacterium tuberculosis H37Rv
ggagcggcuugcgguggcg

SEQ ID NO: 1342075 - RNA, 20 nt, Mycobacterium tuberculosis H37Rv
ggauagcgucgucccagcgc

SEQ ID NO: 1342076 - RNA, 23 nt, Mycobacterium tuberculosis H37Rv
ggauagguggucuuggcgguggc

SEQ ID NO: 1342077 - RNA, 22 nt, Mycobacterium tuberculosis H37Rv
ggauacuguucugcuggcugug

SEQ ID NO: 1342078 - RNA, 14 nt, Mycobacterium tuberculosis H37Rv
ggagucgacgacgu

SEQ ID NO: 1342079 - RNA, 15 nt, Mycobacterium tuberculosis H37Rv
ggagucgaacaucac

SEQ ID NO: 1342080 - RNA, 20 nt, Mycobacterium tuberculosis H37Rv
ggagucgucggcaugggccg

SEQ ID NO: 1342081 - RNA, 17 nt, Mycobacterium tuberculosis H37Rv
ggagucgguaucggcag

SEQ ID NO: 1342082 - RNA, 20 nt, Mycobacterium tuberculosis H37Rv
ggagucgucggcaacgcugg

SEQ ID NO: 1342083 - RNA, 14 nt, Mycobacterium tuberculosis H37Rv
ggaguggccgggcg

SEQ ID NO: 1342084 - RNA, 19 nt, Mycobacterium tuberculosis H37Rv
ggagugucgaugcgcgccg

SEQ ID NO: 1342085 - RNA, 22 nt, Mycobacterium tuberculosis H37Rv
ggagucuucaacgucgagaucc

SEQ ID NO: 1342086 - RNA, 15 nt, Mycobacterium tuberculosis H37Rv
ggagugaggcugugc

SEQ ID NO: 1342087 - RNA, 17 nt, Mycobacterium tuberculosis H37Rv
ggagugaggcugugccc

SEQ ID NO: 1342088 - RNA, 23 nt, Mycobacterium tuberculosis H37Rv
ggaugcaugucaaguucgccagc

SEQ ID NO: 1342089 - RNA, 20 nt, Mycobacterium tuberculosis H37Rv
ggaugaucugcgcggcccgc

SEQ ID NO: 1342090 - RNA, 15 nt, Mycobacterium tuberculosis H37Rv
ggaucugacccagca

SEQ ID NO: 1342091 - RNA, 15 nt, Mycobacterium tuberculosis H37Rv
ggaucugacggcgcc

SEQ ID NO: 1342092 - RNA, 18 nt, Mycobacterium tuberculosis H37Rv
ggaucugggcucgguccu

SEQ ID NO: 1342093 - RNA, 15 nt, Mycobacterium tuberculosis H37Rv
ggaucuggcgcagca

SEQ ID NO: 1342094 - RNA, 20 nt, Mycobacterium tuberculosis H37Rv
ggaucaaggccgguccgauu

SEQ ID NO: 1342095 - RNA, 17 nt, Mycobacterium tuberculosis H37Rv
ggaucaaaaccucgugc

SEQ ID NO: 1342096 - RNA, 17 nt, Mycobacterium tuberculosis H37Rv
ggaucaaccggcccucc

SEQ ID NO: 1342097 - RNA, 15 nt, Mycobacterium tuberculosis H37Rv
ggaucaacgcacggc

SEQ ID NO: 1342098 - RNA, 20 nt, Mycobacterium tuberculosis H37Rv
ggaucacucccccacacacc

SEQ ID NO: 1342099 - RNA, 22 nt, Mycobacterium tuberculosis H37Rv
ggaucuagaggcggcccccggc

SEQ ID NO: 1342100 - RNA, 21 nt, Mycobacterium tuberculosis H37Rv
ggaucucaucgggccacagca

SEQ ID NO: 1342101 - RNA, 22 nt, Mycobacterium tuberculosis H37Rv
ggaucucguuggugccuucacc

SEQ ID NO: 1342102 - RNA, 20 nt, Mycobacterium tuberculosis H37Rv
ggauggcgucgaccacaggc

SEQ ID NO: 1342103 - RNA, 17 nt, Mycobacterium tuberculosis H37Rv
ggauggcgcccugcgcc

SEQ ID NO: 1342104 - RNA, 13 nt, Mycobacterium tuberculosis H37Rv
ggauggcggccac

SEQ ID NO: 1342105 - RNA, 15 nt, Mycobacterium tuberculosis H37Rv
ggauggaaggcggcc

SEQ ID NO: 1342106 - RNA, 22 nt, Mycobacterium tuberculosis H37Rv
ggauggacggcagccagccacc

SEQ ID NO: 1342107 - RNA, 14 nt, Mycobacterium tuberculosis H37Rv
ggauggacaccacc

SEQ ID NO: 1342108 - RNA, 19 nt, Mycobacterium tuberculosis H37Rv
ggaugccgaaccgcugcgg

SEQ ID NO: 1342109 - RNA, 18 nt, Mycobacterium tuberculosis H37Rv
ggauuggcgucagcagca

SEQ ID NO: 1342110 - RNA, 18 nt, Mycobacterium tuberculosis H37Rv
ggauuggugggccagcag

SEQ ID NO: 1342111 - RNA, 15 nt, Mycobacterium tuberculosis H37Rv
ggauguuugcucggc

SEQ ID NO: 1342112 - RNA, 14 nt, Mycobacterium tuberculosis H37Rv
ggauuaccagugga

SEQ ID NO: 1342113 - RNA, 17 nt, Mycobacterium tuberculosis H37Rv
ggcaaagcgagcaccgc

SEQ ID NO: 1342114 - RNA, 20 nt, Mycobacterium tuberculosis H37Rv
ggcaaccgaaccgguccacu

SEQ ID NO: 1342115 - RNA, 17 nt, Mycobacterium tuberculosis H37Rv
ggcaaccgacacuggga

SEQ ID NO: 1342116 - RNA, 22 nt, Mycobacterium tuberculosis H37Rv
ggcaacccagugucagcaagau

SEQ ID NO: 1342117 - RNA, 13 nt, Mycobacterium tuberculosis H37Rv
ggcaaccagcuuc

SEQ ID NO: 1342118 - RNA, 21 nt, Mycobacterium tuberculosis H37Rv
ggcaaccccgagcggagccgc

SEQ ID NO: 1342119 - RNA, 13 nt, Mycobacterium tuberculosis H37Rv
ggcaaccgcgcgc

SEQ ID NO: 1342120 - RNA, 12 nt, Mycobacterium tuberculosis H37Rv
ggcaacgaucag

SEQ ID NO: 1342121 - RNA, 14 nt, Mycobacterium tuberculosis H37Rv
ggcaacgaucaggu

SEQ ID NO: 1342122 - RNA, 12 nt, Mycobacterium tuberculosis H37Rv
ggcaacgacacg

SEQ ID NO: 1342123 - RNA, 17 nt, Mycobacterium tuberculosis H37Rv
ggcaaccuuuggccgcu

SEQ ID NO: 1342124 - RNA, 14 nt, Mycobacterium tuberculosis H37Rv
ggcaacgcggucug

SEQ ID NO: 1342125 - RNA, 19 nt, Mycobacterium tuberculosis H37Rv
ggcaacaacguucggcaca

SEQ ID NO: 1342126 - RNA, 14 nt, Mycobacterium tuberculosis H37Rv
ggcaacacagcuga

SEQ ID NO: 1342127 - RNA, 20 nt, Mycobacterium tuberculosis H37Rv
ggcaaaucggugcgauccug

SEQ ID NO: 1342128 - RNA, 16 nt, Mycobacterium tuberculosis H37Rv
ggcaaccaccggccgc

SEQ ID NO: 1342129 - RNA, 20 nt, Mycobacterium tuberculosis H37Rv
ggcaaccagcgagcccagcu

SEQ ID NO: 1342130 - RNA, 13 nt, Mycobacterium tuberculosis H37Rv
ggcaccuccagca

SEQ ID NO: 1342131 - RNA, 21 nt, Mycobacterium tuberculosis H37Rv
ggcaccguuaccgccgucgcc

SEQ ID NO: 1342132 - RNA, 19 nt, Mycobacterium tuberculosis H37Rv
ggcaccguggaucugaaga

SEQ ID NO: 1342133 - RNA, 16 nt, Mycobacterium tuberculosis H37Rv
ggcaccgugcgggggg

SEQ ID NO: 1342134 - RNA, 17 nt, Mycobacterium tuberculosis H37Rv
ggcacccgcacggccuc

SEQ ID NO: 1342135 - RNA, 15 nt, Mycobacterium tuberculosis H37Rv
ggcaccggcggucug

SEQ ID NO: 1342136 - RNA, 20 nt, Mycobacterium tuberculosis H37Rv
ggcaccggcggucugcagug

SEQ ID NO: 1342137 - RNA, 22 nt, Mycobacterium tuberculosis H37Rv
ggcaccgggguuacucgcagcg

SEQ ID NO: 1342138 - RNA, 12 nt, Mycobacterium tuberculosis H37Rv
ggcaccgggugc

SEQ ID NO: 1342139 - RNA, 20 nt, Mycobacterium tuberculosis H37Rv
ggcaccgguuugacguccag

SEQ ID NO: 1342140 - RNA, 22 nt, Mycobacterium tuberculosis H37Rv
ggcacccggugagaagaagccc

SEQ ID NO: 1342141 - RNA, 21 nt, Mycobacterium tuberculosis H37Rv
ggcacccggugagaagaagcc

SEQ ID NO: 1342142 - RNA, 23 nt, Mycobacterium tuberculosis H37Rv
ggcacccggggugcccggccgcc

SEQ ID NO: 1342143 - RNA, 22 nt, Mycobacterium tuberculosis H37Rv
ggcacgcuccagcucggccagu

SEQ ID NO: 1342144 - RNA, 16 nt, Mycobacterium tuberculosis H37Rv
ggcacuggauccggga

SEQ ID NO: 1342145 - RNA, 15 nt, Mycobacterium tuberculosis H37Rv
ggcacugcggccagu

SEQ ID NO: 1342146 - RNA, 14 nt, Mycobacterium tuberculosis H37Rv
ggcacggccgucga

SEQ ID NO: 1342147 - RNA, 19 nt, Mycobacterium tuberculosis H37Rv
ggcacgggaaucgcucgcg

SEQ ID NO: 1342148 - RNA, 22 nt, Mycobacterium tuberculosis H37Rv
ggcacaauaggcuccagcgcgc

SEQ ID NO: 1342149 - RNA, 22 nt, Mycobacterium tuberculosis H37Rv
ggcacaaucggauagccgugcu

SEQ ID NO: 1342150 - RNA, 18 nt, Mycobacterium tuberculosis H37Rv
ggcaccauguacaggcug

SEQ ID NO: 1342151 - RNA, 19 nt, Mycobacterium tuberculosis H37Rv
ggcacccgagccgcacagc

SEQ ID NO: 1342152 - RNA, 16 nt, Mycobacterium tuberculosis H37Rv
ggcaccccacggccag

SEQ ID NO: 1342153 - RNA, 15 nt, Mycobacterium tuberculosis H37Rv
ggcaccccacggcca

SEQ ID NO: 1342154 - RNA, 21 nt, Mycobacterium tuberculosis H37Rv
ggcacccaauccggcgccagc

SEQ ID NO: 1342155 - RNA, 17 nt, Mycobacterium tuberculosis H37Rv
ggcaccccacggccagu

SEQ ID NO: 1342156 - RNA, 14 nt, Mycobacterium tuberculosis H37Rv
ggcacccccgucgc

SEQ ID NO: 1342157 - RNA, 20 nt, Mycobacterium tuberculosis H37Rv
ggcaccccgaccaccagagc

SEQ ID NO: 1342158 - RNA, 15 nt, Mycobacterium tuberculosis H37Rv
ggcaccccggccacu

SEQ ID NO: 1342159 - RNA, 21 nt, Mycobacterium tuberculosis H37Rv
ggcaagucgcccagccgagcg

SEQ ID NO: 1342160 - RNA, 15 nt, Mycobacterium tuberculosis H37Rv
ggcaauaccgccagc

SEQ ID NO: 1342161 - RNA, 19 nt, Mycobacterium tuberculosis H37Rv
ggcaauacguagucgccga

SEQ ID NO: 1342162 - RNA, 18 nt, Mycobacterium tuberculosis H37Rv
ggcaaguuccacgggugg

SEQ ID NO: 1342163 - RNA, 23 nt, Mycobacterium tuberculosis H37Rv
ggcaaucacaucaaagucggcgu

SEQ ID NO: 1342164 - RNA, 18 nt, Mycobacterium tuberculosis H37Rv
ggcaaucaacgcaaugcc

SEQ ID NO: 1342165 - RNA, 14 nt, Mycobacterium tuberculosis H37Rv
ggcaaucggcggca

SEQ ID NO: 1342166 - RNA, 22 nt, Mycobacterium tuberculosis H37Rv
ggcaaucgcucugugucgccga

SEQ ID NO: 1342167 - RNA, 15 nt, Mycobacterium tuberculosis H37Rv
ggcaagcccaaaaag

SEQ ID NO: 1342168 - RNA, 14 nt, Mycobacterium tuberculosis H37Rv
ggcaagccguucug

SEQ ID NO: 1342169 - RNA, 12 nt, Mycobacterium tuberculosis H37Rv
ggcaagcgcaga

SEQ ID NO: 1342170 - RNA, 16 nt, Mycobacterium tuberculosis H37Rv
ggcaagggcauacagc

SEQ ID NO: 1342171 - RNA, 21 nt, Mycobacterium tuberculosis H37Rv
ggcaaggcggcggccagccgu

SEQ ID NO: 1342172 - RNA, 18 nt, Mycobacterium tuberculosis H37Rv
ggcaagcugaccgccagc

SEQ ID NO: 1342173 - RNA, 19 nt, Mycobacterium tuberculosis H37Rv
ggcaagcugaccgccagcg

SEQ ID NO: 1342174 - RNA, 21 nt, Mycobacterium tuberculosis H37Rv
ggcaaggcauccaacgcggcg

SEQ ID NO: 1342175 - RNA, 21 nt, Mycobacterium tuberculosis H37Rv
ggcaaggccaccgucgcggcg

SEQ ID NO: 1342176 - RNA, 23 nt, Mycobacterium tuberculosis H37Rv
ggcaacuccggucaacacccgcc

SEQ ID NO: 1342177 - RNA, 19 nt, Mycobacterium tuberculosis H37Rv
ggcaagaccgaacagcggc

SEQ ID NO: 1342178 - RNA, 21 nt, Mycobacterium tuberculosis H37Rv
ggcaagcacaccgccagcggc

SEQ ID NO: 1342179 - RNA, 19 nt, Mycobacterium tuberculosis H37Rv
ggcaagcacaccgccagcg

SEQ ID NO: 1342180 - RNA, 18 nt, Mycobacterium tuberculosis H37Rv
ggcaagcacaccgccagc

SEQ ID NO: 1342181 - RNA, 15 nt, Mycobacterium tuberculosis H37Rv
ggcaagcacaccgcc

SEQ ID NO: 1342182 - RNA, 22 nt, Mycobacterium tuberculosis H37Rv
ggccggguuaucggcagcagga

SEQ ID NO: 1342183 - RNA, 21 nt, Mycobacterium tuberculosis H37Rv
ggccggguuaucggcagcagg

SEQ ID NO: 1342184 - RNA, 23 nt, Mycobacterium tuberculosis H37Rv
ggccgguacacguccaguggcag

SEQ ID NO: 1342185 - RNA, 18 nt, Mycobacterium tuberculosis H37Rv
ggccgggucgucuuccag

SEQ ID NO: 1342186 - RNA, 21 nt, Mycobacterium tuberculosis H37Rv
ggccgggucgaacuugaucac

SEQ ID NO: 1342187 - RNA, 22 nt, Mycobacterium tuberculosis H37Rv
ggccgggcccuccacugcgagc

SEQ ID NO: 1342188 - RNA, 17 nt, Mycobacterium tuberculosis H37Rv
ggccgggcgcaagcagc

SEQ ID NO: 1342189 - RNA, 16 nt, Mycobacterium tuberculosis H37Rv
ggccgggcuccucugg

SEQ ID NO: 1342190 - RNA, 11 nt, Mycobacterium tuberculosis H37Rv
ggccgggaacc

SEQ ID NO: 1342191 - RNA, 20 nt, Mycobacterium tuberculosis H37Rv
ggccggcucagucacgcacu

SEQ ID NO: 1342192 - RNA, 18 nt, Mycobacterium tuberculosis H37Rv
ggccggcucguccgggca

SEQ ID NO: 1342193 - RNA, 16 nt, Mycobacterium tuberculosis H37Rv
ggccggcgucagcccc

SEQ ID NO: 1342194 - RNA, 22 nt, Mycobacterium tuberculosis H37Rv
ggccggcggcggcgcucggcca

SEQ ID NO: 1342195 - RNA, 13 nt, Mycobacterium tuberculosis H37Rv
ggccggcggcggu

SEQ ID NO: 1342196 - RNA, 22 nt, Mycobacterium tuberculosis H37Rv
ggccggcggcucgggugcgccc

SEQ ID NO: 1342197 - RNA, 13 nt, Mycobacterium tuberculosis H37Rv
ggccggcgcggcg

SEQ ID NO: 1342198 - RNA, 17 nt, Mycobacterium tuberculosis H37Rv
ggccgguucaggggugg

SEQ ID NO: 1342199 - RNA, 14 nt, Mycobacterium tuberculosis H37Rv
ggccguacgacggc

SEQ ID NO: 1342200 - RNA, 18 nt, Mycobacterium tuberculosis H37Rv
ggccguacaacagcgcgc

SEQ ID NO: 1342201 - RNA, 19 nt, Mycobacterium tuberculosis H37Rv
ggccgguggaaaccgggcg

SEQ ID NO: 1342202 - RNA, 21 nt, Mycobacterium tuberculosis H37Rv
ggccgguggaaaagccacggc

SEQ ID NO: 1342203 - RNA, 21 nt, Mycobacterium tuberculosis H37Rv
ggccggugaugaucgcgccgg

SEQ ID NO: 1342204 - RNA, 13 nt, Mycobacterium tuberculosis H37Rv
ggccggugggccg

SEQ ID NO: 1342205 - RNA, 21 nt, Mycobacterium tuberculosis H37Rv
ggccgguggguagccagcgcg

SEQ ID NO: 1342206 - RNA, 12 nt, Mycobacterium tuberculosis H37Rv
ggccgguuggcc

SEQ ID NO: 1342207 - RNA, 15 nt, Mycobacterium tuberculosis H37Rv
ggccggugcccgggc

SEQ ID NO: 1342208 - RNA, 19 nt, Mycobacterium tuberculosis H37Rv
ggccggucacguccgcggg

SEQ ID NO: 1342209 - RNA, 21 nt, Mycobacterium tuberculosis H37Rv
ggccgguaccgggacgaaucc

SEQ ID NO: 1342210 - RNA, 23 nt, Mycobacterium tuberculosis H37Rv
ggccgguagaucuucggccgcac

SEQ ID NO: 1342211 - RNA, 14 nt, Mycobacterium tuberculosis H37Rv
ggccgguccgggaa

SEQ ID NO: 1342212 - RNA, 15 nt, Mycobacterium tuberculosis H37Rv
ggccgguccggggca

SEQ ID NO: 1342213 - RNA, 13 nt, Mycobacterium tuberculosis H37Rv
ggccggucgggca

SEQ ID NO: 1342214 - RNA, 18 nt, Mycobacterium tuberculosis H37Rv
ggccguaguggccggcuu

SEQ ID NO: 1342215 - RNA, 18 nt, Mycobacterium tuberculosis H37Rv
ggccguagcccacgacga

SEQ ID NO: 1342216 - RNA, 16 nt, Mycobacterium tuberculosis H37Rv
ggccgucauggcccga

SEQ ID NO: 1342217 - RNA, 18 nt, Mycobacterium tuberculosis H37Rv
ggccgucaccggucggcc

SEQ ID NO: 1342218 - RNA, 21 nt, Mycobacterium tuberculosis H37Rv
ggccgucccgcgagcagcccg

SEQ ID NO: 1342219 - RNA, 22 nt, Mycobacterium tuberculosis H37Rv
ggccgucccgcgagcagcccgg

SEQ ID NO: 1342220 - RNA, 15 nt, Mycobacterium tuberculosis H37Rv
ggccguccgcaccgg

SEQ ID NO: 1342221 - RNA, 20 nt, Mycobacterium tuberculosis H37Rv
ggccguccgcaccggcggcg

SEQ ID NO: 1342222 - RNA, 14 nt, Mycobacterium tuberculosis H37Rv
ggccguccggcgcc

SEQ ID NO: 1342223 - RNA, 13 nt, Mycobacterium tuberculosis H37Rv
ggccguccucggu

SEQ ID NO: 1342224 - RNA, 18 nt, Mycobacterium tuberculosis H37Rv
ggccgucgaacgguagca

SEQ ID NO: 1342225 - RNA, 12 nt, Mycobacterium tuberculosis H37Rv
ggccgucgccgu

SEQ ID NO: 1342226 - RNA, 14 nt, Mycobacterium tuberculosis H37Rv
ggccgucgaucaag

SEQ ID NO: 1342227 - RNA, 15 nt, Mycobacterium tuberculosis H37Rv
ggccgucggccggau

SEQ ID NO: 1342228 - RNA, 22 nt, Mycobacterium tuberculosis H37Rv
ggccgcggagaaggcgcgggcg

SEQ ID NO: 1342229 - RNA, 16 nt, Mycobacterium tuberculosis H37Rv
ggccgcggccucccgc

SEQ ID NO: 1342230 - RNA, 18 nt, Mycobacterium tuberculosis H37Rv
ggccgcggccucccgcaa

SEQ ID NO: 1342231 - RNA, 17 nt, Mycobacterium tuberculosis H37Rv
ggccgcggcgcggcggg

SEQ ID NO: 1342232 - RNA, 19 nt, Mycobacterium tuberculosis H37Rv
ggccgcggcggccagcgca

SEQ ID NO: 1342233 - RNA, 12 nt, Mycobacterium tuberculosis H37Rv
ggccgcggcggu

SEQ ID NO: 1342234 - RNA, 17 nt, Mycobacterium tuberculosis H37Rv
ggccgcggcggccagcg

SEQ ID NO: 1342235 - RNA, 13 nt, Mycobacterium tuberculosis H37Rv
ggccgcggccucg

SEQ ID NO: 1342236 - RNA, 16 nt, Mycobacterium tuberculosis H37Rv
ggccgcggcggccagc

SEQ ID NO: 1342237 - RNA, 22 nt, Mycobacterium tuberculosis H37Rv
ggccgcggucgauguccgcagc

SEQ ID NO: 1342238 - RNA, 17 nt, Mycobacterium tuberculosis H37Rv
ggccgcggucggccacc

SEQ ID NO: 1342239 - RNA, 16 nt, Mycobacterium tuberculosis H37Rv
ggccgcgggcgcggcc

SEQ ID NO: 1342240 - RNA, 13 nt, Mycobacterium tuberculosis H37Rv
ggccgcggcgucg

SEQ ID NO: 1342241 - RNA, 21 nt, Mycobacterium tuberculosis H37Rv
ggccgcuugccccgccuuggc

SEQ ID NO: 1342242 - RNA, 19 nt, Mycobacterium tuberculosis H37Rv
ggccgcuuggccgcugccu

SEQ ID NO: 1342243 - RNA, 21 nt, Mycobacterium tuberculosis H37Rv
ggccgcugugggcgagucggg

SEQ ID NO: 1342244 - RNA, 16 nt, Mycobacterium tuberculosis H37Rv
ggccgcuucgggcguc

SEQ ID NO: 1342245 - RNA, 20 nt, Mycobacterium tuberculosis H37Rv
ggccgcuauggcccgggccg

SEQ ID NO: 1342246 - RNA, 12 nt, Mycobacterium tuberculosis H37Rv
ggccgcucgccu

SEQ ID NO: 1342247 - RNA, 13 nt, Mycobacterium tuberculosis H37Rv
ggccggccgagcg

SEQ ID NO: 1342248 - RNA, 14 nt, Mycobacterium tuberculosis H37Rv
ggccggcgccgcac

SEQ ID NO: 1342249 - RNA, 15 nt, Mycobacterium tuberculosis H37Rv
ggccggcgcaguggu

SEQ ID NO: 1342250 - RNA, 14 nt, Mycobacterium tuberculosis H37Rv
ggccggagccgccg

SEQ ID NO: 1342251 - RNA, 17 nt, Mycobacterium tuberculosis H37Rv
ggccggagccgccggcc

SEQ ID NO: 1342252 - RNA, 14 nt, Mycobacterium tuberculosis H37Rv
ggccggacgggugc

SEQ ID NO: 1342253 - RNA, 23 nt, Mycobacterium tuberculosis H37Rv
ggccggacugaagccgcgagcgc

SEQ ID NO: 1342254 - RNA, 17 nt, Mycobacterium tuberculosis H37Rv
ggccggaguccgucggg

SEQ ID NO: 1342255 - RNA, 22 nt, Mycobacterium tuberculosis H37Rv
ggccggaugacgcccagggcgu

SEQ ID NO: 1342256 - RNA, 20 nt, Mycobacterium tuberculosis H37Rv
ggccggaugagcgaacgcca

SEQ ID NO: 1342257 - RNA, 18 nt, Mycobacterium tuberculosis H37Rv
ggccggcaacggcgcgcc

SEQ ID NO: 1342258 - RNA, 13 nt, Mycobacterium tuberculosis H37Rv
ggccggcaagcag

SEQ ID NO: 1342259 - RNA, 17 nt, Mycobacterium tuberculosis H37Rv
ggccggcagcggcuggg

SEQ ID NO: 1342260 - RNA, 16 nt, Mycobacterium tuberculosis H37Rv
ggcccgucgucgucga

SEQ ID NO: 1342261 - RNA, 19 nt, Mycobacterium tuberculosis H37Rv
ggcccguuggcagcacagg

SEQ ID NO: 1342262 - RNA, 19 nt, Mycobacterium tuberculosis H37Rv
ggcccguagcguccgcgcc

SEQ ID NO: 1342263 - RNA, 15 nt, Mycobacterium tuberculosis H37Rv
ggcccguccugcggg

SEQ ID NO: 1342264 - RNA, 21 nt, Mycobacterium tuberculosis H37Rv
ggcccgucacaaugcccaggc

SEQ ID NO: 1342265 - RNA, 20 nt, Mycobacterium tuberculosis H37Rv
ggcccggugcucaagcgcgu

SEQ ID NO: 1342266 - RNA, 12 nt, Mycobacterium tuberculosis H37Rv
ggcccggugcuc

SEQ ID NO: 1342267 - RNA, 23 nt, Mycobacterium tuberculosis H37Rv
ggcccgggucuccggcgcaccug

SEQ ID NO: 1342268 - RNA, 18 nt, Mycobacterium tuberculosis H37Rv
ggcccgggcggccagcug

SEQ ID NO: 1342269 - RNA, 19 nt, Mycobacterium tuberculosis H37Rv
ggcccggggacgcccucgg

SEQ ID NO: 1342270 - RNA, 12 nt, Mycobacterium tuberculosis H37Rv
ggcccgggcggc

SEQ ID NO: 1342271 - RNA, 23 nt, Mycobacterium tuberculosis H37Rv
ggcccugggugguuccgcgcggc

SEQ ID NO: 1342272 - RNA, 16 nt, Mycobacterium tuberculosis H37Rv
ggcccuggcgaccagc

SEQ ID NO: 1342273 - RNA, 15 nt, Mycobacterium tuberculosis H37Rv
ggcccuggccagccc

SEQ ID NO: 1342274 - RNA, 11 nt, Mycobacterium tuberculosis H37Rv
ggcccugcugg

SEQ ID NO: 1342275 - RNA, 20 nt, Mycobacterium tuberculosis H37Rv
ggccgaaacuucgcccgggc

SEQ ID NO: 1342276 - RNA, 21 nt, Mycobacterium tuberculosis H37Rv
ggccgaaagagccagcggcac

SEQ ID NO: 1342277 - RNA, 18 nt, Mycobacterium tuberculosis H37Rv
ggcccuugcucguccagg

SEQ ID NO: 1342278 - RNA, 18 nt, Mycobacterium tuberculosis H37Rv
ggccgaacacaccgggcg

SEQ ID NO: 1342279 - RNA, 13 nt, Mycobacterium tuberculosis H37Rv
ggccgaccagcac

SEQ ID NO: 1342280 - RNA, 17 nt, Mycobacterium tuberculosis H37Rv
ggcccgagcgcgcgcug

SEQ ID NO: 1342281 - RNA, 15 nt, Mycobacterium tuberculosis H37Rv
ggcccgagcgcgcgc

SEQ ID NO: 1342282 - RNA, 22 nt, Mycobacterium tuberculosis H37Rv
ggcccgagccgcgugggccgcu

SEQ ID NO: 1342283 - RNA, 18 nt, Mycobacterium tuberculosis H37Rv
ggcccgacggcgcccagc

SEQ ID NO: 1342284 - RNA, 14 nt, Mycobacterium tuberculosis H37Rv
ggcccgacggcgcc

SEQ ID NO: 1342285 - RNA, 19 nt, Mycobacterium tuberculosis H37Rv
ggcccgaggugccggggcc

SEQ ID NO: 1342286 - RNA, 20 nt, Mycobacterium tuberculosis H37Rv
ggcccgauagaucgcgugga

SEQ ID NO: 1342287 - RNA, 20 nt, Mycobacterium tuberculosis H37Rv
ggccccguccgauuucccag

SEQ ID NO: 1342288 - RNA, 23 nt, Mycobacterium tuberculosis H37Rv
ggcccacgcgcacucgaccagga

SEQ ID NO: 1342289 - RNA, 13 nt, Mycobacterium tuberculosis H37Rv
ggccccgggaagu

SEQ ID NO: 1342290 - RNA, 20 nt, Mycobacterium tuberculosis H37Rv
ggccccucccuggcucguga

SEQ ID NO: 1342291 - RNA, 20 nt, Mycobacterium tuberculosis H37Rv
ggcccgaaaugccgggcccg

SEQ ID NO: 1342292 - RNA, 23 nt, Mycobacterium tuberculosis H37Rv
ggcccgcgcgagagccuccaugg

SEQ ID NO: 1342293 - RNA, 19 nt, Mycobacterium tuberculosis H37Rv
ggcccggcucggugcgcca

SEQ ID NO: 1342294 - RNA, 20 nt, Mycobacterium tuberculosis H37Rv
ggcccggcucacagcacagc

SEQ ID NO: 1342295 - RNA, 14 nt, Mycobacterium tuberculosis H37Rv
ggcccgggccaccg

SEQ ID NO: 1342296 - RNA, 18 nt, Mycobacterium tuberculosis H37Rv
ggcccggcuacgacggcg

SEQ ID NO: 1342297 - RNA, 14 nt, Mycobacterium tuberculosis H37Rv
ggcccggcucacag

SEQ ID NO: 1342298 - RNA, 13 nt, Mycobacterium tuberculosis H37Rv
ggcccggcgcggc

SEQ ID NO: 1342299 - RNA, 17 nt, Mycobacterium tuberculosis H37Rv
ggccgccguccccgccg

SEQ ID NO: 1342300 - RNA, 14 nt, Mycobacterium tuberculosis H37Rv
ggccgccggccagc

SEQ ID NO: 1342301 - RNA, 21 nt, Mycobacterium tuberculosis H37Rv
ggccgccgcugccgccugcag

SEQ ID NO: 1342302 - RNA, 18 nt, Mycobacterium tuberculosis H37Rv
ggccgccggacccgucga

SEQ ID NO: 1342303 - RNA, 15 nt, Mycobacterium tuberculosis H37Rv
ggccgcgacgacacg

SEQ ID NO: 1342304 - RNA, 15 nt, Mycobacterium tuberculosis H37Rv
ggccgcgaccagcgc

SEQ ID NO: 1342305 - RNA, 19 nt, Mycobacterium tuberculosis H37Rv
ggccgccugacccggcgcc

SEQ ID NO: 1342306 - RNA, 17 nt, Mycobacterium tuberculosis H37Rv
ggccgccuucgccgccg

SEQ ID NO: 1342307 - RNA, 23 nt, Mycobacterium tuberculosis H37Rv
ggccgccuugaggcccugcggcc

SEQ ID NO: 1342308 - RNA, 16 nt, Mycobacterium tuberculosis H37Rv
ggccgccuccgcggca

SEQ ID NO: 1342309 - RNA, 19 nt, Mycobacterium tuberculosis H37Rv
ggccgccguccccgccguc

SEQ ID NO: 1342310 - RNA, 14 nt, Mycobacterium tuberculosis H37Rv
ggccgcgcucgucg

SEQ ID NO: 1342311 - RNA, 17 nt, Mycobacterium tuberculosis H37Rv
ggccgcgcggacccagc

SEQ ID NO: 1342312 - RNA, 16 nt, Mycobacterium tuberculosis H37Rv
ggccgcgcggggugcg

SEQ ID NO: 1342313 - RNA, 22 nt, Mycobacterium tuberculosis H37Rv
ggccgcgcgcucgagcaggcug

SEQ ID NO: 1342314 - RNA, 15 nt, Mycobacterium tuberculosis H37Rv
ggccgcgccgucggc

SEQ ID NO: 1342315 - RNA, 15 nt, Mycobacterium tuberculosis H37Rv
ggccgcgcgcaccgg

SEQ ID NO: 1342316 - RNA, 13 nt, Mycobacterium tuberculosis H37Rv
ggccgcgcaggcu

SEQ ID NO: 1342317 - RNA, 22 nt, Mycobacterium tuberculosis H37Rv
ggccgcgauggugcgccgggcg

SEQ ID NO: 1342318 - RNA, 14 nt, Mycobacterium tuberculosis H37Rv
ggccgcgcccuggc

SEQ ID NO: 1342319 - RNA, 16 nt, Mycobacterium tuberculosis H37Rv
ggccgcgauccagcgc

SEQ ID NO: 1342320 - RNA, 17 nt, Mycobacterium tuberculosis H37Rv
ggccgcgauccagcgcu

SEQ ID NO: 1342321 - RNA, 15 nt, Mycobacterium tuberculosis H37Rv
ggccgcgcagauucc

SEQ ID NO: 1342322 - RNA, 22 nt, Mycobacterium tuberculosis H37Rv
ggccgaccgcgacccggcccag

SEQ ID NO: 1342323 - RNA, 16 nt, Mycobacterium tuberculosis H37Rv
ggccgacccggauguc

SEQ ID NO: 1342324 - RNA, 12 nt, Mycobacterium tuberculosis H37Rv
ggccgacgcugc

SEQ ID NO: 1342325 - RNA, 14 nt, Mycobacterium tuberculosis H37Rv
ggccgacgcugcug

SEQ ID NO: 1342326 - RNA, 19 nt, Mycobacterium tuberculosis H37Rv
ggccgccaacuucaccacc

SEQ ID NO: 1342327 - RNA, 20 nt, Mycobacterium tuberculosis H37Rv
ggccgagagcagccagccac

SEQ ID NO: 1342328 - RNA, 20 nt, Mycobacterium tuberculosis H37Rv
ggccgagaucacgccgggcg

SEQ ID NO: 1342329 - RNA, 13 nt, Mycobacterium tuberculosis H37Rv
ggccgccgcggcg

SEQ ID NO: 1342330 - RNA, 17 nt, Mycobacterium tuberculosis H37Rv
ggccgccgcggcuuguc

SEQ ID NO: 1342331 - RNA, 20 nt, Mycobacterium tuberculosis H37Rv
ggccgccgcgauggccccug

SEQ ID NO: 1342332 - RNA, 12 nt, Mycobacterium tuberculosis H37Rv
ggccgccgcagc

SEQ ID NO: 1342333 - RNA, 16 nt, Mycobacterium tuberculosis H37Rv
ggccgcaugccacggc

SEQ ID NO: 1342334 - RNA, 20 nt, Mycobacterium tuberculosis H37Rv
ggccgccgaccggagccgcc

SEQ ID NO: 1342335 - RNA, 13 nt, Mycobacterium tuberculosis H37Rv
ggccgcccguaga

SEQ ID NO: 1342336 - RNA, 14 nt, Mycobacterium tuberculosis H37Rv
ggccgcccggcgag

SEQ ID NO: 1342337 - RNA, 18 nt, Mycobacterium tuberculosis H37Rv
ggccgcccggcgagcagg

SEQ ID NO: 1342338 - RNA, 15 nt, Mycobacterium tuberculosis H37Rv
ggccgcccgcugcgg

SEQ ID NO: 1342339 - RNA, 17 nt, Mycobacterium tuberculosis H37Rv
ggccgcccgcugcggcg

SEQ ID NO: 1342340 - RNA, 13 nt, Mycobacterium tuberculosis H37Rv
ggccgccagccgg

SEQ ID NO: 1342341 - RNA, 20 nt, Mycobacterium tuberculosis H37Rv
ggccgccagccccacccgca

SEQ ID NO: 1342342 - RNA, 12 nt, Mycobacterium tuberculosis H37Rv
ggccgccagcgc

SEQ ID NO: 1342343 - RNA, 19 nt, Mycobacterium tuberculosis H37Rv
ggccgccaccgucaccgcc

SEQ ID NO: 1342344 - RNA, 16 nt, Mycobacterium tuberculosis H37Rv
ggccgccaccgucacc

SEQ ID NO: 1342345 - RNA, 14 nt, Mycobacterium tuberculosis H37Rv
ggccgccacccgca

SEQ ID NO: 1342346 - RNA, 18 nt, Mycobacterium tuberculosis H37Rv
ggccgcauuagccugcgu

SEQ ID NO: 1342347 - RNA, 21 nt, Mycobacterium tuberculosis H37Rv
ggccagcggccauccggcggc

SEQ ID NO: 1342348 - RNA, 19 nt, Mycobacterium tuberculosis H37Rv
ggccagcgucaacagcgug

SEQ ID NO: 1342349 - RNA, 14 nt, Mycobacterium tuberculosis H37Rv
ggccagcggcagga

SEQ ID NO: 1342350 - RNA, 17 nt, Mycobacterium tuberculosis H37Rv
ggccagcucggccagcu

SEQ ID NO: 1342351 - RNA, 17 nt, Mycobacterium tuberculosis H37Rv
ggccagcucggccuggu

SEQ ID NO: 1342352 - RNA, 12 nt, Mycobacterium tuberculosis H37Rv
ggccagcucccg

SEQ ID NO: 1342353 - RNA, 16 nt, Mycobacterium tuberculosis H37Rv
ggccaggccggcggcg

SEQ ID NO: 1342354 - RNA, 22 nt, Mycobacterium tuberculosis H37Rv
ggccaggccguaguggccggcu

SEQ ID NO: 1342355 - RNA, 22 nt, Mycobacterium tuberculosis H37Rv
ggccaggcgguacgggucgccg

SEQ ID NO: 1342356 - RNA, 19 nt, Mycobacterium tuberculosis H37Rv
ggcccaccagcgcagccga

SEQ ID NO: 1342357 - RNA, 18 nt, Mycobacterium tuberculosis H37Rv
ggcccaccgcugcggcac

SEQ ID NO: 1342358 - RNA, 15 nt, Mycobacterium tuberculosis H37Rv
ggcccaccggccacu

SEQ ID NO: 1342359 - RNA, 16 nt, Mycobacterium tuberculosis H37Rv
ggcccacaccagcgca

SEQ ID NO: 1342360 - RNA, 22 nt, Mycobacterium tuberculosis H37Rv
ggcccacacggucgucgcgagc

SEQ ID NO: 1342361 - RNA, 16 nt, Mycobacterium tuberculosis H37Rv
ggcccaauugcgccga

SEQ ID NO: 1342362 - RNA, 17 nt, Mycobacterium tuberculosis H37Rv
ggcccaccagcgcagcc

SEQ ID NO: 1342363 - RNA, 14 nt, Mycobacterium tuberculosis H37Rv
ggccaguacgucga

SEQ ID NO: 1342364 - RNA, 13 nt, Mycobacterium tuberculosis H37Rv
ggccagugccacc

SEQ ID NO: 1342365 - RNA, 18 nt, Mycobacterium tuberculosis H37Rv
ggccaucgugcggcacuc

SEQ ID NO: 1342366 - RNA, 19 nt, Mycobacterium tuberculosis H37Rv
ggccaucgugcggcacucc

SEQ ID NO: 1342367 - RNA, 21 nt, Mycobacterium tuberculosis H37Rv
ggccaucgcgcggaccagagu

SEQ ID NO: 1342368 - RNA, 14 nt, Mycobacterium tuberculosis H37Rv
ggccaucgucagga

SEQ ID NO: 1342369 - RNA, 17 nt, Mycobacterium tuberculosis H37Rv
ggccaucccggccucca

SEQ ID NO: 1342370 - RNA, 13 nt, Mycobacterium tuberculosis H37Rv
ggccaucccggcc

SEQ ID NO: 1342371 - RNA, 20 nt, Mycobacterium tuberculosis H37Rv
ggccaucgcauccccagcac

SEQ ID NO: 1342372 - RNA, 22 nt, Mycobacterium tuberculosis H37Rv
ggccaucgcauccccagcacaa

SEQ ID NO: 1342373 - RNA, 22 nt, Mycobacterium tuberculosis H37Rv
ggccaucgccgacacccucggg

SEQ ID NO: 1342374 - RNA, 18 nt, Mycobacterium tuberculosis H37Rv
ggccaauagaagcacguc

SEQ ID NO: 1342375 - RNA, 15 nt, Mycobacterium tuberculosis H37Rv
ggccaauccggcggc

SEQ ID NO: 1342376 - RNA, 12 nt, Mycobacterium tuberculosis H37Rv
ggccaauccggg

SEQ ID NO: 1342377 - RNA, 15 nt, Mycobacterium tuberculosis H37Rv
ggccaauccggggcc

SEQ ID NO: 1342378 - RNA, 15 nt, Mycobacterium tuberculosis H37Rv
ggccaaucagcccgc

SEQ ID NO: 1342379 - RNA, 17 nt, Mycobacterium tuberculosis H37Rv
ggccaauggccugcagc

SEQ ID NO: 1342380 - RNA, 22 nt, Mycobacterium tuberculosis H37Rv
ggccaaugccuugagcaaaaug

SEQ ID NO: 1342381 - RNA, 15 nt, Mycobacterium tuberculosis H37Rv
ggccacauccagcgc

SEQ ID NO: 1342382 - RNA, 13 nt, Mycobacterium tuberculosis H37Rv
ggccacagugcau

SEQ ID NO: 1342383 - RNA, 23 nt, Mycobacterium tuberculosis H37Rv
ggccacaggaagcgaccgucguc

SEQ ID NO: 1342384 - RNA, 21 nt, Mycobacterium tuberculosis H37Rv
ggccacaccuuggccgccggc

SEQ ID NO: 1342385 - RNA, 18 nt, Mycobacterium tuberculosis H37Rv
ggccacaugaucgagcag

SEQ ID NO: 1342386 - RNA, 18 nt, Mycobacterium tuberculosis H37Rv
ggccaccaacucggcgac

SEQ ID NO: 1342387 - RNA, 16 nt, Mycobacterium tuberculosis H37Rv
ggccaccguagccagc

SEQ ID NO: 1342388 - RNA, 22 nt, Mycobacterium tuberculosis H37Rv
ggccaccguaaacagcgcgccg

SEQ ID NO: 1342389 - RNA, 18 nt, Mycobacterium tuberculosis H37Rv
ggccaccaccaggcugac

SEQ ID NO: 1342390 - RNA, 16 nt, Mycobacterium tuberculosis H37Rv
ggccaccuccaaaccg

SEQ ID NO: 1342391 - RNA, 22 nt, Mycobacterium tuberculosis H37Rv
ggccaccgucccugugucgccg

SEQ ID NO: 1342392 - RNA, 12 nt, Mycobacterium tuberculosis H37Rv
ggccaccgucgc

SEQ ID NO: 1342393 - RNA, 16 nt, Mycobacterium tuberculosis H37Rv
ggccaccuccgaggcc

SEQ ID NO: 1342394 - RNA, 15 nt, Mycobacterium tuberculosis H37Rv
ggccacguagcagca

SEQ ID NO: 1342395 - RNA, 16 nt, Mycobacterium tuberculosis H37Rv
ggccacgguccggccc

SEQ ID NO: 1342396 - RNA, 17 nt, Mycobacterium tuberculosis H37Rv
ggccacgaugaucccaa

SEQ ID NO: 1342397 - RNA, 14 nt, Mycobacterium tuberculosis H37Rv
ggccacgagucgca

SEQ ID NO: 1342398 - RNA, 16 nt, Mycobacterium tuberculosis H37Rv
ggccaccugcucgucg

SEQ ID NO: 1342399 - RNA, 16 nt, Mycobacterium tuberculosis H37Rv
ggccaccugcuggccg

SEQ ID NO: 1342400 - RNA, 15 nt, Mycobacterium tuberculosis H37Rv
ggccagccuaccggc

SEQ ID NO: 1342401 - RNA, 15 nt, Mycobacterium tuberculosis H37Rv
ggccagccgcggccc

SEQ ID NO: 1342402 - RNA, 13 nt, Mycobacterium tuberculosis H37Rv
ggccagccgcggc

SEQ ID NO: 1342403 - RNA, 22 nt, Mycobacterium tuberculosis H37Rv
ggccagcagcgacuccagcgcc

SEQ ID NO: 1342404 - RNA, 19 nt, Mycobacterium tuberculosis H37Rv
ggccagccgacgcggcggg

SEQ ID NO: 1342405 - RNA, 14 nt, Mycobacterium tuberculosis H37Rv
ggccagcagcagau

SEQ ID NO: 1342406 - RNA, 13 nt, Mycobacterium tuberculosis H37Rv
ggccagcagcagc

SEQ ID NO: 1342407 - RNA, 15 nt, Mycobacterium tuberculosis H37Rv
ggccagcagccgcga

SEQ ID NO: 1342408 - RNA, 20 nt, Mycobacterium tuberculosis H37Rv
ggccacucacauuggccagg

SEQ ID NO: 1342409 - RNA, 16 nt, Mycobacterium tuberculosis H37Rv
ggccacuugcucggcg

SEQ ID NO: 1342410 - RNA, 22 nt, Mycobacterium tuberculosis H37Rv
ggccacugcguuccaucgccga

SEQ ID NO: 1342411 - RNA, 16 nt, Mycobacterium tuberculosis H37Rv
ggccagcagagcggca

SEQ ID NO: 1342412 - RNA, 23 nt, Mycobacterium tuberculosis H37Rv
ggccagacggugcagcuccccgc

SEQ ID NO: 1342413 - RNA, 12 nt, Mycobacterium tuberculosis H37Rv
ggccagcagcaa

SEQ ID NO: 1342414 - RNA, 20 nt, Mycobacterium tuberculosis H37Rv
ggccagacggugcagcuccc

SEQ ID NO: 1342415 - RNA, 18 nt, Mycobacterium tuberculosis H37Rv
ggccagcacgccgccggc

SEQ ID NO: 1342416 - RNA, 14 nt, Mycobacterium tuberculosis H37Rv
ggccaacugggcgg

SEQ ID NO: 1342417 - RNA, 14 nt, Mycobacterium tuberculosis H37Rv
ggccaacgacggcc

SEQ ID NO: 1342418 - RNA, 23 nt, Mycobacterium tuberculosis H37Rv
ggccaacuuggcggccagccgcu

SEQ ID NO: 1342419 - RNA, 16 nt, Mycobacterium tuberculosis H37Rv
ggccaacuuggcggcc

SEQ ID NO: 1342420 - RNA, 13 nt, Mycobacterium tuberculosis H37Rv
ggccaacggcucc

SEQ ID NO: 1342421 - RNA, 15 nt, Mycobacterium tuberculosis H37Rv
ggccaacccgggccg

SEQ ID NO: 1342422 - RNA, 18 nt, Mycobacterium tuberculosis H37Rv
ggccaacccugcggcguc

SEQ ID NO: 1342423 - RNA, 14 nt, Mycobacterium tuberculosis H37Rv
ggccaaccgggccg

SEQ ID NO: 1342424 - RNA, 20 nt, Mycobacterium tuberculosis H37Rv
ggccaaccgggccgccugga

SEQ ID NO: 1342425 - RNA, 17 nt, Mycobacterium tuberculosis H37Rv
ggccaacugggccgagc

SEQ ID NO: 1342426 - RNA, 22 nt, Mycobacterium tuberculosis H37Rv
ggccaagaaugugggcgacggc

SEQ ID NO: 1342427 - RNA, 16 nt, Mycobacterium tuberculosis H37Rv
ggccaagacggcgggc

SEQ ID NO: 1342428 - RNA, 16 nt, Mycobacterium tuberculosis H37Rv
ggccaagguggccacc

SEQ ID NO: 1342429 - RNA, 21 nt, Mycobacterium tuberculosis H37Rv
ggccaaagacccggcacccag

SEQ ID NO: 1342430 - RNA, 18 nt, Mycobacterium tuberculosis H37Rv
ggccaacaccgccagcau

SEQ ID NO: 1342431 - RNA, 20 nt, Mycobacterium tuberculosis H37Rv
ggccaaccccauggccagcg

SEQ ID NO: 1342432 - RNA, 22 nt, Mycobacterium tuberculosis H37Rv
ggccaaccccauggccagcgcu

SEQ ID NO: 1342433 - RNA, 22 nt, Mycobacterium tuberculosis H37Rv
ggccaaagccgucagcucacca

SEQ ID NO: 1342434 - RNA, 17 nt, Mycobacterium tuberculosis H37Rv
ggcauuucagcgcgccg

SEQ ID NO: 1342435 - RNA, 21 nt, Mycobacterium tuberculosis H37Rv
ggccaaaaccagggagcgccc

SEQ ID NO: 1342436 - RNA, 20 nt, Mycobacterium tuberculosis H37Rv
ggcaucgaauuccagccagc

SEQ ID NO: 1342437 - RNA, 22 nt, Mycobacterium tuberculosis H37Rv
ggcauccugcacgacccgcugg

SEQ ID NO: 1342438 - RNA, 20 nt, Mycobacterium tuberculosis H37Rv
ggcauccucugaaccugcug

SEQ ID NO: 1342439 - RNA, 18 nt, Mycobacterium tuberculosis H37Rv
ggcauccgagcgggaacg

SEQ ID NO: 1342440 - RNA, 18 nt, Mycobacterium tuberculosis H37Rv
ggcauccgccccgcccgc

SEQ ID NO: 1342441 - RNA, 15 nt, Mycobacterium tuberculosis H37Rv
ggcaugacauacagc

SEQ ID NO: 1342442 - RNA, 15 nt, Mycobacterium tuberculosis H37Rv
ggcauuaggccgggg

SEQ ID NO: 1342443 - RNA, 13 nt, Mycobacterium tuberculosis H37Rv
ggcauucccgcgg

SEQ ID NO: 1342444 - RNA, 19 nt, Mycobacterium tuberculosis H37Rv
ggcacuugccacggcccgg

SEQ ID NO: 1342445 - RNA, 23 nt, Mycobacterium tuberculosis H37Rv
ggcacuuaccgagccgucagcgu

SEQ ID NO: 1342446 - RNA, 13 nt, Mycobacterium tuberculosis H37Rv
ggcagggccagcg

SEQ ID NO: 1342447 - RNA, 16 nt, Mycobacterium tuberculosis H37Rv
ggcaggugcggcggca

SEQ ID NO: 1342448 - RNA, 21 nt, Mycobacterium tuberculosis H37Rv
ggcagguugcguugcaggaaa

SEQ ID NO: 1342449 - RNA, 18 nt, Mycobacterium tuberculosis H37Rv
ggcagguugcguugcagg

SEQ ID NO: 1342450 - RNA, 22 nt, Mycobacterium tuberculosis H37Rv
ggcagguguuggugcgggguug

SEQ ID NO: 1342451 - RNA, 13 nt, Mycobacterium tuberculosis H37Rv
ggcaggucgagcg

SEQ ID NO: 1342452 - RNA, 16 nt, Mycobacterium tuberculosis H37Rv
ggcaguggcagcccgu

SEQ ID NO: 1342453 - RNA, 18 nt, Mycobacterium tuberculosis H37Rv
ggcaguugaacucgacca

SEQ ID NO: 1342454 - RNA, 18 nt, Mycobacterium tuberculosis H37Rv
ggcaguuguugacagaca

SEQ ID NO: 1342455 - RNA, 17 nt, Mycobacterium tuberculosis H37Rv
ggcaguuuggcggcagg

SEQ ID NO: 1342456 - RNA, 18 nt, Mycobacterium tuberculosis H37Rv
ggcaucaccgccgcggcc

SEQ ID NO: 1342457 - RNA, 16 nt, Mycobacterium tuberculosis H37Rv
ggcaucaccgccgcgg

SEQ ID NO: 1342458 - RNA, 23 nt, Mycobacterium tuberculosis H37Rv
ggcaucaccuggcgugucgccgc

SEQ ID NO: 1342459 - RNA, 22 nt, Mycobacterium tuberculosis H37Rv
ggcaucaucgcugugcgcuggu

SEQ ID NO: 1342460 - RNA, 14 nt, Mycobacterium tuberculosis H37Rv
ggcauccagcagcg

SEQ ID NO: 1342461 - RNA, 21 nt, Mycobacterium tuberculosis H37Rv
ggcaucccggccgcucagcga

SEQ ID NO: 1342462 - RNA, 22 nt, Mycobacterium tuberculosis H37Rv
ggcaucccgggcaguccaggca

SEQ ID NO: 1342463 - RNA, 16 nt, Mycobacterium tuberculosis H37Rv
ggcggccagcucggcc

SEQ ID NO: 1342464 - RNA, 21 nt, Mycobacterium tuberculosis H37Rv
ggcggccagcaucgcgguggu

SEQ ID NO: 1342465 - RNA, 21 nt, Mycobacterium tuberculosis H37Rv
ggcggccagcaucggguggcg

SEQ ID NO: 1342466 - RNA, 18 nt, Mycobacterium tuberculosis H37Rv
ggcggccaugucagcggc

SEQ ID NO: 1342467 - RNA, 20 nt, Mycobacterium tuberculosis H37Rv
ggcggccaugucagcggccu

SEQ ID NO: 1342468 - RNA, 12 nt, Mycobacterium tuberculosis H37Rv
ggcggccgagcg

SEQ ID NO: 1342469 - RNA, 14 nt, Mycobacterium tuberculosis H37Rv
ggcggcccgcagcc

SEQ ID NO: 1342470 - RNA, 14 nt, Mycobacterium tuberculosis H37Rv
ggcggcccgcucgg

SEQ ID NO: 1342471 - RNA, 21 nt, Mycobacterium tuberculosis H37Rv
ggcggccccgcgccaccuccc

SEQ ID NO: 1342472 - RNA, 24 nt, Mycobacterium tuberculosis H37Rv
ggcggccauucuugucggugggcg

SEQ ID NO: 1342473 - RNA, 23 nt, Mycobacterium tuberculosis H37Rv
ggcggcaucgaggccagcagcug

SEQ ID NO: 1342474 - RNA, 20 nt, Mycobacterium tuberculosis H37Rv
ggcggccaacgacgacccgu

SEQ ID NO: 1342475 - RNA, 14 nt, Mycobacterium tuberculosis H37Rv
ggcggccaccaugu

SEQ ID NO: 1342476 - RNA, 18 nt, Mycobacterium tuberculosis H37Rv
ggcggccaccagugcggg

SEQ ID NO: 1342477 - RNA, 12 nt, Mycobacterium tuberculosis H37Rv
ggcggccacguc

SEQ ID NO: 1342478 - RNA, 19 nt, Mycobacterium tuberculosis H37Rv
ggcggccacguggucggcg

SEQ ID NO: 1342479 - RNA, 19 nt, Mycobacterium tuberculosis H37Rv
ggcggccaccucuucucgg

SEQ ID NO: 1342480 - RNA, 18 nt, Mycobacterium tuberculosis H37Rv
ggcggcacuacgcagccg

SEQ ID NO: 1342481 - RNA, 18 nt, Mycobacterium tuberculosis H37Rv
ggcggcagcggugcuggu

SEQ ID NO: 1342482 - RNA, 16 nt, Mycobacterium tuberculosis H37Rv
ggcggcacuggauccg

SEQ ID NO: 1342483 - RNA, 14 nt, Mycobacterium tuberculosis H37Rv
ggcggcauccccag

SEQ ID NO: 1342484 - RNA, 20 nt, Mycobacterium tuberculosis H37Rv
ggcggcauacauccaggcug

SEQ ID NO: 1342485 - RNA, 16 nt, Mycobacterium tuberculosis H37Rv
ggcggcagguguuggu

SEQ ID NO: 1342486 - RNA, 15 nt, Mycobacterium tuberculosis H37Rv
ggcggcacgcucgcg

SEQ ID NO: 1342487 - RNA, 14 nt, Mycobacterium tuberculosis H37Rv
ggcggcagcgaggc

SEQ ID NO: 1342488 - RNA, 20 nt, Mycobacterium tuberculosis H37Rv
ggcggaucuggcuccggcca

SEQ ID NO: 1342489 - RNA, 20 nt, Mycobacterium tuberculosis H37Rv
ggcggaucgcgagcgccgcu

SEQ ID NO: 1342490 - RNA, 19 nt, Mycobacterium tuberculosis H37Rv
ggcggaucugaucggcgcg

SEQ ID NO: 1342491 - RNA, 17 nt, Mycobacterium tuberculosis H37Rv
ggcggcacccggguggc

SEQ ID NO: 1342492 - RNA, 19 nt, Mycobacterium tuberculosis H37Rv
ggcggcaacccugcccggc

SEQ ID NO: 1342493 - RNA, 19 nt, Mycobacterium tuberculosis H37Rv
ggcggagcgggccagcacc

SEQ ID NO: 1342494 - RNA, 15 nt, Mycobacterium tuberculosis H37Rv
ggcggagacggcggc

SEQ ID NO: 1342495 - RNA, 14 nt, Mycobacterium tuberculosis H37Rv
ggcggaggcugggc

SEQ ID NO: 1342496 - RNA, 13 nt, Mycobacterium tuberculosis H37Rv
ggcggaggcuggg

SEQ ID NO: 1342497 - RNA, 22 nt, Mycobacterium tuberculosis H37Rv
ggcggaucccgaggcgcccaac

SEQ ID NO: 1342498 - RNA, 16 nt, Mycobacterium tuberculosis H37Rv
ggcggaucgcgagcgc

SEQ ID NO: 1342499 - RNA, 16 nt, Mycobacterium tuberculosis H37Rv
ggcggacccgcucgcg

SEQ ID NO: 1342500 - RNA, 20 nt, Mycobacterium tuberculosis H37Rv
ggcggacccgcucgcggcga

SEQ ID NO: 1342501 - RNA, 19 nt, Mycobacterium tuberculosis H37Rv
ggcggacgccgcgccggcg

SEQ ID NO: 1342502 - RNA, 17 nt, Mycobacterium tuberculosis H37Rv
ggcggacgugaccagau

SEQ ID NO: 1342503 - RNA, 20 nt, Mycobacterium tuberculosis H37Rv
ggcggcgaucaacucgggca

SEQ ID NO: 1342504 - RNA, 22 nt, Mycobacterium tuberculosis H37Rv
ggcggcgagcgcgaugcagugc

SEQ ID NO: 1342505 - RNA, 13 nt, Mycobacterium tuberculosis H37Rv
ggcggcgccggcg

SEQ ID NO: 1342506 - RNA, 20 nt, Mycobacterium tuberculosis H37Rv
ggcggcgaccagcucagcug

SEQ ID NO: 1342507 - RNA, 22 nt, Mycobacterium tuberculosis H37Rv
ggcggccuugccgggccgcgcg

SEQ ID NO: 1342508 - RNA, 21 nt, Mycobacterium tuberculosis H37Rv
ggcggccuugcgggcucucgg

SEQ ID NO: 1342509 - RNA, 17 nt, Mycobacterium tuberculosis H37Rv
ggcggcgaacagcccca

SEQ ID NO: 1342510 - RNA, 21 nt, Mycobacterium tuberculosis H37Rv
ggcggcgaccucggcggcggc

SEQ ID NO: 1342511 - RNA, 15 nt, Mycobacterium tuberculosis H37Rv
ggcggcgacgagcgc

SEQ ID NO: 1342512 - RNA, 18 nt, Mycobacterium tuberculosis H37Rv
ggcggcgagaaucccggg

SEQ ID NO: 1342513 - RNA, 15 nt, Mycobacterium tuberculosis H37Rv
ggcggccuccucccc

SEQ ID NO: 1342514 - RNA, 20 nt, Mycobacterium tuberculosis H37Rv
ggcggccucccgggccgccg

SEQ ID NO: 1342515 - RNA, 15 nt, Mycobacterium tuberculosis H37Rv
ggcggccucgcugcu

SEQ ID NO: 1342516 - RNA, 18 nt, Mycobacterium tuberculosis H37Rv
ggcggccuucggccggcg

SEQ ID NO: 1342517 - RNA, 17 nt, Mycobacterium tuberculosis H37Rv
ggcggccugggccagcc

SEQ ID NO: 1342518 - RNA, 16 nt, Mycobacterium tuberculosis H37Rv
ggcggccugcucgcag

SEQ ID NO: 1342519 - RNA, 15 nt, Mycobacterium tuberculosis H37Rv
ggcggccgugucggg

SEQ ID NO: 1342520 - RNA, 19 nt, Mycobacterium tuberculosis H37Rv
ggcggccgugucgggcgcg

SEQ ID NO: 1342521 - RNA, 19 nt, Mycobacterium tuberculosis H37Rv
ggcggccucccgggccgcc

SEQ ID NO: 1342522 - RNA, 21 nt, Mycobacterium tuberculosis H37Rv
ggcggccggacucguucaugu

SEQ ID NO: 1342523 - RNA, 21 nt, Mycobacterium tuberculosis H37Rv
ggcggcguccaucgcgcgccg

SEQ ID NO: 1342524 - RNA, 16 nt, Mycobacterium tuberculosis H37Rv
ggcggcguccagcagc

SEQ ID NO: 1342525 - RNA, 16 nt, Mycobacterium tuberculosis H37Rv
ggcggcguccaccugc

SEQ ID NO: 1342526 - RNA, 17 nt, Mycobacterium tuberculosis H37Rv
ggcggcgugaagugagc

SEQ ID NO: 1342527 - RNA, 17 nt, Mycobacterium tuberculosis H37Rv
ggcggcuacuccaacug

SEQ ID NO: 1342528 - RNA, 21 nt, Mycobacterium tuberculosis H37Rv
ggcggcguuaccaccgucacc

SEQ ID NO: 1342529 - RNA, 22 nt, Mycobacterium tuberculosis H37Rv
ggcggcggugguaccggcgcca

SEQ ID NO: 1342530 - RNA, 16 nt, Mycobacterium tuberculosis H37Rv
ggcggcggucggcugg

SEQ ID NO: 1342531 - RNA, 17 nt, Mycobacterium tuberculosis H37Rv
ggcggcggucggcuggg

SEQ ID NO: 1342532 - RNA, 15 nt, Mycobacterium tuberculosis H37Rv
ggcggcggugcagca

SEQ ID NO: 1342533 - RNA, 13 nt, Mycobacterium tuberculosis H37Rv
ggcggcgguggcg

SEQ ID NO: 1342534 - RNA, 13 nt, Mycobacterium tuberculosis H37Rv
ggcggcgggggcg

SEQ ID NO: 1342535 - RNA, 19 nt, Mycobacterium tuberculosis H37Rv
ggcggcgggggcggcggcu

SEQ ID NO: 1342536 - RNA, 16 nt, Mycobacterium tuberculosis H37Rv
ggcggcgggggcggcg

SEQ ID NO: 1342537 - RNA, 18 nt, Mycobacterium tuberculosis H37Rv
ggcggcgcugcagcugcu

SEQ ID NO: 1342538 - RNA, 12 nt, Mycobacterium tuberculosis H37Rv
ggcggcgcucgu

SEQ ID NO: 1342539 - RNA, 17 nt, Mycobacterium tuberculosis H37Rv
ggcggcgcgggucggcg

SEQ ID NO: 1342540 - RNA, 22 nt, Mycobacterium tuberculosis H37Rv
ggcggcgcuggucgcgguggcg

SEQ ID NO: 1342541 - RNA, 15 nt, Mycobacterium tuberculosis H37Rv
ggcggcggacccgcu

SEQ ID NO: 1342542 - RNA, 22 nt, Mycobacterium tuberculosis H37Rv
ggcggcggacccgcucgcggcg

SEQ ID NO: 1342543 - RNA, 18 nt, Mycobacterium tuberculosis H37Rv
ggcggcggaggcugggcu

SEQ ID NO: 1342544 - RNA, 15 nt, Mycobacterium tuberculosis H37Rv
ggcggcggaggcugg

SEQ ID NO: 1342545 - RNA, 14 nt, Mycobacterium tuberculosis H37Rv
ggcggcggccagcc

SEQ ID NO: 1342546 - RNA, 13 nt, Mycobacterium tuberculosis H37Rv
ggcggcggcaagu

SEQ ID NO: 1342547 - RNA, 16 nt, Mycobacterium tuberculosis H37Rv
ggcgcuccacugacca

SEQ ID NO: 1342548 - RNA, 15 nt, Mycobacterium tuberculosis H37Rv
ggcgcuaggaacgcc

SEQ ID NO: 1342549 - RNA, 19 nt, Mycobacterium tuberculosis H37Rv
ggcgcucagcgcggccacg

SEQ ID NO: 1342550 - RNA, 14 nt, Mycobacterium tuberculosis H37Rv
ggcgcucagcgcgg

SEQ ID NO: 1342551 - RNA, 19 nt, Mycobacterium tuberculosis H37Rv
ggcgcucacaauggcucug

SEQ ID NO: 1342552 - RNA, 20 nt, Mycobacterium tuberculosis H37Rv
ggcgcguucgucgucgcuga

SEQ ID NO: 1342553 - RNA, 18 nt, Mycobacterium tuberculosis H37Rv
ggcgcugaucggcagggu

SEQ ID NO: 1342554 - RNA, 20 nt, Mycobacterium tuberculosis H37Rv
ggcgcugaacgcgagcaaca

SEQ ID NO: 1342555 - RNA, 21 nt, Mycobacterium tuberculosis H37Rv
ggcgcugauggugcugcggcg

SEQ ID NO: 1342556 - RNA, 15 nt, Mycobacterium tuberculosis H37Rv
ggcgcugagggugcu

SEQ ID NO: 1342557 - RNA, 12 nt, Mycobacterium tuberculosis H37Rv
ggcgcugcagca

SEQ ID NO: 1342558 - RNA, 11 nt, Mycobacterium tuberculosis H37Rv
ggcgcugcagc

SEQ ID NO: 1342559 - RNA, 14 nt, Mycobacterium tuberculosis H37Rv
ggcgcugcagcugc

SEQ ID NO: 1342560 - RNA, 13 nt, Mycobacterium tuberculosis H37Rv
ggcgcucgcgcgc

SEQ ID NO: 1342561 - RNA, 17 nt, Mycobacterium tuberculosis H37Rv
ggcgcucgcgcgcuggg

SEQ ID NO: 1342562 - RNA, 17 nt, Mycobacterium tuberculosis H37Rv
ggcgcuggacggcgggc

SEQ ID NO: 1342563 - RNA, 15 nt, Mycobacterium tuberculosis H37Rv
ggcgcugcuggcaga

SEQ ID NO: 1342564 - RNA, 16 nt, Mycobacterium tuberculosis H37Rv
ggcgcugcggcgugcc

SEQ ID NO: 1342565 - RNA, 21 nt, Mycobacterium tuberculosis H37Rv
ggcgcugcgcaccgccgcgcg

SEQ ID NO: 1342566 - RNA, 16 nt, Mycobacterium tuberculosis H37Rv
ggcgcugcgcaccgcc

SEQ ID NO: 1342567 - RNA, 14 nt, Mycobacterium tuberculosis H37Rv
ggcgcugccgggau

SEQ ID NO: 1342568 - RNA, 19 nt, Mycobacterium tuberculosis H37Rv
ggcgcugcgcgcgauccac

SEQ ID NO: 1342569 - RNA, 22 nt, Mycobacterium tuberculosis H37Rv
ggcgcuggaccgggucgggcac

SEQ ID NO: 1342570 - RNA, 14 nt, Mycobacterium tuberculosis H37Rv
ggcgcuggccagca

SEQ ID NO: 1342571 - RNA, 18 nt, Mycobacterium tuberculosis H37Rv
ggcgcuggcguggccaac

SEQ ID NO: 1342572 - RNA, 22 nt, Mycobacterium tuberculosis H37Rv
ggcggaaaaucggcuggcccga

SEQ ID NO: 1342573 - RNA, 23 nt, Mycobacterium tuberculosis H37Rv
ggcggaacagcuucgcgcagccg

SEQ ID NO: 1342574 - RNA, 11 nt, Mycobacterium tuberculosis H37Rv
ggcgcggcgga

SEQ ID NO: 1342575 - RNA, 12 nt, Mycobacterium tuberculosis H37Rv
ggcgcggcggcg

SEQ ID NO: 1342576 - RNA, 20 nt, Mycobacterium tuberculosis H37Rv
ggcgcggcacccggucggcc

SEQ ID NO: 1342577 - RNA, 15 nt, Mycobacterium tuberculosis H37Rv
ggcgcggcccaccuc

SEQ ID NO: 1342578 - RNA, 18 nt, Mycobacterium tuberculosis H37Rv
ggcgcggccgcagccagc

SEQ ID NO: 1342579 - RNA, 17 nt, Mycobacterium tuberculosis H37Rv
ggcgcgucggcguuggg

SEQ ID NO: 1342580 - RNA, 18 nt, Mycobacterium tuberculosis H37Rv
ggcgcgugcagcggcgcc

SEQ ID NO: 1342581 - RNA, 21 nt, Mycobacterium tuberculosis H37Rv
ggcgcguaguaaugcucgacg

SEQ ID NO: 1342582 - RNA, 15 nt, Mycobacterium tuberculosis H37Rv
ggcgcguccucgccg

SEQ ID NO: 1342583 - RNA, 20 nt, Mycobacterium tuberculosis H37Rv
ggcgcguccgggcucgcgcu

SEQ ID NO: 1342584 - RNA, 17 nt, Mycobacterium tuberculosis H37Rv
ggcgcgggucggcgacc

SEQ ID NO: 1342585 - RNA, 22 nt, Mycobacterium tuberculosis H37Rv
ggcgcgggucggcgaccgcgcu

SEQ ID NO: 1342586 - RNA, 21 nt, Mycobacterium tuberculosis H37Rv
ggcgcgggugaccaggcggcg

SEQ ID NO: 1342587 - RNA, 18 nt, Mycobacterium tuberculosis H37Rv
ggcgcgggugcgccggcg

SEQ ID NO: 1342588 - RNA, 15 nt, Mycobacterium tuberculosis H37Rv
ggcgcggggccgccg

SEQ ID NO: 1342589 - RNA, 19 nt, Mycobacterium tuberculosis H37Rv
ggcgcggugcgcucacugg

SEQ ID NO: 1342590 - RNA, 17 nt, Mycobacterium tuberculosis H37Rv
ggcgcgguucgucggcg

SEQ ID NO: 1342591 - RNA, 23 nt, Mycobacterium tuberculosis H37Rv
ggcgcgccccaccgcgccgagca

SEQ ID NO: 1342592 - RNA, 17 nt, Mycobacterium tuberculosis H37Rv
ggcgcgcaucugcucgg

SEQ ID NO: 1342593 - RNA, 13 nt, Mycobacterium tuberculosis H37Rv
ggcgcgcgcgccg

SEQ ID NO: 1342594 - RNA, 14 nt, Mycobacterium tuberculosis H37Rv
ggcgcgcgcgccgg

SEQ ID NO: 1342595 - RNA, 23 nt, Mycobacterium tuberculosis H37Rv
ggcgcggagagccugcucgcagc

SEQ ID NO: 1342596 - RNA, 19 nt, Mycobacterium tuberculosis H37Rv
ggcgcgcuggcgggcggcg

SEQ ID NO: 1342597 - RNA, 14 nt, Mycobacterium tuberculosis H37Rv
ggcgcgcucggccg

SEQ ID NO: 1342598 - RNA, 15 nt, Mycobacterium tuberculosis H37Rv
ggcgcgcucggccgg

SEQ ID NO: 1342599 - RNA, 15 nt, Mycobacterium tuberculosis H37Rv
ggcgcgcggggccuc

SEQ ID NO: 1342600 - RNA, 15 nt, Mycobacterium tuberculosis H37Rv
ggcgcgcggcgagcc

SEQ ID NO: 1342601 - RNA, 13 nt, Mycobacterium tuberculosis H37Rv
ggcgcgcggcgcc

SEQ ID NO: 1342602 - RNA, 14 nt, Mycobacterium tuberculosis H37Rv
ggcgcgcggcgccg

SEQ ID NO: 1342603 - RNA, 22 nt, Mycobacterium tuberculosis H37Rv
ggcgguaacucuggugugggcg

SEQ ID NO: 1342604 - RNA, 13 nt, Mycobacterium tuberculosis H37Rv
ggcgguaauacag

SEQ ID NO: 1342605 - RNA, 15 nt, Mycobacterium tuberculosis H37Rv
ggcgggugccgagcu

SEQ ID NO: 1342606 - RNA, 15 nt, Mycobacterium tuberculosis H37Rv
ggcgggugcggcgau

SEQ ID NO: 1342607 - RNA, 15 nt, Mycobacterium tuberculosis H37Rv
ggcggggcggcggug

SEQ ID NO: 1342608 - RNA, 16 nt, Mycobacterium tuberculosis H37Rv
ggcgggggcgucgccg

SEQ ID NO: 1342609 - RNA, 16 nt, Mycobacterium tuberculosis H37Rv
ggcggggccggcggcu

SEQ ID NO: 1342610 - RNA, 14 nt, Mycobacterium tuberculosis H37Rv
ggcggggugagggg

SEQ ID NO: 1342611 - RNA, 22 nt, Mycobacterium tuberculosis H37Rv
ggcgggcugaucgcccggcgcg

SEQ ID NO: 1342612 - RNA, 22 nt, Mycobacterium tuberculosis H37Rv
ggcggucucacguugugagcca

SEQ ID NO: 1342613 - RNA, 18 nt, Mycobacterium tuberculosis H37Rv
ggcggucuguaagacagc

SEQ ID NO: 1342614 - RNA, 12 nt, Mycobacterium tuberculosis H37Rv
ggcggucugcgc

SEQ ID NO: 1342615 - RNA, 22 nt, Mycobacterium tuberculosis H37Rv
ggcggucggaaugccgucgccg

SEQ ID NO: 1342616 - RNA, 23 nt, Mycobacterium tuberculosis H37Rv
ggcggucgaucauggcggcagca

SEQ ID NO: 1342617 - RNA, 18 nt, Mycobacterium tuberculosis H37Rv
ggcgguagucggccagcu

SEQ ID NO: 1342618 - RNA, 21 nt, Mycobacterium tuberculosis H37Rv
ggcgguaugccacaggcugcc

SEQ ID NO: 1342619 - RNA, 14 nt, Mycobacterium tuberculosis H37Rv
ggcggucagcggcu

SEQ ID NO: 1342620 - RNA, 15 nt, Mycobacterium tuberculosis H37Rv
ggcggucagcggcuc

SEQ ID NO: 1342621 - RNA, 21 nt, Mycobacterium tuberculosis H37Rv
ggcggucaccaccgacccgcu

SEQ ID NO: 1342622 - RNA, 13 nt, Mycobacterium tuberculosis H37Rv
ggcggucagcggc

SEQ ID NO: 1342623 - RNA, 23 nt, Mycobacterium tuberculosis H37Rv
ggcggucagcagcgccgucagca

SEQ ID NO: 1342624 - RNA, 12 nt, Mycobacterium tuberculosis H37Rv
ggcggcugucgg

SEQ ID NO: 1342625 - RNA, 23 nt, Mycobacterium tuberculosis H37Rv
ggcggcuucguggcggcgcgcgc

SEQ ID NO: 1342626 - RNA, 22 nt, Mycobacterium tuberculosis H37Rv
ggcgggacccgugagcucgucg

SEQ ID NO: 1342627 - RNA, 14 nt, Mycobacterium tuberculosis H37Rv
ggcgggagcugccg

SEQ ID NO: 1342628 - RNA, 15 nt, Mycobacterium tuberculosis H37Rv
ggcgggacgucgccg

SEQ ID NO: 1342629 - RNA, 21 nt, Mycobacterium tuberculosis H37Rv
ggcggcuuagaacgugcuggu

SEQ ID NO: 1342630 - RNA, 20 nt, Mycobacterium tuberculosis H37Rv
ggcggcuguggucgcugcug

SEQ ID NO: 1342631 - RNA, 15 nt, Mycobacterium tuberculosis H37Rv
ggcggcuuccucgag

SEQ ID NO: 1342632 - RNA, 13 nt, Mycobacterium tuberculosis H37Rv
ggcggcuccaccg

SEQ ID NO: 1342633 - RNA, 17 nt, Mycobacterium tuberculosis H37Rv
ggcggcuggucucuggc

SEQ ID NO: 1342634 - RNA, 21 nt, Mycobacterium tuberculosis H37Rv
ggcggcuccgcccggcguguc

SEQ ID NO: 1342635 - RNA, 20 nt, Mycobacterium tuberculosis H37Rv
ggcgggcggugggcagcagc

SEQ ID NO: 1342636 - RNA, 20 nt, Mycobacterium tuberculosis H37Rv
ggcgggcgauuucggcgccg

SEQ ID NO: 1342637 - RNA, 16 nt, Mycobacterium tuberculosis H37Rv
ggcgggcgcggguggc

SEQ ID NO: 1342638 - RNA, 17 nt, Mycobacterium tuberculosis H37Rv
ggcgggcgcggguggcg

SEQ ID NO: 1342639 - RNA, 21 nt, Mycobacterium tuberculosis H37Rv
ggcgggcccgccggccccgcc

SEQ ID NO: 1342640 - RNA, 15 nt, Mycobacterium tuberculosis H37Rv
ggcgggcccgggggg

SEQ ID NO: 1342641 - RNA, 14 nt, Mycobacterium tuberculosis H37Rv
ggcgggcagcgggc

SEQ ID NO: 1342642 - RNA, 21 nt, Mycobacterium tuberculosis H37Rv
ggcgggaucgagagccgaccg

SEQ ID NO: 1342643 - RNA, 19 nt, Mycobacterium tuberculosis H37Rv
ggcgggcacgcacaaguuc

SEQ ID NO: 1342644 - RNA, 16 nt, Mycobacterium tuberculosis H37Rv
ggcgggcaacgcagca

SEQ ID NO: 1342645 - RNA, 21 nt, Mycobacterium tuberculosis H37Rv
ggcgggcaaucaccgccggcg

SEQ ID NO: 1342646 - RNA, 18 nt, Mycobacterium tuberculosis H37Rv
ggcgucacguaauucccc

SEQ ID NO: 1342647 - RNA, 21 nt, Mycobacterium tuberculosis H37Rv
ggcgucaucgacuugccgccg

SEQ ID NO: 1342648 - RNA, 14 nt, Mycobacterium tuberculosis H37Rv
ggcgucauccgcgg

SEQ ID NO: 1342649 - RNA, 23 nt, Mycobacterium tuberculosis H37Rv
ggcgucagugcagaagacaagug

SEQ ID NO: 1342650 - RNA, 15 nt, Mycobacterium tuberculosis H37Rv
ggcguccaucagaga

SEQ ID NO: 1342651 - RNA, 20 nt, Mycobacterium tuberculosis H37Rv
ggcguccgcccagcacccuc

SEQ ID NO: 1342652 - RNA, 21 nt, Mycobacterium tuberculosis H37Rv
ggcgucccagccgaucacggg

SEQ ID NO: 1342653 - RNA, 15 nt, Mycobacterium tuberculosis H37Rv
ggcguccaggcagcg

SEQ ID NO: 1342654 - RNA, 16 nt, Mycobacterium tuberculosis H37Rv
ggcgucccagggcaca

SEQ ID NO: 1342655 - RNA, 15 nt, Mycobacterium tuberculosis H37Rv
ggcguauugcggccu

SEQ ID NO: 1342656 - RNA, 21 nt, Mycobacterium tuberculosis H37Rv
ggcguagguccuugucggccc

SEQ ID NO: 1342657 - RNA, 24 nt, Mycobacterium tuberculosis H37Rv
ggcguaggcaggaucgccugagcg

SEQ ID NO: 1342658 - RNA, 23 nt, Mycobacterium tuberculosis H37Rv
ggcguacccguuaugcgccgccc

SEQ ID NO: 1342659 - RNA, 22 nt, Mycobacterium tuberculosis H37Rv
ggcgguguccagaacgguggcg

SEQ ID NO: 1342660 - RNA, 18 nt, Mycobacterium tuberculosis H37Rv
ggcggugucgucaucggg

SEQ ID NO: 1342661 - RNA, 12 nt, Mycobacterium tuberculosis H37Rv
ggcggugggucg

SEQ ID NO: 1342662 - RNA, 19 nt, Mycobacterium tuberculosis H37Rv
ggcggugggggcguacugu

SEQ ID NO: 1342663 - RNA, 18 nt, Mycobacterium tuberculosis H37Rv
ggcggugggcagcagcug

SEQ ID NO: 1342664 - RNA, 15 nt, Mycobacterium tuberculosis H37Rv
ggcgguggcccgauu

SEQ ID NO: 1342665 - RNA, 17 nt, Mycobacterium tuberculosis H37Rv
ggcgguggcgaacagca

SEQ ID NO: 1342666 - RNA, 14 nt, Mycobacterium tuberculosis H37Rv
ggcgguggcgaggu

SEQ ID NO: 1342667 - RNA, 14 nt, Mycobacterium tuberculosis H37Rv
ggcggugaaggccc

SEQ ID NO: 1342668 - RNA, 20 nt, Mycobacterium tuberculosis H37Rv
ggcggugaacaccgccagca

SEQ ID NO: 1342669 - RNA, 17 nt, Mycobacterium tuberculosis H37Rv
ggcggugacgugguggg

SEQ ID NO: 1342670 - RNA, 16 nt, Mycobacterium tuberculosis H37Rv
ggcggugcccagcagc

SEQ ID NO: 1342671 - RNA, 12 nt, Mycobacterium tuberculosis H37Rv
ggcggugccggc

SEQ ID NO: 1342672 - RNA, 16 nt, Mycobacterium tuberculosis H37Rv
ggcggugccggcggcg

SEQ ID NO: 1342673 - RNA, 15 nt, Mycobacterium tuberculosis H37Rv
ggcggugcgcaccac

SEQ ID NO: 1342674 - RNA, 16 nt, Mycobacterium tuberculosis H37Rv
ggcgguguugcucccg

SEQ ID NO: 1342675 - RNA, 16 nt, Mycobacterium tuberculosis H37Rv
ggcgguuaucgucggg

SEQ ID NO: 1342676 - RNA, 13 nt, Mycobacterium tuberculosis H37Rv
ggcguacagcgcc

SEQ ID NO: 1342677 - RNA, 14 nt, Mycobacterium tuberculosis H37Rv
ggcgucgaacucau

SEQ ID NO: 1342678 - RNA, 15 nt, Mycobacterium tuberculosis H37Rv
ggcgucgaagcacau

SEQ ID NO: 1342679 - RNA, 14 nt, Mycobacterium tuberculosis H37Rv
ggcgucgacccaga

SEQ ID NO: 1342680 - RNA, 18 nt, Mycobacterium tuberculosis H37Rv
ggcgucgaucagggcccc

SEQ ID NO: 1342681 - RNA, 17 nt, Mycobacterium tuberculosis H37Rv
ggcgucgcugcgcuggu

SEQ ID NO: 1342682 - RNA, 19 nt, Mycobacterium tuberculosis H37Rv
ggcgucgccggccccgccg

SEQ ID NO: 1342683 - RNA, 22 nt, Mycobacterium tuberculosis H37Rv
ggcgucgccggccccgccggcg

SEQ ID NO: 1342684 - RNA, 11 nt, Mycobacterium tuberculosis H37Rv
ggcgucgccgu

SEQ ID NO: 1342685 - RNA, 13 nt, Mycobacterium tuberculosis H37Rv
ggcgucgccgugc

SEQ ID NO: 1342686 - RNA, 19 nt, Mycobacterium tuberculosis H37Rv
ggcgucgaugccggcugcc

SEQ ID NO: 1342687 - RNA, 17 nt, Mycobacterium tuberculosis H37Rv
ggcgucggcgcggccgu

SEQ ID NO: 1342688 - RNA, 15 nt, Mycobacterium tuberculosis H37Rv
ggcgucggcgcggcc

SEQ ID NO: 1342689 - RNA, 20 nt, Mycobacterium tuberculosis H37Rv
ggcgucgcggaucuguuccu

SEQ ID NO: 1342690 - RNA, 20 nt, Mycobacterium tuberculosis H37Rv
ggcgucgucgaguuggccau

SEQ ID NO: 1342691 - RNA, 16 nt, Mycobacterium tuberculosis H37Rv
ggcgucgucggcggcg

SEQ ID NO: 1342692 - RNA, 16 nt, Mycobacterium tuberculosis H37Rv
ggcgucgucggcgggc

SEQ ID NO: 1342693 - RNA, 15 nt, Mycobacterium tuberculosis H37Rv
ggcgucgugagaggc

SEQ ID NO: 1342694 - RNA, 16 nt, Mycobacterium tuberculosis H37Rv
ggcgucuuccucggcc

SEQ ID NO: 1342695 - RNA, 20 nt, Mycobacterium tuberculosis H37Rv
ggcgucugagcgagcucccg

SEQ ID NO: 1342696 - RNA, 18 nt, Mycobacterium tuberculosis H37Rv
ggcgucgugcgcggccgg

SEQ ID NO: 1342697 - RNA, 23 nt, Mycobacterium tuberculosis H37Rv
ggcgucucgcagcaacggcggcg

SEQ ID NO: 1342698 - RNA, 18 nt, Mycobacterium tuberculosis H37Rv
ggcguggucggcaaagcg

SEQ ID NO: 1342699 - RNA, 12 nt, Mycobacterium tuberculosis H37Rv
ggcguggucucg

SEQ ID NO: 1342700 - RNA, 21 nt, Mycobacterium tuberculosis H37Rv
ggcguguuuagcggcugaggg

SEQ ID NO: 1342701 - RNA, 15 nt, Mycobacterium tuberculosis H37Rv
ggcguggcgggggcu

SEQ ID NO: 1342702 - RNA, 16 nt, Mycobacterium tuberculosis H37Rv
ggcgugcagacccggu

SEQ ID NO: 1342703 - RNA, 17 nt, Mycobacterium tuberculosis H37Rv
ggcgugauagcccuugc

SEQ ID NO: 1342704 - RNA, 18 nt, Mycobacterium tuberculosis H37Rv
ggcgugcacaggucagcg

SEQ ID NO: 1342705 - RNA, 13 nt, Mycobacterium tuberculosis H37Rv
ggcgugcagcagc

SEQ ID NO: 1342706 - RNA, 15 nt, Mycobacterium tuberculosis H37Rv
ggcgugacgggcagg

SEQ ID NO: 1342707 - RNA, 20 nt, Mycobacterium tuberculosis H37Rv
ggcgugaccuaccuccucgg

SEQ ID NO: 1342708 - RNA, 15 nt, Mycobacterium tuberculosis H37Rv
ggcgugagcgcgcgc

SEQ ID NO: 1342709 - RNA, 14 nt, Mycobacterium tuberculosis H37Rv
ggcgugaguggcuc

SEQ ID NO: 1342710 - RNA, 16 nt, Mycobacterium tuberculosis H37Rv
ggcgugcucggaggcg

SEQ ID NO: 1342711 - RNA, 16 nt, Mycobacterium tuberculosis H37Rv
ggcguugaucgacauc

SEQ ID NO: 1342712 - RNA, 19 nt, Mycobacterium tuberculosis H37Rv
ggcguugcugaugucgccg

SEQ ID NO: 1342713 - RNA, 19 nt, Mycobacterium tuberculosis H37Rv
ggcguucagcggccagcag

SEQ ID NO: 1342714 - RNA, 18 nt, Mycobacterium tuberculosis H37Rv
ggcguucagcggccagca

SEQ ID NO: 1342715 - RNA, 24 nt, Mycobacterium tuberculosis H37Rv
ggcguuccccgagaacggcgggcg

SEQ ID NO: 1342716 - RNA, 21 nt, Mycobacterium tuberculosis H37Rv
ggcguuguuaucgaagcccga

SEQ ID NO: 1342717 - RNA, 17 nt, Mycobacterium tuberculosis H37Rv
ggcguuugaugcgggcg

SEQ ID NO: 1342718 - RNA, 18 nt, Mycobacterium tuberculosis H37Rv
ggcguuucggcgggcgcc

SEQ ID NO: 1342719 - RNA, 20 nt, Mycobacterium tuberculosis H37Rv
ggcuaacaccgcaggcacau

SEQ ID NO: 1342720 - RNA, 21 nt, Mycobacterium tuberculosis H37Rv
ggcuaguugagcgcugcgccg

SEQ ID NO: 1342721 - RNA, 16 nt, Mycobacterium tuberculosis H37Rv
ggcuaggucagcgggc

SEQ ID NO: 1342722 - RNA, 14 nt, Mycobacterium tuberculosis H37Rv
ggcuaggccagcac

SEQ ID NO: 1342723 - RNA, 19 nt, Mycobacterium tuberculosis H37Rv
ggcuagggcccuggcggcc

SEQ ID NO: 1342724 - RNA, 18 nt, Mycobacterium tuberculosis H37Rv
ggcuacgccccacugccg

SEQ ID NO: 1342725 - RNA, 15 nt, Mycobacterium tuberculosis H37Rv
ggcuacgccuccuuc

SEQ ID NO: 1342726 - RNA, 14 nt, Mycobacterium tuberculosis H37Rv
ggcuacgcgcgccc

SEQ ID NO: 1342727 - RNA, 15 nt, Mycobacterium tuberculosis H37Rv
ggcuacgacggcgcc

SEQ ID NO: 1342728 - RNA, 22 nt, Mycobacterium tuberculosis H37Rv
ggcuaccccagggagugccgca

SEQ ID NO: 1342729 - RNA, 22 nt, Mycobacterium tuberculosis H37Rv
ggcuaccuaacccgcgccggcc

SEQ ID NO: 1342730 - RNA, 15 nt, Mycobacterium tuberculosis H37Rv
ggcuaccccagggag

SEQ ID NO: 1342731 - RNA, 20 nt, Mycobacterium tuberculosis H37Rv
ggcuaccggcagcugcucgg

SEQ ID NO: 1342732 - RNA, 13 nt, Mycobacterium tuberculosis H37Rv
ggcuaccuuggac

SEQ ID NO: 1342733 - RNA, 16 nt, Mycobacterium tuberculosis H37Rv
ggcuaauagcucgccg

SEQ ID NO: 1342734 - RNA, 17 nt, Mycobacterium tuberculosis H37Rv
ggcuaaucagccaggcc

SEQ ID NO: 1342735 - RNA, 21 nt, Mycobacterium tuberculosis H37Rv
ggccuuuuggcgaaccgcaga

SEQ ID NO: 1342736 - RNA, 22 nt, Mycobacterium tuberculosis H37Rv
ggccuuuuggcgaaccgcagac

SEQ ID NO: 1342737 - RNA, 23 nt, Mycobacterium tuberculosis H37Rv
ggccuuuuggcgaaccgcagacc

SEQ ID NO: 1342738 - RNA, 16 nt, Mycobacterium tuberculosis H37Rv
ggccuuggugcggccg

SEQ ID NO: 1342739 - RNA, 19 nt, Mycobacterium tuberculosis H37Rv
ggcgaaaauugcuccacca

SEQ ID NO: 1342740 - RNA, 17 nt, Mycobacterium tuberculosis H37Rv
ggcgaaagauggccuca

SEQ ID NO: 1342741 - RNA, 16 nt, Mycobacterium tuberculosis H37Rv
ggcgaaauuccgggcc

SEQ ID NO: 1342742 - RNA, 23 nt, Mycobacterium tuberculosis H37Rv
ggcgaaauagcccaagccgaucg

SEQ ID NO: 1342743 - RNA, 22 nt, Mycobacterium tuberculosis H37Rv
ggcgaacggauucccgcccagc

SEQ ID NO: 1342744 - RNA, 20 nt, Mycobacterium tuberculosis H37Rv
ggcgaacgcguccagcgcgg

SEQ ID NO: 1342745 - RNA, 19 nt, Mycobacterium tuberculosis H37Rv
ggcgaacucgcgccgagcc

SEQ ID NO: 1342746 - RNA, 18 nt, Mycobacterium tuberculosis H37Rv
ggcgaaccacggcagcca

SEQ ID NO: 1342747 - RNA, 20 nt, Mycobacterium tuberculosis H37Rv
ggcgaaccgucagcgcgccg

SEQ ID NO: 1342748 - RNA, 18 nt, Mycobacterium tuberculosis H37Rv
ggcgaaccgucagcgcgc

SEQ ID NO: 1342749 - RNA, 16 nt, Mycobacterium tuberculosis H37Rv
ggcgaagucacgcacc

SEQ ID NO: 1342750 - RNA, 14 nt, Mycobacterium tuberculosis H37Rv
ggcgaaugacggcc

SEQ ID NO: 1342751 - RNA, 16 nt, Mycobacterium tuberculosis H37Rv
ggcgaaugacggccag

SEQ ID NO: 1342752 - RNA, 12 nt, Mycobacterium tuberculosis H37Rv
ggcgaaguuggu

SEQ ID NO: 1342753 - RNA, 17 nt, Mycobacterium tuberculosis H37Rv
ggcgaauccgcacaggu

SEQ ID NO: 1342754 - RNA, 15 nt, Mycobacterium tuberculosis H37Rv
ggcgaaggucuggcc

SEQ ID NO: 1342755 - RNA, 14 nt, Mycobacterium tuberculosis H37Rv
ggcgaaggccagca

SEQ ID NO: 1342756 - RNA, 20 nt, Mycobacterium tuberculosis H37Rv
ggcgaaggccgcgcgcaggg

SEQ ID NO: 1342757 - RNA, 20 nt, Mycobacterium tuberculosis H37Rv
ggcgaagcgggcgugcucgg

SEQ ID NO: 1342758 - RNA, 20 nt, Mycobacterium tuberculosis H37Rv
ggcgaaugcgggccuccugc

SEQ ID NO: 1342759 - RNA, 18 nt, Mycobacterium tuberculosis H37Rv
ggcgacagcgcggcgguc

SEQ ID NO: 1342760 - RNA, 18 nt, Mycobacterium tuberculosis H37Rv
ggcgacaaucgagaacgc

SEQ ID NO: 1342761 - RNA, 14 nt, Mycobacterium tuberculosis H37Rv
ggcgaccaccagcg

SEQ ID NO: 1342762 - RNA, 19 nt, Mycobacterium tuberculosis H37Rv
ggcgaccacccccggcagg

SEQ ID NO: 1342763 - RNA, 20 nt, Mycobacterium tuberculosis H37Rv
ggcgaccacccccggcaggc

SEQ ID NO: 1342764 - RNA, 16 nt, Mycobacterium tuberculosis H37Rv
ggcgaccacgccgccg

SEQ ID NO: 1342765 - RNA, 22 nt, Mycobacterium tuberculosis H37Rv
ggcgaccacgccgccggcgcug

SEQ ID NO: 1342766 - RNA, 12 nt, Mycobacterium tuberculosis H37Rv
ggcgaccacggc

SEQ ID NO: 1342767 - RNA, 16 nt, Mycobacterium tuberculosis H37Rv
ggcgaccagccgagcg

SEQ ID NO: 1342768 - RNA, 18 nt, Mycobacterium tuberculosis H37Rv
ggcgaccaggagccucca

SEQ ID NO: 1342769 - RNA, 20 nt, Mycobacterium tuberculosis H37Rv
ggcgaccagcucagcugcgg

SEQ ID NO: 1342770 - RNA, 19 nt, Mycobacterium tuberculosis H37Rv
ggcgacgaaguccccguag

SEQ ID NO: 1342771 - RNA, 21 nt, Mycobacterium tuberculosis H37Rv
ggcgacgcggaguccgucgac

SEQ ID NO: 1342772 - RNA, 13 nt, Mycobacterium tuberculosis H37Rv
ggcgacggcggcg

SEQ ID NO: 1342773 - RNA, 23 nt, Mycobacterium tuberculosis H37Rv
ggcgacgucaucgccgacccgcc

SEQ ID NO: 1342774 - RNA, 22 nt, Mycobacterium tuberculosis H37Rv
ggcgaccugcgcgagguuggcg

SEQ ID NO: 1342775 - RNA, 16 nt, Mycobacterium tuberculosis H37Rv
ggcgaccucggcggcg

SEQ ID NO: 1342776 - RNA, 20 nt, Mycobacterium tuberculosis H37Rv
ggcgaccugccggaccgcgg

SEQ ID NO: 1342777 - RNA, 14 nt, Mycobacterium tuberculosis H37Rv
ggcgaccugcucgc

SEQ ID NO: 1342778 - RNA, 11 nt, Mycobacterium tuberculosis H37Rv
ggcgacccagc

SEQ ID NO: 1342779 - RNA, 16 nt, Mycobacterium tuberculosis H37Rv
ggcgaccaugcuccua

SEQ ID NO: 1342780 - RNA, 14 nt, Mycobacterium tuberculosis H37Rv
ggcgacccgcuggg

SEQ ID NO: 1342781 - RNA, 20 nt, Mycobacterium tuberculosis H37Rv
ggcgacccggucacucuggc

SEQ ID NO: 1342782 - RNA, 21 nt, Mycobacterium tuberculosis H37Rv
ggcgacccggucacucuggcg

SEQ ID NO: 1342783 - RNA, 13 nt, Mycobacterium tuberculosis H37Rv
ggcgaccaggagc

SEQ ID NO: 1342784 - RNA, 14 nt, Mycobacterium tuberculosis H37Rv
ggcgaccaggagcc

SEQ ID NO: 1342785 - RNA, 13 nt, Mycobacterium tuberculosis H37Rv
ggcgaccggccgg

SEQ ID NO: 1342786 - RNA, 15 nt, Mycobacterium tuberculosis H37Rv
ggcgaccgcgucguc

SEQ ID NO: 1342787 - RNA, 18 nt, Mycobacterium tuberculosis H37Rv
ggcgagcggccuccagca

SEQ ID NO: 1342788 - RNA, 16 nt, Mycobacterium tuberculosis H37Rv
ggcgaggacggcggcc

SEQ ID NO: 1342789 - RNA, 13 nt, Mycobacterium tuberculosis H37Rv
ggcgaggcucccg

SEQ ID NO: 1342790 - RNA, 18 nt, Mycobacterium tuberculosis H37Rv
ggcgaggcgggagcgugg

SEQ ID NO: 1342791 - RNA, 15 nt, Mycobacterium tuberculosis H37Rv
ggcgagccggcgcgc

SEQ ID NO: 1342792 - RNA, 22 nt, Mycobacterium tuberculosis H37Rv
ggcgagccucgcgcgccacggu

SEQ ID NO: 1342793 - RNA, 13 nt, Mycobacterium tuberculosis H37Rv
ggcgagcgcccgc

SEQ ID NO: 1342794 - RNA, 11 nt, Mycobacterium tuberculosis H37Rv
ggcgagcgcgc

SEQ ID NO: 1342795 - RNA, 20 nt, Mycobacterium tuberculosis H37Rv
ggcgagcgcggccugcacca

SEQ ID NO: 1342796 - RNA, 15 nt, Mycobacterium tuberculosis H37Rv
ggcgagcggccucca

SEQ ID NO: 1342797 - RNA, 16 nt, Mycobacterium tuberculosis H37Rv
ggcgagcggccuccag

SEQ ID NO: 1342798 - RNA, 13 nt, Mycobacterium tuberculosis H37Rv
ggcgagcggccuc

SEQ ID NO: 1342799 - RNA, 13 nt, Mycobacterium tuberculosis H37Rv
ggcgagcucgucg

SEQ ID NO: 1342800 - RNA, 22 nt, Mycobacterium tuberculosis H37Rv
ggcgacugucccauacgugucg

SEQ ID NO: 1342801 - RNA, 12 nt, Mycobacterium tuberculosis H37Rv
ggcgagaagcgu

SEQ ID NO: 1342802 - RNA, 16 nt, Mycobacterium tuberculosis H37Rv
ggcgacugcagcgaag

SEQ ID NO: 1342803 - RNA, 16 nt, Mycobacterium tuberculosis H37Rv
ggcgacucugcggggc

SEQ ID NO: 1342804 - RNA, 16 nt, Mycobacterium tuberculosis H37Rv
ggcgacugcgucggcg

SEQ ID NO: 1342805 - RNA, 18 nt, Mycobacterium tuberculosis H37Rv
ggcgagagggcggggcag

SEQ ID NO: 1342806 - RNA, 18 nt, Mycobacterium tuberculosis H37Rv
ggcgagcaacucguccag

SEQ ID NO: 1342807 - RNA, 22 nt, Mycobacterium tuberculosis H37Rv
ggcgagcaccaccccagcggcc

SEQ ID NO: 1342808 - RNA, 24 nt, Mycobacterium tuberculosis H37Rv
ggcgagcaacucguccagcagugc

SEQ ID NO: 1342809 - RNA, 18 nt, Mycobacterium tuberculosis H37Rv
ggcgagcacaugcugccg

SEQ ID NO: 1342810 - RNA, 22 nt, Mycobacterium tuberculosis H37Rv
ggcgagcagacgcauaagcccc

SEQ ID NO: 1342811 - RNA, 21 nt, Mycobacterium tuberculosis H37Rv
ggcgagcagagaacuccgcca

SEQ ID NO: 1342812 - RNA, 13 nt, Mycobacterium tuberculosis H37Rv
ggcgagcagcagg

SEQ ID NO: 1342813 - RNA, 17 nt, Mycobacterium tuberculosis H37Rv
ggccuggucggccaggu

SEQ ID NO: 1342814 - RNA, 21 nt, Mycobacterium tuberculosis H37Rv
ggccugucgaagauccagcgc

SEQ ID NO: 1342815 - RNA, 22 nt, Mycobacterium tuberculosis H37Rv
ggccugucgaagauccagcgca

SEQ ID NO: 1342816 - RNA, 15 nt, Mycobacterium tuberculosis H37Rv
ggccuguucggcggc

SEQ ID NO: 1342817 - RNA, 16 nt, Mycobacterium tuberculosis H37Rv
ggccuggggcagccgg

SEQ ID NO: 1342818 - RNA, 18 nt, Mycobacterium tuberculosis H37Rv
ggccuucuccccgaucag

SEQ ID NO: 1342819 - RNA, 16 nt, Mycobacterium tuberculosis H37Rv
ggccuucagcguccag

SEQ ID NO: 1342820 - RNA, 16 nt, Mycobacterium tuberculosis H37Rv
ggccuucagcucacca

SEQ ID NO: 1342821 - RNA, 22 nt, Mycobacterium tuberculosis H37Rv
ggccuugccgaucagcuggcuc

SEQ ID NO: 1342822 - RNA, 22 nt, Mycobacterium tuberculosis H37Rv
ggccuugacgcacgacugugcg

SEQ ID NO: 1342823 - RNA, 16 nt, Mycobacterium tuberculosis H37Rv
ggccuucggccggcgu

SEQ ID NO: 1342824 - RNA, 13 nt, Mycobacterium tuberculosis H37Rv
ggccuuggcggcg

SEQ ID NO: 1342825 - RNA, 19 nt, Mycobacterium tuberculosis H37Rv
ggccuugcgucaucggcuc

SEQ ID NO: 1342826 - RNA, 14 nt, Mycobacterium tuberculosis H37Rv
ggccugcgcagacu

SEQ ID NO: 1342827 - RNA, 13 nt, Mycobacterium tuberculosis H37Rv
ggccugcgcgacc

SEQ ID NO: 1342828 - RNA, 15 nt, Mycobacterium tuberculosis H37Rv
ggccugcgcgauccg

SEQ ID NO: 1342829 - RNA, 17 nt, Mycobacterium tuberculosis H37Rv
ggccuggaucgugccga

SEQ ID NO: 1342830 - RNA, 13 nt, Mycobacterium tuberculosis H37Rv
ggccugcagccga

SEQ ID NO: 1342831 - RNA, 21 nt, Mycobacterium tuberculosis H37Rv
ggccugccauaggcccacggc

SEQ ID NO: 1342832 - RNA, 14 nt, Mycobacterium tuberculosis H37Rv
ggccugagcggcca

SEQ ID NO: 1342833 - RNA, 19 nt, Mycobacterium tuberculosis H37Rv
ggccugagcgucgucgccg

SEQ ID NO: 1342834 - RNA, 21 nt, Mycobacterium tuberculosis H37Rv
ggccugagcgucgucgccggc

SEQ ID NO: 1342835 - RNA, 22 nt, Mycobacterium tuberculosis H37Rv
ggccugcaacgucacucccugg

SEQ ID NO: 1342836 - RNA, 15 nt, Mycobacterium tuberculosis H37Rv
ggccugcacgccggc

SEQ ID NO: 1342837 - RNA, 20 nt, Mycobacterium tuberculosis H37Rv
ggccuccugcuggcccugcu

SEQ ID NO: 1342838 - RNA, 21 nt, Mycobacterium tuberculosis H37Rv
ggccuccugcuggcccugcuc

SEQ ID NO: 1342839 - RNA, 13 nt, Mycobacterium tuberculosis H37Rv
ggccucgcgagaa

SEQ ID NO: 1342840 - RNA, 21 nt, Mycobacterium tuberculosis H37Rv
ggccuccacauacgcggcggc

SEQ ID NO: 1342841 - RNA, 11 nt, Mycobacterium tuberculosis H37Rv
ggccuccucgu

SEQ ID NO: 1342842 - RNA, 13 nt, Mycobacterium tuberculosis H37Rv
ggccucccacggc

SEQ ID NO: 1342843 - RNA, 14 nt, Mycobacterium tuberculosis H37Rv
ggccucccgggccg

SEQ ID NO: 1342844 - RNA, 15 nt, Mycobacterium tuberculosis H37Rv
ggccuccgcugccgc

SEQ ID NO: 1342845 - RNA, 21 nt, Mycobacterium tuberculosis H37Rv
ggccucgucgugcaccucguc

SEQ ID NO: 1342846 - RNA, 23 nt, Mycobacterium tuberculosis H37Rv
ggccucgucgugcaccucguccc

SEQ ID NO: 1342847 - RNA, 19 nt, Mycobacterium tuberculosis H37Rv
ggccucggggaucgcaagc

SEQ ID NO: 1342848 - RNA, 14 nt, Mycobacterium tuberculosis H37Rv
ggccucgggacucc

SEQ ID NO: 1342849 - RNA, 14 nt, Mycobacterium tuberculosis H37Rv
ggccucguccagcu

SEQ ID NO: 1342850 - RNA, 23 nt, Mycobacterium tuberculosis H37Rv
ggccucggccagcgucagcuguu

SEQ ID NO: 1342851 - RNA, 15 nt, Mycobacterium tuberculosis H37Rv
ggccucgcugcucag

SEQ ID NO: 1342852 - RNA, 14 nt, Mycobacterium tuberculosis H37Rv
ggccgucggcgggc

SEQ ID NO: 1342853 - RNA, 23 nt, Mycobacterium tuberculosis H37Rv
ggccgucgcgggacaacagcaug

SEQ ID NO: 1342854 - RNA, 17 nt, Mycobacterium tuberculosis H37Rv
ggccgugaauucgccga

SEQ ID NO: 1342855 - RNA, 15 nt, Mycobacterium tuberculosis H37Rv
ggccgugagcccggc

SEQ ID NO: 1342856 - RNA, 14 nt, Mycobacterium tuberculosis H37Rv
ggccgugaccgagc

SEQ ID NO: 1342857 - RNA, 20 nt, Mycobacterium tuberculosis H37Rv
ggccgugggugucgguggcc

SEQ ID NO: 1342858 - RNA, 17 nt, Mycobacterium tuberculosis H37Rv
ggccgugucgggcgcga

SEQ ID NO: 1342859 - RNA, 20 nt, Mycobacterium tuberculosis H37Rv
ggccguuccacaucaaaacg

SEQ ID NO: 1342860 - RNA, 23 nt, Mycobacterium tuberculosis H37Rv
ggccguugcuauucgccagcgcc

SEQ ID NO: 1342861 - RNA, 15 nt, Mycobacterium tuberculosis H37Rv
ggccguugccccguc

SEQ ID NO: 1342862 - RNA, 13 nt, Mycobacterium tuberculosis H37Rv
ggccucagcccgg

SEQ ID NO: 1342863 - RNA, 20 nt, Mycobacterium tuberculosis H37Rv
ggccucagcccgucagccga

SEQ ID NO: 1342864 - RNA, 16 nt, Mycobacterium tuberculosis H37Rv
ggccucaacgccagcu

SEQ ID NO: 1342865 - RNA, 23 nt, Mycobacterium tuberculosis H37Rv
ggccuaucccgaaucucacccac

SEQ ID NO: 1342866 - RNA, 16 nt, Mycobacterium tuberculosis H37Rv
ggccuagggcggcggc

SEQ ID NO: 1342867 - RNA, 14 nt, Mycobacterium tuberculosis H37Rv
ggccuagccgcggc

SEQ ID NO: 1342868 - RNA, 16 nt, Mycobacterium tuberculosis H37Rv
ggccuagcaugaggcc

SEQ ID NO: 1342869 - RNA, 17 nt, Mycobacterium tuberculosis H37Rv
ggccuagcaugaggccc

SEQ ID NO: 1342870 - RNA, 22 nt, Mycobacterium tuberculosis H37Rv
ggccuaccaggcgcggcccagg

SEQ ID NO: 1342871 - RNA, 22 nt, Mycobacterium tuberculosis H37Rv
ggccguugacggugucuugcca

SEQ ID NO: 1342872 - RNA, 22 nt, Mycobacterium tuberculosis H37Rv
ggcgccgcccgcgccaccagca

SEQ ID NO: 1342873 - RNA, 19 nt, Mycobacterium tuberculosis H37Rv
ggcgccgcccuugccgccg

SEQ ID NO: 1342874 - RNA, 22 nt, Mycobacterium tuberculosis H37Rv
ggcgccgcagaucaccgccagc

SEQ ID NO: 1342875 - RNA, 11 nt, Mycobacterium tuberculosis H37Rv
ggcgccgcaga

SEQ ID NO: 1342876 - RNA, 14 nt, Mycobacterium tuberculosis H37Rv
ggcgccgcagcgcu

SEQ ID NO: 1342877 - RNA, 15 nt, Mycobacterium tuberculosis H37Rv
ggcgccgccaagggc

SEQ ID NO: 1342878 - RNA, 15 nt, Mycobacterium tuberculosis H37Rv
ggcgccgcggcuggg

SEQ ID NO: 1342879 - RNA, 15 nt, Mycobacterium tuberculosis H37Rv
ggcgccgccgucgcc

SEQ ID NO: 1342880 - RNA, 16 nt, Mycobacterium tuberculosis H37Rv
ggcgccgccgucgccg

SEQ ID NO: 1342881 - RNA, 19 nt, Mycobacterium tuberculosis H37Rv
ggcgccgccgugcggguuc

SEQ ID NO: 1342882 - RNA, 16 nt, Mycobacterium tuberculosis H37Rv
ggcgccgccguccagc

SEQ ID NO: 1342883 - RNA, 21 nt, Mycobacterium tuberculosis H37Rv
ggcgccgccuggacgccgccg

SEQ ID NO: 1342884 - RNA, 19 nt, Mycobacterium tuberculosis H37Rv
ggcgccgauaccggcggcg

SEQ ID NO: 1342885 - RNA, 19 nt, Mycobacterium tuberculosis H37Rv
ggcgccgcaaucagacggc

SEQ ID NO: 1342886 - RNA, 21 nt, Mycobacterium tuberculosis H37Rv
ggcgccgauuuugggaucgug

SEQ ID NO: 1342887 - RNA, 18 nt, Mycobacterium tuberculosis H37Rv
ggcgccgauaccggcggc

SEQ ID NO: 1342888 - RNA, 18 nt, Mycobacterium tuberculosis H37Rv
ggcgccgaacaccggcuc

SEQ ID NO: 1342889 - RNA, 16 nt, Mycobacterium tuberculosis H37Rv
ggcgccgagcagcccg

SEQ ID NO: 1342890 - RNA, 19 nt, Mycobacterium tuberculosis H37Rv
ggcgccgagcagcccgcgg

SEQ ID NO: 1342891 - RNA, 23 nt, Mycobacterium tuberculosis H37Rv
ggcgcccuuaagccggcgcggcg

SEQ ID NO: 1342892 - RNA, 20 nt, Mycobacterium tuberculosis H37Rv
ggcgcccuuaagccggcgcg

SEQ ID NO: 1342893 - RNA, 19 nt, Mycobacterium tuberculosis H37Rv
ggcgccgaaguagccgacc

SEQ ID NO: 1342894 - RNA, 19 nt, Mycobacterium tuberculosis H37Rv
ggcgccgaagccuugcagc

SEQ ID NO: 1342895 - RNA, 18 nt, Mycobacterium tuberculosis H37Rv
ggcgcccgugccgcccgc

SEQ ID NO: 1342896 - RNA, 16 nt, Mycobacterium tuberculosis H37Rv
ggcgcccgaagccggg

SEQ ID NO: 1342897 - RNA, 13 nt, Mycobacterium tuberculosis H37Rv
ggcgcccccgcca

SEQ ID NO: 1342898 - RNA, 23 nt, Mycobacterium tuberculosis H37Rv
ggcgcccccgccauugccgccgg

SEQ ID NO: 1342899 - RNA, 15 nt, Mycobacterium tuberculosis H37Rv
ggcgccccaccggcc

SEQ ID NO: 1342900 - RNA, 11 nt, Mycobacterium tuberculosis H37Rv
ggcgcccaggc

SEQ ID NO: 1342901 - RNA, 14 nt, Mycobacterium tuberculosis H37Rv
ggcgcccaggaacu

SEQ ID NO: 1342902 - RNA, 23 nt, Mycobacterium tuberculosis H37Rv
ggcgcccggcuuuugcgcccagc

SEQ ID NO: 1342903 - RNA, 16 nt, Mycobacterium tuberculosis H37Rv
ggcgcccgcucggccg

SEQ ID NO: 1342904 - RNA, 14 nt, Mycobacterium tuberculosis H37Rv
ggcgcccgcggucc

SEQ ID NO: 1342905 - RNA, 20 nt, Mycobacterium tuberculosis H37Rv
ggcgcccgcccgagccgcug

SEQ ID NO: 1342906 - RNA, 12 nt, Mycobacterium tuberculosis H37Rv
ggcgcccgccgc

SEQ ID NO: 1342907 - RNA, 19 nt, Mycobacterium tuberculosis H37Rv
ggcgcccgcccgagccgcu

SEQ ID NO: 1342908 - RNA, 13 nt, Mycobacterium tuberculosis H37Rv
ggcgcccgccccg

SEQ ID NO: 1342909 - RNA, 22 nt, Mycobacterium tuberculosis H37Rv
ggcgccaauggcggaccgggcc

SEQ ID NO: 1342910 - RNA, 18 nt, Mycobacterium tuberculosis H37Rv
ggcgccagaucgacgcca

SEQ ID NO: 1342911 - RNA, 12 nt, Mycobacterium tuberculosis H37Rv
ggcgccagcagu

SEQ ID NO: 1342912 - RNA, 21 nt, Mycobacterium tuberculosis H37Rv
ggcgccauuugggcccauggc

SEQ ID NO: 1342913 - RNA, 13 nt, Mycobacterium tuberculosis H37Rv
ggcgccagggccu

SEQ ID NO: 1342914 - RNA, 19 nt, Mycobacterium tuberculosis H37Rv
ggcgccaggucggcggacg

SEQ ID NO: 1342915 - RNA, 19 nt, Mycobacterium tuberculosis H37Rv
ggcgccagugcggucucga

SEQ ID NO: 1342916 - RNA, 17 nt, Mycobacterium tuberculosis H37Rv
ggcgccaguucggcggg

SEQ ID NO: 1342917 - RNA, 21 nt, Mycobacterium tuberculosis H37Rv
ggcgccaguucggcgggcgcg

SEQ ID NO: 1342918 - RNA, 16 nt, Mycobacterium tuberculosis H37Rv
ggcgccaugaagccgg

SEQ ID NO: 1342919 - RNA, 20 nt, Mycobacterium tuberculosis H37Rv
ggcgccaucccgccgcccgc

SEQ ID NO: 1342920 - RNA, 19 nt, Mycobacterium tuberculosis H37Rv
ggcgccggaacgagcggcc

SEQ ID NO: 1342921 - RNA, 17 nt, Mycobacterium tuberculosis H37Rv
ggcgccgcggcuggggg

SEQ ID NO: 1342922 - RNA, 19 nt, Mycobacterium tuberculosis H37Rv
ggcgccggauauggcagug

SEQ ID NO: 1342923 - RNA, 23 nt, Mycobacterium tuberculosis H37Rv
ggcgccggcgucggcgcccagcu

SEQ ID NO: 1342924 - RNA, 18 nt, Mycobacterium tuberculosis H37Rv
ggcgccggcgucggcgcc

SEQ ID NO: 1342925 - RNA, 13 nt, Mycobacterium tuberculosis H37Rv
ggcgccggcggcc

SEQ ID NO: 1342926 - RNA, 19 nt, Mycobacterium tuberculosis H37Rv
ggcgccggcgcugcugcca

SEQ ID NO: 1342927 - RNA, 15 nt, Mycobacterium tuberculosis H37Rv
ggcgccggcgcagau

SEQ ID NO: 1342928 - RNA, 19 nt, Mycobacterium tuberculosis H37Rv
ggcgccguuagcgucgccu

SEQ ID NO: 1342929 - RNA, 18 nt, Mycobacterium tuberculosis H37Rv
ggcgccgugccccgggcc

SEQ ID NO: 1342930 - RNA, 20 nt, Mycobacterium tuberculosis H37Rv
ggcgccgucguugugccggu

SEQ ID NO: 1342931 - RNA, 16 nt, Mycobacterium tuberculosis H37Rv
ggcgccuagcacgaag

SEQ ID NO: 1342932 - RNA, 19 nt, Mycobacterium tuberculosis H37Rv
ggcgccguugucggcggug

SEQ ID NO: 1342933 - RNA, 23 nt, Mycobacterium tuberculosis H37Rv
ggcgccgucggagccggccaccu

SEQ ID NO: 1342934 - RNA, 14 nt, Mycobacterium tuberculosis H37Rv
ggcgccggucgccg

SEQ ID NO: 1342935 - RNA, 20 nt, Mycobacterium tuberculosis H37Rv
ggcgccggucgccggcuggg

SEQ ID NO: 1342936 - RNA, 17 nt, Mycobacterium tuberculosis H37Rv
ggcgccgucggagccgg

SEQ ID NO: 1342937 - RNA, 23 nt, Mycobacterium tuberculosis H37Rv
ggcgccgguguuuccgaaacccg

SEQ ID NO: 1342938 - RNA, 18 nt, Mycobacterium tuberculosis H37Rv
ggcgccggugcggcgggc

SEQ ID NO: 1342939 - RNA, 16 nt, Mycobacterium tuberculosis H37Rv
ggcgccggugccgccg

SEQ ID NO: 1342940 - RNA, 17 nt, Mycobacterium tuberculosis H37Rv
ggcgccggugccgccgg

SEQ ID NO: 1342941 - RNA, 21 nt, Mycobacterium tuberculosis H37Rv
ggcgccggugccgccgggugc

SEQ ID NO: 1342942 - RNA, 12 nt, Mycobacterium tuberculosis H37Rv
ggcgccggggcc

SEQ ID NO: 1342943 - RNA, 12 nt, Mycobacterium tuberculosis H37Rv
ggcgccgggggc

SEQ ID NO: 1342944 - RNA, 19 nt, Mycobacterium tuberculosis H37Rv
ggcgccgggggcgccgccg

SEQ ID NO: 1342945 - RNA, 20 nt, Mycobacterium tuberculosis H37Rv
ggcgccgggucacgugggcc

SEQ ID NO: 1342946 - RNA, 14 nt, Mycobacterium tuberculosis H37Rv
ggcgccggcuugga

SEQ ID NO: 1342947 - RNA, 14 nt, Mycobacterium tuberculosis H37Rv
ggcgccugaggugc

SEQ ID NO: 1342948 - RNA, 16 nt, Mycobacterium tuberculosis H37Rv
ggcgccugaggugcug

SEQ ID NO: 1342949 - RNA, 21 nt, Mycobacterium tuberculosis H37Rv
ggcgccucggugacgucgccg

SEQ ID NO: 1342950 - RNA, 19 nt, Mycobacterium tuberculosis H37Rv
ggcgccugcugcggccagg

SEQ ID NO: 1342951 - RNA, 21 nt, Mycobacterium tuberculosis H37Rv
ggcgccugcugcggccaggga

SEQ ID NO: 1342952 - RNA, 15 nt, Mycobacterium tuberculosis H37Rv
ggcgcgaccgcggcg

SEQ ID NO: 1342953 - RNA, 16 nt, Mycobacterium tuberculosis H37Rv
ggcgccuuggucgccg

SEQ ID NO: 1342954 - RNA, 20 nt, Mycobacterium tuberculosis H37Rv
ggcgcgauccccgcgcugag

SEQ ID NO: 1342955 - RNA, 20 nt, Mycobacterium tuberculosis H37Rv
ggcgcgaugguuauccccug

SEQ ID NO: 1342956 - RNA, 20 nt, Mycobacterium tuberculosis H37Rv
ggcgcgcaacguagccagca

SEQ ID NO: 1342957 - RNA, 22 nt, Mycobacterium tuberculosis H37Rv
ggcgcgcaacguagccagcagc

SEQ ID NO: 1342958 - RNA, 24 nt, Mycobacterium tuberculosis H37Rv
ggcgcgauagauacccgcggcagc

SEQ ID NO: 1342959 - RNA, 21 nt, Mycobacterium tuberculosis H37Rv
ggcgcgaggaacgccggggcg

SEQ ID NO: 1342960 - RNA, 15 nt, Mycobacterium tuberculosis H37Rv
ggcgcaacucgacca

SEQ ID NO: 1342961 - RNA, 21 nt, Mycobacterium tuberculosis H37Rv
ggcgcaagaaugccgccgacg

SEQ ID NO: 1342962 - RNA, 18 nt, Mycobacterium tuberculosis H37Rv
ggcgcaagaaugccgccg

SEQ ID NO: 1342963 - RNA, 17 nt, Mycobacterium tuberculosis H37Rv
ggcgcaccugggcugcc

SEQ ID NO: 1342964 - RNA, 17 nt, Mycobacterium tuberculosis H37Rv
ggcgcaccaucgcggcc

SEQ ID NO: 1342965 - RNA, 18 nt, Mycobacterium tuberculosis H37Rv
ggcgcaccacaccacggu

SEQ ID NO: 1342966 - RNA, 22 nt, Mycobacterium tuberculosis H37Rv
ggcgcaccacaccacgguggcc

SEQ ID NO: 1342967 - RNA, 14 nt, Mycobacterium tuberculosis H37Rv
ggcgcagcaacgca

SEQ ID NO: 1342968 - RNA, 20 nt, Mycobacterium tuberculosis H37Rv
ggcgcacugguugggcgaga

SEQ ID NO: 1342969 - RNA, 18 nt, Mycobacterium tuberculosis H37Rv
ggcgcaccugggcugccg

SEQ ID NO: 1342970 - RNA, 14 nt, Mycobacterium tuberculosis H37Rv
ggcgcacgcccgca

SEQ ID NO: 1342971 - RNA, 17 nt, Mycobacterium tuberculosis H37Rv
ggcgcagcacggcggcc

SEQ ID NO: 1342972 - RNA, 15 nt, Mycobacterium tuberculosis H37Rv
ggcgcagcgaccggu

SEQ ID NO: 1342973 - RNA, 14 nt, Mycobacterium tuberculosis H37Rv
ggcgcagcgccagc

SEQ ID NO: 1342974 - RNA, 17 nt, Mycobacterium tuberculosis H37Rv
ggcgcauuccggcgcca

SEQ ID NO: 1342975 - RNA, 21 nt, Mycobacterium tuberculosis H37Rv
ggcgcauuccggcgccaggau

SEQ ID NO: 1342976 - RNA, 22 nt, Mycobacterium tuberculosis H37Rv
ggcgccacccgcgccgcccgcu

SEQ ID NO: 1342977 - RNA, 20 nt, Mycobacterium tuberculosis H37Rv
ggcgccaccgccgcugccgg

SEQ ID NO: 1342978 - RNA, 21 nt, Mycobacterium tuberculosis H37Rv
ggcgccaccggcgccgcccgc

SEQ ID NO: 1342979 - RNA, 17 nt, Mycobacterium tuberculosis H37Rv
ggcgcauaccggcgucg

SEQ ID NO: 1342980 - RNA, 21 nt, Mycobacterium tuberculosis H37Rv
ggcgcaguuggcaccagccgg

SEQ ID NO: 1342981 - RNA, 16 nt, Mycobacterium tuberculosis H37Rv
ggcgcauagggccacc

SEQ ID NO: 1342982 - RNA, 15 nt, Mycobacterium tuberculosis H37Rv
ggcgcauaggcggcc

SEQ ID NO: 1342983 - RNA, 16 nt, Mycobacterium tuberculosis H37Rv
ggcgcagcucaccgac

SEQ ID NO: 1342984 - RNA, 13 nt, Mycobacterium tuberculosis H37Rv
ggcgcagcgucuc

SEQ ID NO: 1342985 - RNA, 14 nt, Mycobacterium tuberculosis H37Rv
ggcgcagcucaccg

SEQ ID NO: 1342986 - RNA, 19 nt, Mycobacterium tuberculosis H37Rv
ggcgcaggucgcgcaguug

SEQ ID NO: 1342987 - RNA, 20 nt, Mycobacterium tuberculosis H37Rv
ggcgaucaacucgggcagcg

SEQ ID NO: 1342988 - RNA, 18 nt, Mycobacterium tuberculosis H37Rv
ggcgaucagcagcgccag

SEQ ID NO: 1342989 - RNA, 14 nt, Mycobacterium tuberculosis H37Rv
ggcgaucaagccuc

SEQ ID NO: 1342990 - RNA, 15 nt, Mycobacterium tuberculosis H37Rv
ggcgauccaggccag

SEQ ID NO: 1342991 - RNA, 16 nt, Mycobacterium tuberculosis H37Rv
ggcgaucagcagccgc

SEQ ID NO: 1342992 - RNA, 14 nt, Mycobacterium tuberculosis H37Rv
ggcgaucgccuggg

SEQ ID NO: 1342993 - RNA, 17 nt, Mycobacterium tuberculosis H37Rv
ggcgaucgugccgggcc

SEQ ID NO: 1342994 - RNA, 19 nt, Mycobacterium tuberculosis H37Rv
ggcgagggcggucagcggc

SEQ ID NO: 1342995 - RNA, 20 nt, Mycobacterium tuberculosis H37Rv
ggcgagggcggucagcggcc

SEQ ID NO: 1342996 - RNA, 20 nt, Mycobacterium tuberculosis H37Rv
ggcgagguauaaacgcggcg

SEQ ID NO: 1342997 - RNA, 22 nt, Mycobacterium tuberculosis H37Rv
ggcgagucgguugucggggccg

SEQ ID NO: 1342998 - RNA, 21 nt, Mycobacterium tuberculosis H37Rv
ggcgagugucuuagccagcag

SEQ ID NO: 1342999 - RNA, 20 nt, Mycobacterium tuberculosis H37Rv
ggcgaggucccggccgagcg

SEQ ID NO: 1343000 - RNA, 22 nt, Mycobacterium tuberculosis H37Rv
ggcgagugucuuagccagcagc

SEQ ID NO: 1343001 - RNA, 16 nt, Mycobacterium tuberculosis H37Rv
ggcgaguucggcagcg

SEQ ID NO: 1343002 - RNA, 23 nt, Mycobacterium tuberculosis H37Rv
ggcgauucugcgucugcucggcg

SEQ ID NO: 1343003 - RNA, 22 nt, Mycobacterium tuberculosis H37Rv
ggcgauucugugucugcucgcg

SEQ ID NO: 1343004 - RNA, 19 nt, Mycobacterium tuberculosis H37Rv
ggcgauuaccggcacgccg

SEQ ID NO: 1343005 - RNA, 22 nt, Mycobacterium tuberculosis H37Rv
ggcgauuuugcgucugcucgcg

SEQ ID NO: 1343006 - RNA, 20 nt, Mycobacterium tuberculosis H37Rv
ggcgauugucggggccgcag

SEQ ID NO: 1343007 - RNA, 19 nt, Mycobacterium tuberculosis H37Rv
ggcgaugucggcugguggg

SEQ ID NO: 1343008 - RNA, 23 nt, Mycobacterium tuberculosis H37Rv
ggcgauugcaccauggcgcgacc

SEQ ID NO: 1343009 - RNA, 20 nt, Mycobacterium tuberculosis H37Rv
ggcgaugagggcuuguggug

SEQ ID NO: 1343010 - RNA, 23 nt, Mycobacterium tuberculosis H37Rv
ggcgaugagggcuuguggugagc

SEQ ID NO: 1343011 - RNA, 14 nt, Mycobacterium tuberculosis H37Rv
ggcgaugagcgugc

SEQ ID NO: 1343012 - RNA, 23 nt, Mycobacterium tuberculosis H37Rv
ggcgaugagguggccgcgcaggg

SEQ ID NO: 1343013 - RNA, 17 nt, Mycobacterium tuberculosis H37Rv
ggcgaucugcugugucg

SEQ ID NO: 1343014 - RNA, 12 nt, Mycobacterium tuberculosis H37Rv
ggcgaucugguc

SEQ ID NO: 1343015 - RNA, 20 nt, Mycobacterium tuberculosis H37Rv
ggcgaucuggucggcggccu

SEQ ID NO: 1343016 - RNA, 21 nt, Mycobacterium tuberculosis H37Rv
ggcgaucuggucggcggccuc

SEQ ID NO: 1343017 - RNA, 22 nt, Mycobacterium tuberculosis H37Rv
ggcgaucucuaccagccgcccc

SEQ ID NO: 1343018 - RNA, 23 nt, Mycobacterium tuberculosis H37Rv
ggcgaucucgaccguauugacca

SEQ ID NO: 1343019 - RNA, 17 nt, Mycobacterium tuberculosis H37Rv
ggcgaugcugggcgaga

SEQ ID NO: 1343020 - RNA, 18 nt, Mycobacterium tuberculosis H37Rv
ggcgaugcguccgcccag

SEQ ID NO: 1343021 - RNA, 21 nt, Mycobacterium tuberculosis H37Rv
ggcgaugcgggccgccaggcg

SEQ ID NO: 1343022 - RNA, 20 nt, Mycobacterium tuberculosis H37Rv
ggcuccaccgggcccgccgu

SEQ ID NO: 1343023 - RNA, 12 nt, Mycobacterium tuberculosis H37Rv
ggcucaucgcag

SEQ ID NO: 1343024 - RNA, 15 nt, Mycobacterium tuberculosis H37Rv
ggcucagcgguggcg

SEQ ID NO: 1343025 - RNA, 22 nt, Mycobacterium tuberculosis H37Rv
ggcucagcgguggcguggugga

SEQ ID NO: 1343026 - RNA, 14 nt, Mycobacterium tuberculosis H37Rv
ggcucagcggcgac

SEQ ID NO: 1343027 - RNA, 14 nt, Mycobacterium tuberculosis H37Rv
ggcucagcgguggc

SEQ ID NO: 1343028 - RNA, 20 nt, Mycobacterium tuberculosis H37Rv
ggcucagucacgcacucccg

SEQ ID NO: 1343029 - RNA, 14 nt, Mycobacterium tuberculosis H37Rv
ggcucaccuucaga

SEQ ID NO: 1343030 - RNA, 19 nt, Mycobacterium tuberculosis H37Rv
ggcucacgucuaacacgcg

SEQ ID NO: 1343031 - RNA, 13 nt, Mycobacterium tuberculosis H37Rv
ggcucacagcaca

SEQ ID NO: 1343032 - RNA, 19 nt, Mycobacterium tuberculosis H37Rv
ggcucagcagcgccgcgcg

SEQ ID NO: 1343033 - RNA, 16 nt, Mycobacterium tuberculosis H37Rv
ggcucaaccucuggcg

SEQ ID NO: 1343034 - RNA, 15 nt, Mycobacterium tuberculosis H37Rv
ggcucaaccucuggc

SEQ ID NO: 1343035 - RNA, 20 nt, Mycobacterium tuberculosis H37Rv
ggcucaaccucuggcggcgg

SEQ ID NO: 1343036 - RNA, 20 nt, Mycobacterium tuberculosis H37Rv
ggcucgacgcgucgccggcc

SEQ ID NO: 1343037 - RNA, 20 nt, Mycobacterium tuberculosis H37Rv
ggcucgaagcuggcgccgca

SEQ ID NO: 1343038 - RNA, 19 nt, Mycobacterium tuberculosis H37Rv
ggcuccuccccggcccgcu

SEQ ID NO: 1343039 - RNA, 21 nt, Mycobacterium tuberculosis H37Rv
ggcuccuccgguaucggcgac

SEQ ID NO: 1343040 - RNA, 17 nt, Mycobacterium tuberculosis H37Rv
ggcuccgggaugaagcu

SEQ ID NO: 1343041 - RNA, 20 nt, Mycobacterium tuberculosis H37Rv
ggcuccgggaugaagcucga

SEQ ID NO: 1343042 - RNA, 16 nt, Mycobacterium tuberculosis H37Rv
ggcuccgggacgguga

SEQ ID NO: 1343043 - RNA, 14 nt, Mycobacterium tuberculosis H37Rv
ggcuccgccagcgc

SEQ ID NO: 1343044 - RNA, 22 nt, Mycobacterium tuberculosis H37Rv
ggcuccagcgcgcgccgcagcg

SEQ ID NO: 1343045 - RNA, 19 nt, Mycobacterium tuberculosis H37Rv
ggcuccagcgcgcgccgca

SEQ ID NO: 1343046 - RNA, 17 nt, Mycobacterium tuberculosis H37Rv
ggcuccagcgcgcgccg

SEQ ID NO: 1343047 - RNA, 15 nt, Mycobacterium tuberculosis H37Rv
ggcuccagcgcgcgc

SEQ ID NO: 1343048 - RNA, 22 nt, Mycobacterium tuberculosis H37Rv
ggcuccgaacauggccagcauc

SEQ ID NO: 1343049 - RNA, 16 nt, Mycobacterium tuberculosis H37Rv
ggcuccggcggcagcg

SEQ ID NO: 1343050 - RNA, 23 nt, Mycobacterium tuberculosis H37Rv
ggcucucguagcgcucagcugag

SEQ ID NO: 1343051 - RNA, 20 nt, Mycobacterium tuberculosis H37Rv
ggcucucuucgcgcgcuggg

SEQ ID NO: 1343052 - RNA, 16 nt, Mycobacterium tuberculosis H37Rv
ggcucuacucgcggcc

SEQ ID NO: 1343053 - RNA, 19 nt, Mycobacterium tuberculosis H37Rv
ggcucuagaucgccgagcg

SEQ ID NO: 1343054 - RNA, 16 nt, Mycobacterium tuberculosis H37Rv
ggcucucagcgacagc

SEQ ID NO: 1343055 - RNA, 15 nt, Mycobacterium tuberculosis H37Rv
ggcucuacguaagcg

SEQ ID NO: 1343056 - RNA, 13 nt, Mycobacterium tuberculosis H37Rv
ggcucgcucgccg

SEQ ID NO: 1343057 - RNA, 17 nt, Mycobacterium tuberculosis H37Rv
ggcucgcucgccgagcu

SEQ ID NO: 1343058 - RNA, 21 nt, Mycobacterium tuberculosis H37Rv
ggcucgcccgcuacggcagcc

SEQ ID NO: 1343059 - RNA, 21 nt, Mycobacterium tuberculosis H37Rv
ggcucgcauguucuccacgcc

SEQ ID NO: 1343060 - RNA, 13 nt, Mycobacterium tuberculosis H37Rv
ggcucgguggcgg

SEQ ID NO: 1343061 - RNA, 20 nt, Mycobacterium tuberculosis H37Rv
ggcucgguggcgccggggcg

SEQ ID NO: 1343062 - RNA, 14 nt, Mycobacterium tuberculosis H37Rv
ggcucggcaggccc

SEQ ID NO: 1343063 - RNA, 18 nt, Mycobacterium tuberculosis H37Rv
ggcucgggugcgcccggc

SEQ ID NO: 1343064 - RNA, 13 nt, Mycobacterium tuberculosis H37Rv
ggcucgggcagcg

SEQ ID NO: 1343065 - RNA, 20 nt, Mycobacterium tuberculosis H37Rv
ggcucggccagccagcgggc

SEQ ID NO: 1343066 - RNA, 13 nt, Mycobacterium tuberculosis H37Rv
ggcucggccggag

SEQ ID NO: 1343067 - RNA, 23 nt, Mycobacterium tuberculosis H37Rv
ggcugagacgguguugcucgccg

SEQ ID NO: 1343068 - RNA, 21 nt, Mycobacterium tuberculosis H37Rv
ggcugaccggggcgcccggcc

SEQ ID NO: 1343069 - RNA, 20 nt, Mycobacterium tuberculosis H37Rv
ggcugaccggggcgcccggc

SEQ ID NO: 1343070 - RNA, 18 nt, Mycobacterium tuberculosis H37Rv
ggcugaaacguccuugaa

SEQ ID NO: 1343071 - RNA, 20 nt, Mycobacterium tuberculosis H37Rv
ggcugaccgaagaagcccga

SEQ ID NO: 1343072 - RNA, 18 nt, Mycobacterium tuberculosis H37Rv
ggcugaaggacggcagcu

SEQ ID NO: 1343073 - RNA, 19 nt, Mycobacterium tuberculosis H37Rv
ggcugauuggcccaccgcc

SEQ ID NO: 1343074 - RNA, 19 nt, Mycobacterium tuberculosis H37Rv
ggcugcaccggcuugggcc

SEQ ID NO: 1343075 - RNA, 18 nt, Mycobacterium tuberculosis H37Rv
ggcugcaaccagcggcac

SEQ ID NO: 1343076 - RNA, 15 nt, Mycobacterium tuberculosis H37Rv
ggcugaugacgcgga

SEQ ID NO: 1343077 - RNA, 19 nt, Mycobacterium tuberculosis H37Rv
ggcugaucccggccaggcc

SEQ ID NO: 1343078 - RNA, 15 nt, Mycobacterium tuberculosis H37Rv
ggcugagcccgccgc

SEQ ID NO: 1343079 - RNA, 17 nt, Mycobacterium tuberculosis H37Rv
ggcugaggaacgccggc

SEQ ID NO: 1343080 - RNA, 13 nt, Mycobacterium tuberculosis H37Rv
ggcugagcccgcc

SEQ ID NO: 1343081 - RNA, 17 nt, Mycobacterium tuberculosis H37Rv
ggcugagggcccuuggc

SEQ ID NO: 1343082 - RNA, 14 nt, Mycobacterium tuberculosis H37Rv
ggcugcuguuggua

SEQ ID NO: 1343083 - RNA, 16 nt, Mycobacterium tuberculosis H37Rv
ggcugcguuggcuggu

SEQ ID NO: 1343084 - RNA, 14 nt, Mycobacterium tuberculosis H37Rv
ggcugcucgacggc

SEQ ID NO: 1343085 - RNA, 15 nt, Mycobacterium tuberculosis H37Rv
ggcugcgggcccggc

SEQ ID NO: 1343086 - RNA, 20 nt, Mycobacterium tuberculosis H37Rv
ggcugcgcgcucggccagca

SEQ ID NO: 1343087 - RNA, 22 nt, Mycobacterium tuberculosis H37Rv
ggcugcgcgcucggccagcauc

SEQ ID NO: 1343088 - RNA, 21 nt, Mycobacterium tuberculosis H37Rv
ggcugcgccgaacaccacacc

SEQ ID NO: 1343089 - RNA, 24 nt, Mycobacterium tuberculosis H37Rv
ggcugcgcuuugcacagcggcauc

SEQ ID NO: 1343090 - RNA, 15 nt, Mycobacterium tuberculosis H37Rv
ggcugcgaccggcuc

SEQ ID NO: 1343091 - RNA, 16 nt, Mycobacterium tuberculosis H37Rv
ggcugcgaccggcucc

SEQ ID NO: 1343092 - RNA, 16 nt, Mycobacterium tuberculosis H37Rv
ggcugccgcccaugcc

SEQ ID NO: 1343093 - RNA, 18 nt, Mycobacterium tuberculosis H37Rv
ggcugccgcggugccaac

SEQ ID NO: 1343094 - RNA, 19 nt, Mycobacterium tuberculosis H37Rv
ggcugccgcaaacgcggcg

SEQ ID NO: 1343095 - RNA, 12 nt, Mycobacterium tuberculosis H37Rv
ggcugcccgcgg

SEQ ID NO: 1343096 - RNA, 12 nt, Mycobacterium tuberculosis H37Rv
ggcugccacggc

SEQ ID NO: 1343097 - RNA, 15 nt, Mycobacterium tuberculosis H37Rv
ggcugccacggccuu

SEQ ID NO: 1343098 - RNA, 21 nt, Mycobacterium tuberculosis H37Rv
ggcugccagugccgcccacca

SEQ ID NO: 1343099 - RNA, 22 nt, Mycobacterium tuberculosis H37Rv
ggcuggcggcguggcgccggcc

SEQ ID NO: 1343100 - RNA, 14 nt, Mycobacterium tuberculosis H37Rv
ggcuggcggcgacc

SEQ ID NO: 1343101 - RNA, 12 nt, Mycobacterium tuberculosis H37Rv
ggcuggcggccu

SEQ ID NO: 1343102 - RNA, 13 nt, Mycobacterium tuberculosis H37Rv
ggcugggcccgcc

SEQ ID NO: 1343103 - RNA, 14 nt, Mycobacterium tuberculosis H37Rv
ggcugggcccgccg

SEQ ID NO: 1343104 - RNA, 14 nt, Mycobacterium tuberculosis H37Rv
ggcugggcgccacc

SEQ ID NO: 1343105 - RNA, 22 nt, Mycobacterium tuberculosis H37Rv
ggcuggcccaccuccucgccgg

SEQ ID NO: 1343106 - RNA, 17 nt, Mycobacterium tuberculosis H37Rv
ggcuggcaucccgggca

SEQ ID NO: 1343107 - RNA, 24 nt, Mycobacterium tuberculosis H37Rv
ggcuggcccgcaugccggcgcacc

SEQ ID NO: 1343108 - RNA, 15 nt, Mycobacterium tuberculosis H37Rv
ggcuggccgcgccuc

SEQ ID NO: 1343109 - RNA, 19 nt, Mycobacterium tuberculosis H37Rv
ggcuggaccacucgccggc

SEQ ID NO: 1343110 - RNA, 21 nt, Mycobacterium tuberculosis H37Rv
ggcuggaccacucgccggcgg

SEQ ID NO: 1343111 - RNA, 21 nt, Mycobacterium tuberculosis H37Rv
ggcugcuuggucgcccagcca

SEQ ID NO: 1343112 - RNA, 16 nt, Mycobacterium tuberculosis H37Rv
ggcuggcaccucccgg

SEQ ID NO: 1343113 - RNA, 19 nt, Mycobacterium tuberculosis H37Rv
ggcuggugggggagcggcc

SEQ ID NO: 1343114 - RNA, 19 nt, Mycobacterium tuberculosis H37Rv
ggcuggugccaacugcgcc

SEQ ID NO: 1343115 - RNA, 20 nt, Mycobacterium tuberculosis H37Rv
ggcuguaacacccggccgcc

SEQ ID NO: 1343116 - RNA, 21 nt, Mycobacterium tuberculosis H37Rv
ggcuguacucgcggcgcggcc

SEQ ID NO: 1343117 - RNA, 14 nt, Mycobacterium tuberculosis H37Rv
ggcuggggccgcuu

SEQ ID NO: 1343118 - RNA, 13 nt, Mycobacterium tuberculosis H37Rv
ggcuggucgccgu

SEQ ID NO: 1343119 - RNA, 12 nt, Mycobacterium tuberculosis H37Rv
ggcugguagcug

SEQ ID NO: 1343120 - RNA, 14 nt, Mycobacterium tuberculosis H37Rv
ggcugguaggcgcu

SEQ ID NO: 1343121 - RNA, 13 nt, Mycobacterium tuberculosis H37Rv
ggcuuccagccac

SEQ ID NO: 1343122 - RNA, 13 nt, Mycobacterium tuberculosis H37Rv
ggcuuccuccucg

SEQ ID NO: 1343123 - RNA, 15 nt, Mycobacterium tuberculosis H37Rv
ggcuuccuccucggc

SEQ ID NO: 1343124 - RNA, 16 nt, Mycobacterium tuberculosis H37Rv
ggcuuggaccagcgug

SEQ ID NO: 1343125 - RNA, 16 nt, Mycobacterium tuberculosis H37Rv
ggcuugggccagcgca

SEQ ID NO: 1343126 - RNA, 13 nt, Mycobacterium tuberculosis H37Rv
ggcuuggugccca

SEQ ID NO: 1343127 - RNA, 19 nt, Mycobacterium tuberculosis H37Rv
ggcuucgacgucggcgacc

SEQ ID NO: 1343128 - RNA, 19 nt, Mycobacterium tuberculosis H37Rv
ggcuucgccgcgggacaga

SEQ ID NO: 1343129 - RNA, 23 nt, Mycobacterium tuberculosis H37Rv
ggcuucgcuggcuugggccagcg

SEQ ID NO: 1343130 - RNA, 21 nt, Mycobacterium tuberculosis H37Rv
ggcuucgcagcgccggcgggc

SEQ ID NO: 1343131 - RNA, 18 nt, Mycobacterium tuberculosis H37Rv
ggcuuggggucccgccgg

SEQ ID NO: 1343132 - RNA, 13 nt, Mycobacterium tuberculosis H37Rv
gggcgcgucggcg

SEQ ID NO: 1343133 - RNA, 23 nt, Mycobacterium tuberculosis H37Rv
gggcgcucgcgcgcugggcgcgc

SEQ ID NO: 1343134 - RNA, 17 nt, Mycobacterium tuberculosis H37Rv
gggcgcggguggcgcca

SEQ ID NO: 1343135 - RNA, 18 nt, Mycobacterium tuberculosis H37Rv
gggcgcggguggcgccag

SEQ ID NO: 1343136 - RNA, 21 nt, Mycobacterium tuberculosis H37Rv
gggcgcgcugcccacggaggg

SEQ ID NO: 1343137 - RNA, 18 nt, Mycobacterium tuberculosis H37Rv
gggcgcgggugaccaggc

SEQ ID NO: 1343138 - RNA, 22 nt, Mycobacterium tuberculosis H37Rv
gggcgcguagcucagcgguaga

SEQ ID NO: 1343139 - RNA, 16 nt, Mycobacterium tuberculosis H37Rv
gggcgcggggcggccu

SEQ ID NO: 1343140 - RNA, 17 nt, Mycobacterium tuberculosis H37Rv
gggcguccacgcugacc

SEQ ID NO: 1343141 - RNA, 15 nt, Mycobacterium tuberculosis H37Rv
gggcguccgccggcg

SEQ ID NO: 1343142 - RNA, 20 nt, Mycobacterium tuberculosis H37Rv
gggcgguagccauccgugaa

SEQ ID NO: 1343143 - RNA, 18 nt, Mycobacterium tuberculosis H37Rv
gggcggucgcguugcaga

SEQ ID NO: 1343144 - RNA, 22 nt, Mycobacterium tuberculosis H37Rv
gggcgguggccacccggccgcg

SEQ ID NO: 1343145 - RNA, 20 nt, Mycobacterium tuberculosis H37Rv
gggcguguaaccccaggcgc

SEQ ID NO: 1343146 - RNA, 17 nt, Mycobacterium tuberculosis H37Rv
gggcguggugagcagug

SEQ ID NO: 1343147 - RNA, 13 nt, Mycobacterium tuberculosis H37Rv
gggcgugccgccg

SEQ ID NO: 1343148 - RNA, 14 nt, Mycobacterium tuberculosis H37Rv
gggcgugccgacca

SEQ ID NO: 1343149 - RNA, 14 nt, Mycobacterium tuberculosis H37Rv
gggcgucgccgccg

SEQ ID NO: 1343150 - RNA, 17 nt, Mycobacterium tuberculosis H37Rv
gggcggugaggcagcga

SEQ ID NO: 1343151 - RNA, 21 nt, Mycobacterium tuberculosis H37Rv
gggcgucgcaacccggccugg

SEQ ID NO: 1343152 - RNA, 18 nt, Mycobacterium tuberculosis H37Rv
gggcgucugcagcgggcg

SEQ ID NO: 1343153 - RNA, 19 nt, Mycobacterium tuberculosis H37Rv
gggcgugacgggcaggagc

SEQ ID NO: 1343154 - RNA, 18 nt, Mycobacterium tuberculosis H37Rv
gggcugggauagcgcggu

SEQ ID NO: 1343155 - RNA, 22 nt, Mycobacterium tuberculosis H37Rv
gggcuggguaugcacccaggca

SEQ ID NO: 1343156 - RNA, 18 nt, Mycobacterium tuberculosis H37Rv
gggcuggcuguggcgcgc

SEQ ID NO: 1343157 - RNA, 14 nt, Mycobacterium tuberculosis H37Rv
gggcuugcgcagca

SEQ ID NO: 1343158 - RNA, 14 nt, Mycobacterium tuberculosis H37Rv
gggcugccacggcc

SEQ ID NO: 1343159 - RNA, 15 nt, Mycobacterium tuberculosis H37Rv
gggcguuucggcggg

SEQ ID NO: 1343160 - RNA, 19 nt, Mycobacterium tuberculosis H37Rv
gggcugcugcucggccugg

SEQ ID NO: 1343161 - RNA, 19 nt, Mycobacterium tuberculosis H37Rv
gggcugccggccagacggu

SEQ ID NO: 1343162 - RNA, 20 nt, Mycobacterium tuberculosis H37Rv
gggcuuuagugucugcucgc

SEQ ID NO: 1343163 - RNA, 21 nt, Mycobacterium tuberculosis H37Rv
ggggaaaccggccagccgacg

SEQ ID NO: 1343164 - RNA, 21 nt, Mycobacterium tuberculosis H37Rv
ggggaagaucucggccaggau

SEQ ID NO: 1343165 - RNA, 14 nt, Mycobacterium tuberculosis H37Rv
ggggaacaccgcgg

SEQ ID NO: 1343166 - RNA, 24 nt, Mycobacterium tuberculosis H37Rv
ggggaaguuggcugagcagcgcgg

SEQ ID NO: 1343167 - RNA, 19 nt, Mycobacterium tuberculosis H37Rv
ggggaaguuggcugagcag

SEQ ID NO: 1343168 - RNA, 21 nt, Mycobacterium tuberculosis H37Rv
ggggaacguccgcgccgagcc

SEQ ID NO: 1343169 - RNA, 18 nt, Mycobacterium tuberculosis H37Rv
gggcgccacugaccgcga

SEQ ID NO: 1343170 - RNA, 16 nt, Mycobacterium tuberculosis H37Rv
gggcgcaccgcggacc

SEQ ID NO: 1343171 - RNA, 15 nt, Mycobacterium tuberculosis H37Rv
gggcgcaccgagcga

SEQ ID NO: 1343172 - RNA, 13 nt, Mycobacterium tuberculosis H37Rv
gggcgcagguugg

SEQ ID NO: 1343173 - RNA, 14 nt, Mycobacterium tuberculosis H37Rv
gggcgaugcggcgu

SEQ ID NO: 1343174 - RNA, 17 nt, Mycobacterium tuberculosis H37Rv
gggcgauggucgggaug

SEQ ID NO: 1343175 - RNA, 22 nt, Mycobacterium tuberculosis H37Rv
gggcgauuuugcgucugcucgc

SEQ ID NO: 1343176 - RNA, 21 nt, Mycobacterium tuberculosis H37Rv
gggcgaucucggcgagcacca

SEQ ID NO: 1343177 - RNA, 22 nt, Mycobacterium tuberculosis H37Rv
gggcgaucgcuucgcaagucau

SEQ ID NO: 1343178 - RNA, 16 nt, Mycobacterium tuberculosis H37Rv
gggcgaguacaggcgc

SEQ ID NO: 1343179 - RNA, 12 nt, Mycobacterium tuberculosis H37Rv
gggcgccccagg

SEQ ID NO: 1343180 - RNA, 18 nt, Mycobacterium tuberculosis H37Rv
gggcgcccgccccgcgcc

SEQ ID NO: 1343181 - RNA, 21 nt, Mycobacterium tuberculosis H37Rv
gggcgcgcuggcgggcggcgu

SEQ ID NO: 1343182 - RNA, 18 nt, Mycobacterium tuberculosis H37Rv
gggcgcgcaucugcucgg

SEQ ID NO: 1343183 - RNA, 17 nt, Mycobacterium tuberculosis H37Rv
gggccgcggcggccagc

SEQ ID NO: 1343184 - RNA, 20 nt, Mycobacterium tuberculosis H37Rv
gggccggaugacgcccaggg

SEQ ID NO: 1343185 - RNA, 14 nt, Mycobacterium tuberculosis H37Rv
gggccgcucgccuc

SEQ ID NO: 1343186 - RNA, 22 nt, Mycobacterium tuberculosis H37Rv
gggccggacugaagccgcgagc

SEQ ID NO: 1343187 - RNA, 14 nt, Mycobacterium tuberculosis H37Rv
gggccggccgagcg

SEQ ID NO: 1343188 - RNA, 17 nt, Mycobacterium tuberculosis H37Rv
gggccggcaccgcagcg

SEQ ID NO: 1343189 - RNA, 20 nt, Mycobacterium tuberculosis H37Rv
gggccggcagcggcugggac

SEQ ID NO: 1343190 - RNA, 17 nt, Mycobacterium tuberculosis H37Rv
gggcgaauccggcgggu

SEQ ID NO: 1343191 - RNA, 18 nt, Mycobacterium tuberculosis H37Rv
gggcgaauccggcgggug

SEQ ID NO: 1343192 - RNA, 16 nt, Mycobacterium tuberculosis H37Rv
gggcgaauccggcggg

SEQ ID NO: 1343193 - RNA, 21 nt, Mycobacterium tuberculosis H37Rv
gggcgaaacgcccgggcggcg

SEQ ID NO: 1343194 - RNA, 20 nt, Mycobacterium tuberculosis H37Rv
gggcgagccaguaccaggua

SEQ ID NO: 1343195 - RNA, 15 nt, Mycobacterium tuberculosis H37Rv
gggcgagcgcggccu

SEQ ID NO: 1343196 - RNA, 14 nt, Mycobacterium tuberculosis H37Rv
gggcgagagcgcgg

SEQ ID NO: 1343197 - RNA, 17 nt, Mycobacterium tuberculosis H37Rv
gggcgagaccgcgagca

SEQ ID NO: 1343198 - RNA, 19 nt, Mycobacterium tuberculosis H37Rv
gggcgaccugcggacccac

SEQ ID NO: 1343199 - RNA, 13 nt, Mycobacterium tuberculosis H37Rv
gggcaccggccgg

SEQ ID NO: 1343200 - RNA, 22 nt, Mycobacterium tuberculosis H37Rv
gggcaccgguuugacguccagg

SEQ ID NO: 1343201 - RNA, 16 nt, Mycobacterium tuberculosis H37Rv
gggcaccgagcugagc

SEQ ID NO: 1343202 - RNA, 22 nt, Mycobacterium tuberculosis H37Rv
gggcaccgagcugagcggccag

SEQ ID NO: 1343203 - RNA, 14 nt, Mycobacterium tuberculosis H37Rv
gggcaccgagcuga

SEQ ID NO: 1343204 - RNA, 17 nt, Mycobacterium tuberculosis H37Rv
gggcaccagucgcccca

SEQ ID NO: 1343205 - RNA, 14 nt, Mycobacterium tuberculosis H37Rv
gggcaccagucgcc

SEQ ID NO: 1343206 - RNA, 19 nt, Mycobacterium tuberculosis H37Rv
gggcaccacuuggguggcg

SEQ ID NO: 1343207 - RNA, 17 nt, Mycobacterium tuberculosis H37Rv
gggcacaucgggcgugg

SEQ ID NO: 1343208 - RNA, 23 nt, Mycobacterium tuberculosis H37Rv
gggaugcucgauccacugccgcg

SEQ ID NO: 1343209 - RNA, 15 nt, Mycobacterium tuberculosis H37Rv
gggaugugcggcugc

SEQ ID NO: 1343210 - RNA, 22 nt, Mycobacterium tuberculosis H37Rv
gggaugacgguuccggucgggu

SEQ ID NO: 1343211 - RNA, 20 nt, Mycobacterium tuberculosis H37Rv
gggaugcaugucuuguggug

SEQ ID NO: 1343212 - RNA, 20 nt, Mycobacterium tuberculosis H37Rv
gggaugaagaacgcgagcgc

SEQ ID NO: 1343213 - RNA, 21 nt, Mycobacterium tuberculosis H37Rv
gggauaggccguggucgaggg

SEQ ID NO: 1343214 - RNA, 12 nt, Mycobacterium tuberculosis H37Rv
gggagcggcugc

SEQ ID NO: 1343215 - RNA, 14 nt, Mycobacterium tuberculosis H37Rv
gggagcggcguguc

SEQ ID NO: 1343216 - RNA, 20 nt, Mycobacterium tuberculosis H37Rv
gggaggcgcggucgaccuga

SEQ ID NO: 1343217 - RNA, 12 nt, Mycobacterium tuberculosis H37Rv
gggaggcggcgc

SEQ ID NO: 1343218 - RNA, 22 nt, Mycobacterium tuberculosis H37Rv
gggagucgucggcaugggccgg

SEQ ID NO: 1343219 - RNA, 23 nt, Mycobacterium tuberculosis H37Rv
gggaguguguccgaaggcuuguc

SEQ ID NO: 1343220 - RNA, 22 nt, Mycobacterium tuberculosis H37Rv
gggagguacccccagcacccgg

SEQ ID NO: 1343221 - RNA, 23 nt, Mycobacterium tuberculosis H37Rv
gggaguaguggugggcguggcug

SEQ ID NO: 1343222 - RNA, 20 nt, Mycobacterium tuberculosis H37Rv
gggagucaucgcggcggcga

SEQ ID NO: 1343223 - RNA, 15 nt, Mycobacterium tuberculosis H37Rv
gggaaacccggccag

SEQ ID NO: 1343224 - RNA, 17 nt, Mycobacterium tuberculosis H37Rv
gggaaacccggccagcu

SEQ ID NO: 1343225 - RNA, 12 nt, Mycobacterium tuberculosis H37Rv
gggaaacaccgg

SEQ ID NO: 1343226 - RNA, 12 nt, Mycobacterium tuberculosis H37Rv
gggaaccaccag

SEQ ID NO: 1343227 - RNA, 20 nt, Mycobacterium tuberculosis H37Rv
gggaaccacggucagcacgc

SEQ ID NO: 1343228 - RNA, 13 nt, Mycobacterium tuberculosis H37Rv
gggaacccgagcu

SEQ ID NO: 1343229 - RNA, 22 nt, Mycobacterium tuberculosis H37Rv
gggaacguccagccguggcggc

SEQ ID NO: 1343230 - RNA, 20 nt, Mycobacterium tuberculosis H37Rv
gggaacguccgcgccgagcc

SEQ ID NO: 1343231 - RNA, 20 nt, Mycobacterium tuberculosis H37Rv
gggaaccguccaagccggcu

SEQ ID NO: 1343232 - RNA, 17 nt, Mycobacterium tuberculosis H37Rv
gggaacgaugccgccgg

SEQ ID NO: 1343233 - RNA, 21 nt, Mycobacterium tuberculosis H37Rv
gggaacaggccguaccaguua

SEQ ID NO: 1343234 - RNA, 20 nt, Mycobacterium tuberculosis H37Rv
gggccagaucgaagcgcagc

SEQ ID NO: 1343235 - RNA, 23 nt, Mycobacterium tuberculosis H37Rv
gggccacugagccacagggaagc

SEQ ID NO: 1343236 - RNA, 15 nt, Mycobacterium tuberculosis H37Rv
gggccacguagcagc

SEQ ID NO: 1343237 - RNA, 22 nt, Mycobacterium tuberculosis H37Rv
gggccacgcuucuuccgcgcgc

SEQ ID NO: 1343238 - RNA, 22 nt, Mycobacterium tuberculosis H37Rv
gggccaccgccgccugcccggc

SEQ ID NO: 1343239 - RNA, 19 nt, Mycobacterium tuberculosis H37Rv
gggccaccaccacggccag

SEQ ID NO: 1343240 - RNA, 13 nt, Mycobacterium tuberculosis H37Rv
gggccaccaccuc

SEQ ID NO: 1343241 - RNA, 18 nt, Mycobacterium tuberculosis H37Rv
gggccaccacgcgccgca

SEQ ID NO: 1343242 - RNA, 17 nt, Mycobacterium tuberculosis H37Rv
gggccaagacggcgggc

SEQ ID NO: 1343243 - RNA, 17 nt, Mycobacterium tuberculosis H37Rv
gggccaccaccacggcc

SEQ ID NO: 1343244 - RNA, 16 nt, Mycobacterium tuberculosis H37Rv
gggccaccaccacggc

SEQ ID NO: 1343245 - RNA, 13 nt, Mycobacterium tuberculosis H37Rv
gggcaugucgccg

SEQ ID NO: 1343246 - RNA, 17 nt, Mycobacterium tuberculosis H37Rv
gggccaaagccgucagc

SEQ ID NO: 1343247 - RNA, 15 nt, Mycobacterium tuberculosis H37Rv
gggccagcacccgcu

SEQ ID NO: 1343248 - RNA, 22 nt, Mycobacterium tuberculosis H37Rv
gggccagauuucugggagccgg

SEQ ID NO: 1343249 - RNA, 21 nt, Mycobacterium tuberculosis H37Rv
gggcccccaaucagugcagcg

SEQ ID NO: 1343250 - RNA, 21 nt, Mycobacterium tuberculosis H37Rv
gggcccgaccuguccacccag

SEQ ID NO: 1343251 - RNA, 22 nt, Mycobacterium tuberculosis H37Rv
gggcccgccgucuuggcccggu

SEQ ID NO: 1343252 - RNA, 11 nt, Mycobacterium tuberculosis H37Rv
gggcccgccgu

SEQ ID NO: 1343253 - RNA, 12 nt, Mycobacterium tuberculosis H37Rv
gggcccgccagc

SEQ ID NO: 1343254 - RNA, 20 nt, Mycobacterium tuberculosis H37Rv
gggcccuccacugcgagcgc

SEQ ID NO: 1343255 - RNA, 13 nt, Mycobacterium tuberculosis H37Rv
gggccgcgcggcg

SEQ ID NO: 1343256 - RNA, 14 nt, Mycobacterium tuberculosis H37Rv
gggccgcggccaca

SEQ ID NO: 1343257 - RNA, 20 nt, Mycobacterium tuberculosis H37Rv
gggccgcggccacaucgcca

SEQ ID NO: 1343258 - RNA, 12 nt, Mycobacterium tuberculosis H37Rv
gggccgcgcuga

SEQ ID NO: 1343259 - RNA, 16 nt, Mycobacterium tuberculosis H37Rv
gggcccgcgcggcggu

SEQ ID NO: 1343260 - RNA, 14 nt, Mycobacterium tuberculosis H37Rv
gggcccgcgcggcg

SEQ ID NO: 1343261 - RNA, 14 nt, Mycobacterium tuberculosis H37Rv
gggcaguagcugug

SEQ ID NO: 1343262 - RNA, 22 nt, Mycobacterium tuberculosis H37Rv
gggcaggccccacuggugcagc

SEQ ID NO: 1343263 - RNA, 20 nt, Mycobacterium tuberculosis H37Rv
gggcagcugguaggucaccg

SEQ ID NO: 1343264 - RNA, 14 nt, Mycobacterium tuberculosis H37Rv
gggcagcuguucgg

SEQ ID NO: 1343265 - RNA, 20 nt, Mycobacterium tuberculosis H37Rv
gggcagcucguccagcgagc

SEQ ID NO: 1343266 - RNA, 22 nt, Mycobacterium tuberculosis H37Rv
gggcacgaucgucgcggccaag

SEQ ID NO: 1343267 - RNA, 21 nt, Mycobacterium tuberculosis H37Rv
gggcagucaggccuagcgcgg

SEQ ID NO: 1343268 - RNA, 16 nt, Mycobacterium tuberculosis H37Rv
gggcagucaggccuag

SEQ ID NO: 1343269 - RNA, 19 nt, Mycobacterium tuberculosis H37Rv
gggcaguuuggcggcaggu

SEQ ID NO: 1343270 - RNA, 22 nt, Mycobacterium tuberculosis H37Rv
gggcaguuguugacagacacag

SEQ ID NO: 1343271 - RNA, 13 nt, Mycobacterium tuberculosis H37Rv
gggcaucaccgcc

SEQ ID NO: 1343272 - RNA, 19 nt, Mycobacterium tuberculosis H37Rv
gggcaucagcagagccccg

SEQ ID NO: 1343273 - RNA, 20 nt, Mycobacterium tuberculosis H37Rv
gggcaucagcagagccccgg

SEQ ID NO: 1343274 - RNA, 14 nt, Mycobacterium tuberculosis H37Rv
gggcauccuucacc

SEQ ID NO: 1343275 - RNA, 14 nt, Mycobacterium tuberculosis H37Rv
gggcauggucgccg

SEQ ID NO: 1343276 - RNA, 16 nt, Mycobacterium tuberculosis H37Rv
gggcauggugguggcc

SEQ ID NO: 1343277 - RNA, 23 nt, Mycobacterium tuberculosis H37Rv
gggcaucgcgaauauagcggcgu

SEQ ID NO: 1343278 - RNA, 18 nt, Mycobacterium tuberculosis H37Rv
gggcaucgucgccgagcg

SEQ ID NO: 1343279 - RNA, 15 nt, Mycobacterium tuberculosis H37Rv
gggcaugauguugaa

SEQ ID NO: 1343280 - RNA, 15 nt, Mycobacterium tuberculosis H37Rv
gggucuugccgagca

SEQ ID NO: 1343281 - RNA, 20 nt, Mycobacterium tuberculosis H37Rv
gggucuugacggcgccaggc

SEQ ID NO: 1343282 - RNA, 18 nt, Mycobacterium tuberculosis H37Rv
gggucuggcaggccagca

SEQ ID NO: 1343283 - RNA, 15 nt, Mycobacterium tuberculosis H37Rv
gggugacgggaaacu

SEQ ID NO: 1343284 - RNA, 17 nt, Mycobacterium tuberculosis H37Rv
gggugaccaggcggcgc

SEQ ID NO: 1343285 - RNA, 18 nt, Mycobacterium tuberculosis H37Rv
gggugcgcgaggucggcg

SEQ ID NO: 1343286 - RNA, 21 nt, Mycobacterium tuberculosis H37Rv
gggugcgccgucagcccaggu

SEQ ID NO: 1343287 - RNA, 15 nt, Mycobacterium tuberculosis H37Rv
gggugccgucgggua

SEQ ID NO: 1343288 - RNA, 15 nt, Mycobacterium tuberculosis H37Rv
gggugagccgagcca

SEQ ID NO: 1343289 - RNA, 21 nt, Mycobacterium tuberculosis H37Rv
gggucugcgccgccggcggcg

SEQ ID NO: 1343290 - RNA, 16 nt, Mycobacterium tuberculosis H37Rv
gggucugcgccgccgg

SEQ ID NO: 1343291 - RNA, 14 nt, Mycobacterium tuberculosis H37Rv
gggucgugccagca

SEQ ID NO: 1343292 - RNA, 20 nt, Mycobacterium tuberculosis H37Rv
gggucgugccccggcgcggu

SEQ ID NO: 1343293 - RNA, 18 nt, Mycobacterium tuberculosis H37Rv
gggucguugaggccggug

SEQ ID NO: 1343294 - RNA, 14 nt, Mycobacterium tuberculosis H37Rv
gggucgggucccag

SEQ ID NO: 1343295 - RNA, 22 nt, Mycobacterium tuberculosis H37Rv
gggucgguuuccuccggcagca

SEQ ID NO: 1343296 - RNA, 18 nt, Mycobacterium tuberculosis H37Rv
gggucgucauugcccuug

SEQ ID NO: 1343297 - RNA, 20 nt, Mycobacterium tuberculosis H37Rv
ggguccguuuuaccucggcc

SEQ ID NO: 1343298 - RNA, 22 nt, Mycobacterium tuberculosis H37Rv
gggucgggcaaccugccgggcc

SEQ ID NO: 1343299 - RNA, 13 nt, Mycobacterium tuberculosis H37Rv
gggucgggcaccg

SEQ ID NO: 1343300 - RNA, 15 nt, Mycobacterium tuberculosis H37Rv
gggucgggcaccgcg

SEQ ID NO: 1343301 - RNA, 18 nt, Mycobacterium tuberculosis H37Rv
gggucgggacgcugccgg

SEQ ID NO: 1343302 - RNA, 20 nt, Mycobacterium tuberculosis H37Rv
ggguccagcggccgccgcgg

SEQ ID NO: 1343303 - RNA, 22 nt, Mycobacterium tuberculosis H37Rv
ggguccagcgggaucugaccca

SEQ ID NO: 1343304 - RNA, 20 nt, Mycobacterium tuberculosis H37Rv
ggguccccguaaauaucggg

SEQ ID NO: 1343305 - RNA, 16 nt, Mycobacterium tuberculosis H37Rv
ggguccaucggggccg

SEQ ID NO: 1343306 - RNA, 13 nt, Mycobacterium tuberculosis H37Rv
gggucccggccgg

SEQ ID NO: 1343307 - RNA, 20 nt, Mycobacterium tuberculosis H37Rv
ggguaucgacccuccagcac

SEQ ID NO: 1343308 - RNA, 17 nt, Mycobacterium tuberculosis H37Rv
gggucaguaggcggauc

SEQ ID NO: 1343309 - RNA, 16 nt, Mycobacterium tuberculosis H37Rv
ggguaguugaggccgu

SEQ ID NO: 1343310 - RNA, 18 nt, Mycobacterium tuberculosis H37Rv
ggguaucaaccggccggu

SEQ ID NO: 1343311 - RNA, 17 nt, Mycobacterium tuberculosis H37Rv
ggguaugcacccaggca

SEQ ID NO: 1343312 - RNA, 14 nt, Mycobacterium tuberculosis H37Rv
ggguagccaaccug

SEQ ID NO: 1343313 - RNA, 24 nt, Mycobacterium tuberculosis H37Rv
ggguacgucaccggguccggugaa

SEQ ID NO: 1343314 - RNA, 14 nt, Mycobacterium tuberculosis H37Rv
ggguacgccgggca

SEQ ID NO: 1343315 - RNA, 23 nt, Mycobacterium tuberculosis H37Rv
ggguagggcaucgucgccgagcg

SEQ ID NO: 1343316 - RNA, 13 nt, Mycobacterium tuberculosis H37Rv
ggguaggcuccca

SEQ ID NO: 1343317 - RNA, 13 nt, Mycobacterium tuberculosis H37Rv
ggguagcggcgcc

SEQ ID NO: 1343318 - RNA, 18 nt, Mycobacterium tuberculosis H37Rv
ggguagcguucaaggucu

SEQ ID NO: 1343319 - RNA, 16 nt, Mycobacterium tuberculosis H37Rv
ggguagccgcccagcg

SEQ ID NO: 1343320 - RNA, 21 nt, Mycobacterium tuberculosis H37Rv
ggggacccgcuccaagcgcgg

SEQ ID NO: 1343321 - RNA, 16 nt, Mycobacterium tuberculosis H37Rv
ggggaccacgccgacg

SEQ ID NO: 1343322 - RNA, 14 nt, Mycobacterium tuberculosis H37Rv
ggggaccccgccag

SEQ ID NO: 1343323 - RNA, 21 nt, Mycobacterium tuberculosis H37Rv
ggggacucugccacccagcac

SEQ ID NO: 1343324 - RNA, 15 nt, Mycobacterium tuberculosis H37Rv
ggggacuggcaggcc

SEQ ID NO: 1343325 - RNA, 17 nt, Mycobacterium tuberculosis H37Rv
ggggacgggcggccagg

SEQ ID NO: 1343326 - RNA, 13 nt, Mycobacterium tuberculosis H37Rv
ggguggcaccggu

SEQ ID NO: 1343327 - RNA, 17 nt, Mycobacterium tuberculosis H37Rv
ggguggccacgcccagg

SEQ ID NO: 1343328 - RNA, 24 nt, Mycobacterium tuberculosis H37Rv
ggguggcgccaggucggcggacgc

SEQ ID NO: 1343329 - RNA, 22 nt, Mycobacterium tuberculosis H37Rv
ggguggcgccaggucggcgggc

SEQ ID NO: 1343330 - RNA, 13 nt, Mycobacterium tuberculosis H37Rv
ggguggcgccagu

SEQ ID NO: 1343331 - RNA, 22 nt, Mycobacterium tuberculosis H37Rv
ggguggcgccaguucggcgggc

SEQ ID NO: 1343332 - RNA, 14 nt, Mycobacterium tuberculosis H37Rv
gggugcuggcagga

SEQ ID NO: 1343333 - RNA, 14 nt, Mycobacterium tuberculosis H37Rv
ggguggaaucaggg

SEQ ID NO: 1343334 - RNA, 16 nt, Mycobacterium tuberculosis H37Rv
gggugcgggucggcgc

SEQ ID NO: 1343335 - RNA, 16 nt, Mycobacterium tuberculosis H37Rv
ggguugcggcagcugg

SEQ ID NO: 1343336 - RNA, 24 nt, Mycobacterium tuberculosis H37Rv
ggguugaggaucccggccgggucg

SEQ ID NO: 1343337 - RNA, 19 nt, Mycobacterium tuberculosis H37Rv
ggguugacguaggcggcgg

SEQ ID NO: 1343338 - RNA, 14 nt, Mycobacterium tuberculosis H37Rv
ggguugggcggagc

SEQ ID NO: 1343339 - RNA, 23 nt, Mycobacterium tuberculosis H37Rv
ggguuucgaucuucucgcggacg

SEQ ID NO: 1343340 - RNA, 21 nt, Mycobacterium tuberculosis H37Rv
ggguuuugauagacgacccgg

SEQ ID NO: 1343341 - RNA, 19 nt, Mycobacterium tuberculosis H37Rv
gguaaccggcggcagcgau

SEQ ID NO: 1343342 - RNA, 19 nt, Mycobacterium tuberculosis H37Rv
gguaagcgaacggguaguc

SEQ ID NO: 1343343 - RNA, 14 nt, Mycobacterium tuberculosis H37Rv
gguaagcagccagc

SEQ ID NO: 1343344 - RNA, 21 nt, Mycobacterium tuberculosis H37Rv
ggucaccagcuggaacggcag

SEQ ID NO: 1343345 - RNA, 14 nt, Mycobacterium tuberculosis H37Rv
gguaugccgcccgc

SEQ ID NO: 1343346 - RNA, 22 nt, Mycobacterium tuberculosis H37Rv
ggucacgguucgcccgucgcga

SEQ ID NO: 1343347 - RNA, 21 nt, Mycobacterium tuberculosis H37Rv
ggucagccccaugaucuggug

SEQ ID NO: 1343348 - RNA, 16 nt, Mycobacterium tuberculosis H37Rv
ggucagccgcggcggc

SEQ ID NO: 1343349 - RNA, 12 nt, Mycobacterium tuberculosis H37Rv
ggucagcgccga

SEQ ID NO: 1343350 - RNA, 15 nt, Mycobacterium tuberculosis H37Rv
ggucagccuuuccac

SEQ ID NO: 1343351 - RNA, 15 nt, Mycobacterium tuberculosis H37Rv
ggucacgccgucacc

SEQ ID NO: 1343352 - RNA, 16 nt, Mycobacterium tuberculosis H37Rv
ggucacgcagcacccu

SEQ ID NO: 1343353 - RNA, 20 nt, Mycobacterium tuberculosis H37Rv
ggucaccggcuucuccucca

SEQ ID NO: 1343354 - RNA, 17 nt, Mycobacterium tuberculosis H37Rv
ggucacgcagucgggca

SEQ ID NO: 1343355 - RNA, 21 nt, Mycobacterium tuberculosis H37Rv
gguaguucuuggucaggcugg

SEQ ID NO: 1343356 - RNA, 13 nt, Mycobacterium tuberculosis H37Rv
gguaguggggugc

SEQ ID NO: 1343357 - RNA, 23 nt, Mycobacterium tuberculosis H37Rv
gguaguggggugcgggucggcgc

SEQ ID NO: 1343358 - RNA, 17 nt, Mycobacterium tuberculosis H37Rv
gguaguugucccgccgc

SEQ ID NO: 1343359 - RNA, 13 nt, Mycobacterium tuberculosis H37Rv
gguaguagcugac

SEQ ID NO: 1343360 - RNA, 16 nt, Mycobacterium tuberculosis H37Rv
gguagucggccuccuc

SEQ ID NO: 1343361 - RNA, 12 nt, Mycobacterium tuberculosis H37Rv
gguagucgccgu

SEQ ID NO: 1343362 - RNA, 23 nt, Mycobacterium tuberculosis H37Rv
gguagcaccgauuuuggcaagcu

SEQ ID NO: 1343363 - RNA, 17 nt, Mycobacterium tuberculosis H37Rv
gguagaucagcgccugg

SEQ ID NO: 1343364 - RNA, 14 nt, Mycobacterium tuberculosis H37Rv
gguagcacggucug

SEQ ID NO: 1343365 - RNA, 21 nt, Mycobacterium tuberculosis H37Rv
gguagcguucaaggucuccag

SEQ ID NO: 1343366 - RNA, 23 nt, Mycobacterium tuberculosis H37Rv
gguagcugugguggugaugggca

SEQ ID NO: 1343367 - RNA, 20 nt, Mycobacterium tuberculosis H37Rv
gguaggaacuacccgccagc

SEQ ID NO: 1343368 - RNA, 16 nt, Mycobacterium tuberculosis H37Rv
gguaggagcggguggc

SEQ ID NO: 1343369 - RNA, 14 nt, Mycobacterium tuberculosis H37Rv
gguaggcggccagc

SEQ ID NO: 1343370 - RNA, 14 nt, Mycobacterium tuberculosis H37Rv
gguaggccggugcg

SEQ ID NO: 1343371 - RNA, 13 nt, Mycobacterium tuberculosis H37Rv
gguaggcgguguc

SEQ ID NO: 1343372 - RNA, 17 nt, Mycobacterium tuberculosis H37Rv
gguaggucaccaggcug

SEQ ID NO: 1343373 - RNA, 17 nt, Mycobacterium tuberculosis H37Rv
gguaccgaucagcaggg

SEQ ID NO: 1343374 - RNA, 17 nt, Mycobacterium tuberculosis H37Rv
gguaccgcgugcgccgg

SEQ ID NO: 1343375 - RNA, 17 nt, Mycobacterium tuberculosis H37Rv
gguaccaucaccgcgcc

SEQ ID NO: 1343376 - RNA, 11 nt, Mycobacterium tuberculosis H37Rv
gguaccgcccg

SEQ ID NO: 1343377 - RNA, 17 nt, Mycobacterium tuberculosis H37Rv
gguaccggaaucggcgg

SEQ ID NO: 1343378 - RNA, 22 nt, Mycobacterium tuberculosis H37Rv
gguaccggcuucgucggccagc

SEQ ID NO: 1343379 - RNA, 23 nt, Mycobacterium tuberculosis H37Rv
gguaccgggacgaaucccgcgcc

SEQ ID NO: 1343380 - RNA, 19 nt, Mycobacterium tuberculosis H37Rv
gguaccucaacaccaggcc

SEQ ID NO: 1343381 - RNA, 23 nt, Mycobacterium tuberculosis H37Rv
gguacggaccguggcagcugcuc

SEQ ID NO: 1343382 - RNA, 19 nt, Mycobacterium tuberculosis H37Rv
gguacggucucacggcgcg

SEQ ID NO: 1343383 - RNA, 22 nt, Mycobacterium tuberculosis H37Rv
gguacugcgaugugcgugaaca

SEQ ID NO: 1343384 - RNA, 16 nt, Mycobacterium tuberculosis H37Rv
gguacugcggcucgcu

SEQ ID NO: 1343385 - RNA, 21 nt, Mycobacterium tuberculosis H37Rv
gguacgugaauuaaggugacc

SEQ ID NO: 1343386 - RNA, 15 nt, Mycobacterium tuberculosis H37Rv
gguagacauggguga

SEQ ID NO: 1343387 - RNA, 18 nt, Mycobacterium tuberculosis H37Rv
gguagaccaccugcaugu

SEQ ID NO: 1343388 - RNA, 13 nt, Mycobacterium tuberculosis H37Rv
gguagaccaugaa

SEQ ID NO: 1343389 - RNA, 14 nt, Mycobacterium tuberculosis H37Rv
gguaaugccagcgg

SEQ ID NO: 1343390 - RNA, 13 nt, Mycobacterium tuberculosis H37Rv
gguacacguccag

SEQ ID NO: 1343391 - RNA, 22 nt, Mycobacterium tuberculosis H37Rv
gguacagacacgcgcgcucgcg

SEQ ID NO: 1343392 - RNA, 20 nt, Mycobacterium tuberculosis H37Rv
gguacacccgcucgcccgcc

SEQ ID NO: 1343393 - RNA, 14 nt, Mycobacterium tuberculosis H37Rv
gguacaccaggccg

SEQ ID NO: 1343394 - RNA, 14 nt, Mycobacterium tuberculosis H37Rv
gguaauucgcggcc

SEQ ID NO: 1343395 - RNA, 18 nt, Mycobacterium tuberculosis H37Rv
gguaauucuugacgccga

SEQ ID NO: 1343396 - RNA, 22 nt, Mycobacterium tuberculosis H37Rv
ggugucggugguaccggcggcg

SEQ ID NO: 1343397 - RNA, 15 nt, Mycobacterium tuberculosis H37Rv
ggugucgggcagcaa

SEQ ID NO: 1343398 - RNA, 16 nt, Mycobacterium tuberculosis H37Rv
ggugucgacgcgggcg

SEQ ID NO: 1343399 - RNA, 18 nt, Mycobacterium tuberculosis H37Rv
gguguccagccacgcugu

SEQ ID NO: 1343400 - RNA, 17 nt, Mycobacterium tuberculosis H37Rv
gguguccccgcccggcc

SEQ ID NO: 1343401 - RNA, 15 nt, Mycobacterium tuberculosis H37Rv
ggugguuguggcggg

SEQ ID NO: 1343402 - RNA, 13 nt, Mycobacterium tuberculosis H37Rv
gguggugacacga

SEQ ID NO: 1343403 - RNA, 20 nt, Mycobacterium tuberculosis H37Rv
gguggugggccguggguguc

SEQ ID NO: 1343404 - RNA, 23 nt, Mycobacterium tuberculosis H37Rv
ggugguuagguggcuggcugugc

SEQ ID NO: 1343405 - RNA, 23 nt, Mycobacterium tuberculosis H37Rv
gguggcgucaccgccggugcuga

SEQ ID NO: 1343406 - RNA, 18 nt, Mycobacterium tuberculosis H37Rv
gguggcguuugaugcggg

SEQ ID NO: 1343407 - RNA, 23 nt, Mycobacterium tuberculosis H37Rv
gguggcguccagggcgccgaucg

SEQ ID NO: 1343408 - RNA, 14 nt, Mycobacterium tuberculosis H37Rv
gguggcgggcuugc

SEQ ID NO: 1343409 - RNA, 16 nt, Mycobacterium tuberculosis H37Rv
gguggcuugccccgcc

SEQ ID NO: 1343410 - RNA, 16 nt, Mycobacterium tuberculosis H37Rv
ggugggcagcagcugg

SEQ ID NO: 1343411 - RNA, 18 nt, Mycobacterium tuberculosis H37Rv
gguggugccaaccugggc

SEQ ID NO: 1343412 - RNA, 18 nt, Mycobacterium tuberculosis H37Rv
gguggugccgcggccacc

SEQ ID NO: 1343413 - RNA, 23 nt, Mycobacterium tuberculosis H37Rv
gguggucugccaaaagggcggca

SEQ ID NO: 1343414 - RNA, 14 nt, Mycobacterium tuberculosis H37Rv
gguggucgggcgca

SEQ ID NO: 1343415 - RNA, 18 nt, Mycobacterium tuberculosis H37Rv
ggugguagcugacgcugc

SEQ ID NO: 1343416 - RNA, 15 nt, Mycobacterium tuberculosis H37Rv
ggugggccagcagca

SEQ ID NO: 1343417 - RNA, 20 nt, Mycobacterium tuberculosis H37Rv
gguggucagguuggcacgcu

SEQ ID NO: 1343418 - RNA, 23 nt, Mycobacterium tuberculosis H37Rv
gguggucacgcagucgggcagcg

SEQ ID NO: 1343419 - RNA, 17 nt, Mycobacterium tuberculosis H37Rv
gguggaguuggcugccg

SEQ ID NO: 1343420 - RNA, 16 nt, Mycobacterium tuberculosis H37Rv
gguggagcggcgcggg

SEQ ID NO: 1343421 - RNA, 21 nt, Mycobacterium tuberculosis H37Rv
gguggaaacugaugucgccga

SEQ ID NO: 1343422 - RNA, 20 nt, Mycobacterium tuberculosis H37Rv
gguggaacuccggguggcgg

SEQ ID NO: 1343423 - RNA, 21 nt, Mycobacterium tuberculosis H37Rv
gguggacgugcagccgcaggu

SEQ ID NO: 1343424 - RNA, 16 nt, Mycobacterium tuberculosis H37Rv
gguggacggcaggcgg

SEQ ID NO: 1343425 - RNA, 14 nt, Mycobacterium tuberculosis H37Rv
gguggaccggccug

SEQ ID NO: 1343426 - RNA, 21 nt, Mycobacterium tuberculosis H37Rv
gguggacgagccagaggugga

SEQ ID NO: 1343427 - RNA, 20 nt, Mycobacterium tuberculosis H37Rv
gguggaguuuccgaagcccg

SEQ ID NO: 1343428 - RNA, 22 nt, Mycobacterium tuberculosis H37Rv
gguggaguuuccgaagcccggg

SEQ ID NO: 1343429 - RNA, 15 nt, Mycobacterium tuberculosis H37Rv
gguggcgccggggcg

SEQ ID NO: 1343430 - RNA, 17 nt, Mycobacterium tuberculosis H37Rv
gguggcgccggggcgca

SEQ ID NO: 1343431 - RNA, 13 nt, Mycobacterium tuberculosis H37Rv
gguggcggcggcg

SEQ ID NO: 1343432 - RNA, 13 nt, Mycobacterium tuberculosis H37Rv
gguggcggccucc

SEQ ID NO: 1343433 - RNA, 20 nt, Mycobacterium tuberculosis H37Rv
gguggcggcgagcagcaggu

SEQ ID NO: 1343434 - RNA, 18 nt, Mycobacterium tuberculosis H37Rv
ggugcucagcggcucgcc

SEQ ID NO: 1343435 - RNA, 15 nt, Mycobacterium tuberculosis H37Rv
ggugcucagcggcuc

SEQ ID NO: 1343436 - RNA, 15 nt, Mycobacterium tuberculosis H37Rv
ggugcuacugggugg

SEQ ID NO: 1343437 - RNA, 15 nt, Mycobacterium tuberculosis H37Rv
ggugcuacuggugug

SEQ ID NO: 1343438 - RNA, 21 nt, Mycobacterium tuberculosis H37Rv
ggugcuaccggcuuggcggga

SEQ ID NO: 1343439 - RNA, 21 nt, Mycobacterium tuberculosis H37Rv
ggugcgguucgcugcggcggu

SEQ ID NO: 1343440 - RNA, 19 nt, Mycobacterium tuberculosis H37Rv
ggugcgguucgcugcggcg

SEQ ID NO: 1343441 - RNA, 18 nt, Mycobacterium tuberculosis H37Rv
ggugcgucacagccgggu

SEQ ID NO: 1343442 - RNA, 22 nt, Mycobacterium tuberculosis H37Rv
ggugcguccaggccagggcggu

SEQ ID NO: 1343443 - RNA, 20 nt, Mycobacterium tuberculosis H37Rv
ggugcguccaggccagggcg

SEQ ID NO: 1343444 - RNA, 22 nt, Mycobacterium tuberculosis H37Rv
ggugcgggcgugguaaccaggg

SEQ ID NO: 1343445 - RNA, 13 nt, Mycobacterium tuberculosis H37Rv
ggugcggggccgg

SEQ ID NO: 1343446 - RNA, 14 nt, Mycobacterium tuberculosis H37Rv
ggugcggcacgccg

SEQ ID NO: 1343447 - RNA, 20 nt, Mycobacterium tuberculosis H37Rv
ggugcggcacgccggccgcg

SEQ ID NO: 1343448 - RNA, 16 nt, Mycobacterium tuberculosis H37Rv
ggugcgccgcagcagg

SEQ ID NO: 1343449 - RNA, 15 nt, Mycobacterium tuberculosis H37Rv
ggugcggccgcggcg

SEQ ID NO: 1343450 - RNA, 20 nt, Mycobacterium tuberculosis H37Rv
ggugcggccgggucucuugc

SEQ ID NO: 1343451 - RNA, 15 nt, Mycobacterium tuberculosis H37Rv
ggugcgcgaccagga

SEQ ID NO: 1343452 - RNA, 24 nt, Mycobacterium tuberculosis H37Rv
ggugcgcgaggucggcggcgcagg

SEQ ID NO: 1343453 - RNA, 23 nt, Mycobacterium tuberculosis H37Rv
ggugcgcauggacaacagcuugg

SEQ ID NO: 1343454 - RNA, 12 nt, Mycobacterium tuberculosis H37Rv
ggugcgcacggc

SEQ ID NO: 1343455 - RNA, 16 nt, Mycobacterium tuberculosis H37Rv
ggugcgcacggcggcc

SEQ ID NO: 1343456 - RNA, 20 nt, Mycobacterium tuberculosis H37Rv
ggugcgccauucgcccggcc

SEQ ID NO: 1343457 - RNA, 22 nt, Mycobacterium tuberculosis H37Rv
ggugcgccacgaccgcggcggc

SEQ ID NO: 1343458 - RNA, 23 nt, Mycobacterium tuberculosis H37Rv
ggugcgccacgaccgcggcggca

SEQ ID NO: 1343459 - RNA, 13 nt, Mycobacterium tuberculosis H37Rv
ggugccggugcgc

SEQ ID NO: 1343460 - RNA, 19 nt, Mycobacterium tuberculosis H37Rv
ggugccgguguugccgccg

SEQ ID NO: 1343461 - RNA, 19 nt, Mycobacterium tuberculosis H37Rv
ggugccgucagcggcggcc

SEQ ID NO: 1343462 - RNA, 23 nt, Mycobacterium tuberculosis H37Rv
ggugccguugcgucugcucggcg

SEQ ID NO: 1343463 - RNA, 15 nt, Mycobacterium tuberculosis H37Rv
ggugccgggguggcg

SEQ ID NO: 1343464 - RNA, 17 nt, Mycobacterium tuberculosis H37Rv
ggugccugucagaagga

SEQ ID NO: 1343465 - RNA, 20 nt, Mycobacterium tuberculosis H37Rv
ggugccuucaccgccguucc

SEQ ID NO: 1343466 - RNA, 15 nt, Mycobacterium tuberculosis H37Rv
ggugccgggcaccac

SEQ ID NO: 1343467 - RNA, 19 nt, Mycobacterium tuberculosis H37Rv
ggugccggcguugccgccg

SEQ ID NO: 1343468 - RNA, 14 nt, Mycobacterium tuberculosis H37Rv
ggugccgggguggc

SEQ ID NO: 1343469 - RNA, 17 nt, Mycobacterium tuberculosis H37Rv
ggugccgucugcggggu

SEQ ID NO: 1343470 - RNA, 21 nt, Mycobacterium tuberculosis H37Rv
ggugccggccguucgugggca

SEQ ID NO: 1343471 - RNA, 16 nt, Mycobacterium tuberculosis H37Rv
ggugccggccaucgcc

SEQ ID NO: 1343472 - RNA, 19 nt, Mycobacterium tuberculosis H37Rv
ggugccggcguaggcagga

SEQ ID NO: 1343473 - RNA, 21 nt, Mycobacterium tuberculosis H37Rv
ggugccggcgccgcccuugcc

SEQ ID NO: 1343474 - RNA, 21 nt, Mycobacterium tuberculosis H37Rv
ggugccggcgccgccagcacc

SEQ ID NO: 1343475 - RNA, 12 nt, Mycobacterium tuberculosis H37Rv
ggugccgcccga

SEQ ID NO: 1343476 - RNA, 12 nt, Mycobacterium tuberculosis H37Rv
ggugccgcccgc

SEQ ID NO: 1343477 - RNA, 14 nt, Mycobacterium tuberculosis H37Rv
ggugccgcccgcgc

SEQ ID NO: 1343478 - RNA, 18 nt, Mycobacterium tuberculosis H37Rv
ggugccgcccgcgccucc

SEQ ID NO: 1343479 - RNA, 15 nt, Mycobacterium tuberculosis H37Rv
ggugccgcccgcgcc

SEQ ID NO: 1343480 - RNA, 19 nt, Mycobacterium tuberculosis H37Rv
ggugccgcccgcgccgccg

SEQ ID NO: 1343481 - RNA, 14 nt, Mycobacterium tuberculosis H37Rv
ggugccgccgccgg

SEQ ID NO: 1343482 - RNA, 22 nt, Mycobacterium tuberculosis H37Rv
ggugccgcggcuaggccaagcc

SEQ ID NO: 1343483 - RNA, 15 nt, Mycobacterium tuberculosis H37Rv
ggugccgcggcuagg

SEQ ID NO: 1343484 - RNA, 15 nt, Mycobacterium tuberculosis H37Rv
ggugccgccguuccc

SEQ ID NO: 1343485 - RNA, 16 nt, Mycobacterium tuberculosis H37Rv
ggugccgccugugcca

SEQ ID NO: 1343486 - RNA, 13 nt, Mycobacterium tuberculosis H37Rv
ggugccgcgcagc

SEQ ID NO: 1343487 - RNA, 15 nt, Mycobacterium tuberculosis H37Rv
ggugccgccgucgcc

SEQ ID NO: 1343488 - RNA, 16 nt, Mycobacterium tuberculosis H37Rv
ggugccgccaccaccg

SEQ ID NO: 1343489 - RNA, 14 nt, Mycobacterium tuberculosis H37Rv
ggugccgacccgcc

SEQ ID NO: 1343490 - RNA, 16 nt, Mycobacterium tuberculosis H37Rv
ggugccgacccgccgc

SEQ ID NO: 1343491 - RNA, 21 nt, Mycobacterium tuberculosis H37Rv
ggugccgagcacucggccacg

SEQ ID NO: 1343492 - RNA, 17 nt, Mycobacterium tuberculosis H37Rv
ggugcagcgugcagcgg

SEQ ID NO: 1343493 - RNA, 20 nt, Mycobacterium tuberculosis H37Rv
ggugccgaagcugcccaacc

SEQ ID NO: 1343494 - RNA, 20 nt, Mycobacterium tuberculosis H37Rv
ggugaucuugccggccagca

SEQ ID NO: 1343495 - RNA, 13 nt, Mycobacterium tuberculosis H37Rv
ggugaucgauccg

SEQ ID NO: 1343496 - RNA, 22 nt, Mycobacterium tuberculosis H37Rv
ggugaucgauccggcuccaccc

SEQ ID NO: 1343497 - RNA, 23 nt, Mycobacterium tuberculosis H37Rv
ggugaucagcaggaucggcagca

SEQ ID NO: 1343498 - RNA, 18 nt, Mycobacterium tuberculosis H37Rv
ggugaucagcucagugau

SEQ ID NO: 1343499 - RNA, 18 nt, Mycobacterium tuberculosis H37Rv
ggugcagaauucggcgcg

SEQ ID NO: 1343500 - RNA, 15 nt, Mycobacterium tuberculosis H37Rv
ggugcagcaccagcc

SEQ ID NO: 1343501 - RNA, 19 nt, Mycobacterium tuberculosis H37Rv
ggugcagcacggcgccgcc

SEQ ID NO: 1343502 - RNA, 19 nt, Mycobacterium tuberculosis H37Rv
ggugcagaucggcucaccg

SEQ ID NO: 1343503 - RNA, 21 nt, Mycobacterium tuberculosis H37Rv
ggugcacgccuugagccgagg

SEQ ID NO: 1343504 - RNA, 20 nt, Mycobacterium tuberculosis H37Rv
ggucgacggggcggucggcc

SEQ ID NO: 1343505 - RNA, 18 nt, Mycobacterium tuberculosis H37Rv
ggucgacgggucggcgcc

SEQ ID NO: 1343506 - RNA, 20 nt, Mycobacterium tuberculosis H37Rv
ggucgacgggucggcgccga

SEQ ID NO: 1343507 - RNA, 20 nt, Mycobacterium tuberculosis H37Rv
ggucgacgagauccagcgcc

SEQ ID NO: 1343508 - RNA, 19 nt, Mycobacterium tuberculosis H37Rv
ggucgacgaacaccccggg

SEQ ID NO: 1343509 - RNA, 19 nt, Mycobacterium tuberculosis H37Rv
ggucgacccaacgcagauc

SEQ ID NO: 1343510 - RNA, 17 nt, Mycobacterium tuberculosis H37Rv
gguccuugcggccgggc

SEQ ID NO: 1343511 - RNA, 23 nt, Mycobacterium tuberculosis H37Rv
ggucaggucugacagaccgggca

SEQ ID NO: 1343512 - RNA, 20 nt, Mycobacterium tuberculosis H37Rv
ggucaggucgagguccucgg

SEQ ID NO: 1343513 - RNA, 22 nt, Mycobacterium tuberculosis H37Rv
ggucaggcggccgucgucggcc

SEQ ID NO: 1343514 - RNA, 16 nt, Mycobacterium tuberculosis H37Rv
ggucaggcggcuggcc

SEQ ID NO: 1343515 - RNA, 17 nt, Mycobacterium tuberculosis H37Rv
ggucagcgggcuugccg

SEQ ID NO: 1343516 - RNA, 19 nt, Mycobacterium tuberculosis H37Rv
ggucagcugacgggccgcu

SEQ ID NO: 1343517 - RNA, 13 nt, Mycobacterium tuberculosis H37Rv
ggucagcugcugc

SEQ ID NO: 1343518 - RNA, 19 nt, Mycobacterium tuberculosis H37Rv
ggucagcgugcagguaggu

SEQ ID NO: 1343519 - RNA, 17 nt, Mycobacterium tuberculosis H37Rv
ggucagcgugcagguag

SEQ ID NO: 1343520 - RNA, 21 nt, Mycobacterium tuberculosis H37Rv
ggucagcgccgacuccaguuc

SEQ ID NO: 1343521 - RNA, 13 nt, Mycobacterium tuberculosis H37Rv
ggucagcggcugg

SEQ ID NO: 1343522 - RNA, 16 nt, Mycobacterium tuberculosis H37Rv
ggucgcaccgccggcc

SEQ ID NO: 1343523 - RNA, 18 nt, Mycobacterium tuberculosis H37Rv
ggucgagguggcgggcga

SEQ ID NO: 1343524 - RNA, 16 nt, Mycobacterium tuberculosis H37Rv
ggucgagguggggugg

SEQ ID NO: 1343525 - RNA, 19 nt, Mycobacterium tuberculosis H37Rv
ggucgccaacgccagcacc

SEQ ID NO: 1343526 - RNA, 19 nt, Mycobacterium tuberculosis H37Rv
ggucgccaccgccggcagc

SEQ ID NO: 1343527 - RNA, 20 nt, Mycobacterium tuberculosis H37Rv
ggucgccaccgccggcagca

SEQ ID NO: 1343528 - RNA, 14 nt, Mycobacterium tuberculosis H37Rv
ggucgcccgugucg

SEQ ID NO: 1343529 - RNA, 12 nt, Mycobacterium tuberculosis H37Rv
ggucgcccaggc

SEQ ID NO: 1343530 - RNA, 19 nt, Mycobacterium tuberculosis H37Rv
ggucgcccaacaccgcgcc

SEQ ID NO: 1343531 - RNA, 16 nt, Mycobacterium tuberculosis H37Rv
ggucggaacuagccag

SEQ ID NO: 1343532 - RNA, 19 nt, Mycobacterium tuberculosis H37Rv
ggucggcaucggagauacg

SEQ ID NO: 1343533 - RNA, 11 nt, Mycobacterium tuberculosis H37Rv
ggucggccacc

SEQ ID NO: 1343534 - RNA, 17 nt, Mycobacterium tuberculosis H37Rv
ggucggcacgacccggg

SEQ ID NO: 1343535 - RNA, 13 nt, Mycobacterium tuberculosis H37Rv
ggucggccaggcc

SEQ ID NO: 1343536 - RNA, 16 nt, Mycobacterium tuberculosis H37Rv
ggucggccugcggcac

SEQ ID NO: 1343537 - RNA, 13 nt, Mycobacterium tuberculosis H37Rv
ggucgccuccucg

SEQ ID NO: 1343538 - RNA, 19 nt, Mycobacterium tuberculosis H37Rv
ggucgcgacuaccaucgcc

SEQ ID NO: 1343539 - RNA, 21 nt, Mycobacterium tuberculosis H37Rv
ggucgccucgcuaacucccca

SEQ ID NO: 1343540 - RNA, 19 nt, Mycobacterium tuberculosis H37Rv
ggucgccgccaucagcccu

SEQ ID NO: 1343541 - RNA, 18 nt, Mycobacterium tuberculosis H37Rv
ggucgccggaccagagcc

SEQ ID NO: 1343542 - RNA, 14 nt, Mycobacterium tuberculosis H37Rv
ggucgccggcaccg

SEQ ID NO: 1343543 - RNA, 14 nt, Mycobacterium tuberculosis H37Rv
ggucgccgguggcc

SEQ ID NO: 1343544 - RNA, 14 nt, Mycobacterium tuberculosis H37Rv
ggugacgucgccgg

SEQ ID NO: 1343545 - RNA, 14 nt, Mycobacterium tuberculosis H37Rv
ggugacgugguggg

SEQ ID NO: 1343546 - RNA, 14 nt, Mycobacterium tuberculosis H37Rv
ggugacgcccgcuc

SEQ ID NO: 1343547 - RNA, 17 nt, Mycobacterium tuberculosis H37Rv
ggugacgccgccagcac

SEQ ID NO: 1343548 - RNA, 13 nt, Mycobacterium tuberculosis H37Rv
ggugacgccagcc

SEQ ID NO: 1343549 - RNA, 17 nt, Mycobacterium tuberculosis H37Rv
ggugacggaguuggccc

SEQ ID NO: 1343550 - RNA, 22 nt, Mycobacterium tuberculosis H37Rv
ggugacggcggcugucggccgg

SEQ ID NO: 1343551 - RNA, 23 nt, Mycobacterium tuberculosis H37Rv
ggugaguucgccggaggcaagca

SEQ ID NO: 1343552 - RNA, 21 nt, Mycobacterium tuberculosis H37Rv
ggugauagaggauaucgccga

SEQ ID NO: 1343553 - RNA, 21 nt, Mycobacterium tuberculosis H37Rv
ggugaacggcagcacggucug

SEQ ID NO: 1343554 - RNA, 15 nt, Mycobacterium tuberculosis H37Rv
ggugaacgguagcac

SEQ ID NO: 1343555 - RNA, 14 nt, Mycobacterium tuberculosis H37Rv
ggugaacccgccgg

SEQ ID NO: 1343556 - RNA, 19 nt, Mycobacterium tuberculosis H37Rv
ggugaacccgauuggggug

SEQ ID NO: 1343557 - RNA, 14 nt, Mycobacterium tuberculosis H37Rv
ggugaccgcgggcg

SEQ ID NO: 1343558 - RNA, 22 nt, Mycobacterium tuberculosis H37Rv
ggugacgaagagcaccgcgccc

SEQ ID NO: 1343559 - RNA, 19 nt, Mycobacterium tuberculosis H37Rv
ggugacgacaugguuggug

SEQ ID NO: 1343560 - RNA, 13 nt, Mycobacterium tuberculosis H37Rv
ggucgugucgcca

SEQ ID NO: 1343561 - RNA, 23 nt, Mycobacterium tuberculosis H37Rv
ggucguggugcaacacgccggcc

SEQ ID NO: 1343562 - RNA, 14 nt, Mycobacterium tuberculosis H37Rv
ggucguugaggccg

SEQ ID NO: 1343563 - RNA, 14 nt, Mycobacterium tuberculosis H37Rv
ggucguucaccgau

SEQ ID NO: 1343564 - RNA, 16 nt, Mycobacterium tuberculosis H37Rv
ggucguuggcggcggu

SEQ ID NO: 1343565 - RNA, 18 nt, Mycobacterium tuberculosis H37Rv
ggucgugaaaccacaccu

SEQ ID NO: 1343566 - RNA, 14 nt, Mycobacterium tuberculosis H37Rv
ggucguccggcggc

SEQ ID NO: 1343567 - RNA, 22 nt, Mycobacterium tuberculosis H37Rv
ggucggcgaugaugacggcggc

SEQ ID NO: 1343568 - RNA, 22 nt, Mycobacterium tuberculosis H37Rv
ggucggcgaucaugggagcggg

SEQ ID NO: 1343569 - RNA, 18 nt, Mycobacterium tuberculosis H37Rv
ggucggccugcggcaccg

SEQ ID NO: 1343570 - RNA, 16 nt, Mycobacterium tuberculosis H37Rv
ggucguugaggccggu

SEQ ID NO: 1343571 - RNA, 19 nt, Mycobacterium tuberculosis H37Rv
ggucuuggcgauccaggcc

SEQ ID NO: 1343572 - RNA, 20 nt, Mycobacterium tuberculosis H37Rv
ggucuugggcgcgggugcgc

SEQ ID NO: 1343573 - RNA, 21 nt, Mycobacterium tuberculosis H37Rv
ggucuucuucaccgccuuggu

SEQ ID NO: 1343574 - RNA, 15 nt, Mycobacterium tuberculosis H37Rv
ggucuuugagccggu

SEQ ID NO: 1343575 - RNA, 20 nt, Mycobacterium tuberculosis H37Rv
ggucuuuaauccagcgccga

SEQ ID NO: 1343576 - RNA, 16 nt, Mycobacterium tuberculosis H37Rv
ggucuugcaucgccga

SEQ ID NO: 1343577 - RNA, 19 nt, Mycobacterium tuberculosis H37Rv
guaagggacaccagcucga

SEQ ID NO: 1343578 - RNA, 16 nt, Mycobacterium tuberculosis H37Rv
guaaggcacggguguu

SEQ ID NO: 1343579 - RNA, 15 nt, Mycobacterium tuberculosis H37Rv
guaaggagccgggcc

SEQ ID NO: 1343580 - RNA, 22 nt, Mycobacterium tuberculosis H37Rv
guaagcgccaaggcgauggucu

SEQ ID NO: 1343581 - RNA, 12 nt, Mycobacterium tuberculosis H37Rv
guaagcggaugu

SEQ ID NO: 1343582 - RNA, 17 nt, Mycobacterium tuberculosis H37Rv
guaagcaccagccagcc

SEQ ID NO: 1343583 - RNA, 17 nt, Mycobacterium tuberculosis H37Rv
guaacgccgcucaucca

SEQ ID NO: 1343584 - RNA, 12 nt, Mycobacterium tuberculosis H37Rv
guaaccuccucg

SEQ ID NO: 1343585 - RNA, 20 nt, Mycobacterium tuberculosis H37Rv
guaagaaucgaagcggcugc

SEQ ID NO: 1343586 - RNA, 14 nt, Mycobacterium tuberculosis H37Rv
guaaagcucaccac

SEQ ID NO: 1343587 - RNA, 18 nt, Mycobacterium tuberculosis H37Rv
gguuaaccuccaggucgc

SEQ ID NO: 1343588 - RNA, 17 nt, Mycobacterium tuberculosis H37Rv
gguguuuaugguugugc

SEQ ID NO: 1343589 - RNA, 11 nt, Mycobacterium tuberculosis H37Rv
gguguuuuugu

SEQ ID NO: 1343590 - RNA, 16 nt, Mycobacterium tuberculosis H37Rv
gguguuucaggcagcg

SEQ ID NO: 1343591 - RNA, 18 nt, Mycobacterium tuberculosis H37Rv
guaaacaagacaugcuga

SEQ ID NO: 1343592 - RNA, 15 nt, Mycobacterium tuberculosis H37Rv
guaaagccaacuggu

SEQ ID NO: 1343593 - RNA, 19 nt, Mycobacterium tuberculosis H37Rv
guaaaccagguggccaggc

SEQ ID NO: 1343594 - RNA, 15 nt, Mycobacterium tuberculosis H37Rv
guaaaccggcugacc

SEQ ID NO: 1343595 - RNA, 22 nt, Mycobacterium tuberculosis H37Rv
guaauggccgccgguccaugga

SEQ ID NO: 1343596 - RNA, 17 nt, Mycobacterium tuberculosis H37Rv
guaaugcugcugcagca

SEQ ID NO: 1343597 - RNA, 21 nt, Mycobacterium tuberculosis H37Rv
guaccgauagccugcggcggc

SEQ ID NO: 1343598 - RNA, 18 nt, Mycobacterium tuberculosis H37Rv
guacccguuaugcgccgc

SEQ ID NO: 1343599 - RNA, 14 nt, Mycobacterium tuberculosis H37Rv
guaccgcuggacag

SEQ ID NO: 1343600 - RNA, 22 nt, Mycobacterium tuberculosis H37Rv
guaccggcaaacgcgcagguca

SEQ ID NO: 1343601 - RNA, 21 nt, Mycobacterium tuberculosis H37Rv
guaccggcuucgucggccagc

SEQ ID NO: 1343602 - RNA, 14 nt, Mycobacterium tuberculosis H37Rv
guaccgggacgaau

SEQ ID NO: 1343603 - RNA, 18 nt, Mycobacterium tuberculosis H37Rv
guaccgccacuggcgcug

SEQ ID NO: 1343604 - RNA, 22 nt, Mycobacterium tuberculosis H37Rv
guacccaccucccgcagccggg

SEQ ID NO: 1343605 - RNA, 14 nt, Mycobacterium tuberculosis H37Rv
guacccagcgcggc

SEQ ID NO: 1343606 - RNA, 12 nt, Mycobacterium tuberculosis H37Rv
guacccaccucc

SEQ ID NO: 1343607 - RNA, 14 nt, Mycobacterium tuberculosis H37Rv
guacccaucugcuc

SEQ ID NO: 1343608 - RNA, 16 nt, Mycobacterium tuberculosis H37Rv
guacccgaccagcacc

SEQ ID NO: 1343609 - RNA, 15 nt, Mycobacterium tuberculosis H37Rv
guaccccccagcgac

SEQ ID NO: 1343610 - RNA, 15 nt, Mycobacterium tuberculosis H37Rv
guacccaucugcuca

SEQ ID NO: 1343611 - RNA, 14 nt, Mycobacterium tuberculosis H37Rv
guagaccucuucgg

SEQ ID NO: 1343612 - RNA, 20 nt, Mycobacterium tuberculosis H37Rv
guagaccggaaaccacagcg

SEQ ID NO: 1343613 - RNA, 13 nt, Mycobacterium tuberculosis H37Rv
guagaccagcagg

SEQ ID NO: 1343614 - RNA, 18 nt, Mycobacterium tuberculosis H37Rv
guagacguugccaacacc

SEQ ID NO: 1343615 - RNA, 13 nt, Mycobacterium tuberculosis H37Rv
guagacggggcga

SEQ ID NO: 1343616 - RNA, 17 nt, Mycobacterium tuberculosis H37Rv
guagacgguggcgcuga

SEQ ID NO: 1343617 - RNA, 17 nt, Mycobacterium tuberculosis H37Rv
guagacuugcugcuccu

SEQ ID NO: 1343618 - RNA, 22 nt, Mycobacterium tuberculosis H37Rv
guacuggcguugccaccggagc

SEQ ID NO: 1343619 - RNA, 16 nt, Mycobacterium tuberculosis H37Rv
guacucccaggccgcc

SEQ ID NO: 1343620 - RNA, 21 nt, Mycobacterium tuberculosis H37Rv
guacucccgcgaucgcgacac

SEQ ID NO: 1343621 - RNA, 14 nt, Mycobacterium tuberculosis H37Rv
guacuugccacggc

SEQ ID NO: 1343622 - RNA, 15 nt, Mycobacterium tuberculosis H37Rv
guacuugccacggcg

SEQ ID NO: 1343623 - RNA, 16 nt, Mycobacterium tuberculosis H37Rv
guacuugaccguccac

SEQ ID NO: 1343624 - RNA, 13 nt, Mycobacterium tuberculosis H37Rv
guacgggcaggcc

SEQ ID NO: 1343625 - RNA, 17 nt, Mycobacterium tuberculosis H37Rv
guacggugguaagacgc

SEQ ID NO: 1343626 - RNA, 21 nt, Mycobacterium tuberculosis H37Rv
guacuaacaacaccaccagca

SEQ ID NO: 1343627 - RNA, 18 nt, Mycobacterium tuberculosis H37Rv
guaccucaacaccaggcc

SEQ ID NO: 1343628 - RNA, 13 nt, Mycobacterium tuberculosis H37Rv
guaccggccagcc

SEQ ID NO: 1343629 - RNA, 14 nt, Mycobacterium tuberculosis H37Rv
guacgggcaggccg

SEQ ID NO: 1343630 - RNA, 14 nt, Mycobacterium tuberculosis H37Rv
guacggcugugcga

SEQ ID NO: 1343631 - RNA, 15 nt, Mycobacterium tuberculosis H37Rv
guacggcucggcgcu

SEQ ID NO: 1343632 - RNA, 16 nt, Mycobacterium tuberculosis H37Rv
guacggcucggcgcug

SEQ ID NO: 1343633 - RNA, 11 nt, Mycobacterium tuberculosis H37Rv
guacggcggcu

SEQ ID NO: 1343634 - RNA, 22 nt, Mycobacterium tuberculosis H37Rv
guagguggccggcuugcaguga

SEQ ID NO: 1343635 - RNA, 14 nt, Mycobacterium tuberculosis H37Rv
guaggugacgacgu

SEQ ID NO: 1343636 - RNA, 20 nt, Mycobacterium tuberculosis H37Rv
guagucgccggucaggcuca

SEQ ID NO: 1343637 - RNA, 23 nt, Mycobacterium tuberculosis H37Rv
guagucccucaucaccucuccgu

SEQ ID NO: 1343638 - RNA, 16 nt, Mycobacterium tuberculosis H37Rv
guaguccucgguggcc

SEQ ID NO: 1343639 - RNA, 18 nt, Mycobacterium tuberculosis H37Rv
guagucacggucguggug

SEQ ID NO: 1343640 - RNA, 16 nt, Mycobacterium tuberculosis H37Rv
guaguccagcacggcc

SEQ ID NO: 1343641 - RNA, 19 nt, Mycobacterium tuberculosis H37Rv
guagucgggcaaggcggcg

SEQ ID NO: 1343642 - RNA, 15 nt, Mycobacterium tuberculosis H37Rv
guaggcuggccgccu

SEQ ID NO: 1343643 - RNA, 23 nt, Mycobacterium tuberculosis H37Rv
guaggcuggccgccuccgcggca

SEQ ID NO: 1343644 - RNA, 14 nt, Mycobacterium tuberculosis H37Rv
guaggggcaggcca

SEQ ID NO: 1343645 - RNA, 23 nt, Mycobacterium tuberculosis H37Rv
guaggucagcgcgucguccaggg

SEQ ID NO: 1343646 - RNA, 13 nt, Mycobacterium tuberculosis H37Rv
guagggugggucg

SEQ ID NO: 1343647 - RNA, 20 nt, Mycobacterium tuberculosis H37Rv
guaggccaccacugcgcccg

SEQ ID NO: 1343648 - RNA, 22 nt, Mycobacterium tuberculosis H37Rv
guaggccgagcauccgacacug

SEQ ID NO: 1343649 - RNA, 17 nt, Mycobacterium tuberculosis H37Rv
guaggccgcuaugcagg

SEQ ID NO: 1343650 - RNA, 16 nt, Mycobacterium tuberculosis H37Rv
guaggccggggcgucg

SEQ ID NO: 1343651 - RNA, 23 nt, Mycobacterium tuberculosis H37Rv
guaggccugcccccggcgcggcg

SEQ ID NO: 1343652 - RNA, 16 nt, Mycobacterium tuberculosis H37Rv
guaggcgaccgccauu

SEQ ID NO: 1343653 - RNA, 19 nt, Mycobacterium tuberculosis H37Rv
guagaucagcgccuggucc

SEQ ID NO: 1343654 - RNA, 20 nt, Mycobacterium tuberculosis H37Rv
guagaucucuucggagccga

SEQ ID NO: 1343655 - RNA, 21 nt, Mycobacterium tuberculosis H37Rv
guagccgugggccacgaugau

SEQ ID NO: 1343656 - RNA, 17 nt, Mycobacterium tuberculosis H37Rv
guagccguagccgccgu

SEQ ID NO: 1343657 - RNA, 13 nt, Mycobacterium tuberculosis H37Rv
guagcgacgccau

SEQ ID NO: 1343658 - RNA, 22 nt, Mycobacterium tuberculosis H37Rv
guagcgcaaugcggcccgggug

SEQ ID NO: 1343659 - RNA, 13 nt, Mycobacterium tuberculosis H37Rv
guagcgcaccaca

SEQ ID NO: 1343660 - RNA, 20 nt, Mycobacterium tuberculosis H37Rv
guagcgcaaccgcgcuugga

SEQ ID NO: 1343661 - RNA, 18 nt, Mycobacterium tuberculosis H37Rv
guagcgagcccacguggg

SEQ ID NO: 1343662 - RNA, 14 nt, Mycobacterium tuberculosis H37Rv
guagcgagcgggug

SEQ ID NO: 1343663 - RNA, 16 nt, Mycobacterium tuberculosis H37Rv
guagcguccaggucau

SEQ ID NO: 1343664 - RNA, 19 nt, Mycobacterium tuberculosis H37Rv
guagcgucgcacccagggc

SEQ ID NO: 1343665 - RNA, 17 nt, Mycobacterium tuberculosis H37Rv
guagcgccgcacuucuu

SEQ ID NO: 1343666 - RNA, 17 nt, Mycobacterium tuberculosis H37Rv
gucgcccuguucggccc

SEQ ID NO: 1343667 - RNA, 18 nt, Mycobacterium tuberculosis H37Rv
gucgccgaaguuccagcc

SEQ ID NO: 1343668 - RNA, 21 nt, Mycobacterium tuberculosis H37Rv
gucgccgaacgccaccaccuc

SEQ ID NO: 1343669 - RNA, 17 nt, Mycobacterium tuberculosis H37Rv
gucgccgaacagcagcc

SEQ ID NO: 1343670 - RNA, 23 nt, Mycobacterium tuberculosis H37Rv
gucgccgaacagcagcccgcccu

SEQ ID NO: 1343671 - RNA, 20 nt, Mycobacterium tuberculosis H37Rv
gucgccgaucgagacuucuu

SEQ ID NO: 1343672 - RNA, 16 nt, Mycobacterium tuberculosis H37Rv
gucgccgaggacgccg

SEQ ID NO: 1343673 - RNA, 20 nt, Mycobacterium tuberculosis H37Rv
gucgccgaggacgccggcgc

SEQ ID NO: 1343674 - RNA, 20 nt, Mycobacterium tuberculosis H37Rv
gucgccgaguaccggccagc

SEQ ID NO: 1343675 - RNA, 23 nt, Mycobacterium tuberculosis H37Rv
gucgccgaguaccggccagccgc

SEQ ID NO: 1343676 - RNA, 15 nt, Mycobacterium tuberculosis H37Rv
gucgccgccaccagc

SEQ ID NO: 1343677 - RNA, 17 nt, Mycobacterium tuberculosis H37Rv
gucgccgccagguugcc

SEQ ID NO: 1343678 - RNA, 21 nt, Mycobacterium tuberculosis H37Rv
gucgccgccuucuuggcggcc

SEQ ID NO: 1343679 - RNA, 16 nt, Mycobacterium tuberculosis H37Rv
gucgccgccggcgccg

SEQ ID NO: 1343680 - RNA, 11 nt, Mycobacterium tuberculosis H37Rv
gucgccgccgu

SEQ ID NO: 1343681 - RNA, 20 nt, Mycobacterium tuberculosis H37Rv
gucgccgccauugccgccgg

SEQ ID NO: 1343682 - RNA, 17 nt, Mycobacterium tuberculosis H37Rv
gucgccgcccacaugaa

SEQ ID NO: 1343683 - RNA, 21 nt, Mycobacterium tuberculosis H37Rv
gucgccgcccgugccgcccuc

SEQ ID NO: 1343684 - RNA, 15 nt, Mycobacterium tuberculosis H37Rv
gucgcccagccgagc

SEQ ID NO: 1343685 - RNA, 14 nt, Mycobacterium tuberculosis H37Rv
gucgccagggccgc

SEQ ID NO: 1343686 - RNA, 18 nt, Mycobacterium tuberculosis H37Rv
gucgccacccgacaugcg

SEQ ID NO: 1343687 - RNA, 19 nt, Mycobacterium tuberculosis H37Rv
gucgcauucugcugccagc

SEQ ID NO: 1343688 - RNA, 16 nt, Mycobacterium tuberculosis H37Rv
gucgccggucaucgcc

SEQ ID NO: 1343689 - RNA, 12 nt, Mycobacterium tuberculosis H37Rv
gucgccggugcc

SEQ ID NO: 1343690 - RNA, 18 nt, Mycobacterium tuberculosis H37Rv
gucgccggucaggccgcc

SEQ ID NO: 1343691 - RNA, 20 nt, Mycobacterium tuberculosis H37Rv
gucgccggucaggccgccgc

SEQ ID NO: 1343692 - RNA, 13 nt, Mycobacterium tuberculosis H37Rv
gucgccggcggcg

SEQ ID NO: 1343693 - RNA, 15 nt, Mycobacterium tuberculosis H37Rv
gucgccggcggcggu

SEQ ID NO: 1343694 - RNA, 14 nt, Mycobacterium tuberculosis H37Rv
gucgccggcugggg

SEQ ID NO: 1343695 - RNA, 18 nt, Mycobacterium tuberculosis H37Rv
gucgccggcgucgagccg

SEQ ID NO: 1343696 - RNA, 14 nt, Mycobacterium tuberculosis H37Rv
gucgccggccuuga

SEQ ID NO: 1343697 - RNA, 16 nt, Mycobacterium tuberculosis H37Rv
gucgccgccgcgggcg

SEQ ID NO: 1343698 - RNA, 15 nt, Mycobacterium tuberculosis H37Rv
gucgccggccggccc

SEQ ID NO: 1343699 - RNA, 15 nt, Mycobacterium tuberculosis H37Rv
gucgccgcggcggca

SEQ ID NO: 1343700 - RNA, 15 nt, Mycobacterium tuberculosis H37Rv
gucgccgcgggcagc

SEQ ID NO: 1343701 - RNA, 18 nt, Mycobacterium tuberculosis H37Rv
gucgccggaccagagcca

SEQ ID NO: 1343702 - RNA, 14 nt, Mycobacterium tuberculosis H37Rv
gucgccggaugcug

SEQ ID NO: 1343703 - RNA, 22 nt, Mycobacterium tuberculosis H37Rv
gucgcggaucagcccgcgcagc

SEQ ID NO: 1343704 - RNA, 14 nt, Mycobacterium tuberculosis H37Rv
gucgcgcgcucgcg

SEQ ID NO: 1343705 - RNA, 17 nt, Mycobacterium tuberculosis H37Rv
gucgcgcuaaggugggc

SEQ ID NO: 1343706 - RNA, 22 nt, Mycobacterium tuberculosis H37Rv
gucgcgaaauagcugcggaggg

SEQ ID NO: 1343707 - RNA, 19 nt, Mycobacterium tuberculosis H37Rv
gucgcggcuauggcgccgc

SEQ ID NO: 1343708 - RNA, 15 nt, Mycobacterium tuberculosis H37Rv
guccugggccgccgc

SEQ ID NO: 1343709 - RNA, 23 nt, Mycobacterium tuberculosis H37Rv
gucgaggcaggccucggcgccgc

SEQ ID NO: 1343710 - RNA, 18 nt, Mycobacterium tuberculosis H37Rv
gucgaggcccucgcgcgc

SEQ ID NO: 1343711 - RNA, 16 nt, Mycobacterium tuberculosis H37Rv
gucgaggucagcuccc

SEQ ID NO: 1343712 - RNA, 17 nt, Mycobacterium tuberculosis H37Rv
gucgaggucagcucccg

SEQ ID NO: 1343713 - RNA, 13 nt, Mycobacterium tuberculosis H37Rv
gucgaggucccga

SEQ ID NO: 1343714 - RNA, 14 nt, Mycobacterium tuberculosis H37Rv
gucgaggugacuug

SEQ ID NO: 1343715 - RNA, 18 nt, Mycobacterium tuberculosis H37Rv
gucgaggugggguggugg

SEQ ID NO: 1343716 - RNA, 18 nt, Mycobacterium tuberculosis H37Rv
gucgagguucucccgcgc

SEQ ID NO: 1343717 - RNA, 22 nt, Mycobacterium tuberculosis H37Rv
gucgagguucucccgcgcuugg

SEQ ID NO: 1343718 - RNA, 13 nt, Mycobacterium tuberculosis H37Rv
gucgcagcugccg

SEQ ID NO: 1343719 - RNA, 15 nt, Mycobacterium tuberculosis H37Rv
gucgcagugcacccg

SEQ ID NO: 1343720 - RNA, 22 nt, Mycobacterium tuberculosis H37Rv
gucgcacucauagaacucgccg

SEQ ID NO: 1343721 - RNA, 15 nt, Mycobacterium tuberculosis H37Rv
gucgcaccagcgaac

SEQ ID NO: 1343722 - RNA, 19 nt, Mycobacterium tuberculosis H37Rv
gucgaucagcggcagcacc

SEQ ID NO: 1343723 - RNA, 15 nt, Mycobacterium tuberculosis H37Rv
gucgauaccggcgug

SEQ ID NO: 1343724 - RNA, 14 nt, Mycobacterium tuberculosis H37Rv
gucgauaaccuggc

SEQ ID NO: 1343725 - RNA, 19 nt, Mycobacterium tuberculosis H37Rv
gucgaguuuugcggccagg

SEQ ID NO: 1343726 - RNA, 20 nt, Mycobacterium tuberculosis H37Rv
gucgaguucgcagucgauga

SEQ ID NO: 1343727 - RNA, 21 nt, Mycobacterium tuberculosis H37Rv
gucgaguagccguagccgccg

SEQ ID NO: 1343728 - RNA, 13 nt, Mycobacterium tuberculosis H37Rv
gucgaucucccag

SEQ ID NO: 1343729 - RNA, 18 nt, Mycobacterium tuberculosis H37Rv
gucgauucgucgaaggga

SEQ ID NO: 1343730 - RNA, 16 nt, Mycobacterium tuberculosis H37Rv
gucgauuggcucgccg

SEQ ID NO: 1343731 - RNA, 19 nt, Mycobacterium tuberculosis H37Rv
gucccagcugaccagcguc

SEQ ID NO: 1343732 - RNA, 16 nt, Mycobacterium tuberculosis H37Rv
gucccagcugaccagc

SEQ ID NO: 1343733 - RNA, 20 nt, Mycobacterium tuberculosis H37Rv
gucccagggcacaucgggcg

SEQ ID NO: 1343734 - RNA, 15 nt, Mycobacterium tuberculosis H37Rv
gucccagggcugccg

SEQ ID NO: 1343735 - RNA, 15 nt, Mycobacterium tuberculosis H37Rv
gucccagagaaucag

SEQ ID NO: 1343736 - RNA, 20 nt, Mycobacterium tuberculosis H37Rv
gucccagcucccgcggcgcc

SEQ ID NO: 1343737 - RNA, 15 nt, Mycobacterium tuberculosis H37Rv
guccccgcagcgccu

SEQ ID NO: 1343738 - RNA, 21 nt, Mycobacterium tuberculosis H37Rv
guccccgcagcucgaccagga

SEQ ID NO: 1343739 - RNA, 14 nt, Mycobacterium tuberculosis H37Rv
guccccgcagcgcc

SEQ ID NO: 1343740 - RNA, 16 nt, Mycobacterium tuberculosis H37Rv
guccccgcccggccag

SEQ ID NO: 1343741 - RNA, 23 nt, Mycobacterium tuberculosis H37Rv
gucccaugcacggccgagcaggu

SEQ ID NO: 1343742 - RNA, 14 nt, Mycobacterium tuberculosis H37Rv
guccccaggugggc

SEQ ID NO: 1343743 - RNA, 23 nt, Mycobacterium tuberculosis H37Rv
guccccaggugggcagcaggccc

SEQ ID NO: 1343744 - RNA, 16 nt, Mycobacterium tuberculosis H37Rv
guccaucaccggcggc

SEQ ID NO: 1343745 - RNA, 20 nt, Mycobacterium tuberculosis H37Rv
guccaucaccggcggcccca

SEQ ID NO: 1343746 - RNA, 16 nt, Mycobacterium tuberculosis H37Rv
guccaucgccaccgcg

SEQ ID NO: 1343747 - RNA, 19 nt, Mycobacterium tuberculosis H37Rv
guccauccgcagcagguga

SEQ ID NO: 1343748 - RNA, 21 nt, Mycobacterium tuberculosis H37Rv
guccaucgcgcggcugugccc

SEQ ID NO: 1343749 - RNA, 23 nt, Mycobacterium tuberculosis H37Rv
guccaucgcgcugcggcccacac

SEQ ID NO: 1343750 - RNA, 17 nt, Mycobacterium tuberculosis H37Rv
guccgccacggcgggcg

SEQ ID NO: 1343751 - RNA, 19 nt, Mycobacterium tuberculosis H37Rv
guccgcagcguccagcgcc

SEQ ID NO: 1343752 - RNA, 20 nt, Mycobacterium tuberculosis H37Rv
guccgccaaguacugggcca

SEQ ID NO: 1343753 - RNA, 16 nt, Mycobacterium tuberculosis H37Rv
guccgccaccaagaag

SEQ ID NO: 1343754 - RNA, 14 nt, Mycobacterium tuberculosis H37Rv
guccgcaccggcgg

SEQ ID NO: 1343755 - RNA, 18 nt, Mycobacterium tuberculosis H37Rv
guccgagggcgucgccgc

SEQ ID NO: 1343756 - RNA, 21 nt, Mycobacterium tuberculosis H37Rv
guccccggcugccagcgccgc

SEQ ID NO: 1343757 - RNA, 19 nt, Mycobacterium tuberculosis H37Rv
gucccgauggcgguggggc

SEQ ID NO: 1343758 - RNA, 15 nt, Mycobacterium tuberculosis H37Rv
gucccgcgagcagcc

SEQ ID NO: 1343759 - RNA, 16 nt, Mycobacterium tuberculosis H37Rv
gucccgcgagcagccc

SEQ ID NO: 1343760 - RNA, 19 nt, Mycobacterium tuberculosis H37Rv
gucccgcgagcagcccggc

SEQ ID NO: 1343761 - RNA, 22 nt, Mycobacterium tuberculosis H37Rv
gucccgccgaccgacaccacca

SEQ ID NO: 1343762 - RNA, 19 nt, Mycobacterium tuberculosis H37Rv
gucccgccgcaccgccgca

SEQ ID NO: 1343763 - RNA, 18 nt, Mycobacterium tuberculosis H37Rv
gucccgcgggccagcacc

SEQ ID NO: 1343764 - RNA, 16 nt, Mycobacterium tuberculosis H37Rv
guccgccgcagacgcc

SEQ ID NO: 1343765 - RNA, 15 nt, Mycobacterium tuberculosis H37Rv
guccgccgccugcgc

SEQ ID NO: 1343766 - RNA, 12 nt, Mycobacterium tuberculosis H37Rv
guccgcccagca

SEQ ID NO: 1343767 - RNA, 18 nt, Mycobacterium tuberculosis H37Rv
guccgcccagccgcagca

SEQ ID NO: 1343768 - RNA, 19 nt, Mycobacterium tuberculosis H37Rv
guccggcacgcgucuggaa

SEQ ID NO: 1343769 - RNA, 22 nt, Mycobacterium tuberculosis H37Rv
guccggcggccgccaucagccg

SEQ ID NO: 1343770 - RNA, 14 nt, Mycobacterium tuberculosis H37Rv
guccggcggccgcc

SEQ ID NO: 1343771 - RNA, 19 nt, Mycobacterium tuberculosis H37Rv
guccggcucauccgacggg

SEQ ID NO: 1343772 - RNA, 18 nt, Mycobacterium tuberculosis H37Rv
guccggcuuaccggcggg

SEQ ID NO: 1343773 - RNA, 12 nt, Mycobacterium tuberculosis H37Rv
guccggccacgg

SEQ ID NO: 1343774 - RNA, 16 nt, Mycobacterium tuberculosis H37Rv
guccggcccguagcug

SEQ ID NO: 1343775 - RNA, 12 nt, Mycobacterium tuberculosis H37Rv
guccggcccccc

SEQ ID NO: 1343776 - RNA, 19 nt, Mycobacterium tuberculosis H37Rv
guccugacgguacagcucc

SEQ ID NO: 1343777 - RNA, 19 nt, Mycobacterium tuberculosis H37Rv
guccugcgagaggugcugc

SEQ ID NO: 1343778 - RNA, 16 nt, Mycobacterium tuberculosis H37Rv
guccugcgccgcacgc

SEQ ID NO: 1343779 - RNA, 19 nt, Mycobacterium tuberculosis H37Rv
guccugcggguaggugacg

SEQ ID NO: 1343780 - RNA, 15 nt, Mycobacterium tuberculosis H37Rv
guccuggaucagcca

SEQ ID NO: 1343781 - RNA, 14 nt, Mycobacterium tuberculosis H37Rv
guccugcgggaggc

SEQ ID NO: 1343782 - RNA, 20 nt, Mycobacterium tuberculosis H37Rv
guccuggcguagugcagcug

SEQ ID NO: 1343783 - RNA, 16 nt, Mycobacterium tuberculosis H37Rv
guccguucgaugccag

SEQ ID NO: 1343784 - RNA, 20 nt, Mycobacterium tuberculosis H37Rv
guccuauccgggccccugau

SEQ ID NO: 1343785 - RNA, 13 nt, Mycobacterium tuberculosis H37Rv
guccuccagaucc

SEQ ID NO: 1343786 - RNA, 15 nt, Mycobacterium tuberculosis H37Rv
guccuccagauccgg

SEQ ID NO: 1343787 - RNA, 14 nt, Mycobacterium tuberculosis H37Rv
guccucaucgagcg

SEQ ID NO: 1343788 - RNA, 20 nt, Mycobacterium tuberculosis H37Rv
guccucgucgucgagguccu

SEQ ID NO: 1343789 - RNA, 16 nt, Mycobacterium tuberculosis H37Rv
gucaaggugcgccgcc

SEQ ID NO: 1343790 - RNA, 16 nt, Mycobacterium tuberculosis H37Rv
gucaaugacaccgggg

SEQ ID NO: 1343791 - RNA, 16 nt, Mycobacterium tuberculosis H37Rv
gucaaucgcgucauca

SEQ ID NO: 1343792 - RNA, 18 nt, Mycobacterium tuberculosis H37Rv
gucaagcagcagcagcuu

SEQ ID NO: 1343793 - RNA, 16 nt, Mycobacterium tuberculosis H37Rv
gucaagcaaguccacc

SEQ ID NO: 1343794 - RNA, 18 nt, Mycobacterium tuberculosis H37Rv
gucaacggccgacuuggu

SEQ ID NO: 1343795 - RNA, 14 nt, Mycobacterium tuberculosis H37Rv
gucaacgugaacug

SEQ ID NO: 1343796 - RNA, 15 nt, Mycobacterium tuberculosis H37Rv
gucaacguggauguc

SEQ ID NO: 1343797 - RNA, 11 nt, Mycobacterium tuberculosis H37Rv
gucaaccugcg

SEQ ID NO: 1343798 - RNA, 19 nt, Mycobacterium tuberculosis H37Rv
gucaaccccggaccgcggc

SEQ ID NO: 1343799 - RNA, 17 nt, Mycobacterium tuberculosis H37Rv
gucaacccguaaaagcc

SEQ ID NO: 1343800 - RNA, 12 nt, Mycobacterium tuberculosis H37Rv
gucaaccgcgcc

SEQ ID NO: 1343801 - RNA, 18 nt, Mycobacterium tuberculosis H37Rv
gucaacccgcaccccggc

SEQ ID NO: 1343802 - RNA, 17 nt, Mycobacterium tuberculosis H37Rv
gucaacagauaaggauc

SEQ ID NO: 1343803 - RNA, 18 nt, Mycobacterium tuberculosis H37Rv
gucaacagauaaggauca

SEQ ID NO: 1343804 - RNA, 14 nt, Mycobacterium tuberculosis H37Rv
gucaacaccgcggc

SEQ ID NO: 1343805 - RNA, 18 nt, Mycobacterium tuberculosis H37Rv
gucaacaccaugguggug

SEQ ID NO: 1343806 - RNA, 21 nt, Mycobacterium tuberculosis H37Rv
gucagauguuguacggcccgc

SEQ ID NO: 1343807 - RNA, 16 nt, Mycobacterium tuberculosis H37Rv
gucagaccgcgaacag

SEQ ID NO: 1343808 - RNA, 22 nt, Mycobacterium tuberculosis H37Rv
gucagacgccggccgccgaccg

SEQ ID NO: 1343809 - RNA, 11 nt, Mycobacterium tuberculosis H37Rv
gucacugcccu

SEQ ID NO: 1343810 - RNA, 19 nt, Mycobacterium tuberculosis H37Rv
gucacuacuccggucccgc

SEQ ID NO: 1343811 - RNA, 22 nt, Mycobacterium tuberculosis H37Rv
gucacugcccugauugaagccc

SEQ ID NO: 1343812 - RNA, 21 nt, Mycobacterium tuberculosis H37Rv
gucacugcgaaaaaucaugcc

SEQ ID NO: 1343813 - RNA, 18 nt, Mycobacterium tuberculosis H37Rv
gucaccgcggguggaugu

SEQ ID NO: 1343814 - RNA, 18 nt, Mycobacterium tuberculosis H37Rv
gucaccgacacggugcug

SEQ ID NO: 1343815 - RNA, 18 nt, Mycobacterium tuberculosis H37Rv
gucaccgcaaccgagcug

SEQ ID NO: 1343816 - RNA, 19 nt, Mycobacterium tuberculosis H37Rv
gucacaacgcgugaccagg

SEQ ID NO: 1343817 - RNA, 13 nt, Mycobacterium tuberculosis H37Rv
gucacaaacccag

SEQ ID NO: 1343818 - RNA, 19 nt, Mycobacterium tuberculosis H37Rv
gucaccccggucccgccga

SEQ ID NO: 1343819 - RNA, 20 nt, Mycobacterium tuberculosis H37Rv
gucacccaucucgaagguga

SEQ ID NO: 1343820 - RNA, 18 nt, Mycobacterium tuberculosis H37Rv
gucacgccgucaccgcug

SEQ ID NO: 1343821 - RNA, 18 nt, Mycobacterium tuberculosis H37Rv
gucaccgccguugccgcc

SEQ ID NO: 1343822 - RNA, 15 nt, Mycobacterium tuberculosis H37Rv
gucaccgggugcacc

SEQ ID NO: 1343823 - RNA, 20 nt, Mycobacterium tuberculosis H37Rv
gucacggugcguucgugcug

SEQ ID NO: 1343824 - RNA, 20 nt, Mycobacterium tuberculosis H37Rv
gucacguggucggccacccc

SEQ ID NO: 1343825 - RNA, 17 nt, Mycobacterium tuberculosis H37Rv
gucacguaauuccccag

SEQ ID NO: 1343826 - RNA, 16 nt, Mycobacterium tuberculosis H37Rv
gucacgggcguuguua

SEQ ID NO: 1343827 - RNA, 22 nt, Mycobacterium tuberculosis H37Rv
gucacgggguccgaugcgugcc

SEQ ID NO: 1343828 - RNA, 19 nt, Mycobacterium tuberculosis H37Rv
gucacggaccgccaccuug

SEQ ID NO: 1343829 - RNA, 17 nt, Mycobacterium tuberculosis H37Rv
gucagcugguugggggu

SEQ ID NO: 1343830 - RNA, 15 nt, Mycobacterium tuberculosis H37Rv
gucagcucgccagcc

SEQ ID NO: 1343831 - RNA, 21 nt, Mycobacterium tuberculosis H37Rv
gucaggaugaucugcgcggcc

SEQ ID NO: 1343832 - RNA, 19 nt, Mycobacterium tuberculosis H37Rv
gucaggcagcuccgccgcc

SEQ ID NO: 1343833 - RNA, 21 nt, Mycobacterium tuberculosis H37Rv
gucaggcagcuccgccgccga

SEQ ID NO: 1343834 - RNA, 19 nt, Mycobacterium tuberculosis H37Rv
gucaggcaguccaccgcgc

SEQ ID NO: 1343835 - RNA, 20 nt, Mycobacterium tuberculosis H37Rv
gucaggccgacuaaccacug

SEQ ID NO: 1343836 - RNA, 17 nt, Mycobacterium tuberculosis H37Rv
gucaggccuccaaaauc

SEQ ID NO: 1343837 - RNA, 16 nt, Mycobacterium tuberculosis H37Rv
gucaggccuccaaaau

SEQ ID NO: 1343838 - RNA, 15 nt, Mycobacterium tuberculosis H37Rv
gucaggccgccgcgg

SEQ ID NO: 1343839 - RNA, 16 nt, Mycobacterium tuberculosis H37Rv
gucaggccgccgcggc

SEQ ID NO: 1343840 - RNA, 13 nt, Mycobacterium tuberculosis H37Rv
gucaggcggcgga

SEQ ID NO: 1343841 - RNA, 14 nt, Mycobacterium tuberculosis H37Rv
gucaggcggcggac

SEQ ID NO: 1343842 - RNA, 20 nt, Mycobacterium tuberculosis H37Rv
gucaggcgugccggggauau

SEQ ID NO: 1343843 - RNA, 12 nt, Mycobacterium tuberculosis H37Rv
gucaggccagcg

SEQ ID NO: 1343844 - RNA, 15 nt, Mycobacterium tuberculosis H37Rv
gucaggcggccgucg

SEQ ID NO: 1343845 - RNA, 15 nt, Mycobacterium tuberculosis H37Rv
gucaggcucauccgc

SEQ ID NO: 1343846 - RNA, 20 nt, Mycobacterium tuberculosis H37Rv
gucaggcucauccgccgggc

SEQ ID NO: 1343847 - RNA, 14 nt, Mycobacterium tuberculosis H37Rv
gucaggcggcuggc

SEQ ID NO: 1343848 - RNA, 20 nt, Mycobacterium tuberculosis H37Rv
gucagcgaacggccaggaca

SEQ ID NO: 1343849 - RNA, 15 nt, Mycobacterium tuberculosis H37Rv
gucagccugccaggu

SEQ ID NO: 1343850 - RNA, 20 nt, Mycobacterium tuberculosis H37Rv
gucagccugccagguacuca

SEQ ID NO: 1343851 - RNA, 10 nt, Mycobacterium tuberculosis H37Rv
gucagccggu

SEQ ID NO: 1343852 - RNA, 20 nt, Mycobacterium tuberculosis H37Rv
gucagcguggacgcccgccc

SEQ ID NO: 1343853 - RNA, 14 nt, Mycobacterium tuberculosis H37Rv
gucagcgugcaggu

SEQ ID NO: 1343854 - RNA, 13 nt, Mycobacterium tuberculosis H37Rv
gucagcgugccgg

SEQ ID NO: 1343855 - RNA, 16 nt, Mycobacterium tuberculosis H37Rv
gucagcgggcagcagg

SEQ ID NO: 1343856 - RNA, 14 nt, Mycobacterium tuberculosis H37Rv
gucagcgccggcca

SEQ ID NO: 1343857 - RNA, 20 nt, Mycobacterium tuberculosis H37Rv
gucagcgcgccgucggguuc

SEQ ID NO: 1343858 - RNA, 18 nt, Mycobacterium tuberculosis H37Rv
gucagcggcugggcgguc

SEQ ID NO: 1343859 - RNA, 17 nt, Mycobacterium tuberculosis H37Rv
gucagcggcucggcggg

SEQ ID NO: 1343860 - RNA, 13 nt, Mycobacterium tuberculosis H37Rv
gucagcccggcgc

SEQ ID NO: 1343861 - RNA, 13 nt, Mycobacterium tuberculosis H37Rv
gucagccaccuga

SEQ ID NO: 1343862 - RNA, 16 nt, Mycobacterium tuberculosis H37Rv
gucagcaccccgccgc

SEQ ID NO: 1343863 - RNA, 14 nt, Mycobacterium tuberculosis H37Rv
gucagcagaugggc

SEQ ID NO: 1343864 - RNA, 16 nt, Mycobacterium tuberculosis H37Rv
gucagcagacugccga

SEQ ID NO: 1343865 - RNA, 14 nt, Mycobacterium tuberculosis H37Rv
gucaggugauucgc

SEQ ID NO: 1343866 - RNA, 21 nt, Mycobacterium tuberculosis H37Rv
gucaggugauucgcgcagcgc

SEQ ID NO: 1343867 - RNA, 16 nt, Mycobacterium tuberculosis H37Rv
gucagguggccaaugc

SEQ ID NO: 1343868 - RNA, 17 nt, Mycobacterium tuberculosis H37Rv
gucagggucagcuggga

SEQ ID NO: 1343869 - RNA, 15 nt, Mycobacterium tuberculosis H37Rv
gucagugaucaccaa

SEQ ID NO: 1343870 - RNA, 13 nt, Mycobacterium tuberculosis H37Rv
gucaucuggaagu

SEQ ID NO: 1343871 - RNA, 22 nt, Mycobacterium tuberculosis H37Rv
gucauacccagcucgucgcuga

SEQ ID NO: 1343872 - RNA, 17 nt, Mycobacterium tuberculosis H37Rv
gucaugccagucgccga

SEQ ID NO: 1343873 - RNA, 23 nt, Mycobacterium tuberculosis H37Rv
gugcgguauuugaacgcccgcuu

SEQ ID NO: 1343874 - RNA, 18 nt, Mycobacterium tuberculosis H37Rv
gugcggguucacugccgg

SEQ ID NO: 1343875 - RNA, 19 nt, Mycobacterium tuberculosis H37Rv
gugcgggcuucaacacacu

SEQ ID NO: 1343876 - RNA, 21 nt, Mycobacterium tuberculosis H37Rv
gugcgggccggucgugccggg

SEQ ID NO: 1343877 - RNA, 17 nt, Mycobacterium tuberculosis H37Rv
gugcggcgaagguagua

SEQ ID NO: 1343878 - RNA, 21 nt, Mycobacterium tuberculosis H37Rv
gugcggccguggcguggcuug

SEQ ID NO: 1343879 - RNA, 15 nt, Mycobacterium tuberculosis H37Rv
gugcggccgcggcga

SEQ ID NO: 1343880 - RNA, 13 nt, Mycobacterium tuberculosis H37Rv
gugcggcugcaac

SEQ ID NO: 1343881 - RNA, 24 nt, Mycobacterium tuberculosis H37Rv
gugcggcguuaucgucggcuugcu

SEQ ID NO: 1343882 - RNA, 12 nt, Mycobacterium tuberculosis H37Rv
gugcggcggcug

SEQ ID NO: 1343883 - RNA, 23 nt, Mycobacterium tuberculosis H37Rv
gugcgcuggaugugggcgcucgc

SEQ ID NO: 1343884 - RNA, 19 nt, Mycobacterium tuberculosis H37Rv
gugcggaauggucagguuc

SEQ ID NO: 1343885 - RNA, 20 nt, Mycobacterium tuberculosis H37Rv
gugcgcugaugacgcggggc

SEQ ID NO: 1343886 - RNA, 14 nt, Mycobacterium tuberculosis H37Rv
gugcggacaguucc

SEQ ID NO: 1343887 - RNA, 19 nt, Mycobacterium tuberculosis H37Rv
gugcggaaaccgcuggggg

SEQ ID NO: 1343888 - RNA, 22 nt, Mycobacterium tuberculosis H37Rv
gugcggaucacucccccacaca

SEQ ID NO: 1343889 - RNA, 12 nt, Mycobacterium tuberculosis H37Rv
gugcgcgcggcg

SEQ ID NO: 1343890 - RNA, 18 nt, Mycobacterium tuberculosis H37Rv
gugccgcugcauccgcag

SEQ ID NO: 1343891 - RNA, 15 nt, Mycobacterium tuberculosis H37Rv
gugccgcggccaccg

SEQ ID NO: 1343892 - RNA, 12 nt, Mycobacterium tuberculosis H37Rv
gugccgcggcca

SEQ ID NO: 1343893 - RNA, 22 nt, Mycobacterium tuberculosis H37Rv
gugccuucuucgcuaccuucuu

SEQ ID NO: 1343894 - RNA, 16 nt, Mycobacterium tuberculosis H37Rv
gugccuucaccgccgu

SEQ ID NO: 1343895 - RNA, 23 nt, Mycobacterium tuberculosis H37Rv
gugccgccugcgccgccagcgcc

SEQ ID NO: 1343896 - RNA, 20 nt, Mycobacterium tuberculosis H37Rv
gugccgccggugccgccugc

SEQ ID NO: 1343897 - RNA, 17 nt, Mycobacterium tuberculosis H37Rv
gugccgccuccgccugc

SEQ ID NO: 1343898 - RNA, 13 nt, Mycobacterium tuberculosis H37Rv
gugccgccgacac

SEQ ID NO: 1343899 - RNA, 17 nt, Mycobacterium tuberculosis H37Rv
gugccgccgacaccacc

SEQ ID NO: 1343900 - RNA, 15 nt, Mycobacterium tuberculosis H37Rv
gugccgcccaggagc

SEQ ID NO: 1343901 - RNA, 13 nt, Mycobacterium tuberculosis H37Rv
gugccgccgaugu

SEQ ID NO: 1343902 - RNA, 14 nt, Mycobacterium tuberculosis H37Rv
gugccgccgccggc

SEQ ID NO: 1343903 - RNA, 16 nt, Mycobacterium tuberculosis H37Rv
gugcgagaagcaggga

SEQ ID NO: 1343904 - RNA, 17 nt, Mycobacterium tuberculosis H37Rv
gugccuuucggcagacc

SEQ ID NO: 1343905 - RNA, 24 nt, Mycobacterium tuberculosis H37Rv
gugcgccgaauggcggugggcuug

SEQ ID NO: 1343906 - RNA, 13 nt, Mycobacterium tuberculosis H37Rv
gugcgcccaucau

SEQ ID NO: 1343907 - RNA, 15 nt, Mycobacterium tuberculosis H37Rv
gugcgagggcacggc

SEQ ID NO: 1343908 - RNA, 13 nt, Mycobacterium tuberculosis H37Rv
gugcugccgcaca

SEQ ID NO: 1343909 - RNA, 17 nt, Mycobacterium tuberculosis H37Rv
gugcugcgcugucuugc

SEQ ID NO: 1343910 - RNA, 14 nt, Mycobacterium tuberculosis H37Rv
gugcugccuuggga

SEQ ID NO: 1343911 - RNA, 14 nt, Mycobacterium tuberculosis H37Rv
gugcugguccaggc

SEQ ID NO: 1343912 - RNA, 19 nt, Mycobacterium tuberculosis H37Rv
gugcugcaccguuuccggc

SEQ ID NO: 1343913 - RNA, 20 nt, Mycobacterium tuberculosis H37Rv
gugcugcaaggaauuccggc

SEQ ID NO: 1343914 - RNA, 17 nt, Mycobacterium tuberculosis H37Rv
gugcugaugggucaggc

SEQ ID NO: 1343915 - RNA, 17 nt, Mycobacterium tuberculosis H37Rv
gugcugaccccgccggc

SEQ ID NO: 1343916 - RNA, 14 nt, Mycobacterium tuberculosis H37Rv
gugcugaccgcgcc

SEQ ID NO: 1343917 - RNA, 19 nt, Mycobacterium tuberculosis H37Rv
gugcucgcgaucugcucgu

SEQ ID NO: 1343918 - RNA, 21 nt, Mycobacterium tuberculosis H37Rv
gugcucggaggcgaucaggau

SEQ ID NO: 1343919 - RNA, 23 nt, Mycobacterium tuberculosis H37Rv
gugcucgaaggaccggcaccugg

SEQ ID NO: 1343920 - RNA, 17 nt, Mycobacterium tuberculosis H37Rv
gugcguccggugcuggu

SEQ ID NO: 1343921 - RNA, 16 nt, Mycobacterium tuberculosis H37Rv
gugcggugaccgugaa

SEQ ID NO: 1343922 - RNA, 13 nt, Mycobacterium tuberculosis H37Rv
gugcgguggcagg

SEQ ID NO: 1343923 - RNA, 13 nt, Mycobacterium tuberculosis H37Rv
gugcgguggugcg

SEQ ID NO: 1343924 - RNA, 15 nt, Mycobacterium tuberculosis H37Rv
gugcguugucggcug

SEQ ID NO: 1343925 - RNA, 16 nt, Mycobacterium tuberculosis H37Rv
gugcguuggaugaagu

SEQ ID NO: 1343926 - RNA, 22 nt, Mycobacterium tuberculosis H37Rv
gugcguugacucugcguccacc

SEQ ID NO: 1343927 - RNA, 18 nt, Mycobacterium tuberculosis H37Rv
gugcguguaccuguccag

SEQ ID NO: 1343928 - RNA, 21 nt, Mycobacterium tuberculosis H37Rv
gugcuacccauucggcggcgg

SEQ ID NO: 1343929 - RNA, 20 nt, Mycobacterium tuberculosis H37Rv
gugcuaccggcuuggcggga

SEQ ID NO: 1343930 - RNA, 17 nt, Mycobacterium tuberculosis H37Rv
gugcuccaccucgguac

SEQ ID NO: 1343931 - RNA, 14 nt, Mycobacterium tuberculosis H37Rv
gugccccgccgagc

SEQ ID NO: 1343932 - RNA, 15 nt, Mycobacterium tuberculosis H37Rv
gugccccgccgagcg

SEQ ID NO: 1343933 - RNA, 12 nt, Mycobacterium tuberculosis H37Rv
gugccccgccga

SEQ ID NO: 1343934 - RNA, 15 nt, Mycobacterium tuberculosis H37Rv
gugccccgagcugcc

SEQ ID NO: 1343935 - RNA, 14 nt, Mycobacterium tuberculosis H37Rv
gugccccgcccggc

SEQ ID NO: 1343936 - RNA, 15 nt, Mycobacterium tuberculosis H37Rv
gugcccaggaaggcg

SEQ ID NO: 1343937 - RNA, 17 nt, Mycobacterium tuberculosis H37Rv
gugccaggucggcgggc

SEQ ID NO: 1343938 - RNA, 15 nt, Mycobacterium tuberculosis H37Rv
gugccagcagcagcg

SEQ ID NO: 1343939 - RNA, 12 nt, Mycobacterium tuberculosis H37Rv
gugccagcugcc

SEQ ID NO: 1343940 - RNA, 14 nt, Mycobacterium tuberculosis H37Rv
gugccagcgccccg

SEQ ID NO: 1343941 - RNA, 19 nt, Mycobacterium tuberculosis H37Rv
gugcccugccggcagcggc

SEQ ID NO: 1343942 - RNA, 15 nt, Mycobacterium tuberculosis H37Rv
gugccgaaguggagc

SEQ ID NO: 1343943 - RNA, 19 nt, Mycobacterium tuberculosis H37Rv
gugccgcccaccacacagc

SEQ ID NO: 1343944 - RNA, 23 nt, Mycobacterium tuberculosis H37Rv
gugccgccaucgccgccggugcc

SEQ ID NO: 1343945 - RNA, 15 nt, Mycobacterium tuberculosis H37Rv
gugccgaccaccagc

SEQ ID NO: 1343946 - RNA, 15 nt, Mycobacterium tuberculosis H37Rv
gugccgacccgccgc

SEQ ID NO: 1343947 - RNA, 22 nt, Mycobacterium tuberculosis H37Rv
gugccgacccgcuucgcccggc

SEQ ID NO: 1343948 - RNA, 13 nt, Mycobacterium tuberculosis H37Rv
gugcccgcgcggc

SEQ ID NO: 1343949 - RNA, 20 nt, Mycobacterium tuberculosis H37Rv
gugcccggcuccuccccggc

SEQ ID NO: 1343950 - RNA, 17 nt, Mycobacterium tuberculosis H37Rv
gugcccgggaccauagc

SEQ ID NO: 1343951 - RNA, 16 nt, Mycobacterium tuberculosis H37Rv
gugcccgcguugccaa

SEQ ID NO: 1343952 - RNA, 19 nt, Mycobacterium tuberculosis H37Rv
gugcccgcguugccaaagc

SEQ ID NO: 1343953 - RNA, 23 nt, Mycobacterium tuberculosis H37Rv
gugcccggaauguaguccagcuc

SEQ ID NO: 1343954 - RNA, 23 nt, Mycobacterium tuberculosis H37Rv
gugcagcaggaaguagccgagcc

SEQ ID NO: 1343955 - RNA, 14 nt, Mycobacterium tuberculosis H37Rv
gugcagcaccagcc

SEQ ID NO: 1343956 - RNA, 18 nt, Mycobacterium tuberculosis H37Rv
gugcagcacgugugcggg

SEQ ID NO: 1343957 - RNA, 15 nt, Mycobacterium tuberculosis H37Rv
gugcagcagcgcgcg

SEQ ID NO: 1343958 - RNA, 19 nt, Mycobacterium tuberculosis H37Rv
gugcagaccaccgccugga

SEQ ID NO: 1343959 - RNA, 13 nt, Mycobacterium tuberculosis H37Rv
gugcagacaggcg

SEQ ID NO: 1343960 - RNA, 16 nt, Mycobacterium tuberculosis H37Rv
gugccagcaggggacg

SEQ ID NO: 1343961 - RNA, 20 nt, Mycobacterium tuberculosis H37Rv
gugccagaucggcggguggc

SEQ ID NO: 1343962 - RNA, 15 nt, Mycobacterium tuberculosis H37Rv
gugccacgccugagc

SEQ ID NO: 1343963 - RNA, 20 nt, Mycobacterium tuberculosis H37Rv
gugccacuucuucacuggcg

SEQ ID NO: 1343964 - RNA, 18 nt, Mycobacterium tuberculosis H37Rv
gugccaauuccagccccc

SEQ ID NO: 1343965 - RNA, 19 nt, Mycobacterium tuberculosis H37Rv
gugccacagcucgccguga

SEQ ID NO: 1343966 - RNA, 21 nt, Mycobacterium tuberculosis H37Rv
gugcacacaauucgggcguga

SEQ ID NO: 1343967 - RNA, 21 nt, Mycobacterium tuberculosis H37Rv
gugcacacugguggugcccgg

SEQ ID NO: 1343968 - RNA, 14 nt, Mycobacterium tuberculosis H37Rv
gugcacagcaguga

SEQ ID NO: 1343969 - RNA, 14 nt, Mycobacterium tuberculosis H37Rv
gugcaccaucauca

SEQ ID NO: 1343970 - RNA, 20 nt, Mycobacterium tuberculosis H37Rv
gugcaccaucaucaccucuc

SEQ ID NO: 1343971 - RNA, 17 nt, Mycobacterium tuberculosis H37Rv
gugauggugaccagcag

SEQ ID NO: 1343972 - RNA, 22 nt, Mycobacterium tuberculosis H37Rv
gugauggugacuucgguggcgg

SEQ ID NO: 1343973 - RNA, 15 nt, Mycobacterium tuberculosis H37Rv
gugauggugugcagc

SEQ ID NO: 1343974 - RNA, 17 nt, Mycobacterium tuberculosis H37Rv
gugauggugugcagcag

SEQ ID NO: 1343975 - RNA, 14 nt, Mycobacterium tuberculosis H37Rv
gugaugucggugcg

SEQ ID NO: 1343976 - RNA, 19 nt, Mycobacterium tuberculosis H37Rv
gugauugcgcgggcaucgu

SEQ ID NO: 1343977 - RNA, 15 nt, Mycobacterium tuberculosis H37Rv
gugauucggccugag

SEQ ID NO: 1343978 - RNA, 17 nt, Mycobacterium tuberculosis H37Rv
gugaugcaugcuaggca

SEQ ID NO: 1343979 - RNA, 19 nt, Mycobacterium tuberculosis H37Rv
gugaugcccuggggguggc

SEQ ID NO: 1343980 - RNA, 22 nt, Mycobacterium tuberculosis H37Rv
gugaugggggagccggugacgg

SEQ ID NO: 1343981 - RNA, 14 nt, Mycobacterium tuberculosis H37Rv
gugaugggggagcc

SEQ ID NO: 1343982 - RNA, 17 nt, Mycobacterium tuberculosis H37Rv
gugauggccgaccagcc

SEQ ID NO: 1343983 - RNA, 15 nt, Mycobacterium tuberculosis H37Rv
gugaugcggucgcgg

SEQ ID NO: 1343984 - RNA, 21 nt, Mycobacterium tuberculosis H37Rv
gucgcugcugccgcaccggug

SEQ ID NO: 1343985 - RNA, 15 nt, Mycobacterium tuberculosis H37Rv
gucgcugggaggcgc

SEQ ID NO: 1343986 - RNA, 18 nt, Mycobacterium tuberculosis H37Rv
gucgcugagcacggcgcg

SEQ ID NO: 1343987 - RNA, 20 nt, Mycobacterium tuberculosis H37Rv
gucgcugcggcgcuggccag

SEQ ID NO: 1343988 - RNA, 19 nt, Mycobacterium tuberculosis H37Rv
gucgcugccgccgccggcg

SEQ ID NO: 1343989 - RNA, 15 nt, Mycobacterium tuberculosis H37Rv
gucgcuguccacugc

SEQ ID NO: 1343990 - RNA, 22 nt, Mycobacterium tuberculosis H37Rv
guggcgauuucggcgccuggcg

SEQ ID NO: 1343991 - RNA, 13 nt, Mycobacterium tuberculosis H37Rv
guggcgagcgccu

SEQ ID NO: 1343992 - RNA, 22 nt, Mycobacterium tuberculosis H37Rv
guggcgaaucuuugguagucug

SEQ ID NO: 1343993 - RNA, 14 nt, Mycobacterium tuberculosis H37Rv
guggcccgcgggca

SEQ ID NO: 1343994 - RNA, 13 nt, Mycobacterium tuberculosis H37Rv
guggcccgcggug

SEQ ID NO: 1343995 - RNA, 21 nt, Mycobacterium tuberculosis H37Rv
guggccuugacagcuuucuug

SEQ ID NO: 1343996 - RNA, 22 nt, Mycobacterium tuberculosis H37Rv
guggcgccaguucggcgggagc

SEQ ID NO: 1343997 - RNA, 21 nt, Mycobacterium tuberculosis H37Rv
guggcgccaugaagccgggcg

SEQ ID NO: 1343998 - RNA, 12 nt, Mycobacterium tuberculosis H37Rv
guggcgcgggcc

SEQ ID NO: 1343999 - RNA, 15 nt, Mycobacterium tuberculosis H37Rv
guggcgccggccacg

SEQ ID NO: 1344000 - RNA, 22 nt, Mycobacterium tuberculosis H37Rv
guggcgccguugucggcgguga

SEQ ID NO: 1344001 - RNA, 17 nt, Mycobacterium tuberculosis H37Rv
guggaucuuggccagca

SEQ ID NO: 1344002 - RNA, 23 nt, Mycobacterium tuberculosis H37Rv
guggaugcgccgcacggcgacgc

SEQ ID NO: 1344003 - RNA, 21 nt, Mycobacterium tuberculosis H37Rv
gugcuggugggccggaccuug

SEQ ID NO: 1344004 - RNA, 15 nt, Mycobacterium tuberculosis H37Rv
gugcuggugggccgg

SEQ ID NO: 1344005 - RNA, 20 nt, Mycobacterium tuberculosis H37Rv
gugcuguggaugccgacggc

SEQ ID NO: 1344006 - RNA, 21 nt, Mycobacterium tuberculosis H37Rv
guggauucgaucaggccuugg

SEQ ID NO: 1344007 - RNA, 18 nt, Mycobacterium tuberculosis H37Rv
guggauccggcagcagcc

SEQ ID NO: 1344008 - RNA, 15 nt, Mycobacterium tuberculosis H37Rv
guggccaccacggcg

SEQ ID NO: 1344009 - RNA, 18 nt, Mycobacterium tuberculosis H37Rv
guggccaccacggcgcgc

SEQ ID NO: 1344010 - RNA, 14 nt, Mycobacterium tuberculosis H37Rv
guggcaaucgagga

SEQ ID NO: 1344011 - RNA, 22 nt, Mycobacterium tuberculosis H37Rv
guggcaaggccaaccgggccgc

SEQ ID NO: 1344012 - RNA, 13 nt, Mycobacterium tuberculosis H37Rv
guggccagcgcgg

SEQ ID NO: 1344013 - RNA, 14 nt, Mycobacterium tuberculosis H37Rv
guggccagcccgcc

SEQ ID NO: 1344014 - RNA, 18 nt, Mycobacterium tuberculosis H37Rv
guggccagcaggcggcug

SEQ ID NO: 1344015 - RNA, 17 nt, Mycobacterium tuberculosis H37Rv
guggggguccggcggcc

SEQ ID NO: 1344016 - RNA, 20 nt, Mycobacterium tuberculosis H37Rv
gugggucaacgucaggcccu

SEQ ID NO: 1344017 - RNA, 13 nt, Mycobacterium tuberculosis H37Rv
gugggugaggcca

SEQ ID NO: 1344018 - RNA, 18 nt, Mycobacterium tuberculosis H37Rv
gugguaggacgccagcaa

SEQ ID NO: 1344019 - RNA, 16 nt, Mycobacterium tuberculosis H37Rv
gugguaggccggugcg

SEQ ID NO: 1344020 - RNA, 21 nt, Mycobacterium tuberculosis H37Rv
gugguagcgacgauguuggug

SEQ ID NO: 1344021 - RNA, 20 nt, Mycobacterium tuberculosis H37Rv
gugguacgugcgagcccacc

SEQ ID NO: 1344022 - RNA, 21 nt, Mycobacterium tuberculosis H37Rv
gugguaaccauauggcccgcg

SEQ ID NO: 1344023 - RNA, 20 nt, Mycobacterium tuberculosis H37Rv
guggguguuguugugggugg

SEQ ID NO: 1344024 - RNA, 22 nt, Mycobacterium tuberculosis H37Rv
guggguguuguugugggugguc

SEQ ID NO: 1344025 - RNA, 16 nt, Mycobacterium tuberculosis H37Rv
guggcuggcaugccgg

SEQ ID NO: 1344026 - RNA, 13 nt, Mycobacterium tuberculosis H37Rv
guggcuggcugug

SEQ ID NO: 1344027 - RNA, 19 nt, Mycobacterium tuberculosis H37Rv
guggcugaucccggccagg

SEQ ID NO: 1344028 - RNA, 20 nt, Mycobacterium tuberculosis H37Rv
guggcuauuccgacucgagu

SEQ ID NO: 1344029 - RNA, 14 nt, Mycobacterium tuberculosis H37Rv
guggcggcaggugu

SEQ ID NO: 1344030 - RNA, 19 nt, Mycobacterium tuberculosis H37Rv
guggcuccaucgucuggug

SEQ ID NO: 1344031 - RNA, 15 nt, Mycobacterium tuberculosis H37Rv
gugggcuuggcugug

SEQ ID NO: 1344032 - RNA, 20 nt, Mycobacterium tuberculosis H37Rv
guggcuuugacugcuggggg

SEQ ID NO: 1344033 - RNA, 21 nt, Mycobacterium tuberculosis H37Rv
guggcuuugacugcugggggu

SEQ ID NO: 1344034 - RNA, 16 nt, Mycobacterium tuberculosis H37Rv
guggcuuugacugcug

SEQ ID NO: 1344035 - RNA, 13 nt, Mycobacterium tuberculosis H37Rv
guggcugugcggg

SEQ ID NO: 1344036 - RNA, 17 nt, Mycobacterium tuberculosis H37Rv
guggggccggggucggc

SEQ ID NO: 1344037 - RNA, 19 nt, Mycobacterium tuberculosis H37Rv
guggggccggcgucgauga

SEQ ID NO: 1344038 - RNA, 20 nt, Mycobacterium tuberculosis H37Rv
gugggcuuggcugugguagg

SEQ ID NO: 1344039 - RNA, 12 nt, Mycobacterium tuberculosis H37Rv
gugguuuugggc

SEQ ID NO: 1344040 - RNA, 16 nt, Mycobacterium tuberculosis H37Rv
gugguuguccacggcg

SEQ ID NO: 1344041 - RNA, 15 nt, Mycobacterium tuberculosis H37Rv
gugguucggcggcgc

SEQ ID NO: 1344042 - RNA, 15 nt, Mycobacterium tuberculosis H37Rv
guggugggcguggcu

SEQ ID NO: 1344043 - RNA, 15 nt, Mycobacterium tuberculosis H37Rv
guggugggcuuggcu

SEQ ID NO: 1344044 - RNA, 16 nt, Mycobacterium tuberculosis H37Rv
gugguggugaugggca

SEQ ID NO: 1344045 - RNA, 18 nt, Mycobacterium tuberculosis H37Rv
guggugguugaucagcca

SEQ ID NO: 1344046 - RNA, 20 nt, Mycobacterium tuberculosis H37Rv
gugguguaucgacggcggcc

SEQ ID NO: 1344047 - RNA, 20 nt, Mycobacterium tuberculosis H37Rv
gugguguccaccgcaucggu

SEQ ID NO: 1344048 - RNA, 14 nt, Mycobacterium tuberculosis H37Rv
guggugcgcuggcc

SEQ ID NO: 1344049 - RNA, 18 nt, Mycobacterium tuberculosis H37Rv
gugguggaacuccgggug

SEQ ID NO: 1344050 - RNA, 16 nt, Mycobacterium tuberculosis H37Rv
gugguggacgaugcgg

SEQ ID NO: 1344051 - RNA, 15 nt, Mycobacterium tuberculosis H37Rv
gugguggagcggcgc

SEQ ID NO: 1344052 - RNA, 23 nt, Mycobacterium tuberculosis H37Rv
guggugcaccgauuccagcggaa

SEQ ID NO: 1344053 - RNA, 15 nt, Mycobacterium tuberculosis H37Rv
guggugccaaccugg

SEQ ID NO: 1344054 - RNA, 13 nt, Mycobacterium tuberculosis H37Rv
guggugaguacca

SEQ ID NO: 1344055 - RNA, 21 nt, Mycobacterium tuberculosis H37Rv
guggucuuggcgguggcccga

SEQ ID NO: 1344056 - RNA, 14 nt, Mycobacterium tuberculosis H37Rv
guggucagcugcug

SEQ ID NO: 1344057 - RNA, 14 nt, Mycobacterium tuberculosis H37Rv
guggucaucgccac

SEQ ID NO: 1344058 - RNA, 17 nt, Mycobacterium tuberculosis H37Rv
guggucuuggcgguggc

SEQ ID NO: 1344059 - RNA, 14 nt, Mycobacterium tuberculosis H37Rv
guggucagcaccca

SEQ ID NO: 1344060 - RNA, 12 nt, Mycobacterium tuberculosis H37Rv
guguacccgccu

SEQ ID NO: 1344061 - RNA, 19 nt, Mycobacterium tuberculosis H37Rv
gugugagucccacgccagc

SEQ ID NO: 1344062 - RNA, 13 nt, Mycobacterium tuberculosis H37Rv
gugugcagcagca

SEQ ID NO: 1344063 - RNA, 18 nt, Mycobacterium tuberculosis H37Rv
gugugggcguugucuagc

SEQ ID NO: 1344064 - RNA, 16 nt, Mycobacterium tuberculosis H37Rv
gugugcgugcggucga

SEQ ID NO: 1344065 - RNA, 12 nt, Mycobacterium tuberculosis H37Rv
gugugcgugcgg

SEQ ID NO: 1344066 - RNA, 16 nt, Mycobacterium tuberculosis H37Rv
gugugcgcaugguggg

SEQ ID NO: 1344067 - RNA, 21 nt, Mycobacterium tuberculosis H37Rv
gugugcgccaaggucugccgg

SEQ ID NO: 1344068 - RNA, 16 nt, Mycobacterium tuberculosis H37Rv
guguggugacagagcg

SEQ ID NO: 1344069 - RNA, 20 nt, Mycobacterium tuberculosis H37Rv
guguguggcgccggggacca

SEQ ID NO: 1344070 - RNA, 15 nt, Mycobacterium tuberculosis H37Rv
guguuguuagccccg

SEQ ID NO: 1344071 - RNA, 16 nt, Mycobacterium tuberculosis H37Rv
guguuguugaagcccg

SEQ ID NO: 1344072 - RNA, 16 nt, Mycobacterium tuberculosis H37Rv
guguuguaggccgggc

SEQ ID NO: 1344073 - RNA, 15 nt, Mycobacterium tuberculosis H37Rv
guguuucaggcagcg

SEQ ID NO: 1344074 - RNA, 20 nt, Mycobacterium tuberculosis H37Rv
guguucuaccugcacccagg

SEQ ID NO: 1344075 - RNA, 13 nt, Mycobacterium tuberculosis H37Rv
guguucuccugcc

SEQ ID NO: 1344076 - RNA, 15 nt, Mycobacterium tuberculosis H37Rv
guguguuuggugguu

SEQ ID NO: 1344077 - RNA, 14 nt, Mycobacterium tuberculosis H37Rv
guguugaccggguc

SEQ ID NO: 1344078 - RNA, 17 nt, Mycobacterium tuberculosis H37Rv
guguugagggugcccga

SEQ ID NO: 1344079 - RNA, 23 nt, Mycobacterium tuberculosis H37Rv
guguugcacguacgggcaguggu

SEQ ID NO: 1344080 - RNA, 15 nt, Mycobacterium tuberculosis H37Rv
guuacuggagauacc

SEQ ID NO: 1344081 - RNA, 12 nt, Mycobacterium tuberculosis H37Rv
guuacucaccaa

SEQ ID NO: 1344082 - RNA, 20 nt, Mycobacterium tuberculosis H37Rv
guuacguuguacucgugcgg

SEQ ID NO: 1344083 - RNA, 17 nt, Mycobacterium tuberculosis H37Rv
guuccugguagucgccc

SEQ ID NO: 1344084 - RNA, 16 nt, Mycobacterium tuberculosis H37Rv
guuccugcaagaacca

SEQ ID NO: 1344085 - RNA, 15 nt, Mycobacterium tuberculosis H37Rv
guucgaugaaaaugc

SEQ ID NO: 1344086 - RNA, 13 nt, Mycobacterium tuberculosis H37Rv
guucgaugacuga

SEQ ID NO: 1344087 - RNA, 21 nt, Mycobacterium tuberculosis H37Rv
guucgaguccccuuagcucca

SEQ ID NO: 1344088 - RNA, 15 nt, Mycobacterium tuberculosis H37Rv
guucgcucccccgcu

SEQ ID NO: 1344089 - RNA, 12 nt, Mycobacterium tuberculosis H37Rv
guucgcuccccc

SEQ ID NO: 1344090 - RNA, 14 nt, Mycobacterium tuberculosis H37Rv
guucgcucccccgc

SEQ ID NO: 1344091 - RNA, 15 nt, Mycobacterium tuberculosis H37Rv
guucgcgcaaaugcc

SEQ ID NO: 1344092 - RNA, 13 nt, Mycobacterium tuberculosis H37Rv
guucgcgcuggca

SEQ ID NO: 1344093 - RNA, 18 nt, Mycobacterium tuberculosis H37Rv
guucccgccggccccgcc

SEQ ID NO: 1344094 - RNA, 22 nt, Mycobacterium tuberculosis H37Rv
guucccggugaccacuugcagc

SEQ ID NO: 1344095 - RNA, 16 nt, Mycobacterium tuberculosis H37Rv
guuccgggcgcgugga

SEQ ID NO: 1344096 - RNA, 20 nt, Mycobacterium tuberculosis H37Rv
guuccccgagaacggcgggc

SEQ ID NO: 1344097 - RNA, 21 nt, Mycobacterium tuberculosis H37Rv
guuccccgagaacggcgggcg

SEQ ID NO: 1344098 - RNA, 16 nt, Mycobacterium tuberculosis H37Rv
guucccccggcaccgc

SEQ ID NO: 1344099 - RNA, 20 nt, Mycobacterium tuberculosis H37Rv
guuccaacuccugcagcccg

SEQ ID NO: 1344100 - RNA, 16 nt, Mycobacterium tuberculosis H37Rv
guuccacacccaguug

SEQ ID NO: 1344101 - RNA, 15 nt, Mycobacterium tuberculosis H37Rv
guuccacaccaggcc

SEQ ID NO: 1344102 - RNA, 19 nt, Mycobacterium tuberculosis H37Rv
guuccacaccaggccgagc

SEQ ID NO: 1344103 - RNA, 14 nt, Mycobacterium tuberculosis H37Rv
guuccaacuccugc

SEQ ID NO: 1344104 - RNA, 16 nt, Mycobacterium tuberculosis H37Rv
guuccacgacaaccgu

SEQ ID NO: 1344105 - RNA, 15 nt, Mycobacterium tuberculosis H37Rv
guucccaucccucgg

SEQ ID NO: 1344106 - RNA, 21 nt, Mycobacterium tuberculosis H37Rv
guuccacgagucgucguccga

SEQ ID NO: 1344107 - RNA, 14 nt, Mycobacterium tuberculosis H37Rv
guuagcaccaguuc

SEQ ID NO: 1344108 - RNA, 17 nt, Mycobacterium tuberculosis H37Rv
guucagccaggccgcaa

SEQ ID NO: 1344109 - RNA, 14 nt, Mycobacterium tuberculosis H37Rv
guucaugcggcggc

SEQ ID NO: 1344110 - RNA, 16 nt, Mycobacterium tuberculosis H37Rv
guucaugcggcggcgc

SEQ ID NO: 1344111 - RNA, 24 nt, Mycobacterium tuberculosis H37Rv
guucauguagcagcgcggcuuggc

SEQ ID NO: 1344112 - RNA, 15 nt, Mycobacterium tuberculosis H37Rv
guucagcgucgacug

SEQ ID NO: 1344113 - RNA, 22 nt, Mycobacterium tuberculosis H37Rv
guucagcgccacguccaucacc

SEQ ID NO: 1344114 - RNA, 14 nt, Mycobacterium tuberculosis H37Rv
guugaucgcggaca

SEQ ID NO: 1344115 - RNA, 13 nt, Mycobacterium tuberculosis H37Rv
guugaugaagguc

SEQ ID NO: 1344116 - RNA, 13 nt, Mycobacterium tuberculosis H37Rv
guugaugaccagg

SEQ ID NO: 1344117 - RNA, 20 nt, Mycobacterium tuberculosis H37Rv
guugaugccgccggagucga

SEQ ID NO: 1344118 - RNA, 17 nt, Mycobacterium tuberculosis H37Rv
guugauuucggcggcga

SEQ ID NO: 1344119 - RNA, 21 nt, Mycobacterium tuberculosis H37Rv
guugcacugcucguugaugaa

SEQ ID NO: 1344120 - RNA, 13 nt, Mycobacterium tuberculosis H37Rv
guugcacugcugg

SEQ ID NO: 1344121 - RNA, 12 nt, Mycobacterium tuberculosis H37Rv
guugcagcagca

SEQ ID NO: 1344122 - RNA, 15 nt, Mycobacterium tuberculosis H37Rv
guugcagaccgggug

SEQ ID NO: 1344123 - RNA, 18 nt, Mycobacterium tuberculosis H37Rv
guugacggugucuugcca

SEQ ID NO: 1344124 - RNA, 20 nt, Mycobacterium tuberculosis H37Rv
guugacgguugccccggcga

SEQ ID NO: 1344125 - RNA, 19 nt, Mycobacterium tuberculosis H37Rv
guugagcagcuugguggcg

SEQ ID NO: 1344126 - RNA, 15 nt, Mycobacterium tuberculosis H37Rv
guugagcauaugacg

SEQ ID NO: 1344127 - RNA, 14 nt, Mycobacterium tuberculosis H37Rv
guugauccugcagu

SEQ ID NO: 1344128 - RNA, 12 nt, Mycobacterium tuberculosis H37Rv
guugaucagcca

SEQ ID NO: 1344129 - RNA, 17 nt, Mycobacterium tuberculosis H37Rv
guugaggacguggacuu

SEQ ID NO: 1344130 - RNA, 20 nt, Mycobacterium tuberculosis H37Rv
guugaggccggugaacggua

SEQ ID NO: 1344131 - RNA, 20 nt, Mycobacterium tuberculosis H37Rv
guugaccaaugucagugccc

SEQ ID NO: 1344132 - RNA, 17 nt, Mycobacterium tuberculosis H37Rv
guugaccuccuccuccg

SEQ ID NO: 1344133 - RNA, 20 nt, Mycobacterium tuberculosis H37Rv
guugaccagaaccuggagcc

SEQ ID NO: 1344134 - RNA, 13 nt, Mycobacterium tuberculosis H37Rv
guugaccagcacg

SEQ ID NO: 1344135 - RNA, 15 nt, Mycobacterium tuberculosis H37Rv
guugaccaggccgac

SEQ ID NO: 1344136 - RNA, 22 nt, Mycobacterium tuberculosis H37Rv
guugaaucccagauaugcagga

SEQ ID NO: 1344137 - RNA, 22 nt, Mycobacterium tuberculosis H37Rv
guugaagaagccgguguugaug

SEQ ID NO: 1344138 - RNA, 17 nt, Mycobacterium tuberculosis H37Rv
guugaagccgcccgagu

SEQ ID NO: 1344139 - RNA, 22 nt, Mycobacterium tuberculosis H37Rv
guugaagaagcccgaguuguuc

SEQ ID NO: 1344140 - RNA, 21 nt, Mycobacterium tuberculosis H37Rv
guugaacaauccgguguugag

SEQ ID NO: 1344141 - RNA, 15 nt, Mycobacterium tuberculosis H37Rv
guugaacauguccag

SEQ ID NO: 1344142 - RNA, 19 nt, Mycobacterium tuberculosis H37Rv
guucguggcuggcaugccg

SEQ ID NO: 1344143 - RNA, 15 nt, Mycobacterium tuberculosis H37Rv
guucgucgggcaugc

SEQ ID NO: 1344144 - RNA, 17 nt, Mycobacterium tuberculosis H37Rv
guucgucgguugccacg

SEQ ID NO: 1344145 - RNA, 17 nt, Mycobacterium tuberculosis H37Rv
guucgucgucgcugaau

SEQ ID NO: 1344146 - RNA, 16 nt, Mycobacterium tuberculosis H37Rv
guucuucuccaccacc

SEQ ID NO: 1344147 - RNA, 11 nt, Mycobacterium tuberculosis H37Rv
guucuuggcca

SEQ ID NO: 1344148 - RNA, 14 nt, Mycobacterium tuberculosis H37Rv
guugcggugugccg

SEQ ID NO: 1344149 - RNA, 22 nt, Mycobacterium tuberculosis H37Rv
guugcuaaacuccgugccgagc

SEQ ID NO: 1344150 - RNA, 21 nt, Mycobacterium tuberculosis H37Rv
guugcggcugcguuggcuggu

SEQ ID NO: 1344151 - RNA, 16 nt, Mycobacterium tuberculosis H37Rv
guugcccgacccgccg

SEQ ID NO: 1344152 - RNA, 17 nt, Mycobacterium tuberculosis H37Rv
guugcccgacccgccga

SEQ ID NO: 1344153 - RNA, 18 nt, Mycobacterium tuberculosis H37Rv
guugccccgucguucucc

SEQ ID NO: 1344154 - RNA, 16 nt, Mycobacterium tuberculosis H37Rv
guugccaucaaggcca

SEQ ID NO: 1344155 - RNA, 17 nt, Mycobacterium tuberculosis H37Rv
guugccaucaaggccac

SEQ ID NO: 1344156 - RNA, 20 nt, Mycobacterium tuberculosis H37Rv
guugccaucaaggccaccuc

SEQ ID NO: 1344157 - RNA, 19 nt, Mycobacterium tuberculosis H37Rv
guugccgccauuggcaggc

SEQ ID NO: 1344158 - RNA, 22 nt, Mycobacterium tuberculosis H37Rv
guugccgauccccaggccgcuu

SEQ ID NO: 1344159 - RNA, 17 nt, Mycobacterium tuberculosis H37Rv
guugccgaaacccgagu

SEQ ID NO: 1344160 - RNA, 17 nt, Mycobacterium tuberculosis H37Rv
guugccgaagcccgagc

SEQ ID NO: 1344161 - RNA, 17 nt, Mycobacterium tuberculosis H37Rv
guugcccguucaugcgg

SEQ ID NO: 1344162 - RNA, 18 nt, Mycobacterium tuberculosis H37Rv
guugccgucagggucagc

SEQ ID NO: 1344163 - RNA, 19 nt, Mycobacterium tuberculosis H37Rv
guugccguuggugccgccu

SEQ ID NO: 1344164 - RNA, 19 nt, Mycobacterium tuberculosis H37Rv
guugccuagguucgccacg

SEQ ID NO: 1344165 - RNA, 23 nt, Mycobacterium tuberculosis H37Rv
guugccucggcgaggucagagaa

SEQ ID NO: 1344166 - RNA, 19 nt, Mycobacterium tuberculosis H37Rv
guugccugcgcgagugcca

SEQ ID NO: 1344167 - RNA, 14 nt, Mycobacterium tuberculosis H37Rv
guugccggcggcga

SEQ ID NO: 1344168 - RNA, 15 nt, Mycobacterium tuberculosis H37Rv
guugccgccggugcc

SEQ ID NO: 1344169 - RNA, 22 nt, Mycobacterium tuberculosis H37Rv
guugccgcgaucgggcccagca

SEQ ID NO: 1344170 - RNA, 19 nt, Mycobacterium tuberculosis H37Rv
guuggccaccagcuggcga

SEQ ID NO: 1344171 - RNA, 17 nt, Mycobacterium tuberculosis H37Rv
guuggccaggcccgagu

SEQ ID NO: 1344172 - RNA, 18 nt, Mycobacterium tuberculosis H37Rv
guuggcgaacugguagcc

SEQ ID NO: 1344173 - RNA, 23 nt, Mycobacterium tuberculosis H37Rv
guuggccguggucgagguggggu

SEQ ID NO: 1344174 - RNA, 19 nt, Mycobacterium tuberculosis H37Rv
guuggccucgagcgcugug

SEQ ID NO: 1344175 - RNA, 20 nt, Mycobacterium tuberculosis H37Rv
guuggccggcgccaccgagu

SEQ ID NO: 1344176 - RNA, 21 nt, Mycobacterium tuberculosis H37Rv
guuggcaaagacgcuggccac

SEQ ID NO: 1344177 - RNA, 18 nt, Mycobacterium tuberculosis H37Rv
guugcuggcgcccccgcc

SEQ ID NO: 1344178 - RNA, 18 nt, Mycobacterium tuberculosis H37Rv
guuggcgauccgcggcgu

SEQ ID NO: 1344179 - RNA, 12 nt, Mycobacterium tuberculosis H37Rv
guuggcggccuc

SEQ ID NO: 1344180 - RNA, 21 nt, Mycobacterium tuberculosis H37Rv
guuggcggcggucggcugggc

SEQ ID NO: 1344181 - RNA, 12 nt, Mycobacterium tuberculosis H37Rv
guuggcggcugc

SEQ ID NO: 1344182 - RNA, 17 nt, Mycobacterium tuberculosis H37Rv
guuggcucggcgcagca

SEQ ID NO: 1344183 - RNA, 18 nt, Mycobacterium tuberculosis H37Rv
guugggccgacugggcgc

SEQ ID NO: 1344184 - RNA, 21 nt, Mycobacterium tuberculosis H37Rv
guugggcgcgaaacgccgcaa

SEQ ID NO: 1344185 - RNA, 20 nt, Mycobacterium tuberculosis H37Rv
guugggugggugcagcacgu

SEQ ID NO: 1344186 - RNA, 14 nt, Mycobacterium tuberculosis H37Rv
guuggguggcaccg

SEQ ID NO: 1344187 - RNA, 16 nt, Mycobacterium tuberculosis H37Rv
guugguaaucuuggcc

SEQ ID NO: 1344188 - RNA, 19 nt, Mycobacterium tuberculosis H37Rv
guuggucggcugauuggcc

SEQ ID NO: 1344189 - RNA, 14 nt, Mycobacterium tuberculosis H37Rv
guuggucggugcug

SEQ ID NO: 1344190 - RNA, 17 nt, Mycobacterium tuberculosis H37Rv
guugguauuagggccgg

SEQ ID NO: 1344191 - RNA, 13 nt, Mycobacterium tuberculosis H37Rv
guuggucguggcu

SEQ ID NO: 1344192 - RNA, 13 nt, Mycobacterium tuberculosis H37Rv
guuggugaugccg

SEQ ID NO: 1344193 - RNA, 17 nt, Mycobacterium tuberculosis H37Rv
guuggugcgggguuggc

SEQ ID NO: 1344194 - RNA, 16 nt, Mycobacterium tuberculosis H37Rv
guuggugcuggccuug

SEQ ID NO: 1344195 - RNA, 16 nt, Mycobacterium tuberculosis H37Rv
guuuccgccgccgcca

SEQ ID NO: 1344196 - RNA, 18 nt, Mycobacterium tuberculosis H37Rv
guuuccucgagccagcuc

SEQ ID NO: 1344197 - RNA, 19 nt, Mycobacterium tuberculosis H37Rv
guuuccucgagccagcucc

SEQ ID NO: 1344198 - RNA, 19 nt, Mycobacterium tuberculosis H37Rv
guuugacguccagggccac

SEQ ID NO: 1344199 - RNA, 14 nt, Mycobacterium tuberculosis H37Rv
guuucugaagcccg

SEQ ID NO: 1344200 - RNA, 15 nt, Mycobacterium tuberculosis H37Rv
guuucugaagcccga

SEQ ID NO: 1344201 - RNA, 16 nt, Mycobacterium tuberculosis H37Rv
guuugaacgcaugcga

SEQ ID NO: 1344202 - RNA, 14 nt, Mycobacterium tuberculosis H37Rv
guuucgaucucgag

SEQ ID NO: 1344203 - RNA, 12 nt, Mycobacterium tuberculosis H37Rv
guuguacuggcu

SEQ ID NO: 1344204 - RNA, 21 nt, Mycobacterium tuberculosis H37Rv
guuguucgggcugccaggagc

SEQ ID NO: 1344205 - RNA, 20 nt, Mycobacterium tuberculosis H37Rv
guugucagcgaacggccagg

SEQ ID NO: 1344206 - RNA, 22 nt, Mycobacterium tuberculosis H37Rv
guuguugggcgagggugaagac

SEQ ID NO: 1344207 - RNA, 14 nt, Mycobacterium tuberculosis H37Rv
guuguuggccagac

SEQ ID NO: 1344208 - RNA, 20 nt, Mycobacterium tuberculosis H37Rv
guuuacccgcauggacgcga

SEQ ID NO: 1344209 - RNA, 16 nt, Mycobacterium tuberculosis H37Rv
guuuagcggcugaggg

SEQ ID NO: 1344210 - RNA, 22 nt, Mycobacterium tuberculosis H37Rv
guuuagcaacuacucauccaga

SEQ ID NO: 1344211 - RNA, 20 nt, Mycobacterium tuberculosis H37Rv
guuugagcgcacucaccuug

SEQ ID NO: 1344212 - RNA, 23 nt, Mycobacterium tuberculosis H37Rv
guuugaucuccaccuucuggucc

SEQ ID NO: 1344213 - RNA, 19 nt, Mycobacterium tuberculosis H37Rv
guuugaugcgggcggcaag

SEQ ID NO: 1344214 - RNA, 14 nt, Mycobacterium tuberculosis H37Rv
guuugauuccaggu

SEQ ID NO: 1344215 - RNA, 21 nt, Mycobacterium tuberculosis H37Rv
uaaacaccgcgaacuugcuga

SEQ ID NO: 1344216 - RNA, 18 nt, Mycobacterium tuberculosis H37Rv
uaaaggccuugggcggca

SEQ ID NO: 1344217 - RNA, 20 nt, Mycobacterium tuberculosis H37Rv
uaaaccgauaucgcugcgga

SEQ ID NO: 1344218 - RNA, 16 nt, Mycobacterium tuberculosis H37Rv
uaaacagcgcgccggc

SEQ ID NO: 1344219 - RNA, 13 nt, Mycobacterium tuberculosis H37Rv
uaacccagcggcg

SEQ ID NO: 1344220 - RNA, 16 nt, Mycobacterium tuberculosis H37Rv
uaacccagcaccacaa

SEQ ID NO: 1344221 - RNA, 22 nt, Mycobacterium tuberculosis H37Rv
uaagccuucggugucgccgaac

SEQ ID NO: 1344222 - RNA, 19 nt, Mycobacterium tuberculosis H37Rv
uaagccgcgcccaucagug

SEQ ID NO: 1344223 - RNA, 18 nt, Mycobacterium tuberculosis H37Rv
uaagcggauguccccgac

SEQ ID NO: 1344224 - RNA, 18 nt, Mycobacterium tuberculosis H37Rv
uaagcccccgcacgcacg

SEQ ID NO: 1344225 - RNA, 12 nt, Mycobacterium tuberculosis H37Rv
uaagcaccagcc

SEQ ID NO: 1344226 - RNA, 22 nt, Mycobacterium tuberculosis H37Rv
uaaguguugcgaagcauucagg

SEQ ID NO: 1344227 - RNA, 22 nt, Mycobacterium tuberculosis H37Rv
uaagggcgggcuuggggucccg

SEQ ID NO: 1344228 - RNA, 21 nt, Mycobacterium tuberculosis H37Rv
uaagggucaucgccagcggca

SEQ ID NO: 1344229 - RNA, 15 nt, Mycobacterium tuberculosis H37Rv
uaagggacaccagcu

SEQ ID NO: 1344230 - RNA, 19 nt, Mycobacterium tuberculosis H37Rv
uaaggcugcagugccgcac

SEQ ID NO: 1344231 - RNA, 13 nt, Mycobacterium tuberculosis H37Rv
uaauugccagccu

SEQ ID NO: 1344232 - RNA, 16 nt, Mycobacterium tuberculosis H37Rv
uaaugcugcugcagca

SEQ ID NO: 1344233 - RNA, 13 nt, Mycobacterium tuberculosis H37Rv
uaaucaagcagcg

SEQ ID NO: 1344234 - RNA, 22 nt, Mycobacterium tuberculosis H37Rv
uaaucaaggugaucagcaggau

SEQ ID NO: 1344235 - RNA, 15 nt, Mycobacterium tuberculosis H37Rv
uaauauuuucccgcc

SEQ ID NO: 1344236 - RNA, 13 nt, Mycobacterium tuberculosis H37Rv
uaaucguuccgca

SEQ ID NO: 1344237 - RNA, 16 nt, Mycobacterium tuberculosis H37Rv
uaaucuccucaagcga

SEQ ID NO: 1344238 - RNA, 24 nt, Mycobacterium tuberculosis H37Rv
uaaucgcgagaccaacauacagca

SEQ ID NO: 1344239 - RNA, 18 nt, Mycobacterium tuberculosis H37Rv
uaauccagcgccgaccuc

SEQ ID NO: 1344240 - RNA, 13 nt, Mycobacterium tuberculosis H37Rv
uacagcgccaggg

SEQ ID NO: 1344241 - RNA, 15 nt, Mycobacterium tuberculosis H37Rv
uacagcaauccgcaa

SEQ ID NO: 1344242 - RNA, 19 nt, Mycobacterium tuberculosis H37Rv
uacacaaauccgcaccagc

SEQ ID NO: 1344243 - RNA, 24 nt, Mycobacterium tuberculosis H37Rv
uacaacgccgucgucguagaacug

SEQ ID NO: 1344244 - RNA, 15 nt, Mycobacterium tuberculosis H37Rv
uacaacgccgucguc

SEQ ID NO: 1344245 - RNA, 19 nt, Mycobacterium tuberculosis H37Rv
uacaucgccuugcccagcg

SEQ ID NO: 1344246 - RNA, 14 nt, Mycobacterium tuberculosis H37Rv
uacaucgaccaccu

SEQ ID NO: 1344247 - RNA, 15 nt, Mycobacterium tuberculosis H37Rv
uacaucgaccaccuc

SEQ ID NO: 1344248 - RNA, 15 nt, Mycobacterium tuberculosis H37Rv
uacaggccacgcacc

SEQ ID NO: 1344249 - RNA, 15 nt, Mycobacterium tuberculosis H37Rv
uacaggucgccgggg

SEQ ID NO: 1344250 - RNA, 18 nt, Mycobacterium tuberculosis H37Rv
uacaggucggcccacggu

SEQ ID NO: 1344251 - RNA, 20 nt, Mycobacterium tuberculosis H37Rv
uaccaauucccgcgcggcgu

SEQ ID NO: 1344252 - RNA, 16 nt, Mycobacterium tuberculosis H37Rv
uaccaauccaggccac

SEQ ID NO: 1344253 - RNA, 19 nt, Mycobacterium tuberculosis H37Rv
uaccaaccugcgcggcgau

SEQ ID NO: 1344254 - RNA, 18 nt, Mycobacterium tuberculosis H37Rv
uaccggcgaucugcugug

SEQ ID NO: 1344255 - RNA, 14 nt, Mycobacterium tuberculosis H37Rv
uaccggcgugcagu

SEQ ID NO: 1344256 - RNA, 23 nt, Mycobacterium tuberculosis H37Rv
uaccguucgggccguccucccac

SEQ ID NO: 1344257 - RNA, 14 nt, Mycobacterium tuberculosis H37Rv
uaccggcccggguu

SEQ ID NO: 1344258 - RNA, 18 nt, Mycobacterium tuberculosis H37Rv
uaccggccgccaucaucg

SEQ ID NO: 1344259 - RNA, 15 nt, Mycobacterium tuberculosis H37Rv
uaccggcagcugcuc

SEQ ID NO: 1344260 - RNA, 17 nt, Mycobacterium tuberculosis H37Rv
uaccggccuuuccagca

SEQ ID NO: 1344261 - RNA, 18 nt, Mycobacterium tuberculosis H37Rv
uaccgcuggaaaaucggg

SEQ ID NO: 1344262 - RNA, 14 nt, Mycobacterium tuberculosis H37Rv
uaccgacaccgugu

SEQ ID NO: 1344263 - RNA, 17 nt, Mycobacterium tuberculosis H37Rv
uaccgagaucaccgcca

SEQ ID NO: 1344264 - RNA, 19 nt, Mycobacterium tuberculosis H37Rv
uaccgagauugggcuggga

SEQ ID NO: 1344265 - RNA, 13 nt, Mycobacterium tuberculosis H37Rv
uaccgagcacauc

SEQ ID NO: 1344266 - RNA, 13 nt, Mycobacterium tuberculosis H37Rv
uaccgagcagcag

SEQ ID NO: 1344267 - RNA, 13 nt, Mycobacterium tuberculosis H37Rv
uaccgaacagugg

SEQ ID NO: 1344268 - RNA, 19 nt, Mycobacterium tuberculosis H37Rv
uaccucggccgccagcccc

SEQ ID NO: 1344269 - RNA, 16 nt, Mycobacterium tuberculosis H37Rv
uacccgccucgggccg

SEQ ID NO: 1344270 - RNA, 14 nt, Mycobacterium tuberculosis H37Rv
uacccgggccaggc

SEQ ID NO: 1344271 - RNA, 20 nt, Mycobacterium tuberculosis H37Rv
uacccguagcaccacaucgg

SEQ ID NO: 1344272 - RNA, 16 nt, Mycobacterium tuberculosis H37Rv
uacccggaccgucgug

SEQ ID NO: 1344273 - RNA, 18 nt, Mycobacterium tuberculosis H37Rv
uacccgcgcgaccugaau

SEQ ID NO: 1344274 - RNA, 16 nt, Mycobacterium tuberculosis H37Rv
uacccaucgccacacc

SEQ ID NO: 1344275 - RNA, 12 nt, Mycobacterium tuberculosis H37Rv
uacccagcgccc

SEQ ID NO: 1344276 - RNA, 13 nt, Mycobacterium tuberculosis H37Rv
uacccagcgcggc

SEQ ID NO: 1344277 - RNA, 14 nt, Mycobacterium tuberculosis H37Rv
uaccaccggcaccg

SEQ ID NO: 1344278 - RNA, 17 nt, Mycobacterium tuberculosis H37Rv
uaccaccgucaccgccg

SEQ ID NO: 1344279 - RNA, 19 nt, Mycobacterium tuberculosis H37Rv
uaccuguguugagcggcag

SEQ ID NO: 1344280 - RNA, 11 nt, Mycobacterium tuberculosis H37Rv
uacgaccaaua

SEQ ID NO: 1344281 - RNA, 21 nt, Mycobacterium tuberculosis H37Rv
uacgacuuggugcagcgcagg

SEQ ID NO: 1344282 - RNA, 22 nt, Mycobacterium tuberculosis H37Rv
uacgacgucgcuguaggccagc

SEQ ID NO: 1344283 - RNA, 14 nt, Mycobacterium tuberculosis H37Rv
uacgaggcgggcag

SEQ ID NO: 1344284 - RNA, 19 nt, Mycobacterium tuberculosis H37Rv
uacgcccacuccagcagcu

SEQ ID NO: 1344285 - RNA, 17 nt, Mycobacterium tuberculosis H37Rv
uacgccaaccgcuucca

SEQ ID NO: 1344286 - RNA, 14 nt, Mycobacterium tuberculosis H37Rv
uacgccggccgcgc

SEQ ID NO: 1344287 - RNA, 20 nt, Mycobacterium tuberculosis H37Rv
uacgccccacugccgugccg

SEQ ID NO: 1344288 - RNA, 16 nt, Mycobacterium tuberculosis H37Rv
uacgcgacgguguagc

SEQ ID NO: 1344289 - RNA, 16 nt, Mycobacterium tuberculosis H37Rv
uacgguugaugcaucc

SEQ ID NO: 1344290 - RNA, 21 nt, Mycobacterium tuberculosis H37Rv
uacgcuccgaugaccaggguc

SEQ ID NO: 1344291 - RNA, 14 nt, Mycobacterium tuberculosis H37Rv
uagucgggcaaggc

SEQ ID NO: 1344292 - RNA, 18 nt, Mycobacterium tuberculosis H37Rv
uaggucagcgggcuugcc

SEQ ID NO: 1344293 - RNA, 16 nt, Mycobacterium tuberculosis H37Rv
uagucggcggugcaga

SEQ ID NO: 1344294 - RNA, 19 nt, Mycobacterium tuberculosis H37Rv
uagucucgacaaagcggcu

SEQ ID NO: 1344295 - RNA, 23 nt, Mycobacterium tuberculosis H37Rv
uagucucgacaaagcggcugccc

SEQ ID NO: 1344296 - RNA, 20 nt, Mycobacterium tuberculosis H37Rv
uauagcccguagccgaucag

SEQ ID NO: 1344297 - RNA, 11 nt, Mycobacterium tuberculosis H37Rv
uauagaagccg

SEQ ID NO: 1344298 - RNA, 20 nt, Mycobacterium tuberculosis H37Rv
uauaggcccgggcggccagc

SEQ ID NO: 1344299 - RNA, 17 nt, Mycobacterium tuberculosis H37Rv
uauagcucacgguggcc

SEQ ID NO: 1344300 - RNA, 15 nt, Mycobacterium tuberculosis H37Rv
uauccagucgauccu

SEQ ID NO: 1344301 - RNA, 19 nt, Mycobacterium tuberculosis H37Rv
uaucccgaaucucacccac

SEQ ID NO: 1344302 - RNA, 20 nt, Mycobacterium tuberculosis H37Rv
uaucgcagcguuggccgcug

SEQ ID NO: 1344303 - RNA, 15 nt, Mycobacterium tuberculosis H37Rv
uagccgccggugccg

SEQ ID NO: 1344304 - RNA, 16 nt, Mycobacterium tuberculosis H37Rv
uagccgccggugccgc

SEQ ID NO: 1344305 - RNA, 23 nt, Mycobacterium tuberculosis H37Rv
uagccgcugcacguggccacggc

SEQ ID NO: 1344306 - RNA, 14 nt, Mycobacterium tuberculosis H37Rv
uagccgcggccaca

SEQ ID NO: 1344307 - RNA, 19 nt, Mycobacterium tuberculosis H37Rv
uagccgcagcuuggccuca

SEQ ID NO: 1344308 - RNA, 16 nt, Mycobacterium tuberculosis H37Rv
uagccgauccagcagg

SEQ ID NO: 1344309 - RNA, 23 nt, Mycobacterium tuberculosis H37Rv
uagccaugggauucggccagacg

SEQ ID NO: 1344310 - RNA, 15 nt, Mycobacterium tuberculosis H37Rv
uagccagcagcggcu

SEQ ID NO: 1344311 - RNA, 20 nt, Mycobacterium tuberculosis H37Rv
uagccaggcaaccggucagc

SEQ ID NO: 1344312 - RNA, 20 nt, Mycobacterium tuberculosis H37Rv
uagccacgcaugggccaggu

SEQ ID NO: 1344313 - RNA, 19 nt, Mycobacterium tuberculosis H37Rv
uagccugcguggagcgcuu

SEQ ID NO: 1344314 - RNA, 18 nt, Mycobacterium tuberculosis H37Rv
uagcgaagugcgcgcugg

SEQ ID NO: 1344315 - RNA, 15 nt, Mycobacterium tuberculosis H37Rv
uagcgaagaacuggg

SEQ ID NO: 1344316 - RNA, 23 nt, Mycobacterium tuberculosis H37Rv
uagccguugccgccgaacagcug

SEQ ID NO: 1344317 - RNA, 20 nt, Mycobacterium tuberculosis H37Rv
uagccggcgugcacucccuu

SEQ ID NO: 1344318 - RNA, 11 nt, Mycobacterium tuberculosis H37Rv
uagcacaccga

SEQ ID NO: 1344319 - RNA, 13 nt, Mycobacterium tuberculosis H37Rv
uagaucagcgccu

SEQ ID NO: 1344320 - RNA, 17 nt, Mycobacterium tuberculosis H37Rv
uagaucacccgcagccg

SEQ ID NO: 1344321 - RNA, 16 nt, Mycobacterium tuberculosis H37Rv
uagaucaagaucugcu

SEQ ID NO: 1344322 - RNA, 14 nt, Mycobacterium tuberculosis H37Rv
uagcagaaggccgc

SEQ ID NO: 1344323 - RNA, 11 nt, Mycobacterium tuberculosis H37Rv
uagcacccacg

SEQ ID NO: 1344324 - RNA, 23 nt, Mycobacterium tuberculosis H37Rv
uagcaccaguucccuacacccau

SEQ ID NO: 1344325 - RNA, 16 nt, Mycobacterium tuberculosis H37Rv
uagcacaucaugaaga

SEQ ID NO: 1344326 - RNA, 18 nt, Mycobacterium tuberculosis H37Rv
uagcacaucgccggcguc

SEQ ID NO: 1344327 - RNA, 17 nt, Mycobacterium tuberculosis H37Rv
uagcgagcgcacaccgg

SEQ ID NO: 1344328 - RNA, 20 nt, Mycobacterium tuberculosis H37Rv
uagcucacguuugaggaccu

SEQ ID NO: 1344329 - RNA, 14 nt, Mycobacterium tuberculosis H37Rv
uagcucccugggcg

SEQ ID NO: 1344330 - RNA, 13 nt, Mycobacterium tuberculosis H37Rv
uagcugccggccc

SEQ ID NO: 1344331 - RNA, 16 nt, Mycobacterium tuberculosis H37Rv
uagcugcguccggaac

SEQ ID NO: 1344332 - RNA, 17 nt, Mycobacterium tuberculosis H37Rv
uaggcgauggcggcgcg

SEQ ID NO: 1344333 - RNA, 12 nt, Mycobacterium tuberculosis H37Rv
uagggcagcgcc

SEQ ID NO: 1344334 - RNA, 16 nt, Mycobacterium tuberculosis H37Rv
uagggccgccaucccc

SEQ ID NO: 1344335 - RNA, 22 nt, Mycobacterium tuberculosis H37Rv
uaggguggcgauccacaggcug

SEQ ID NO: 1344336 - RNA, 21 nt, Mycobacterium tuberculosis H37Rv
uagggcugaccgaagaagccc

SEQ ID NO: 1344337 - RNA, 14 nt, Mycobacterium tuberculosis H37Rv
uaggcgaccagaua

SEQ ID NO: 1344338 - RNA, 16 nt, Mycobacterium tuberculosis H37Rv
uaggcgaucucacgca

SEQ ID NO: 1344339 - RNA, 13 nt, Mycobacterium tuberculosis H37Rv
uaggcgaccagau

SEQ ID NO: 1344340 - RNA, 14 nt, Mycobacterium tuberculosis H37Rv
uaggccucggcagc

SEQ ID NO: 1344341 - RNA, 15 nt, Mycobacterium tuberculosis H37Rv
uaggccucggcagca

SEQ ID NO: 1344342 - RNA, 13 nt, Mycobacterium tuberculosis H37Rv
uagaccugguuga

SEQ ID NO: 1344343 - RNA, 15 nt, Mycobacterium tuberculosis H37Rv
uagaccaugaagaac

SEQ ID NO: 1344344 - RNA, 20 nt, Mycobacterium tuberculosis H37Rv
uagacagucugcgacuggau

SEQ ID NO: 1344345 - RNA, 21 nt, Mycobacterium tuberculosis H37Rv
uagacggcgaaaaucccgcuc

SEQ ID NO: 1344346 - RNA, 22 nt, Mycobacterium tuberculosis H37Rv
uagaggauggucagcagcucca

SEQ ID NO: 1344347 - RNA, 19 nt, Mycobacterium tuberculosis H37Rv
uagaggauggucagcagcu

SEQ ID NO: 1344348 - RNA, 16 nt, Mycobacterium tuberculosis H37Rv
uagaggauggucagca

SEQ ID NO: 1344349 - RNA, 18 nt, Mycobacterium tuberculosis H37Rv
uagaggacugcggucugg

SEQ ID NO: 1344350 - RNA, 21 nt, Mycobacterium tuberculosis H37Rv
uacuaggcccagcacggucaa

SEQ ID NO: 1344351 - RNA, 13 nt, Mycobacterium tuberculosis H37Rv
uacuaugccaacg

SEQ ID NO: 1344352 - RNA, 17 nt, Mycobacterium tuberculosis H37Rv
uagaacgucuggguugc

SEQ ID NO: 1344353 - RNA, 20 nt, Mycobacterium tuberculosis H37Rv
uagaagccgacguugaagcc

SEQ ID NO: 1344354 - RNA, 16 nt, Mycobacterium tuberculosis H37Rv
gccccggcauacucuu

SEQ ID NO: 1344355 - RNA, 14 nt, Mycobacterium tuberculosis H37Rv
gccccggccaggac

SEQ ID NO: 1344356 - RNA, 21 nt, Mycobacterium tuberculosis H37Rv
gccccggcauugcccgagccc

SEQ ID NO: 1344357 - RNA, 17 nt, Mycobacterium tuberculosis H37Rv
gccccggcgcggccagc

SEQ ID NO: 1344358 - RNA, 12 nt, Mycobacterium tuberculosis H37Rv
gccccggcggcg

SEQ ID NO: 1344359 - RNA, 14 nt, Mycobacterium tuberculosis H37Rv
gccccgccgcuacc

SEQ ID NO: 1344360 - RNA, 12 nt, Mycobacterium tuberculosis H37Rv
gccccgccggcc

SEQ ID NO: 1344361 - RNA, 23 nt, Mycobacterium tuberculosis H37Rv
gccccgccggggccgccgucgcc

SEQ ID NO: 1344362 - RNA, 17 nt, Mycobacterium tuberculosis H37Rv
gccccgccuuggccacc

SEQ ID NO: 1344363 - RNA, 19 nt, Mycobacterium tuberculosis H37Rv
gccccgccgucacccccga

SEQ ID NO: 1344364 - RNA, 15 nt, Mycobacterium tuberculosis H37Rv
gccccgccguuaccg

SEQ ID NO: 1344365 - RNA, 17 nt, Mycobacterium tuberculosis H37Rv
gccccgccguugccgcc

SEQ ID NO: 1344366 - RNA, 21 nt, Mycobacterium tuberculosis H37Rv
gccccgccguuuccgccgccg

SEQ ID NO: 1344367 - RNA, 17 nt, Mycobacterium tuberculosis H37Rv
gccccgcgccggccgca

SEQ ID NO: 1344368 - RNA, 13 nt, Mycobacterium tuberculosis H37Rv
gccccgcgccggc

SEQ ID NO: 1344369 - RNA, 15 nt, Mycobacterium tuberculosis H37Rv
gccccgcggccagca

SEQ ID NO: 1344370 - RNA, 12 nt, Mycobacterium tuberculosis H37Rv
gccccgcggcca

SEQ ID NO: 1344371 - RNA, 20 nt, Mycobacterium tuberculosis H37Rv
gccccgcgcguucggcgagc

SEQ ID NO: 1344372 - RNA, 12 nt, Mycobacterium tuberculosis H37Rv
gccccgcagcug

SEQ ID NO: 1344373 - RNA, 18 nt, Mycobacterium tuberculosis H37Rv
gccccgcggcgccgccac

SEQ ID NO: 1344374 - RNA, 17 nt, Mycobacterium tuberculosis H37Rv
gccccgcggcgccgcca

SEQ ID NO: 1344375 - RNA, 15 nt, Mycobacterium tuberculosis H37Rv
gccccgcggagcgca

SEQ ID NO: 1344376 - RNA, 12 nt, Mycobacterium tuberculosis H37Rv
gccccgcggcgc

SEQ ID NO: 1344377 - RNA, 22 nt, Mycobacterium tuberculosis H37Rv
gcccgacaccgccccgccgcga

SEQ ID NO: 1344378 - RNA, 18 nt, Mycobacterium tuberculosis H37Rv
gccccuucaaagcggccu

SEQ ID NO: 1344379 - RNA, 14 nt, Mycobacterium tuberculosis H37Rv
gcccgacccggccg

SEQ ID NO: 1344380 - RNA, 22 nt, Mycobacterium tuberculosis H37Rv
gcccgacgagucgccgcgggca

SEQ ID NO: 1344381 - RNA, 21 nt, Mycobacterium tuberculosis H37Rv
gcccgacgagauugccgggcc

SEQ ID NO: 1344382 - RNA, 20 nt, Mycobacterium tuberculosis H37Rv
gcccgacaccguccagcagc

SEQ ID NO: 1344383 - RNA, 14 nt, Mycobacterium tuberculosis H37Rv
gcccgacccaucac

SEQ ID NO: 1344384 - RNA, 15 nt, Mycobacterium tuberculosis H37Rv
gcccgacccaucacc

SEQ ID NO: 1344385 - RNA, 17 nt, Mycobacterium tuberculosis H37Rv
gcccgacccaucaccag

SEQ ID NO: 1344386 - RNA, 17 nt, Mycobacterium tuberculosis H37Rv
gcccgacccgccgacgc

SEQ ID NO: 1344387 - RNA, 20 nt, Mycobacterium tuberculosis H37Rv
gccccuggcaccucgcccuc

SEQ ID NO: 1344388 - RNA, 12 nt, Mycobacterium tuberculosis H37Rv
gccccggggugc

SEQ ID NO: 1344389 - RNA, 21 nt, Mycobacterium tuberculosis H37Rv
gccccggcucucuucgcgcgc

SEQ ID NO: 1344390 - RNA, 14 nt, Mycobacterium tuberculosis H37Rv
gccccggcucucuu

SEQ ID NO: 1344391 - RNA, 18 nt, Mycobacterium tuberculosis H37Rv
gccccggcgguaccagag

SEQ ID NO: 1344392 - RNA, 19 nt, Mycobacterium tuberculosis H37Rv
gccccggcgguaccagagc

SEQ ID NO: 1344393 - RNA, 23 nt, Mycobacterium tuberculosis H37Rv
gcccgcgcagcgguccgccgccu

SEQ ID NO: 1344394 - RNA, 17 nt, Mycobacterium tuberculosis H37Rv
gcccgcgaucgggccga

SEQ ID NO: 1344395 - RNA, 20 nt, Mycobacterium tuberculosis H37Rv
gcccgcgaucucggagcgca

SEQ ID NO: 1344396 - RNA, 22 nt, Mycobacterium tuberculosis H37Rv
gcccgcgccgccgcuacccccg

SEQ ID NO: 1344397 - RNA, 16 nt, Mycobacterium tuberculosis H37Rv
gcccgcgccgccgcca

SEQ ID NO: 1344398 - RNA, 17 nt, Mycobacterium tuberculosis H37Rv
gcccgcgccgccgccac

SEQ ID NO: 1344399 - RNA, 15 nt, Mycobacterium tuberculosis H37Rv
gcccgcgccaccggc

SEQ ID NO: 1344400 - RNA, 23 nt, Mycobacterium tuberculosis H37Rv
gcccgcgccgccgcuacccccga

SEQ ID NO: 1344401 - RNA, 21 nt, Mycobacterium tuberculosis H37Rv
gcccgcgucgacgagcggcuu

SEQ ID NO: 1344402 - RNA, 21 nt, Mycobacterium tuberculosis H37Rv
gcccgccggauccgccagacc

SEQ ID NO: 1344403 - RNA, 13 nt, Mycobacterium tuberculosis H37Rv
gcccgccagcgcc

SEQ ID NO: 1344404 - RNA, 13 nt, Mycobacterium tuberculosis H37Rv
gcccgccagccca

SEQ ID NO: 1344405 - RNA, 15 nt, Mycobacterium tuberculosis H37Rv
gcccgccagcccagc

SEQ ID NO: 1344406 - RNA, 19 nt, Mycobacterium tuberculosis H37Rv
gcccgccagcgauccacca

SEQ ID NO: 1344407 - RNA, 15 nt, Mycobacterium tuberculosis H37Rv
gcccgccacagcccc

SEQ ID NO: 1344408 - RNA, 19 nt, Mycobacterium tuberculosis H37Rv
gcccgcauugccaacgccc

SEQ ID NO: 1344409 - RNA, 13 nt, Mycobacterium tuberculosis H37Rv
gcccgccaccccg

SEQ ID NO: 1344410 - RNA, 13 nt, Mycobacterium tuberculosis H37Rv
gcccgccaccggg

SEQ ID NO: 1344411 - RNA, 18 nt, Mycobacterium tuberculosis H37Rv
gcccgcaggucggccacc

SEQ ID NO: 1344412 - RNA, 15 nt, Mycobacterium tuberculosis H37Rv
gcccgcauccgcacc

SEQ ID NO: 1344413 - RNA, 14 nt, Mycobacterium tuberculosis H37Rv
gcccgcaucgcggc

SEQ ID NO: 1344414 - RNA, 13 nt, Mycobacterium tuberculosis H37Rv
gcccgcagcagca

SEQ ID NO: 1344415 - RNA, 22 nt, Mycobacterium tuberculosis H37Rv
gcccgcacccccgacaccgccg

SEQ ID NO: 1344416 - RNA, 14 nt, Mycobacterium tuberculosis H37Rv
gcccgcacccgcgc

SEQ ID NO: 1344417 - RNA, 15 nt, Mycobacterium tuberculosis H37Rv
gcccgacgccagcug

SEQ ID NO: 1344418 - RNA, 16 nt, Mycobacterium tuberculosis H37Rv
gcccgacgccagcugc

SEQ ID NO: 1344419 - RNA, 17 nt, Mycobacterium tuberculosis H37Rv
gcccgacgccagcugcc

SEQ ID NO: 1344420 - RNA, 17 nt, Mycobacterium tuberculosis H37Rv
gcccgagacgguguugc

SEQ ID NO: 1344421 - RNA, 21 nt, Mycobacterium tuberculosis H37Rv
gcccgagaccggcaccggccg

SEQ ID NO: 1344422 - RNA, 23 nt, Mycobacterium tuberculosis H37Rv
gcccgacgugaagccaagcgacu

SEQ ID NO: 1344423 - RNA, 18 nt, Mycobacterium tuberculosis H37Rv
gcccgcaccaccggcccc

SEQ ID NO: 1344424 - RNA, 14 nt, Mycobacterium tuberculosis H37Rv
gcccgcaccagaaa

SEQ ID NO: 1344425 - RNA, 18 nt, Mycobacterium tuberculosis H37Rv
gcccgcacggccgcagcc

SEQ ID NO: 1344426 - RNA, 19 nt, Mycobacterium tuberculosis H37Rv
gcccgcacggccgcagccg

SEQ ID NO: 1344427 - RNA, 21 nt, Mycobacterium tuberculosis H37Rv
gcccgcacguuggcggccagc

SEQ ID NO: 1344428 - RNA, 16 nt, Mycobacterium tuberculosis H37Rv
gcccgcacugccgccg

SEQ ID NO: 1344429 - RNA, 17 nt, Mycobacterium tuberculosis H37Rv
gcccgagcccagccggg

SEQ ID NO: 1344430 - RNA, 15 nt, Mycobacterium tuberculosis H37Rv
gcccgagcccagcgc

SEQ ID NO: 1344431 - RNA, 21 nt, Mycobacterium tuberculosis H37Rv
gcccgagcccagcgccuccag

SEQ ID NO: 1344432 - RNA, 17 nt, Mycobacterium tuberculosis H37Rv
gcccgagcccagcgccu

SEQ ID NO: 1344433 - RNA, 16 nt, Mycobacterium tuberculosis H37Rv
gcccgagccgcguggg

SEQ ID NO: 1344434 - RNA, 18 nt, Mycobacterium tuberculosis H37Rv
gcccggcgugucgccgcc

SEQ ID NO: 1344435 - RNA, 23 nt, Mycobacterium tuberculosis H37Rv
gcccggcguuguugaccagcacg

SEQ ID NO: 1344436 - RNA, 21 nt, Mycobacterium tuberculosis H37Rv
gcccggcgugucgccgccacc

SEQ ID NO: 1344437 - RNA, 13 nt, Mycobacterium tuberculosis H37Rv
gcccgggccgcgu

SEQ ID NO: 1344438 - RNA, 23 nt, Mycobacterium tuberculosis H37Rv
gcccggcuaggagaucagcaccg

SEQ ID NO: 1344439 - RNA, 16 nt, Mycobacterium tuberculosis H37Rv
gcccggcucacagcac

SEQ ID NO: 1344440 - RNA, 11 nt, Mycobacterium tuberculosis H37Rv
gcccggcggcg

SEQ ID NO: 1344441 - RNA, 13 nt, Mycobacterium tuberculosis H37Rv
gcccggcggccgc

SEQ ID NO: 1344442 - RNA, 14 nt, Mycobacterium tuberculosis H37Rv
gcccggcggccgcu

SEQ ID NO: 1344443 - RNA, 15 nt, Mycobacterium tuberculosis H37Rv
gcccggcggccagcu

SEQ ID NO: 1344444 - RNA, 17 nt, Mycobacterium tuberculosis H37Rv
gcccggcggccagcucc

SEQ ID NO: 1344445 - RNA, 18 nt, Mycobacterium tuberculosis H37Rv
gcccggccuugccgccgg

SEQ ID NO: 1344446 - RNA, 15 nt, Mycobacterium tuberculosis H37Rv
gcccguagcugcgca

SEQ ID NO: 1344447 - RNA, 16 nt, Mycobacterium tuberculosis H37Rv
gcccgggugacgggaa

SEQ ID NO: 1344448 - RNA, 21 nt, Mycobacterium tuberculosis H37Rv
gcccguccaggcgcugcagca

SEQ ID NO: 1344449 - RNA, 14 nt, Mycobacterium tuberculosis H37Rv
gcccgucccgccgg

SEQ ID NO: 1344450 - RNA, 18 nt, Mycobacterium tuberculosis H37Rv
gcccguccaggcgcugca

SEQ ID NO: 1344451 - RNA, 18 nt, Mycobacterium tuberculosis H37Rv
gcccgggcggccagcugc

SEQ ID NO: 1344452 - RNA, 17 nt, Mycobacterium tuberculosis H37Rv
gcccgggcggccagcug

SEQ ID NO: 1344453 - RNA, 16 nt, Mycobacterium tuberculosis H37Rv
gcccgggcggccagcu

SEQ ID NO: 1344454 - RNA, 14 nt, Mycobacterium tuberculosis H37Rv
gcccgggcgggagu

SEQ ID NO: 1344455 - RNA, 21 nt, Mycobacterium tuberculosis H37Rv
gcccgggcgggauccacccag

SEQ ID NO: 1344456 - RNA, 17 nt, Mycobacterium tuberculosis H37Rv
gcccggggcgcacagcu

SEQ ID NO: 1344457 - RNA, 17 nt, Mycobacterium tuberculosis H37Rv
gcccgggguccaucggg

SEQ ID NO: 1344458 - RNA, 21 nt, Mycobacterium tuberculosis H37Rv
gcccgggguccaucggggccg

SEQ ID NO: 1344459 - RNA, 22 nt, Mycobacterium tuberculosis H37Rv
gcccggggcgcucgugauguug

SEQ ID NO: 1344460 - RNA, 19 nt, Mycobacterium tuberculosis H37Rv
gcccgggucuccggcgcac

SEQ ID NO: 1344461 - RNA, 21 nt, Mycobacterium tuberculosis H37Rv
gcccgcucagccguccgggcg

SEQ ID NO: 1344462 - RNA, 14 nt, Mycobacterium tuberculosis H37Rv
gcccgcucauaccg

SEQ ID NO: 1344463 - RNA, 13 nt, Mycobacterium tuberculosis H37Rv
gcccgcucagccg

SEQ ID NO: 1344464 - RNA, 17 nt, Mycobacterium tuberculosis H37Rv
gcccgcucaacgggccg

SEQ ID NO: 1344465 - RNA, 21 nt, Mycobacterium tuberculosis H37Rv
gcccgcguucagggcacgcug

SEQ ID NO: 1344466 - RNA, 13 nt, Mycobacterium tuberculosis H37Rv
gcccgcguucagg

SEQ ID NO: 1344467 - RNA, 20 nt, Mycobacterium tuberculosis H37Rv
gcccgcgugcgcaucccgaa

SEQ ID NO: 1344468 - RNA, 15 nt, Mycobacterium tuberculosis H37Rv
gcccgcucagccguc

SEQ ID NO: 1344469 - RNA, 17 nt, Mycobacterium tuberculosis H37Rv
gcccgcucgaucggcag

SEQ ID NO: 1344470 - RNA, 14 nt, Mycobacterium tuberculosis H37Rv
gcccgcuccgggac

SEQ ID NO: 1344471 - RNA, 19 nt, Mycobacterium tuberculosis H37Rv
gcccgcugaucagauccuc

SEQ ID NO: 1344472 - RNA, 14 nt, Mycobacterium tuberculosis H37Rv
gcccgcugcagacg

SEQ ID NO: 1344473 - RNA, 13 nt, Mycobacterium tuberculosis H37Rv
gcccgcugagcac

SEQ ID NO: 1344474 - RNA, 13 nt, Mycobacterium tuberculosis H37Rv
gcccgcugagcca

SEQ ID NO: 1344475 - RNA, 17 nt, Mycobacterium tuberculosis H37Rv
gcccgcucggccgcagc

SEQ ID NO: 1344476 - RNA, 18 nt, Mycobacterium tuberculosis H37Rv
gcccgcucggccgcagcc

SEQ ID NO: 1344477 - RNA, 13 nt, Mycobacterium tuberculosis H37Rv
gcccgcucggccg

SEQ ID NO: 1344478 - RNA, 16 nt, Mycobacterium tuberculosis H37Rv
gcccggccgccagcgc

SEQ ID NO: 1344479 - RNA, 15 nt, Mycobacterium tuberculosis H37Rv
gcccggccaugauga

SEQ ID NO: 1344480 - RNA, 11 nt, Mycobacterium tuberculosis H37Rv
gcccggccgcg

SEQ ID NO: 1344481 - RNA, 16 nt, Mycobacterium tuberculosis H37Rv
gcccggccccgcaagc

SEQ ID NO: 1344482 - RNA, 13 nt, Mycobacterium tuberculosis H37Rv
gcccggccgcagc

SEQ ID NO: 1344483 - RNA, 13 nt, Mycobacterium tuberculosis H37Rv
gcccggccgccac

SEQ ID NO: 1344484 - RNA, 14 nt, Mycobacterium tuberculosis H37Rv
gcccggccgccacu

SEQ ID NO: 1344485 - RNA, 19 nt, Mycobacterium tuberculosis H37Rv
gcccgcugggcucgcugca

SEQ ID NO: 1344486 - RNA, 14 nt, Mycobacterium tuberculosis H37Rv
gcccgcuucagcac

SEQ ID NO: 1344487 - RNA, 15 nt, Mycobacterium tuberculosis H37Rv
gcccgcuucagcacg

SEQ ID NO: 1344488 - RNA, 15 nt, Mycobacterium tuberculosis H37Rv
gcccgcugcgcggcc

SEQ ID NO: 1344489 - RNA, 19 nt, Mycobacterium tuberculosis H37Rv
gcccgcugcgccgggucug

SEQ ID NO: 1344490 - RNA, 14 nt, Mycobacterium tuberculosis H37Rv
gcccugacacccau

SEQ ID NO: 1344491 - RNA, 14 nt, Mycobacterium tuberculosis H37Rv
gcccugccgccggc

SEQ ID NO: 1344492 - RNA, 17 nt, Mycobacterium tuberculosis H37Rv
gcccugccggcagcggc

SEQ ID NO: 1344493 - RNA, 18 nt, Mycobacterium tuberculosis H37Rv
gcccugccgacgcuccag

SEQ ID NO: 1344494 - RNA, 15 nt, Mycobacterium tuberculosis H37Rv
gcccugaccgcccgc

SEQ ID NO: 1344495 - RNA, 17 nt, Mycobacterium tuberculosis H37Rv
gcccugcgcagccgccu

SEQ ID NO: 1344496 - RNA, 15 nt, Mycobacterium tuberculosis H37Rv
gcccugggcgccggc

SEQ ID NO: 1344497 - RNA, 21 nt, Mycobacterium tuberculosis H37Rv
gcccucgucgcgggccaccgc

SEQ ID NO: 1344498 - RNA, 21 nt, Mycobacterium tuberculosis H37Rv
gcccucguuaucgaccgccgc

SEQ ID NO: 1344499 - RNA, 17 nt, Mycobacterium tuberculosis H37Rv
gcccucgucgaucgccg

SEQ ID NO: 1344500 - RNA, 17 nt, Mycobacterium tuberculosis H37Rv
gcccuccagggcccugc

SEQ ID NO: 1344501 - RNA, 24 nt, Mycobacterium tuberculosis H37Rv
gcccuccucgaccgcggccuuggc

SEQ ID NO: 1344502 - RNA, 19 nt, Mycobacterium tuberculosis H37Rv
gcccuccucgaccgcggcc

SEQ ID NO: 1344503 - RNA, 21 nt, Mycobacterium tuberculosis H37Rv
gcccucccgggcccgcugggc

SEQ ID NO: 1344504 - RNA, 15 nt, Mycobacterium tuberculosis H37Rv
gcccuccgagcacag

SEQ ID NO: 1344505 - RNA, 17 nt, Mycobacterium tuberculosis H37Rv
gcccucccgggcccgcu

SEQ ID NO: 1344506 - RNA, 19 nt, Mycobacterium tuberculosis H37Rv
gcccuccggguauggcggc

SEQ ID NO: 1344507 - RNA, 15 nt, Mycobacterium tuberculosis H37Rv
gcccucagccgcggc

SEQ ID NO: 1344508 - RNA, 20 nt, Mycobacterium tuberculosis H37Rv
gcccucagcuagcgcgggcu

SEQ ID NO: 1344509 - RNA, 18 nt, Mycobacterium tuberculosis H37Rv
gcccucauaggccugcag

SEQ ID NO: 1344510 - RNA, 22 nt, Mycobacterium tuberculosis H37Rv
gcccuccacugcgagcgccggc

SEQ ID NO: 1344511 - RNA, 13 nt, Mycobacterium tuberculosis H37Rv
gcccuccaccggu

SEQ ID NO: 1344512 - RNA, 16 nt, Mycobacterium tuberculosis H37Rv
gcccguucugcccagg

SEQ ID NO: 1344513 - RNA, 18 nt, Mycobacterium tuberculosis H37Rv
gcccguucaugcggcggc

SEQ ID NO: 1344514 - RNA, 19 nt, Mycobacterium tuberculosis H37Rv
gcccguucaugcggcggcg

SEQ ID NO: 1344515 - RNA, 15 nt, Mycobacterium tuberculosis H37Rv
gcccguugcagguga

SEQ ID NO: 1344516 - RNA, 15 nt, Mycobacterium tuberculosis H37Rv
gcccguuugccgguu

SEQ ID NO: 1344517 - RNA, 17 nt, Mycobacterium tuberculosis H37Rv
gcccguuuccucagcug

SEQ ID NO: 1344518 - RNA, 20 nt, Mycobacterium tuberculosis H37Rv
gcccguccggcccccgaggc

SEQ ID NO: 1344519 - RNA, 17 nt, Mycobacterium tuberculosis H37Rv
gcccguccucgucggug

SEQ ID NO: 1344520 - RNA, 19 nt, Mycobacterium tuberculosis H37Rv
gcccguguuaaagaagccu

SEQ ID NO: 1344521 - RNA, 18 nt, Mycobacterium tuberculosis H37Rv
gcccguguuaaagaagcc

SEQ ID NO: 1344522 - RNA, 14 nt, Mycobacterium tuberculosis H37Rv
gcccagguugccaa

SEQ ID NO: 1344523 - RNA, 15 nt, Mycobacterium tuberculosis H37Rv
gcccagguugccuug

SEQ ID NO: 1344524 - RNA, 23 nt, Mycobacterium tuberculosis H37Rv
gcccaggugggccgagagcagcc

SEQ ID NO: 1344525 - RNA, 22 nt, Mycobacterium tuberculosis H37Rv
gcccagguguguggcggcgucc

SEQ ID NO: 1344526 - RNA, 20 nt, Mycobacterium tuberculosis H37Rv
gcccaggugaucgcgaggcu

SEQ ID NO: 1344527 - RNA, 18 nt, Mycobacterium tuberculosis H37Rv
gcccaggugcguccaggc

SEQ ID NO: 1344528 - RNA, 22 nt, Mycobacterium tuberculosis H37Rv
gcccaggucuccaucaaccgcg

SEQ ID NO: 1344529 - RNA, 17 nt, Mycobacterium tuberculosis H37Rv
gcccaggugacgcccgc

SEQ ID NO: 1344530 - RNA, 17 nt, Mycobacterium tuberculosis H37Rv
gcccaggucgaugcggg

SEQ ID NO: 1344531 - RNA, 15 nt, Mycobacterium tuberculosis H37Rv
gcccaggucuccauc

SEQ ID NO: 1344532 - RNA, 21 nt, Mycobacterium tuberculosis H37Rv
gcccagugggacaggucggca

SEQ ID NO: 1344533 - RNA, 22 nt, Mycobacterium tuberculosis H37Rv
gcccaggcgaucgcccggcccc

SEQ ID NO: 1344534 - RNA, 23 nt, Mycobacterium tuberculosis H37Rv
gcccaggccgaucagcgcggcgc

SEQ ID NO: 1344535 - RNA, 17 nt, Mycobacterium tuberculosis H37Rv
gcccaggcguccaucag

SEQ ID NO: 1344536 - RNA, 22 nt, Mycobacterium tuberculosis H37Rv
gcccaggcgugucgucgcggcc

SEQ ID NO: 1344537 - RNA, 11 nt, Mycobacterium tuberculosis H37Rv
gcccagggugg

SEQ ID NO: 1344538 - RNA, 22 nt, Mycobacterium tuberculosis H37Rv
gcccaucgcgacuagacgccgc

SEQ ID NO: 1344539 - RNA, 15 nt, Mycobacterium tuberculosis H37Rv
gcccaguuccgcugc

SEQ ID NO: 1344540 - RNA, 22 nt, Mycobacterium tuberculosis H37Rv
gcccauaacagcuggcggcagc

SEQ ID NO: 1344541 - RNA, 17 nt, Mycobacterium tuberculosis H37Rv
gcccauaacagcuggcg

SEQ ID NO: 1344542 - RNA, 14 nt, Mycobacterium tuberculosis H37Rv
gcccauagcaccuc

SEQ ID NO: 1344543 - RNA, 17 nt, Mycobacterium tuberculosis H37Rv
gcccaucacacccggua

SEQ ID NO: 1344544 - RNA, 14 nt, Mycobacterium tuberculosis H37Rv
gcccaucacacccg

SEQ ID NO: 1344545 - RNA, 20 nt, Mycobacterium tuberculosis H37Rv
gcccagaaaaccgccgcaac

SEQ ID NO: 1344546 - RNA, 15 nt, Mycobacterium tuberculosis H37Rv
gcccacuccagcagc

SEQ ID NO: 1344547 - RNA, 21 nt, Mycobacterium tuberculosis H37Rv
gcccacuccagcagcucgccg

SEQ ID NO: 1344548 - RNA, 20 nt, Mycobacterium tuberculosis H37Rv
gcccagcacccucaggcaau

SEQ ID NO: 1344549 - RNA, 18 nt, Mycobacterium tuberculosis H37Rv
gcccagcaaccgcucggc

SEQ ID NO: 1344550 - RNA, 19 nt, Mycobacterium tuberculosis H37Rv
gcccagcaccaccacccga

SEQ ID NO: 1344551 - RNA, 22 nt, Mycobacterium tuberculosis H37Rv
gcccacggugccggcacccgag

SEQ ID NO: 1344552 - RNA, 23 nt, Mycobacterium tuberculosis H37Rv
gcccacggcgaccacgccgccgg

SEQ ID NO: 1344553 - RNA, 19 nt, Mycobacterium tuberculosis H37Rv
gcccacguuggccccgcgg

SEQ ID NO: 1344554 - RNA, 23 nt, Mycobacterium tuberculosis H37Rv
gcccacguuggccaggcccgagu

SEQ ID NO: 1344555 - RNA, 15 nt, Mycobacterium tuberculosis H37Rv
gcccacguggggccg

SEQ ID NO: 1344556 - RNA, 16 nt, Mycobacterium tuberculosis H37Rv
gcccacguggggccgg

SEQ ID NO: 1344557 - RNA, 18 nt, Mycobacterium tuberculosis H37Rv
gcccacgugggcacucau

SEQ ID NO: 1344558 - RNA, 18 nt, Mycobacterium tuberculosis H37Rv
gccaugcucgccaaaccc

SEQ ID NO: 1344559 - RNA, 21 nt, Mycobacterium tuberculosis H37Rv
gccaugcgguuugccggugcg

SEQ ID NO: 1344560 - RNA, 17 nt, Mycobacterium tuberculosis H37Rv
gcccacggcgaccagga

SEQ ID NO: 1344561 - RNA, 19 nt, Mycobacterium tuberculosis H37Rv
gcccacggcgaccaggagc

SEQ ID NO: 1344562 - RNA, 15 nt, Mycobacterium tuberculosis H37Rv
gccaugcugcccuug

SEQ ID NO: 1344563 - RNA, 22 nt, Mycobacterium tuberculosis H37Rv
gccaugcgggugucgggcagca

SEQ ID NO: 1344564 - RNA, 19 nt, Mycobacterium tuberculosis H37Rv
gcccagcgacccggccagc

SEQ ID NO: 1344565 - RNA, 21 nt, Mycobacterium tuberculosis H37Rv
gcccagccggaccgcgacggc

SEQ ID NO: 1344566 - RNA, 19 nt, Mycobacterium tuberculosis H37Rv
gcccagcgaccgcugcaga

SEQ ID NO: 1344567 - RNA, 14 nt, Mycobacterium tuberculosis H37Rv
gcccagccgcagca

SEQ ID NO: 1344568 - RNA, 14 nt, Mycobacterium tuberculosis H37Rv
gcccagccgagcgg

SEQ ID NO: 1344569 - RNA, 18 nt, Mycobacterium tuberculosis H37Rv
gcccagccgagcggcggc

SEQ ID NO: 1344570 - RNA, 13 nt, Mycobacterium tuberculosis H37Rv
gcccagcccggcg

SEQ ID NO: 1344571 - RNA, 15 nt, Mycobacterium tuberculosis H37Rv
gcccagccgccagcc

SEQ ID NO: 1344572 - RNA, 17 nt, Mycobacterium tuberculosis H37Rv
gcccagccgccagcccg

SEQ ID NO: 1344573 - RNA, 12 nt, Mycobacterium tuberculosis H37Rv
gcccagcagcac

SEQ ID NO: 1344574 - RNA, 14 nt, Mycobacterium tuberculosis H37Rv
gcccagcagcaccu

SEQ ID NO: 1344575 - RNA, 19 nt, Mycobacterium tuberculosis H37Rv
gcccagcagcaccugcacc

SEQ ID NO: 1344576 - RNA, 23 nt, Mycobacterium tuberculosis H37Rv
gcccaggccaccggcugcaacca

SEQ ID NO: 1344577 - RNA, 11 nt, Mycobacterium tuberculosis H37Rv
gcccauggcgu

SEQ ID NO: 1344578 - RNA, 19 nt, Mycobacterium tuberculosis H37Rv
gcccauggcgucgaaccag

SEQ ID NO: 1344579 - RNA, 14 nt, Mycobacterium tuberculosis H37Rv
gcccaucucaugca

SEQ ID NO: 1344580 - RNA, 21 nt, Mycobacterium tuberculosis H37Rv
gcccaucucaugcaucugcuu

SEQ ID NO: 1344581 - RNA, 19 nt, Mycobacterium tuberculosis H37Rv
gcccaucucgggcaggccg

SEQ ID NO: 1344582 - RNA, 15 nt, Mycobacterium tuberculosis H37Rv
gcccaugauggucac

SEQ ID NO: 1344583 - RNA, 16 nt, Mycobacterium tuberculosis H37Rv
gcccauggccaccagg

SEQ ID NO: 1344584 - RNA, 18 nt, Mycobacterium tuberculosis H37Rv
gccccaccgacagcccca

SEQ ID NO: 1344585 - RNA, 21 nt, Mycobacterium tuberculosis H37Rv
gccccaccgguaccgccacuu

SEQ ID NO: 1344586 - RNA, 11 nt, Mycobacterium tuberculosis H37Rv
gccccaccggu

SEQ ID NO: 1344587 - RNA, 16 nt, Mycobacterium tuberculosis H37Rv
gccccacuggugcagc

SEQ ID NO: 1344588 - RNA, 23 nt, Mycobacterium tuberculosis H37Rv
gccccacaagucgcgcgccaaga

SEQ ID NO: 1344589 - RNA, 14 nt, Mycobacterium tuberculosis H37Rv
gccccacagcgugc

SEQ ID NO: 1344590 - RNA, 23 nt, Mycobacterium tuberculosis H37Rv
gccccagauauugaaccgggcca

SEQ ID NO: 1344591 - RNA, 18 nt, Mycobacterium tuberculosis H37Rv
gccccgcaucgcccaagc

SEQ ID NO: 1344592 - RNA, 14 nt, Mycobacterium tuberculosis H37Rv
gccccgccagcggc

SEQ ID NO: 1344593 - RNA, 19 nt, Mycobacterium tuberculosis H37Rv
gccccgccaccucgccggc

SEQ ID NO: 1344594 - RNA, 13 nt, Mycobacterium tuberculosis H37Rv
gccccgccagcgc

SEQ ID NO: 1344595 - RNA, 19 nt, Mycobacterium tuberculosis H37Rv
gccccgccgaugccgccgg

SEQ ID NO: 1344596 - RNA, 22 nt, Mycobacterium tuberculosis H37Rv
gccccgccgaugccgccggccc

SEQ ID NO: 1344597 - RNA, 14 nt, Mycobacterium tuberculosis H37Rv
gccccgccgccaua

SEQ ID NO: 1344598 - RNA, 12 nt, Mycobacterium tuberculosis H37Rv
gccccgccgagc

SEQ ID NO: 1344599 - RNA, 13 nt, Mycobacterium tuberculosis H37Rv
gccccgccgagca

SEQ ID NO: 1344600 - RNA, 18 nt, Mycobacterium tuberculosis H37Rv
gccccgagcugccgucgc

SEQ ID NO: 1344601 - RNA, 20 nt, Mycobacterium tuberculosis H37Rv
gcccccguagaugguggugg

SEQ ID NO: 1344602 - RNA, 17 nt, Mycobacterium tuberculosis H37Rv
gcccccgacguugcugg

SEQ ID NO: 1344603 - RNA, 21 nt, Mycobacterium tuberculosis H37Rv
gcccccgccauugccgccggc

SEQ ID NO: 1344604 - RNA, 21 nt, Mycobacterium tuberculosis H37Rv
gcccccgugggguguggcggc

SEQ ID NO: 1344605 - RNA, 20 nt, Mycobacterium tuberculosis H37Rv
gcccccguuaccgccgucgc

SEQ ID NO: 1344606 - RNA, 20 nt, Mycobacterium tuberculosis H37Rv
gcccccguucuggaaccccg

SEQ ID NO: 1344607 - RNA, 20 nt, Mycobacterium tuberculosis H37Rv
gcccccguuuacggcccggc

SEQ ID NO: 1344608 - RNA, 21 nt, Mycobacterium tuberculosis H37Rv
gccccgacauacgucggggcc

SEQ ID NO: 1344609 - RNA, 23 nt, Mycobacterium tuberculosis H37Rv
gccccgaaacgauggccgggucg

SEQ ID NO: 1344610 - RNA, 16 nt, Mycobacterium tuberculosis H37Rv
gccccgaccagcagac

SEQ ID NO: 1344611 - RNA, 16 nt, Mycobacterium tuberculosis H37Rv
gccccgaccgcguaca

SEQ ID NO: 1344612 - RNA, 15 nt, Mycobacterium tuberculosis H37Rv
gccccgaccagcaga

SEQ ID NO: 1344613 - RNA, 16 nt, Mycobacterium tuberculosis H37Rv
gcccccuggauggcgc

SEQ ID NO: 1344614 - RNA, 20 nt, Mycobacterium tuberculosis H37Rv
gcccccugguacaccaggcc

SEQ ID NO: 1344615 - RNA, 16 nt, Mycobacterium tuberculosis H37Rv
gcccccggugccgccc

SEQ ID NO: 1344616 - RNA, 15 nt, Mycobacterium tuberculosis H37Rv
gccccaucaccaccg

SEQ ID NO: 1344617 - RNA, 18 nt, Mycobacterium tuberculosis H37Rv
gccccaugcaacacaccg

SEQ ID NO: 1344618 - RNA, 18 nt, Mycobacterium tuberculosis H37Rv
gccccaugccgaccggca

SEQ ID NO: 1344619 - RNA, 15 nt, Mycobacterium tuberculosis H37Rv
gccccaugcgccagc

SEQ ID NO: 1344620 - RNA, 17 nt, Mycobacterium tuberculosis H37Rv
gccccaucaccaccggc

SEQ ID NO: 1344621 - RNA, 13 nt, Mycobacterium tuberculosis H37Rv
gccccaucgcugg

SEQ ID NO: 1344622 - RNA, 17 nt, Mycobacterium tuberculosis H37Rv
gccccaguccgaagcug

SEQ ID NO: 1344623 - RNA, 15 nt, Mycobacterium tuberculosis H37Rv
gccccagguuccgcu

SEQ ID NO: 1344624 - RNA, 17 nt, Mycobacterium tuberculosis H37Rv
gccccagggugcgccau

SEQ ID NO: 1344625 - RNA, 18 nt, Mycobacterium tuberculosis H37Rv
gccccagggugcgcuggc

SEQ ID NO: 1344626 - RNA, 19 nt, Mycobacterium tuberculosis H37Rv
gccccagggugcgcuggcc

SEQ ID NO: 1344627 - RNA, 20 nt, Mycobacterium tuberculosis H37Rv
gccccagggugcgcuggccg

SEQ ID NO: 1344628 - RNA, 16 nt, Mycobacterium tuberculosis H37Rv
gcccccaaaccggcgg

SEQ ID NO: 1344629 - RNA, 21 nt, Mycobacterium tuberculosis H37Rv
gcccccaacgcgguaaagccc

SEQ ID NO: 1344630 - RNA, 21 nt, Mycobacterium tuberculosis H37Rv
gcccccauugccgccgucgcc

SEQ ID NO: 1344631 - RNA, 16 nt, Mycobacterium tuberculosis H37Rv
gcccccauugccgccg

SEQ ID NO: 1344632 - RNA, 13 nt, Mycobacterium tuberculosis H37Rv
gcccccagguaac

SEQ ID NO: 1344633 - RNA, 17 nt, Mycobacterium tuberculosis H37Rv
gccccccgcgccugccu

SEQ ID NO: 1344634 - RNA, 17 nt, Mycobacterium tuberculosis H37Rv
gccccccgagcccgcca

SEQ ID NO: 1344635 - RNA, 18 nt, Mycobacterium tuberculosis H37Rv
gccccccggggccgcaac

SEQ ID NO: 1344636 - RNA, 14 nt, Mycobacterium tuberculosis H37Rv
gccccccgcgccug

SEQ ID NO: 1344637 - RNA, 13 nt, Mycobacterium tuberculosis H37Rv
gccccccggggcc

SEQ ID NO: 1344638 - RNA, 14 nt, Mycobacterium tuberculosis H37Rv
gccccccggggccg

SEQ ID NO: 1344639 - RNA, 17 nt, Mycobacterium tuberculosis H37Rv
gccagcgaugugaaccg

SEQ ID NO: 1344640 - RNA, 23 nt, Mycobacterium tuberculosis H37Rv
gccagcgaugugaaccgggcacc

SEQ ID NO: 1344641 - RNA, 18 nt, Mycobacterium tuberculosis H37Rv
gccagcgauaucggcggc

SEQ ID NO: 1344642 - RNA, 14 nt, Mycobacterium tuberculosis H37Rv
gccagccgugcagg

SEQ ID NO: 1344643 - RNA, 14 nt, Mycobacterium tuberculosis H37Rv
gccagccgugccgg

SEQ ID NO: 1344644 - RNA, 21 nt, Mycobacterium tuberculosis H37Rv
gccagccgucgucagguggcc

SEQ ID NO: 1344645 - RNA, 21 nt, Mycobacterium tuberculosis H37Rv
gccagccggauguuggucggc

SEQ ID NO: 1344646 - RNA, 19 nt, Mycobacterium tuberculosis H37Rv
gccagccggcgcacucccg

SEQ ID NO: 1344647 - RNA, 21 nt, Mycobacterium tuberculosis H37Rv
gccagcagcaaacaucgcagg

SEQ ID NO: 1344648 - RNA, 12 nt, Mycobacterium tuberculosis H37Rv
gccagcagcagc

SEQ ID NO: 1344649 - RNA, 19 nt, Mycobacterium tuberculosis H37Rv
gccagcagcagcgccgcgu

SEQ ID NO: 1344650 - RNA, 15 nt, Mycobacterium tuberculosis H37Rv
gccagcagcagcgcc

SEQ ID NO: 1344651 - RNA, 20 nt, Mycobacterium tuberculosis H37Rv
gccagcagcuuguuuuccac

SEQ ID NO: 1344652 - RNA, 18 nt, Mycobacterium tuberculosis H37Rv
gccagcagcugcuccagu

SEQ ID NO: 1344653 - RNA, 23 nt, Mycobacterium tuberculosis H37Rv
gccagcaggcggcugaacggcag

SEQ ID NO: 1344654 - RNA, 13 nt, Mycobacterium tuberculosis H37Rv
gccagcaggauga

SEQ ID NO: 1344655 - RNA, 16 nt, Mycobacterium tuberculosis H37Rv
gccagcaggccgaaga

SEQ ID NO: 1344656 - RNA, 22 nt, Mycobacterium tuberculosis H37Rv
gccagcagggccaccaccacgg

SEQ ID NO: 1344657 - RNA, 13 nt, Mycobacterium tuberculosis H37Rv
gccagcagggcca

SEQ ID NO: 1344658 - RNA, 19 nt, Mycobacterium tuberculosis H37Rv
gccagcagguauuugccgu

SEQ ID NO: 1344659 - RNA, 19 nt, Mycobacterium tuberculosis H37Rv
gccagcgcagccaggcugc

SEQ ID NO: 1344660 - RNA, 16 nt, Mycobacterium tuberculosis H37Rv
gccagcgcagccaggc

SEQ ID NO: 1344661 - RNA, 17 nt, Mycobacterium tuberculosis H37Rv
gccagcgcagccaggcu

SEQ ID NO: 1344662 - RNA, 13 nt, Mycobacterium tuberculosis H37Rv
gccagcgcagcac

SEQ ID NO: 1344663 - RNA, 17 nt, Mycobacterium tuberculosis H37Rv
gccagcgcgccacgagc

SEQ ID NO: 1344664 - RNA, 14 nt, Mycobacterium tuberculosis H37Rv
gccagcgccaccgu

SEQ ID NO: 1344665 - RNA, 19 nt, Mycobacterium tuberculosis H37Rv
gccagcgcgcgcgggugca

SEQ ID NO: 1344666 - RNA, 21 nt, Mycobacterium tuberculosis H37Rv
gccagcgguagcugcccagcg

SEQ ID NO: 1344667 - RNA, 19 nt, Mycobacterium tuberculosis H37Rv
gccagcggguccccgguca

SEQ ID NO: 1344668 - RNA, 15 nt, Mycobacterium tuberculosis H37Rv
gccagcgggcgauga

SEQ ID NO: 1344669 - RNA, 13 nt, Mycobacterium tuberculosis H37Rv
gccagcggcugcc

SEQ ID NO: 1344670 - RNA, 21 nt, Mycobacterium tuberculosis H37Rv
gccagcgguaaugccagcggc

SEQ ID NO: 1344671 - RNA, 16 nt, Mycobacterium tuberculosis H37Rv
gccagcggcgcgaccg

SEQ ID NO: 1344672 - RNA, 12 nt, Mycobacterium tuberculosis H37Rv
gccagcgcggcg

SEQ ID NO: 1344673 - RNA, 13 nt, Mycobacterium tuberculosis H37Rv
gccagcgcggcgc

SEQ ID NO: 1344674 - RNA, 13 nt, Mycobacterium tuberculosis H37Rv
gccagcucggcca

SEQ ID NO: 1344675 - RNA, 14 nt, Mycobacterium tuberculosis H37Rv
gccagcucgggcgc

SEQ ID NO: 1344676 - RNA, 20 nt, Mycobacterium tuberculosis H37Rv
gccagcucgggcgcgcggcg

SEQ ID NO: 1344677 - RNA, 23 nt, Mycobacterium tuberculosis H37Rv
gccagcucgggcgcgcggcgagc

SEQ ID NO: 1344678 - RNA, 16 nt, Mycobacterium tuberculosis H37Rv
gccagcucgcgggccg

SEQ ID NO: 1344679 - RNA, 22 nt, Mycobacterium tuberculosis H37Rv
gccagcucccgggcggcggccu

SEQ ID NO: 1344680 - RNA, 13 nt, Mycobacterium tuberculosis H37Rv
gccagcucgccgg

SEQ ID NO: 1344681 - RNA, 14 nt, Mycobacterium tuberculosis H37Rv
gccagcucgccggc

SEQ ID NO: 1344682 - RNA, 16 nt, Mycobacterium tuberculosis H37Rv
gccagcucgccggccg

SEQ ID NO: 1344683 - RNA, 18 nt, Mycobacterium tuberculosis H37Rv
gccagcucgccggccggg

SEQ ID NO: 1344684 - RNA, 15 nt, Mycobacterium tuberculosis H37Rv
gccagcuccucagcc

SEQ ID NO: 1344685 - RNA, 16 nt, Mycobacterium tuberculosis H37Rv
gccagcucccgcgagc

SEQ ID NO: 1344686 - RNA, 18 nt, Mycobacterium tuberculosis H37Rv
gccaggaagcgguggccu

SEQ ID NO: 1344687 - RNA, 20 nt, Mycobacterium tuberculosis H37Rv
gccaggucagccgcgcgggu

SEQ ID NO: 1344688 - RNA, 19 nt, Mycobacterium tuberculosis H37Rv
gccagguacucaguguucc

SEQ ID NO: 1344689 - RNA, 22 nt, Mycobacterium tuberculosis H37Rv
gccagguccgccggugccgccg

SEQ ID NO: 1344690 - RNA, 22 nt, Mycobacterium tuberculosis H37Rv
gccaggucgauaccggcgugca

SEQ ID NO: 1344691 - RNA, 15 nt, Mycobacterium tuberculosis H37Rv
gccaggucggccacc

SEQ ID NO: 1344692 - RNA, 17 nt, Mycobacterium tuberculosis H37Rv
gccaggucgccaccuuc

SEQ ID NO: 1344693 - RNA, 20 nt, Mycobacterium tuberculosis H37Rv
gccaggucggcgaugaugac

SEQ ID NO: 1344694 - RNA, 18 nt, Mycobacterium tuberculosis H37Rv
gccaggucggcgggcgcg

SEQ ID NO: 1344695 - RNA, 15 nt, Mycobacterium tuberculosis H37Rv
gccagggaggggccg

SEQ ID NO: 1344696 - RNA, 21 nt, Mycobacterium tuberculosis H37Rv
gccagggaucagccgugcggg

SEQ ID NO: 1344697 - RNA, 19 nt, Mycobacterium tuberculosis H37Rv
gccagggaucagccgugcg

SEQ ID NO: 1344698 - RNA, 13 nt, Mycobacterium tuberculosis H37Rv
gccaggcccagcu

SEQ ID NO: 1344699 - RNA, 14 nt, Mycobacterium tuberculosis H37Rv
gccaggcccagcua

SEQ ID NO: 1344700 - RNA, 15 nt, Mycobacterium tuberculosis H37Rv
gccaguacucggcca

SEQ ID NO: 1344701 - RNA, 18 nt, Mycobacterium tuberculosis H37Rv
gccaguacucggccagcg

SEQ ID NO: 1344702 - RNA, 19 nt, Mycobacterium tuberculosis H37Rv
gccagugaacgcgcgugca

SEQ ID NO: 1344703 - RNA, 21 nt, Mycobacterium tuberculosis H37Rv
gccagugaacgcgcgugcagc

SEQ ID NO: 1344704 - RNA, 16 nt, Mycobacterium tuberculosis H37Rv
gccagugaacgcgcgu

SEQ ID NO: 1344705 - RNA, 17 nt, Mycobacterium tuberculosis H37Rv
gccagugauggcgcggu

SEQ ID NO: 1344706 - RNA, 22 nt, Mycobacterium tuberculosis H37Rv
gccagugcugcaccgauucggg

SEQ ID NO: 1344707 - RNA, 21 nt, Mycobacterium tuberculosis H37Rv
gccagugcguggugggcggga

SEQ ID NO: 1344708 - RNA, 18 nt, Mycobacterium tuberculosis H37Rv
gccagugcgcagaacacc

SEQ ID NO: 1344709 - RNA, 15 nt, Mycobacterium tuberculosis H37Rv
gccagugccaccugg

SEQ ID NO: 1344710 - RNA, 22 nt, Mycobacterium tuberculosis H37Rv
gccagugccaccugggcgggcu

SEQ ID NO: 1344711 - RNA, 23 nt, Mycobacterium tuberculosis H37Rv
gccagugcccgcacugccgccgg

SEQ ID NO: 1344712 - RNA, 22 nt, Mycobacterium tuberculosis H37Rv
gccagugcccgcacugccgccg

SEQ ID NO: 1344713 - RNA, 13 nt, Mycobacterium tuberculosis H37Rv
gccagugccgccc

SEQ ID NO: 1344714 - RNA, 18 nt, Mycobacterium tuberculosis H37Rv
gccaguuuccagaugcac

SEQ ID NO: 1344715 - RNA, 18 nt, Mycobacterium tuberculosis H37Rv
gccaguugguagccgccc

SEQ ID NO: 1344716 - RNA, 21 nt, Mycobacterium tuberculosis H37Rv
gccaguucggccuugaucgug

SEQ ID NO: 1344717 - RNA, 22 nt, Mycobacterium tuberculosis H37Rv
gccaguucggcgucguccgcgc

SEQ ID NO: 1344718 - RNA, 14 nt, Mycobacterium tuberculosis H37Rv
gccaguucgcggcu

SEQ ID NO: 1344719 - RNA, 22 nt, Mycobacterium tuberculosis H37Rv
gccaucccgaucccggccagcu

SEQ ID NO: 1344720 - RNA, 14 nt, Mycobacterium tuberculosis H37Rv
gccauccccuggcc

SEQ ID NO: 1344721 - RNA, 18 nt, Mycobacterium tuberculosis H37Rv
gccauaauucgcccgcuc

SEQ ID NO: 1344722 - RNA, 18 nt, Mycobacterium tuberculosis H37Rv
gccauaaccgguggggac

SEQ ID NO: 1344723 - RNA, 22 nt, Mycobacterium tuberculosis H37Rv
gccauaccggccgccaucaucg

SEQ ID NO: 1344724 - RNA, 14 nt, Mycobacterium tuberculosis H37Rv
gccauaccugccgg

SEQ ID NO: 1344725 - RNA, 19 nt, Mycobacterium tuberculosis H37Rv
gccauacgcgcugacccgc

SEQ ID NO: 1344726 - RNA, 19 nt, Mycobacterium tuberculosis H37Rv
gccauacagcaccccgccg

SEQ ID NO: 1344727 - RNA, 15 nt, Mycobacterium tuberculosis H37Rv
gccauagcgccgcgc

SEQ ID NO: 1344728 - RNA, 15 nt, Mycobacterium tuberculosis H37Rv
gccaugccgcucggc

SEQ ID NO: 1344729 - RNA, 19 nt, Mycobacterium tuberculosis H37Rv
gccaucgggucacccccgg

SEQ ID NO: 1344730 - RNA, 22 nt, Mycobacterium tuberculosis H37Rv
gccaucgggauggacaccaccu

SEQ ID NO: 1344731 - RNA, 20 nt, Mycobacterium tuberculosis H37Rv
gccaucggcuaggccggccg

SEQ ID NO: 1344732 - RNA, 20 nt, Mycobacterium tuberculosis H37Rv
gccaucgcccgaugcgccag

SEQ ID NO: 1344733 - RNA, 14 nt, Mycobacterium tuberculosis H37Rv
gccaucgccgccgg

SEQ ID NO: 1344734 - RNA, 16 nt, Mycobacterium tuberculosis H37Rv
gccagaucgaacgcag

SEQ ID NO: 1344735 - RNA, 21 nt, Mycobacterium tuberculosis H37Rv
gccagaucagcaccgacagcc

SEQ ID NO: 1344736 - RNA, 15 nt, Mycobacterium tuberculosis H37Rv
gccagaucgcuagga

SEQ ID NO: 1344737 - RNA, 19 nt, Mycobacterium tuberculosis H37Rv
gccagaucuccccgaccgc

SEQ ID NO: 1344738 - RNA, 21 nt, Mycobacterium tuberculosis H37Rv
gccagaucuccccgaccgcgc

SEQ ID NO: 1344739 - RNA, 19 nt, Mycobacterium tuberculosis H37Rv
gccagaucucgcgcgcggc

SEQ ID NO: 1344740 - RNA, 20 nt, Mycobacterium tuberculosis H37Rv
gccagaucggcggguggcgc

SEQ ID NO: 1344741 - RNA, 16 nt, Mycobacterium tuberculosis H37Rv
gccagaucggucggcc

SEQ ID NO: 1344742 - RNA, 18 nt, Mycobacterium tuberculosis H37Rv
gccagaguuaccaggucg

SEQ ID NO: 1344743 - RNA, 20 nt, Mycobacterium tuberculosis H37Rv
gccagaguuaccaggucgga

SEQ ID NO: 1344744 - RNA, 19 nt, Mycobacterium tuberculosis H37Rv
gccagauuggcgcugcccg

SEQ ID NO: 1344745 - RNA, 15 nt, Mycobacterium tuberculosis H37Rv
gccagauuggcgcug

SEQ ID NO: 1344746 - RNA, 15 nt, Mycobacterium tuberculosis H37Rv
gccagaugguggcau

SEQ ID NO: 1344747 - RNA, 21 nt, Mycobacterium tuberculosis H37Rv
gccagcacgccgccggccgcc

SEQ ID NO: 1344748 - RNA, 16 nt, Mycobacterium tuberculosis H37Rv
gccagcacgccgccgg

SEQ ID NO: 1344749 - RNA, 18 nt, Mycobacterium tuberculosis H37Rv
gccagauuucugggagcc

SEQ ID NO: 1344750 - RNA, 21 nt, Mycobacterium tuberculosis H37Rv
gccagcacgcccucgacgcgc

SEQ ID NO: 1344751 - RNA, 22 nt, Mycobacterium tuberculosis H37Rv
gccagcacgguguugcgcaccc

SEQ ID NO: 1344752 - RNA, 17 nt, Mycobacterium tuberculosis H37Rv
gccagaaugggcggcau

SEQ ID NO: 1344753 - RNA, 14 nt, Mycobacterium tuberculosis H37Rv
gccagaccgcgcgc

SEQ ID NO: 1344754 - RNA, 19 nt, Mycobacterium tuberculosis H37Rv
gccagaccgcaccauugcu

SEQ ID NO: 1344755 - RNA, 13 nt, Mycobacterium tuberculosis H37Rv
gccagaccgcacc

SEQ ID NO: 1344756 - RNA, 19 nt, Mycobacterium tuberculosis H37Rv
gccagaccagggcagcggc

SEQ ID NO: 1344757 - RNA, 18 nt, Mycobacterium tuberculosis H37Rv
gccagacccaccaccgca

SEQ ID NO: 1344758 - RNA, 15 nt, Mycobacterium tuberculosis H37Rv
gccagaccagggcag

SEQ ID NO: 1344759 - RNA, 16 nt, Mycobacterium tuberculosis H37Rv
gccagaccagggcagc

SEQ ID NO: 1344760 - RNA, 13 nt, Mycobacterium tuberculosis H37Rv
gccagaccagggc

SEQ ID NO: 1344761 - RNA, 13 nt, Mycobacterium tuberculosis H37Rv
gccagaccgcggc

SEQ ID NO: 1344762 - RNA, 15 nt, Mycobacterium tuberculosis H37Rv
gccagagucgcccgc

SEQ ID NO: 1344763 - RNA, 23 nt, Mycobacterium tuberculosis H37Rv
gccagagucggagacccguccgg

SEQ ID NO: 1344764 - RNA, 15 nt, Mycobacterium tuberculosis H37Rv
gccacugccgaccag

SEQ ID NO: 1344765 - RNA, 22 nt, Mycobacterium tuberculosis H37Rv
gccagaacggaauucagcgacg

SEQ ID NO: 1344766 - RNA, 19 nt, Mycobacterium tuberculosis H37Rv
gccacggcuuugcggcgcg

SEQ ID NO: 1344767 - RNA, 15 nt, Mycobacterium tuberculosis H37Rv
gccacggcaucggcc

SEQ ID NO: 1344768 - RNA, 18 nt, Mycobacterium tuberculosis H37Rv
gccacggcaucggccacc

SEQ ID NO: 1344769 - RNA, 18 nt, Mycobacterium tuberculosis H37Rv
gccacggcaaaggcgcuc

SEQ ID NO: 1344770 - RNA, 22 nt, Mycobacterium tuberculosis H37Rv
gccacggcagcgcccagaucgc

SEQ ID NO: 1344771 - RNA, 22 nt, Mycobacterium tuberculosis H37Rv
gccacgcuucuuccgcgcgccg

SEQ ID NO: 1344772 - RNA, 23 nt, Mycobacterium tuberculosis H37Rv
gccacgcuucuuccgcgcgccgg

SEQ ID NO: 1344773 - RNA, 22 nt, Mycobacterium tuberculosis H37Rv
gccacggacccgaagucacagg

SEQ ID NO: 1344774 - RNA, 18 nt, Mycobacterium tuberculosis H37Rv
gccacggaucgcggcggc

SEQ ID NO: 1344775 - RNA, 18 nt, Mycobacterium tuberculosis H37Rv
gccacgcugucccgcggg

SEQ ID NO: 1344776 - RNA, 16 nt, Mycobacterium tuberculosis H37Rv
gccacgcucggcggcc

SEQ ID NO: 1344777 - RNA, 20 nt, Mycobacterium tuberculosis H37Rv
gccacgcucggcggccagcu

SEQ ID NO: 1344778 - RNA, 23 nt, Mycobacterium tuberculosis H37Rv
gccacgcucggcggccagcuccc

SEQ ID NO: 1344779 - RNA, 21 nt, Mycobacterium tuberculosis H37Rv
gccacguuacgcucgcgggcc

SEQ ID NO: 1344780 - RNA, 16 nt, Mycobacterium tuberculosis H37Rv
gccacguucgcggcca

SEQ ID NO: 1344781 - RNA, 19 nt, Mycobacterium tuberculosis H37Rv
gccacguccucagccgugc

SEQ ID NO: 1344782 - RNA, 17 nt, Mycobacterium tuberculosis H37Rv
gccacuccucggugugc

SEQ ID NO: 1344783 - RNA, 20 nt, Mycobacterium tuberculosis H37Rv
gccacugaccgcgaucgccg

SEQ ID NO: 1344784 - RNA, 20 nt, Mycobacterium tuberculosis H37Rv
gccacggugacccugguggu

SEQ ID NO: 1344785 - RNA, 22 nt, Mycobacterium tuberculosis H37Rv
gccacgguccggcccaccagcg

SEQ ID NO: 1344786 - RNA, 14 nt, Mycobacterium tuberculosis H37Rv
gccacgguccggcc

SEQ ID NO: 1344787 - RNA, 20 nt, Mycobacterium tuberculosis H37Rv
gccacgguccggcccaccag

SEQ ID NO: 1344788 - RNA, 18 nt, Mycobacterium tuberculosis H37Rv
gccacgggcggccaccgc

SEQ ID NO: 1344789 - RNA, 16 nt, Mycobacterium tuberculosis H37Rv
gccacgguacauccag

SEQ ID NO: 1344790 - RNA, 21 nt, Mycobacterium tuberculosis H37Rv
gccacguccaucaccggcggc

SEQ ID NO: 1344791 - RNA, 19 nt, Mycobacterium tuberculosis H37Rv
gccacgucgaugugcgccc

SEQ ID NO: 1344792 - RNA, 23 nt, Mycobacterium tuberculosis H37Rv
gccacguccaucaccggcggccc

SEQ ID NO: 1344793 - RNA, 22 nt, Mycobacterium tuberculosis H37Rv
gccacgucccaggacuccggcc

SEQ ID NO: 1344794 - RNA, 17 nt, Mycobacterium tuberculosis H37Rv
gccacguagcagcagac

SEQ ID NO: 1344795 - RNA, 14 nt, Mycobacterium tuberculosis H37Rv
gccacguagcagcg

SEQ ID NO: 1344796 - RNA, 22 nt, Mycobacterium tuberculosis H37Rv
gccacggugucgcgaugcuucc

SEQ ID NO: 1344797 - RNA, 23 nt, Mycobacterium tuberculosis H37Rv
gccacggugucgucgaccaccug

SEQ ID NO: 1344798 - RNA, 19 nt, Mycobacterium tuberculosis H37Rv
gccacguacuccaccgcgc

SEQ ID NO: 1344799 - RNA, 15 nt, Mycobacterium tuberculosis H37Rv
gccacguagcagcag

SEQ ID NO: 1344800 - RNA, 19 nt, Mycobacterium tuberculosis H37Rv
gccacgguugguccaaugc

SEQ ID NO: 1344801 - RNA, 15 nt, Mycobacterium tuberculosis H37Rv
gccacguaauucccc

SEQ ID NO: 1344802 - RNA, 19 nt, Mycobacterium tuberculosis H37Rv
gccacguaauuccccaggg

SEQ ID NO: 1344803 - RNA, 20 nt, Mycobacterium tuberculosis H37Rv
gccaccacggucaagccggc

SEQ ID NO: 1344804 - RNA, 22 nt, Mycobacterium tuberculosis H37Rv
gccaccacggucaagccggcgc

SEQ ID NO: 1344805 - RNA, 18 nt, Mycobacterium tuberculosis H37Rv
gccaccagaaccagcgac

SEQ ID NO: 1344806 - RNA, 17 nt, Mycobacterium tuberculosis H37Rv
gccaccacugcgcccgc

SEQ ID NO: 1344807 - RNA, 23 nt, Mycobacterium tuberculosis H37Rv
gccaccaccucggugaccaggcc

SEQ ID NO: 1344808 - RNA, 21 nt, Mycobacterium tuberculosis H37Rv
gccaccacgcaugcgcgcgcc

SEQ ID NO: 1344809 - RNA, 17 nt, Mycobacterium tuberculosis H37Rv
gccacaucgccagcagc

SEQ ID NO: 1344810 - RNA, 23 nt, Mycobacterium tuberculosis H37Rv
gccacaucguucaugaucggcag

SEQ ID NO: 1344811 - RNA, 23 nt, Mycobacterium tuberculosis H37Rv
gccacaugaccugauccggccgg

SEQ ID NO: 1344812 - RNA, 13 nt, Mycobacterium tuberculosis H37Rv
gccacaugccaca

SEQ ID NO: 1344813 - RNA, 18 nt, Mycobacterium tuberculosis H37Rv
gccaccaccgccgccggc

SEQ ID NO: 1344814 - RNA, 16 nt, Mycobacterium tuberculosis H37Rv
gccaccagacaacgcc

SEQ ID NO: 1344815 - RNA, 14 nt, Mycobacterium tuberculosis H37Rv
gccaccagaccagg

SEQ ID NO: 1344816 - RNA, 15 nt, Mycobacterium tuberculosis H37Rv
gccaccagccgggca

SEQ ID NO: 1344817 - RNA, 19 nt, Mycobacterium tuberculosis H37Rv
gccaccagaaacaccgacg

SEQ ID NO: 1344818 - RNA, 21 nt, Mycobacterium tuberculosis H37Rv
gccaccgagaucaugccggcg

SEQ ID NO: 1344819 - RNA, 22 nt, Mycobacterium tuberculosis H37Rv
gccaccgacgacaucgguggcc

SEQ ID NO: 1344820 - RNA, 20 nt, Mycobacterium tuberculosis H37Rv
gccaccagucacgcccacca

SEQ ID NO: 1344821 - RNA, 15 nt, Mycobacterium tuberculosis H37Rv
gccaccagggccacc

SEQ ID NO: 1344822 - RNA, 19 nt, Mycobacterium tuberculosis H37Rv
gcauaccgaacagcaccuc

SEQ ID NO: 1344823 - RNA, 16 nt, Mycobacterium tuberculosis H37Rv
gcauacagcgcccgga

SEQ ID NO: 1344824 - RNA, 15 nt, Mycobacterium tuberculosis H37Rv
gccacagggaagcaa

SEQ ID NO: 1344825 - RNA, 16 nt, Mycobacterium tuberculosis H37Rv
gccaccggugccggcg

SEQ ID NO: 1344826 - RNA, 21 nt, Mycobacterium tuberculosis H37Rv
gccaccgguaccgaucagcag

SEQ ID NO: 1344827 - RNA, 21 nt, Mycobacterium tuberculosis H37Rv
gccaccggcgucugcccgccc

SEQ ID NO: 1344828 - RNA, 17 nt, Mycobacterium tuberculosis H37Rv
gccaccgggacgauucu

SEQ ID NO: 1344829 - RNA, 17 nt, Mycobacterium tuberculosis H37Rv
gccaccgccgccugccc

SEQ ID NO: 1344830 - RNA, 15 nt, Mycobacterium tuberculosis H37Rv
gccaccgccgcugcc

SEQ ID NO: 1344831 - RNA, 23 nt, Mycobacterium tuberculosis H37Rv
gccaccgccgccgccgacgccgc

SEQ ID NO: 1344832 - RNA, 14 nt, Mycobacterium tuberculosis H37Rv
gccaccgccgccgg

SEQ ID NO: 1344833 - RNA, 13 nt, Mycobacterium tuberculosis H37Rv
gccaccgccgccu

SEQ ID NO: 1344834 - RNA, 15 nt, Mycobacterium tuberculosis H37Rv
gccaccgccgccugc

SEQ ID NO: 1344835 - RNA, 21 nt, Mycobacterium tuberculosis H37Rv
gccaccgccgccgccaccggc

SEQ ID NO: 1344836 - RNA, 14 nt, Mycobacterium tuberculosis H37Rv
gccaccgccagcgu

SEQ ID NO: 1344837 - RNA, 17 nt, Mycobacterium tuberculosis H37Rv
gccaccgcccagugcca

SEQ ID NO: 1344838 - RNA, 16 nt, Mycobacterium tuberculosis H37Rv
gccaccgagcccucca

SEQ ID NO: 1344839 - RNA, 16 nt, Mycobacterium tuberculosis H37Rv
gccaccgaggcguuca

SEQ ID NO: 1344840 - RNA, 20 nt, Mycobacterium tuberculosis H37Rv
gccaccgaucgacugcagcc

SEQ ID NO: 1344841 - RNA, 17 nt, Mycobacterium tuberculosis H37Rv
gccaccgccaccgcggc

SEQ ID NO: 1344842 - RNA, 22 nt, Mycobacterium tuberculosis H37Rv
gccaccugacgugcggcgcggc

SEQ ID NO: 1344843 - RNA, 15 nt, Mycobacterium tuberculosis H37Rv
gccaccuguugcccu

SEQ ID NO: 1344844 - RNA, 22 nt, Mycobacterium tuberculosis H37Rv
gccaccuguuggcaugccgccc

SEQ ID NO: 1344845 - RNA, 14 nt, Mycobacterium tuberculosis H37Rv
gccaccugcuggcc

SEQ ID NO: 1344846 - RNA, 21 nt, Mycobacterium tuberculosis H37Rv
gccaccugguuuacccgcaug

SEQ ID NO: 1344847 - RNA, 17 nt, Mycobacterium tuberculosis H37Rv
gccaccuugugcaggcc

SEQ ID NO: 1344848 - RNA, 18 nt, Mycobacterium tuberculosis H37Rv
gccaccgucagcgcgacc

SEQ ID NO: 1344849 - RNA, 19 nt, Mycobacterium tuberculosis H37Rv
gccaccgucaccgccguca

SEQ ID NO: 1344850 - RNA, 19 nt, Mycobacterium tuberculosis H37Rv
gccaccgggcgugcggcgg

SEQ ID NO: 1344851 - RNA, 16 nt, Mycobacterium tuberculosis H37Rv
gccaccgucgcugccc

SEQ ID NO: 1344852 - RNA, 20 nt, Mycobacterium tuberculosis H37Rv
gccaccgucgcugcccgcgc

SEQ ID NO: 1344853 - RNA, 20 nt, Mycobacterium tuberculosis H37Rv
gccaccgugguucggcggcg

SEQ ID NO: 1344854 - RNA, 22 nt, Mycobacterium tuberculosis H37Rv
gccaccucggguguggucacca

SEQ ID NO: 1344855 - RNA, 19 nt, Mycobacterium tuberculosis H37Rv
gccaccucccacgccgccg

SEQ ID NO: 1344856 - RNA, 13 nt, Mycobacterium tuberculosis H37Rv
gccaccgugugca

SEQ ID NO: 1344857 - RNA, 20 nt, Mycobacterium tuberculosis H37Rv
gccaccguugccgaaccacg

SEQ ID NO: 1344858 - RNA, 14 nt, Mycobacterium tuberculosis H37Rv
gccaccgucaugcc

SEQ ID NO: 1344859 - RNA, 17 nt, Mycobacterium tuberculosis H37Rv
gccacgacgaacaccag

SEQ ID NO: 1344860 - RNA, 13 nt, Mycobacterium tuberculosis H37Rv
gccacgacccagc

SEQ ID NO: 1344861 - RNA, 13 nt, Mycobacterium tuberculosis H37Rv
gccacgccagcgu

SEQ ID NO: 1344862 - RNA, 18 nt, Mycobacterium tuberculosis H37Rv
gccacgcaugggccaggu

SEQ ID NO: 1344863 - RNA, 20 nt, Mycobacterium tuberculosis H37Rv
gccacgccagcucgccggcc

SEQ ID NO: 1344864 - RNA, 17 nt, Mycobacterium tuberculosis H37Rv
gccacgcccgacgccag

SEQ ID NO: 1344865 - RNA, 21 nt, Mycobacterium tuberculosis H37Rv
gccacgcccgacgccagcugc

SEQ ID NO: 1344866 - RNA, 13 nt, Mycobacterium tuberculosis H37Rv
gccacgcccacag

SEQ ID NO: 1344867 - RNA, 16 nt, Mycobacterium tuberculosis H37Rv
gccacgcccgacgcca

SEQ ID NO: 1344868 - RNA, 19 nt, Mycobacterium tuberculosis H37Rv
gccacgccgaugggaaccg

SEQ ID NO: 1344869 - RNA, 13 nt, Mycobacterium tuberculosis H37Rv
gccgccauugcca

SEQ ID NO: 1344870 - RNA, 22 nt, Mycobacterium tuberculosis H37Rv
gccgccauugagcucccgcaac

SEQ ID NO: 1344871 - RNA, 13 nt, Mycobacterium tuberculosis H37Rv
gccgccauuggcu

SEQ ID NO: 1344872 - RNA, 16 nt, Mycobacterium tuberculosis H37Rv
gccgccauugccgccg

SEQ ID NO: 1344873 - RNA, 14 nt, Mycobacterium tuberculosis H37Rv
gccgccauuggaca

SEQ ID NO: 1344874 - RNA, 13 nt, Mycobacterium tuberculosis H37Rv
gccgccauugccg

SEQ ID NO: 1344875 - RNA, 18 nt, Mycobacterium tuberculosis H37Rv
gccgcccaagccgccggc

SEQ ID NO: 1344876 - RNA, 14 nt, Mycobacterium tuberculosis H37Rv
gccgcccacaugaa

SEQ ID NO: 1344877 - RNA, 17 nt, Mycobacterium tuberculosis H37Rv
gccgcccagaccgccga

SEQ ID NO: 1344878 - RNA, 13 nt, Mycobacterium tuberculosis H37Rv
gccgccaucaucg

SEQ ID NO: 1344879 - RNA, 18 nt, Mycobacterium tuberculosis H37Rv
gccgccaucgccgccaac

SEQ ID NO: 1344880 - RNA, 17 nt, Mycobacterium tuberculosis H37Rv
gccgccaucgccgccgg

SEQ ID NO: 1344881 - RNA, 16 nt, Mycobacterium tuberculosis H37Rv
gccgccaugcgcacca

SEQ ID NO: 1344882 - RNA, 16 nt, Mycobacterium tuberculosis H37Rv
gccgccauggccgccg

SEQ ID NO: 1344883 - RNA, 19 nt, Mycobacterium tuberculosis H37Rv
gccgccauguacaggcccc

SEQ ID NO: 1344884 - RNA, 17 nt, Mycobacterium tuberculosis H37Rv
gccgccagcugcgcagc

SEQ ID NO: 1344885 - RNA, 14 nt, Mycobacterium tuberculosis H37Rv
gccgccaucagccg

SEQ ID NO: 1344886 - RNA, 15 nt, Mycobacterium tuberculosis H37Rv
gccgccagcgcgccg

SEQ ID NO: 1344887 - RNA, 17 nt, Mycobacterium tuberculosis H37Rv
gccgccagccggcgcac

SEQ ID NO: 1344888 - RNA, 15 nt, Mycobacterium tuberculosis H37Rv
gccgccagcgccacc

SEQ ID NO: 1344889 - RNA, 13 nt, Mycobacterium tuberculosis H37Rv
gccgccagccggc

SEQ ID NO: 1344890 - RNA, 15 nt, Mycobacterium tuberculosis H37Rv
gccgccagccggcgc

SEQ ID NO: 1344891 - RNA, 13 nt, Mycobacterium tuberculosis H37Rv
gccgccagccugg

SEQ ID NO: 1344892 - RNA, 17 nt, Mycobacterium tuberculosis H37Rv
gccgcccaucaccccga

SEQ ID NO: 1344893 - RNA, 20 nt, Mycobacterium tuberculosis H37Rv
gccgccccauacuugcgccg

SEQ ID NO: 1344894 - RNA, 20 nt, Mycobacterium tuberculosis H37Rv
gccgcccagugcggccaccu

SEQ ID NO: 1344895 - RNA, 12 nt, Mycobacterium tuberculosis H37Rv
gccgcccccgcc

SEQ ID NO: 1344896 - RNA, 15 nt, Mycobacterium tuberculosis H37Rv
gccgccccggccgcu

SEQ ID NO: 1344897 - RNA, 17 nt, Mycobacterium tuberculosis H37Rv
gccgccccgcagcugcg

SEQ ID NO: 1344898 - RNA, 11 nt, Mycobacterium tuberculosis H37Rv
gccgccccggc

SEQ ID NO: 1344899 - RNA, 14 nt, Mycobacterium tuberculosis H37Rv
gccgcccccgccgg

SEQ ID NO: 1344900 - RNA, 15 nt, Mycobacterium tuberculosis H37Rv
gccgcccccgccggc

SEQ ID NO: 1344901 - RNA, 22 nt, Mycobacterium tuberculosis H37Rv
gccgcccgaguuguggacgccc

SEQ ID NO: 1344902 - RNA, 15 nt, Mycobacterium tuberculosis H37Rv
gccgccccggcgcug

SEQ ID NO: 1344903 - RNA, 14 nt, Mycobacterium tuberculosis H37Rv
gccgccccggcgcu

SEQ ID NO: 1344904 - RNA, 18 nt, Mycobacterium tuberculosis H37Rv
gccgccccggcgcuggug

SEQ ID NO: 1344905 - RNA, 17 nt, Mycobacterium tuberculosis H37Rv
gccgcccgcagggccgc

SEQ ID NO: 1344906 - RNA, 13 nt, Mycobacterium tuberculosis H37Rv
gccgcccgcagcg

SEQ ID NO: 1344907 - RNA, 15 nt, Mycobacterium tuberculosis H37Rv
gccgcccgcgccacc

SEQ ID NO: 1344908 - RNA, 16 nt, Mycobacterium tuberculosis H37Rv
gccgcccgcgccacca

SEQ ID NO: 1344909 - RNA, 17 nt, Mycobacterium tuberculosis H37Rv
gccgcccgcgccgccgc

SEQ ID NO: 1344910 - RNA, 22 nt, Mycobacterium tuberculosis H37Rv
gccgcccgcuccuccggcacca

SEQ ID NO: 1344911 - RNA, 21 nt, Mycobacterium tuberculosis H37Rv
gccgcccuggccgcccagacc

SEQ ID NO: 1344912 - RNA, 15 nt, Mycobacterium tuberculosis H37Rv
gccgcccgucccgcc

SEQ ID NO: 1344913 - RNA, 16 nt, Mycobacterium tuberculosis H37Rv
gccgcccgugccgccc

SEQ ID NO: 1344914 - RNA, 12 nt, Mycobacterium tuberculosis H37Rv
gccgcccggcga

SEQ ID NO: 1344915 - RNA, 15 nt, Mycobacterium tuberculosis H37Rv
gccgcccggucgggc

SEQ ID NO: 1344916 - RNA, 18 nt, Mycobacterium tuberculosis H37Rv
gccgcgaccgccucgccg

SEQ ID NO: 1344917 - RNA, 15 nt, Mycobacterium tuberculosis H37Rv
gccgcgaccgcgagc

SEQ ID NO: 1344918 - RNA, 16 nt, Mycobacterium tuberculosis H37Rv
gccgcgaccgcgagca

SEQ ID NO: 1344919 - RNA, 17 nt, Mycobacterium tuberculosis H37Rv
gccgcgaccagcgccgc

SEQ ID NO: 1344920 - RNA, 15 nt, Mycobacterium tuberculosis H37Rv
gccgcgacccgcgca

SEQ ID NO: 1344921 - RNA, 23 nt, Mycobacterium tuberculosis H37Rv
gccgcgacgaugccucggcggcc

SEQ ID NO: 1344922 - RNA, 14 nt, Mycobacterium tuberculosis H37Rv
gccgcgcaccaaca

SEQ ID NO: 1344923 - RNA, 23 nt, Mycobacterium tuberculosis H37Rv
gccgcgcaccaacaccagcgcgu

SEQ ID NO: 1344924 - RNA, 14 nt, Mycobacterium tuberculosis H37Rv
gccgcgaagcgcuc

SEQ ID NO: 1344925 - RNA, 16 nt, Mycobacterium tuberculosis H37Rv
gccgcgaacuccagca

SEQ ID NO: 1344926 - RNA, 18 nt, Mycobacterium tuberculosis H37Rv
gccgcgaacuccagcagc

SEQ ID NO: 1344927 - RNA, 19 nt, Mycobacterium tuberculosis H37Rv
gccgccugcccggcccgcu

SEQ ID NO: 1344928 - RNA, 14 nt, Mycobacterium tuberculosis H37Rv
gccgcgacauccgc

SEQ ID NO: 1344929 - RNA, 18 nt, Mycobacterium tuberculosis H37Rv
gccgcgacauccgcggca

SEQ ID NO: 1344930 - RNA, 23 nt, Mycobacterium tuberculosis H37Rv
gccgcgaaggggugcccggcggc

SEQ ID NO: 1344931 - RNA, 14 nt, Mycobacterium tuberculosis H37Rv
gccgccucgggcac

SEQ ID NO: 1344932 - RNA, 19 nt, Mycobacterium tuberculosis H37Rv
gccgccugacccggcgccg

SEQ ID NO: 1344933 - RNA, 14 nt, Mycobacterium tuberculosis H37Rv
gccgccuccgcggc

SEQ ID NO: 1344934 - RNA, 16 nt, Mycobacterium tuberculosis H37Rv
gccgccguugccggcu

SEQ ID NO: 1344935 - RNA, 16 nt, Mycobacterium tuberculosis H37Rv
gccgccguugccgccg

SEQ ID NO: 1344936 - RNA, 18 nt, Mycobacterium tuberculosis H37Rv
gccgccguugccgccagc

SEQ ID NO: 1344937 - RNA, 22 nt, Mycobacterium tuberculosis H37Rv
gccgccguugccauugccuccc

SEQ ID NO: 1344938 - RNA, 22 nt, Mycobacterium tuberculosis H37Rv
gccgccguugccggcuuggccu

SEQ ID NO: 1344939 - RNA, 20 nt, Mycobacterium tuberculosis H37Rv
gccgccguugccguuggugc

SEQ ID NO: 1344940 - RNA, 18 nt, Mycobacterium tuberculosis H37Rv
gccgccguucccgccggc

SEQ ID NO: 1344941 - RNA, 19 nt, Mycobacterium tuberculosis H37Rv
gccgccguucccgccggcc

SEQ ID NO: 1344942 - RNA, 20 nt, Mycobacterium tuberculosis H37Rv
gccgccguucccgccggccc

SEQ ID NO: 1344943 - RNA, 17 nt, Mycobacterium tuberculosis H37Rv
gccgccguucccgccgg

SEQ ID NO: 1344944 - RNA, 18 nt, Mycobacterium tuberculosis H37Rv
gccgccguuaccgccggc

SEQ ID NO: 1344945 - RNA, 22 nt, Mycobacterium tuberculosis H37Rv
gccgccguuaccgccggcgccg

SEQ ID NO: 1344946 - RNA, 18 nt, Mycobacterium tuberculosis H37Rv
gccgccguccagcgccgc

SEQ ID NO: 1344947 - RNA, 22 nt, Mycobacterium tuberculosis H37Rv
gccgccguccagcgccgcggcc

SEQ ID NO: 1344948 - RNA, 15 nt, Mycobacterium tuberculosis H37Rv
gccgccgucgccgcc

SEQ ID NO: 1344949 - RNA, 17 nt, Mycobacterium tuberculosis H37Rv
gccgccgucgccgccgu

SEQ ID NO: 1344950 - RNA, 23 nt, Mycobacterium tuberculosis H37Rv
gccgccgucaccgccgaccaggc

SEQ ID NO: 1344951 - RNA, 18 nt, Mycobacterium tuberculosis H37Rv
gccgccgggauaacccag

SEQ ID NO: 1344952 - RNA, 16 nt, Mycobacterium tuberculosis H37Rv
gccgccggcuccgcca

SEQ ID NO: 1344953 - RNA, 15 nt, Mycobacterium tuberculosis H37Rv
gccgccggcgcuggc

SEQ ID NO: 1344954 - RNA, 12 nt, Mycobacterium tuberculosis H37Rv
gccgccggcgcu

SEQ ID NO: 1344955 - RNA, 22 nt, Mycobacterium tuberculosis H37Rv
gccgccggcgccggagccgccc

SEQ ID NO: 1344956 - RNA, 16 nt, Mycobacterium tuberculosis H37Rv
gccgccggcgccgccc

SEQ ID NO: 1344957 - RNA, 17 nt, Mycobacterium tuberculosis H37Rv
gccgccggcgccgccgg

SEQ ID NO: 1344958 - RNA, 17 nt, Mycobacterium tuberculosis H37Rv
gccgccggcgccgccau

SEQ ID NO: 1344959 - RNA, 19 nt, Mycobacterium tuberculosis H37Rv
gccgcccucccuggggccg

SEQ ID NO: 1344960 - RNA, 15 nt, Mycobacterium tuberculosis H37Rv
gccgccgcacaucug

SEQ ID NO: 1344961 - RNA, 20 nt, Mycobacterium tuberculosis H37Rv
gccgccgccaccggcgccgc

SEQ ID NO: 1344962 - RNA, 19 nt, Mycobacterium tuberculosis H37Rv
gccgccgccaccggcgccg

SEQ ID NO: 1344963 - RNA, 15 nt, Mycobacterium tuberculosis H37Rv
gccgccgccaccggc

SEQ ID NO: 1344964 - RNA, 14 nt, Mycobacterium tuberculosis H37Rv
gccgccgcacacca

SEQ ID NO: 1344965 - RNA, 22 nt, Mycobacterium tuberculosis H37Rv
gccgccggcgccagcgccgcca

SEQ ID NO: 1344966 - RNA, 17 nt, Mycobacterium tuberculosis H37Rv
gccgccggcgcccaggc

SEQ ID NO: 1344967 - RNA, 20 nt, Mycobacterium tuberculosis H37Rv
gccgccgccccggcgcuggu

SEQ ID NO: 1344968 - RNA, 13 nt, Mycobacterium tuberculosis H37Rv
gccgcagccagca

SEQ ID NO: 1344969 - RNA, 19 nt, Mycobacterium tuberculosis H37Rv
gccgcagcccgugacuggu

SEQ ID NO: 1344970 - RNA, 21 nt, Mycobacterium tuberculosis H37Rv
gccgcagcccgugacugguga

SEQ ID NO: 1344971 - RNA, 20 nt, Mycobacterium tuberculosis H37Rv
gccgcagcggccagcccagc

SEQ ID NO: 1344972 - RNA, 22 nt, Mycobacterium tuberculosis H37Rv
gccgcagcuccccgaccgaacc

SEQ ID NO: 1344973 - RNA, 23 nt, Mycobacterium tuberculosis H37Rv
gccgcaucgacgcucaucucggg

SEQ ID NO: 1344974 - RNA, 13 nt, Mycobacterium tuberculosis H37Rv
gccgcagggccuc

SEQ ID NO: 1344975 - RNA, 19 nt, Mycobacterium tuberculosis H37Rv
gccgcagguucaacgcggg

SEQ ID NO: 1344976 - RNA, 16 nt, Mycobacterium tuberculosis H37Rv
gccgcaguacugguag

SEQ ID NO: 1344977 - RNA, 23 nt, Mycobacterium tuberculosis H37Rv
gccgcaguacugguagaggcggc

SEQ ID NO: 1344978 - RNA, 23 nt, Mycobacterium tuberculosis H37Rv
gccgccaccgcgacgagcggccg

SEQ ID NO: 1344979 - RNA, 17 nt, Mycobacterium tuberculosis H37Rv
gccgccacccggcgggc

SEQ ID NO: 1344980 - RNA, 22 nt, Mycobacterium tuberculosis H37Rv
gccgccaccuuggcugggcccg

SEQ ID NO: 1344981 - RNA, 20 nt, Mycobacterium tuberculosis H37Rv
gccgccacgguacauccaga

SEQ ID NO: 1344982 - RNA, 16 nt, Mycobacterium tuberculosis H37Rv
gccgccaccggcgccg

SEQ ID NO: 1344983 - RNA, 20 nt, Mycobacterium tuberculosis H37Rv
gccgccaccgucaccgccgu

SEQ ID NO: 1344984 - RNA, 18 nt, Mycobacterium tuberculosis H37Rv
gccgcaucgucgccgcgc

SEQ ID NO: 1344985 - RNA, 23 nt, Mycobacterium tuberculosis H37Rv
gccgccaacuccucagccgccug

SEQ ID NO: 1344986 - RNA, 15 nt, Mycobacterium tuberculosis H37Rv
gccgccacaccgccg

SEQ ID NO: 1344987 - RNA, 18 nt, Mycobacterium tuberculosis H37Rv
gccgaucucuccggcggc

SEQ ID NO: 1344988 - RNA, 12 nt, Mycobacterium tuberculosis H37Rv
gccgaucggcac

SEQ ID NO: 1344989 - RNA, 13 nt, Mycobacterium tuberculosis H37Rv
gccgaucgggagu

SEQ ID NO: 1344990 - RNA, 18 nt, Mycobacterium tuberculosis H37Rv
gccgaucacugucgggua

SEQ ID NO: 1344991 - RNA, 20 nt, Mycobacterium tuberculosis H37Rv
gccgaugacgaugccgccga

SEQ ID NO: 1344992 - RNA, 21 nt, Mycobacterium tuberculosis H37Rv
gccgaugaccgaagagcgcgc

SEQ ID NO: 1344993 - RNA, 19 nt, Mycobacterium tuberculosis H37Rv
gccgaucugcucgccgagc

SEQ ID NO: 1344994 - RNA, 16 nt, Mycobacterium tuberculosis H37Rv
gccgaugaccgcaacc

SEQ ID NO: 1344995 - RNA, 16 nt, Mycobacterium tuberculosis H37Rv
gccgaugaugcggcgc

SEQ ID NO: 1344996 - RNA, 22 nt, Mycobacterium tuberculosis H37Rv
gccgaugaugcggcgcagcgac

SEQ ID NO: 1344997 - RNA, 15 nt, Mycobacterium tuberculosis H37Rv
gccgaugccgccgcc

SEQ ID NO: 1344998 - RNA, 16 nt, Mycobacterium tuberculosis H37Rv
gccgaugccgccgccg

SEQ ID NO: 1344999 - RNA, 17 nt, Mycobacterium tuberculosis H37Rv
gccgauaccggcggcga

SEQ ID NO: 1345000 - RNA, 18 nt, Mycobacterium tuberculosis H37Rv
gccgauaccggcggcgag

SEQ ID NO: 1345001 - RNA, 24 nt, Mycobacterium tuberculosis H37Rv
gccgauaccagccaaaacgagcag

SEQ ID NO: 1345002 - RNA, 23 nt, Mycobacterium tuberculosis H37Rv
gcccugguccaggcccuggccag

SEQ ID NO: 1345003 - RNA, 15 nt, Mycobacterium tuberculosis H37Rv
gcccugguccaggcc

SEQ ID NO: 1345004 - RNA, 18 nt, Mycobacterium tuberculosis H37Rv
gcccugggugauggccgc

SEQ ID NO: 1345005 - RNA, 20 nt, Mycobacterium tuberculosis H37Rv
gcccugggugauggccgcgc

SEQ ID NO: 1345006 - RNA, 22 nt, Mycobacterium tuberculosis H37Rv
gcccugggugauggccgcgccc

SEQ ID NO: 1345007 - RNA, 22 nt, Mycobacterium tuberculosis H37Rv
gcccugggugguuccgcgcggc

SEQ ID NO: 1345008 - RNA, 19 nt, Mycobacterium tuberculosis H37Rv
gccgauaccggcggcgagc

SEQ ID NO: 1345009 - RNA, 21 nt, Mycobacterium tuberculosis H37Rv
gccgauaugcgugagcugcuc

SEQ ID NO: 1345010 - RNA, 16 nt, Mycobacterium tuberculosis H37Rv
gccgaucaccgcugug

SEQ ID NO: 1345011 - RNA, 15 nt, Mycobacterium tuberculosis H37Rv
gccgcacccggucga

SEQ ID NO: 1345012 - RNA, 23 nt, Mycobacterium tuberculosis H37Rv
gccgcacccguugcucccacggc

SEQ ID NO: 1345013 - RNA, 14 nt, Mycobacterium tuberculosis H37Rv
gccgcaccgccacc

SEQ ID NO: 1345014 - RNA, 15 nt, Mycobacterium tuberculosis H37Rv
gccgcacgcuagccg

SEQ ID NO: 1345015 - RNA, 21 nt, Mycobacterium tuberculosis H37Rv
gccgcacggcgacgccagugu

SEQ ID NO: 1345016 - RNA, 14 nt, Mycobacterium tuberculosis H37Rv
gccgcaccggugcu

SEQ ID NO: 1345017 - RNA, 15 nt, Mycobacterium tuberculosis H37Rv
gccgcacgccgacca

SEQ ID NO: 1345018 - RNA, 20 nt, Mycobacterium tuberculosis H37Rv
gccgcacgccgaccagcacc

SEQ ID NO: 1345019 - RNA, 17 nt, Mycobacterium tuberculosis H37Rv
gccgcacgccggccagc

SEQ ID NO: 1345020 - RNA, 18 nt, Mycobacterium tuberculosis H37Rv
gccgcagaaucccaacuc

SEQ ID NO: 1345021 - RNA, 16 nt, Mycobacterium tuberculosis H37Rv
gccgcacgggcgaccu

SEQ ID NO: 1345022 - RNA, 20 nt, Mycobacterium tuberculosis H37Rv
gccgcacgucgaccucggca

SEQ ID NO: 1345023 - RNA, 18 nt, Mycobacterium tuberculosis H37Rv
gccgaugcugcgggcggu

SEQ ID NO: 1345024 - RNA, 21 nt, Mycobacterium tuberculosis H37Rv
gccgcacauugguguccacca

SEQ ID NO: 1345025 - RNA, 20 nt, Mycobacterium tuberculosis H37Rv
gccgcacauugguguccacc

SEQ ID NO: 1345026 - RNA, 17 nt, Mycobacterium tuberculosis H37Rv
gccgcacaugagcugga

SEQ ID NO: 1345027 - RNA, 19 nt, Mycobacterium tuberculosis H37Rv
gccgcaccagaucgucggg

SEQ ID NO: 1345028 - RNA, 16 nt, Mycobacterium tuberculosis H37Rv
gccgcacaucugcggg

SEQ ID NO: 1345029 - RNA, 14 nt, Mycobacterium tuberculosis H37Rv
gccgcaccagcauu

SEQ ID NO: 1345030 - RNA, 23 nt, Mycobacterium tuberculosis H37Rv
gccggccccgccguuaccgccgu

SEQ ID NO: 1345031 - RNA, 14 nt, Mycobacterium tuberculosis H37Rv
gccggccccgccgu

SEQ ID NO: 1345032 - RNA, 23 nt, Mycobacterium tuberculosis H37Rv
gccggccccgccggccccgccgu

SEQ ID NO: 1345033 - RNA, 20 nt, Mycobacterium tuberculosis H37Rv
gccggccccgccggccccgc

SEQ ID NO: 1345034 - RNA, 14 nt, Mycobacterium tuberculosis H37Rv
gccggccccgccgc

SEQ ID NO: 1345035 - RNA, 14 nt, Mycobacterium tuberculosis H37Rv
gccggccccgccga

SEQ ID NO: 1345036 - RNA, 12 nt, Mycobacterium tuberculosis H37Rv
gccggcccccac

SEQ ID NO: 1345037 - RNA, 22 nt, Mycobacterium tuberculosis H37Rv
gccggccauacgcgcgcggucg

SEQ ID NO: 1345038 - RNA, 17 nt, Mycobacterium tuberculosis H37Rv
gccggccauacgcgcgc

SEQ ID NO: 1345039 - RNA, 21 nt, Mycobacterium tuberculosis H37Rv
gccggcauugacccauccggc

SEQ ID NO: 1345040 - RNA, 18 nt, Mycobacterium tuberculosis H37Rv
gccggcaucgcgcgcggc

SEQ ID NO: 1345041 - RNA, 21 nt, Mycobacterium tuberculosis H37Rv
gccggcaucgucgacgcccga

SEQ ID NO: 1345042 - RNA, 13 nt, Mycobacterium tuberculosis H37Rv
gccggccggaacg

SEQ ID NO: 1345043 - RNA, 20 nt, Mycobacterium tuberculosis H37Rv
gccggccgcucaccccgcgc

SEQ ID NO: 1345044 - RNA, 15 nt, Mycobacterium tuberculosis H37Rv
gccggccgcgaccgc

SEQ ID NO: 1345045 - RNA, 17 nt, Mycobacterium tuberculosis H37Rv
gccggccgcggggcauc

SEQ ID NO: 1345046 - RNA, 16 nt, Mycobacterium tuberculosis H37Rv
gccggccggcccauuc

SEQ ID NO: 1345047 - RNA, 15 nt, Mycobacterium tuberculosis H37Rv
gccggccggcccggg

SEQ ID NO: 1345048 - RNA, 13 nt, Mycobacterium tuberculosis H37Rv
gccggccggcggg

SEQ ID NO: 1345049 - RNA, 21 nt, Mycobacterium tuberculosis H37Rv
gccggccggcaaugccgcggc

SEQ ID NO: 1345050 - RNA, 13 nt, Mycobacterium tuberculosis H37Rv
gccggccgcccgc

SEQ ID NO: 1345051 - RNA, 16 nt, Mycobacterium tuberculosis H37Rv
gccggccgccagcgca

SEQ ID NO: 1345052 - RNA, 13 nt, Mycobacterium tuberculosis H37Rv
gccggcccgcggg

SEQ ID NO: 1345053 - RNA, 21 nt, Mycobacterium tuberculosis H37Rv
gccggccgcacgccggccagc

SEQ ID NO: 1345054 - RNA, 18 nt, Mycobacterium tuberculosis H37Rv
gccggcccugcucggcca

SEQ ID NO: 1345055 - RNA, 14 nt, Mycobacterium tuberculosis H37Rv
gccggcccugcggc

SEQ ID NO: 1345056 - RNA, 20 nt, Mycobacterium tuberculosis H37Rv
gccggcccggguaucgccag

SEQ ID NO: 1345057 - RNA, 13 nt, Mycobacterium tuberculosis H37Rv
gccggccuggccg

SEQ ID NO: 1345058 - RNA, 17 nt, Mycobacterium tuberculosis H37Rv
gccggccuugagcaccc

SEQ ID NO: 1345059 - RNA, 21 nt, Mycobacterium tuberculosis H37Rv
gccggccucgccgaagcgggc

SEQ ID NO: 1345060 - RNA, 13 nt, Mycobacterium tuberculosis H37Rv
gccggccucugga

SEQ ID NO: 1345061 - RNA, 16 nt, Mycobacterium tuberculosis H37Rv
gccggccgucggccgg

SEQ ID NO: 1345062 - RNA, 17 nt, Mycobacterium tuberculosis H37Rv
gccggcgccacccgcgc

SEQ ID NO: 1345063 - RNA, 15 nt, Mycobacterium tuberculosis H37Rv
gccggcgccacccgc

SEQ ID NO: 1345064 - RNA, 19 nt, Mycobacterium tuberculosis H37Rv
gccggcgccacccgcgccg

SEQ ID NO: 1345065 - RNA, 18 nt, Mycobacterium tuberculosis H37Rv
gccggcgacgggucgggc

SEQ ID NO: 1345066 - RNA, 19 nt, Mycobacterium tuberculosis H37Rv
gccggcgacaccgcaggug

SEQ ID NO: 1345067 - RNA, 18 nt, Mycobacterium tuberculosis H37Rv
gccggcgaacucgcgccg

SEQ ID NO: 1345068 - RNA, 17 nt, Mycobacterium tuberculosis H37Rv
gccggcgagggccacgg

SEQ ID NO: 1345069 - RNA, 21 nt, Mycobacterium tuberculosis H37Rv
gccggcgaauccgcacagguc

SEQ ID NO: 1345070 - RNA, 14 nt, Mycobacterium tuberculosis H37Rv
gccggcgauggccc

SEQ ID NO: 1345071 - RNA, 14 nt, Mycobacterium tuberculosis H37Rv
gccggcggccgccc

SEQ ID NO: 1345072 - RNA, 15 nt, Mycobacterium tuberculosis H37Rv
gccggcgcucgcggc

SEQ ID NO: 1345073 - RNA, 17 nt, Mycobacterium tuberculosis H37Rv
gccggcgcugcccgggc

SEQ ID NO: 1345074 - RNA, 23 nt, Mycobacterium tuberculosis H37Rv
gccggcggcaaagagcagccggc

SEQ ID NO: 1345075 - RNA, 15 nt, Mycobacterium tuberculosis H37Rv
gccggcgcggcggcg

SEQ ID NO: 1345076 - RNA, 14 nt, Mycobacterium tuberculosis H37Rv
gccggcgcggcggc

SEQ ID NO: 1345077 - RNA, 15 nt, Mycobacterium tuberculosis H37Rv
gccggcgccgccauu

SEQ ID NO: 1345078 - RNA, 13 nt, Mycobacterium tuberculosis H37Rv
gccggcgccgcac

SEQ ID NO: 1345079 - RNA, 21 nt, Mycobacterium tuberculosis H37Rv
gccggcuccgccguugccgcc

SEQ ID NO: 1345080 - RNA, 20 nt, Mycobacterium tuberculosis H37Rv
gccggcuccgccagcgccgc

SEQ ID NO: 1345081 - RNA, 14 nt, Mycobacterium tuberculosis H37Rv
gccggcuccgccgu

SEQ ID NO: 1345082 - RNA, 18 nt, Mycobacterium tuberculosis H37Rv
gccggcugcauccuccuc

SEQ ID NO: 1345083 - RNA, 14 nt, Mycobacterium tuberculosis H37Rv
gccggcugacaacg

SEQ ID NO: 1345084 - RNA, 17 nt, Mycobacterium tuberculosis H37Rv
gccggcugcauccuccu

SEQ ID NO: 1345085 - RNA, 14 nt, Mycobacterium tuberculosis H37Rv
gccgggcaaccagc

SEQ ID NO: 1345086 - RNA, 18 nt, Mycobacterium tuberculosis H37Rv
gccgggcaaccagcagca

SEQ ID NO: 1345087 - RNA, 17 nt, Mycobacterium tuberculosis H37Rv
gccgggcaaccagcagc

SEQ ID NO: 1345088 - RNA, 18 nt, Mycobacterium tuberculosis H37Rv
gccgggcaccaccacacc

SEQ ID NO: 1345089 - RNA, 16 nt, Mycobacterium tuberculosis H37Rv
gccgggcaccacccuu

SEQ ID NO: 1345090 - RNA, 20 nt, Mycobacterium tuberculosis H37Rv
gccggcuucggugagcgggc

SEQ ID NO: 1345091 - RNA, 17 nt, Mycobacterium tuberculosis H37Rv
gccggcuucggcgagcg

SEQ ID NO: 1345092 - RNA, 22 nt, Mycobacterium tuberculosis H37Rv
gccggcuuggccuuugccgucg

SEQ ID NO: 1345093 - RNA, 22 nt, Mycobacterium tuberculosis H37Rv
gccggcuucgcccagagccgcu

SEQ ID NO: 1345094 - RNA, 16 nt, Mycobacterium tuberculosis H37Rv
gccggcuucgcccaga

SEQ ID NO: 1345095 - RNA, 15 nt, Mycobacterium tuberculosis H37Rv
gccggggccccaugc

SEQ ID NO: 1345096 - RNA, 17 nt, Mycobacterium tuberculosis H37Rv
gccgggcgaugcugggc

SEQ ID NO: 1345097 - RNA, 13 nt, Mycobacterium tuberculosis H37Rv
gccgggcgcacgc

SEQ ID NO: 1345098 - RNA, 17 nt, Mycobacterium tuberculosis H37Rv
gccgggcgcacgcccgc

SEQ ID NO: 1345099 - RNA, 21 nt, Mycobacterium tuberculosis H37Rv
gccgggcgcccuuaagccggc

SEQ ID NO: 1345100 - RNA, 18 nt, Mycobacterium tuberculosis H37Rv
gccggggccgcuggcggu

SEQ ID NO: 1345101 - RNA, 17 nt, Mycobacterium tuberculosis H37Rv
gccggggccgccgucgc

SEQ ID NO: 1345102 - RNA, 20 nt, Mycobacterium tuberculosis H37Rv
gccggggcgaugucggcugg

SEQ ID NO: 1345103 - RNA, 19 nt, Mycobacterium tuberculosis H37Rv
gccggggcgucgcaacccg

SEQ ID NO: 1345104 - RNA, 16 nt, Mycobacterium tuberculosis H37Rv
gccgggggcgccgccg

SEQ ID NO: 1345105 - RNA, 12 nt, Mycobacterium tuberculosis H37Rv
gccgggccaggc

SEQ ID NO: 1345106 - RNA, 15 nt, Mycobacterium tuberculosis H37Rv
gccgggcagucaggc

SEQ ID NO: 1345107 - RNA, 20 nt, Mycobacterium tuberculosis H37Rv
gccgggcgaguacaggcgca

SEQ ID NO: 1345108 - RNA, 15 nt, Mycobacterium tuberculosis H37Rv
gccgggccgcgcggg

SEQ ID NO: 1345109 - RNA, 13 nt, Mycobacterium tuberculosis H37Rv
gccgggccggcca

SEQ ID NO: 1345110 - RNA, 13 nt, Mycobacterium tuberculosis H37Rv
gccgggccguaga

SEQ ID NO: 1345111 - RNA, 13 nt, Mycobacterium tuberculosis H37Rv
gccgggcccagca

SEQ ID NO: 1345112 - RNA, 15 nt, Mycobacterium tuberculosis H37Rv
gccgggccccacauc

SEQ ID NO: 1345113 - RNA, 16 nt, Mycobacterium tuberculosis H37Rv
gccgggccgccgagcg

SEQ ID NO: 1345114 - RNA, 15 nt, Mycobacterium tuberculosis H37Rv
gccgggccgccgagc

SEQ ID NO: 1345115 - RNA, 13 nt, Mycobacterium tuberculosis H37Rv
gccgggccgccga

SEQ ID NO: 1345116 - RNA, 16 nt, Mycobacterium tuberculosis H37Rv
gccgcucggggugguc

SEQ ID NO: 1345117 - RNA, 20 nt, Mycobacterium tuberculosis H37Rv
gccgcucguuacgccgagca

SEQ ID NO: 1345118 - RNA, 22 nt, Mycobacterium tuberculosis H37Rv
gccgcucguuacgccgagcaca

SEQ ID NO: 1345119 - RNA, 17 nt, Mycobacterium tuberculosis H37Rv
gccgcugagcccugcgc

SEQ ID NO: 1345120 - RNA, 17 nt, Mycobacterium tuberculosis H37Rv
gccgcugaagccaaaug

SEQ ID NO: 1345121 - RNA, 20 nt, Mycobacterium tuberculosis H37Rv
gccgcuggagaucacgccga

SEQ ID NO: 1345122 - RNA, 14 nt, Mycobacterium tuberculosis H37Rv
gccgcuggccagca

SEQ ID NO: 1345123 - RNA, 12 nt, Mycobacterium tuberculosis H37Rv
gccgcugagccc

SEQ ID NO: 1345124 - RNA, 21 nt, Mycobacterium tuberculosis H37Rv
gccgcugaucugccgccgcgg

SEQ ID NO: 1345125 - RNA, 18 nt, Mycobacterium tuberculosis H37Rv
gccgcugaucugccgccg

SEQ ID NO: 1345126 - RNA, 22 nt, Mycobacterium tuberculosis H37Rv
gccgcuggcaaucccgcggucg

SEQ ID NO: 1345127 - RNA, 22 nt, Mycobacterium tuberculosis H37Rv
gccgcuaccccagccggcagca

SEQ ID NO: 1345128 - RNA, 18 nt, Mycobacterium tuberculosis H37Rv
gccgcuaccgaacaguag

SEQ ID NO: 1345129 - RNA, 17 nt, Mycobacterium tuberculosis H37Rv
gccgcuaccgcccgcgc

SEQ ID NO: 1345130 - RNA, 22 nt, Mycobacterium tuberculosis H37Rv
gccgcuaggacggcgcgagccg

SEQ ID NO: 1345131 - RNA, 21 nt, Mycobacterium tuberculosis H37Rv
gccgcuacgccggcccgaggc

SEQ ID NO: 1345132 - RNA, 20 nt, Mycobacterium tuberculosis H37Rv
gccgcguuuauaccucgccg

SEQ ID NO: 1345133 - RNA, 23 nt, Mycobacterium tuberculosis H37Rv
gccgcguucgcgcaaaugccugc

SEQ ID NO: 1345134 - RNA, 15 nt, Mycobacterium tuberculosis H37Rv
gccgcguugccgggg

SEQ ID NO: 1345135 - RNA, 18 nt, Mycobacterium tuberculosis H37Rv
gccgcguucacgcaauug

SEQ ID NO: 1345136 - RNA, 12 nt, Mycobacterium tuberculosis H37Rv
gccgcgggcgcg

SEQ ID NO: 1345137 - RNA, 17 nt, Mycobacterium tuberculosis H37Rv
gccgcgguagacgccgc

SEQ ID NO: 1345138 - RNA, 17 nt, Mycobacterium tuberculosis H37Rv
gccgcgguacccaccuc

SEQ ID NO: 1345139 - RNA, 17 nt, Mycobacterium tuberculosis H37Rv
gccgcgguaggugcaug

SEQ ID NO: 1345140 - RNA, 21 nt, Mycobacterium tuberculosis H37Rv
gccgcggugaugggccaggcg

SEQ ID NO: 1345141 - RNA, 15 nt, Mycobacterium tuberculosis H37Rv
gccgcggugauugac

SEQ ID NO: 1345142 - RNA, 17 nt, Mycobacterium tuberculosis H37Rv
gccgcguaaaccggcug

SEQ ID NO: 1345143 - RNA, 16 nt, Mycobacterium tuberculosis H37Rv
gccgcggucggccacc

SEQ ID NO: 1345144 - RNA, 16 nt, Mycobacterium tuberculosis H37Rv
gccgcggucggcgacg

SEQ ID NO: 1345145 - RNA, 20 nt, Mycobacterium tuberculosis H37Rv
gccgcggucagauccagaga

SEQ ID NO: 1345146 - RNA, 20 nt, Mycobacterium tuberculosis H37Rv
gccgcggucggcgugcaggg

SEQ ID NO: 1345147 - RNA, 19 nt, Mycobacterium tuberculosis H37Rv
gccgcggucggcgugcagg

SEQ ID NO: 1345148 - RNA, 18 nt, Mycobacterium tuberculosis H37Rv
gccgcggugacggcggcu

SEQ ID NO: 1345149 - RNA, 14 nt, Mycobacterium tuberculosis H37Rv
gccgcgcagcgagg

SEQ ID NO: 1345150 - RNA, 16 nt, Mycobacterium tuberculosis H37Rv
gccgcgcagccgcucg

SEQ ID NO: 1345151 - RNA, 22 nt, Mycobacterium tuberculosis H37Rv
gccgcgcaucugucgcgcggca

SEQ ID NO: 1345152 - RNA, 11 nt, Mycobacterium tuberculosis H37Rv
gccgcggcggu

SEQ ID NO: 1345153 - RNA, 19 nt, Mycobacterium tuberculosis H37Rv
gccgcgcccaaugcgggcu

SEQ ID NO: 1345154 - RNA, 22 nt, Mycobacterium tuberculosis H37Rv
gccgcgcccaaugcgggcuggg

SEQ ID NO: 1345155 - RNA, 23 nt, Mycobacterium tuberculosis H37Rv
gccgcggcuggugucgggcguca

SEQ ID NO: 1345156 - RNA, 22 nt, Mycobacterium tuberculosis H37Rv
gccgcgggacaccaccgcccgc

SEQ ID NO: 1345157 - RNA, 21 nt, Mycobacterium tuberculosis H37Rv
gccgcggcuacaucggcggcg

SEQ ID NO: 1345158 - RNA, 14 nt, Mycobacterium tuberculosis H37Rv
gccgcggcuaggcc

SEQ ID NO: 1345159 - RNA, 17 nt, Mycobacterium tuberculosis H37Rv
gccggacccggucgccg

SEQ ID NO: 1345160 - RNA, 23 nt, Mycobacterium tuberculosis H37Rv
gccggacccaccgucacccccga

SEQ ID NO: 1345161 - RNA, 18 nt, Mycobacterium tuberculosis H37Rv
gccggaccagcuccugca

SEQ ID NO: 1345162 - RNA, 17 nt, Mycobacterium tuberculosis H37Rv
gccggaggaucgcuggu

SEQ ID NO: 1345163 - RNA, 19 nt, Mycobacterium tuberculosis H37Rv
gccggaggcaagcaaccgg

SEQ ID NO: 1345164 - RNA, 17 nt, Mycobacterium tuberculosis H37Rv
gccggacgacaacaggc

SEQ ID NO: 1345165 - RNA, 21 nt, Mycobacterium tuberculosis H37Rv
gccggacccgucgagcagcau

SEQ ID NO: 1345166 - RNA, 14 nt, Mycobacterium tuberculosis H37Rv
gccggaaagcccgu

SEQ ID NO: 1345167 - RNA, 19 nt, Mycobacterium tuberculosis H37Rv
gccgcuuucgccggcgcca

SEQ ID NO: 1345168 - RNA, 23 nt, Mycobacterium tuberculosis H37Rv
gccgcuuuugauugaccaacccu

SEQ ID NO: 1345169 - RNA, 22 nt, Mycobacterium tuberculosis H37Rv
gccgcuuucuuggcgggcgccu

SEQ ID NO: 1345170 - RNA, 22 nt, Mycobacterium tuberculosis H37Rv
gccgcuugggccugggccgcac

SEQ ID NO: 1345171 - RNA, 22 nt, Mycobacterium tuberculosis H37Rv
gccgcugucguaccgcucggcg

SEQ ID NO: 1345172 - RNA, 14 nt, Mycobacterium tuberculosis H37Rv
gccgcuggugguga

SEQ ID NO: 1345173 - RNA, 17 nt, Mycobacterium tuberculosis H37Rv
gccgcugggugaccagg

SEQ ID NO: 1345174 - RNA, 17 nt, Mycobacterium tuberculosis H37Rv
gccggauagcgcagcuc

SEQ ID NO: 1345175 - RNA, 16 nt, Mycobacterium tuberculosis H37Rv
gccggauaggucgggc

SEQ ID NO: 1345176 - RNA, 15 nt, Mycobacterium tuberculosis H37Rv
gccggauagcgcagc

SEQ ID NO: 1345177 - RNA, 17 nt, Mycobacterium tuberculosis H37Rv
gccggaguuccgccauu

SEQ ID NO: 1345178 - RNA, 17 nt, Mycobacterium tuberculosis H37Rv
gccggcaacagcucgcc

SEQ ID NO: 1345179 - RNA, 15 nt, Mycobacterium tuberculosis H37Rv
gccggcagcggcgag

SEQ ID NO: 1345180 - RNA, 16 nt, Mycobacterium tuberculosis H37Rv
gccggcagcggcgcgc

SEQ ID NO: 1345181 - RNA, 13 nt, Mycobacterium tuberculosis H37Rv
gccggcagcggcg

SEQ ID NO: 1345182 - RNA, 19 nt, Mycobacterium tuberculosis H37Rv
gccggcacccaccagugca

SEQ ID NO: 1345183 - RNA, 22 nt, Mycobacterium tuberculosis H37Rv
gccggcaccaccguugccgccg

SEQ ID NO: 1345184 - RNA, 23 nt, Mycobacterium tuberculosis H37Rv
gccggcaccaccguugccgccgu

SEQ ID NO: 1345185 - RNA, 16 nt, Mycobacterium tuberculosis H37Rv
gccggcacccgucggg

SEQ ID NO: 1345186 - RNA, 19 nt, Mycobacterium tuberculosis H37Rv
gccggcaaugccgcggcca

SEQ ID NO: 1345187 - RNA, 17 nt, Mycobacterium tuberculosis H37Rv
gccggcaauaccgccag

SEQ ID NO: 1345188 - RNA, 18 nt, Mycobacterium tuberculosis H37Rv
gccggcaacggcgcgccg

SEQ ID NO: 1345189 - RNA, 22 nt, Mycobacterium tuberculosis H37Rv
gccggcaagaccgaacagcggc

SEQ ID NO: 1345190 - RNA, 22 nt, Mycobacterium tuberculosis H37Rv
gccucgucgucggacucguccu

SEQ ID NO: 1345191 - RNA, 18 nt, Mycobacterium tuberculosis H37Rv
gccucguugaccagaacc

SEQ ID NO: 1345192 - RNA, 13 nt, Mycobacterium tuberculosis H37Rv
gccucgucgccgc

SEQ ID NO: 1345193 - RNA, 17 nt, Mycobacterium tuberculosis H37Rv
gccucggugagcugcac

SEQ ID NO: 1345194 - RNA, 24 nt, Mycobacterium tuberculosis H37Rv
gccucgguaaagccgcggacggcg

SEQ ID NO: 1345195 - RNA, 13 nt, Mycobacterium tuberculosis H37Rv
gccucggggccua

SEQ ID NO: 1345196 - RNA, 23 nt, Mycobacterium tuberculosis H37Rv
gccucggcguaggcgauggcggc

SEQ ID NO: 1345197 - RNA, 20 nt, Mycobacterium tuberculosis H37Rv
gccucggcggccagcucggc

SEQ ID NO: 1345198 - RNA, 15 nt, Mycobacterium tuberculosis H37Rv
gccucggcgccgccc

SEQ ID NO: 1345199 - RNA, 16 nt, Mycobacterium tuberculosis H37Rv
gccucggcgccgccca

SEQ ID NO: 1345200 - RNA, 16 nt, Mycobacterium tuberculosis H37Rv
gccucgauggcggugg

SEQ ID NO: 1345201 - RNA, 23 nt, Mycobacterium tuberculosis H37Rv
gccucgaugucgcggucgcccgc

SEQ ID NO: 1345202 - RNA, 21 nt, Mycobacterium tuberculosis H37Rv
gccucgaggguuuccauggcg

SEQ ID NO: 1345203 - RNA, 22 nt, Mycobacterium tuberculosis H37Rv
gccucgauccgcaucaugucga

SEQ ID NO: 1345204 - RNA, 20 nt, Mycobacterium tuberculosis H37Rv
gccucgauaggugagcgcgg

SEQ ID NO: 1345205 - RNA, 23 nt, Mycobacterium tuberculosis H37Rv
gccucgauaggugagcgcgggcu

SEQ ID NO: 1345206 - RNA, 13 nt, Mycobacterium tuberculosis H37Rv
gccucgaucgacu

SEQ ID NO: 1345207 - RNA, 22 nt, Mycobacterium tuberculosis H37Rv
gccucgaucgacucgaaccguu

SEQ ID NO: 1345208 - RNA, 23 nt, Mycobacterium tuberculosis H37Rv
gccucgagcaacggacgaagcac

SEQ ID NO: 1345209 - RNA, 18 nt, Mycobacterium tuberculosis H37Rv
gccucgcgggcagggccu

SEQ ID NO: 1345210 - RNA, 21 nt, Mycobacterium tuberculosis H37Rv
gccucgcgggaagucccgagu

SEQ ID NO: 1345211 - RNA, 22 nt, Mycobacterium tuberculosis H37Rv
gccucgcggaugagcucggcca

SEQ ID NO: 1345212 - RNA, 17 nt, Mycobacterium tuberculosis H37Rv
gccucgccggccgccag

SEQ ID NO: 1345213 - RNA, 17 nt, Mycobacterium tuberculosis H37Rv
gccucgccgaagugguc

SEQ ID NO: 1345214 - RNA, 18 nt, Mycobacterium tuberculosis H37Rv
gccucggcaucgccgcgg

SEQ ID NO: 1345215 - RNA, 16 nt, Mycobacterium tuberculosis H37Rv
gccucgcugcucagca

SEQ ID NO: 1345216 - RNA, 18 nt, Mycobacterium tuberculosis H37Rv
gccucgcguucgcugguc

SEQ ID NO: 1345217 - RNA, 21 nt, Mycobacterium tuberculosis H37Rv
gccucgcuaacuccccagaca

SEQ ID NO: 1345218 - RNA, 13 nt, Mycobacterium tuberculosis H37Rv
gccucgcucucca

SEQ ID NO: 1345219 - RNA, 15 nt, Mycobacterium tuberculosis H37Rv
gccucccuuuuccaa

SEQ ID NO: 1345220 - RNA, 19 nt, Mycobacterium tuberculosis H37Rv
gccucccgggccgccgcga

SEQ ID NO: 1345221 - RNA, 17 nt, Mycobacterium tuberculosis H37Rv
gccucccgggccgccgc

SEQ ID NO: 1345222 - RNA, 13 nt, Mycobacterium tuberculosis H37Rv
gccuccauggccu

SEQ ID NO: 1345223 - RNA, 18 nt, Mycobacterium tuberculosis H37Rv
gccucccacucacccagc

SEQ ID NO: 1345224 - RNA, 16 nt, Mycobacterium tuberculosis H37Rv
gccucgacacccagcc

SEQ ID NO: 1345225 - RNA, 15 nt, Mycobacterium tuberculosis H37Rv
gccucgaccgccagc

SEQ ID NO: 1345226 - RNA, 16 nt, Mycobacterium tuberculosis H37Rv
gccucgaccgccagcc

SEQ ID NO: 1345227 - RNA, 18 nt, Mycobacterium tuberculosis H37Rv
gccucgaccgccagccgc

SEQ ID NO: 1345228 - RNA, 15 nt, Mycobacterium tuberculosis H37Rv
gccuccugccgccgc

SEQ ID NO: 1345229 - RNA, 21 nt, Mycobacterium tuberculosis H37Rv
gccuccucuuggguccacaac

SEQ ID NO: 1345230 - RNA, 13 nt, Mycobacterium tuberculosis H37Rv
gccuccucgugca

SEQ ID NO: 1345231 - RNA, 16 nt, Mycobacterium tuberculosis H37Rv
gccuccucuugggucc

SEQ ID NO: 1345232 - RNA, 18 nt, Mycobacterium tuberculosis H37Rv
gccuccgcugccgcccgc

SEQ ID NO: 1345233 - RNA, 21 nt, Mycobacterium tuberculosis H37Rv
gccuccggagaauccgggacg

SEQ ID NO: 1345234 - RNA, 21 nt, Mycobacterium tuberculosis H37Rv
gccuccggauccucggccgcc

SEQ ID NO: 1345235 - RNA, 18 nt, Mycobacterium tuberculosis H37Rv
gccuccggcgccgcccga

SEQ ID NO: 1345236 - RNA, 16 nt, Mycobacterium tuberculosis H37Rv
gccuccgcugccgccc

SEQ ID NO: 1345237 - RNA, 21 nt, Mycobacterium tuberculosis H37Rv
gccuccacucuucgggcggcg

SEQ ID NO: 1345238 - RNA, 16 nt, Mycobacterium tuberculosis H37Rv
gccuccacccgccacg

SEQ ID NO: 1345239 - RNA, 14 nt, Mycobacterium tuberculosis H37Rv
gccuccacccgcca

SEQ ID NO: 1345240 - RNA, 21 nt, Mycobacterium tuberculosis H37Rv
gccuccaaaaucgcggccaca

SEQ ID NO: 1345241 - RNA, 22 nt, Mycobacterium tuberculosis H37Rv
gccuccaaaaucgcggccacac

SEQ ID NO: 1345242 - RNA, 14 nt, Mycobacterium tuberculosis H37Rv
gccuccaagcccgc

SEQ ID NO: 1345243 - RNA, 20 nt, Mycobacterium tuberculosis H37Rv
gccuccacauacgcggcggc

SEQ ID NO: 1345244 - RNA, 21 nt, Mycobacterium tuberculosis H37Rv
gccuccacauacgcggcggcc

SEQ ID NO: 1345245 - RNA, 22 nt, Mycobacterium tuberculosis H37Rv
gccuccacauacgcggcggccu

SEQ ID NO: 1345246 - RNA, 23 nt, Mycobacterium tuberculosis H37Rv
gccuccagcagguccgcggccgc

SEQ ID NO: 1345247 - RNA, 21 nt, Mycobacterium tuberculosis H37Rv
gccuccagcagguccgcggcc

SEQ ID NO: 1345248 - RNA, 19 nt, Mycobacterium tuberculosis H37Rv
gccuccagauucgccgccc

SEQ ID NO: 1345249 - RNA, 13 nt, Mycobacterium tuberculosis H37Rv
gccuccagccggc

SEQ ID NO: 1345250 - RNA, 17 nt, Mycobacterium tuberculosis H37Rv
gccucagcccgucagcc

SEQ ID NO: 1345251 - RNA, 15 nt, Mycobacterium tuberculosis H37Rv
gccucaggggcgccu

SEQ ID NO: 1345252 - RNA, 15 nt, Mycobacterium tuberculosis H37Rv
gccucauccaccgau

SEQ ID NO: 1345253 - RNA, 21 nt, Mycobacterium tuberculosis H37Rv
gccucaucggcaaacuccugc

SEQ ID NO: 1345254 - RNA, 19 nt, Mycobacterium tuberculosis H37Rv
gccucaucggacagcgccu

SEQ ID NO: 1345255 - RNA, 23 nt, Mycobacterium tuberculosis H37Rv
gccucaucggacagcgccuggcc

SEQ ID NO: 1345256 - RNA, 15 nt, Mycobacterium tuberculosis H37Rv
gccucaugcuaggcc

SEQ ID NO: 1345257 - RNA, 20 nt, Mycobacterium tuberculosis H37Rv
gccgugccagcaggggacgg

SEQ ID NO: 1345258 - RNA, 20 nt, Mycobacterium tuberculosis H37Rv
gccgugcccggugcggugca

SEQ ID NO: 1345259 - RNA, 15 nt, Mycobacterium tuberculosis H37Rv
gccgugccgcacagc

SEQ ID NO: 1345260 - RNA, 17 nt, Mycobacterium tuberculosis H37Rv
gccguucgucgcgggug

SEQ ID NO: 1345261 - RNA, 17 nt, Mycobacterium tuberculosis H37Rv
gccgugugcucgaagga

SEQ ID NO: 1345262 - RNA, 18 nt, Mycobacterium tuberculosis H37Rv
gccgugugugcgauccag

SEQ ID NO: 1345263 - RNA, 17 nt, Mycobacterium tuberculosis H37Rv
gccguugaucgcaaacc

SEQ ID NO: 1345264 - RNA, 21 nt, Mycobacterium tuberculosis H37Rv
gccguugacgccguugccgcc

SEQ ID NO: 1345265 - RNA, 14 nt, Mycobacterium tuberculosis H37Rv
gccguguccgccgg

SEQ ID NO: 1345266 - RNA, 17 nt, Mycobacterium tuberculosis H37Rv
gccguggugcgcauggc

SEQ ID NO: 1345267 - RNA, 14 nt, Mycobacterium tuberculosis H37Rv
gccgugucgggcgc

SEQ ID NO: 1345268 - RNA, 18 nt, Mycobacterium tuberculosis H37Rv
gccgugucaccgggugca

SEQ ID NO: 1345269 - RNA, 15 nt, Mycobacterium tuberculosis H37Rv
gccguggcgucggcg

SEQ ID NO: 1345270 - RNA, 19 nt, Mycobacterium tuberculosis H37Rv
gccguggucgagggcggcg

SEQ ID NO: 1345271 - RNA, 20 nt, Mycobacterium tuberculosis H37Rv
gccgucggguaggccgccgu

SEQ ID NO: 1345272 - RNA, 18 nt, Mycobacterium tuberculosis H37Rv
gccgucggguccgcggcc

SEQ ID NO: 1345273 - RNA, 14 nt, Mycobacterium tuberculosis H37Rv
gccgucggcgugca

SEQ ID NO: 1345274 - RNA, 19 nt, Mycobacterium tuberculosis H37Rv
gccgucggcguacagcgcc

SEQ ID NO: 1345275 - RNA, 22 nt, Mycobacterium tuberculosis H37Rv
gccgguacacguccaguggcag

SEQ ID NO: 1345276 - RNA, 19 nt, Mycobacterium tuberculosis H37Rv
gccgucggugccgccgccg

SEQ ID NO: 1345277 - RNA, 22 nt, Mycobacterium tuberculosis H37Rv
gccgucggugccggggcugccg

SEQ ID NO: 1345278 - RNA, 17 nt, Mycobacterium tuberculosis H37Rv
gccgucggugccgccgc

SEQ ID NO: 1345279 - RNA, 20 nt, Mycobacterium tuberculosis H37Rv
gccgucgggugcagcacggc

SEQ ID NO: 1345280 - RNA, 14 nt, Mycobacterium tuberculosis H37Rv
gccgucgucgccgu

SEQ ID NO: 1345281 - RNA, 15 nt, Mycobacterium tuberculosis H37Rv
gccgucggcgccggc

SEQ ID NO: 1345282 - RNA, 14 nt, Mycobacterium tuberculosis H37Rv
gccgucggcgccuc

SEQ ID NO: 1345283 - RNA, 16 nt, Mycobacterium tuberculosis H37Rv
gccggguuaucggcag

SEQ ID NO: 1345284 - RNA, 17 nt, Mycobacterium tuberculosis H37Rv
gccggguuaucggcagc

SEQ ID NO: 1345285 - RNA, 12 nt, Mycobacterium tuberculosis H37Rv
gccggguuccag

SEQ ID NO: 1345286 - RNA, 18 nt, Mycobacterium tuberculosis H37Rv
gccgggguaggggucgag

SEQ ID NO: 1345287 - RNA, 19 nt, Mycobacterium tuberculosis H37Rv
gccgggucagcccggcgcg

SEQ ID NO: 1345288 - RNA, 21 nt, Mycobacterium tuberculosis H37Rv
gccggguauugauugacugcu

SEQ ID NO: 1345289 - RNA, 16 nt, Mycobacterium tuberculosis H37Rv
gccgggugcgccguug

SEQ ID NO: 1345290 - RNA, 14 nt, Mycobacterium tuberculosis H37Rv
gccgggugcgagcg

SEQ ID NO: 1345291 - RNA, 16 nt, Mycobacterium tuberculosis H37Rv
gccgggugggagcagc

SEQ ID NO: 1345292 - RNA, 13 nt, Mycobacterium tuberculosis H37Rv
gccggguguuggg

SEQ ID NO: 1345293 - RNA, 22 nt, Mycobacterium tuberculosis H37Rv
gccgggucagcccggcgcgauc

SEQ ID NO: 1345294 - RNA, 16 nt, Mycobacterium tuberculosis H37Rv
gccggguccgccgggc

SEQ ID NO: 1345295 - RNA, 23 nt, Mycobacterium tuberculosis H37Rv
gccgggucgaacaggccggccgc

SEQ ID NO: 1345296 - RNA, 19 nt, Mycobacterium tuberculosis H37Rv
gccguugccgauccccagg

SEQ ID NO: 1345297 - RNA, 12 nt, Mycobacterium tuberculosis H37Rv
gccguugccgcc

SEQ ID NO: 1345298 - RNA, 15 nt, Mycobacterium tuberculosis H37Rv
gccguugccgccaug

SEQ ID NO: 1345299 - RNA, 15 nt, Mycobacterium tuberculosis H37Rv
gccguugccgccauu

SEQ ID NO: 1345300 - RNA, 15 nt, Mycobacterium tuberculosis H37Rv
gccguugccgccgcc

SEQ ID NO: 1345301 - RNA, 21 nt, Mycobacterium tuberculosis H37Rv
gccguugcuauucgccagcgc

SEQ ID NO: 1345302 - RNA, 22 nt, Mycobacterium tuberculosis H37Rv
gccguugggaaccgacuugguu

SEQ ID NO: 1345303 - RNA, 17 nt, Mycobacterium tuberculosis H37Rv
gccuaacucgccugcac

SEQ ID NO: 1345304 - RNA, 14 nt, Mycobacterium tuberculosis H37Rv
gccuaccagcaccg

SEQ ID NO: 1345305 - RNA, 18 nt, Mycobacterium tuberculosis H37Rv
gccuaccggccuuuccag

SEQ ID NO: 1345306 - RNA, 22 nt, Mycobacterium tuberculosis H37Rv
gccuaccggccuuuccagcacc

SEQ ID NO: 1345307 - RNA, 12 nt, Mycobacterium tuberculosis H37Rv
gccuaccggccu

SEQ ID NO: 1345308 - RNA, 18 nt, Mycobacterium tuberculosis H37Rv
gccucaccgacgucgcca

SEQ ID NO: 1345309 - RNA, 14 nt, Mycobacterium tuberculosis H37Rv
gccucaacgccagc

SEQ ID NO: 1345310 - RNA, 14 nt, Mycobacterium tuberculosis H37Rv
gccucaaggcggcc

SEQ ID NO: 1345311 - RNA, 20 nt, Mycobacterium tuberculosis H37Rv
gccucaaaccggaaacagca

SEQ ID NO: 1345312 - RNA, 16 nt, Mycobacterium tuberculosis H37Rv
gccuagccgcggcacc

SEQ ID NO: 1345313 - RNA, 21 nt, Mycobacterium tuberculosis H37Rv
gccuagguucgccacgcccga

SEQ ID NO: 1345314 - RNA, 21 nt, Mycobacterium tuberculosis H37Rv
gccuaguccggcacugcggcc

SEQ ID NO: 1345315 - RNA, 21 nt, Mycobacterium tuberculosis H37Rv
gccuaucccgaaucucaccca

SEQ ID NO: 1345316 - RNA, 12 nt, Mycobacterium tuberculosis H37Rv
gccugccacagc

SEQ ID NO: 1345317 - RNA, 11 nt, Mycobacterium tuberculosis H37Rv
gccugccaccc

SEQ ID NO: 1345318 - RNA, 12 nt, Mycobacterium tuberculosis H37Rv
gccugcccagca

SEQ ID NO: 1345319 - RNA, 19 nt, Mycobacterium tuberculosis H37Rv
gccugcagguuuccggccu

SEQ ID NO: 1345320 - RNA, 12 nt, Mycobacterium tuberculosis H37Rv
gccugcaggccg

SEQ ID NO: 1345321 - RNA, 15 nt, Mycobacterium tuberculosis H37Rv
gccugcaggccgccg

SEQ ID NO: 1345322 - RNA, 20 nt, Mycobacterium tuberculosis H37Rv
gccugcaagcuaagcgccug

SEQ ID NO: 1345323 - RNA, 16 nt, Mycobacterium tuberculosis H37Rv
gccugcaccagcgagu

SEQ ID NO: 1345324 - RNA, 23 nt, Mycobacterium tuberculosis H37Rv
gccugcagcgaaacaccggccag

SEQ ID NO: 1345325 - RNA, 22 nt, Mycobacterium tuberculosis H37Rv
gccugcagcgaaacaccggcca

SEQ ID NO: 1345326 - RNA, 18 nt, Mycobacterium tuberculosis H37Rv
gccugccgacggcaucaa

SEQ ID NO: 1345327 - RNA, 13 nt, Mycobacterium tuberculosis H37Rv
gccugcccgccgu

SEQ ID NO: 1345328 - RNA, 20 nt, Mycobacterium tuberculosis H37Rv
gccugcccccgcgcgcacgg

SEQ ID NO: 1345329 - RNA, 21 nt, Mycobacterium tuberculosis H37Rv
gccugcccggcccgcucagcc

SEQ ID NO: 1345330 - RNA, 17 nt, Mycobacterium tuberculosis H37Rv
gccugcccccgcgcgca

SEQ ID NO: 1345331 - RNA, 14 nt, Mycobacterium tuberculosis H37Rv
gccugcccccgcgc

SEQ ID NO: 1345332 - RNA, 22 nt, Mycobacterium tuberculosis H37Rv
gccugccccacccgcggcgccg

SEQ ID NO: 1345333 - RNA, 12 nt, Mycobacterium tuberculosis H37Rv
gccugccccaga

SEQ ID NO: 1345334 - RNA, 13 nt, Mycobacterium tuberculosis H37Rv
gccugccccagau

SEQ ID NO: 1345335 - RNA, 16 nt, Mycobacterium tuberculosis H37Rv
gccugccgaugacgau

SEQ ID NO: 1345336 - RNA, 15 nt, Mycobacterium tuberculosis H37Rv
gccugccgaugacga

SEQ ID NO: 1345337 - RNA, 16 nt, Mycobacterium tuberculosis H37Rv
gccugccgcucgccgg

SEQ ID NO: 1345338 - RNA, 13 nt, Mycobacterium tuberculosis H37Rv
gccugccgggaca

SEQ ID NO: 1345339 - RNA, 21 nt, Mycobacterium tuberculosis H37Rv
gccugccucgccugcacgccc

SEQ ID NO: 1345340 - RNA, 13 nt, Mycobacterium tuberculosis H37Rv
gccugcgcacgac

SEQ ID NO: 1345341 - RNA, 13 nt, Mycobacterium tuberculosis H37Rv
gccugcgacagca

SEQ ID NO: 1345342 - RNA, 13 nt, Mycobacterium tuberculosis H37Rv
gccugcgccgcgc

SEQ ID NO: 1345343 - RNA, 17 nt, Mycobacterium tuberculosis H37Rv
gccugcgccgcccgcgc

SEQ ID NO: 1345344 - RNA, 21 nt, Mycobacterium tuberculosis H37Rv
gccugcgcgaugcgauucugc

SEQ ID NO: 1345345 - RNA, 21 nt, Mycobacterium tuberculosis H37Rv
gccugcgccuuggucgccggc

SEQ ID NO: 1345346 - RNA, 13 nt, Mycobacterium tuberculosis H37Rv
gccugcgcagacu

SEQ ID NO: 1345347 - RNA, 13 nt, Mycobacterium tuberculosis H37Rv
gccugcgccgccc

SEQ ID NO: 1345348 - RNA, 17 nt, Mycobacterium tuberculosis H37Rv
gccucugaccagccggu

SEQ ID NO: 1345349 - RNA, 15 nt, Mycobacterium tuberculosis H37Rv
gccucucuucccaac

SEQ ID NO: 1345350 - RNA, 15 nt, Mycobacterium tuberculosis H37Rv
gccucugcucagccg

SEQ ID NO: 1345351 - RNA, 21 nt, Mycobacterium tuberculosis H37Rv
gccugaaacggcugcagaggc

SEQ ID NO: 1345352 - RNA, 18 nt, Mycobacterium tuberculosis H37Rv
gccugaccgaagucugca

SEQ ID NO: 1345353 - RNA, 16 nt, Mycobacterium tuberculosis H37Rv
gccugaggugcugcca

SEQ ID NO: 1345354 - RNA, 16 nt, Mycobacterium tuberculosis H37Rv
gccugagcgccgcggc

SEQ ID NO: 1345355 - RNA, 23 nt, Mycobacterium tuberculosis H37Rv
gccugagcggggauguccgcggc

SEQ ID NO: 1345356 - RNA, 20 nt, Mycobacterium tuberculosis H37Rv
gccugagcgucgucgccggc

SEQ ID NO: 1345357 - RNA, 21 nt, Mycobacterium tuberculosis H37Rv
gccuggguuggugauugcggc

SEQ ID NO: 1345358 - RNA, 22 nt, Mycobacterium tuberculosis H37Rv
gccuggguuggugauugcggcc

SEQ ID NO: 1345359 - RNA, 14 nt, Mycobacterium tuberculosis H37Rv
gccugguccucacg

SEQ ID NO: 1345360 - RNA, 15 nt, Mycobacterium tuberculosis H37Rv
gccuggccugcccag

SEQ ID NO: 1345361 - RNA, 15 nt, Mycobacterium tuberculosis H37Rv
gccuggcuggccagc

SEQ ID NO: 1345362 - RNA, 18 nt, Mycobacterium tuberculosis H37Rv
gccuggcuggccagcugc

SEQ ID NO: 1345363 - RNA, 13 nt, Mycobacterium tuberculosis H37Rv
gccuggcuggcca

SEQ ID NO: 1345364 - RNA, 20 nt, Mycobacterium tuberculosis H37Rv
gccuggcuacgcgcgcccga

SEQ ID NO: 1345365 - RNA, 17 nt, Mycobacterium tuberculosis H37Rv
gccugggccgcacaagu

SEQ ID NO: 1345366 - RNA, 13 nt, Mycobacterium tuberculosis H37Rv
gccugugcggcgg

SEQ ID NO: 1345367 - RNA, 14 nt, Mycobacterium tuberculosis H37Rv
gccuguccugcggg

SEQ ID NO: 1345368 - RNA, 17 nt, Mycobacterium tuberculosis H37Rv
gccuguccugcgggagg

SEQ ID NO: 1345369 - RNA, 21 nt, Mycobacterium tuberculosis H37Rv
gccuguccugcgggaggcagc

SEQ ID NO: 1345370 - RNA, 20 nt, Mycobacterium tuberculosis H37Rv
gccuggucuuguugcgcagc

SEQ ID NO: 1345371 - RNA, 16 nt, Mycobacterium tuberculosis H37Rv
gccuguagucccucau

SEQ ID NO: 1345372 - RNA, 20 nt, Mycobacterium tuberculosis H37Rv
gccugcugcugcagcgaugc

SEQ ID NO: 1345373 - RNA, 12 nt, Mycobacterium tuberculosis H37Rv
gccugcuggccg

SEQ ID NO: 1345374 - RNA, 13 nt, Mycobacterium tuberculosis H37Rv
gccugcugcggcc

SEQ ID NO: 1345375 - RNA, 20 nt, Mycobacterium tuberculosis H37Rv
gccugcugcggccagggagc

SEQ ID NO: 1345376 - RNA, 13 nt, Mycobacterium tuberculosis H37Rv
gccugcuuggcca

SEQ ID NO: 1345377 - RNA, 22 nt, Mycobacterium tuberculosis H37Rv
gccuggaaucgcggagccagga

SEQ ID NO: 1345378 - RNA, 15 nt, Mycobacterium tuberculosis H37Rv
gccuggagcuguggc

SEQ ID NO: 1345379 - RNA, 15 nt, Mycobacterium tuberculosis H37Rv
gccuggaagaucacg

SEQ ID NO: 1345380 - RNA, 16 nt, Mycobacterium tuberculosis H37Rv
gccuggcagggugggg

SEQ ID NO: 1345381 - RNA, 16 nt, Mycobacterium tuberculosis H37Rv
gccuggccaccugguu

SEQ ID NO: 1345382 - RNA, 15 nt, Mycobacterium tuberculosis H37Rv
gccugcguggagcgc

SEQ ID NO: 1345383 - RNA, 17 nt, Mycobacterium tuberculosis H37Rv
gccugcgucucgaugag

SEQ ID NO: 1345384 - RNA, 16 nt, Mycobacterium tuberculosis H37Rv
gccugcuccucggcca

SEQ ID NO: 1345385 - RNA, 21 nt, Mycobacterium tuberculosis H37Rv
gccugcuccucggccagcgug

SEQ ID NO: 1345386 - RNA, 17 nt, Mycobacterium tuberculosis H37Rv
gccugcucgcagcgggc

SEQ ID NO: 1345387 - RNA, 19 nt, Mycobacterium tuberculosis H37Rv
gccugcucggagagcagca

SEQ ID NO: 1345388 - RNA, 18 nt, Mycobacterium tuberculosis H37Rv
gccugcgggaacgcggcg

SEQ ID NO: 1345389 - RNA, 13 nt, Mycobacterium tuberculosis H37Rv
gccugcggcggcg

SEQ ID NO: 1345390 - RNA, 15 nt, Mycobacterium tuberculosis H37Rv
gccugcggcaccggc

SEQ ID NO: 1345391 - RNA, 19 nt, Mycobacterium tuberculosis H37Rv
gccuucuucgcuaccuucu

SEQ ID NO: 1345392 - RNA, 21 nt, Mycobacterium tuberculosis H37Rv
gccuucuucgcuaccuucuug

SEQ ID NO: 1345393 - RNA, 16 nt, Mycobacterium tuberculosis H37Rv
gccuucuuggcgggag

SEQ ID NO: 1345394 - RNA, 22 nt, Mycobacterium tuberculosis H37Rv
gccuucuccggcgucacggcgu

SEQ ID NO: 1345395 - RNA, 14 nt, Mycobacterium tuberculosis H37Rv
gccuugaccagcag

SEQ ID NO: 1345396 - RNA, 18 nt, Mycobacterium tuberculosis H37Rv
gccuugacagcuuucuug

SEQ ID NO: 1345397 - RNA, 15 nt, Mycobacterium tuberculosis H37Rv
gccuugagccgcccc

SEQ ID NO: 1345398 - RNA, 15 nt, Mycobacterium tuberculosis H37Rv
gccuugaccagcagc

SEQ ID NO: 1345399 - RNA, 15 nt, Mycobacterium tuberculosis H37Rv
gccuugacccuccgc

SEQ ID NO: 1345400 - RNA, 20 nt, Mycobacterium tuberculosis H37Rv
gccuugaccgcggucuucuu

SEQ ID NO: 1345401 - RNA, 19 nt, Mycobacterium tuberculosis H37Rv
gccuugaucugagcgcggg

SEQ ID NO: 1345402 - RNA, 13 nt, Mycobacterium tuberculosis H37Rv
gccuugcccagcg

SEQ ID NO: 1345403 - RNA, 15 nt, Mycobacterium tuberculosis H37Rv
gccuugccaccggua

SEQ ID NO: 1345404 - RNA, 22 nt, Mycobacterium tuberculosis H37Rv
gccuugcagcgcguucggcacc

SEQ ID NO: 1345405 - RNA, 15 nt, Mycobacterium tuberculosis H37Rv
gccuugcgcacaggc

SEQ ID NO: 1345406 - RNA, 19 nt, Mycobacterium tuberculosis H37Rv
gccuugccgaucagcuggc

SEQ ID NO: 1345407 - RNA, 14 nt, Mycobacterium tuberculosis H37Rv
gccuuggcagccca

SEQ ID NO: 1345408 - RNA, 13 nt, Mycobacterium tuberculosis H37Rv
gccuuggcagccc

SEQ ID NO: 1345409 - RNA, 20 nt, Mycobacterium tuberculosis H37Rv
gccuuggcacccuccgccgg

SEQ ID NO: 1345410 - RNA, 22 nt, Mycobacterium tuberculosis H37Rv
gccuuguuccagcgcaucgagc

SEQ ID NO: 1345411 - RNA, 24 nt, Mycobacterium tuberculosis H37Rv
gccuugucggcgugucgcgucgca

SEQ ID NO: 1345412 - RNA, 12 nt, Mycobacterium tuberculosis H37Rv
gccuugucuagu

SEQ ID NO: 1345413 - RNA, 12 nt, Mycobacterium tuberculosis H37Rv
gccuuggcggcc

SEQ ID NO: 1345414 - RNA, 18 nt, Mycobacterium tuberculosis H37Rv
gccuuggcggccgcgacc

SEQ ID NO: 1345415 - RNA, 16 nt, Mycobacterium tuberculosis H37Rv
gccuuggucaccuucu

SEQ ID NO: 1345416 - RNA, 18 nt, Mycobacterium tuberculosis H37Rv
gccuuggucaccuucuug

SEQ ID NO: 1345417 - RNA, 18 nt, Mycobacterium tuberculosis H37Rv
gccuuggucgccgccuuc

SEQ ID NO: 1345418 - RNA, 21 nt, Mycobacterium tuberculosis H37Rv
gccuuggucgccgccuucuug

SEQ ID NO: 1345419 - RNA, 21 nt, Mycobacterium tuberculosis H37Rv
gccuuggucgccgcuuucuug

SEQ ID NO: 1345420 - RNA, 14 nt, Mycobacterium tuberculosis H37Rv
gccuuggcccccgg

SEQ ID NO: 1345421 - RNA, 20 nt, Mycobacterium tuberculosis H37Rv
gccuuggcgaacgccacggc

SEQ ID NO: 1345422 - RNA, 13 nt, Mycobacterium tuberculosis H37Rv
gccuuagcugcca

SEQ ID NO: 1345423 - RNA, 21 nt, Mycobacterium tuberculosis H37Rv
gccuuacgcgggugaccaaca

SEQ ID NO: 1345424 - RNA, 23 nt, Mycobacterium tuberculosis H37Rv
gccuucacgcuggccuccagcuu

SEQ ID NO: 1345425 - RNA, 16 nt, Mycobacterium tuberculosis H37Rv
gccuucagcguccagg

SEQ ID NO: 1345426 - RNA, 14 nt, Mycobacterium tuberculosis H37Rv
gccuucagcucacc

SEQ ID NO: 1345427 - RNA, 20 nt, Mycobacterium tuberculosis H37Rv
gccuuccuggcgggcgccuu

SEQ ID NO: 1345428 - RNA, 13 nt, Mycobacterium tuberculosis H37Rv
gccuucgccgccg

SEQ ID NO: 1345429 - RNA, 18 nt, Mycobacterium tuberculosis H37Rv
gccuucguagcggccgca

SEQ ID NO: 1345430 - RNA, 20 nt, Mycobacterium tuberculosis H37Rv
gccuucguagcggccgcagg

SEQ ID NO: 1345431 - RNA, 22 nt, Mycobacterium tuberculosis H37Rv
gccuucggcuaggucagcgggc

SEQ ID NO: 1345432 - RNA, 16 nt, Mycobacterium tuberculosis H37Rv
gccuuccaggcgggcg

SEQ ID NO: 1345433 - RNA, 17 nt, Mycobacterium tuberculosis H37Rv
gcgacagaugccgggcu

SEQ ID NO: 1345434 - RNA, 15 nt, Mycobacterium tuberculosis H37Rv
gcgacagccguggcg

SEQ ID NO: 1345435 - RNA, 15 nt, Mycobacterium tuberculosis H37Rv
gcgaccaggcgcggc

SEQ ID NO: 1345436 - RNA, 16 nt, Mycobacterium tuberculosis H37Rv
gcgacagcgcggcggu

SEQ ID NO: 1345437 - RNA, 11 nt, Mycobacterium tuberculosis H37Rv
gcgacagcgcu

SEQ ID NO: 1345438 - RNA, 19 nt, Mycobacterium tuberculosis H37Rv
gcgaccuggucgcuggugc

SEQ ID NO: 1345439 - RNA, 12 nt, Mycobacterium tuberculosis H37Rv
gcgaccugaaug

SEQ ID NO: 1345440 - RNA, 20 nt, Mycobacterium tuberculosis H37Rv
gcgaccuccggaaucgcccg

SEQ ID NO: 1345441 - RNA, 17 nt, Mycobacterium tuberculosis H37Rv
gcgaccucggcggcggc

SEQ ID NO: 1345442 - RNA, 17 nt, Mycobacterium tuberculosis H37Rv
gcgacccggccagcggc

SEQ ID NO: 1345443 - RNA, 18 nt, Mycobacterium tuberculosis H37Rv
gcgacccggcccagcgcc

SEQ ID NO: 1345444 - RNA, 23 nt, Mycobacterium tuberculosis H37Rv
gcgaccggugccugcaacgccag

SEQ ID NO: 1345445 - RNA, 16 nt, Mycobacterium tuberculosis H37Rv
gcgaccgucccagcgc

SEQ ID NO: 1345446 - RNA, 15 nt, Mycobacterium tuberculosis H37Rv
gcgaccccaggcgcu

SEQ ID NO: 1345447 - RNA, 17 nt, Mycobacterium tuberculosis H37Rv
gcgacccgggccgcggc

SEQ ID NO: 1345448 - RNA, 19 nt, Mycobacterium tuberculosis H37Rv
gcgacacguuggcggaugc

SEQ ID NO: 1345449 - RNA, 18 nt, Mycobacterium tuberculosis H37Rv
gcgacacgccagccgugc

SEQ ID NO: 1345450 - RNA, 14 nt, Mycobacterium tuberculosis H37Rv
gcgacacgccggcg

SEQ ID NO: 1345451 - RNA, 18 nt, Mycobacterium tuberculosis H37Rv
gcgaagucuugaccgcac

SEQ ID NO: 1345452 - RNA, 15 nt, Mycobacterium tuberculosis H37Rv
gcgaagucgcauggc

SEQ ID NO: 1345453 - RNA, 15 nt, Mycobacterium tuberculosis H37Rv
gcgaaggaccagagc

SEQ ID NO: 1345454 - RNA, 13 nt, Mycobacterium tuberculosis H37Rv
gcgaaggccgcgc

SEQ ID NO: 1345455 - RNA, 15 nt, Mycobacterium tuberculosis H37Rv
gcgaaggccagcaga

SEQ ID NO: 1345456 - RNA, 16 nt, Mycobacterium tuberculosis H37Rv
gcgaagguguccucca

SEQ ID NO: 1345457 - RNA, 20 nt, Mycobacterium tuberculosis H37Rv
gcgaaauaacggagcggccu

SEQ ID NO: 1345458 - RNA, 23 nt, Mycobacterium tuberculosis H37Rv
gcgaaaucaguucccgaaccccg

SEQ ID NO: 1345459 - RNA, 16 nt, Mycobacterium tuberculosis H37Rv
gcgaacgaucccgccg

SEQ ID NO: 1345460 - RNA, 22 nt, Mycobacterium tuberculosis H37Rv
gcgaacacccggucaucggccg

SEQ ID NO: 1345461 - RNA, 21 nt, Mycobacterium tuberculosis H37Rv
gcgaacgcguccagcgcggcc

SEQ ID NO: 1345462 - RNA, 13 nt, Mycobacterium tuberculosis H37Rv
gcgaacggccagg

SEQ ID NO: 1345463 - RNA, 23 nt, Mycobacterium tuberculosis H37Rv
gcgaacuuaacuacggugcccug

SEQ ID NO: 1345464 - RNA, 18 nt, Mycobacterium tuberculosis H37Rv
gcgaacucgcgccgagcc

SEQ ID NO: 1345465 - RNA, 15 nt, Mycobacterium tuberculosis H37Rv
gcgaacgggcuuccg

SEQ ID NO: 1345466 - RNA, 18 nt, Mycobacterium tuberculosis H37Rv
gccuuugucgccuucuug

SEQ ID NO: 1345467 - RNA, 16 nt, Mycobacterium tuberculosis H37Rv
gccuuugucgccuucu

SEQ ID NO: 1345468 - RNA, 16 nt, Mycobacterium tuberculosis H37Rv
gccuuuggucgcggcu

SEQ ID NO: 1345469 - RNA, 14 nt, Mycobacterium tuberculosis H37Rv
gccuuugagcgcgg

SEQ ID NO: 1345470 - RNA, 20 nt, Mycobacterium tuberculosis H37Rv
gccuuguucuuggccacccc

SEQ ID NO: 1345471 - RNA, 19 nt, Mycobacterium tuberculosis H37Rv
gccuuguuggcgaagucgu

SEQ ID NO: 1345472 - RNA, 18 nt, Mycobacterium tuberculosis H37Rv
gcgaucgcgagcgagcca

SEQ ID NO: 1345473 - RNA, 17 nt, Mycobacterium tuberculosis H37Rv
gcgaucgccgcacagcg

SEQ ID NO: 1345474 - RNA, 17 nt, Mycobacterium tuberculosis H37Rv
gcgaucgcguccuccuc

SEQ ID NO: 1345475 - RNA, 19 nt, Mycobacterium tuberculosis H37Rv
gcgaugaccacgccgacga

SEQ ID NO: 1345476 - RNA, 21 nt, Mycobacterium tuberculosis H37Rv
gcgaugaauucuuuggggcgc

SEQ ID NO: 1345477 - RNA, 19 nt, Mycobacterium tuberculosis H37Rv
gcgaugaugacggcggccc

SEQ ID NO: 1345478 - RNA, 20 nt, Mycobacterium tuberculosis H37Rv
gcgaucccaacgcccgggcg

SEQ ID NO: 1345479 - RNA, 19 nt, Mycobacterium tuberculosis H37Rv
gcgauccccaacacccggc

SEQ ID NO: 1345480 - RNA, 15 nt, Mycobacterium tuberculosis H37Rv
gcgauccccagcacc

SEQ ID NO: 1345481 - RNA, 20 nt, Mycobacterium tuberculosis H37Rv
gcgaucccgaucgcgcuggg

SEQ ID NO: 1345482 - RNA, 19 nt, Mycobacterium tuberculosis H37Rv
gcgauccggucggccaggc

SEQ ID NO: 1345483 - RNA, 15 nt, Mycobacterium tuberculosis H37Rv
gcgauccggucgggg

SEQ ID NO: 1345484 - RNA, 16 nt, Mycobacterium tuberculosis H37Rv
gcgauccggggcuggc

SEQ ID NO: 1345485 - RNA, 21 nt, Mycobacterium tuberculosis H37Rv
gcgaucgcagugagcagccgg

SEQ ID NO: 1345486 - RNA, 22 nt, Mycobacterium tuberculosis H37Rv
gcgaucgcagugagcagccgga

SEQ ID NO: 1345487 - RNA, 22 nt, Mycobacterium tuberculosis H37Rv
gcgaucgccggccgcgugacgu

SEQ ID NO: 1345488 - RNA, 18 nt, Mycobacterium tuberculosis H37Rv
gcgaucgccgcgcugguc

SEQ ID NO: 1345489 - RNA, 13 nt, Mycobacterium tuberculosis H37Rv
gcgaucgccuggg

SEQ ID NO: 1345490 - RNA, 15 nt, Mycobacterium tuberculosis H37Rv
gcgauccugaccagc

SEQ ID NO: 1345491 - RNA, 14 nt, Mycobacterium tuberculosis H37Rv
gcgauccggucggc

SEQ ID NO: 1345492 - RNA, 17 nt, Mycobacterium tuberculosis H37Rv
gcgagggcacggcggug

SEQ ID NO: 1345493 - RNA, 17 nt, Mycobacterium tuberculosis H37Rv
gcgagggcauccgagcg

SEQ ID NO: 1345494 - RNA, 23 nt, Mycobacterium tuberculosis H37Rv
gcgagggcuaccggcgccgcgcg

SEQ ID NO: 1345495 - RNA, 13 nt, Mycobacterium tuberculosis H37Rv
gcgagguccagca

SEQ ID NO: 1345496 - RNA, 18 nt, Mycobacterium tuberculosis H37Rv
gcgagguaagcgagucga

SEQ ID NO: 1345497 - RNA, 19 nt, Mycobacterium tuberculosis H37Rv
gcgaggucccggccgagcg

SEQ ID NO: 1345498 - RNA, 16 nt, Mycobacterium tuberculosis H37Rv
gcgauaccgaggaucu

SEQ ID NO: 1345499 - RNA, 18 nt, Mycobacterium tuberculosis H37Rv
gcgauacagacggggauc

SEQ ID NO: 1345500 - RNA, 16 nt, Mycobacterium tuberculosis H37Rv
gcgauacacggcggcg

SEQ ID NO: 1345501 - RNA, 21 nt, Mycobacterium tuberculosis H37Rv
gcgaggugauuggucacaccc

SEQ ID NO: 1345502 - RNA, 22 nt, Mycobacterium tuberculosis H37Rv
gcgaucaggcugccgcugcgcc

SEQ ID NO: 1345503 - RNA, 22 nt, Mycobacterium tuberculosis H37Rv
gcgaucaucaggugcgccuggc

SEQ ID NO: 1345504 - RNA, 19 nt, Mycobacterium tuberculosis H37Rv
gcgauccaccaagcucgca

SEQ ID NO: 1345505 - RNA, 18 nt, Mycobacterium tuberculosis H37Rv
gcgauaguugccgaggcg

SEQ ID NO: 1345506 - RNA, 14 nt, Mycobacterium tuberculosis H37Rv
gcgaucaggcugcc

SEQ ID NO: 1345507 - RNA, 17 nt, Mycobacterium tuberculosis H37Rv
gcgauaccgacacccca

SEQ ID NO: 1345508 - RNA, 18 nt, Mycobacterium tuberculosis H37Rv
gcgagcaacucguccagc

SEQ ID NO: 1345509 - RNA, 17 nt, Mycobacterium tuberculosis H37Rv
gcgagcccgccacagcc

SEQ ID NO: 1345510 - RNA, 22 nt, Mycobacterium tuberculosis H37Rv
gcgagcccgccacagccccagg

SEQ ID NO: 1345511 - RNA, 19 nt, Mycobacterium tuberculosis H37Rv
gcgagaucgggccggccgc

SEQ ID NO: 1345512 - RNA, 16 nt, Mycobacterium tuberculosis H37Rv
gcgagauagcaccagu

SEQ ID NO: 1345513 - RNA, 15 nt, Mycobacterium tuberculosis H37Rv
gcgagccgugccagc

SEQ ID NO: 1345514 - RNA, 13 nt, Mycobacterium tuberculosis H37Rv
gcgagcgcacacc

SEQ ID NO: 1345515 - RNA, 16 nt, Mycobacterium tuberculosis H37Rv
gcgagcgaguccagcg

SEQ ID NO: 1345516 - RNA, 22 nt, Mycobacterium tuberculosis H37Rv
gcgaggcgcucacccgccgcgg

SEQ ID NO: 1345517 - RNA, 22 nt, Mycobacterium tuberculosis H37Rv
gcgaggccagcgguaaugccag

SEQ ID NO: 1345518 - RNA, 16 nt, Mycobacterium tuberculosis H37Rv
gcgaggcagcacccgc

SEQ ID NO: 1345519 - RNA, 16 nt, Mycobacterium tuberculosis H37Rv
gcgaggaacgccgggg

SEQ ID NO: 1345520 - RNA, 21 nt, Mycobacterium tuberculosis H37Rv
gcgagcgccggccgcggcggc

SEQ ID NO: 1345521 - RNA, 19 nt, Mycobacterium tuberculosis H37Rv
gcgagcgccggccgcggcg

SEQ ID NO: 1345522 - RNA, 18 nt, Mycobacterium tuberculosis H37Rv
gcgacgagaucagccucg

SEQ ID NO: 1345523 - RNA, 20 nt, Mycobacterium tuberculosis H37Rv
gcgacgaccgucggcuccag

SEQ ID NO: 1345524 - RNA, 20 nt, Mycobacterium tuberculosis H37Rv
gcgacgacccgggucggcac

SEQ ID NO: 1345525 - RNA, 15 nt, Mycobacterium tuberculosis H37Rv
gcgacgaagaagaac

SEQ ID NO: 1345526 - RNA, 19 nt, Mycobacterium tuberculosis H37Rv
gcgaccuugacccgcaagu

SEQ ID NO: 1345527 - RNA, 18 nt, Mycobacterium tuberculosis H37Rv
gcgacgaucguccaaugc

SEQ ID NO: 1345528 - RNA, 16 nt, Mycobacterium tuberculosis H37Rv
gcgacgaugcagguga

SEQ ID NO: 1345529 - RNA, 22 nt, Mycobacterium tuberculosis H37Rv
gcgacucugcgucugcucacca

SEQ ID NO: 1345530 - RNA, 12 nt, Mycobacterium tuberculosis H37Rv
gcgacucggugc

SEQ ID NO: 1345531 - RNA, 17 nt, Mycobacterium tuberculosis H37Rv
gcgacucggugcgguga

SEQ ID NO: 1345532 - RNA, 12 nt, Mycobacterium tuberculosis H37Rv
gcgacgagaucu

SEQ ID NO: 1345533 - RNA, 17 nt, Mycobacterium tuberculosis H37Rv
gcgacgaucucggcggc

SEQ ID NO: 1345534 - RNA, 15 nt, Mycobacterium tuberculosis H37Rv
gcgagagccuccaug

SEQ ID NO: 1345535 - RNA, 13 nt, Mycobacterium tuberculosis H37Rv
gcgagagccggcg

SEQ ID NO: 1345536 - RNA, 14 nt, Mycobacterium tuberculosis H37Rv
gcgagacuugguga

SEQ ID NO: 1345537 - RNA, 17 nt, Mycobacterium tuberculosis H37Rv
gcgacugcagcggcgca

SEQ ID NO: 1345538 - RNA, 14 nt, Mycobacterium tuberculosis H37Rv
gcgacugcucgccg

SEQ ID NO: 1345539 - RNA, 18 nt, Mycobacterium tuberculosis H37Rv
gcgacugcucgccggacg

SEQ ID NO: 1345540 - RNA, 18 nt, Mycobacterium tuberculosis H37Rv
gcgcagcaccaggguggc

SEQ ID NO: 1345541 - RNA, 18 nt, Mycobacterium tuberculosis H37Rv
gcgcagcacugcggcagc

SEQ ID NO: 1345542 - RNA, 19 nt, Mycobacterium tuberculosis H37Rv
gcgcagcaacugggcggcc

SEQ ID NO: 1345543 - RNA, 13 nt, Mycobacterium tuberculosis H37Rv
gcgcacggcggcc

SEQ ID NO: 1345544 - RNA, 17 nt, Mycobacterium tuberculosis H37Rv
gcgcaaugcggcccggg

SEQ ID NO: 1345545 - RNA, 20 nt, Mycobacterium tuberculosis H37Rv
gcgcaaugcaucgcggcggc

SEQ ID NO: 1345546 - RNA, 18 nt, Mycobacterium tuberculosis H37Rv
gcgcacgccaccgggacg

SEQ ID NO: 1345547 - RNA, 17 nt, Mycobacterium tuberculosis H37Rv
gcgcagcugggugcgcc

SEQ ID NO: 1345548 - RNA, 17 nt, Mycobacterium tuberculosis H37Rv
gcgcagcuuggccagcc

SEQ ID NO: 1345549 - RNA, 22 nt, Mycobacterium tuberculosis H37Rv
gcgcagcuagcccucagcuagc

SEQ ID NO: 1345550 - RNA, 20 nt, Mycobacterium tuberculosis H37Rv
gcgcagcugacgucaccacg

SEQ ID NO: 1345551 - RNA, 19 nt, Mycobacterium tuberculosis H37Rv
gcgcagcggcauccacacc

SEQ ID NO: 1345552 - RNA, 14 nt, Mycobacterium tuberculosis H37Rv
gcgcagccgcagcc

SEQ ID NO: 1345553 - RNA, 13 nt, Mycobacterium tuberculosis H37Rv
gcgcagcggacgg

SEQ ID NO: 1345554 - RNA, 14 nt, Mycobacterium tuberculosis H37Rv
gcgauuccacggca

SEQ ID NO: 1345555 - RNA, 21 nt, Mycobacterium tuberculosis H37Rv
gcgauucacacucgggcggcu

SEQ ID NO: 1345556 - RNA, 11 nt, Mycobacterium tuberculosis H37Rv
gcgaugugggc

SEQ ID NO: 1345557 - RNA, 14 nt, Mycobacterium tuberculosis H37Rv
gcgauugauccggu

SEQ ID NO: 1345558 - RNA, 22 nt, Mycobacterium tuberculosis H37Rv
gcgauucugcgucugcucgccg

SEQ ID NO: 1345559 - RNA, 18 nt, Mycobacterium tuberculosis H37Rv
gcgauucugcgucugcuc

SEQ ID NO: 1345560 - RNA, 23 nt, Mycobacterium tuberculosis H37Rv
gcgauucugcgucugcucgccag

SEQ ID NO: 1345561 - RNA, 22 nt, Mycobacterium tuberculosis H37Rv
gcgauuccggcggccacgccgg

SEQ ID NO: 1345562 - RNA, 20 nt, Mycobacterium tuberculosis H37Rv
gcgaugauguugagcuggac

SEQ ID NO: 1345563 - RNA, 22 nt, Mycobacterium tuberculosis H37Rv
gcgauggccccugucauguccu

SEQ ID NO: 1345564 - RNA, 19 nt, Mycobacterium tuberculosis H37Rv
gcgauggcgauagcggcgc

SEQ ID NO: 1345565 - RNA, 20 nt, Mycobacterium tuberculosis H37Rv
gcgauggcgauagcggcgcu

SEQ ID NO: 1345566 - RNA, 18 nt, Mycobacterium tuberculosis H37Rv
gcgauggccgacgcugcu

SEQ ID NO: 1345567 - RNA, 17 nt, Mycobacterium tuberculosis H37Rv
gcgaugggccgguccgg

SEQ ID NO: 1345568 - RNA, 15 nt, Mycobacterium tuberculosis H37Rv
gcgaugggcccagcg

SEQ ID NO: 1345569 - RNA, 18 nt, Mycobacterium tuberculosis H37Rv
gcgaugggagcccggcgg

SEQ ID NO: 1345570 - RNA, 18 nt, Mycobacterium tuberculosis H37Rv
gcgauggcguagcccaug

SEQ ID NO: 1345571 - RNA, 23 nt, Mycobacterium tuberculosis H37Rv
gcgaugguggccgccaccuccca

SEQ ID NO: 1345572 - RNA, 18 nt, Mycobacterium tuberculosis H37Rv
gcgauggugcgccgggcg

SEQ ID NO: 1345573 - RNA, 17 nt, Mycobacterium tuberculosis H37Rv
gcgcaacccagccgcgc

SEQ ID NO: 1345574 - RNA, 15 nt, Mycobacterium tuberculosis H37Rv
gcgcaacacauccag

SEQ ID NO: 1345575 - RNA, 19 nt, Mycobacterium tuberculosis H37Rv
gcgcaacguagccagcagc

SEQ ID NO: 1345576 - RNA, 19 nt, Mycobacterium tuberculosis H37Rv
gcgcaauagcgacagcagc

SEQ ID NO: 1345577 - RNA, 22 nt, Mycobacterium tuberculosis H37Rv
gcgcaacgggucgguccacuuc

SEQ ID NO: 1345578 - RNA, 17 nt, Mycobacterium tuberculosis H37Rv
gcgcaacgccgccagcc

SEQ ID NO: 1345579 - RNA, 20 nt, Mycobacterium tuberculosis H37Rv
gcgcaacgccgccagccugg

SEQ ID NO: 1345580 - RNA, 16 nt, Mycobacterium tuberculosis H37Rv
gcgcaaccggccgucc

SEQ ID NO: 1345581 - RNA, 23 nt, Mycobacterium tuberculosis H37Rv
gcgcaaccuaaauugccgggccc

SEQ ID NO: 1345582 - RNA, 14 nt, Mycobacterium tuberculosis H37Rv
gcgcaaccuccgcg

SEQ ID NO: 1345583 - RNA, 19 nt, Mycobacterium tuberculosis H37Rv
gcgauuuugcgucugcucg

SEQ ID NO: 1345584 - RNA, 22 nt, Mycobacterium tuberculosis H37Rv
gcgauuuugugucugcucgccg

SEQ ID NO: 1345585 - RNA, 19 nt, Mycobacterium tuberculosis H37Rv
gcgauugucggggccgcag

SEQ ID NO: 1345586 - RNA, 18 nt, Mycobacterium tuberculosis H37Rv
gcgauuuugcgucugcuc

SEQ ID NO: 1345587 - RNA, 15 nt, Mycobacterium tuberculosis H37Rv
gcgcaaacucagacu

SEQ ID NO: 1345588 - RNA, 16 nt, Mycobacterium tuberculosis H37Rv
gcgcgaccacccgccg

SEQ ID NO: 1345589 - RNA, 17 nt, Mycobacterium tuberculosis H37Rv
gcgcgaccccaggcgcu

SEQ ID NO: 1345590 - RNA, 17 nt, Mycobacterium tuberculosis H37Rv
gcgcgaccucgcuggcc

SEQ ID NO: 1345591 - RNA, 18 nt, Mycobacterium tuberculosis H37Rv
gcgcgaacgucaaccggg

SEQ ID NO: 1345592 - RNA, 22 nt, Mycobacterium tuberculosis H37Rv
gcgcgaacgucaaccgggcggc

SEQ ID NO: 1345593 - RNA, 23 nt, Mycobacterium tuberculosis H37Rv
gcgcgaacgucaaccgggcggcg

SEQ ID NO: 1345594 - RNA, 24 nt, Mycobacterium tuberculosis H37Rv
gcgcgaagucuugaccgcaccggc

SEQ ID NO: 1345595 - RNA, 15 nt, Mycobacterium tuberculosis H37Rv
gcgccguggcgcggu

SEQ ID NO: 1345596 - RNA, 19 nt, Mycobacterium tuberculosis H37Rv
gcgccguuagcgucgccuu

SEQ ID NO: 1345597 - RNA, 21 nt, Mycobacterium tuberculosis H37Rv
gcgccguucacccuggugguc

SEQ ID NO: 1345598 - RNA, 20 nt, Mycobacterium tuberculosis H37Rv
gcgccguugccgccgucgcc

SEQ ID NO: 1345599 - RNA, 16 nt, Mycobacterium tuberculosis H37Rv
gcgccguuaccgccgu

SEQ ID NO: 1345600 - RNA, 15 nt, Mycobacterium tuberculosis H37Rv
gcgccuaccagcacc

SEQ ID NO: 1345601 - RNA, 16 nt, Mycobacterium tuberculosis H37Rv
gcgccuaccagcaccg

SEQ ID NO: 1345602 - RNA, 13 nt, Mycobacterium tuberculosis H37Rv
gcgcgaacacccg

SEQ ID NO: 1345603 - RNA, 16 nt, Mycobacterium tuberculosis H37Rv
gcgcgaacgucaaccg

SEQ ID NO: 1345604 - RNA, 17 nt, Mycobacterium tuberculosis H37Rv
gcgcgagcagacacaga

SEQ ID NO: 1345605 - RNA, 15 nt, Mycobacterium tuberculosis H37Rv
gcgcgagaacacccg

SEQ ID NO: 1345606 - RNA, 18 nt, Mycobacterium tuberculosis H37Rv
gcgcgacguccaccagcc

SEQ ID NO: 1345607 - RNA, 22 nt, Mycobacterium tuberculosis H37Rv
gcgcgaggaggcuuacaugccc

SEQ ID NO: 1345608 - RNA, 14 nt, Mycobacterium tuberculosis H37Rv
gcgcgaggggccgg

SEQ ID NO: 1345609 - RNA, 20 nt, Mycobacterium tuberculosis H37Rv
gcgcgaggaacgccggggcg

SEQ ID NO: 1345610 - RNA, 13 nt, Mycobacterium tuberculosis H37Rv
gcgcgagccgcuc

SEQ ID NO: 1345611 - RNA, 12 nt, Mycobacterium tuberculosis H37Rv
gcgcgccgcaca

SEQ ID NO: 1345612 - RNA, 17 nt, Mycobacterium tuberculosis H37Rv
gcgcgccacccagcacc

SEQ ID NO: 1345613 - RNA, 15 nt, Mycobacterium tuberculosis H37Rv
gcgcgcaucugcucg

SEQ ID NO: 1345614 - RNA, 21 nt, Mycobacterium tuberculosis H37Rv
gcgcgauagauacccgcggca

SEQ ID NO: 1345615 - RNA, 22 nt, Mycobacterium tuberculosis H37Rv
gcgcgaucaccgagucgacggc

SEQ ID NO: 1345616 - RNA, 18 nt, Mycobacterium tuberculosis H37Rv
gcgcggaucggcggccgc

SEQ ID NO: 1345617 - RNA, 22 nt, Mycobacterium tuberculosis H37Rv
gcgcggauucgguuagcgcggc

SEQ ID NO: 1345618 - RNA, 21 nt, Mycobacterium tuberculosis H37Rv
gcgcggcaaaguuggccgccc

SEQ ID NO: 1345619 - RNA, 20 nt, Mycobacterium tuberculosis H37Rv
gcgcggccaauugcgccgcc

SEQ ID NO: 1345620 - RNA, 20 nt, Mycobacterium tuberculosis H37Rv
gcgcggccaaucagcccgcc

SEQ ID NO: 1345621 - RNA, 19 nt, Mycobacterium tuberculosis H37Rv
gcgcggccuuggugggcag

SEQ ID NO: 1345622 - RNA, 18 nt, Mycobacterium tuberculosis H37Rv
gcgcggccagcagcagau

SEQ ID NO: 1345623 - RNA, 13 nt, Mycobacterium tuberculosis H37Rv
gcgcggccagccc

SEQ ID NO: 1345624 - RNA, 22 nt, Mycobacterium tuberculosis H37Rv
gcgcgggauguaccccggcccg

SEQ ID NO: 1345625 - RNA, 14 nt, Mycobacterium tuberculosis H37Rv
gcgcggcgcggguc

SEQ ID NO: 1345626 - RNA, 20 nt, Mycobacterium tuberculosis H37Rv
gcgcggcgacgacggccugc

SEQ ID NO: 1345627 - RNA, 13 nt, Mycobacterium tuberculosis H37Rv
gcgcggcgagcac

SEQ ID NO: 1345628 - RNA, 23 nt, Mycobacterium tuberculosis H37Rv
gcgcggcgaucgcuccgcggcgc

SEQ ID NO: 1345629 - RNA, 18 nt, Mycobacterium tuberculosis H37Rv
gcgcggcgaagccgggug

SEQ ID NO: 1345630 - RNA, 20 nt, Mycobacterium tuberculosis H37Rv
gcgcggcgaagccgggugcu

SEQ ID NO: 1345631 - RNA, 17 nt, Mycobacterium tuberculosis H37Rv
gcgcgcuggcgggcggc

SEQ ID NO: 1345632 - RNA, 18 nt, Mycobacterium tuberculosis H37Rv
gcgcgcuggcgggcggcg

SEQ ID NO: 1345633 - RNA, 13 nt, Mycobacterium tuberculosis H37Rv
gcgcgcugccgcu

SEQ ID NO: 1345634 - RNA, 15 nt, Mycobacterium tuberculosis H37Rv
gcgcgcugggcgcgc

SEQ ID NO: 1345635 - RNA, 17 nt, Mycobacterium tuberculosis H37Rv
gcgcgcugggcgcgcuc

SEQ ID NO: 1345636 - RNA, 12 nt, Mycobacterium tuberculosis H37Rv
gcgcgcugggcg

SEQ ID NO: 1345637 - RNA, 23 nt, Mycobacterium tuberculosis H37Rv
gcgcgcugggcccgagcgcgcgc

SEQ ID NO: 1345638 - RNA, 17 nt, Mycobacterium tuberculosis H37Rv
gcgcgcugggaggcggc

SEQ ID NO: 1345639 - RNA, 15 nt, Mycobacterium tuberculosis H37Rv
gcgcggacccagcac

SEQ ID NO: 1345640 - RNA, 17 nt, Mycobacterium tuberculosis H37Rv
gcgcggacccagcaccc

SEQ ID NO: 1345641 - RNA, 20 nt, Mycobacterium tuberculosis H37Rv
gcgcgcuuuccucaccagcc

SEQ ID NO: 1345642 - RNA, 22 nt, Mycobacterium tuberculosis H37Rv
gcgcgccggcuagggcccuggc

SEQ ID NO: 1345643 - RNA, 22 nt, Mycobacterium tuberculosis H37Rv
gcgcgccgcauccagccgugcg

SEQ ID NO: 1345644 - RNA, 11 nt, Mycobacterium tuberculosis H37Rv
gcgcgccgcga

SEQ ID NO: 1345645 - RNA, 23 nt, Mycobacterium tuberculosis H37Rv
gcgcgccggauacaccggcaccg

SEQ ID NO: 1345646 - RNA, 23 nt, Mycobacterium tuberculosis H37Rv
gcgcucgucuaccccgagccuug

SEQ ID NO: 1345647 - RNA, 19 nt, Mycobacterium tuberculosis H37Rv
gcgcucggugccgcccagg

SEQ ID NO: 1345648 - RNA, 15 nt, Mycobacterium tuberculosis H37Rv
gcgcucgggcugccg

SEQ ID NO: 1345649 - RNA, 18 nt, Mycobacterium tuberculosis H37Rv
gcgcucgaacucggcggc

SEQ ID NO: 1345650 - RNA, 22 nt, Mycobacterium tuberculosis H37Rv
gcgcucgaacucggcggccagc

SEQ ID NO: 1345651 - RNA, 19 nt, Mycobacterium tuberculosis H37Rv
gcgcucgaaagagccgcuu

SEQ ID NO: 1345652 - RNA, 22 nt, Mycobacterium tuberculosis H37Rv
gcgcucgaaggccgcacucaca

SEQ ID NO: 1345653 - RNA, 15 nt, Mycobacterium tuberculosis H37Rv
gcgcucggccagcau

SEQ ID NO: 1345654 - RNA, 16 nt, Mycobacterium tuberculosis H37Rv
gcgcucggccagcauc

SEQ ID NO: 1345655 - RNA, 19 nt, Mycobacterium tuberculosis H37Rv
gcgcuccaacaaugccagc

SEQ ID NO: 1345656 - RNA, 23 nt, Mycobacterium tuberculosis H37Rv
gcgcuccaacaacuccagcaggu

SEQ ID NO: 1345657 - RNA, 15 nt, Mycobacterium tuberculosis H37Rv
gcgcuccagccgcgc

SEQ ID NO: 1345658 - RNA, 18 nt, Mycobacterium tuberculosis H37Rv
gcgcucaucugcgcgcgg

SEQ ID NO: 1345659 - RNA, 15 nt, Mycobacterium tuberculosis H37Rv
gcgcucaucugcgcg

SEQ ID NO: 1345660 - RNA, 18 nt, Mycobacterium tuberculosis H37Rv
gcgcuccaacaacuccag

SEQ ID NO: 1345661 - RNA, 20 nt, Mycobacterium tuberculosis H37Rv
gcgcucauugcaucugccaa

SEQ ID NO: 1345662 - RNA, 12 nt, Mycobacterium tuberculosis H37Rv
gcgcucccgccg

SEQ ID NO: 1345663 - RNA, 22 nt, Mycobacterium tuberculosis H37Rv
gcgcuccagcugagcggccggc

SEQ ID NO: 1345664 - RNA, 21 nt, Mycobacterium tuberculosis H37Rv
gcgcucccacgcuucggccug

SEQ ID NO: 1345665 - RNA, 24 nt, Mycobacterium tuberculosis H37Rv
gcgcucccacgcuucggccugugc

SEQ ID NO: 1345666 - RNA, 19 nt, Mycobacterium tuberculosis H37Rv
gcgcugcggcccacaccag

SEQ ID NO: 1345667 - RNA, 21 nt, Mycobacterium tuberculosis H37Rv
gcgcugcggcccacaccagcg

SEQ ID NO: 1345668 - RNA, 21 nt, Mycobacterium tuberculosis H37Rv
gcgcugcggaucguggcgccc

SEQ ID NO: 1345669 - RNA, 14 nt, Mycobacterium tuberculosis H37Rv
gcgcugggcgcgcu

SEQ ID NO: 1345670 - RNA, 17 nt, Mycobacterium tuberculosis H37Rv
gcgcugggcgcgcucau

SEQ ID NO: 1345671 - RNA, 14 nt, Mycobacterium tuberculosis H37Rv
gcgcugcgcaccgc

SEQ ID NO: 1345672 - RNA, 21 nt, Mycobacterium tuberculosis H37Rv
gcgcugcccgggcugccgccc

SEQ ID NO: 1345673 - RNA, 15 nt, Mycobacterium tuberculosis H37Rv
gcgcugcaccggguc

SEQ ID NO: 1345674 - RNA, 19 nt, Mycobacterium tuberculosis H37Rv
gcgcugccaccgcgguggc

SEQ ID NO: 1345675 - RNA, 18 nt, Mycobacterium tuberculosis H37Rv
gcgcugaugacgcggggc

SEQ ID NO: 1345676 - RNA, 17 nt, Mycobacterium tuberculosis H37Rv
gcgcuagcgccgcgcuu

SEQ ID NO: 1345677 - RNA, 21 nt, Mycobacterium tuberculosis H37Rv
gcgcuaccuguguugagcggc

SEQ ID NO: 1345678 - RNA, 14 nt, Mycobacterium tuberculosis H37Rv
gcgcucagcgcggc

SEQ ID NO: 1345679 - RNA, 15 nt, Mycobacterium tuberculosis H37Rv
gcgcucacugcagcg

SEQ ID NO: 1345680 - RNA, 15 nt, Mycobacterium tuberculosis H37Rv
gcgcucaucacccag

SEQ ID NO: 1345681 - RNA, 18 nt, Mycobacterium tuberculosis H37Rv
gcgcucaucacccagcgc

SEQ ID NO: 1345682 - RNA, 22 nt, Mycobacterium tuberculosis H37Rv
gcgcucaggucaucggcggcgg

SEQ ID NO: 1345683 - RNA, 14 nt, Mycobacterium tuberculosis H37Rv
gcgcguucggcgcu

SEQ ID NO: 1345684 - RNA, 23 nt, Mycobacterium tuberculosis H37Rv
gcgcuaaggugggcacagcgacc

SEQ ID NO: 1345685 - RNA, 16 nt, Mycobacterium tuberculosis H37Rv
gcgcguggaaaccggu

SEQ ID NO: 1345686 - RNA, 16 nt, Mycobacterium tuberculosis H37Rv
gcgcgugacagugacc

SEQ ID NO: 1345687 - RNA, 15 nt, Mycobacterium tuberculosis H37Rv
gcgcgucggucaccg

SEQ ID NO: 1345688 - RNA, 15 nt, Mycobacterium tuberculosis H37Rv
gcgcgucucgagcgc

SEQ ID NO: 1345689 - RNA, 19 nt, Mycobacterium tuberculosis H37Rv
gcgcgucgcgcgcggcaug

SEQ ID NO: 1345690 - RNA, 22 nt, Mycobacterium tuberculosis H37Rv
gcgcguccucgccgcacgccgg

SEQ ID NO: 1345691 - RNA, 15 nt, Mycobacterium tuberculosis H37Rv
gcgcggggccgccgc

SEQ ID NO: 1345692 - RNA, 11 nt, Mycobacterium tuberculosis H37Rv
gcgcggggccg

SEQ ID NO: 1345693 - RNA, 13 nt, Mycobacterium tuberculosis H37Rv
gcgcggggcggcc

SEQ ID NO: 1345694 - RNA, 14 nt, Mycobacterium tuberculosis H37Rv
gcgcguccgggcag

SEQ ID NO: 1345695 - RNA, 15 nt, Mycobacterium tuberculosis H37Rv
gcgcguccgucggcg

SEQ ID NO: 1345696 - RNA, 23 nt, Mycobacterium tuberculosis H37Rv
gcgccgaauuggcccgggucucc

SEQ ID NO: 1345697 - RNA, 17 nt, Mycobacterium tuberculosis H37Rv
gcgccgacagccgaucc

SEQ ID NO: 1345698 - RNA, 17 nt, Mycobacterium tuberculosis H37Rv
gcgccgaaaccacuucc

SEQ ID NO: 1345699 - RNA, 20 nt, Mycobacterium tuberculosis H37Rv
gcgccgaaaccacuuccggc

SEQ ID NO: 1345700 - RNA, 16 nt, Mycobacterium tuberculosis H37Rv
gcgccgaaaccgccgg

SEQ ID NO: 1345701 - RNA, 23 nt, Mycobacterium tuberculosis H37Rv
gcgccgaacaccacaccgagcac

SEQ ID NO: 1345702 - RNA, 14 nt, Mycobacterium tuberculosis H37Rv
gcgccgaaccagcg

SEQ ID NO: 1345703 - RNA, 15 nt, Mycobacterium tuberculosis H37Rv
gcgccgaacgccagc

SEQ ID NO: 1345704 - RNA, 14 nt, Mycobacterium tuberculosis H37Rv
gcgccgaacucaac

SEQ ID NO: 1345705 - RNA, 18 nt, Mycobacterium tuberculosis H37Rv
gcgccgagcccgggccug

SEQ ID NO: 1345706 - RNA, 15 nt, Mycobacterium tuberculosis H37Rv
gcgccgagccagcac

SEQ ID NO: 1345707 - RNA, 17 nt, Mycobacterium tuberculosis H37Rv
gcgccgacgacuccggc

SEQ ID NO: 1345708 - RNA, 12 nt, Mycobacterium tuberculosis H37Rv
gcgccgaccaca

SEQ ID NO: 1345709 - RNA, 22 nt, Mycobacterium tuberculosis H37Rv
gcgccgaccagaacgacgccgc

SEQ ID NO: 1345710 - RNA, 21 nt, Mycobacterium tuberculosis H37Rv
gcgccgacccgcgcgccggcg

SEQ ID NO: 1345711 - RNA, 23 nt, Mycobacterium tuberculosis H37Rv
gcgccgaucacggugggcgccga

SEQ ID NO: 1345712 - RNA, 20 nt, Mycobacterium tuberculosis H37Rv
gcgccgaguuguucgcccac

SEQ ID NO: 1345713 - RNA, 15 nt, Mycobacterium tuberculosis H37Rv
gcgccgagcucggcg

SEQ ID NO: 1345714 - RNA, 22 nt, Mycobacterium tuberculosis H37Rv
gcgccgauuccaccgccgacgc

SEQ ID NO: 1345715 - RNA, 17 nt, Mycobacterium tuberculosis H37Rv
gcgccgcacccgggacg

SEQ ID NO: 1345716 - RNA, 14 nt, Mycobacterium tuberculosis H37Rv
gcgccgcauaccag

SEQ ID NO: 1345717 - RNA, 16 nt, Mycobacterium tuberculosis H37Rv
gcgccgcacggcgacg

SEQ ID NO: 1345718 - RNA, 17 nt, Mycobacterium tuberculosis H37Rv
gcgccgcaccaagcagc

SEQ ID NO: 1345719 - RNA, 14 nt, Mycobacterium tuberculosis H37Rv
gcgccgcacggcga

SEQ ID NO: 1345720 - RNA, 13 nt, Mycobacterium tuberculosis H37Rv
gcgccgcagagca

SEQ ID NO: 1345721 - RNA, 19 nt, Mycobacterium tuberculosis H37Rv
gcgccgcagaucaccgcca

SEQ ID NO: 1345722 - RNA, 16 nt, Mycobacterium tuberculosis H37Rv
gcgccgcagugacggg

SEQ ID NO: 1345723 - RNA, 20 nt, Mycobacterium tuberculosis H37Rv
gcgccgccagcgccgccggc

SEQ ID NO: 1345724 - RNA, 21 nt, Mycobacterium tuberculosis H37Rv
gcgccgccagcgccgccggcg

SEQ ID NO: 1345725 - RNA, 14 nt, Mycobacterium tuberculosis H37Rv
gcgccgcagggccg

SEQ ID NO: 1345726 - RNA, 20 nt, Mycobacterium tuberculosis H37Rv
gcgccgccacugccggcagc

SEQ ID NO: 1345727 - RNA, 23 nt, Mycobacterium tuberculosis H37Rv
gcgccgccacggaucgcggcggc

SEQ ID NO: 1345728 - RNA, 15 nt, Mycobacterium tuberculosis H37Rv
gcgccgccagcacca

SEQ ID NO: 1345729 - RNA, 22 nt, Mycobacterium tuberculosis H37Rv
gcgccgccaccgaagccgccgg

SEQ ID NO: 1345730 - RNA, 15 nt, Mycobacterium tuberculosis H37Rv
gcgccgcccagcauc

SEQ ID NO: 1345731 - RNA, 23 nt, Mycobacterium tuberculosis H37Rv
gcgccgcccaugccuccagaacc

SEQ ID NO: 1345732 - RNA, 20 nt, Mycobacterium tuberculosis H37Rv
gcgccgcccgcgccaccagc

SEQ ID NO: 1345733 - RNA, 19 nt, Mycobacterium tuberculosis H37Rv
gcgccgcccgcgcccccgg

SEQ ID NO: 1345734 - RNA, 15 nt, Mycobacterium tuberculosis H37Rv
gcgccgcgcggcuug

SEQ ID NO: 1345735 - RNA, 14 nt, Mycobacterium tuberculosis H37Rv
gcgccgcgcgggug

SEQ ID NO: 1345736 - RNA, 22 nt, Mycobacterium tuberculosis H37Rv
gcgccgcgcuugcgaucggcac

SEQ ID NO: 1345737 - RNA, 14 nt, Mycobacterium tuberculosis H37Rv
gcgccgcggcuggg

SEQ ID NO: 1345738 - RNA, 13 nt, Mycobacterium tuberculosis H37Rv
gcgccgcggcgga

SEQ ID NO: 1345739 - RNA, 14 nt, Mycobacterium tuberculosis H37Rv
gcgccgcguggcug

SEQ ID NO: 1345740 - RNA, 19 nt, Mycobacterium tuberculosis H37Rv
gcgccgcguggcuggcggc

SEQ ID NO: 1345741 - RNA, 19 nt, Mycobacterium tuberculosis H37Rv
gcgccgcguugucggcgcu

SEQ ID NO: 1345742 - RNA, 12 nt, Mycobacterium tuberculosis H37Rv
gcgccgcggccc

SEQ ID NO: 1345743 - RNA, 20 nt, Mycobacterium tuberculosis H37Rv
gcgccggaguugaagaagcc

SEQ ID NO: 1345744 - RNA, 22 nt, Mycobacterium tuberculosis H37Rv
gcgccgcuaggugacgccgcca

SEQ ID NO: 1345745 - RNA, 23 nt, Mycobacterium tuberculosis H37Rv
gcgccggauggguggccagcaac

SEQ ID NO: 1345746 - RNA, 15 nt, Mycobacterium tuberculosis H37Rv
gcgccggccaugccu

SEQ ID NO: 1345747 - RNA, 14 nt, Mycobacterium tuberculosis H37Rv
gcgccggccaggcu

SEQ ID NO: 1345748 - RNA, 12 nt, Mycobacterium tuberculosis H37Rv
gcgccggccagg

SEQ ID NO: 1345749 - RNA, 19 nt, Mycobacterium tuberculosis H37Rv
gcgccggccaacagguucc

SEQ ID NO: 1345750 - RNA, 22 nt, Mycobacterium tuberculosis H37Rv
gcgccgugaucagcucgcgcac

SEQ ID NO: 1345751 - RNA, 19 nt, Mycobacterium tuberculosis H37Rv
gcgccgucgucgagcacca

SEQ ID NO: 1345752 - RNA, 16 nt, Mycobacterium tuberculosis H37Rv
gcgccgucgggccugc

SEQ ID NO: 1345753 - RNA, 19 nt, Mycobacterium tuberculosis H37Rv
gcgccgucgggccugccgg

SEQ ID NO: 1345754 - RNA, 21 nt, Mycobacterium tuberculosis H37Rv
gcgccgucagcccaggugggc

SEQ ID NO: 1345755 - RNA, 18 nt, Mycobacterium tuberculosis H37Rv
gcgccguacagcggcggc

SEQ ID NO: 1345756 - RNA, 22 nt, Mycobacterium tuberculosis H37Rv
gcgccguaacagccggccggau

SEQ ID NO: 1345757 - RNA, 15 nt, Mycobacterium tuberculosis H37Rv
gcgccguagagccgc

SEQ ID NO: 1345758 - RNA, 17 nt, Mycobacterium tuberculosis H37Rv
gcgccgucagcccaggu

SEQ ID NO: 1345759 - RNA, 14 nt, Mycobacterium tuberculosis H37Rv
gcgccggccgcggc

SEQ ID NO: 1345760 - RNA, 13 nt, Mycobacterium tuberculosis H37Rv
gcgccggccgcug

SEQ ID NO: 1345761 - RNA, 17 nt, Mycobacterium tuberculosis H37Rv
gcgccggccgcacgccg

SEQ ID NO: 1345762 - RNA, 16 nt, Mycobacterium tuberculosis H37Rv
gcgccggcccgcagcc

SEQ ID NO: 1345763 - RNA, 22 nt, Mycobacterium tuberculosis H37Rv
gcgccggccauaccgcucgccg

SEQ ID NO: 1345764 - RNA, 17 nt, Mycobacterium tuberculosis H37Rv
gcgccggugcggcgggc

SEQ ID NO: 1345765 - RNA, 18 nt, Mycobacterium tuberculosis H37Rv
gcgccggugcggcgggcu

SEQ ID NO: 1345766 - RNA, 12 nt, Mycobacterium tuberculosis H37Rv
gcgccggugcug

SEQ ID NO: 1345767 - RNA, 16 nt, Mycobacterium tuberculosis H37Rv
gcgccggugccgccgg

SEQ ID NO: 1345768 - RNA, 16 nt, Mycobacterium tuberculosis H37Rv
gcgccgguuggccagu

SEQ ID NO: 1345769 - RNA, 20 nt, Mycobacterium tuberculosis H37Rv
gcgccgguuucgaggcgaag

SEQ ID NO: 1345770 - RNA, 14 nt, Mycobacterium tuberculosis H37Rv
gcgccggcgcugcu

SEQ ID NO: 1345771 - RNA, 15 nt, Mycobacterium tuberculosis H37Rv
gcgccggcgcugcug

SEQ ID NO: 1345772 - RNA, 19 nt, Mycobacterium tuberculosis H37Rv
gcgccggucgccggcuggg

SEQ ID NO: 1345773 - RNA, 12 nt, Mycobacterium tuberculosis H37Rv
gcgccacucaag

SEQ ID NO: 1345774 - RNA, 23 nt, Mycobacterium tuberculosis H37Rv
gcgccacguccaucaccggcggc

SEQ ID NO: 1345775 - RNA, 23 nt, Mycobacterium tuberculosis H37Rv
gcgcaggauucugcugaccauga

SEQ ID NO: 1345776 - RNA, 22 nt, Mycobacterium tuberculosis H37Rv
gcgcaggauguucaaucccucc

SEQ ID NO: 1345777 - RNA, 18 nt, Mycobacterium tuberculosis H37Rv
gcgccagggucgguugcu

SEQ ID NO: 1345778 - RNA, 13 nt, Mycobacterium tuberculosis H37Rv
gcgccaggucggc

SEQ ID NO: 1345779 - RNA, 21 nt, Mycobacterium tuberculosis H37Rv
gcgccaggucggcgggcgcgg

SEQ ID NO: 1345780 - RNA, 13 nt, Mycobacterium tuberculosis H37Rv
gcgccagcgggcu

SEQ ID NO: 1345781 - RNA, 19 nt, Mycobacterium tuberculosis H37Rv
gcgcccaacgcgggugccg

SEQ ID NO: 1345782 - RNA, 16 nt, Mycobacterium tuberculosis H37Rv
gcgccauuugggccca

SEQ ID NO: 1345783 - RNA, 23 nt, Mycobacterium tuberculosis H37Rv
gcgcccaggccgaucagcgcggc

SEQ ID NO: 1345784 - RNA, 15 nt, Mycobacterium tuberculosis H37Rv
gcgccaugcgccaac

SEQ ID NO: 1345785 - RNA, 16 nt, Mycobacterium tuberculosis H37Rv
gcgccauucgcccggc

SEQ ID NO: 1345786 - RNA, 22 nt, Mycobacterium tuberculosis H37Rv
gcgccauucgcccggccgcagc

SEQ ID NO: 1345787 - RNA, 20 nt, Mycobacterium tuberculosis H37Rv
gcgcccgcugagccagcucc

SEQ ID NO: 1345788 - RNA, 19 nt, Mycobacterium tuberculosis H37Rv
gcgcccgcuaacuggcccg

SEQ ID NO: 1345789 - RNA, 14 nt, Mycobacterium tuberculosis H37Rv
gcgcccgcucggcc

SEQ ID NO: 1345790 - RNA, 20 nt, Mycobacterium tuberculosis H37Rv
gcgcccgcucggccgcagcc

SEQ ID NO: 1345791 - RNA, 22 nt, Mycobacterium tuberculosis H37Rv
gcgcccgcucggccgcagccag

SEQ ID NO: 1345792 - RNA, 12 nt, Mycobacterium tuberculosis H37Rv
gcgcccgcgaaa

SEQ ID NO: 1345793 - RNA, 20 nt, Mycobacterium tuberculosis H37Rv
gcgcccggcgcaagcgccgc

SEQ ID NO: 1345794 - RNA, 18 nt, Mycobacterium tuberculosis H37Rv
gcgcccuuaagccggcgc

SEQ ID NO: 1345795 - RNA, 15 nt, Mycobacterium tuberculosis H37Rv
gcgcccuggccgccc

SEQ ID NO: 1345796 - RNA, 16 nt, Mycobacterium tuberculosis H37Rv
gcgcccuggccgcccu

SEQ ID NO: 1345797 - RNA, 17 nt, Mycobacterium tuberculosis H37Rv
gcgcccguccgcgcgcc

SEQ ID NO: 1345798 - RNA, 13 nt, Mycobacterium tuberculosis H37Rv
gcgcccuccucga

SEQ ID NO: 1345799 - RNA, 21 nt, Mycobacterium tuberculosis H37Rv
gcgcccuccucgaugcccuug

SEQ ID NO: 1345800 - RNA, 16 nt, Mycobacterium tuberculosis H37Rv
gcgcccugcgccacac

SEQ ID NO: 1345801 - RNA, 18 nt, Mycobacterium tuberculosis H37Rv
gcgcccgccggcaaccgg

SEQ ID NO: 1345802 - RNA, 16 nt, Mycobacterium tuberculosis H37Rv
gcgcccgggucccggc

SEQ ID NO: 1345803 - RNA, 13 nt, Mycobacterium tuberculosis H37Rv
gcgcccggcugau

SEQ ID NO: 1345804 - RNA, 24 nt, Mycobacterium tuberculosis H37Rv
gcgcccucagccgcggccacauga

SEQ ID NO: 1345805 - RNA, 17 nt, Mycobacterium tuberculosis H37Rv
gcgcccgucuccagcac

SEQ ID NO: 1345806 - RNA, 16 nt, Mycobacterium tuberculosis H37Rv
gcgccccaccgcgccg

SEQ ID NO: 1345807 - RNA, 22 nt, Mycobacterium tuberculosis H37Rv
gcgccccaccggcccgggaaau

SEQ ID NO: 1345808 - RNA, 18 nt, Mycobacterium tuberculosis H37Rv
gcgcccauagcugccggc

SEQ ID NO: 1345809 - RNA, 14 nt, Mycobacterium tuberculosis H37Rv
gcgccccgccgcac

SEQ ID NO: 1345810 - RNA, 14 nt, Mycobacterium tuberculosis H37Rv
gcgccccgcggucc

SEQ ID NO: 1345811 - RNA, 14 nt, Mycobacterium tuberculosis H37Rv
gcgcccccggugcc

SEQ ID NO: 1345812 - RNA, 17 nt, Mycobacterium tuberculosis H37Rv
gcgccccaugcaacaca

SEQ ID NO: 1345813 - RNA, 15 nt, Mycobacterium tuberculosis H37Rv
gcgcccgccaucagc

SEQ ID NO: 1345814 - RNA, 19 nt, Mycobacterium tuberculosis H37Rv
gcgcccgccaucagcccgg

SEQ ID NO: 1345815 - RNA, 21 nt, Mycobacterium tuberculosis H37Rv
gcgcccgccgcggcagcaucc

SEQ ID NO: 1345816 - RNA, 23 nt, Mycobacterium tuberculosis H37Rv
gcgcccgccgcgaacuccagcag

SEQ ID NO: 1345817 - RNA, 20 nt, Mycobacterium tuberculosis H37Rv
gcgcccgaagccgggcccca

SEQ ID NO: 1345818 - RNA, 16 nt, Mycobacterium tuberculosis H37Rv
gcgccccuggcaccuc

SEQ ID NO: 1345819 - RNA, 15 nt, Mycobacterium tuberculosis H37Rv
gcguuucggcgggcg

SEQ ID NO: 1345820 - RNA, 23 nt, Mycobacterium tuberculosis H37Rv
gcguucggucagugggacgggcg

SEQ ID NO: 1345821 - RNA, 21 nt, Mycobacterium tuberculosis H37Rv
gcguuucgaaccgcacgguga

SEQ ID NO: 1345822 - RNA, 14 nt, Mycobacterium tuberculosis H37Rv
gcguugcacagcag

SEQ ID NO: 1345823 - RNA, 20 nt, Mycobacterium tuberculosis H37Rv
gcguugacgucgagcagcgc

SEQ ID NO: 1345824 - RNA, 14 nt, Mycobacterium tuberculosis H37Rv
gcguucgaugccac

SEQ ID NO: 1345825 - RNA, 22 nt, Mycobacterium tuberculosis H37Rv
gcguuccucgacguaggccagg

SEQ ID NO: 1345826 - RNA, 15 nt, Mycobacterium tuberculosis H37Rv
gcguucgccgcccgg

SEQ ID NO: 1345827 - RNA, 17 nt, Mycobacterium tuberculosis H37Rv
gcguucgccgcccggcg

SEQ ID NO: 1345828 - RNA, 15 nt, Mycobacterium tuberculosis H37Rv
gcguucggccgggcc

SEQ ID NO: 1345829 - RNA, 16 nt, Mycobacterium tuberculosis H37Rv
gcguucggcaccuggu

SEQ ID NO: 1345830 - RNA, 15 nt, Mycobacterium tuberculosis H37Rv
gcguggucgcgcggc

SEQ ID NO: 1345831 - RNA, 18 nt, Mycobacterium tuberculosis H37Rv
gcguggugaagucggugc

SEQ ID NO: 1345832 - RNA, 18 nt, Mycobacterium tuberculosis H37Rv
gcguggugcugaccgcgc

SEQ ID NO: 1345833 - RNA, 19 nt, Mycobacterium tuberculosis H37Rv
gcguuacccaucgccacac

SEQ ID NO: 1345834 - RNA, 14 nt, Mycobacterium tuberculosis H37Rv
gcguuacgccgcga

SEQ ID NO: 1345835 - RNA, 14 nt, Mycobacterium tuberculosis H37Rv
gcguguaccugucc

SEQ ID NO: 1345836 - RNA, 15 nt, Mycobacterium tuberculosis H37Rv
gcguguacggcggcu

SEQ ID NO: 1345837 - RNA, 21 nt, Mycobacterium tuberculosis H37Rv
gcgugcugccguauccaggcg

SEQ ID NO: 1345838 - RNA, 15 nt, Mycobacterium tuberculosis H37Rv
gcgugcugugcucac

SEQ ID NO: 1345839 - RNA, 19 nt, Mycobacterium tuberculosis H37Rv
gcgugcugugcucacgagc

SEQ ID NO: 1345840 - RNA, 19 nt, Mycobacterium tuberculosis H37Rv
gcguggaacuugcgcaggu

SEQ ID NO: 1345841 - RNA, 17 nt, Mycobacterium tuberculosis H37Rv
gcgugcuugaccgccug

SEQ ID NO: 1345842 - RNA, 15 nt, Mycobacterium tuberculosis H37Rv
gcgugggcgcggcgc

SEQ ID NO: 1345843 - RNA, 20 nt, Mycobacterium tuberculosis H37Rv
gcgugggcgugagcgcgcgc

SEQ ID NO: 1345844 - RNA, 13 nt, Mycobacterium tuberculosis H37Rv
gcguggaucgcgc

SEQ ID NO: 1345845 - RNA, 14 nt, Mycobacterium tuberculosis H37Rv
gcguggacgcccgc

SEQ ID NO: 1345846 - RNA, 17 nt, Mycobacterium tuberculosis H37Rv
gcguggacgcccgcccg

SEQ ID NO: 1345847 - RNA, 18 nt, Mycobacterium tuberculosis H37Rv
gcgugccgaccagcaucu

SEQ ID NO: 1345848 - RNA, 14 nt, Mycobacterium tuberculosis H37Rv
gcgugccccagucc

SEQ ID NO: 1345849 - RNA, 14 nt, Mycobacterium tuberculosis H37Rv
gcgugcaugagccg

SEQ ID NO: 1345850 - RNA, 16 nt, Mycobacterium tuberculosis H37Rv
gcgugccacucgaugc

SEQ ID NO: 1345851 - RNA, 24 nt, Mycobacterium tuberculosis H37Rv
gcgugccagcgccccgcgguccug

SEQ ID NO: 1345852 - RNA, 23 nt, Mycobacterium tuberculosis H37Rv
gcgugcaucgcgauuccggcggc

SEQ ID NO: 1345853 - RNA, 15 nt, Mycobacterium tuberculosis H37Rv
gcgugccagcgcccc

SEQ ID NO: 1345854 - RNA, 19 nt, Mycobacterium tuberculosis H37Rv
gcgugaagucacggcggcu

SEQ ID NO: 1345855 - RNA, 21 nt, Mycobacterium tuberculosis H37Rv
gcgugcacugaccgcggcugu

SEQ ID NO: 1345856 - RNA, 15 nt, Mycobacterium tuberculosis H37Rv
gcgugcagcggcggg

SEQ ID NO: 1345857 - RNA, 15 nt, Mycobacterium tuberculosis H37Rv
gcguaugcacaugau

SEQ ID NO: 1345858 - RNA, 13 nt, Mycobacterium tuberculosis H37Rv
gcguaucucccaa

SEQ ID NO: 1345859 - RNA, 21 nt, Mycobacterium tuberculosis H37Rv
gcguaucucccaacggcagcg

SEQ ID NO: 1345860 - RNA, 22 nt, Mycobacterium tuberculosis H37Rv
gcguaugccaggacuggcaccg

SEQ ID NO: 1345861 - RNA, 23 nt, Mycobacterium tuberculosis H37Rv
gcgucucgaucaccucgcgggug

SEQ ID NO: 1345862 - RNA, 12 nt, Mycobacterium tuberculosis H37Rv
gcgucucggugg

SEQ ID NO: 1345863 - RNA, 17 nt, Mycobacterium tuberculosis H37Rv
gcgucugcagcgggcgu

SEQ ID NO: 1345864 - RNA, 18 nt, Mycobacterium tuberculosis H37Rv
gcgucugcccgcccagcc

SEQ ID NO: 1345865 - RNA, 21 nt, Mycobacterium tuberculosis H37Rv
gcguagugcggcguggaucag

SEQ ID NO: 1345866 - RNA, 22 nt, Mycobacterium tuberculosis H37Rv
gcgucuuggaaggcgcgcgccc

SEQ ID NO: 1345867 - RNA, 17 nt, Mycobacterium tuberculosis H37Rv
gcgucugcucgccaggc

SEQ ID NO: 1345868 - RNA, 18 nt, Mycobacterium tuberculosis H37Rv
gcgucugcucgccaggca

SEQ ID NO: 1345869 - RNA, 16 nt, Mycobacterium tuberculosis H37Rv
gcgucugcucgccagc

SEQ ID NO: 1345870 - RNA, 15 nt, Mycobacterium tuberculosis H37Rv
gcgucugcucggcgc

SEQ ID NO: 1345871 - RNA, 18 nt, Mycobacterium tuberculosis H37Rv
gcgucugcucggcgcagc

SEQ ID NO: 1345872 - RNA, 17 nt, Mycobacterium tuberculosis H37Rv
gcgucugcucggcggcc

SEQ ID NO: 1345873 - RNA, 13 nt, Mycobacterium tuberculosis H37Rv
gcgucugcggcgg

SEQ ID NO: 1345874 - RNA, 19 nt, Mycobacterium tuberculosis H37Rv
gcgucugcgguggccuguc

SEQ ID NO: 1345875 - RNA, 20 nt, Mycobacterium tuberculosis H37Rv
gcgucugcucggcggugccg

SEQ ID NO: 1345876 - RNA, 18 nt, Mycobacterium tuberculosis H37Rv
gcgucugcugaccggagu

SEQ ID NO: 1345877 - RNA, 16 nt, Mycobacterium tuberculosis H37Rv
gcgucugggugcaggu

SEQ ID NO: 1345878 - RNA, 16 nt, Mycobacterium tuberculosis H37Rv
gcgucuggucagccgc

SEQ ID NO: 1345879 - RNA, 13 nt, Mycobacterium tuberculosis H37Rv
gcuacccauggcc

SEQ ID NO: 1345880 - RNA, 21 nt, Mycobacterium tuberculosis H37Rv
gcuacccgcgcgaccugaaug

SEQ ID NO: 1345881 - RNA, 16 nt, Mycobacterium tuberculosis H37Rv
gcuacccgggccaggc

SEQ ID NO: 1345882 - RNA, 17 nt, Mycobacterium tuberculosis H37Rv
gcuacccauucggcggc

SEQ ID NO: 1345883 - RNA, 14 nt, Mycobacterium tuberculosis H37Rv
gcuaccgcccgcgc

SEQ ID NO: 1345884 - RNA, 12 nt, Mycobacterium tuberculosis H37Rv
gcuaccgcccgc

SEQ ID NO: 1345885 - RNA, 17 nt, Mycobacterium tuberculosis H37Rv
gcuacccgggccaggcu

SEQ ID NO: 1345886 - RNA, 22 nt, Mycobacterium tuberculosis H37Rv
gcuaccgaacaguaggccuccg

SEQ ID NO: 1345887 - RNA, 23 nt, Mycobacterium tuberculosis H37Rv
gcuaccgaacaguaggccuccgc

SEQ ID NO: 1345888 - RNA, 21 nt, Mycobacterium tuberculosis H37Rv
gcuacgcaacgggucgggucc

SEQ ID NO: 1345889 - RNA, 20 nt, Mycobacterium tuberculosis H37Rv
gcuacgcgcgcucgcucacc

SEQ ID NO: 1345890 - RNA, 15 nt, Mycobacterium tuberculosis H37Rv
gcuacgccuccuucg

SEQ ID NO: 1345891 - RNA, 13 nt, Mycobacterium tuberculosis H37Rv
gcuacgcgcgcuc

SEQ ID NO: 1345892 - RNA, 20 nt, Mycobacterium tuberculosis H37Rv
gcuacggcgacacgccagcc

SEQ ID NO: 1345893 - RNA, 22 nt, Mycobacterium tuberculosis H37Rv
gcuacgggccgcgguacccacc

SEQ ID NO: 1345894 - RNA, 18 nt, Mycobacterium tuberculosis H37Rv
gcuacucgaaacccaugu

SEQ ID NO: 1345895 - RNA, 17 nt, Mycobacterium tuberculosis H37Rv
gcuacaccugcggcguc

SEQ ID NO: 1345896 - RNA, 14 nt, Mycobacterium tuberculosis H37Rv
gcuacaucggcggc

SEQ ID NO: 1345897 - RNA, 20 nt, Mycobacterium tuberculosis H37Rv
gcuacccaccggccggugcc

SEQ ID NO: 1345898 - RNA, 18 nt, Mycobacterium tuberculosis H37Rv
gcuaaggugggcacagcg

SEQ ID NO: 1345899 - RNA, 15 nt, Mycobacterium tuberculosis H37Rv
gcuaacuggcccgga

SEQ ID NO: 1345900 - RNA, 20 nt, Mycobacterium tuberculosis H37Rv
gcuaacuccccagacaucca

SEQ ID NO: 1345901 - RNA, 14 nt, Mycobacterium tuberculosis H37Rv
gcuaaccaugcugu

SEQ ID NO: 1345902 - RNA, 17 nt, Mycobacterium tuberculosis H37Rv
gcuaaccgacgcugaag

SEQ ID NO: 1345903 - RNA, 20 nt, Mycobacterium tuberculosis H37Rv
gcuaaacuccgugccgagcg

SEQ ID NO: 1345904 - RNA, 22 nt, Mycobacterium tuberculosis H37Rv
gcucggccauagcgccgcgccc

SEQ ID NO: 1345905 - RNA, 20 nt, Mycobacterium tuberculosis H37Rv
gcucggccuguucggcggcu

SEQ ID NO: 1345906 - RNA, 20 nt, Mycobacterium tuberculosis H37Rv
gcucggcgaucugcguuugg

SEQ ID NO: 1345907 - RNA, 22 nt, Mycobacterium tuberculosis H37Rv
gcucggcggccagcucccgcga

SEQ ID NO: 1345908 - RNA, 15 nt, Mycobacterium tuberculosis H37Rv
gcucggcggcccggc

SEQ ID NO: 1345909 - RNA, 14 nt, Mycobacterium tuberculosis H37Rv
gcucggcgcagcua

SEQ ID NO: 1345910 - RNA, 13 nt, Mycobacterium tuberculosis H37Rv
gcucggcaggccc

SEQ ID NO: 1345911 - RNA, 12 nt, Mycobacterium tuberculosis H37Rv
gcucggcaggcc

SEQ ID NO: 1345912 - RNA, 14 nt, Mycobacterium tuberculosis H37Rv
gcucggccgaugcg

SEQ ID NO: 1345913 - RNA, 19 nt, Mycobacterium tuberculosis H37Rv
gcucggccgaugcgcagug

SEQ ID NO: 1345914 - RNA, 14 nt, Mycobacterium tuberculosis H37Rv
gcucggccgcagcc

SEQ ID NO: 1345915 - RNA, 17 nt, Mycobacterium tuberculosis H37Rv
gcucggccgaggcgguc

SEQ ID NO: 1345916 - RNA, 13 nt, Mycobacterium tuberculosis H37Rv
gcucggcccagcg

SEQ ID NO: 1345917 - RNA, 14 nt, Mycobacterium tuberculosis H37Rv
gcucggauccggcc

SEQ ID NO: 1345918 - RNA, 18 nt, Mycobacterium tuberculosis H37Rv
gcucgcugcaccagcugc

SEQ ID NO: 1345919 - RNA, 14 nt, Mycobacterium tuberculosis H37Rv
gcucgcugcaccag

SEQ ID NO: 1345920 - RNA, 15 nt, Mycobacterium tuberculosis H37Rv
gcucgcugcgcgccc

SEQ ID NO: 1345921 - RNA, 13 nt, Mycobacterium tuberculosis H37Rv
gcucgcggugggc

SEQ ID NO: 1345922 - RNA, 17 nt, Mycobacterium tuberculosis H37Rv
gcucgcguggccgccgg

SEQ ID NO: 1345923 - RNA, 20 nt, Mycobacterium tuberculosis H37Rv
gcucgcucaccggcuggugc

SEQ ID NO: 1345924 - RNA, 19 nt, Mycobacterium tuberculosis H37Rv
gcucgcucaccggcuggug

SEQ ID NO: 1345925 - RNA, 20 nt, Mycobacterium tuberculosis H37Rv
gcucgcugaugcaucccaac

SEQ ID NO: 1345926 - RNA, 20 nt, Mycobacterium tuberculosis H37Rv
gcucgcugaucuggggcacc

SEQ ID NO: 1345927 - RNA, 14 nt, Mycobacterium tuberculosis H37Rv
gcucgcugaccuug

SEQ ID NO: 1345928 - RNA, 17 nt, Mycobacterium tuberculosis H37Rv
gcucgcucugcgcggcu

SEQ ID NO: 1345929 - RNA, 21 nt, Mycobacterium tuberculosis H37Rv
gcucgcacccgcucggcgcgc

SEQ ID NO: 1345930 - RNA, 21 nt, Mycobacterium tuberculosis H37Rv
gcucgcacucguugccgacca

SEQ ID NO: 1345931 - RNA, 13 nt, Mycobacterium tuberculosis H37Rv
gcucgcaucaucg

SEQ ID NO: 1345932 - RNA, 13 nt, Mycobacterium tuberculosis H37Rv
gcucgccaccucg

SEQ ID NO: 1345933 - RNA, 18 nt, Mycobacterium tuberculosis H37Rv
gcucgcagaucgugggga

SEQ ID NO: 1345934 - RNA, 17 nt, Mycobacterium tuberculosis H37Rv
gcucgcaggccggcggc

SEQ ID NO: 1345935 - RNA, 17 nt, Mycobacterium tuberculosis H37Rv
gcucgcauucggcgagc

SEQ ID NO: 1345936 - RNA, 14 nt, Mycobacterium tuberculosis H37Rv
gcucgccagcgggg

SEQ ID NO: 1345937 - RNA, 14 nt, Mycobacterium tuberculosis H37Rv
gcucgccagccggc

SEQ ID NO: 1345938 - RNA, 18 nt, Mycobacterium tuberculosis H37Rv
gcucgcgcaaggcgccgc

SEQ ID NO: 1345939 - RNA, 15 nt, Mycobacterium tuberculosis H37Rv
gcucgcgaaggggcg

SEQ ID NO: 1345940 - RNA, 21 nt, Mycobacterium tuberculosis H37Rv
gcucgcgaggcucgcguggcc

SEQ ID NO: 1345941 - RNA, 22 nt, Mycobacterium tuberculosis H37Rv
gcucgccgguaggcggccagcg

SEQ ID NO: 1345942 - RNA, 20 nt, Mycobacterium tuberculosis H37Rv
gcucgccgguaggcggccag

SEQ ID NO: 1345943 - RNA, 16 nt, Mycobacterium tuberculosis H37Rv
gcucgccgggucagcc

SEQ ID NO: 1345944 - RNA, 21 nt, Mycobacterium tuberculosis H37Rv
gcucgccuaucgacucaguca

SEQ ID NO: 1345945 - RNA, 23 nt, Mycobacterium tuberculosis H37Rv
gcucgccguaagcaccagccagc

SEQ ID NO: 1345946 - RNA, 13 nt, Mycobacterium tuberculosis H37Rv
gcucgccguggug

SEQ ID NO: 1345947 - RNA, 14 nt, Mycobacterium tuberculosis H37Rv
gcucgcgcgcuggg

SEQ ID NO: 1345948 - RNA, 20 nt, Mycobacterium tuberculosis H37Rv
gcucgcgcccgcuaacuggc

SEQ ID NO: 1345949 - RNA, 23 nt, Mycobacterium tuberculosis H37Rv
gcucgcggcuucaguccggcccc

SEQ ID NO: 1345950 - RNA, 24 nt, Mycobacterium tuberculosis H37Rv
gcucgcggggcgcaccgcggaccg

SEQ ID NO: 1345951 - RNA, 14 nt, Mycobacterium tuberculosis H37Rv
gcucgcggcgcagg

SEQ ID NO: 1345952 - RNA, 21 nt, Mycobacterium tuberculosis H37Rv
gcucgcggcuucaguccggcc

SEQ ID NO: 1345953 - RNA, 16 nt, Mycobacterium tuberculosis H37Rv
gcucgcggcggcgcug

SEQ ID NO: 1345954 - RNA, 14 nt, Mycobacterium tuberculosis H37Rv
gcucgaagcccgga

SEQ ID NO: 1345955 - RNA, 13 nt, Mycobacterium tuberculosis H37Rv
gcucgaaggaccg

SEQ ID NO: 1345956 - RNA, 14 nt, Mycobacterium tuberculosis H37Rv
gcucgaugucccga

SEQ ID NO: 1345957 - RNA, 23 nt, Mycobacterium tuberculosis H37Rv
gcucgaugucagcggccgcgacg

SEQ ID NO: 1345958 - RNA, 17 nt, Mycobacterium tuberculosis H37Rv
gcucgaugucagcggcc

SEQ ID NO: 1345959 - RNA, 14 nt, Mycobacterium tuberculosis H37Rv
gcucgauggcggcc

SEQ ID NO: 1345960 - RNA, 21 nt, Mycobacterium tuberculosis H37Rv
gcucgacgaagaucgcgugcc

SEQ ID NO: 1345961 - RNA, 21 nt, Mycobacterium tuberculosis H37Rv
gcucgacgaaugugagcgcgc

SEQ ID NO: 1345962 - RNA, 23 nt, Mycobacterium tuberculosis H37Rv
gcucgacgaaugugagcgcgcuc

SEQ ID NO: 1345963 - RNA, 15 nt, Mycobacterium tuberculosis H37Rv
gcucgacgacgggcg

SEQ ID NO: 1345964 - RNA, 18 nt, Mycobacterium tuberculosis H37Rv
gcuccuccgguaucggcg

SEQ ID NO: 1345965 - RNA, 16 nt, Mycobacterium tuberculosis H37Rv
gcuccucaucgugggg

SEQ ID NO: 1345966 - RNA, 17 nt, Mycobacterium tuberculosis H37Rv
gcuccucacggauccgc

SEQ ID NO: 1345967 - RNA, 17 nt, Mycobacterium tuberculosis H37Rv
gcuccguuguccagcgc

SEQ ID NO: 1345968 - RNA, 23 nt, Mycobacterium tuberculosis H37Rv
gcuccuaucacuggacucuucgg

SEQ ID NO: 1345969 - RNA, 21 nt, Mycobacterium tuberculosis H37Rv
gcucgaaauccugguggcaga

SEQ ID NO: 1345970 - RNA, 19 nt, Mycobacterium tuberculosis H37Rv
gcuccugagguuuggggcc

SEQ ID NO: 1345971 - RNA, 18 nt, Mycobacterium tuberculosis H37Rv
gcuccucgugcacgcaca

SEQ ID NO: 1345972 - RNA, 16 nt, Mycobacterium tuberculosis H37Rv
gcuccucggccagcgu

SEQ ID NO: 1345973 - RNA, 15 nt, Mycobacterium tuberculosis H37Rv
gcuccgaugugccga

SEQ ID NO: 1345974 - RNA, 16 nt, Mycobacterium tuberculosis H37Rv
gcuccgauuccgaacu

SEQ ID NO: 1345975 - RNA, 23 nt, Mycobacterium tuberculosis H37Rv
gcuccgauucuucgaugaugccg

SEQ ID NO: 1345976 - RNA, 21 nt, Mycobacterium tuberculosis H37Rv
gcuccguggugcuagcgccgc

SEQ ID NO: 1345977 - RNA, 21 nt, Mycobacterium tuberculosis H37Rv
gcuccgugguugccgaagccg

SEQ ID NO: 1345978 - RNA, 13 nt, Mycobacterium tuberculosis H37Rv
gcucccugcaccc

SEQ ID NO: 1345979 - RNA, 15 nt, Mycobacterium tuberculosis H37Rv
gcuccgaccgguggc

SEQ ID NO: 1345980 - RNA, 17 nt, Mycobacterium tuberculosis H37Rv
gcuccaguggcgccagg

SEQ ID NO: 1345981 - RNA, 21 nt, Mycobacterium tuberculosis H37Rv
gcuagggcgaugagggcuugu

SEQ ID NO: 1345982 - RNA, 21 nt, Mycobacterium tuberculosis H37Rv
gcuagucgugccgcgucggcc

SEQ ID NO: 1345983 - RNA, 13 nt, Mycobacterium tuberculosis H37Rv
gcucacaauggcu

SEQ ID NO: 1345984 - RNA, 18 nt, Mycobacterium tuberculosis H37Rv
gcuaggaccgcgguggcc

SEQ ID NO: 1345985 - RNA, 19 nt, Mycobacterium tuberculosis H37Rv
gcuagcuuggcggccagcg

SEQ ID NO: 1345986 - RNA, 14 nt, Mycobacterium tuberculosis H37Rv
gcuacuuggucagu

SEQ ID NO: 1345987 - RNA, 23 nt, Mycobacterium tuberculosis H37Rv
gcuaggucaguucccagaccacc

SEQ ID NO: 1345988 - RNA, 13 nt, Mycobacterium tuberculosis H37Rv
gcucaccggcgcc

SEQ ID NO: 1345989 - RNA, 16 nt, Mycobacterium tuberculosis H37Rv
gcucacccggagcacc

SEQ ID NO: 1345990 - RNA, 17 nt, Mycobacterium tuberculosis H37Rv
gcucacccggagcaccc

SEQ ID NO: 1345991 - RNA, 15 nt, Mycobacterium tuberculosis H37Rv
gcucaccaggcgagc

SEQ ID NO: 1345992 - RNA, 22 nt, Mycobacterium tuberculosis H37Rv
gcucaccacgccggucgaggug

SEQ ID NO: 1345993 - RNA, 17 nt, Mycobacterium tuberculosis H37Rv
gcucacauacagcaggc

SEQ ID NO: 1345994 - RNA, 17 nt, Mycobacterium tuberculosis H37Rv
gcucacauccggucaga

SEQ ID NO: 1345995 - RNA, 21 nt, Mycobacterium tuberculosis H37Rv
gcucacauucaacagauccga

SEQ ID NO: 1345996 - RNA, 17 nt, Mycobacterium tuberculosis H37Rv
gcucacagcacagcgca

SEQ ID NO: 1345997 - RNA, 19 nt, Mycobacterium tuberculosis H37Rv
gcucacacucggccgggcu

SEQ ID NO: 1345998 - RNA, 13 nt, Mycobacterium tuberculosis H37Rv
gcucagaccaagg

SEQ ID NO: 1345999 - RNA, 20 nt, Mycobacterium tuberculosis H37Rv
gcucacuggcgauaucggcc

SEQ ID NO: 1346000 - RNA, 17 nt, Mycobacterium tuberculosis H37Rv
gcuccaauugcggccgc

SEQ ID NO: 1346001 - RNA, 20 nt, Mycobacterium tuberculosis H37Rv
gcuccaacaacuccagcagg

SEQ ID NO: 1346002 - RNA, 22 nt, Mycobacterium tuberculosis H37Rv
gcuccaacagguaagccacaua

SEQ ID NO: 1346003 - RNA, 21 nt, Mycobacterium tuberculosis H37Rv
gcuccaacgauggaacgggcg

SEQ ID NO: 1346004 - RNA, 18 nt, Mycobacterium tuberculosis H37Rv
gcuccaacaacuccagca

SEQ ID NO: 1346005 - RNA, 20 nt, Mycobacterium tuberculosis H37Rv
gcuccaaaagccucagccgc

SEQ ID NO: 1346006 - RNA, 17 nt, Mycobacterium tuberculosis H37Rv
gcucaucgaccggggcu

SEQ ID NO: 1346007 - RNA, 15 nt, Mycobacterium tuberculosis H37Rv
gcuccaguggcgcca

SEQ ID NO: 1346008 - RNA, 20 nt, Mycobacterium tuberculosis H37Rv
gcuccagcgcgcgccgcagc

SEQ ID NO: 1346009 - RNA, 17 nt, Mycobacterium tuberculosis H37Rv
gcuccagcgcgcgccgc

SEQ ID NO: 1346010 - RNA, 15 nt, Mycobacterium tuberculosis H37Rv
gcuccagcgcgcgcc

SEQ ID NO: 1346011 - RNA, 14 nt, Mycobacterium tuberculosis H37Rv
gcucagugaccugu

SEQ ID NO: 1346012 - RNA, 24 nt, Mycobacterium tuberculosis H37Rv
gcucaggucgcagaccagacugca

SEQ ID NO: 1346013 - RNA, 19 nt, Mycobacterium tuberculosis H37Rv
gcucaggucaccggccgcc

SEQ ID NO: 1346014 - RNA, 20 nt, Mycobacterium tuberculosis H37Rv
gcucaggucaccggccgccg

SEQ ID NO: 1346015 - RNA, 14 nt, Mycobacterium tuberculosis H37Rv
gcucagguucagcu

SEQ ID NO: 1346016 - RNA, 22 nt, Mycobacterium tuberculosis H37Rv
gcucagguucagcuugaugucu

SEQ ID NO: 1346017 - RNA, 23 nt, Mycobacterium tuberculosis H37Rv
gcucaggguguucacguucagcc

SEQ ID NO: 1346018 - RNA, 19 nt, Mycobacterium tuberculosis H37Rv
gcucagggugcgccgcagc

SEQ ID NO: 1346019 - RNA, 20 nt, Mycobacterium tuberculosis H37Rv
gcucauaccgggaggacacc

SEQ ID NO: 1346020 - RNA, 19 nt, Mycobacterium tuberculosis H37Rv
gcucaucacccagcgccga

SEQ ID NO: 1346021 - RNA, 21 nt, Mycobacterium tuberculosis H37Rv
gcgggccaccacgcgccgcac

SEQ ID NO: 1346022 - RNA, 22 nt, Mycobacterium tuberculosis H37Rv
gcgggccacgaucggcugguua

SEQ ID NO: 1346023 - RNA, 18 nt, Mycobacterium tuberculosis H37Rv
gcgggccugcacgccggc

SEQ ID NO: 1346024 - RNA, 19 nt, Mycobacterium tuberculosis H37Rv
gcgggccugcacgccggcg

SEQ ID NO: 1346025 - RNA, 21 nt, Mycobacterium tuberculosis H37Rv
gcgggccugcacgccggcgcu

SEQ ID NO: 1346026 - RNA, 23 nt, Mycobacterium tuberculosis H37Rv
gcgggccugcccgggaugcuccc

SEQ ID NO: 1346027 - RNA, 16 nt, Mycobacterium tuberculosis H37Rv
gcgggccugcgcgauc

SEQ ID NO: 1346028 - RNA, 18 nt, Mycobacterium tuberculosis H37Rv
gcgggcccgcaggucggc

SEQ ID NO: 1346029 - RNA, 22 nt, Mycobacterium tuberculosis H37Rv
gcgggccucggcgaccaucuga

SEQ ID NO: 1346030 - RNA, 12 nt, Mycobacterium tuberculosis H37Rv
gcgggcuugagc

SEQ ID NO: 1346031 - RNA, 20 nt, Mycobacterium tuberculosis H37Rv
gcgggcuguccgggcuguug

SEQ ID NO: 1346032 - RNA, 16 nt, Mycobacterium tuberculosis H37Rv
gcgggcgaugcgggcc

SEQ ID NO: 1346033 - RNA, 15 nt, Mycobacterium tuberculosis H37Rv
gcgggcuugccguug

SEQ ID NO: 1346034 - RNA, 21 nt, Mycobacterium tuberculosis H37Rv
gcgggcuuggggucccgccgg

SEQ ID NO: 1346035 - RNA, 17 nt, Mycobacterium tuberculosis H37Rv
gcgggcuuugagcgccc

SEQ ID NO: 1346036 - RNA, 19 nt, Mycobacterium tuberculosis H37Rv
gcgggcgaccaccgcggca

SEQ ID NO: 1346037 - RNA, 23 nt, Mycobacterium tuberculosis H37Rv
gcgggccccaucgccuggaugcc

SEQ ID NO: 1346038 - RNA, 19 nt, Mycobacterium tuberculosis H37Rv
gcgggcgaugagcgcgauc

SEQ ID NO: 1346039 - RNA, 21 nt, Mycobacterium tuberculosis H37Rv
gcgggcgagaacccacgcaug

SEQ ID NO: 1346040 - RNA, 15 nt, Mycobacterium tuberculosis H37Rv
gcgggcgaucggcau

SEQ ID NO: 1346041 - RNA, 12 nt, Mycobacterium tuberculosis H37Rv
gcgggggcagcg

SEQ ID NO: 1346042 - RNA, 16 nt, Mycobacterium tuberculosis H37Rv
gcgggucaggccaggg

SEQ ID NO: 1346043 - RNA, 14 nt, Mycobacterium tuberculosis H37Rv
gcgggucgccgggc

SEQ ID NO: 1346044 - RNA, 20 nt, Mycobacterium tuberculosis H37Rv
gcggguccuucugccgggag

SEQ ID NO: 1346045 - RNA, 18 nt, Mycobacterium tuberculosis H37Rv
gcgggucagcgccgagag

SEQ ID NO: 1346046 - RNA, 13 nt, Mycobacterium tuberculosis H37Rv
gcggguggugcca

SEQ ID NO: 1346047 - RNA, 16 nt, Mycobacterium tuberculosis H37Rv
gcggguggcgccggug

SEQ ID NO: 1346048 - RNA, 18 nt, Mycobacterium tuberculosis H37Rv
gcggguggcgccggugcg

SEQ ID NO: 1346049 - RNA, 14 nt, Mycobacterium tuberculosis H37Rv
gcggguggcggcgu

SEQ ID NO: 1346050 - RNA, 12 nt, Mycobacterium tuberculosis H37Rv
gcggggccggcg

SEQ ID NO: 1346051 - RNA, 15 nt, Mycobacterium tuberculosis H37Rv
gcggggccgccgcgg

SEQ ID NO: 1346052 - RNA, 16 nt, Mycobacterium tuberculosis H37Rv
gcggggccggcggcuc

SEQ ID NO: 1346053 - RNA, 13 nt, Mycobacterium tuberculosis H37Rv
gcggggccgggcg

SEQ ID NO: 1346054 - RNA, 24 nt, Mycobacterium tuberculosis H37Rv
gcggggaaguuggcugagcagcgc

SEQ ID NO: 1346055 - RNA, 19 nt, Mycobacterium tuberculosis H37Rv
gcggggcagaagucguugc

SEQ ID NO: 1346056 - RNA, 16 nt, Mycobacterium tuberculosis H37Rv
gcggggaucagcgagu

SEQ ID NO: 1346057 - RNA, 22 nt, Mycobacterium tuberculosis H37Rv
gcgggggagcgaacggcgcagu

SEQ ID NO: 1346058 - RNA, 22 nt, Mycobacterium tuberculosis H37Rv
gcggggcugggcgccaugcgcc

SEQ ID NO: 1346059 - RNA, 21 nt, Mycobacterium tuberculosis H37Rv
gcggggcuagucgggguggga

SEQ ID NO: 1346060 - RNA, 23 nt, Mycobacterium tuberculosis H37Rv
gcggggcuaguugagcgcugcgc

SEQ ID NO: 1346061 - RNA, 14 nt, Mycobacterium tuberculosis H37Rv
gcggggcgcaccgc

SEQ ID NO: 1346062 - RNA, 12 nt, Mycobacterium tuberculosis H37Rv
gcggggcggccu

SEQ ID NO: 1346063 - RNA, 17 nt, Mycobacterium tuberculosis H37Rv
gcggggcggcggugggc

SEQ ID NO: 1346064 - RNA, 13 nt, Mycobacterium tuberculosis H37Rv
gcggcggcggccc

SEQ ID NO: 1346065 - RNA, 14 nt, Mycobacterium tuberculosis H37Rv
gcggcggcggcccg

SEQ ID NO: 1346066 - RNA, 12 nt, Mycobacterium tuberculosis H37Rv
gcggcgggcacg

SEQ ID NO: 1346067 - RNA, 13 nt, Mycobacterium tuberculosis H37Rv
gcggcgggcagcg

SEQ ID NO: 1346068 - RNA, 13 nt, Mycobacterium tuberculosis H37Rv
gcggcggcggagg

SEQ ID NO: 1346069 - RNA, 17 nt, Mycobacterium tuberculosis H37Rv
gcggcucgggugcgccc

SEQ ID NO: 1346070 - RNA, 20 nt, Mycobacterium tuberculosis H37Rv
gcggcucgggugcgcccggc

SEQ ID NO: 1346071 - RNA, 21 nt, Mycobacterium tuberculosis H37Rv
gcggcucgggugcgcccggcc

SEQ ID NO: 1346072 - RNA, 13 nt, Mycobacterium tuberculosis H37Rv
gcggcugccgguu

SEQ ID NO: 1346073 - RNA, 12 nt, Mycobacterium tuberculosis H37Rv
gcggcugccagc

SEQ ID NO: 1346074 - RNA, 12 nt, Mycobacterium tuberculosis H37Rv
gcggcugcagcc

SEQ ID NO: 1346075 - RNA, 21 nt, Mycobacterium tuberculosis H37Rv
gcgggagguacccccagcacc

SEQ ID NO: 1346076 - RNA, 17 nt, Mycobacterium tuberculosis H37Rv
gcgggaugcgcgcccga

SEQ ID NO: 1346077 - RNA, 13 nt, Mycobacterium tuberculosis H37Rv
gcgggauucuggc

SEQ ID NO: 1346078 - RNA, 16 nt, Mycobacterium tuberculosis H37Rv
gcgggauggccgccga

SEQ ID NO: 1346079 - RNA, 14 nt, Mycobacterium tuberculosis H37Rv
gcgggaugcgcgcc

SEQ ID NO: 1346080 - RNA, 15 nt, Mycobacterium tuberculosis H37Rv
gcggcuuggaucuca

SEQ ID NO: 1346081 - RNA, 19 nt, Mycobacterium tuberculosis H37Rv
gcggcuuggaucucaucca

SEQ ID NO: 1346082 - RNA, 22 nt, Mycobacterium tuberculosis H37Rv
gcggcuucgucgacaucgccau

SEQ ID NO: 1346083 - RNA, 15 nt, Mycobacterium tuberculosis H37Rv
gcggcuugaacagcu

SEQ ID NO: 1346084 - RNA, 23 nt, Mycobacterium tuberculosis H37Rv
gcggcuucacugcuaguggucug

SEQ ID NO: 1346085 - RNA, 16 nt, Mycobacterium tuberculosis H37Rv
gcgggauugcgcgcug

SEQ ID NO: 1346086 - RNA, 21 nt, Mycobacterium tuberculosis H37Rv
gcgggcaagccggacagauca

SEQ ID NO: 1346087 - RNA, 23 nt, Mycobacterium tuberculosis H37Rv
gcgggcaagucgcccagccgagc

SEQ ID NO: 1346088 - RNA, 18 nt, Mycobacterium tuberculosis H37Rv
gcgggcacgcacaaguuc

SEQ ID NO: 1346089 - RNA, 18 nt, Mycobacterium tuberculosis H37Rv
gcgggcacgccgccgacg

SEQ ID NO: 1346090 - RNA, 14 nt, Mycobacterium tuberculosis H37Rv
gcgggcacgccgcc

SEQ ID NO: 1346091 - RNA, 11 nt, Mycobacterium tuberculosis H37Rv
gcgggcagcag

SEQ ID NO: 1346092 - RNA, 20 nt, Mycobacterium tuberculosis H37Rv
gcgggcaguuguugacagac

SEQ ID NO: 1346093 - RNA, 18 nt, Mycobacterium tuberculosis H37Rv
gcgggcagcguguaaccg

SEQ ID NO: 1346094 - RNA, 19 nt, Mycobacterium tuberculosis H37Rv
gcggguucaacgcgcgcac

SEQ ID NO: 1346095 - RNA, 17 nt, Mycobacterium tuberculosis H37Rv
gcggguucaacgcgcgc

SEQ ID NO: 1346096 - RNA, 20 nt, Mycobacterium tuberculosis H37Rv
gcgggugguuugcgcccuga

SEQ ID NO: 1346097 - RNA, 22 nt, Mycobacterium tuberculosis H37Rv
gcggucagaugcgccgcugguc

SEQ ID NO: 1346098 - RNA, 18 nt, Mycobacterium tuberculosis H37Rv
gcgguccaacagcgccag

SEQ ID NO: 1346099 - RNA, 15 nt, Mycobacterium tuberculosis H37Rv
gcggucagcggcugg

SEQ ID NO: 1346100 - RNA, 21 nt, Mycobacterium tuberculosis H37Rv
gcggucgcgcccucagccgcg

SEQ ID NO: 1346101 - RNA, 13 nt, Mycobacterium tuberculosis H37Rv
gcggucgccgcgc

SEQ ID NO: 1346102 - RNA, 23 nt, Mycobacterium tuberculosis H37Rv
gcggucgcgguagcagccgcuga

SEQ ID NO: 1346103 - RNA, 18 nt, Mycobacterium tuberculosis H37Rv
gcggucgcgcccucagcc

SEQ ID NO: 1346104 - RNA, 19 nt, Mycobacterium tuberculosis H37Rv
gcggucgcagcagaccaca

SEQ ID NO: 1346105 - RNA, 19 nt, Mycobacterium tuberculosis H37Rv
gcggugcgcaccaccgagc

SEQ ID NO: 1346106 - RNA, 19 nt, Mycobacterium tuberculosis H37Rv
gcggugccgucagcggcgg

SEQ ID NO: 1346107 - RNA, 16 nt, Mycobacterium tuberculosis H37Rv
gcggugccggcggcgc

SEQ ID NO: 1346108 - RNA, 14 nt, Mycobacterium tuberculosis H37Rv
gcggugccguggug

SEQ ID NO: 1346109 - RNA, 18 nt, Mycobacterium tuberculosis H37Rv
gcggucggaaugccgucg

SEQ ID NO: 1346110 - RNA, 15 nt, Mycobacterium tuberculosis H37Rv
gcggucggcagaccg

SEQ ID NO: 1346111 - RNA, 23 nt, Mycobacterium tuberculosis H37Rv
gcgguggugccgcggccaccgcc

SEQ ID NO: 1346112 - RNA, 18 nt, Mycobacterium tuberculosis H37Rv
gcggugucacgacccaag

SEQ ID NO: 1346113 - RNA, 18 nt, Mycobacterium tuberculosis H37Rv
gcgguguagaagcgggcg

SEQ ID NO: 1346114 - RNA, 22 nt, Mycobacterium tuberculosis H37Rv
gcgguguagaagcgggcgucgc

SEQ ID NO: 1346115 - RNA, 12 nt, Mycobacterium tuberculosis H37Rv
gcgguggcggcg

SEQ ID NO: 1346116 - RNA, 15 nt, Mycobacterium tuberculosis H37Rv
gcggugggcagcagc

SEQ ID NO: 1346117 - RNA, 23 nt, Mycobacterium tuberculosis H37Rv
gcgguggcgucgucggcgggcug

SEQ ID NO: 1346118 - RNA, 13 nt, Mycobacterium tuberculosis H37Rv
gcgguggccggcg

SEQ ID NO: 1346119 - RNA, 21 nt, Mycobacterium tuberculosis H37Rv
gcgguggccgucgggugcagc

SEQ ID NO: 1346120 - RNA, 14 nt, Mycobacterium tuberculosis H37Rv
gcgguggcccgccg

SEQ ID NO: 1346121 - RNA, 16 nt, Mycobacterium tuberculosis H37Rv
gcgguggcccgccggc

SEQ ID NO: 1346122 - RNA, 17 nt, Mycobacterium tuberculosis H37Rv
gcguaauccgagcgcgg

SEQ ID NO: 1346123 - RNA, 15 nt, Mycobacterium tuberculosis H37Rv
gcguacaggccggcc

SEQ ID NO: 1346124 - RNA, 21 nt, Mycobacterium tuberculosis H37Rv
gcguagguggccagcgcggcg

SEQ ID NO: 1346125 - RNA, 20 nt, Mycobacterium tuberculosis H37Rv
gcguagaucaucuggcuggu

SEQ ID NO: 1346126 - RNA, 21 nt, Mycobacterium tuberculosis H37Rv
gcguagaagaaguacaucugc

SEQ ID NO: 1346127 - RNA, 19 nt, Mycobacterium tuberculosis H37Rv
gcguacugguccgcacggu

SEQ ID NO: 1346128 - RNA, 22 nt, Mycobacterium tuberculosis H37Rv
gcguacccguuaugcgccgccc

SEQ ID NO: 1346129 - RNA, 14 nt, Mycobacterium tuberculosis H37Rv
gcguacucccccga

SEQ ID NO: 1346130 - RNA, 18 nt, Mycobacterium tuberculosis H37Rv
gcguacucggcauccagg

SEQ ID NO: 1346131 - RNA, 16 nt, Mycobacterium tuberculosis H37Rv
gcguacucgugaugaa

SEQ ID NO: 1346132 - RNA, 21 nt, Mycobacterium tuberculosis H37Rv
gcgguguuggcgccagccccg

SEQ ID NO: 1346133 - RNA, 23 nt, Mycobacterium tuberculosis H37Rv
gcgguguuggcgccagccccgcc

SEQ ID NO: 1346134 - RNA, 21 nt, Mycobacterium tuberculosis H37Rv
gcgguuagaucacccgcagcc

SEQ ID NO: 1346135 - RNA, 16 nt, Mycobacterium tuberculosis H37Rv
gcgguuagcagccgcu

SEQ ID NO: 1346136 - RNA, 17 nt, Mycobacterium tuberculosis H37Rv
gcgguugacccacagca

SEQ ID NO: 1346137 - RNA, 20 nt, Mycobacterium tuberculosis H37Rv
gcgguuggcggcgaugguau

SEQ ID NO: 1346138 - RNA, 16 nt, Mycobacterium tuberculosis H37Rv
gcgguuguccuccgac

SEQ ID NO: 1346139 - RNA, 19 nt, Mycobacterium tuberculosis H37Rv
gcgguuggaucggcggccg

SEQ ID NO: 1346140 - RNA, 16 nt, Mycobacterium tuberculosis H37Rv
gcgguuugccagugau

SEQ ID NO: 1346141 - RNA, 17 nt, Mycobacterium tuberculosis H37Rv
gcgguuugccagugaug

SEQ ID NO: 1346142 - RNA, 17 nt, Mycobacterium tuberculosis H37Rv
gcgguuuucggcugccg

SEQ ID NO: 1346143 - RNA, 20 nt, Mycobacterium tuberculosis H37Rv
gcggcgaugauggcgcgauc

SEQ ID NO: 1346144 - RNA, 19 nt, Mycobacterium tuberculosis H37Rv
gcggcgccuuccacggagu

SEQ ID NO: 1346145 - RNA, 17 nt, Mycobacterium tuberculosis H37Rv
gcggcgcgaccgucugg

SEQ ID NO: 1346146 - RNA, 15 nt, Mycobacterium tuberculosis H37Rv
gcggcgaucgcuccg

SEQ ID NO: 1346147 - RNA, 19 nt, Mycobacterium tuberculosis H37Rv
gcggcgaucaggcggacgg

SEQ ID NO: 1346148 - RNA, 24 nt, Mycobacterium tuberculosis H37Rv
gcggcgcgggggugggcgugacgg

SEQ ID NO: 1346149 - RNA, 12 nt, Mycobacterium tuberculosis H37Rv
gcggcgcgggug

SEQ ID NO: 1346150 - RNA, 18 nt, Mycobacterium tuberculosis H37Rv
gcggcgcggcgggcagcg

SEQ ID NO: 1346151 - RNA, 11 nt, Mycobacterium tuberculosis H37Rv
gcggcgcuggg

SEQ ID NO: 1346152 - RNA, 15 nt, Mycobacterium tuberculosis H37Rv
gcggcgcuggcgggc

SEQ ID NO: 1346153 - RNA, 20 nt, Mycobacterium tuberculosis H37Rv
gcggcgcggucgaagcuggc

SEQ ID NO: 1346154 - RNA, 14 nt, Mycobacterium tuberculosis H37Rv
gcggcgcgggugcg

SEQ ID NO: 1346155 - RNA, 14 nt, Mycobacterium tuberculosis H37Rv
gcggcgacauccac

SEQ ID NO: 1346156 - RNA, 15 nt, Mycobacterium tuberculosis H37Rv
gcggcgagcagcagg

SEQ ID NO: 1346157 - RNA, 13 nt, Mycobacterium tuberculosis H37Rv
gcggcgagcgcga

SEQ ID NO: 1346158 - RNA, 16 nt, Mycobacterium tuberculosis H37Rv
gcggcgagggcgguca

SEQ ID NO: 1346159 - RNA, 19 nt, Mycobacterium tuberculosis H37Rv
gcggcgaccucggcggcgg

SEQ ID NO: 1346160 - RNA, 17 nt, Mycobacterium tuberculosis H37Rv
gcggcgacgagcgcagc

SEQ ID NO: 1346161 - RNA, 14 nt, Mycobacterium tuberculosis H37Rv
gcggcgacuaccca

SEQ ID NO: 1346162 - RNA, 13 nt, Mycobacterium tuberculosis H37Rv
gcggccuuggcga

SEQ ID NO: 1346163 - RNA, 21 nt, Mycobacterium tuberculosis H37Rv
gcggcgaacucuacgguggug

SEQ ID NO: 1346164 - RNA, 22 nt, Mycobacterium tuberculosis H37Rv
gcggcgaacucuacgguggugc

SEQ ID NO: 1346165 - RNA, 23 nt, Mycobacterium tuberculosis H37Rv
gcggcgaacucuacgguggugcg

SEQ ID NO: 1346166 - RNA, 15 nt, Mycobacterium tuberculosis H37Rv
gcggcgaaccagcgc

SEQ ID NO: 1346167 - RNA, 16 nt, Mycobacterium tuberculosis H37Rv
gcggcgaagaagccgg

SEQ ID NO: 1346168 - RNA, 16 nt, Mycobacterium tuberculosis H37Rv
gcggccuugccgggcc

SEQ ID NO: 1346169 - RNA, 23 nt, Mycobacterium tuberculosis H37Rv
gcggccuucggccggcguguucu

SEQ ID NO: 1346170 - RNA, 14 nt, Mycobacterium tuberculosis H37Rv
gcggccuggucggc

SEQ ID NO: 1346171 - RNA, 18 nt, Mycobacterium tuberculosis H37Rv
gcggccugcucgggggcc

SEQ ID NO: 1346172 - RNA, 19 nt, Mycobacterium tuberculosis H37Rv
gcggccgcagcggccagcc

SEQ ID NO: 1346173 - RNA, 22 nt, Mycobacterium tuberculosis H37Rv
gcggccgcagcggccagcccag

SEQ ID NO: 1346174 - RNA, 14 nt, Mycobacterium tuberculosis H37Rv
gcggccgccacucc

SEQ ID NO: 1346175 - RNA, 18 nt, Mycobacterium tuberculosis H37Rv
gcggccgcagcggccagc

SEQ ID NO: 1346176 - RNA, 13 nt, Mycobacterium tuberculosis H37Rv
gcggccgcagcgg

SEQ ID NO: 1346177 - RNA, 14 nt, Mycobacterium tuberculosis H37Rv
gcggccgcagccag

SEQ ID NO: 1346178 - RNA, 18 nt, Mycobacterium tuberculosis H37Rv
gcggccgcagccagcaag

SEQ ID NO: 1346179 - RNA, 20 nt, Mycobacterium tuberculosis H37Rv
gcggcccguuugccgguucg

SEQ ID NO: 1346180 - RNA, 21 nt, Mycobacterium tuberculosis H37Rv
gcggcccucgaauucggccgg

SEQ ID NO: 1346181 - RNA, 15 nt, Mycobacterium tuberculosis H37Rv
gcggcccucgagcag

SEQ ID NO: 1346182 - RNA, 18 nt, Mycobacterium tuberculosis H37Rv
gcggcccgggaacccgcu

SEQ ID NO: 1346183 - RNA, 13 nt, Mycobacterium tuberculosis H37Rv
gcggccgccgcgg

SEQ ID NO: 1346184 - RNA, 12 nt, Mycobacterium tuberculosis H37Rv
gcggccgcccgu

SEQ ID NO: 1346185 - RNA, 11 nt, Mycobacterium tuberculosis H37Rv
gcggccgccgc

SEQ ID NO: 1346186 - RNA, 13 nt, Mycobacterium tuberculosis H37Rv
gcggccgccccag

SEQ ID NO: 1346187 - RNA, 22 nt, Mycobacterium tuberculosis H37Rv
gcggccgccccaggcugguccg

SEQ ID NO: 1346188 - RNA, 19 nt, Mycobacterium tuberculosis H37Rv
gcggccgccuacccguucu

SEQ ID NO: 1346189 - RNA, 14 nt, Mycobacterium tuberculosis H37Rv
gcggccgccuaccc

SEQ ID NO: 1346190 - RNA, 20 nt, Mycobacterium tuberculosis H37Rv
gcggccgccguccccgccgu

SEQ ID NO: 1346191 - RNA, 24 nt, Mycobacterium tuberculosis H37Rv
gcggccgcgaccagcgccgcaccc

SEQ ID NO: 1346192 - RNA, 16 nt, Mycobacterium tuberculosis H37Rv
gcggccgcgauggcgu

SEQ ID NO: 1346193 - RNA, 19 nt, Mycobacterium tuberculosis H37Rv
gcggccgcggcgcggcggg

SEQ ID NO: 1346194 - RNA, 18 nt, Mycobacterium tuberculosis H37Rv
gcggccggcacgaccgcu

SEQ ID NO: 1346195 - RNA, 15 nt, Mycobacterium tuberculosis H37Rv
gcggccgcggaugcu

SEQ ID NO: 1346196 - RNA, 12 nt, Mycobacterium tuberculosis H37Rv
gcggccgcuggg

SEQ ID NO: 1346197 - RNA, 23 nt, Mycobacterium tuberculosis H37Rv
gcggccgcucacauacagcaggc

SEQ ID NO: 1346198 - RNA, 15 nt, Mycobacterium tuberculosis H37Rv
gcggccgcuccaccu

SEQ ID NO: 1346199 - RNA, 22 nt, Mycobacterium tuberculosis H37Rv
gcggccgcgcgcaucgcgccuu

SEQ ID NO: 1346200 - RNA, 14 nt, Mycobacterium tuberculosis H37Rv
gcggccgcgcgcuc

SEQ ID NO: 1346201 - RNA, 15 nt, Mycobacterium tuberculosis H37Rv
gcggccgcgcugcag

SEQ ID NO: 1346202 - RNA, 15 nt, Mycobacterium tuberculosis H37Rv
gcggccgcgcgcauc

SEQ ID NO: 1346203 - RNA, 21 nt, Mycobacterium tuberculosis H37Rv
gcggccuaggacgccgcccuc

SEQ ID NO: 1346204 - RNA, 22 nt, Mycobacterium tuberculosis H37Rv
gcggccuaacgaguaggcggcu

SEQ ID NO: 1346205 - RNA, 18 nt, Mycobacterium tuberculosis H37Rv
gcggccuccagcacccgg

SEQ ID NO: 1346206 - RNA, 19 nt, Mycobacterium tuberculosis H37Rv
gcggccuagggcggcggcg

SEQ ID NO: 1346207 - RNA, 18 nt, Mycobacterium tuberculosis H37Rv
gcggccgucgucggccag

SEQ ID NO: 1346208 - RNA, 13 nt, Mycobacterium tuberculosis H37Rv
gcggccguucgcc

SEQ ID NO: 1346209 - RNA, 19 nt, Mycobacterium tuberculosis H37Rv
gcggccuagcgccacuuga

SEQ ID NO: 1346210 - RNA, 17 nt, Mycobacterium tuberculosis H37Rv
gcggccucggucuggug

SEQ ID NO: 1346211 - RNA, 13 nt, Mycobacterium tuberculosis H37Rv
gcggccucccgca

SEQ ID NO: 1346212 - RNA, 12 nt, Mycobacterium tuberculosis H37Rv
gcggccugaccg

SEQ ID NO: 1346213 - RNA, 16 nt, Mycobacterium tuberculosis H37Rv
gcggccugcccgccgu

SEQ ID NO: 1346214 - RNA, 23 nt, Mycobacterium tuberculosis H37Rv
gcggccggcgcucgcggcggcgc

SEQ ID NO: 1346215 - RNA, 24 nt, Mycobacterium tuberculosis H37Rv
gcggccggcgcucgcggcggcgcu

SEQ ID NO: 1346216 - RNA, 15 nt, Mycobacterium tuberculosis H37Rv
gcggccggcggccgc

SEQ ID NO: 1346217 - RNA, 15 nt, Mycobacterium tuberculosis H37Rv
gcggccggcgucggc

SEQ ID NO: 1346218 - RNA, 14 nt, Mycobacterium tuberculosis H37Rv
gcggccgggcgccc

SEQ ID NO: 1346219 - RNA, 14 nt, Mycobacterium tuberculosis H37Rv
gcggccggccgccc

SEQ ID NO: 1346220 - RNA, 16 nt, Mycobacterium tuberculosis H37Rv
gcggcacucccugggg

SEQ ID NO: 1346221 - RNA, 14 nt, Mycobacterium tuberculosis H37Rv
gcggcagcacccac

SEQ ID NO: 1346222 - RNA, 22 nt, Mycobacterium tuberculosis H37Rv
gcgcuguugcuggcgcccccgc

SEQ ID NO: 1346223 - RNA, 18 nt, Mycobacterium tuberculosis H37Rv
gcgcuguugcuggcgccc

SEQ ID NO: 1346224 - RNA, 17 nt, Mycobacterium tuberculosis H37Rv
gcgcuggugcgccacgc

SEQ ID NO: 1346225 - RNA, 15 nt, Mycobacterium tuberculosis H37Rv
gcgcuggugcgcggu

SEQ ID NO: 1346226 - RNA, 16 nt, Mycobacterium tuberculosis H37Rv
gcgcuggucgcaaugg

SEQ ID NO: 1346227 - RNA, 17 nt, Mycobacterium tuberculosis H37Rv
gcgcugcucacgcagca

SEQ ID NO: 1346228 - RNA, 22 nt, Mycobacterium tuberculosis H37Rv
gcgcugggucgugucgccacac

SEQ ID NO: 1346229 - RNA, 18 nt, Mycobacterium tuberculosis H37Rv
gcgcuguagucgcgccuc

SEQ ID NO: 1346230 - RNA, 15 nt, Mycobacterium tuberculosis H37Rv
gcggcagcggugcug

SEQ ID NO: 1346231 - RNA, 13 nt, Mycobacterium tuberculosis H37Rv
gcggcagcgcggc

SEQ ID NO: 1346232 - RNA, 14 nt, Mycobacterium tuberculosis H37Rv
gcggcagcgcggcc

SEQ ID NO: 1346233 - RNA, 17 nt, Mycobacterium tuberculosis H37Rv
gcggcagcggcgccgcc

SEQ ID NO: 1346234 - RNA, 15 nt, Mycobacterium tuberculosis H37Rv
gcggcagccuggccu

SEQ ID NO: 1346235 - RNA, 22 nt, Mycobacterium tuberculosis H37Rv
gcggcagcuggcgcagccugcc

SEQ ID NO: 1346236 - RNA, 23 nt, Mycobacterium tuberculosis H37Rv
gcggcagguugcguugcaggaaa

SEQ ID NO: 1346237 - RNA, 20 nt, Mycobacterium tuberculosis H37Rv
gcggcaucgaggccagcagc

SEQ ID NO: 1346238 - RNA, 19 nt, Mycobacterium tuberculosis H37Rv
gcggcaggugcggcggcau

SEQ ID NO: 1346239 - RNA, 22 nt, Mycobacterium tuberculosis H37Rv
gcggcauucucgagcacccgca

SEQ ID NO: 1346240 - RNA, 15 nt, Mycobacterium tuberculosis H37Rv
gcggcauuggcggug

SEQ ID NO: 1346241 - RNA, 18 nt, Mycobacterium tuberculosis H37Rv
gcggccaacagcacccgg

SEQ ID NO: 1346242 - RNA, 13 nt, Mycobacterium tuberculosis H37Rv
gcggccaaggucg

SEQ ID NO: 1346243 - RNA, 14 nt, Mycobacterium tuberculosis H37Rv
gcggcaucggccag

SEQ ID NO: 1346244 - RNA, 17 nt, Mycobacterium tuberculosis H37Rv
gcggcaucgcgggcggc

SEQ ID NO: 1346245 - RNA, 15 nt, Mycobacterium tuberculosis H37Rv
gcggccaccgccgcc

SEQ ID NO: 1346246 - RNA, 15 nt, Mycobacterium tuberculosis H37Rv
gcggccacgccggcg

SEQ ID NO: 1346247 - RNA, 20 nt, Mycobacterium tuberculosis H37Rv
gcggccagagccgcgcgccg

SEQ ID NO: 1346248 - RNA, 12 nt, Mycobacterium tuberculosis H37Rv
gcggccagcagc

SEQ ID NO: 1346249 - RNA, 13 nt, Mycobacterium tuberculosis H37Rv
gcggccaccaccg

SEQ ID NO: 1346250 - RNA, 22 nt, Mycobacterium tuberculosis H37Rv
gcggccacaaugcggccguucg

SEQ ID NO: 1346251 - RNA, 16 nt, Mycobacterium tuberculosis H37Rv
gcggccaauggugggc

SEQ ID NO: 1346252 - RNA, 18 nt, Mycobacterium tuberculosis H37Rv
gcggccaaucagcccgcc

SEQ ID NO: 1346253 - RNA, 20 nt, Mycobacterium tuberculosis H37Rv
gcggccaccagaucgcacac

SEQ ID NO: 1346254 - RNA, 12 nt, Mycobacterium tuberculosis H37Rv
gcggccaccagc

SEQ ID NO: 1346255 - RNA, 22 nt, Mycobacterium tuberculosis H37Rv
gcggcccgcagcccgccgggcu

SEQ ID NO: 1346256 - RNA, 22 nt, Mycobacterium tuberculosis H37Rv
gcggcccgcaucguugccgacc

SEQ ID NO: 1346257 - RNA, 13 nt, Mycobacterium tuberculosis H37Rv
gcggcccgcagcc

SEQ ID NO: 1346258 - RNA, 23 nt, Mycobacterium tuberculosis H37Rv
gcggccccggcauugcccgagcc

SEQ ID NO: 1346259 - RNA, 20 nt, Mycobacterium tuberculosis H37Rv
gcggccccaggggcaccagc

SEQ ID NO: 1346260 - RNA, 13 nt, Mycobacterium tuberculosis H37Rv
gcggccccgccgu

SEQ ID NO: 1346261 - RNA, 16 nt, Mycobacterium tuberculosis H37Rv
gcggccccgcgccacc

SEQ ID NO: 1346262 - RNA, 20 nt, Mycobacterium tuberculosis H37Rv
gcggcccgaucugagcugcc

SEQ ID NO: 1346263 - RNA, 14 nt, Mycobacterium tuberculosis H37Rv
gcggcccacgcgca

SEQ ID NO: 1346264 - RNA, 15 nt, Mycobacterium tuberculosis H37Rv
gcggcccacaccagc

SEQ ID NO: 1346265 - RNA, 20 nt, Mycobacterium tuberculosis H37Rv
gcggcccacaccagcgcagc

SEQ ID NO: 1346266 - RNA, 18 nt, Mycobacterium tuberculosis H37Rv
gcggcccaugggggaacc

SEQ ID NO: 1346267 - RNA, 18 nt, Mycobacterium tuberculosis H37Rv
gcggccaugucagcggcc

SEQ ID NO: 1346268 - RNA, 21 nt, Mycobacterium tuberculosis H37Rv
gcggccauuagcagcacccgg

SEQ ID NO: 1346269 - RNA, 14 nt, Mycobacterium tuberculosis H37Rv
gcggcccacaccag

SEQ ID NO: 1346270 - RNA, 16 nt, Mycobacterium tuberculosis H37Rv
gcggccauccggcggc

SEQ ID NO: 1346271 - RNA, 17 nt, Mycobacterium tuberculosis H37Rv
gcggccauccggcggcg

SEQ ID NO: 1346272 - RNA, 17 nt, Mycobacterium tuberculosis H37Rv
gcggccauaucgcccac

SEQ ID NO: 1346273 - RNA, 15 nt, Mycobacterium tuberculosis H37Rv
gcggccagugcucgc

SEQ ID NO: 1346274 - RNA, 16 nt, Mycobacterium tuberculosis H37Rv
gcggccagggagcggc

SEQ ID NO: 1346275 - RNA, 14 nt, Mycobacterium tuberculosis H37Rv
gcggccaggcgcga

SEQ ID NO: 1346276 - RNA, 23 nt, Mycobacterium tuberculosis H37Rv
gcggccaggaugccugccacccg

SEQ ID NO: 1346277 - RNA, 14 nt, Mycobacterium tuberculosis H37Rv
gcggccagcucaug

SEQ ID NO: 1346278 - RNA, 22 nt, Mycobacterium tuberculosis H37Rv
gcggccagcuccagcgccgcgg

SEQ ID NO: 1346279 - RNA, 13 nt, Mycobacterium tuberculosis H37Rv
gcggccagcuccc

SEQ ID NO: 1346280 - RNA, 16 nt, Mycobacterium tuberculosis H37Rv
gcaagaaucagcagca

SEQ ID NO: 1346281 - RNA, 17 nt, Mycobacterium tuberculosis H37Rv
gcaagaaucagcagcag

SEQ ID NO: 1346282 - RNA, 15 nt, Mycobacterium tuberculosis H37Rv
gcaacugggcggccu

SEQ ID NO: 1346283 - RNA, 14 nt, Mycobacterium tuberculosis H37Rv
gcaagacgaugaca

SEQ ID NO: 1346284 - RNA, 22 nt, Mycobacterium tuberculosis H37Rv
gcaagaccgcguuccgggccgg

SEQ ID NO: 1346285 - RNA, 19 nt, Mycobacterium tuberculosis H37Rv
gcaagaccguuacaccauc

SEQ ID NO: 1346286 - RNA, 21 nt, Mycobacterium tuberculosis H37Rv
gcaaggcauccaacgcggcgc

SEQ ID NO: 1346287 - RNA, 17 nt, Mycobacterium tuberculosis H37Rv
gcaacgugugcaccauc

SEQ ID NO: 1346288 - RNA, 21 nt, Mycobacterium tuberculosis H37Rv
gcaacgugugcaccaucauca

SEQ ID NO: 1346289 - RNA, 20 nt, Mycobacterium tuberculosis H37Rv
gcaacguagccagcagcggc

SEQ ID NO: 1346290 - RNA, 21 nt, Mycobacterium tuberculosis H37Rv
gcaacguagccagcagcggcu

SEQ ID NO: 1346291 - RNA, 22 nt, Mycobacterium tuberculosis H37Rv
gcaacguagccagcagcggcuc

SEQ ID NO: 1346292 - RNA, 21 nt, Mycobacterium tuberculosis H37Rv
gcaacuagccgcugccuggcc

SEQ ID NO: 1346293 - RNA, 16 nt, Mycobacterium tuberculosis H37Rv
gcaacucgaucgccug

SEQ ID NO: 1346294 - RNA, 20 nt, Mycobacterium tuberculosis H37Rv
gcaacuccggucaacacccg

SEQ ID NO: 1346295 - RNA, 21 nt, Mycobacterium tuberculosis H37Rv
gcaacucgcauaugccgccgg

SEQ ID NO: 1346296 - RNA, 17 nt, Mycobacterium tuberculosis H37Rv
gcaacucguccagcagu

SEQ ID NO: 1346297 - RNA, 14 nt, Mycobacterium tuberculosis H37Rv
gcaacugggcggcc

SEQ ID NO: 1346298 - RNA, 23 nt, Mycobacterium tuberculosis H37Rv
gcaacugcagguucuugaccagc

SEQ ID NO: 1346299 - RNA, 19 nt, Mycobacterium tuberculosis H37Rv
gcaaguugagcagcuuggu

SEQ ID NO: 1346300 - RNA, 20 nt, Mycobacterium tuberculosis H37Rv
gcaaguucggccgagugcac

SEQ ID NO: 1346301 - RNA, 18 nt, Mycobacterium tuberculosis H37Rv
gcaaguugagcagcuugg

SEQ ID NO: 1346302 - RNA, 20 nt, Mycobacterium tuberculosis H37Rv
gcaaggcggaucuucucggu

SEQ ID NO: 1346303 - RNA, 21 nt, Mycobacterium tuberculosis H37Rv
gcaaggccaaccgggccgccu

SEQ ID NO: 1346304 - RNA, 24 nt, Mycobacterium tuberculosis H37Rv
gcaauaagggagaccgcggccggc

SEQ ID NO: 1346305 - RNA, 22 nt, Mycobacterium tuberculosis H37Rv
gcaauacggcggcgccgcccaa

SEQ ID NO: 1346306 - RNA, 18 nt, Mycobacterium tuberculosis H37Rv
gcaauacccgagcguccg

SEQ ID NO: 1346307 - RNA, 22 nt, Mycobacterium tuberculosis H37Rv
gcaaucaugucagcgcugagcc

SEQ ID NO: 1346308 - RNA, 13 nt, Mycobacterium tuberculosis H37Rv
gcaaucagcuggu

SEQ ID NO: 1346309 - RNA, 21 nt, Mycobacterium tuberculosis H37Rv
gcaauccaaggcucagcagcg

SEQ ID NO: 1346310 - RNA, 20 nt, Mycobacterium tuberculosis H37Rv
gcaauccggucagcgcggcg

SEQ ID NO: 1346311 - RNA, 18 nt, Mycobacterium tuberculosis H37Rv
gcaaccggagaucccggu

SEQ ID NO: 1346312 - RNA, 21 nt, Mycobacterium tuberculosis H37Rv
gcaacccggucggcagcuggg

SEQ ID NO: 1346313 - RNA, 16 nt, Mycobacterium tuberculosis H37Rv
gcaacccagccgcgcc

SEQ ID NO: 1346314 - RNA, 20 nt, Mycobacterium tuberculosis H37Rv
gcaacccagccgcgccagcu

SEQ ID NO: 1346315 - RNA, 22 nt, Mycobacterium tuberculosis H37Rv
gcaacgaagagggcgccgcgcg

SEQ ID NO: 1346316 - RNA, 20 nt, Mycobacterium tuberculosis H37Rv
gcaacgaagccggcgccggc

SEQ ID NO: 1346317 - RNA, 16 nt, Mycobacterium tuberculosis H37Rv
gcaaccuuuggccgcu

SEQ ID NO: 1346318 - RNA, 15 nt, Mycobacterium tuberculosis H37Rv
gcaaccugccgggcc

SEQ ID NO: 1346319 - RNA, 20 nt, Mycobacterium tuberculosis H37Rv
gcaaccugccgggccacggc

SEQ ID NO: 1346320 - RNA, 19 nt, Mycobacterium tuberculosis H37Rv
gcaaccgggaggccaccgc

SEQ ID NO: 1346321 - RNA, 20 nt, Mycobacterium tuberculosis H37Rv
gcaaccgugccgcaucaccc

SEQ ID NO: 1346322 - RNA, 22 nt, Mycobacterium tuberculosis H37Rv
gcaacgcggccuugcgcacagg

SEQ ID NO: 1346323 - RNA, 16 nt, Mycobacterium tuberculosis H37Rv
gcaacgccgcggacca

SEQ ID NO: 1346324 - RNA, 23 nt, Mycobacterium tuberculosis H37Rv
gcaacgaucagguuggcggcugc

SEQ ID NO: 1346325 - RNA, 19 nt, Mycobacterium tuberculosis H37Rv
gcaacgauuuuagcggcug

SEQ ID NO: 1346326 - RNA, 20 nt, Mycobacterium tuberculosis H37Rv
gcaacgcccaacgucgccag

SEQ ID NO: 1346327 - RNA, 17 nt, Mycobacterium tuberculosis H37Rv
gcaacgcggucugcucc

SEQ ID NO: 1346328 - RNA, 19 nt, Mycobacterium tuberculosis H37Rv
gcaacgcggcgaagugcac

SEQ ID NO: 1346329 - RNA, 21 nt, Mycobacterium tuberculosis H37Rv
gcaacggauuggugggccagc

SEQ ID NO: 1346330 - RNA, 15 nt, Mycobacterium tuberculosis H37Rv
gcaacggcggggccg

SEQ ID NO: 1346331 - RNA, 20 nt, Mycobacterium tuberculosis H37Rv
gcaacggcggggccggcggc

SEQ ID NO: 1346332 - RNA, 22 nt, Mycobacterium tuberculosis H37Rv
gcaacggcggggccggcggcuc

SEQ ID NO: 1346333 - RNA, 12 nt, Mycobacterium tuberculosis H37Rv
gcaacagcacca

SEQ ID NO: 1346334 - RNA, 20 nt, Mycobacterium tuberculosis H37Rv
gcaacaccagggccuccacc

SEQ ID NO: 1346335 - RNA, 19 nt, Mycobacterium tuberculosis H37Rv
gcaacaacgucugcagccu

SEQ ID NO: 1346336 - RNA, 21 nt, Mycobacterium tuberculosis H37Rv
gcaacaacgucugcagccucg

SEQ ID NO: 1346337 - RNA, 17 nt, Mycobacterium tuberculosis H37Rv
gcaacauuuucgcccgc

SEQ ID NO: 1346338 - RNA, 16 nt, Mycobacterium tuberculosis H37Rv
gcaaccagcagcaggu

SEQ ID NO: 1346339 - RNA, 19 nt, Mycobacterium tuberculosis H37Rv
gcaaccagcgagcccagcu

SEQ ID NO: 1346340 - RNA, 23 nt, Mycobacterium tuberculosis H37Rv
gcaaccaggaugguugcgacggc

SEQ ID NO: 1346341 - RNA, 17 nt, Mycobacterium tuberculosis H37Rv
gcaaccacguccgcaac

SEQ ID NO: 1346342 - RNA, 12 nt, Mycobacterium tuberculosis H37Rv
gcaaccagcagc

SEQ ID NO: 1346343 - RNA, 23 nt, Mycobacterium tuberculosis H37Rv
gcaaccaaagcgacgagcagcaa

SEQ ID NO: 1346344 - RNA, 16 nt, Mycobacterium tuberculosis H37Rv
gcaacaggcccacggc

SEQ ID NO: 1346345 - RNA, 13 nt, Mycobacterium tuberculosis H37Rv
gcaacagcgcggu

SEQ ID NO: 1346346 - RNA, 23 nt, Mycobacterium tuberculosis H37Rv
gcaacaggccaacuuggcggcca

SEQ ID NO: 1346347 - RNA, 16 nt, Mycobacterium tuberculosis H37Rv
gcaacaucagcaggac

SEQ ID NO: 1346348 - RNA, 20 nt, Mycobacterium tuberculosis H37Rv
gcaacaucgaauaugacugc

SEQ ID NO: 1346349 - RNA, 16 nt, Mycobacterium tuberculosis H37Rv
gcaacaucggaugacc

SEQ ID NO: 1346350 - RNA, 18 nt, Mycobacterium tuberculosis H37Rv
gcacgauggugugcagca

SEQ ID NO: 1346351 - RNA, 14 nt, Mycobacterium tuberculosis H37Rv
gcacgccggugguc

SEQ ID NO: 1346352 - RNA, 17 nt, Mycobacterium tuberculosis H37Rv
gcacgccggcgcuggag

SEQ ID NO: 1346353 - RNA, 16 nt, Mycobacterium tuberculosis H37Rv
gcacgaaaucagcccg

SEQ ID NO: 1346354 - RNA, 18 nt, Mycobacterium tuberculosis H37Rv
gcacgacaccucgaaggc

SEQ ID NO: 1346355 - RNA, 21 nt, Mycobacterium tuberculosis H37Rv
gcacgacaccucgaaggcacu

SEQ ID NO: 1346356 - RNA, 19 nt, Mycobacterium tuberculosis H37Rv
gcacgacaacuucgccgga

SEQ ID NO: 1346357 - RNA, 14 nt, Mycobacterium tuberculosis H37Rv
gcacgaucgcccgu

SEQ ID NO: 1346358 - RNA, 23 nt, Mycobacterium tuberculosis H37Rv
gcaccguuguaugcugcgcgccg

SEQ ID NO: 1346359 - RNA, 19 nt, Mycobacterium tuberculosis H37Rv
gcaccguuaccgccgucgc

SEQ ID NO: 1346360 - RNA, 22 nt, Mycobacterium tuberculosis H37Rv
gcaccguuaccgccgucgccac

SEQ ID NO: 1346361 - RNA, 19 nt, Mycobacterium tuberculosis H37Rv
gcaccgugcggggggcagc

SEQ ID NO: 1346362 - RNA, 21 nt, Mycobacterium tuberculosis H37Rv
gcaccgugcggggggcagcuc

SEQ ID NO: 1346363 - RNA, 14 nt, Mycobacterium tuberculosis H37Rv
gcaccggaucgccg

SEQ ID NO: 1346364 - RNA, 17 nt, Mycobacterium tuberculosis H37Rv
gcaccggauacagccac

SEQ ID NO: 1346365 - RNA, 18 nt, Mycobacterium tuberculosis H37Rv
gcaccgcuucaggcgcca

SEQ ID NO: 1346366 - RNA, 21 nt, Mycobacterium tuberculosis H37Rv
gcaccuccaccgcgccggcgg

SEQ ID NO: 1346367 - RNA, 18 nt, Mycobacterium tuberculosis H37Rv
gcaccugcgcgcggccgc

SEQ ID NO: 1346368 - RNA, 17 nt, Mycobacterium tuberculosis H37Rv
gcaccuauggucaaccg

SEQ ID NO: 1346369 - RNA, 15 nt, Mycobacterium tuberculosis H37Rv
gcaccugggcgcgcu

SEQ ID NO: 1346370 - RNA, 18 nt, Mycobacterium tuberculosis H37Rv
gcaccugggcgcgcuggc

SEQ ID NO: 1346371 - RNA, 20 nt, Mycobacterium tuberculosis H37Rv
gcaccuggucggccgcaagg

SEQ ID NO: 1346372 - RNA, 20 nt, Mycobacterium tuberculosis H37Rv
gcaccugggcugccggccag

SEQ ID NO: 1346373 - RNA, 12 nt, Mycobacterium tuberculosis H37Rv
gcaccugggcgc

SEQ ID NO: 1346374 - RNA, 15 nt, Mycobacterium tuberculosis H37Rv
gcaccugcgcgcggc

SEQ ID NO: 1346375 - RNA, 14 nt, Mycobacterium tuberculosis H37Rv
gcaccgcuguugca

SEQ ID NO: 1346376 - RNA, 17 nt, Mycobacterium tuberculosis H37Rv
gcaccgcugccgcugcc

SEQ ID NO: 1346377 - RNA, 13 nt, Mycobacterium tuberculosis H37Rv
gcaccgcggccag

SEQ ID NO: 1346378 - RNA, 14 nt, Mycobacterium tuberculosis H37Rv
gcaccgcggccagc

SEQ ID NO: 1346379 - RNA, 17 nt, Mycobacterium tuberculosis H37Rv
gcaccgcggccagcacc

SEQ ID NO: 1346380 - RNA, 23 nt, Mycobacterium tuberculosis H37Rv
gcaccgcgggaucgguggcggca

SEQ ID NO: 1346381 - RNA, 20 nt, Mycobacterium tuberculosis H37Rv
gcaccgcgguacgccggucg

SEQ ID NO: 1346382 - RNA, 14 nt, Mycobacterium tuberculosis H37Rv
gcaccgcgccggcg

SEQ ID NO: 1346383 - RNA, 22 nt, Mycobacterium tuberculosis H37Rv
gcaccgcggaccggcgucggcu

SEQ ID NO: 1346384 - RNA, 16 nt, Mycobacterium tuberculosis H37Rv
gcaccgcgccgcgccg

SEQ ID NO: 1346385 - RNA, 18 nt, Mycobacterium tuberculosis H37Rv
gcaccgccugcgccgccc

SEQ ID NO: 1346386 - RNA, 16 nt, Mycobacterium tuberculosis H37Rv
gcaccgccugcgccuu

SEQ ID NO: 1346387 - RNA, 18 nt, Mycobacterium tuberculosis H37Rv
gcaccgcgaacauggugc

SEQ ID NO: 1346388 - RNA, 19 nt, Mycobacterium tuberculosis H37Rv
gcaccgaaacgccgaccuu

SEQ ID NO: 1346389 - RNA, 20 nt, Mycobacterium tuberculosis H37Rv
gcaccgaagauggccagcgc

SEQ ID NO: 1346390 - RNA, 19 nt, Mycobacterium tuberculosis H37Rv
gcaccgaacccgccaccgc

SEQ ID NO: 1346391 - RNA, 16 nt, Mycobacterium tuberculosis H37Rv
gcaccgaagauggcca

SEQ ID NO: 1346392 - RNA, 17 nt, Mycobacterium tuberculosis H37Rv
gcaccgaagauggccag

SEQ ID NO: 1346393 - RNA, 13 nt, Mycobacterium tuberculosis H37Rv
gcacccggccacc

SEQ ID NO: 1346394 - RNA, 12 nt, Mycobacterium tuberculosis H37Rv
gcacccgcuggc

SEQ ID NO: 1346395 - RNA, 13 nt, Mycobacterium tuberculosis H37Rv
gcacccgcugguc

SEQ ID NO: 1346396 - RNA, 19 nt, Mycobacterium tuberculosis H37Rv
gcaccgaaaaacaccagcg

SEQ ID NO: 1346397 - RNA, 23 nt, Mycobacterium tuberculosis H37Rv
gcaccgaaaaacaccagcgaggc

SEQ ID NO: 1346398 - RNA, 20 nt, Mycobacterium tuberculosis H37Rv
gcaccgaccagggccgccgc

SEQ ID NO: 1346399 - RNA, 15 nt, Mycobacterium tuberculosis H37Rv
gcaccgaccgcaccg

SEQ ID NO: 1346400 - RNA, 21 nt, Mycobacterium tuberculosis H37Rv
gcaccgacagcccgaacgagg

SEQ ID NO: 1346401 - RNA, 19 nt, Mycobacterium tuberculosis H37Rv
gcaccgacaucgucaucca

SEQ ID NO: 1346402 - RNA, 19 nt, Mycobacterium tuberculosis H37Rv
gcacccgaguuauagaagc

SEQ ID NO: 1346403 - RNA, 23 nt, Mycobacterium tuberculosis H37Rv
gcacccgaauuugucggcgaagc

SEQ ID NO: 1346404 - RNA, 16 nt, Mycobacterium tuberculosis H37Rv
gcacccgagccgcaca

SEQ ID NO: 1346405 - RNA, 16 nt, Mycobacterium tuberculosis H37Rv
gcaccccggcggcguc

SEQ ID NO: 1346406 - RNA, 16 nt, Mycobacterium tuberculosis H37Rv
gcaccccgaucuggcg

SEQ ID NO: 1346407 - RNA, 13 nt, Mycobacterium tuberculosis H37Rv
gcacccccugcac

SEQ ID NO: 1346408 - RNA, 21 nt, Mycobacterium tuberculosis H37Rv
gcacccgauaguucuggcccg

SEQ ID NO: 1346409 - RNA, 21 nt, Mycobacterium tuberculosis H37Rv
gcacccgaguuauagaagccg

SEQ ID NO: 1346410 - RNA, 17 nt, Mycobacterium tuberculosis H37Rv
gcacccgcucggcgcgc

SEQ ID NO: 1346411 - RNA, 21 nt, Mycobacterium tuberculosis H37Rv
gcacccgcucggcgcgcgggu

SEQ ID NO: 1346412 - RNA, 14 nt, Mycobacterium tuberculosis H37Rv
gcacccgcgccagu

SEQ ID NO: 1346413 - RNA, 19 nt, Mycobacterium tuberculosis H37Rv
gcacccgcucggccgccgg

SEQ ID NO: 1346414 - RNA, 23 nt, Mycobacterium tuberculosis H37Rv
gcacccgcgucgagugccgccac

SEQ ID NO: 1346415 - RNA, 23 nt, Mycobacterium tuberculosis H37Rv
gcacccgcgggucguccggcggc

SEQ ID NO: 1346416 - RNA, 19 nt, Mycobacterium tuberculosis H37Rv
gcacccagacgauggccag

SEQ ID NO: 1346417 - RNA, 23 nt, Mycobacterium tuberculosis H37Rv
gcacccacaucagccgcaccagu

SEQ ID NO: 1346418 - RNA, 19 nt, Mycobacterium tuberculosis H37Rv
gcacccacuuuucgguggc

SEQ ID NO: 1346419 - RNA, 22 nt, Mycobacterium tuberculosis H37Rv
gcacccacuuuucgguggcggc

SEQ ID NO: 1346420 - RNA, 17 nt, Mycobacterium tuberculosis H37Rv
gcacccagacgauggcc

SEQ ID NO: 1346421 - RNA, 15 nt, Mycobacterium tuberculosis H37Rv
gcacccaccacacca

SEQ ID NO: 1346422 - RNA, 24 nt, Mycobacterium tuberculosis H37Rv
gcacccacgccgguggcacggccc

SEQ ID NO: 1346423 - RNA, 23 nt, Mycobacterium tuberculosis H37Rv
gcacccaaugccaccgcggccgc

SEQ ID NO: 1346424 - RNA, 17 nt, Mycobacterium tuberculosis H37Rv
gcacccaaugccaccgc

SEQ ID NO: 1346425 - RNA, 15 nt, Mycobacterium tuberculosis H37Rv
gcacccaacuccauc

SEQ ID NO: 1346426 - RNA, 16 nt, Mycobacterium tuberculosis H37Rv
gcacccaacuccauca

SEQ ID NO: 1346427 - RNA, 14 nt, Mycobacterium tuberculosis H37Rv
gcacccaaugccac

SEQ ID NO: 1346428 - RNA, 21 nt, Mycobacterium tuberculosis H37Rv
gcacccaauccggcgccagca

SEQ ID NO: 1346429 - RNA, 13 nt, Mycobacterium tuberculosis H37Rv
gcaccccacggcc

SEQ ID NO: 1346430 - RNA, 18 nt, Mycobacterium tuberculosis H37Rv
gcacccagucggcgccgc

SEQ ID NO: 1346431 - RNA, 20 nt, Mycobacterium tuberculosis H37Rv
gcaccccauacucggcggcu

SEQ ID NO: 1346432 - RNA, 16 nt, Mycobacterium tuberculosis H37Rv
gcacccccgucgccac

SEQ ID NO: 1346433 - RNA, 20 nt, Mycobacterium tuberculosis H37Rv
gcaccccgaccaccagagcg

SEQ ID NO: 1346434 - RNA, 15 nt, Mycobacterium tuberculosis H37Rv
gcacaggucagcgcu

SEQ ID NO: 1346435 - RNA, 16 nt, Mycobacterium tuberculosis H37Rv
gcacaggaucacccac

SEQ ID NO: 1346436 - RNA, 19 nt, Mycobacterium tuberculosis H37Rv
gcacaggcggccagcaucg

SEQ ID NO: 1346437 - RNA, 14 nt, Mycobacterium tuberculosis H37Rv
gcacagcgccgcgu

SEQ ID NO: 1346438 - RNA, 14 nt, Mycobacterium tuberculosis H37Rv
gcacagcagugaac

SEQ ID NO: 1346439 - RNA, 14 nt, Mycobacterium tuberculosis H37Rv
gcacagcagcaacg

SEQ ID NO: 1346440 - RNA, 21 nt, Mycobacterium tuberculosis H37Rv
gcacagccgcuuggcgcggcc

SEQ ID NO: 1346441 - RNA, 14 nt, Mycobacterium tuberculosis H37Rv
gcacagcgaccauc

SEQ ID NO: 1346442 - RNA, 23 nt, Mycobacterium tuberculosis H37Rv
gcacaccugcgcggcgugcgcgg

SEQ ID NO: 1346443 - RNA, 15 nt, Mycobacterium tuberculosis H37Rv
gcacaccgggcacca

SEQ ID NO: 1346444 - RNA, 13 nt, Mycobacterium tuberculosis H37Rv
gcacaccgucguc

SEQ ID NO: 1346445 - RNA, 14 nt, Mycobacterium tuberculosis H37Rv
gcacaccgguggac

SEQ ID NO: 1346446 - RNA, 17 nt, Mycobacterium tuberculosis H37Rv
gcacaccgguggcgccc

SEQ ID NO: 1346447 - RNA, 15 nt, Mycobacterium tuberculosis H37Rv
gcacaccugcgcggc

SEQ ID NO: 1346448 - RNA, 15 nt, Mycobacterium tuberculosis H37Rv
gcacacccaucaccg

SEQ ID NO: 1346449 - RNA, 14 nt, Mycobacterium tuberculosis H37Rv
gcacacccgcaccg

SEQ ID NO: 1346450 - RNA, 17 nt, Mycobacterium tuberculosis H37Rv
gcacaacgcgacgccgc

SEQ ID NO: 1346451 - RNA, 16 nt, Mycobacterium tuberculosis H37Rv
gcacaacgcccaccac

SEQ ID NO: 1346452 - RNA, 18 nt, Mycobacterium tuberculosis H37Rv
gcacaccggcacugccca

SEQ ID NO: 1346453 - RNA, 17 nt, Mycobacterium tuberculosis H37Rv
gcacaccgacagcaccc

SEQ ID NO: 1346454 - RNA, 16 nt, Mycobacterium tuberculosis H37Rv
gcacacccgguuggcc

SEQ ID NO: 1346455 - RNA, 23 nt, Mycobacterium tuberculosis H37Rv
gcaaugccgacucaggucggugc

SEQ ID NO: 1346456 - RNA, 14 nt, Mycobacterium tuberculosis H37Rv
gcacaaacccaguu

SEQ ID NO: 1346457 - RNA, 12 nt, Mycobacterium tuberculosis H37Rv
gcaaugaccugg

SEQ ID NO: 1346458 - RNA, 23 nt, Mycobacterium tuberculosis H37Rv
gcaaugaccuggccgcccgcugc

SEQ ID NO: 1346459 - RNA, 15 nt, Mycobacterium tuberculosis H37Rv
gcaaugacccgcggg

SEQ ID NO: 1346460 - RNA, 16 nt, Mycobacterium tuberculosis H37Rv
gcaaugaccugcagcg

SEQ ID NO: 1346461 - RNA, 20 nt, Mycobacterium tuberculosis H37Rv
gcaccagguugcaaccuugg

SEQ ID NO: 1346462 - RNA, 16 nt, Mycobacterium tuberculosis H37Rv
gcaccagguguccccg

SEQ ID NO: 1346463 - RNA, 15 nt, Mycobacterium tuberculosis H37Rv
gcaccaggggcgcgu

SEQ ID NO: 1346464 - RNA, 19 nt, Mycobacterium tuberculosis H37Rv
gcaccagccagccugcugg

SEQ ID NO: 1346465 - RNA, 17 nt, Mycobacterium tuberculosis H37Rv
gcaccagcgaauccagc

SEQ ID NO: 1346466 - RNA, 17 nt, Mycobacterium tuberculosis H37Rv
gcacccaacccggcggc

SEQ ID NO: 1346467 - RNA, 19 nt, Mycobacterium tuberculosis H37Rv
gcaccauuguuccgucccc

SEQ ID NO: 1346468 - RNA, 21 nt, Mycobacterium tuberculosis H37Rv
gcaccaugggucuggcaggcc

SEQ ID NO: 1346469 - RNA, 23 nt, Mycobacterium tuberculosis H37Rv
gcaccaucgguaucgagggcagc

SEQ ID NO: 1346470 - RNA, 22 nt, Mycobacterium tuberculosis H37Rv
gcaccaucgguaucgagggcag

SEQ ID NO: 1346471 - RNA, 14 nt, Mycobacterium tuberculosis H37Rv
gcaccauccggucc

SEQ ID NO: 1346472 - RNA, 19 nt, Mycobacterium tuberculosis H37Rv
gcaccaaggucuucaggcc

SEQ ID NO: 1346473 - RNA, 20 nt, Mycobacterium tuberculosis H37Rv
gcaccaaggccgugaugcca

SEQ ID NO: 1346474 - RNA, 19 nt, Mycobacterium tuberculosis H37Rv
gcaccaaggccgugaugcc

SEQ ID NO: 1346475 - RNA, 15 nt, Mycobacterium tuberculosis H37Rv
gcacauccugcagcu

SEQ ID NO: 1346476 - RNA, 14 nt, Mycobacterium tuberculosis H37Rv
gcacauccugcagc

SEQ ID NO: 1346477 - RNA, 14 nt, Mycobacterium tuberculosis H37Rv
gcaccacaccacgg

SEQ ID NO: 1346478 - RNA, 19 nt, Mycobacterium tuberculosis H37Rv
gcaccacaccacgguggcc

SEQ ID NO: 1346479 - RNA, 22 nt, Mycobacterium tuberculosis H37Rv
gcaccacaccacgguggccgcu

SEQ ID NO: 1346480 - RNA, 15 nt, Mycobacterium tuberculosis H37Rv
gcaccaaggccgccu

SEQ ID NO: 1346481 - RNA, 23 nt, Mycobacterium tuberculosis H37Rv
gcaccaccaagguguggccuugc

SEQ ID NO: 1346482 - RNA, 22 nt, Mycobacterium tuberculosis H37Rv
gcaccacagugaaauccgagcc

SEQ ID NO: 1346483 - RNA, 14 nt, Mycobacterium tuberculosis H37Rv
gcaccaccacaccg

SEQ ID NO: 1346484 - RNA, 19 nt, Mycobacterium tuberculosis H37Rv
gcaccaccacaccggagcc

SEQ ID NO: 1346485 - RNA, 20 nt, Mycobacterium tuberculosis H37Rv
gcaccaccacgugaucagau

SEQ ID NO: 1346486 - RNA, 15 nt, Mycobacterium tuberculosis H37Rv
gcagaguucccugau

SEQ ID NO: 1346487 - RNA, 20 nt, Mycobacterium tuberculosis H37Rv
gcagacucgauaugcagcuc

SEQ ID NO: 1346488 - RNA, 13 nt, Mycobacterium tuberculosis H37Rv
gcagacucgaggu

SEQ ID NO: 1346489 - RNA, 14 nt, Mycobacterium tuberculosis H37Rv
gcagacucgagguc

SEQ ID NO: 1346490 - RNA, 21 nt, Mycobacterium tuberculosis H37Rv
gcagagaacuccgccaccauc

SEQ ID NO: 1346491 - RNA, 13 nt, Mycobacterium tuberculosis H37Rv
gcagagaccaagg

SEQ ID NO: 1346492 - RNA, 16 nt, Mycobacterium tuberculosis H37Rv
gcagagaccaaggucc

SEQ ID NO: 1346493 - RNA, 18 nt, Mycobacterium tuberculosis H37Rv
gcagacacuaaagcccuc

SEQ ID NO: 1346494 - RNA, 18 nt, Mycobacterium tuberculosis H37Rv
gcagacacgagucgccag

SEQ ID NO: 1346495 - RNA, 14 nt, Mycobacterium tuberculosis H37Rv
gcagacacugcugc

SEQ ID NO: 1346496 - RNA, 17 nt, Mycobacterium tuberculosis H37Rv
gcagacauggcaaguca

SEQ ID NO: 1346497 - RNA, 14 nt, Mycobacterium tuberculosis H37Rv
gcagaccaugguca

SEQ ID NO: 1346498 - RNA, 17 nt, Mycobacterium tuberculosis H37Rv
gcagaccaccagugagg

SEQ ID NO: 1346499 - RNA, 17 nt, Mycobacterium tuberculosis H37Rv
gcagacgcagagucgca

SEQ ID NO: 1346500 - RNA, 21 nt, Mycobacterium tuberculosis H37Rv
gcagacgcaaaaucgcacggu

SEQ ID NO: 1346501 - RNA, 19 nt, Mycobacterium tuberculosis H37Rv
gcagacgcaaaagcccccu

SEQ ID NO: 1346502 - RNA, 15 nt, Mycobacterium tuberculosis H37Rv
gcagacgcaaaagcc

SEQ ID NO: 1346503 - RNA, 13 nt, Mycobacterium tuberculosis H37Rv
gcagaccgccacc

SEQ ID NO: 1346504 - RNA, 16 nt, Mycobacterium tuberculosis H37Rv
gcagaccgaucggcag

SEQ ID NO: 1346505 - RNA, 14 nt, Mycobacterium tuberculosis H37Rv
gcagaccguccagc

SEQ ID NO: 1346506 - RNA, 16 nt, Mycobacterium tuberculosis H37Rv
gcagaauccugcgcug

SEQ ID NO: 1346507 - RNA, 21 nt, Mycobacterium tuberculosis H37Rv
gcagaauccggucgaugaccu

SEQ ID NO: 1346508 - RNA, 14 nt, Mycobacterium tuberculosis H37Rv
gcagaaggccgcgg

SEQ ID NO: 1346509 - RNA, 14 nt, Mycobacterium tuberculosis H37Rv
gcagaaccgccaac

SEQ ID NO: 1346510 - RNA, 18 nt, Mycobacterium tuberculosis H37Rv
gcagaacucgcguauccc

SEQ ID NO: 1346511 - RNA, 22 nt, Mycobacterium tuberculosis H37Rv
gcagaaacaucgacagcaucac

SEQ ID NO: 1346512 - RNA, 22 nt, Mycobacterium tuberculosis H37Rv
gcagaaccgccaacauugguga

SEQ ID NO: 1346513 - RNA, 19 nt, Mycobacterium tuberculosis H37Rv
gcagaacaguaucgccgga

SEQ ID NO: 1346514 - RNA, 13 nt, Mycobacterium tuberculosis H37Rv
gcacuucagcuuc

SEQ ID NO: 1346515 - RNA, 18 nt, Mycobacterium tuberculosis H37Rv
gcacgcgguucaccacgu

SEQ ID NO: 1346516 - RNA, 14 nt, Mycobacterium tuberculosis H37Rv
gcacuucagcuucg

SEQ ID NO: 1346517 - RNA, 12 nt, Mycobacterium tuberculosis H37Rv
gcacgcgggcac

SEQ ID NO: 1346518 - RNA, 23 nt, Mycobacterium tuberculosis H37Rv
gcacgcgggagguacccccagca

SEQ ID NO: 1346519 - RNA, 22 nt, Mycobacterium tuberculosis H37Rv
gcacgcggacaugacagccccg

SEQ ID NO: 1346520 - RNA, 17 nt, Mycobacterium tuberculosis H37Rv
gcacgcggcaauggugc

SEQ ID NO: 1346521 - RNA, 19 nt, Mycobacterium tuberculosis H37Rv
gcacuuucuuccucggggc

SEQ ID NO: 1346522 - RNA, 23 nt, Mycobacterium tuberculosis H37Rv
gcagccccaaaucguaggggucu

SEQ ID NO: 1346523 - RNA, 19 nt, Mycobacterium tuberculosis H37Rv
gcagcccaaagcgccagca

SEQ ID NO: 1346524 - RNA, 19 nt, Mycobacterium tuberculosis H37Rv
gcagcagcuucggacuggg

SEQ ID NO: 1346525 - RNA, 14 nt, Mycobacterium tuberculosis H37Rv
gcagcagcuugacc

SEQ ID NO: 1346526 - RNA, 16 nt, Mycobacterium tuberculosis H37Rv
gcagccagaucuccag

SEQ ID NO: 1346527 - RNA, 15 nt, Mycobacterium tuberculosis H37Rv
gcagccagcgccaug

SEQ ID NO: 1346528 - RNA, 15 nt, Mycobacterium tuberculosis H37Rv
gcagccacgcgggcg

SEQ ID NO: 1346529 - RNA, 13 nt, Mycobacterium tuberculosis H37Rv
gcagccugcagcg

SEQ ID NO: 1346530 - RNA, 17 nt, Mycobacterium tuberculosis H37Rv
gcagccugcgccgcgcg

SEQ ID NO: 1346531 - RNA, 17 nt, Mycobacterium tuberculosis H37Rv
gcagccguagcugggca

SEQ ID NO: 1346532 - RNA, 20 nt, Mycobacterium tuberculosis H37Rv
gcagcgaccgucguccagac

SEQ ID NO: 1346533 - RNA, 14 nt, Mycobacterium tuberculosis H37Rv
gcagccgcagccgg

SEQ ID NO: 1346534 - RNA, 10 nt, Mycobacterium tuberculosis H37Rv
gcagccgccc

SEQ ID NO: 1346535 - RNA, 13 nt, Mycobacterium tuberculosis H37Rv
gcagccgcccgcc

SEQ ID NO: 1346536 - RNA, 19 nt, Mycobacterium tuberculosis H37Rv
gcagccgcauaggccccgc

SEQ ID NO: 1346537 - RNA, 20 nt, Mycobacterium tuberculosis H37Rv
gcagccgcauaggccccgcc

SEQ ID NO: 1346538 - RNA, 15 nt, Mycobacterium tuberculosis H37Rv
gcagccgcagguggg

SEQ ID NO: 1346539 - RNA, 16 nt, Mycobacterium tuberculosis H37Rv
gcagccgcccgcccac

SEQ ID NO: 1346540 - RNA, 19 nt, Mycobacterium tuberculosis H37Rv
gcagccgcccgcccaccuc

SEQ ID NO: 1346541 - RNA, 16 nt, Mycobacterium tuberculosis H37Rv
gcagccgcgaguccag

SEQ ID NO: 1346542 - RNA, 15 nt, Mycobacterium tuberculosis H37Rv
gcagaucggccggau

SEQ ID NO: 1346543 - RNA, 23 nt, Mycobacterium tuberculosis H37Rv
gcagaucguggggaccucggcgc

SEQ ID NO: 1346544 - RNA, 19 nt, Mycobacterium tuberculosis H37Rv
gcagaugaugccguucgga

SEQ ID NO: 1346545 - RNA, 21 nt, Mycobacterium tuberculosis H37Rv
gcagaugaauugccgggcgca

SEQ ID NO: 1346546 - RNA, 14 nt, Mycobacterium tuberculosis H37Rv
gcagaugagcgcgg

SEQ ID NO: 1346547 - RNA, 14 nt, Mycobacterium tuberculosis H37Rv
gcagaucagggugg

SEQ ID NO: 1346548 - RNA, 16 nt, Mycobacterium tuberculosis H37Rv
gcagauauugccugcc

SEQ ID NO: 1346549 - RNA, 16 nt, Mycobacterium tuberculosis H37Rv
gcagauccccgccacc

SEQ ID NO: 1346550 - RNA, 18 nt, Mycobacterium tuberculosis H37Rv
gcagauacgccaaccgcu

SEQ ID NO: 1346551 - RNA, 17 nt, Mycobacterium tuberculosis H37Rv
gcagauacuuguugaag

SEQ ID NO: 1346552 - RNA, 16 nt, Mycobacterium tuberculosis H37Rv
gcagcaacugggcggc

SEQ ID NO: 1346553 - RNA, 14 nt, Mycobacterium tuberculosis H37Rv
gcagcaacgacguc

SEQ ID NO: 1346554 - RNA, 20 nt, Mycobacterium tuberculosis H37Rv
gcagcaggaaguagccgagc

SEQ ID NO: 1346555 - RNA, 13 nt, Mycobacterium tuberculosis H37Rv
gcagcagcgggcu

SEQ ID NO: 1346556 - RNA, 13 nt, Mycobacterium tuberculosis H37Rv
gcagcagcugguc

SEQ ID NO: 1346557 - RNA, 23 nt, Mycobacterium tuberculosis H37Rv
gcagcagcuggucgugggccacc

SEQ ID NO: 1346558 - RNA, 21 nt, Mycobacterium tuberculosis H37Rv
gcagcacuuccaagccgaccu

SEQ ID NO: 1346559 - RNA, 15 nt, Mycobacterium tuberculosis H37Rv
gcagcagcggcggcg

SEQ ID NO: 1346560 - RNA, 15 nt, Mycobacterium tuberculosis H37Rv
gcagcacucgguguc

SEQ ID NO: 1346561 - RNA, 17 nt, Mycobacterium tuberculosis H37Rv
gcagcacggcggccacg

SEQ ID NO: 1346562 - RNA, 17 nt, Mycobacterium tuberculosis H37Rv
gcagcacgauccagcug

SEQ ID NO: 1346563 - RNA, 16 nt, Mycobacterium tuberculosis H37Rv
gcagcacgaccugguu

SEQ ID NO: 1346564 - RNA, 21 nt, Mycobacterium tuberculosis H37Rv
gcaggccgguuugcacgcacc

SEQ ID NO: 1346565 - RNA, 15 nt, Mycobacterium tuberculosis H37Rv
gcaggccgggcacca

SEQ ID NO: 1346566 - RNA, 14 nt, Mycobacterium tuberculosis H37Rv
gcaggccggcggcg

SEQ ID NO: 1346567 - RNA, 16 nt, Mycobacterium tuberculosis H37Rv
gcaggccgcugggccg

SEQ ID NO: 1346568 - RNA, 13 nt, Mycobacterium tuberculosis H37Rv
gcaggccgcuggg

SEQ ID NO: 1346569 - RNA, 15 nt, Mycobacterium tuberculosis H37Rv
gcaggaucggcuugg

SEQ ID NO: 1346570 - RNA, 14 nt, Mycobacterium tuberculosis H37Rv
gcaggaucggcuug

SEQ ID NO: 1346571 - RNA, 15 nt, Mycobacterium tuberculosis H37Rv
gcagggccggcaccg

SEQ ID NO: 1346572 - RNA, 20 nt, Mycobacterium tuberculosis H37Rv
gcagggccggcaccgcagcg

SEQ ID NO: 1346573 - RNA, 20 nt, Mycobacterium tuberculosis H37Rv
gcagggccucggucgccaug

SEQ ID NO: 1346574 - RNA, 16 nt, Mycobacterium tuberculosis H37Rv
gcaggcuuagcuuccg

SEQ ID NO: 1346575 - RNA, 20 nt, Mycobacterium tuberculosis H37Rv
gcaggcuuccagccacagcc

SEQ ID NO: 1346576 - RNA, 16 nt, Mycobacterium tuberculosis H37Rv
gcaggcucagcuggug

SEQ ID NO: 1346577 - RNA, 23 nt, Mycobacterium tuberculosis H37Rv
gcagcucggggcgaugagccugc

SEQ ID NO: 1346578 - RNA, 16 nt, Mycobacterium tuberculosis H37Rv
gcagcucgggcaggga

SEQ ID NO: 1346579 - RNA, 17 nt, Mycobacterium tuberculosis H37Rv
gcagcucggccgaggcg

SEQ ID NO: 1346580 - RNA, 22 nt, Mycobacterium tuberculosis H37Rv
gcagcucgccggcacgcagcca

SEQ ID NO: 1346581 - RNA, 15 nt, Mycobacterium tuberculosis H37Rv
gcagcucgaccagga

SEQ ID NO: 1346582 - RNA, 17 nt, Mycobacterium tuberculosis H37Rv
gcagcucgauacccagg

SEQ ID NO: 1346583 - RNA, 19 nt, Mycobacterium tuberculosis H37Rv
gcagcucgauacccaggau

SEQ ID NO: 1346584 - RNA, 14 nt, Mycobacterium tuberculosis H37Rv
gcagcuccguggug

SEQ ID NO: 1346585 - RNA, 16 nt, Mycobacterium tuberculosis H37Rv
gcagcuccccgccgga

SEQ ID NO: 1346586 - RNA, 13 nt, Mycobacterium tuberculosis H37Rv
gcagcuccccgac

SEQ ID NO: 1346587 - RNA, 16 nt, Mycobacterium tuberculosis H37Rv
gcagcucaucgcgcac

SEQ ID NO: 1346588 - RNA, 13 nt, Mycobacterium tuberculosis H37Rv
gcagcucaucgcg

SEQ ID NO: 1346589 - RNA, 22 nt, Mycobacterium tuberculosis H37Rv
gcagcuacggggcggucgagcc

SEQ ID NO: 1346590 - RNA, 15 nt, Mycobacterium tuberculosis H37Rv
gcagcuagcccggca

SEQ ID NO: 1346591 - RNA, 18 nt, Mycobacterium tuberculosis H37Rv
gcagcuagcccucagcua

SEQ ID NO: 1346592 - RNA, 13 nt, Mycobacterium tuberculosis H37Rv
gcagcgacacguu

SEQ ID NO: 1346593 - RNA, 19 nt, Mycobacterium tuberculosis H37Rv
gcagcgugaucuggccacg

SEQ ID NO: 1346594 - RNA, 23 nt, Mycobacterium tuberculosis H37Rv
gcagcgagacuucgacgcggcga

SEQ ID NO: 1346595 - RNA, 21 nt, Mycobacterium tuberculosis H37Rv
gcaggaaucgggucagcacca

SEQ ID NO: 1346596 - RNA, 21 nt, Mycobacterium tuberculosis H37Rv
gcaggaccagcaccgccgcgc

SEQ ID NO: 1346597 - RNA, 18 nt, Mycobacterium tuberculosis H37Rv
gcaggacgcccacaugcu

SEQ ID NO: 1346598 - RNA, 22 nt, Mycobacterium tuberculosis H37Rv
gcagcuggucgugggccaccac

SEQ ID NO: 1346599 - RNA, 20 nt, Mycobacterium tuberculosis H37Rv
gcagcuggcgcagccugccg

SEQ ID NO: 1346600 - RNA, 18 nt, Mycobacterium tuberculosis H37Rv
gcagcuggcgcagccugc

SEQ ID NO: 1346601 - RNA, 14 nt, Mycobacterium tuberculosis H37Rv
gcagcugggcagga

SEQ ID NO: 1346602 - RNA, 23 nt, Mycobacterium tuberculosis H37Rv
gcaggaaaucguccuuggacagg

SEQ ID NO: 1346603 - RNA, 17 nt, Mycobacterium tuberculosis H37Rv
gcagucuuucccggggc

SEQ ID NO: 1346604 - RNA, 23 nt, Mycobacterium tuberculosis H37Rv
gcagucuuucccggggcuggggg

SEQ ID NO: 1346605 - RNA, 16 nt, Mycobacterium tuberculosis H37Rv
gcaguacuugguugcg

SEQ ID NO: 1346606 - RNA, 20 nt, Mycobacterium tuberculosis H37Rv
gcagucgggcagcgcucuca

SEQ ID NO: 1346607 - RNA, 23 nt, Mycobacterium tuberculosis H37Rv
gcaguacuaacaacaccaccagc

SEQ ID NO: 1346608 - RNA, 14 nt, Mycobacterium tuberculosis H37Rv
gcaguacaccgccc

SEQ ID NO: 1346609 - RNA, 16 nt, Mycobacterium tuberculosis H37Rv
gcaguacaccgcccgg

SEQ ID NO: 1346610 - RNA, 15 nt, Mycobacterium tuberculosis H37Rv
gcagugacucgauca

SEQ ID NO: 1346611 - RNA, 22 nt, Mycobacterium tuberculosis H37Rv
gcagugaacguaucgccucgag

SEQ ID NO: 1346612 - RNA, 22 nt, Mycobacterium tuberculosis H37Rv
gcagugacgccucgacacccag

SEQ ID NO: 1346613 - RNA, 12 nt, Mycobacterium tuberculosis H37Rv
gcaguugaacuc

SEQ ID NO: 1346614 - RNA, 20 nt, Mycobacterium tuberculosis H37Rv
gcaguucucggucccgccgg

SEQ ID NO: 1346615 - RNA, 15 nt, Mycobacterium tuberculosis H37Rv
gcaguucggucagcg

SEQ ID NO: 1346616 - RNA, 22 nt, Mycobacterium tuberculosis H37Rv
gcaguucggcgaugcgcgggug

SEQ ID NO: 1346617 - RNA, 19 nt, Mycobacterium tuberculosis H37Rv
gcauaaccggcgcgccccg

SEQ ID NO: 1346618 - RNA, 15 nt, Mycobacterium tuberculosis H37Rv
gcaguuggcaccagc

SEQ ID NO: 1346619 - RNA, 15 nt, Mycobacterium tuberculosis H37Rv
gcaggucgcaccaca

SEQ ID NO: 1346620 - RNA, 14 nt, Mycobacterium tuberculosis H37Rv
gcaggugcugggcg

SEQ ID NO: 1346621 - RNA, 19 nt, Mycobacterium tuberculosis H37Rv
gcagguggagugcacagac

SEQ ID NO: 1346622 - RNA, 16 nt, Mycobacterium tuberculosis H37Rv
gcagguuaggguccag

SEQ ID NO: 1346623 - RNA, 22 nt, Mycobacterium tuberculosis H37Rv
gcagguucgagggugaccccca

SEQ ID NO: 1346624 - RNA, 19 nt, Mycobacterium tuberculosis H37Rv
gcagguucuugaccagcag

SEQ ID NO: 1346625 - RNA, 20 nt, Mycobacterium tuberculosis H37Rv
gcagguucuugaccagcagc

SEQ ID NO: 1346626 - RNA, 18 nt, Mycobacterium tuberculosis H37Rv
gcagguucucggugccga

SEQ ID NO: 1346627 - RNA, 22 nt, Mycobacterium tuberculosis H37Rv
gcagguccgccaccgcgagcag

SEQ ID NO: 1346628 - RNA, 21 nt, Mycobacterium tuberculosis H37Rv
gcaggucgccugcccccgcgc

SEQ ID NO: 1346629 - RNA, 19 nt, Mycobacterium tuberculosis H37Rv
gcaggucgccugcccccgc

SEQ ID NO: 1346630 - RNA, 22 nt, Mycobacterium tuberculosis H37Rv
gcaggucgagcgcccacuggug

SEQ ID NO: 1346631 - RNA, 22 nt, Mycobacterium tuberculosis H37Rv
gcagguauaccgagggucgggc

SEQ ID NO: 1346632 - RNA, 16 nt, Mycobacterium tuberculosis H37Rv
gcagguacaucaccac

SEQ ID NO: 1346633 - RNA, 14 nt, Mycobacterium tuberculosis H37Rv
gcagggugccggcg

SEQ ID NO: 1346634 - RNA, 14 nt, Mycobacterium tuberculosis H37Rv
gcagggugaccagg

SEQ ID NO: 1346635 - RNA, 22 nt, Mycobacterium tuberculosis H37Rv
gcagggucgccccgaagcgggc

SEQ ID NO: 1346636 - RNA, 14 nt, Mycobacterium tuberculosis H37Rv
gcagggcggugcca

SEQ ID NO: 1346637 - RNA, 23 nt, Mycobacterium tuberculosis H37Rv
gauguguagguggggcacuucca

SEQ ID NO: 1346638 - RNA, 17 nt, Mycobacterium tuberculosis H37Rv
gaugugguuggugcugg

SEQ ID NO: 1346639 - RNA, 20 nt, Mycobacterium tuberculosis H37Rv
gaugugccgauuggccugcc

SEQ ID NO: 1346640 - RNA, 23 nt, Mycobacterium tuberculosis H37Rv
gauguggaugacgcagucgccca

SEQ ID NO: 1346641 - RNA, 13 nt, Mycobacterium tuberculosis H37Rv
gaugucuuccugc

SEQ ID NO: 1346642 - RNA, 22 nt, Mycobacterium tuberculosis H37Rv
gaugugagcacaccgacagcac

SEQ ID NO: 1346643 - RNA, 19 nt, Mycobacterium tuberculosis H37Rv
gauggcuggccagcacgcc

SEQ ID NO: 1346644 - RNA, 16 nt, Mycobacterium tuberculosis H37Rv
gauggcguccaucucg

SEQ ID NO: 1346645 - RNA, 17 nt, Mycobacterium tuberculosis H37Rv
gauggcgucggccagga

SEQ ID NO: 1346646 - RNA, 17 nt, Mycobacterium tuberculosis H37Rv
gaugucucggcaccaca

SEQ ID NO: 1346647 - RNA, 20 nt, Mycobacterium tuberculosis H37Rv
gaugucggugcguccggugc

SEQ ID NO: 1346648 - RNA, 14 nt, Mycobacterium tuberculosis H37Rv
gaugucggcuggug

SEQ ID NO: 1346649 - RNA, 15 nt, Mycobacterium tuberculosis H37Rv
gaugucguuggccac

SEQ ID NO: 1346650 - RNA, 19 nt, Mycobacterium tuberculosis H37Rv
gaugucguuggccaccucg

SEQ ID NO: 1346651 - RNA, 17 nt, Mycobacterium tuberculosis H37Rv
gaugucggcaccauagc

SEQ ID NO: 1346652 - RNA, 13 nt, Mycobacterium tuberculosis H37Rv
gaugggaaucagu

SEQ ID NO: 1346653 - RNA, 22 nt, Mycobacterium tuberculosis H37Rv
gaugggaaccgaaucggcaccg

SEQ ID NO: 1346654 - RNA, 14 nt, Mycobacterium tuberculosis H37Rv
gauggcuuggacca

SEQ ID NO: 1346655 - RNA, 19 nt, Mycobacterium tuberculosis H37Rv
gauuacaugucacacccac

SEQ ID NO: 1346656 - RNA, 15 nt, Mycobacterium tuberculosis H37Rv
gauguggugugccug

SEQ ID NO: 1346657 - RNA, 18 nt, Mycobacterium tuberculosis H37Rv
gauguugccggaguugaa

SEQ ID NO: 1346658 - RNA, 21 nt, Mycobacterium tuberculosis H37Rv
gauguuggccggcgccaccga

SEQ ID NO: 1346659 - RNA, 19 nt, Mycobacterium tuberculosis H37Rv
gauucacacucgggcggcu

SEQ ID NO: 1346660 - RNA, 16 nt, Mycobacterium tuberculosis H37Rv
gauucgaaggcaccua

SEQ ID NO: 1346661 - RNA, 20 nt, Mycobacterium tuberculosis H37Rv
gauuccuugaugccuuccga

SEQ ID NO: 1346662 - RNA, 18 nt, Mycobacterium tuberculosis H37Rv
gauuccggcggccacgcc

SEQ ID NO: 1346663 - RNA, 18 nt, Mycobacterium tuberculosis H37Rv
gauucccggcgcgguggc

SEQ ID NO: 1346664 - RNA, 19 nt, Mycobacterium tuberculosis H37Rv
gauucccgcccagcagcac

SEQ ID NO: 1346665 - RNA, 20 nt, Mycobacterium tuberculosis H37Rv
gauucccgcccagcagcacc

SEQ ID NO: 1346666 - RNA, 14 nt, Mycobacterium tuberculosis H37Rv
gauuuucucggugc

SEQ ID NO: 1346667 - RNA, 22 nt, Mycobacterium tuberculosis H37Rv
gauuucggugacuccggcugga

SEQ ID NO: 1346668 - RNA, 20 nt, Mycobacterium tuberculosis H37Rv
gauuucccagcgcagugccu

SEQ ID NO: 1346669 - RNA, 14 nt, Mycobacterium tuberculosis H37Rv
gauuucccagcgca

SEQ ID NO: 1346670 - RNA, 14 nt, Mycobacterium tuberculosis H37Rv
gauuuggagcuuuu

SEQ ID NO: 1346671 - RNA, 18 nt, Mycobacterium tuberculosis H37Rv
gauuuggccgucaucucc

SEQ ID NO: 1346672 - RNA, 20 nt, Mycobacterium tuberculosis H37Rv
gauugugagcaauggcgcga

SEQ ID NO: 1346673 - RNA, 21 nt, Mycobacterium tuberculosis H37Rv
gauuggccugccauaggccca

SEQ ID NO: 1346674 - RNA, 17 nt, Mycobacterium tuberculosis H37Rv
gauuggcgucagcagca

SEQ ID NO: 1346675 - RNA, 11 nt, Mycobacterium tuberculosis H37Rv
gauuggcccga

SEQ ID NO: 1346676 - RNA, 14 nt, Mycobacterium tuberculosis H37Rv
gauuggccgcugca

SEQ ID NO: 1346677 - RNA, 19 nt, Mycobacterium tuberculosis H37Rv
gauuggugggccagcagca

SEQ ID NO: 1346678 - RNA, 22 nt, Mycobacterium tuberculosis H37Rv
gauugguggcccgggccaccgg

SEQ ID NO: 1346679 - RNA, 11 nt, Mycobacterium tuberculosis H37Rv
gauuggccccg

SEQ ID NO: 1346680 - RNA, 17 nt, Mycobacterium tuberculosis H37Rv
gauucgggcuucuccau

SEQ ID NO: 1346681 - RNA, 15 nt, Mycobacterium tuberculosis H37Rv
gauucgagccacaug

SEQ ID NO: 1346682 - RNA, 18 nt, Mycobacterium tuberculosis H37Rv
gauucgcggcagccggcg

SEQ ID NO: 1346683 - RNA, 13 nt, Mycobacterium tuberculosis H37Rv
gauucggccagac

SEQ ID NO: 1346684 - RNA, 18 nt, Mycobacterium tuberculosis H37Rv
gaugccugcuagcagcag

SEQ ID NO: 1346685 - RNA, 14 nt, Mycobacterium tuberculosis H37Rv
gaugccugccaccc

SEQ ID NO: 1346686 - RNA, 22 nt, Mycobacterium tuberculosis H37Rv
gaugccucggcggccucgcugc

SEQ ID NO: 1346687 - RNA, 21 nt, Mycobacterium tuberculosis H37Rv
gaugccguucaugccauggau

SEQ ID NO: 1346688 - RNA, 15 nt, Mycobacterium tuberculosis H37Rv
gaugcgcucggccug

SEQ ID NO: 1346689 - RNA, 19 nt, Mycobacterium tuberculosis H37Rv
gaugcccaucacgccccag

SEQ ID NO: 1346690 - RNA, 17 nt, Mycobacterium tuberculosis H37Rv
gaugccccuucaaagcg

SEQ ID NO: 1346691 - RNA, 15 nt, Mycobacterium tuberculosis H37Rv
gauggccugaucuuu

SEQ ID NO: 1346692 - RNA, 23 nt, Mycobacterium tuberculosis H37Rv
gauggccguccgaccgauaacac

SEQ ID NO: 1346693 - RNA, 23 nt, Mycobacterium tuberculosis H37Rv
gauggccucaacgccagcugcuu

SEQ ID NO: 1346694 - RNA, 15 nt, Mycobacterium tuberculosis H37Rv
gauggcgguggcgag

SEQ ID NO: 1346695 - RNA, 12 nt, Mycobacterium tuberculosis H37Rv
gauggcgguggc

SEQ ID NO: 1346696 - RNA, 15 nt, Mycobacterium tuberculosis H37Rv
gauggccagcgcggc

SEQ ID NO: 1346697 - RNA, 16 nt, Mycobacterium tuberculosis H37Rv
gauggccagcgcggcg

SEQ ID NO: 1346698 - RNA, 12 nt, Mycobacterium tuberculosis H37Rv
gauggccaggcc

SEQ ID NO: 1346699 - RNA, 18 nt, Mycobacterium tuberculosis H37Rv
gaugcuaugcaguuccuu

SEQ ID NO: 1346700 - RNA, 13 nt, Mycobacterium tuberculosis H37Rv
gaugcugccagcc

SEQ ID NO: 1346701 - RNA, 19 nt, Mycobacterium tuberculosis H37Rv
gaugcugccagccauggcc

SEQ ID NO: 1346702 - RNA, 19 nt, Mycobacterium tuberculosis H37Rv
gaugauguuuuccccgccc

SEQ ID NO: 1346703 - RNA, 19 nt, Mycobacterium tuberculosis H37Rv
gaugccacccagaugcagc

SEQ ID NO: 1346704 - RNA, 21 nt, Mycobacterium tuberculosis H37Rv
gaugcacaaccgcugcugcug

SEQ ID NO: 1346705 - RNA, 22 nt, Mycobacterium tuberculosis H37Rv
gaugcaacucggcagauugucg

SEQ ID NO: 1346706 - RNA, 14 nt, Mycobacterium tuberculosis H37Rv
gaugcaacccggug

SEQ ID NO: 1346707 - RNA, 17 nt, Mycobacterium tuberculosis H37Rv
gaugcaagcgggcauga

SEQ ID NO: 1346708 - RNA, 17 nt, Mycobacterium tuberculosis H37Rv
gaugaccuucccgucga

SEQ ID NO: 1346709 - RNA, 16 nt, Mycobacterium tuberculosis H37Rv
gaugaccuugcccacc

SEQ ID NO: 1346710 - RNA, 12 nt, Mycobacterium tuberculosis H37Rv
gaugaccgcgcg

SEQ ID NO: 1346711 - RNA, 19 nt, Mycobacterium tuberculosis H37Rv
gaugaccuuggccgugccc

SEQ ID NO: 1346712 - RNA, 15 nt, Mycobacterium tuberculosis H37Rv
gaugacgcagucgcc

SEQ ID NO: 1346713 - RNA, 21 nt, Mycobacterium tuberculosis H37Rv
gaugagggugcucgucaccaa

SEQ ID NO: 1346714 - RNA, 23 nt, Mycobacterium tuberculosis H37Rv
gaugagggcuuguggugagcgga

SEQ ID NO: 1346715 - RNA, 16 nt, Mycobacterium tuberculosis H37Rv
gaugagguggccgcgc

SEQ ID NO: 1346716 - RNA, 19 nt, Mycobacterium tuberculosis H37Rv
gaugagguucaucgccggc

SEQ ID NO: 1346717 - RNA, 16 nt, Mycobacterium tuberculosis H37Rv
gaugacccacugcagg

SEQ ID NO: 1346718 - RNA, 14 nt, Mycobacterium tuberculosis H37Rv
gaugacccacugca

SEQ ID NO: 1346719 - RNA, 22 nt, Mycobacterium tuberculosis H37Rv
gaugaaguguuuggcguugggc

SEQ ID NO: 1346720 - RNA, 21 nt, Mycobacterium tuberculosis H37Rv
gaugaccgccaucgccaacac

SEQ ID NO: 1346721 - RNA, 20 nt, Mycobacterium tuberculosis H37Rv
gaugacccggaaucccgagu

SEQ ID NO: 1346722 - RNA, 18 nt, Mycobacterium tuberculosis H37Rv
gaugaacggaaucuuguu

SEQ ID NO: 1346723 - RNA, 12 nt, Mycobacterium tuberculosis H37Rv
gaugaagcuggu

SEQ ID NO: 1346724 - RNA, 23 nt, Mycobacterium tuberculosis H37Rv
gaucucgaccguauugaccagcg

SEQ ID NO: 1346725 - RNA, 16 nt, Mycobacterium tuberculosis H37Rv
gaucucgaucgacccg

SEQ ID NO: 1346726 - RNA, 20 nt, Mycobacterium tuberculosis H37Rv
gaucucguggaucugccucu

SEQ ID NO: 1346727 - RNA, 17 nt, Mycobacterium tuberculosis H37Rv
gaucucguagccgccgu

SEQ ID NO: 1346728 - RNA, 18 nt, Mycobacterium tuberculosis H37Rv
gaucucggucuccacgcc

SEQ ID NO: 1346729 - RNA, 16 nt, Mycobacterium tuberculosis H37Rv
gaucucgcgcucccac

SEQ ID NO: 1346730 - RNA, 19 nt, Mycobacterium tuberculosis H37Rv
gaucugcagcacgcguggu

SEQ ID NO: 1346731 - RNA, 21 nt, Mycobacterium tuberculosis H37Rv
gaucugccgccgcggccacaa

SEQ ID NO: 1346732 - RNA, 21 nt, Mycobacterium tuberculosis H37Rv
gaucugagaccucagccggcg

SEQ ID NO: 1346733 - RNA, 18 nt, Mycobacterium tuberculosis H37Rv
gaucugagggcucggugg

SEQ ID NO: 1346734 - RNA, 19 nt, Mycobacterium tuberculosis H37Rv
gaucucuccuggaaaggac

SEQ ID NO: 1346735 - RNA, 23 nt, Mycobacterium tuberculosis H37Rv
gaucguuuccguagacgggguga

SEQ ID NO: 1346736 - RNA, 19 nt, Mycobacterium tuberculosis H37Rv
gaucccagcgcagcggacg

SEQ ID NO: 1346737 - RNA, 16 nt, Mycobacterium tuberculosis H37Rv
gaucccacggcgggcg

SEQ ID NO: 1346738 - RNA, 14 nt, Mycobacterium tuberculosis H37Rv
gaucccacccucgg

SEQ ID NO: 1346739 - RNA, 20 nt, Mycobacterium tuberculosis H37Rv
gauccccaggccgcuugccc

SEQ ID NO: 1346740 - RNA, 18 nt, Mycobacterium tuberculosis H37Rv
gauccccaacacccggcu

SEQ ID NO: 1346741 - RNA, 13 nt, Mycobacterium tuberculosis H37Rv
gauccccagcucc

SEQ ID NO: 1346742 - RNA, 20 nt, Mycobacterium tuberculosis H37Rv
gauccccguugacccagacc

SEQ ID NO: 1346743 - RNA, 21 nt, Mycobacterium tuberculosis H37Rv
gaucucaucgggccacagcaa

SEQ ID NO: 1346744 - RNA, 13 nt, Mycobacterium tuberculosis H37Rv
gaucuuggccacc

SEQ ID NO: 1346745 - RNA, 11 nt, Mycobacterium tuberculosis H37Rv
gaucuuggcca

SEQ ID NO: 1346746 - RNA, 16 nt, Mycobacterium tuberculosis H37Rv
gaucuugugccaggcg

SEQ ID NO: 1346747 - RNA, 17 nt, Mycobacterium tuberculosis H37Rv
gaugaaccacggcaggc

SEQ ID NO: 1346748 - RNA, 20 nt, Mycobacterium tuberculosis H37Rv
gaucugcugugucguacccg

SEQ ID NO: 1346749 - RNA, 17 nt, Mycobacterium tuberculosis H37Rv
gaucugcgccaggggca

SEQ ID NO: 1346750 - RNA, 22 nt, Mycobacterium tuberculosis H37Rv
gaucugcgcgucaggccagcgc

SEQ ID NO: 1346751 - RNA, 14 nt, Mycobacterium tuberculosis H37Rv
gaucuggcgcagca

SEQ ID NO: 1346752 - RNA, 13 nt, Mycobacterium tuberculosis H37Rv
gaucugcuggccg

SEQ ID NO: 1346753 - RNA, 15 nt, Mycobacterium tuberculosis H37Rv
gaucugggcuggcag

SEQ ID NO: 1346754 - RNA, 17 nt, Mycobacterium tuberculosis H37Rv
gaucuggcuccggccag

SEQ ID NO: 1346755 - RNA, 16 nt, Mycobacterium tuberculosis H37Rv
gaucuggucggcggcc

SEQ ID NO: 1346756 - RNA, 15 nt, Mycobacterium tuberculosis H37Rv
gaucugguccagugg

SEQ ID NO: 1346757 - RNA, 18 nt, Mycobacterium tuberculosis H37Rv
gaucuugccggccagcag

SEQ ID NO: 1346758 - RNA, 18 nt, Mycobacterium tuberculosis H37Rv
gaucuugacggucgccgu

SEQ ID NO: 1346759 - RNA, 21 nt, Mycobacterium tuberculosis H37Rv
gaucuucugccuuggccggcu

SEQ ID NO: 1346760 - RNA, 16 nt, Mycobacterium tuberculosis H37Rv
gaucuucugccuuggc

SEQ ID NO: 1346761 - RNA, 18 nt, Mycobacterium tuberculosis H37Rv
gaucuucgacaggccacc

SEQ ID NO: 1346762 - RNA, 20 nt, Mycobacterium tuberculosis H37Rv
gaucuucgacaggccaccgc

SEQ ID NO: 1346763 - RNA, 15 nt, Mycobacterium tuberculosis H37Rv
gaucuucggccgcac

SEQ ID NO: 1346764 - RNA, 14 nt, Mycobacterium tuberculosis H37Rv
gaucaccugcagca

SEQ ID NO: 1346765 - RNA, 16 nt, Mycobacterium tuberculosis H37Rv
gaucaccgcggcgguc

SEQ ID NO: 1346766 - RNA, 20 nt, Mycobacterium tuberculosis H37Rv
gaucaccgccaccaccaggg

SEQ ID NO: 1346767 - RNA, 14 nt, Mycobacterium tuberculosis H37Rv
gaucacccgcagcc

SEQ ID NO: 1346768 - RNA, 20 nt, Mycobacterium tuberculosis H37Rv
gaucacccgcaucggcacgc

SEQ ID NO: 1346769 - RNA, 20 nt, Mycobacterium tuberculosis H37Rv
gaucacauaggucacaaacg

SEQ ID NO: 1346770 - RNA, 13 nt, Mycobacterium tuberculosis H37Rv
gaucaaugcgaug

SEQ ID NO: 1346771 - RNA, 20 nt, Mycobacterium tuberculosis H37Rv
gaucaguucguggcuggcau

SEQ ID NO: 1346772 - RNA, 17 nt, Mycobacterium tuberculosis H37Rv
gaucaguucguggcugg

SEQ ID NO: 1346773 - RNA, 15 nt, Mycobacterium tuberculosis H37Rv
gaucacgccaccauc

SEQ ID NO: 1346774 - RNA, 16 nt, Mycobacterium tuberculosis H37Rv
gaucacgccggccucg

SEQ ID NO: 1346775 - RNA, 17 nt, Mycobacterium tuberculosis H37Rv
gaucagaacgcggccuc

SEQ ID NO: 1346776 - RNA, 16 nt, Mycobacterium tuberculosis H37Rv
gaucagacccagcgcg

SEQ ID NO: 1346777 - RNA, 16 nt, Mycobacterium tuberculosis H37Rv
gaucagaaucugccuc

SEQ ID NO: 1346778 - RNA, 15 nt, Mycobacterium tuberculosis H37Rv
gaucaucuggcuggu

SEQ ID NO: 1346779 - RNA, 21 nt, Mycobacterium tuberculosis H37Rv
gaucaucauauccgccccagc

SEQ ID NO: 1346780 - RNA, 13 nt, Mycobacterium tuberculosis H37Rv
gaucaucccggcg

SEQ ID NO: 1346781 - RNA, 16 nt, Mycobacterium tuberculosis H37Rv
gaucauggcgagcguu

SEQ ID NO: 1346782 - RNA, 21 nt, Mycobacterium tuberculosis H37Rv
gauccaggccucgcaccggau

SEQ ID NO: 1346783 - RNA, 17 nt, Mycobacterium tuberculosis H37Rv
gaucaugagcagcacgu

SEQ ID NO: 1346784 - RNA, 20 nt, Mycobacterium tuberculosis H37Rv
gaucaugaacgccagcagcg

SEQ ID NO: 1346785 - RNA, 12 nt, Mycobacterium tuberculosis H37Rv
gauagucgccgc

SEQ ID NO: 1346786 - RNA, 23 nt, Mycobacterium tuberculosis H37Rv
gauagucgccgucgccccaccaa

SEQ ID NO: 1346787 - RNA, 23 nt, Mycobacterium tuberculosis H37Rv
gauaguucaccacaugggagccg

SEQ ID NO: 1346788 - RNA, 12 nt, Mycobacterium tuberculosis H37Rv
gauagccgacca

SEQ ID NO: 1346789 - RNA, 18 nt, Mycobacterium tuberculosis H37Rv
gauagccgaccagguaga

SEQ ID NO: 1346790 - RNA, 16 nt, Mycobacterium tuberculosis H37Rv
gauaggccgcgcggcg

SEQ ID NO: 1346791 - RNA, 22 nt, Mycobacterium tuberculosis H37Rv
gauaggaccacgggaugcaugu

SEQ ID NO: 1346792 - RNA, 24 nt, Mycobacterium tuberculosis H37Rv
gauaagccugggaaacugggucua

SEQ ID NO: 1346793 - RNA, 21 nt, Mycobacterium tuberculosis H37Rv
gauaaggcaaggcauccaacg

SEQ ID NO: 1346794 - RNA, 15 nt, Mycobacterium tuberculosis H37Rv
gauaccggcgugcag

SEQ ID NO: 1346795 - RNA, 16 nt, Mycobacterium tuberculosis H37Rv
gauaccggcgugcagu

SEQ ID NO: 1346796 - RNA, 19 nt, Mycobacterium tuberculosis H37Rv
gauagaacguagcgcccac

SEQ ID NO: 1346797 - RNA, 23 nt, Mycobacterium tuberculosis H37Rv
gauagacuagccgauccagcagg

SEQ ID NO: 1346798 - RNA, 20 nt, Mycobacterium tuberculosis H37Rv
gauaccugggacaggacgac

SEQ ID NO: 1346799 - RNA, 23 nt, Mycobacterium tuberculosis H37Rv
gauacuaaacaggccgccaccgu

SEQ ID NO: 1346800 - RNA, 14 nt, Mycobacterium tuberculosis H37Rv
gagggugcguugga

SEQ ID NO: 1346801 - RNA, 21 nt, Mycobacterium tuberculosis H37Rv
gagggguucacccagcggcgc

SEQ ID NO: 1346802 - RNA, 17 nt, Mycobacterium tuberculosis H37Rv
gaggguagacggggcga

SEQ ID NO: 1346803 - RNA, 14 nt, Mycobacterium tuberculosis H37Rv
gagggucccacggc

SEQ ID NO: 1346804 - RNA, 22 nt, Mycobacterium tuberculosis H37Rv
gagggugugagguagucggcgc

SEQ ID NO: 1346805 - RNA, 22 nt, Mycobacterium tuberculosis H37Rv
gaggguuuucgcauagugcggc

SEQ ID NO: 1346806 - RNA, 19 nt, Mycobacterium tuberculosis H37Rv
gaggguucggacggcuggu

SEQ ID NO: 1346807 - RNA, 17 nt, Mycobacterium tuberculosis H37Rv
gagguaauccgcggggu

SEQ ID NO: 1346808 - RNA, 21 nt, Mycobacterium tuberculosis H37Rv
gagguacccaucgucgagccg

SEQ ID NO: 1346809 - RNA, 18 nt, Mycobacterium tuberculosis H37Rv
gagggcuguugacgccac

SEQ ID NO: 1346810 - RNA, 19 nt, Mycobacterium tuberculosis H37Rv
gagggcgucgccgccguug

SEQ ID NO: 1346811 - RNA, 16 nt, Mycobacterium tuberculosis H37Rv
gagggcucgguggcgc

SEQ ID NO: 1346812 - RNA, 20 nt, Mycobacterium tuberculosis H37Rv
gagggcggaaaaucggcugg

SEQ ID NO: 1346813 - RNA, 15 nt, Mycobacterium tuberculosis H37Rv
gagggcggccgcggu

SEQ ID NO: 1346814 - RNA, 17 nt, Mycobacterium tuberculosis H37Rv
gagggcgccgggggcgc

SEQ ID NO: 1346815 - RNA, 21 nt, Mycobacterium tuberculosis H37Rv
gagggcgccgggggcgccgcc

SEQ ID NO: 1346816 - RNA, 20 nt, Mycobacterium tuberculosis H37Rv
gagggccgucacaggccgcc

SEQ ID NO: 1346817 - RNA, 19 nt, Mycobacterium tuberculosis H37Rv
gaggcugggcugagggugg

SEQ ID NO: 1346818 - RNA, 21 nt, Mycobacterium tuberculosis H37Rv
gaggcugaccguggcgccggu

SEQ ID NO: 1346819 - RNA, 15 nt, Mycobacterium tuberculosis H37Rv
gaggcucgggccgca

SEQ ID NO: 1346820 - RNA, 21 nt, Mycobacterium tuberculosis H37Rv
gaggcuaggcguuugguguga

SEQ ID NO: 1346821 - RNA, 24 nt, Mycobacterium tuberculosis H37Rv
gaggcggucgaucauggcggcagc

SEQ ID NO: 1346822 - RNA, 15 nt, Mycobacterium tuberculosis H37Rv
gagggagcgccgcag

SEQ ID NO: 1346823 - RNA, 22 nt, Mycobacterium tuberculosis H37Rv
gagggagcgccgcagggucccg

SEQ ID NO: 1346824 - RNA, 14 nt, Mycobacterium tuberculosis H37Rv
gagggagcgccgca

SEQ ID NO: 1346825 - RNA, 23 nt, Mycobacterium tuberculosis H37Rv
gagggauguagugcugcucgaca

SEQ ID NO: 1346826 - RNA, 13 nt, Mycobacterium tuberculosis H37Rv
gagggccagcagc

SEQ ID NO: 1346827 - RNA, 23 nt, Mycobacterium tuberculosis H37Rv
gaggcugugccccagggcagugc

SEQ ID NO: 1346828 - RNA, 17 nt, Mycobacterium tuberculosis H37Rv
gaggcuuacaugcccug

SEQ ID NO: 1346829 - RNA, 21 nt, Mycobacterium tuberculosis H37Rv
gaggcuuucgauauagccgcc

SEQ ID NO: 1346830 - RNA, 20 nt, Mycobacterium tuberculosis H37Rv
gaggugguucacggggacca

SEQ ID NO: 1346831 - RNA, 19 nt, Mycobacterium tuberculosis H37Rv
gagguggccgcgcaggggc

SEQ ID NO: 1346832 - RNA, 14 nt, Mycobacterium tuberculosis H37Rv
gaggugcugcaccu

SEQ ID NO: 1346833 - RNA, 16 nt, Mycobacterium tuberculosis H37Rv
gagguggggcaggauc

SEQ ID NO: 1346834 - RNA, 12 nt, Mycobacterium tuberculosis H37Rv
gagguggcgggc

SEQ ID NO: 1346835 - RNA, 14 nt, Mycobacterium tuberculosis H37Rv
gagguggggcagga

SEQ ID NO: 1346836 - RNA, 21 nt, Mycobacterium tuberculosis H37Rv
gaggugauggucgucauccug

SEQ ID NO: 1346837 - RNA, 22 nt, Mycobacterium tuberculosis H37Rv
gaggugauguuggccgccacac

SEQ ID NO: 1346838 - RNA, 21 nt, Mycobacterium tuberculosis H37Rv
gaggugcccaaggccaggauc

SEQ ID NO: 1346839 - RNA, 22 nt, Mycobacterium tuberculosis H37Rv
gaggucgagcgccuuugcccga

SEQ ID NO: 1346840 - RNA, 14 nt, Mycobacterium tuberculosis H37Rv
gaggucgaucaggg

SEQ ID NO: 1346841 - RNA, 20 nt, Mycobacterium tuberculosis H37Rv
gagguccuugaugcgcccca

SEQ ID NO: 1346842 - RNA, 22 nt, Mycobacterium tuberculosis H37Rv
gaggucgaaccgccggcugcgc

SEQ ID NO: 1346843 - RNA, 16 nt, Mycobacterium tuberculosis H37Rv
gaggucaacgccacgc

SEQ ID NO: 1346844 - RNA, 14 nt, Mycobacterium tuberculosis H37Rv
gaggucagcucccg

SEQ ID NO: 1346845 - RNA, 16 nt, Mycobacterium tuberculosis H37Rv
gaggucauaucgacgg

SEQ ID NO: 1346846 - RNA, 18 nt, Mycobacterium tuberculosis H37Rv
gaggucaaaaucagggug

SEQ ID NO: 1346847 - RNA, 19 nt, Mycobacterium tuberculosis H37Rv
gaggucgcggucuuugagc

SEQ ID NO: 1346848 - RNA, 16 nt, Mycobacterium tuberculosis H37Rv
gaggucgccggcacac

SEQ ID NO: 1346849 - RNA, 14 nt, Mycobacterium tuberculosis H37Rv
gaggucggcggcgc

SEQ ID NO: 1346850 - RNA, 15 nt, Mycobacterium tuberculosis H37Rv
gaggucgggcggcga

SEQ ID NO: 1346851 - RNA, 20 nt, Mycobacterium tuberculosis H37Rv
gaggucggccagcagcagug

SEQ ID NO: 1346852 - RNA, 21 nt, Mycobacterium tuberculosis H37Rv
gaggucugguagagguugucg

SEQ ID NO: 1346853 - RNA, 14 nt, Mycobacterium tuberculosis H37Rv
gaguaccggccagc

SEQ ID NO: 1346854 - RNA, 15 nt, Mycobacterium tuberculosis H37Rv
gaguaccggccagcc

SEQ ID NO: 1346855 - RNA, 18 nt, Mycobacterium tuberculosis H37Rv
gaguaccggccagccgcg

SEQ ID NO: 1346856 - RNA, 19 nt, Mycobacterium tuberculosis H37Rv
gaguaagcgaacagcggca

SEQ ID NO: 1346857 - RNA, 13 nt, Mycobacterium tuberculosis H37Rv
gagguuggcggcc

SEQ ID NO: 1346858 - RNA, 17 nt, Mycobacterium tuberculosis H37Rv
gaguagaagauggcacc

SEQ ID NO: 1346859 - RNA, 12 nt, Mycobacterium tuberculosis H37Rv
gaguagcccgcg

SEQ ID NO: 1346860 - RNA, 18 nt, Mycobacterium tuberculosis H37Rv
gaguagucgcuggccaga

SEQ ID NO: 1346861 - RNA, 15 nt, Mycobacterium tuberculosis H37Rv
gaguaggugugcggg

SEQ ID NO: 1346862 - RNA, 17 nt, Mycobacterium tuberculosis H37Rv
gaguccgcugagcgggc

SEQ ID NO: 1346863 - RNA, 19 nt, Mycobacterium tuberculosis H37Rv
gaguccgcugcuucuccga

SEQ ID NO: 1346864 - RNA, 22 nt, Mycobacterium tuberculosis H37Rv
gaguccgcugcuucuccgagau

SEQ ID NO: 1346865 - RNA, 13 nt, Mycobacterium tuberculosis H37Rv
gaguagugguggg

SEQ ID NO: 1346866 - RNA, 18 nt, Mycobacterium tuberculosis H37Rv
gaguccggccgacccgga

SEQ ID NO: 1346867 - RNA, 13 nt, Mycobacterium tuberculosis H37Rv
gagucgcagcacg

SEQ ID NO: 1346868 - RNA, 22 nt, Mycobacterium tuberculosis H37Rv
gagucgauugccaccgagauca

SEQ ID NO: 1346869 - RNA, 12 nt, Mycobacterium tuberculosis H37Rv
gagucgagcaca

SEQ ID NO: 1346870 - RNA, 19 nt, Mycobacterium tuberculosis H37Rv
gagugaccacgcugcuggu

SEQ ID NO: 1346871 - RNA, 21 nt, Mycobacterium tuberculosis H37Rv
gaguuggucguggcugugcgg

SEQ ID NO: 1346872 - RNA, 19 nt, Mycobacterium tuberculosis H37Rv
gaguugguguuauugaugc

SEQ ID NO: 1346873 - RNA, 22 nt, Mycobacterium tuberculosis H37Rv
gaguugguguuauugaugcccg

SEQ ID NO: 1346874 - RNA, 12 nt, Mycobacterium tuberculosis H37Rv
gaguuggccaag

SEQ ID NO: 1346875 - RNA, 16 nt, Mycobacterium tuberculosis H37Rv
gaguugcuugcagggc

SEQ ID NO: 1346876 - RNA, 16 nt, Mycobacterium tuberculosis H37Rv
gagugucuuagccagc

SEQ ID NO: 1346877 - RNA, 21 nt, Mycobacterium tuberculosis H37Rv
gaguggucccguucgcccgcc

SEQ ID NO: 1346878 - RNA, 14 nt, Mycobacterium tuberculosis H37Rv
gaguuuguuuuugc

SEQ ID NO: 1346879 - RNA, 12 nt, Mycobacterium tuberculosis H37Rv
gaguuuuucggg

SEQ ID NO: 1346880 - RNA, 22 nt, Mycobacterium tuberculosis H37Rv
gagcagcaccacccgcaccuca

SEQ ID NO: 1346881 - RNA, 12 nt, Mycobacterium tuberculosis H37Rv
gagcagcaagcc

SEQ ID NO: 1346882 - RNA, 17 nt, Mycobacterium tuberculosis H37Rv
gagcagcaagccgccgg

SEQ ID NO: 1346883 - RNA, 20 nt, Mycobacterium tuberculosis H37Rv
gagcagaaacaacgucgccg

SEQ ID NO: 1346884 - RNA, 14 nt, Mycobacterium tuberculosis H37Rv
gagcacgccgacca

SEQ ID NO: 1346885 - RNA, 14 nt, Mycobacterium tuberculosis H37Rv
gagcacgccgagcc

SEQ ID NO: 1346886 - RNA, 23 nt, Mycobacterium tuberculosis H37Rv
gagcacgccaacguugcgccagc

SEQ ID NO: 1346887 - RNA, 15 nt, Mycobacterium tuberculosis H37Rv
gagcaccucggccuc

SEQ ID NO: 1346888 - RNA, 20 nt, Mycobacterium tuberculosis H37Rv
gagcaccgcucgguccagcc

SEQ ID NO: 1346889 - RNA, 14 nt, Mycobacterium tuberculosis H37Rv
gagcaccaccccag

SEQ ID NO: 1346890 - RNA, 20 nt, Mycobacterium tuberculosis H37Rv
gagcaccaccccagcggcca

SEQ ID NO: 1346891 - RNA, 21 nt, Mycobacterium tuberculosis H37Rv
gagcaccacccgggccucggc

SEQ ID NO: 1346892 - RNA, 15 nt, Mycobacterium tuberculosis H37Rv
gagcacccagcggcg

SEQ ID NO: 1346893 - RNA, 22 nt, Mycobacterium tuberculosis H37Rv
gagcaccgcgaacagcacauau

SEQ ID NO: 1346894 - RNA, 15 nt, Mycobacterium tuberculosis H37Rv
gagcaauuccucagc

SEQ ID NO: 1346895 - RNA, 20 nt, Mycobacterium tuberculosis H37Rv
gagcacaccgacagcaccca

SEQ ID NO: 1346896 - RNA, 19 nt, Mycobacterium tuberculosis H37Rv
gagcacacuccuagccaac

SEQ ID NO: 1346897 - RNA, 14 nt, Mycobacterium tuberculosis H37Rv
gagcacaucgccac

SEQ ID NO: 1346898 - RNA, 17 nt, Mycobacterium tuberculosis H37Rv
gagaucgucgcgaccuu

SEQ ID NO: 1346899 - RNA, 14 nt, Mycobacterium tuberculosis H37Rv
gagaucucugagcg

SEQ ID NO: 1346900 - RNA, 21 nt, Mycobacterium tuberculosis H37Rv
gagaucucugagcgggcgggc

SEQ ID NO: 1346901 - RNA, 20 nt, Mycobacterium tuberculosis H37Rv
gagaugauugccaagcgggu

SEQ ID NO: 1346902 - RNA, 18 nt, Mycobacterium tuberculosis H37Rv
gagaugaucauguggugg

SEQ ID NO: 1346903 - RNA, 16 nt, Mycobacterium tuberculosis H37Rv
gagaugccaucgguga

SEQ ID NO: 1346904 - RNA, 15 nt, Mycobacterium tuberculosis H37Rv
gagauggucgggcgg

SEQ ID NO: 1346905 - RNA, 22 nt, Mycobacterium tuberculosis H37Rv
gagaugccgcgaucgugcaggu

SEQ ID NO: 1346906 - RNA, 15 nt, Mycobacterium tuberculosis H37Rv
gagauugggcuggga

SEQ ID NO: 1346907 - RNA, 15 nt, Mycobacterium tuberculosis H37Rv
gagaucaccgccacc

SEQ ID NO: 1346908 - RNA, 20 nt, Mycobacterium tuberculosis H37Rv
gagaucaccuuggcaagcac

SEQ ID NO: 1346909 - RNA, 12 nt, Mycobacterium tuberculosis H37Rv
gagaucgcccga

SEQ ID NO: 1346910 - RNA, 20 nt, Mycobacterium tuberculosis H37Rv
gagauccugguaaggccggc

SEQ ID NO: 1346911 - RNA, 15 nt, Mycobacterium tuberculosis H37Rv
gagaucaugagguga

SEQ ID NO: 1346912 - RNA, 22 nt, Mycobacterium tuberculosis H37Rv
gagaucauggcgagcguuugga

SEQ ID NO: 1346913 - RNA, 20 nt, Mycobacterium tuberculosis H37Rv
gagauccagcgccuugucua

SEQ ID NO: 1346914 - RNA, 16 nt, Mycobacterium tuberculosis H37Rv
gagaucagucugggcg

SEQ ID NO: 1346915 - RNA, 13 nt, Mycobacterium tuberculosis H37Rv
gagaguggccucg

SEQ ID NO: 1346916 - RNA, 15 nt, Mycobacterium tuberculosis H37Rv
gagaguaggaccucg

SEQ ID NO: 1346917 - RNA, 20 nt, Mycobacterium tuberculosis H37Rv
gagauagcaacgaagccggc

SEQ ID NO: 1346918 - RNA, 14 nt, Mycobacterium tuberculosis H37Rv
gagccgguggcccg

SEQ ID NO: 1346919 - RNA, 19 nt, Mycobacterium tuberculosis H37Rv
gagccgguggcccgccggc

SEQ ID NO: 1346920 - RNA, 20 nt, Mycobacterium tuberculosis H37Rv
gagccggugacgguguuggu

SEQ ID NO: 1346921 - RNA, 17 nt, Mycobacterium tuberculosis H37Rv
gagccgggccguccggg

SEQ ID NO: 1346922 - RNA, 14 nt, Mycobacterium tuberculosis H37Rv
gagccgggcaacca

SEQ ID NO: 1346923 - RNA, 18 nt, Mycobacterium tuberculosis H37Rv
gagccgggcaaccagcag

SEQ ID NO: 1346924 - RNA, 19 nt, Mycobacterium tuberculosis H37Rv
gagccgggcaaccagcagc

SEQ ID NO: 1346925 - RNA, 14 nt, Mycobacterium tuberculosis H37Rv
gagccgcugcggca

SEQ ID NO: 1346926 - RNA, 18 nt, Mycobacterium tuberculosis H37Rv
gagccggacguucuggau

SEQ ID NO: 1346927 - RNA, 13 nt, Mycobacterium tuberculosis H37Rv
gagccggccaccu

SEQ ID NO: 1346928 - RNA, 16 nt, Mycobacterium tuberculosis H37Rv
gagccggcccugcucg

SEQ ID NO: 1346929 - RNA, 14 nt, Mycobacterium tuberculosis H37Rv
gagccgcccaagcc

SEQ ID NO: 1346930 - RNA, 18 nt, Mycobacterium tuberculosis H37Rv
gagccgccaccgaggccg

SEQ ID NO: 1346931 - RNA, 14 nt, Mycobacterium tuberculosis H37Rv
gagccgcgcgccgg

SEQ ID NO: 1346932 - RNA, 21 nt, Mycobacterium tuberculosis H37Rv
gagccgcggucggcgugcagg

SEQ ID NO: 1346933 - RNA, 16 nt, Mycobacterium tuberculosis H37Rv
gagccgccgcgacggc

SEQ ID NO: 1346934 - RNA, 13 nt, Mycobacterium tuberculosis H37Rv
gagccgcagcacc

SEQ ID NO: 1346935 - RNA, 15 nt, Mycobacterium tuberculosis H37Rv
gagccgaucgcccgc

SEQ ID NO: 1346936 - RNA, 16 nt, Mycobacterium tuberculosis H37Rv
gagccgacccgcccga

SEQ ID NO: 1346937 - RNA, 18 nt, Mycobacterium tuberculosis H37Rv
gagccgaggaauacucuc

SEQ ID NO: 1346938 - RNA, 15 nt, Mycobacterium tuberculosis H37Rv
gagccgaggcgggaa

SEQ ID NO: 1346939 - RNA, 18 nt, Mycobacterium tuberculosis H37Rv
gagccgaggugcugcaca

SEQ ID NO: 1346940 - RNA, 18 nt, Mycobacterium tuberculosis H37Rv
gagccgauauaccagggc

SEQ ID NO: 1346941 - RNA, 22 nt, Mycobacterium tuberculosis H37Rv
gagccgacuuugagucguugga

SEQ ID NO: 1346942 - RNA, 18 nt, Mycobacterium tuberculosis H37Rv
gagcccggcgaucagcag

SEQ ID NO: 1346943 - RNA, 22 nt, Mycobacterium tuberculosis H37Rv
gagcccggucccuuuguggggc

SEQ ID NO: 1346944 - RNA, 19 nt, Mycobacterium tuberculosis H37Rv
gagcccgucagcuccccgu

SEQ ID NO: 1346945 - RNA, 17 nt, Mycobacterium tuberculosis H37Rv
gagccccgaccagcaga

SEQ ID NO: 1346946 - RNA, 20 nt, Mycobacterium tuberculosis H37Rv
gagcccgagcucaccgcaca

SEQ ID NO: 1346947 - RNA, 15 nt, Mycobacterium tuberculosis H37Rv
gagcccgccacagcc

SEQ ID NO: 1346948 - RNA, 18 nt, Mycobacterium tuberculosis H37Rv
gagcccgccacagcccca

SEQ ID NO: 1346949 - RNA, 16 nt, Mycobacterium tuberculosis H37Rv
gagccauguccuugga

SEQ ID NO: 1346950 - RNA, 19 nt, Mycobacterium tuberculosis H37Rv
gagcccagccgggcacccu

SEQ ID NO: 1346951 - RNA, 13 nt, Mycobacterium tuberculosis H37Rv
gagccaccaacac

SEQ ID NO: 1346952 - RNA, 16 nt, Mycobacterium tuberculosis H37Rv
gagccaccaacaccgc

SEQ ID NO: 1346953 - RNA, 18 nt, Mycobacterium tuberculosis H37Rv
gagccacucggcccggca

SEQ ID NO: 1346954 - RNA, 18 nt, Mycobacterium tuberculosis H37Rv
gagccacggcuucgccgc

SEQ ID NO: 1346955 - RNA, 15 nt, Mycobacterium tuberculosis H37Rv
gagccacucggcccg

SEQ ID NO: 1346956 - RNA, 18 nt, Mycobacterium tuberculosis H37Rv
gagccagcacccgcagcc

SEQ ID NO: 1346957 - RNA, 16 nt, Mycobacterium tuberculosis H37Rv
gagccauacgcgcuga

SEQ ID NO: 1346958 - RNA, 17 nt, Mycobacterium tuberculosis H37Rv
gagccagggaggggccg

SEQ ID NO: 1346959 - RNA, 17 nt, Mycobacterium tuberculosis H37Rv
gagcaugcccagcgaau

SEQ ID NO: 1346960 - RNA, 16 nt, Mycobacterium tuberculosis H37Rv
gagcaugauguccucc

SEQ ID NO: 1346961 - RNA, 14 nt, Mycobacterium tuberculosis H37Rv
gagcaugauguccu

SEQ ID NO: 1346962 - RNA, 23 nt, Mycobacterium tuberculosis H37Rv
gagcaugccgcccgcgccgccgg

SEQ ID NO: 1346963 - RNA, 16 nt, Mycobacterium tuberculosis H37Rv
gagcaugccguugaca

SEQ ID NO: 1346964 - RNA, 20 nt, Mycobacterium tuberculosis H37Rv
gagcagguaggcgcgauaca

SEQ ID NO: 1346965 - RNA, 14 nt, Mycobacterium tuberculosis H37Rv
gagcagggcggcga

SEQ ID NO: 1346966 - RNA, 21 nt, Mycobacterium tuberculosis H37Rv
gagcagggcucguccaucagc

SEQ ID NO: 1346967 - RNA, 14 nt, Mycobacterium tuberculosis H37Rv
gagcagggccggca

SEQ ID NO: 1346968 - RNA, 16 nt, Mycobacterium tuberculosis H37Rv
gagcaggcgcaccagg

SEQ ID NO: 1346969 - RNA, 11 nt, Mycobacterium tuberculosis H37Rv
gagcagcgcac

SEQ ID NO: 1346970 - RNA, 13 nt, Mycobacterium tuberculosis H37Rv
gagcagccgaugc

SEQ ID NO: 1346971 - RNA, 16 nt, Mycobacterium tuberculosis H37Rv
gagcagccagccaccg

SEQ ID NO: 1346972 - RNA, 13 nt, Mycobacterium tuberculosis H37Rv
gagcagcgcggcc

SEQ ID NO: 1346973 - RNA, 23 nt, Mycobacterium tuberculosis H37Rv
gagcuagccguucggcugccgcg

SEQ ID NO: 1346974 - RNA, 19 nt, Mycobacterium tuberculosis H37Rv
gagcuaccgcuucccccgg

SEQ ID NO: 1346975 - RNA, 22 nt, Mycobacterium tuberculosis H37Rv
gagcucaccgcacaccugcgcg

SEQ ID NO: 1346976 - RNA, 20 nt, Mycobacterium tuberculosis H37Rv
gagcucagcgaugcggcccu

SEQ ID NO: 1346977 - RNA, 19 nt, Mycobacterium tuberculosis H37Rv
gagcucgaugucagcggcc

SEQ ID NO: 1346978 - RNA, 15 nt, Mycobacterium tuberculosis H37Rv
gagcucgaagcccgg

SEQ ID NO: 1346979 - RNA, 17 nt, Mycobacterium tuberculosis H37Rv
gagcucggcgcccagcu

SEQ ID NO: 1346980 - RNA, 15 nt, Mycobacterium tuberculosis H37Rv
gagcugauccgggug

SEQ ID NO: 1346981 - RNA, 11 nt, Mycobacterium tuberculosis H37Rv
gagcugcucgc

SEQ ID NO: 1346982 - RNA, 13 nt, Mycobacterium tuberculosis H37Rv
gagcugcucgccg

SEQ ID NO: 1346983 - RNA, 16 nt, Mycobacterium tuberculosis H37Rv
gagcugaccugguucc

SEQ ID NO: 1346984 - RNA, 17 nt, Mycobacterium tuberculosis H37Rv
gagcugacgauggccag

SEQ ID NO: 1346985 - RNA, 20 nt, Mycobacterium tuberculosis H37Rv
gagcugacgauggccaggcc

SEQ ID NO: 1346986 - RNA, 17 nt, Mycobacterium tuberculosis H37Rv
gagcucuugcgggcagc

SEQ ID NO: 1346987 - RNA, 16 nt, Mycobacterium tuberculosis H37Rv
gagcucggucaccacg

SEQ ID NO: 1346988 - RNA, 20 nt, Mycobacterium tuberculosis H37Rv
gagcgugaaccuggcgacgc

SEQ ID NO: 1346989 - RNA, 19 nt, Mycobacterium tuberculosis H37Rv
gagcgugagccaugccgcu

SEQ ID NO: 1346990 - RNA, 15 nt, Mycobacterium tuberculosis H37Rv
gagcgguugccuucu

SEQ ID NO: 1346991 - RNA, 22 nt, Mycobacterium tuberculosis H37Rv
gagcgguugaucgcguagcugg

SEQ ID NO: 1346992 - RNA, 17 nt, Mycobacterium tuberculosis H37Rv
gagcgguaccccccagc

SEQ ID NO: 1346993 - RNA, 17 nt, Mycobacterium tuberculosis H37Rv
gagcgucaaccacggcc

SEQ ID NO: 1346994 - RNA, 18 nt, Mycobacterium tuberculosis H37Rv
gagcguaguaggcagccu

SEQ ID NO: 1346995 - RNA, 19 nt, Mycobacterium tuberculosis H37Rv
gagcguaguucaccaacgc

SEQ ID NO: 1346996 - RNA, 19 nt, Mycobacterium tuberculosis H37Rv
gagcgguugccauccguca

SEQ ID NO: 1346997 - RNA, 15 nt, Mycobacterium tuberculosis H37Rv
gagcggcgcgggggu

SEQ ID NO: 1346998 - RNA, 16 nt, Mycobacterium tuberculosis H37Rv
gagcgggccagcaccc

SEQ ID NO: 1346999 - RNA, 17 nt, Mycobacterium tuberculosis H37Rv
gagcggcgcgggggugg

SEQ ID NO: 1347000 - RNA, 15 nt, Mycobacterium tuberculosis H37Rv
gagcggcggcacugg

SEQ ID NO: 1347001 - RNA, 16 nt, Mycobacterium tuberculosis H37Rv
gagcggccguggcaug

SEQ ID NO: 1347002 - RNA, 17 nt, Mycobacterium tuberculosis H37Rv
gagcggcuugcgguggc

SEQ ID NO: 1347003 - RNA, 19 nt, Mycobacterium tuberculosis H37Rv
gagcggcuugcgguggcgg

SEQ ID NO: 1347004 - RNA, 22 nt, Mycobacterium tuberculosis H37Rv
gagcggacucgagucugcgcag

SEQ ID NO: 1347005 - RNA, 18 nt, Mycobacterium tuberculosis H37Rv
gagcggccucgggacucc

SEQ ID NO: 1347006 - RNA, 12 nt, Mycobacterium tuberculosis H37Rv
gagcggccgcgc

SEQ ID NO: 1347007 - RNA, 12 nt, Mycobacterium tuberculosis H37Rv
gagcggccggca

SEQ ID NO: 1347008 - RNA, 17 nt, Mycobacterium tuberculosis H37Rv
gagcggccggcaugcug

SEQ ID NO: 1347009 - RNA, 22 nt, Mycobacterium tuberculosis H37Rv
gagcggccaccguagccagcag

SEQ ID NO: 1347010 - RNA, 23 nt, Mycobacterium tuberculosis H37Rv
gagcggcagccaagcgagcggcg

SEQ ID NO: 1347011 - RNA, 13 nt, Mycobacterium tuberculosis H37Rv
gagcgcgccguug

SEQ ID NO: 1347012 - RNA, 18 nt, Mycobacterium tuberculosis H37Rv
gagcgcggugccgccacc

SEQ ID NO: 1347013 - RNA, 14 nt, Mycobacterium tuberculosis H37Rv
gagcgcggcggcgg

SEQ ID NO: 1347014 - RNA, 20 nt, Mycobacterium tuberculosis H37Rv
gagcgcuuggucaaaaagcu

SEQ ID NO: 1347015 - RNA, 18 nt, Mycobacterium tuberculosis H37Rv
gagcgcgccucgcccagc

SEQ ID NO: 1347016 - RNA, 17 nt, Mycobacterium tuberculosis H37Rv
gagcgcgcguagcgggg

SEQ ID NO: 1347017 - RNA, 19 nt, Mycobacterium tuberculosis H37Rv
gagcgcgcguagcggggga

SEQ ID NO: 1347018 - RNA, 12 nt, Mycobacterium tuberculosis H37Rv
gagcgcgcucga

SEQ ID NO: 1347019 - RNA, 19 nt, Mycobacterium tuberculosis H37Rv
gagcgcccgucguaggugg

SEQ ID NO: 1347020 - RNA, 14 nt, Mycobacterium tuberculosis H37Rv
gagcgcccuccucg

SEQ ID NO: 1347021 - RNA, 13 nt, Mycobacterium tuberculosis H37Rv
gagcgccagcgcc

SEQ ID NO: 1347022 - RNA, 20 nt, Mycobacterium tuberculosis H37Rv
gagcgccaggccgcacagca

SEQ ID NO: 1347023 - RNA, 12 nt, Mycobacterium tuberculosis H37Rv
gagcgccaggcc

SEQ ID NO: 1347024 - RNA, 17 nt, Mycobacterium tuberculosis H37Rv
gagcgccaggccgcaca

SEQ ID NO: 1347025 - RNA, 22 nt, Mycobacterium tuberculosis H37Rv
gagcgccaggccgcacagcacc

SEQ ID NO: 1347026 - RNA, 12 nt, Mycobacterium tuberculosis H37Rv
gagcgccgagcu

SEQ ID NO: 1347027 - RNA, 15 nt, Mycobacterium tuberculosis H37Rv
gagcgccgcggcgga

SEQ ID NO: 1347028 - RNA, 22 nt, Mycobacterium tuberculosis H37Rv
gagcgccacgccgaggcguucg

SEQ ID NO: 1347029 - RNA, 12 nt, Mycobacterium tuberculosis H37Rv
gagcgcaccgcu

SEQ ID NO: 1347030 - RNA, 20 nt, Mycobacterium tuberculosis H37Rv
gagcgcaccgcugaccgcaa

SEQ ID NO: 1347031 - RNA, 16 nt, Mycobacterium tuberculosis H37Rv
gagcgcacucaccuug

SEQ ID NO: 1347032 - RNA, 21 nt, Mycobacterium tuberculosis H37Rv
gagcgcagcgccggcagcagc

SEQ ID NO: 1347033 - RNA, 16 nt, Mycobacterium tuberculosis H37Rv
gagccugauaaagccc

SEQ ID NO: 1347034 - RNA, 15 nt, Mycobacterium tuberculosis H37Rv
gagccucgcgcgcca

SEQ ID NO: 1347035 - RNA, 19 nt, Mycobacterium tuberculosis H37Rv
gagccugcaggccgccggc

SEQ ID NO: 1347036 - RNA, 14 nt, Mycobacterium tuberculosis H37Rv
gagccuccauggcc

SEQ ID NO: 1347037 - RNA, 18 nt, Mycobacterium tuberculosis H37Rv
gagccgucggcgccucgg

SEQ ID NO: 1347038 - RNA, 13 nt, Mycobacterium tuberculosis H37Rv
gagccgugccagc

SEQ ID NO: 1347039 - RNA, 17 nt, Mycobacterium tuberculosis H37Rv
gagccgugccgccagca

SEQ ID NO: 1347040 - RNA, 20 nt, Mycobacterium tuberculosis H37Rv
gagccgugccgccagcaacc

SEQ ID NO: 1347041 - RNA, 22 nt, Mycobacterium tuberculosis H37Rv
gagccguccaauuccgcagaga

SEQ ID NO: 1347042 - RNA, 22 nt, Mycobacterium tuberculosis H37Rv
gagccgucgaagcgaacacccg

SEQ ID NO: 1347043 - RNA, 22 nt, Mycobacterium tuberculosis H37Rv
gagcgaggcucccccaccaggg

SEQ ID NO: 1347044 - RNA, 14 nt, Mycobacterium tuberculosis H37Rv
gagcgagccaacuc

SEQ ID NO: 1347045 - RNA, 19 nt, Mycobacterium tuberculosis H37Rv
gagcgagcucccgggcgcu

SEQ ID NO: 1347046 - RNA, 16 nt, Mycobacterium tuberculosis H37Rv
gagcgaguccagcgca

SEQ ID NO: 1347047 - RNA, 18 nt, Mycobacterium tuberculosis H37Rv
gagcgauacgucgucagc

SEQ ID NO: 1347048 - RNA, 22 nt, Mycobacterium tuberculosis H37Rv
gagcgaacgggcuuccgacaug

SEQ ID NO: 1347049 - RNA, 14 nt, Mycobacterium tuberculosis H37Rv
gagcgaacccccgc

SEQ ID NO: 1347050 - RNA, 21 nt, Mycobacterium tuberculosis H37Rv
gagcgaccgcgagggccagca

SEQ ID NO: 1347051 - RNA, 14 nt, Mycobacterium tuberculosis H37Rv
gagcgacccccagc

SEQ ID NO: 1347052 - RNA, 17 nt, Mycobacterium tuberculosis H37Rv
gagcgacccccagcgcc

SEQ ID NO: 1347053 - RNA, 21 nt, Mycobacterium tuberculosis H37Rv
gaggaaccccggucgggguuu

SEQ ID NO: 1347054 - RNA, 22 nt, Mycobacterium tuberculosis H37Rv
gaggaacuugcauccggcccac

SEQ ID NO: 1347055 - RNA, 10 nt, Mycobacterium tuberculosis H37Rv
gaggaagccc

SEQ ID NO: 1347056 - RNA, 19 nt, Mycobacterium tuberculosis H37Rv
gaggaaucguucggggugg

SEQ ID NO: 1347057 - RNA, 23 nt, Mycobacterium tuberculosis H37Rv
gaggaaggugugcgucuccagcu

SEQ ID NO: 1347058 - RNA, 16 nt, Mycobacterium tuberculosis H37Rv
gaggacggcggccagg

SEQ ID NO: 1347059 - RNA, 23 nt, Mycobacterium tuberculosis H37Rv
gaggaccucgucaccggucagcg

SEQ ID NO: 1347060 - RNA, 14 nt, Mycobacterium tuberculosis H37Rv
gaggaccugcucgg

SEQ ID NO: 1347061 - RNA, 12 nt, Mycobacterium tuberculosis H37Rv
gaggacggcuug

SEQ ID NO: 1347062 - RNA, 18 nt, Mycobacterium tuberculosis H37Rv
gaggacggcuugagccgc

SEQ ID NO: 1347063 - RNA, 21 nt, Mycobacterium tuberculosis H37Rv
gaggacgccggcgccgccauu

SEQ ID NO: 1347064 - RNA, 16 nt, Mycobacterium tuberculosis H37Rv
gaggaccugcucgggc

SEQ ID NO: 1347065 - RNA, 17 nt, Mycobacterium tuberculosis H37Rv
gagcuggcugacgauuu

SEQ ID NO: 1347066 - RNA, 22 nt, Mycobacterium tuberculosis H37Rv
gagcuggcgcgcgggguggcgg

SEQ ID NO: 1347067 - RNA, 16 nt, Mycobacterium tuberculosis H37Rv
gagcuguaggucagcg

SEQ ID NO: 1347068 - RNA, 15 nt, Mycobacterium tuberculosis H37Rv
gagcuguaggucagc

SEQ ID NO: 1347069 - RNA, 14 nt, Mycobacterium tuberculosis H37Rv
gagcuguggcgggc

SEQ ID NO: 1347070 - RNA, 12 nt, Mycobacterium tuberculosis H37Rv
gagcuucgccgc

SEQ ID NO: 1347071 - RNA, 16 nt, Mycobacterium tuberculosis H37Rv
gagcuugggccggugc

SEQ ID NO: 1347072 - RNA, 15 nt, Mycobacterium tuberculosis H37Rv
gagcuuuaucugcau

SEQ ID NO: 1347073 - RNA, 22 nt, Mycobacterium tuberculosis H37Rv
gagcuugggccggugcagcacg

SEQ ID NO: 1347074 - RNA, 18 nt, Mycobacterium tuberculosis H37Rv
gagcuugguggccaccac

SEQ ID NO: 1347075 - RNA, 21 nt, Mycobacterium tuberculosis H37Rv
gagcuugguggccaccacggc

SEQ ID NO: 1347076 - RNA, 17 nt, Mycobacterium tuberculosis H37Rv
gagcuuggccagcagca

SEQ ID NO: 1347077 - RNA, 21 nt, Mycobacterium tuberculosis H37Rv
gaggccaaguugcagcgggcc

SEQ ID NO: 1347078 - RNA, 18 nt, Mycobacterium tuberculosis H37Rv
gaggccaaguugcagcgg

SEQ ID NO: 1347079 - RNA, 13 nt, Mycobacterium tuberculosis H37Rv
gaggccaccgcga

SEQ ID NO: 1347080 - RNA, 11 nt, Mycobacterium tuberculosis H37Rv
gaggccagcag

SEQ ID NO: 1347081 - RNA, 15 nt, Mycobacterium tuberculosis H37Rv
gaggcauucucccgg

SEQ ID NO: 1347082 - RNA, 18 nt, Mycobacterium tuberculosis H37Rv
gaggccgccaucgccgcc

SEQ ID NO: 1347083 - RNA, 23 nt, Mycobacterium tuberculosis H37Rv
gaggcccgccacaacggcggcgc

SEQ ID NO: 1347084 - RNA, 13 nt, Mycobacterium tuberculosis H37Rv
gaggcccgggugc

SEQ ID NO: 1347085 - RNA, 19 nt, Mycobacterium tuberculosis H37Rv
gaggcccgucacaaugccc

SEQ ID NO: 1347086 - RNA, 12 nt, Mycobacterium tuberculosis H37Rv
gaggccccccgc

SEQ ID NO: 1347087 - RNA, 13 nt, Mycobacterium tuberculosis H37Rv
gaggccagcagcu

SEQ ID NO: 1347088 - RNA, 20 nt, Mycobacterium tuberculosis H37Rv
gaggccuaccaggcgcggcc

SEQ ID NO: 1347089 - RNA, 15 nt, Mycobacterium tuberculosis H37Rv
gaggccucggccagc

SEQ ID NO: 1347090 - RNA, 15 nt, Mycobacterium tuberculosis H37Rv
gaggccgcugccagg

SEQ ID NO: 1347091 - RNA, 16 nt, Mycobacterium tuberculosis H37Rv
gaggccaaccacagcc

SEQ ID NO: 1347092 - RNA, 13 nt, Mycobacterium tuberculosis H37Rv
gaggccgccguug

SEQ ID NO: 1347093 - RNA, 14 nt, Mycobacterium tuberculosis H37Rv
gaggccggugaacg

SEQ ID NO: 1347094 - RNA, 16 nt, Mycobacterium tuberculosis H37Rv
gaggcgcagcgccagc

SEQ ID NO: 1347095 - RNA, 15 nt, Mycobacterium tuberculosis H37Rv
gaggcgcuucgccac

SEQ ID NO: 1347096 - RNA, 19 nt, Mycobacterium tuberculosis H37Rv
gaggcgaucaccgcgccgg

SEQ ID NO: 1347097 - RNA, 13 nt, Mycobacterium tuberculosis H37Rv
gaggcgcggucga

SEQ ID NO: 1347098 - RNA, 17 nt, Mycobacterium tuberculosis H37Rv
gaggcacaaucaccgcc

SEQ ID NO: 1347099 - RNA, 16 nt, Mycobacterium tuberculosis H37Rv
gaggauuugguggcug

SEQ ID NO: 1347100 - RNA, 13 nt, Mycobacterium tuberculosis H37Rv
gaggcaacaagca

SEQ ID NO: 1347101 - RNA, 19 nt, Mycobacterium tuberculosis H37Rv
gaggauguaguuggugaug

SEQ ID NO: 1347102 - RNA, 22 nt, Mycobacterium tuberculosis H37Rv
gaggaugacgacggugaccggg

SEQ ID NO: 1347103 - RNA, 19 nt, Mycobacterium tuberculosis H37Rv
gaggauccgcaccacgccc

SEQ ID NO: 1347104 - RNA, 15 nt, Mycobacterium tuberculosis H37Rv
gaggaucgcugguug

SEQ ID NO: 1347105 - RNA, 14 nt, Mycobacterium tuberculosis H37Rv
gaggaggcggucga

SEQ ID NO: 1347106 - RNA, 13 nt, Mycobacterium tuberculosis H37Rv
gacgggacccggg

SEQ ID NO: 1347107 - RNA, 17 nt, Mycobacterium tuberculosis H37Rv
gacgggcacaaccagau

SEQ ID NO: 1347108 - RNA, 21 nt, Mycobacterium tuberculosis H37Rv
gacgggcacccgagccgcaca

SEQ ID NO: 1347109 - RNA, 15 nt, Mycobacterium tuberculosis H37Rv
gacgggcacgcggcg

SEQ ID NO: 1347110 - RNA, 22 nt, Mycobacterium tuberculosis H37Rv
gacgggccacgaugcgcacacc

SEQ ID NO: 1347111 - RNA, 21 nt, Mycobacterium tuberculosis H37Rv
gacggggcaaaggagccguug

SEQ ID NO: 1347112 - RNA, 15 nt, Mycobacterium tuberculosis H37Rv
gacggggcaaaggag

SEQ ID NO: 1347113 - RNA, 17 nt, Mycobacterium tuberculosis H37Rv
gacggggugagccgacc

SEQ ID NO: 1347114 - RNA, 23 nt, Mycobacterium tuberculosis H37Rv
gacgggguuguggucgaguugaa

SEQ ID NO: 1347115 - RNA, 18 nt, Mycobacterium tuberculosis H37Rv
gacgggucggcgccgagc

SEQ ID NO: 1347116 - RNA, 14 nt, Mycobacterium tuberculosis H37Rv
gacggcggccagga

SEQ ID NO: 1347117 - RNA, 13 nt, Mycobacterium tuberculosis H37Rv
gacggcgccaggc

SEQ ID NO: 1347118 - RNA, 22 nt, Mycobacterium tuberculosis H37Rv
gacggcgccauuggcgucccgc

SEQ ID NO: 1347119 - RNA, 14 nt, Mycobacterium tuberculosis H37Rv
gacggcgucacccg

SEQ ID NO: 1347120 - RNA, 12 nt, Mycobacterium tuberculosis H37Rv
gacggcggucag

SEQ ID NO: 1347121 - RNA, 14 nt, Mycobacterium tuberculosis H37Rv
gacggcggccuucg

SEQ ID NO: 1347122 - RNA, 20 nt, Mycobacterium tuberculosis H37Rv
gacggcucagcgugcgcugg

SEQ ID NO: 1347123 - RNA, 21 nt, Mycobacterium tuberculosis H37Rv
gacggcuucggcagccgcaua

SEQ ID NO: 1347124 - RNA, 20 nt, Mycobacterium tuberculosis H37Rv
gacgggaaacuccgcggcgc

SEQ ID NO: 1347125 - RNA, 13 nt, Mycobacterium tuberculosis H37Rv
gacgguccguucg

SEQ ID NO: 1347126 - RNA, 14 nt, Mycobacterium tuberculosis H37Rv
gacggugauggggg

SEQ ID NO: 1347127 - RNA, 17 nt, Mycobacterium tuberculosis H37Rv
gacggucaaggugcgcc

SEQ ID NO: 1347128 - RNA, 19 nt, Mycobacterium tuberculosis H37Rv
gacggggucgcccggggcg

SEQ ID NO: 1347129 - RNA, 16 nt, Mycobacterium tuberculosis H37Rv
gacggguggcccgacc

SEQ ID NO: 1347130 - RNA, 20 nt, Mycobacterium tuberculosis H37Rv
gacgguguugguggcggggu

SEQ ID NO: 1347131 - RNA, 11 nt, Mycobacterium tuberculosis H37Rv
gacggugguga

SEQ ID NO: 1347132 - RNA, 22 nt, Mycobacterium tuberculosis H37Rv
gacgguggugaccgcgggcgcc

SEQ ID NO: 1347133 - RNA, 17 nt, Mycobacterium tuberculosis H37Rv
gacgguggugaucacgu

SEQ ID NO: 1347134 - RNA, 13 nt, Mycobacterium tuberculosis H37Rv
gacgguguagccc

SEQ ID NO: 1347135 - RNA, 21 nt, Mycobacterium tuberculosis H37Rv
gacguacggggucgccggcac

SEQ ID NO: 1347136 - RNA, 16 nt, Mycobacterium tuberculosis H37Rv
gacguacagcgcggcg

SEQ ID NO: 1347137 - RNA, 15 nt, Mycobacterium tuberculosis H37Rv
gacguaggcggcggc

SEQ ID NO: 1347138 - RNA, 16 nt, Mycobacterium tuberculosis H37Rv
gacguaggcggcggcc

SEQ ID NO: 1347139 - RNA, 11 nt, Mycobacterium tuberculosis H37Rv
gacguagacgg

SEQ ID NO: 1347140 - RNA, 14 nt, Mycobacterium tuberculosis H37Rv
gacguaggccaggu

SEQ ID NO: 1347141 - RNA, 19 nt, Mycobacterium tuberculosis H37Rv
gacgugccgguccccccgu

SEQ ID NO: 1347142 - RNA, 18 nt, Mycobacterium tuberculosis H37Rv
gacgugcaggaacaccca

SEQ ID NO: 1347143 - RNA, 20 nt, Mycobacterium tuberculosis H37Rv
gacgugaucgcgguccaaca

SEQ ID NO: 1347144 - RNA, 17 nt, Mycobacterium tuberculosis H37Rv
gacgugaaugguggugu

SEQ ID NO: 1347145 - RNA, 15 nt, Mycobacterium tuberculosis H37Rv
gacgugaaugguggu

SEQ ID NO: 1347146 - RNA, 19 nt, Mycobacterium tuberculosis H37Rv
gacgugaagaugcccuucg

SEQ ID NO: 1347147 - RNA, 19 nt, Mycobacterium tuberculosis H37Rv
gacgucuuggaacacggcc

SEQ ID NO: 1347148 - RNA, 23 nt, Mycobacterium tuberculosis H37Rv
gacgucuuugacgaacuggucuc

SEQ ID NO: 1347149 - RNA, 17 nt, Mycobacterium tuberculosis H37Rv
gacgugaagaugcccuu

SEQ ID NO: 1347150 - RNA, 18 nt, Mycobacterium tuberculosis H37Rv
gacgugaguuucaccacu

SEQ ID NO: 1347151 - RNA, 15 nt, Mycobacterium tuberculosis H37Rv
gacguggaugguggu

SEQ ID NO: 1347152 - RNA, 23 nt, Mycobacterium tuberculosis H37Rv
gacgugguguaucgacggcggcc

SEQ ID NO: 1347153 - RNA, 23 nt, Mycobacterium tuberculosis H37Rv
gacgucgacgccggccagcggcc

SEQ ID NO: 1347154 - RNA, 23 nt, Mycobacterium tuberculosis H37Rv
gacgucgauggugcggcccaacc

SEQ ID NO: 1347155 - RNA, 20 nt, Mycobacterium tuberculosis H37Rv
gacgucgccaagaccagaag

SEQ ID NO: 1347156 - RNA, 13 nt, Mycobacterium tuberculosis H37Rv
gacguccaucccg

SEQ ID NO: 1347157 - RNA, 17 nt, Mycobacterium tuberculosis H37Rv
gacguccaccagccggu

SEQ ID NO: 1347158 - RNA, 13 nt, Mycobacterium tuberculosis H37Rv
gacgucaggcuga

SEQ ID NO: 1347159 - RNA, 18 nt, Mycobacterium tuberculosis H37Rv
gacgucucuggugcaggu

SEQ ID NO: 1347160 - RNA, 15 nt, Mycobacterium tuberculosis H37Rv
gacgucguggcgcuc

SEQ ID NO: 1347161 - RNA, 19 nt, Mycobacterium tuberculosis H37Rv
gacgucggcaucggcggcg

SEQ ID NO: 1347162 - RNA, 15 nt, Mycobacterium tuberculosis H37Rv
gacguccugggcccg

SEQ ID NO: 1347163 - RNA, 19 nt, Mycobacterium tuberculosis H37Rv
gacgucgucgucgacggcc

SEQ ID NO: 1347164 - RNA, 15 nt, Mycobacterium tuberculosis H37Rv
gacguuucagccggg

SEQ ID NO: 1347165 - RNA, 15 nt, Mycobacterium tuberculosis H37Rv
gacguucuugggacc

SEQ ID NO: 1347166 - RNA, 13 nt, Mycobacterium tuberculosis H37Rv
gacguugaagccg

SEQ ID NO: 1347167 - RNA, 15 nt, Mycobacterium tuberculosis H37Rv
gacguugcagccggc

SEQ ID NO: 1347168 - RNA, 17 nt, Mycobacterium tuberculosis H37Rv
gacguugcagccggcau

SEQ ID NO: 1347169 - RNA, 11 nt, Mycobacterium tuberculosis H37Rv
gacguugcgua

SEQ ID NO: 1347170 - RNA, 17 nt, Mycobacterium tuberculosis H37Rv
gacguugugccuuagcu

SEQ ID NO: 1347171 - RNA, 19 nt, Mycobacterium tuberculosis H37Rv
gacucugcguccaccacgc

SEQ ID NO: 1347172 - RNA, 17 nt, Mycobacterium tuberculosis H37Rv
gacucugccacccagca

SEQ ID NO: 1347173 - RNA, 22 nt, Mycobacterium tuberculosis H37Rv
gacucugcgucugcucaccagc

SEQ ID NO: 1347174 - RNA, 20 nt, Mycobacterium tuberculosis H37Rv
gacucgguugaggacgaggu

SEQ ID NO: 1347175 - RNA, 20 nt, Mycobacterium tuberculosis H37Rv
gacucgucgcaucaccaggg

SEQ ID NO: 1347176 - RNA, 18 nt, Mycobacterium tuberculosis H37Rv
gacucgggcaggccccac

SEQ ID NO: 1347177 - RNA, 19 nt, Mycobacterium tuberculosis H37Rv
gacugauccucgaugacau

SEQ ID NO: 1347178 - RNA, 17 nt, Mycobacterium tuberculosis H37Rv
gacugaucugugggugg

SEQ ID NO: 1347179 - RNA, 18 nt, Mycobacterium tuberculosis H37Rv
gacugaucuguggguggu

SEQ ID NO: 1347180 - RNA, 14 nt, Mycobacterium tuberculosis H37Rv
gacugaacaccaaa

SEQ ID NO: 1347181 - RNA, 19 nt, Mycobacterium tuberculosis H37Rv
gacugaaucgaccggaacu

SEQ ID NO: 1347182 - RNA, 16 nt, Mycobacterium tuberculosis H37Rv
gacugcgaaugcuggg

SEQ ID NO: 1347183 - RNA, 17 nt, Mycobacterium tuberculosis H37Rv
gacugcgaaugcugggc

SEQ ID NO: 1347184 - RNA, 17 nt, Mycobacterium tuberculosis H37Rv
gacugccguucagcggc

SEQ ID NO: 1347185 - RNA, 16 nt, Mycobacterium tuberculosis H37Rv
gacugcagcccugcgc

SEQ ID NO: 1347186 - RNA, 16 nt, Mycobacterium tuberculosis H37Rv
gacugcagcggcgcau

SEQ ID NO: 1347187 - RNA, 14 nt, Mycobacterium tuberculosis H37Rv
gacugcagcccugc

SEQ ID NO: 1347188 - RNA, 22 nt, Mycobacterium tuberculosis H37Rv
gacugaucugugggugguugug

SEQ ID NO: 1347189 - RNA, 21 nt, Mycobacterium tuberculosis H37Rv
gacugaucaagugccagcgug

SEQ ID NO: 1347190 - RNA, 14 nt, Mycobacterium tuberculosis H37Rv
gacugcacaccacc

SEQ ID NO: 1347191 - RNA, 17 nt, Mycobacterium tuberculosis H37Rv
gacugcacaccaccgcc

SEQ ID NO: 1347192 - RNA, 18 nt, Mycobacterium tuberculosis H37Rv
gacugcaacucuucccau

SEQ ID NO: 1347193 - RNA, 17 nt, Mycobacterium tuberculosis H37Rv
gacugcgucggcggcuu

SEQ ID NO: 1347194 - RNA, 14 nt, Mycobacterium tuberculosis H37Rv
gacugcgggccagc

SEQ ID NO: 1347195 - RNA, 15 nt, Mycobacterium tuberculosis H37Rv
gacugcgcggcacuu

SEQ ID NO: 1347196 - RNA, 13 nt, Mycobacterium tuberculosis H37Rv
gacugcgccgccg

SEQ ID NO: 1347197 - RNA, 13 nt, Mycobacterium tuberculosis H37Rv
gacugcgcggcuu

SEQ ID NO: 1347198 - RNA, 13 nt, Mycobacterium tuberculosis H37Rv
gacugcggaagcc

SEQ ID NO: 1347199 - RNA, 14 nt, Mycobacterium tuberculosis H37Rv
gacugcggaagcca

SEQ ID NO: 1347200 - RNA, 21 nt, Mycobacterium tuberculosis H37Rv
gacugcggauaggugccgcgg

SEQ ID NO: 1347201 - RNA, 16 nt, Mycobacterium tuberculosis H37Rv
gacuggcaccgccagc

SEQ ID NO: 1347202 - RNA, 15 nt, Mycobacterium tuberculosis H37Rv
gacuggcaggccggc

SEQ ID NO: 1347203 - RNA, 15 nt, Mycobacterium tuberculosis H37Rv
gacucacccacccgc

SEQ ID NO: 1347204 - RNA, 20 nt, Mycobacterium tuberculosis H37Rv
gacuccagcaccagcacggc

SEQ ID NO: 1347205 - RNA, 21 nt, Mycobacterium tuberculosis H37Rv
gacuccaccccacccagcgac

SEQ ID NO: 1347206 - RNA, 13 nt, Mycobacterium tuberculosis H37Rv
gacucgccaccgc

SEQ ID NO: 1347207 - RNA, 13 nt, Mycobacterium tuberculosis H37Rv
gacucgacaauuc

SEQ ID NO: 1347208 - RNA, 21 nt, Mycobacterium tuberculosis H37Rv
gacucggucucauagugcagg

SEQ ID NO: 1347209 - RNA, 17 nt, Mycobacterium tuberculosis H37Rv
gacucggccgcaccagc

SEQ ID NO: 1347210 - RNA, 17 nt, Mycobacterium tuberculosis H37Rv
gacucggcaccgcggcc

SEQ ID NO: 1347211 - RNA, 16 nt, Mycobacterium tuberculosis H37Rv
gacucggccgacgaga

SEQ ID NO: 1347212 - RNA, 19 nt, Mycobacterium tuberculosis H37Rv
gacucggaauucggcgucg

SEQ ID NO: 1347213 - RNA, 17 nt, Mycobacterium tuberculosis H37Rv
gacuccgcgcgcugggc

SEQ ID NO: 1347214 - RNA, 18 nt, Mycobacterium tuberculosis H37Rv
gacuccugcggcaccgcu

SEQ ID NO: 1347215 - RNA, 13 nt, Mycobacterium tuberculosis H37Rv
gacuccugggcca

SEQ ID NO: 1347216 - RNA, 21 nt, Mycobacterium tuberculosis H37Rv
gacuccugggccaacacagcg

SEQ ID NO: 1347217 - RNA, 15 nt, Mycobacterium tuberculosis H37Rv
gacuagacgccgccg

SEQ ID NO: 1347218 - RNA, 15 nt, Mycobacterium tuberculosis H37Rv
gacuacccagccagc

SEQ ID NO: 1347219 - RNA, 16 nt, Mycobacterium tuberculosis H37Rv
gacuacccagccagcc

SEQ ID NO: 1347220 - RNA, 19 nt, Mycobacterium tuberculosis H37Rv
gacuaccgccggcggcggc

SEQ ID NO: 1347221 - RNA, 18 nt, Mycobacterium tuberculosis H37Rv
gacuugcaggcgucccag

SEQ ID NO: 1347222 - RNA, 17 nt, Mycobacterium tuberculosis H37Rv
gacuugccgaccccgga

SEQ ID NO: 1347223 - RNA, 15 nt, Mycobacterium tuberculosis H37Rv
gacuugcgcgcggca

SEQ ID NO: 1347224 - RNA, 18 nt, Mycobacterium tuberculosis H37Rv
gacuucggggucaccggc

SEQ ID NO: 1347225 - RNA, 22 nt, Mycobacterium tuberculosis H37Rv
gacuucggaaaggucggccugc

SEQ ID NO: 1347226 - RNA, 18 nt, Mycobacterium tuberculosis H37Rv
gacuuccgcgucgccggc

SEQ ID NO: 1347227 - RNA, 17 nt, Mycobacterium tuberculosis H37Rv
gacuucagcauggugga

SEQ ID NO: 1347228 - RNA, 19 nt, Mycobacterium tuberculosis H37Rv
gacuggggcacgccaugga

SEQ ID NO: 1347229 - RNA, 16 nt, Mycobacterium tuberculosis H37Rv
gacuggucacugcccu

SEQ ID NO: 1347230 - RNA, 20 nt, Mycobacterium tuberculosis H37Rv
gacuggcgugaacguucuuc

SEQ ID NO: 1347231 - RNA, 15 nt, Mycobacterium tuberculosis H37Rv
gacuggcgcccagcc

SEQ ID NO: 1347232 - RNA, 19 nt, Mycobacterium tuberculosis H37Rv
gacuggcgcccagccggaa

SEQ ID NO: 1347233 - RNA, 23 nt, Mycobacterium tuberculosis H37Rv
gacuguucgggaugcagcuguaa

SEQ ID NO: 1347234 - RNA, 16 nt, Mycobacterium tuberculosis H37Rv
gacugucccaccaggu

SEQ ID NO: 1347235 - RNA, 15 nt, Mycobacterium tuberculosis H37Rv
gacugucccagcucc

SEQ ID NO: 1347236 - RNA, 17 nt, Mycobacterium tuberculosis H37Rv
gacuugugccacuucuu

SEQ ID NO: 1347237 - RNA, 19 nt, Mycobacterium tuberculosis H37Rv
gacuuguccaucacaucca

SEQ ID NO: 1347238 - RNA, 16 nt, Mycobacterium tuberculosis H37Rv
gacuuggccaugcugg

SEQ ID NO: 1347239 - RNA, 18 nt, Mycobacterium tuberculosis H37Rv
gagaaacccgaaguagaa

SEQ ID NO: 1347240 - RNA, 14 nt, Mycobacterium tuberculosis H37Rv
gagacuccagcaag

SEQ ID NO: 1347241 - RNA, 13 nt, Mycobacterium tuberculosis H37Rv
gagacuuggggcg

SEQ ID NO: 1347242 - RNA, 21 nt, Mycobacterium tuberculosis H37Rv
gagaccucgucgucgaaguug

SEQ ID NO: 1347243 - RNA, 20 nt, Mycobacterium tuberculosis H37Rv
gagaccggccgggugaacca

SEQ ID NO: 1347244 - RNA, 17 nt, Mycobacterium tuberculosis H37Rv
gagaccgcggccggccg

SEQ ID NO: 1347245 - RNA, 14 nt, Mycobacterium tuberculosis H37Rv
gagaccggcaccgg

SEQ ID NO: 1347246 - RNA, 16 nt, Mycobacterium tuberculosis H37Rv
gagaccggcaccggcc

SEQ ID NO: 1347247 - RNA, 14 nt, Mycobacterium tuberculosis H37Rv
gagaccggccgggu

SEQ ID NO: 1347248 - RNA, 18 nt, Mycobacterium tuberculosis H37Rv
gagaccuucgggguaguu

SEQ ID NO: 1347249 - RNA, 14 nt, Mycobacterium tuberculosis H37Rv
gagacgaucgccag

SEQ ID NO: 1347250 - RNA, 16 nt, Mycobacterium tuberculosis H37Rv
gagacgcuccaguggc

SEQ ID NO: 1347251 - RNA, 20 nt, Mycobacterium tuberculosis H37Rv
gagacgcuccaguggcgcca

SEQ ID NO: 1347252 - RNA, 22 nt, Mycobacterium tuberculosis H37Rv
gagagccugcucgcagcgggcg

SEQ ID NO: 1347253 - RNA, 15 nt, Mycobacterium tuberculosis H37Rv
gagaggcggugcagc

SEQ ID NO: 1347254 - RNA, 21 nt, Mycobacterium tuberculosis H37Rv
gagaggccaagauggcgcgcu

SEQ ID NO: 1347255 - RNA, 14 nt, Mycobacterium tuberculosis H37Rv
gagagcagccagcc

SEQ ID NO: 1347256 - RNA, 21 nt, Mycobacterium tuberculosis H37Rv
gagagaguaucgacccgauga

SEQ ID NO: 1347257 - RNA, 18 nt, Mycobacterium tuberculosis H37Rv
gagagccccgaccagcag

SEQ ID NO: 1347258 - RNA, 18 nt, Mycobacterium tuberculosis H37Rv
gagaagucgcagcgagga

SEQ ID NO: 1347259 - RNA, 12 nt, Mycobacterium tuberculosis H37Rv
gagaagacaccg

SEQ ID NO: 1347260 - RNA, 18 nt, Mycobacterium tuberculosis H37Rv
gagaagagauccuggagg

SEQ ID NO: 1347261 - RNA, 15 nt, Mycobacterium tuberculosis H37Rv
gagaacuugagcucc

SEQ ID NO: 1347262 - RNA, 17 nt, Mycobacterium tuberculosis H37Rv
gagaacuugagcuccuc

SEQ ID NO: 1347263 - RNA, 19 nt, Mycobacterium tuberculosis H37Rv
gagaacgcccgagugacca

SEQ ID NO: 1347264 - RNA, 18 nt, Mycobacterium tuberculosis H37Rv
gagaacgcccgcugcaga

SEQ ID NO: 1347265 - RNA, 15 nt, Mycobacterium tuberculosis H37Rv
gagaacguagggugg

SEQ ID NO: 1347266 - RNA, 19 nt, Mycobacterium tuberculosis H37Rv
gagacaugucgcugccgcc

SEQ ID NO: 1347267 - RNA, 14 nt, Mycobacterium tuberculosis H37Rv
gagaauuccccagc

SEQ ID NO: 1347268 - RNA, 18 nt, Mycobacterium tuberculosis H37Rv
gagaauuccccagccgca

SEQ ID NO: 1347269 - RNA, 16 nt, Mycobacterium tuberculosis H37Rv
gaccgggccgcacggu

SEQ ID NO: 1347270 - RNA, 17 nt, Mycobacterium tuberculosis H37Rv
gaccgggaacagggugg

SEQ ID NO: 1347271 - RNA, 21 nt, Mycobacterium tuberculosis H37Rv
gaccggcuugcccuccgggua

SEQ ID NO: 1347272 - RNA, 18 nt, Mycobacterium tuberculosis H37Rv
gaccggucacccgugcuu

SEQ ID NO: 1347273 - RNA, 21 nt, Mycobacterium tuberculosis H37Rv
gaccggggcgcccggccaggu

SEQ ID NO: 1347274 - RNA, 16 nt, Mycobacterium tuberculosis H37Rv
gaccgggcuggccagc

SEQ ID NO: 1347275 - RNA, 13 nt, Mycobacterium tuberculosis H37Rv
gaccgucacugau

SEQ ID NO: 1347276 - RNA, 22 nt, Mycobacterium tuberculosis H37Rv
gaccgucacugaugggccgguu

SEQ ID NO: 1347277 - RNA, 16 nt, Mycobacterium tuberculosis H37Rv
gaccguauugaccagc

SEQ ID NO: 1347278 - RNA, 21 nt, Mycobacterium tuberculosis H37Rv
gaccguauugaccagcggggu

SEQ ID NO: 1347279 - RNA, 16 nt, Mycobacterium tuberculosis H37Rv
gaccguaccgauccag

SEQ ID NO: 1347280 - RNA, 16 nt, Mycobacterium tuberculosis H37Rv
gaccgggcucuggcca

SEQ ID NO: 1347281 - RNA, 20 nt, Mycobacterium tuberculosis H37Rv
gaccggucggugaugguuuc

SEQ ID NO: 1347282 - RNA, 18 nt, Mycobacterium tuberculosis H37Rv
gaccgguucccgggcagc

SEQ ID NO: 1347283 - RNA, 20 nt, Mycobacterium tuberculosis H37Rv
gaccgguuucuucggccagc

SEQ ID NO: 1347284 - RNA, 21 nt, Mycobacterium tuberculosis H37Rv
gaccgguuucuucggccagcu

SEQ ID NO: 1347285 - RNA, 17 nt, Mycobacterium tuberculosis H37Rv
gaccgguacccguagca

SEQ ID NO: 1347286 - RNA, 18 nt, Mycobacterium tuberculosis H37Rv
gaccggucuggcgaugac

SEQ ID NO: 1347287 - RNA, 18 nt, Mycobacterium tuberculosis H37Rv
gaccggaacguuccugca

SEQ ID NO: 1347288 - RNA, 23 nt, Mycobacterium tuberculosis H37Rv
gaccggacaaacaucgcacccac

SEQ ID NO: 1347289 - RNA, 18 nt, Mycobacterium tuberculosis H37Rv
gaccggcaacgcggccuu

SEQ ID NO: 1347290 - RNA, 16 nt, Mycobacterium tuberculosis H37Rv
gaccggcaccggccgg

SEQ ID NO: 1347291 - RNA, 13 nt, Mycobacterium tuberculosis H37Rv
gaccggcgggcag

SEQ ID NO: 1347292 - RNA, 18 nt, Mycobacterium tuberculosis H37Rv
gaccggccuggcucgucc

SEQ ID NO: 1347293 - RNA, 15 nt, Mycobacterium tuberculosis H37Rv
gaccggccggccgcg

SEQ ID NO: 1347294 - RNA, 15 nt, Mycobacterium tuberculosis H37Rv
gaccggcucgucggg

SEQ ID NO: 1347295 - RNA, 19 nt, Mycobacterium tuberculosis H37Rv
gaccgccgacaccacggcg

SEQ ID NO: 1347296 - RNA, 22 nt, Mycobacterium tuberculosis H37Rv
gaccgcccgugccgucgcccuu

SEQ ID NO: 1347297 - RNA, 16 nt, Mycobacterium tuberculosis H37Rv
gaccgcccgcaccccc

SEQ ID NO: 1347298 - RNA, 18 nt, Mycobacterium tuberculosis H37Rv
gaccgccgcuaccccagc

SEQ ID NO: 1347299 - RNA, 12 nt, Mycobacterium tuberculosis H37Rv
gaccgccgccga

SEQ ID NO: 1347300 - RNA, 16 nt, Mycobacterium tuberculosis H37Rv
gaccgccugcaacacg

SEQ ID NO: 1347301 - RNA, 14 nt, Mycobacterium tuberculosis H37Rv
gaccgcgacccggc

SEQ ID NO: 1347302 - RNA, 23 nt, Mycobacterium tuberculosis H37Rv
gaccgcgaacccgugggcggccg

SEQ ID NO: 1347303 - RNA, 20 nt, Mycobacterium tuberculosis H37Rv
gaccgcgaucgccgacgcca

SEQ ID NO: 1347304 - RNA, 15 nt, Mycobacterium tuberculosis H37Rv
gaccgcgauccccac

SEQ ID NO: 1347305 - RNA, 19 nt, Mycobacterium tuberculosis H37Rv
gaccgcgacggcgccggca

SEQ ID NO: 1347306 - RNA, 22 nt, Mycobacterium tuberculosis H37Rv
gaccgcuggugugucccggggu

SEQ ID NO: 1347307 - RNA, 22 nt, Mycobacterium tuberculosis H37Rv
gaccgcugguucucgcuguuga

SEQ ID NO: 1347308 - RNA, 20 nt, Mycobacterium tuberculosis H37Rv
gaccgcgggucgugccagca

SEQ ID NO: 1347309 - RNA, 23 nt, Mycobacterium tuberculosis H37Rv
gaccgcguuuugcaggcccgagu

SEQ ID NO: 1347310 - RNA, 20 nt, Mycobacterium tuberculosis H37Rv
gaccgcguuccgggccggcg

SEQ ID NO: 1347311 - RNA, 13 nt, Mycobacterium tuberculosis H37Rv
gaccgcugcccag

SEQ ID NO: 1347312 - RNA, 14 nt, Mycobacterium tuberculosis H37Rv
gaccgcugcccagu

SEQ ID NO: 1347313 - RNA, 23 nt, Mycobacterium tuberculosis H37Rv
gaccgcucgucgccgguggcacc

SEQ ID NO: 1347314 - RNA, 12 nt, Mycobacterium tuberculosis H37Rv
gaccgcuaccag

SEQ ID NO: 1347315 - RNA, 17 nt, Mycobacterium tuberculosis H37Rv
gaccgcuaccagcuggg

SEQ ID NO: 1347316 - RNA, 14 nt, Mycobacterium tuberculosis H37Rv
gaccgcggccuugg

SEQ ID NO: 1347317 - RNA, 15 nt, Mycobacterium tuberculosis H37Rv
gaccgcggccuuggc

SEQ ID NO: 1347318 - RNA, 13 nt, Mycobacterium tuberculosis H37Rv
gaccgcggcggca

SEQ ID NO: 1347319 - RNA, 15 nt, Mycobacterium tuberculosis H37Rv
gaccgcggcggccga

SEQ ID NO: 1347320 - RNA, 19 nt, Mycobacterium tuberculosis H37Rv
gaccgcgggucgugccagc

SEQ ID NO: 1347321 - RNA, 19 nt, Mycobacterium tuberculosis H37Rv
gaccgcggucuucuucacc

SEQ ID NO: 1347322 - RNA, 21 nt, Mycobacterium tuberculosis H37Rv
gaccgcggugacucggccucc

SEQ ID NO: 1347323 - RNA, 20 nt, Mycobacterium tuberculosis H37Rv
gaccgcgccgaucaccaccg

SEQ ID NO: 1347324 - RNA, 20 nt, Mycobacterium tuberculosis H37Rv
gaccgcgccggacagcgcau

SEQ ID NO: 1347325 - RNA, 20 nt, Mycobacterium tuberculosis H37Rv
gaccgcgccaacagaugcca

SEQ ID NO: 1347326 - RNA, 22 nt, Mycobacterium tuberculosis H37Rv
gaccgcgaugucacggaugugc

SEQ ID NO: 1347327 - RNA, 15 nt, Mycobacterium tuberculosis H37Rv
gaccgcggccaccgc

SEQ ID NO: 1347328 - RNA, 19 nt, Mycobacterium tuberculosis H37Rv
gaccucgcgcggggcggcu

SEQ ID NO: 1347329 - RNA, 19 nt, Mycobacterium tuberculosis H37Rv
gaccucggguugcagcagc

SEQ ID NO: 1347330 - RNA, 16 nt, Mycobacterium tuberculosis H37Rv
gaccucucugcgccag

SEQ ID NO: 1347331 - RNA, 20 nt, Mycobacterium tuberculosis H37Rv
gaccucgucgcgucgccaga

SEQ ID NO: 1347332 - RNA, 22 nt, Mycobacterium tuberculosis H37Rv
gaccucgucaaucaccaccgcc

SEQ ID NO: 1347333 - RNA, 22 nt, Mycobacterium tuberculosis H37Rv
gaccuccggauaacccagcggc

SEQ ID NO: 1347334 - RNA, 18 nt, Mycobacterium tuberculosis H37Rv
gaccuccagugcggccuu

SEQ ID NO: 1347335 - RNA, 11 nt, Mycobacterium tuberculosis H37Rv
gaccucagccg

SEQ ID NO: 1347336 - RNA, 15 nt, Mycobacterium tuberculosis H37Rv
gaccucagccggcgg

SEQ ID NO: 1347337 - RNA, 21 nt, Mycobacterium tuberculosis H37Rv
gaccuagucaccuugaccggg

SEQ ID NO: 1347338 - RNA, 15 nt, Mycobacterium tuberculosis H37Rv
gaccuagucaccuug

SEQ ID NO: 1347339 - RNA, 20 nt, Mycobacterium tuberculosis H37Rv
gaccgucggcuccaggucca

SEQ ID NO: 1347340 - RNA, 18 nt, Mycobacterium tuberculosis H37Rv
gaccgucugcgacccggg

SEQ ID NO: 1347341 - RNA, 19 nt, Mycobacterium tuberculosis H37Rv
gaccgugccgucggcgugc

SEQ ID NO: 1347342 - RNA, 21 nt, Mycobacterium tuberculosis H37Rv
gaccguggucggagguggggu

SEQ ID NO: 1347343 - RNA, 23 nt, Mycobacterium tuberculosis H37Rv
gaccgugacguagggcagcgcca

SEQ ID NO: 1347344 - RNA, 21 nt, Mycobacterium tuberculosis H37Rv
gaccucucugcgccaggcggc

SEQ ID NO: 1347345 - RNA, 20 nt, Mycobacterium tuberculosis H37Rv
gaccugaugagcucaccggg

SEQ ID NO: 1347346 - RNA, 21 nt, Mycobacterium tuberculosis H37Rv
gaccugaugagcucaccgggg

SEQ ID NO: 1347347 - RNA, 17 nt, Mycobacterium tuberculosis H37Rv
gaccugcgagaucggau

SEQ ID NO: 1347348 - RNA, 14 nt, Mycobacterium tuberculosis H37Rv
gaccugcucgcugg

SEQ ID NO: 1347349 - RNA, 19 nt, Mycobacterium tuberculosis H37Rv
gaccugcucauccaccucg

SEQ ID NO: 1347350 - RNA, 23 nt, Mycobacterium tuberculosis H37Rv
gaccugguaugccgcccgcagcg

SEQ ID NO: 1347351 - RNA, 20 nt, Mycobacterium tuberculosis H37Rv
gaccuguuuggggcugugca

SEQ ID NO: 1347352 - RNA, 23 nt, Mycobacterium tuberculosis H37Rv
gaccuguuuggggcugugcaggc

SEQ ID NO: 1347353 - RNA, 16 nt, Mycobacterium tuberculosis H37Rv
gacccgggccaguucg

SEQ ID NO: 1347354 - RNA, 19 nt, Mycobacterium tuberculosis H37Rv
gacccgggccgcggcggcc

SEQ ID NO: 1347355 - RNA, 21 nt, Mycobacterium tuberculosis H37Rv
gacccgggccgcggcggccag

SEQ ID NO: 1347356 - RNA, 14 nt, Mycobacterium tuberculosis H37Rv
gacccgggaaggaa

SEQ ID NO: 1347357 - RNA, 17 nt, Mycobacterium tuberculosis H37Rv
gacccuaguucagcgcc

SEQ ID NO: 1347358 - RNA, 17 nt, Mycobacterium tuberculosis H37Rv
gacccucagcaccgcug

SEQ ID NO: 1347359 - RNA, 15 nt, Mycobacterium tuberculosis H37Rv
gacccguuccacgcc

SEQ ID NO: 1347360 - RNA, 21 nt, Mycobacterium tuberculosis H37Rv
gacccguugaacucgaagacc

SEQ ID NO: 1347361 - RNA, 14 nt, Mycobacterium tuberculosis H37Rv
gacccguaccagcc

SEQ ID NO: 1347362 - RNA, 14 nt, Mycobacterium tuberculosis H37Rv
gacccuccagcacg

SEQ ID NO: 1347363 - RNA, 16 nt, Mycobacterium tuberculosis H37Rv
gacccuccagcacgcc

SEQ ID NO: 1347364 - RNA, 18 nt, Mycobacterium tuberculosis H37Rv
gacccuccgcaucgcggc

SEQ ID NO: 1347365 - RNA, 16 nt, Mycobacterium tuberculosis H37Rv
gacccugcgccgccac

SEQ ID NO: 1347366 - RNA, 20 nt, Mycobacterium tuberculosis H37Rv
gacccugggguugcaucaug

SEQ ID NO: 1347367 - RNA, 16 nt, Mycobacterium tuberculosis H37Rv
gacccgcuucgcccgg

SEQ ID NO: 1347368 - RNA, 20 nt, Mycobacterium tuberculosis H37Rv
gacccggcagcccggcggcc

SEQ ID NO: 1347369 - RNA, 17 nt, Mycobacterium tuberculosis H37Rv
gacccggccaagggugc

SEQ ID NO: 1347370 - RNA, 17 nt, Mycobacterium tuberculosis H37Rv
gacccgcuucgcccggc

SEQ ID NO: 1347371 - RNA, 22 nt, Mycobacterium tuberculosis H37Rv
gacccggcgaugcagccgggaa

SEQ ID NO: 1347372 - RNA, 13 nt, Mycobacterium tuberculosis H37Rv
gacccggcgcagc

SEQ ID NO: 1347373 - RNA, 22 nt, Mycobacterium tuberculosis H37Rv
gacccggcgccgaaaacaaccc

SEQ ID NO: 1347374 - RNA, 14 nt, Mycobacterium tuberculosis H37Rv
gacccggccggccc

SEQ ID NO: 1347375 - RNA, 23 nt, Mycobacterium tuberculosis H37Rv
gacccggcccagcgcccccagca

SEQ ID NO: 1347376 - RNA, 15 nt, Mycobacterium tuberculosis H37Rv
gacccgaugacccac

SEQ ID NO: 1347377 - RNA, 22 nt, Mycobacterium tuberculosis H37Rv
gacccgcuggucgaugccuucg

SEQ ID NO: 1347378 - RNA, 13 nt, Mycobacterium tuberculosis H37Rv
gacccgccgcgcc

SEQ ID NO: 1347379 - RNA, 22 nt, Mycobacterium tuberculosis H37Rv
gacccgcgcaaccggccgucca

SEQ ID NO: 1347380 - RNA, 17 nt, Mycobacterium tuberculosis H37Rv
gaccgaccgcauggugg

SEQ ID NO: 1347381 - RNA, 18 nt, Mycobacterium tuberculosis H37Rv
gaccgaaccuggucuuga

SEQ ID NO: 1347382 - RNA, 17 nt, Mycobacterium tuberculosis H37Rv
gaccgaaagccgcacca

SEQ ID NO: 1347383 - RNA, 23 nt, Mycobacterium tuberculosis H37Rv
gaccgaacaacagcggcaacgcc

SEQ ID NO: 1347384 - RNA, 14 nt, Mycobacterium tuberculosis H37Rv
gaccgaagaagccc

SEQ ID NO: 1347385 - RNA, 16 nt, Mycobacterium tuberculosis H37Rv
gaccgaagagcgcgcg

SEQ ID NO: 1347386 - RNA, 21 nt, Mycobacterium tuberculosis H37Rv
gaccgaaucagcacggugugc

SEQ ID NO: 1347387 - RNA, 18 nt, Mycobacterium tuberculosis H37Rv
gaccgaucuuggccaccg

SEQ ID NO: 1347388 - RNA, 18 nt, Mycobacterium tuberculosis H37Rv
gaccgaucggcaggccgc

SEQ ID NO: 1347389 - RNA, 15 nt, Mycobacterium tuberculosis H37Rv
gaccgauagcuggcc

SEQ ID NO: 1347390 - RNA, 15 nt, Mycobacterium tuberculosis H37Rv
gaccgauaacacccg

SEQ ID NO: 1347391 - RNA, 18 nt, Mycobacterium tuberculosis H37Rv
gaccgagcuuccaaaccc

SEQ ID NO: 1347392 - RNA, 18 nt, Mycobacterium tuberculosis H37Rv
gaccgcaacgacggccgu

SEQ ID NO: 1347393 - RNA, 15 nt, Mycobacterium tuberculosis H37Rv
gaccgcaccggccgc

SEQ ID NO: 1347394 - RNA, 20 nt, Mycobacterium tuberculosis H37Rv
gaccgauuucgccugcggcc

SEQ ID NO: 1347395 - RNA, 16 nt, Mycobacterium tuberculosis H37Rv
gaccgccaccccgcuu

SEQ ID NO: 1347396 - RNA, 11 nt, Mycobacterium tuberculosis H37Rv
gaccgccaccc

SEQ ID NO: 1347397 - RNA, 16 nt, Mycobacterium tuberculosis H37Rv
gaccgccacacggggc

SEQ ID NO: 1347398 - RNA, 18 nt, Mycobacterium tuberculosis H37Rv
gaccgccacacggggccg

SEQ ID NO: 1347399 - RNA, 21 nt, Mycobacterium tuberculosis H37Rv
gaccgcaucucgggcgaagcc

SEQ ID NO: 1347400 - RNA, 21 nt, Mycobacterium tuberculosis H37Rv
gaccgcauccggucucggccg

SEQ ID NO: 1347401 - RNA, 19 nt, Mycobacterium tuberculosis H37Rv
gaccgccaccccgcuugga

SEQ ID NO: 1347402 - RNA, 22 nt, Mycobacterium tuberculosis H37Rv
gaccgccaccgucauggcgggu

SEQ ID NO: 1347403 - RNA, 20 nt, Mycobacterium tuberculosis H37Rv
gaccgccacguaauucccca

SEQ ID NO: 1347404 - RNA, 21 nt, Mycobacterium tuberculosis H37Rv
gaccgccacguaauuccccag

SEQ ID NO: 1347405 - RNA, 14 nt, Mycobacterium tuberculosis H37Rv
gaccgccagcagca

SEQ ID NO: 1347406 - RNA, 22 nt, Mycobacterium tuberculosis H37Rv
gaccccacacgccgaacgugca

SEQ ID NO: 1347407 - RNA, 14 nt, Mycobacterium tuberculosis H37Rv
gacccccugccaca

SEQ ID NO: 1347408 - RNA, 17 nt, Mycobacterium tuberculosis H37Rv
gacccccugccacagcg

SEQ ID NO: 1347409 - RNA, 21 nt, Mycobacterium tuberculosis H37Rv
gaccccgacgaugcgcacucc

SEQ ID NO: 1347410 - RNA, 13 nt, Mycobacterium tuberculosis H37Rv
gacccccagcgcc

SEQ ID NO: 1347411 - RNA, 19 nt, Mycobacterium tuberculosis H37Rv
gaccccgaacauccgccgc

SEQ ID NO: 1347412 - RNA, 15 nt, Mycobacterium tuberculosis H37Rv
gaccccggcagcgcc

SEQ ID NO: 1347413 - RNA, 22 nt, Mycobacterium tuberculosis H37Rv
gaccccgcuuuuucccggcggc

SEQ ID NO: 1347414 - RNA, 15 nt, Mycobacterium tuberculosis H37Rv
gacccgaccgucguc

SEQ ID NO: 1347415 - RNA, 13 nt, Mycobacterium tuberculosis H37Rv
gaccccggugguc

SEQ ID NO: 1347416 - RNA, 17 nt, Mycobacterium tuberculosis H37Rv
gaccccgguggucuggu

SEQ ID NO: 1347417 - RNA, 16 nt, Mycobacterium tuberculosis H37Rv
gaccccguaggcgccg

SEQ ID NO: 1347418 - RNA, 20 nt, Mycobacterium tuberculosis H37Rv
gaccccggcguugccgccgu

SEQ ID NO: 1347419 - RNA, 15 nt, Mycobacterium tuberculosis H37Rv
gaccccuggccgccg

SEQ ID NO: 1347420 - RNA, 18 nt, Mycobacterium tuberculosis H37Rv
gacccauggucaccagcu

SEQ ID NO: 1347421 - RNA, 23 nt, Mycobacterium tuberculosis H37Rv
gacccauucucggccggcggcgc

SEQ ID NO: 1347422 - RNA, 18 nt, Mycobacterium tuberculosis H37Rv
gacccaucaugguccggg

SEQ ID NO: 1347423 - RNA, 12 nt, Mycobacterium tuberculosis H37Rv
gacccauacgaa

SEQ ID NO: 1347424 - RNA, 18 nt, Mycobacterium tuberculosis H37Rv
gacccagcgcgcgguggc

SEQ ID NO: 1347425 - RNA, 19 nt, Mycobacterium tuberculosis H37Rv
gacccagcgcgcgguggcc

SEQ ID NO: 1347426 - RNA, 15 nt, Mycobacterium tuberculosis H37Rv
gacccagcggcgguc

SEQ ID NO: 1347427 - RNA, 18 nt, Mycobacterium tuberculosis H37Rv
gacccagcggcggucuuu

SEQ ID NO: 1347428 - RNA, 14 nt, Mycobacterium tuberculosis H37Rv
gacccagcagcggc

SEQ ID NO: 1347429 - RNA, 14 nt, Mycobacterium tuberculosis H37Rv
gacccagccagcug

SEQ ID NO: 1347430 - RNA, 18 nt, Mycobacterium tuberculosis H37Rv
gacccaccgucacccccg

SEQ ID NO: 1347431 - RNA, 14 nt, Mycobacterium tuberculosis H37Rv
gacccacugcaggc

SEQ ID NO: 1347432 - RNA, 21 nt, Mycobacterium tuberculosis H37Rv
gaccaugcuccuaucacugga

SEQ ID NO: 1347433 - RNA, 13 nt, Mycobacterium tuberculosis H37Rv
gaccaugaagaac

SEQ ID NO: 1347434 - RNA, 15 nt, Mycobacterium tuberculosis H37Rv
gacccaacgcagauc

SEQ ID NO: 1347435 - RNA, 23 nt, Mycobacterium tuberculosis H37Rv
gacccacagucgccggccggccc

SEQ ID NO: 1347436 - RNA, 18 nt, Mycobacterium tuberculosis H37Rv
gacccacaucaggucggc

SEQ ID NO: 1347437 - RNA, 17 nt, Mycobacterium tuberculosis H37Rv
gacccaagucgccgagg

SEQ ID NO: 1347438 - RNA, 20 nt, Mycobacterium tuberculosis H37Rv
gacccaccgccccggcggcg

SEQ ID NO: 1347439 - RNA, 17 nt, Mycobacterium tuberculosis H37Rv
gacccacccgcaccgcc

SEQ ID NO: 1347440 - RNA, 22 nt, Mycobacterium tuberculosis H37Rv
gacccacauuccguagccggcg

SEQ ID NO: 1347441 - RNA, 21 nt, Mycobacterium tuberculosis H37Rv
gaccaucaccacggccgccga

SEQ ID NO: 1347442 - RNA, 19 nt, Mycobacterium tuberculosis H37Rv
gacgcgagugcgugaucug

SEQ ID NO: 1347443 - RNA, 20 nt, Mycobacterium tuberculosis H37Rv
gacgcgaucuguccgcgaac

SEQ ID NO: 1347444 - RNA, 19 nt, Mycobacterium tuberculosis H37Rv
gacgccuugcacaagcuga

SEQ ID NO: 1347445 - RNA, 22 nt, Mycobacterium tuberculosis H37Rv
gacgcggaaucgcaucggcggg

SEQ ID NO: 1347446 - RNA, 15 nt, Mycobacterium tuberculosis H37Rv
gacgcgccggcgugc

SEQ ID NO: 1347447 - RNA, 20 nt, Mycobacterium tuberculosis H37Rv
gacgcgcaugccccgaccgc

SEQ ID NO: 1347448 - RNA, 21 nt, Mycobacterium tuberculosis H37Rv
gacgccgcucccgcacaagcc

SEQ ID NO: 1347449 - RNA, 15 nt, Mycobacterium tuberculosis H37Rv
gacgccggccuggcc

SEQ ID NO: 1347450 - RNA, 19 nt, Mycobacterium tuberculosis H37Rv
gacgccggccuggccgcca

SEQ ID NO: 1347451 - RNA, 16 nt, Mycobacterium tuberculosis H37Rv
gacgccgcgcagccgg

SEQ ID NO: 1347452 - RNA, 19 nt, Mycobacterium tuberculosis H37Rv
gacgccgcgccggcgggcg

SEQ ID NO: 1347453 - RNA, 15 nt, Mycobacterium tuberculosis H37Rv
gacgccgccggcccc

SEQ ID NO: 1347454 - RNA, 19 nt, Mycobacterium tuberculosis H37Rv
gacgccgccggccccgccg

SEQ ID NO: 1347455 - RNA, 14 nt, Mycobacterium tuberculosis H37Rv
gacgccgccggccc

SEQ ID NO: 1347456 - RNA, 24 nt, Mycobacterium tuberculosis H37Rv
gacgccgccguuguugaggaugac

SEQ ID NO: 1347457 - RNA, 19 nt, Mycobacterium tuberculosis H37Rv
gacgccguugccgccguug

SEQ ID NO: 1347458 - RNA, 21 nt, Mycobacterium tuberculosis H37Rv
gacgccgucggcgcgcaccuc

SEQ ID NO: 1347459 - RNA, 15 nt, Mycobacterium tuberculosis H37Rv
gacgccugcggcggu

SEQ ID NO: 1347460 - RNA, 22 nt, Mycobacterium tuberculosis H37Rv
gacgccgguggcagagccgccg

SEQ ID NO: 1347461 - RNA, 14 nt, Mycobacterium tuberculosis H37Rv
gacgccgacgauga

SEQ ID NO: 1347462 - RNA, 17 nt, Mycobacterium tuberculosis H37Rv
gacgccgagaccgccgc

SEQ ID NO: 1347463 - RNA, 16 nt, Mycobacterium tuberculosis H37Rv
gacgccgccagcaccu

SEQ ID NO: 1347464 - RNA, 17 nt, Mycobacterium tuberculosis H37Rv
gacgccgcccccguggg

SEQ ID NO: 1347465 - RNA, 16 nt, Mycobacterium tuberculosis H37Rv
gacgccgccgcugccg

SEQ ID NO: 1347466 - RNA, 19 nt, Mycobacterium tuberculosis H37Rv
gacgccgccacccggcggg

SEQ ID NO: 1347467 - RNA, 18 nt, Mycobacterium tuberculosis H37Rv
gacgccgaucgcggcggc

SEQ ID NO: 1347468 - RNA, 14 nt, Mycobacterium tuberculosis H37Rv
gacgcccucacgcc

SEQ ID NO: 1347469 - RNA, 22 nt, Mycobacterium tuberculosis H37Rv
gacgcccuccuggcggguggcg

SEQ ID NO: 1347470 - RNA, 14 nt, Mycobacterium tuberculosis H37Rv
gacgcccucggggu

SEQ ID NO: 1347471 - RNA, 16 nt, Mycobacterium tuberculosis H37Rv
gacgcccgcuccgcgg

SEQ ID NO: 1347472 - RNA, 20 nt, Mycobacterium tuberculosis H37Rv
gacgccgaauacggcugccu

SEQ ID NO: 1347473 - RNA, 14 nt, Mycobacterium tuberculosis H37Rv
gacgccagcugccc

SEQ ID NO: 1347474 - RNA, 15 nt, Mycobacterium tuberculosis H37Rv
gacgccaugcccgca

SEQ ID NO: 1347475 - RNA, 15 nt, Mycobacterium tuberculosis H37Rv
gacgccagccuggcc

SEQ ID NO: 1347476 - RNA, 17 nt, Mycobacterium tuberculosis H37Rv
gacgcauaagcccccgc

SEQ ID NO: 1347477 - RNA, 21 nt, Mycobacterium tuberculosis H37Rv
gacgccaaugccgcggaggcg

SEQ ID NO: 1347478 - RNA, 15 nt, Mycobacterium tuberculosis H37Rv
gacgccaacgccagc

SEQ ID NO: 1347479 - RNA, 18 nt, Mycobacterium tuberculosis H37Rv
gacgccaacgccagcggg

SEQ ID NO: 1347480 - RNA, 17 nt, Mycobacterium tuberculosis H37Rv
gacgcauaagcccccga

SEQ ID NO: 1347481 - RNA, 22 nt, Mycobacterium tuberculosis H37Rv
gacggccacguaagcgguuguc

SEQ ID NO: 1347482 - RNA, 15 nt, Mycobacterium tuberculosis H37Rv
gacggccagcccagc

SEQ ID NO: 1347483 - RNA, 19 nt, Mycobacterium tuberculosis H37Rv
gacggcauuucagcgcgcc

SEQ ID NO: 1347484 - RNA, 23 nt, Mycobacterium tuberculosis H37Rv
gacggcauuucagcgcgccgcgu

SEQ ID NO: 1347485 - RNA, 17 nt, Mycobacterium tuberculosis H37Rv
gacggccagugcgcaga

SEQ ID NO: 1347486 - RNA, 22 nt, Mycobacterium tuberculosis H37Rv
gacggccaguugguagccgccc

SEQ ID NO: 1347487 - RNA, 16 nt, Mycobacterium tuberculosis H37Rv
gacggccagcccagca

SEQ ID NO: 1347488 - RNA, 13 nt, Mycobacterium tuberculosis H37Rv
gacggccagcgcg

SEQ ID NO: 1347489 - RNA, 23 nt, Mycobacterium tuberculosis H37Rv
gacggccaucgccagccugugcu

SEQ ID NO: 1347490 - RNA, 21 nt, Mycobacterium tuberculosis H37Rv
gacggcgacgugaaugguggu

SEQ ID NO: 1347491 - RNA, 20 nt, Mycobacterium tuberculosis H37Rv
gacggcgaaaucgacagcag

SEQ ID NO: 1347492 - RNA, 18 nt, Mycobacterium tuberculosis H37Rv
gacggccuggggcagccg

SEQ ID NO: 1347493 - RNA, 12 nt, Mycobacterium tuberculosis H37Rv
gacggccgggac

SEQ ID NO: 1347494 - RNA, 11 nt, Mycobacterium tuberculosis H37Rv
gacggccggcc

SEQ ID NO: 1347495 - RNA, 16 nt, Mycobacterium tuberculosis H37Rv
gacgcuuuccgccgca

SEQ ID NO: 1347496 - RNA, 19 nt, Mycobacterium tuberculosis H37Rv
gacggcaagggcauacagc

SEQ ID NO: 1347497 - RNA, 21 nt, Mycobacterium tuberculosis H37Rv
gacggcaagccauucacgagc

SEQ ID NO: 1347498 - RNA, 22 nt, Mycobacterium tuberculosis H37Rv
gacggaucgucgugcacggcgg

SEQ ID NO: 1347499 - RNA, 17 nt, Mycobacterium tuberculosis H37Rv
gacggcaccggcccaga

SEQ ID NO: 1347500 - RNA, 18 nt, Mycobacterium tuberculosis H37Rv
gacggcagccaccagcga

SEQ ID NO: 1347501 - RNA, 19 nt, Mycobacterium tuberculosis H37Rv
gacggcagccaccagcgac

SEQ ID NO: 1347502 - RNA, 13 nt, Mycobacterium tuberculosis H37Rv
gacggcagugcug

SEQ ID NO: 1347503 - RNA, 17 nt, Mycobacterium tuberculosis H37Rv
gacgcuguccaggucug

SEQ ID NO: 1347504 - RNA, 18 nt, Mycobacterium tuberculosis H37Rv
gacgcugccaagcgaccu

SEQ ID NO: 1347505 - RNA, 15 nt, Mycobacterium tuberculosis H37Rv
gacgcguagcucgcg

SEQ ID NO: 1347506 - RNA, 15 nt, Mycobacterium tuberculosis H37Rv
gacgcgucggcgacg

SEQ ID NO: 1347507 - RNA, 22 nt, Mycobacterium tuberculosis H37Rv
gacgcggcgccgccaucaacaa

SEQ ID NO: 1347508 - RNA, 20 nt, Mycobacterium tuberculosis H37Rv
gacgcucggucgccaccgcc

SEQ ID NO: 1347509 - RNA, 20 nt, Mycobacterium tuberculosis H37Rv
gacgcucgcugcagcagggc

SEQ ID NO: 1347510 - RNA, 16 nt, Mycobacterium tuberculosis H37Rv
gacgcucgcugcagca

SEQ ID NO: 1347511 - RNA, 19 nt, Mycobacterium tuberculosis H37Rv
gacgcuaggacggcugccg

SEQ ID NO: 1347512 - RNA, 22 nt, Mycobacterium tuberculosis H37Rv
gacgcguucaacaccgccgacc

SEQ ID NO: 1347513 - RNA, 11 nt, Mycobacterium tuberculosis H37Rv
gacgacccggg

SEQ ID NO: 1347514 - RNA, 15 nt, Mycobacterium tuberculosis H37Rv
gacgaccgcgcggca

SEQ ID NO: 1347515 - RNA, 12 nt, Mycobacterium tuberculosis H37Rv
gacgaccgcgcg

SEQ ID NO: 1347516 - RNA, 14 nt, Mycobacterium tuberculosis H37Rv
gacgaccgcgcggc

SEQ ID NO: 1347517 - RNA, 15 nt, Mycobacterium tuberculosis H37Rv
gacgaccagcagauc

SEQ ID NO: 1347518 - RNA, 13 nt, Mycobacterium tuberculosis H37Rv
gacgaccagcaga

SEQ ID NO: 1347519 - RNA, 19 nt, Mycobacterium tuberculosis H37Rv
gacgacauuggugcugaca

SEQ ID NO: 1347520 - RNA, 23 nt, Mycobacterium tuberculosis H37Rv
gacgaccauacuaauggcgccac

SEQ ID NO: 1347521 - RNA, 16 nt, Mycobacterium tuberculosis H37Rv
gacgacguggcugcgu

SEQ ID NO: 1347522 - RNA, 14 nt, Mycobacterium tuberculosis H37Rv
gacgacgcccucac

SEQ ID NO: 1347523 - RNA, 18 nt, Mycobacterium tuberculosis H37Rv
gacgacggcgacggcgcc

SEQ ID NO: 1347524 - RNA, 19 nt, Mycobacterium tuberculosis H37Rv
gacgacggguuggcgucgc

SEQ ID NO: 1347525 - RNA, 15 nt, Mycobacterium tuberculosis H37Rv
gacgacgaucaagcc

SEQ ID NO: 1347526 - RNA, 13 nt, Mycobacterium tuberculosis H37Rv
gacgacgccgucg

SEQ ID NO: 1347527 - RNA, 15 nt, Mycobacterium tuberculosis H37Rv
gacgacaccagagcg

SEQ ID NO: 1347528 - RNA, 15 nt, Mycobacterium tuberculosis H37Rv
gacgaauuggcccga

SEQ ID NO: 1347529 - RNA, 22 nt, Mycobacterium tuberculosis H37Rv
gacgaauccacuggucaacggg

SEQ ID NO: 1347530 - RNA, 18 nt, Mycobacterium tuberculosis H37Rv
gacgaauccacuggucaa

SEQ ID NO: 1347531 - RNA, 14 nt, Mycobacterium tuberculosis H37Rv
gacgaagaagaacu

SEQ ID NO: 1347532 - RNA, 17 nt, Mycobacterium tuberculosis H37Rv
gacgaagagcaccgcgc

SEQ ID NO: 1347533 - RNA, 14 nt, Mycobacterium tuberculosis H37Rv
gacgaacaccagcg

SEQ ID NO: 1347534 - RNA, 15 nt, Mycobacterium tuberculosis H37Rv
gacgaacgaaccgcc

SEQ ID NO: 1347535 - RNA, 22 nt, Mycobacterium tuberculosis H37Rv
gacgaacgacggggcaaaggag

SEQ ID NO: 1347536 - RNA, 14 nt, Mycobacterium tuberculosis H37Rv
gacgaacuggucuc

SEQ ID NO: 1347537 - RNA, 18 nt, Mycobacterium tuberculosis H37Rv
gacgaaauccgccgggcg

SEQ ID NO: 1347538 - RNA, 14 nt, Mycobacterium tuberculosis H37Rv
gaccuucaccugga

SEQ ID NO: 1347539 - RNA, 23 nt, Mycobacterium tuberculosis H37Rv
gaccuugaucgagcagggugacc

SEQ ID NO: 1347540 - RNA, 14 nt, Mycobacterium tuberculosis H37Rv
gaccuugcccugcg

SEQ ID NO: 1347541 - RNA, 23 nt, Mycobacterium tuberculosis H37Rv
gaccuucuugacacccaccucgc

SEQ ID NO: 1347542 - RNA, 17 nt, Mycobacterium tuberculosis H37Rv
gaccuuggugcccagca

SEQ ID NO: 1347543 - RNA, 14 nt, Mycobacterium tuberculosis H37Rv
gaccuuggacacuu

SEQ ID NO: 1347544 - RNA, 17 nt, Mycobacterium tuberculosis H37Rv
gacgcaaaagcccccua

SEQ ID NO: 1347545 - RNA, 18 nt, Mycobacterium tuberculosis H37Rv
gacgcaaaauccccucgc

SEQ ID NO: 1347546 - RNA, 21 nt, Mycobacterium tuberculosis H37Rv
gacgcaaaauccccucgcaac

SEQ ID NO: 1347547 - RNA, 15 nt, Mycobacterium tuberculosis H37Rv
gacgcagaagccccc

SEQ ID NO: 1347548 - RNA, 15 nt, Mycobacterium tuberculosis H37Rv
gacgcacgauccgca

SEQ ID NO: 1347549 - RNA, 20 nt, Mycobacterium tuberculosis H37Rv
gacgcaccuauggucaaccg

SEQ ID NO: 1347550 - RNA, 16 nt, Mycobacterium tuberculosis H37Rv
gacgcaggaucacacu

SEQ ID NO: 1347551 - RNA, 14 nt, Mycobacterium tuberculosis H37Rv
gacgauugccacca

SEQ ID NO: 1347552 - RNA, 21 nt, Mycobacterium tuberculosis H37Rv
gacgauuccgcgcgggaaacg

SEQ ID NO: 1347553 - RNA, 14 nt, Mycobacterium tuberculosis H37Rv
gacgauucaccaau

SEQ ID NO: 1347554 - RNA, 22 nt, Mycobacterium tuberculosis H37Rv
gacgauuaccagcggcaccgcg

SEQ ID NO: 1347555 - RNA, 16 nt, Mycobacterium tuberculosis H37Rv
gacgaugucggucgga

SEQ ID NO: 1347556 - RNA, 17 nt, Mycobacterium tuberculosis H37Rv
gacgauguccuggaagc

SEQ ID NO: 1347557 - RNA, 19 nt, Mycobacterium tuberculosis H37Rv
gacgaugaaccgggcagca

SEQ ID NO: 1347558 - RNA, 20 nt, Mycobacterium tuberculosis H37Rv
gacgaugccggcccgcaggc

SEQ ID NO: 1347559 - RNA, 15 nt, Mycobacterium tuberculosis H37Rv
gacgaucugcagcac

SEQ ID NO: 1347560 - RNA, 16 nt, Mycobacterium tuberculosis H37Rv
gacgaucgcggcgggc

SEQ ID NO: 1347561 - RNA, 15 nt, Mycobacterium tuberculosis H37Rv
gacgaucgccaggcc

SEQ ID NO: 1347562 - RNA, 16 nt, Mycobacterium tuberculosis H37Rv
gacgaucaccccgcca

SEQ ID NO: 1347563 - RNA, 18 nt, Mycobacterium tuberculosis H37Rv
gacgaucaccccgccaug

SEQ ID NO: 1347564 - RNA, 14 nt, Mycobacterium tuberculosis H37Rv
gacgaucagcgagu

SEQ ID NO: 1347565 - RNA, 14 nt, Mycobacterium tuberculosis H37Rv
gacgaucgacagcc

SEQ ID NO: 1347566 - RNA, 18 nt, Mycobacterium tuberculosis H37Rv
gacgacuggaaggcgggc

SEQ ID NO: 1347567 - RNA, 14 nt, Mycobacterium tuberculosis H37Rv
gacgagcgauacgu

SEQ ID NO: 1347568 - RNA, 19 nt, Mycobacterium tuberculosis H37Rv
gacaccgcggugccccgga

SEQ ID NO: 1347569 - RNA, 22 nt, Mycobacterium tuberculosis H37Rv
gacaccgagccacgacccagca

SEQ ID NO: 1347570 - RNA, 18 nt, Mycobacterium tuberculosis H37Rv
gacaccgcaacgcgugcg

SEQ ID NO: 1347571 - RNA, 17 nt, Mycobacterium tuberculosis H37Rv
gacaccgaucugcuuca

SEQ ID NO: 1347572 - RNA, 17 nt, Mycobacterium tuberculosis H37Rv
gacaccggccaccagcc

SEQ ID NO: 1347573 - RNA, 14 nt, Mycobacterium tuberculosis H37Rv
gacaccggccgcga

SEQ ID NO: 1347574 - RNA, 17 nt, Mycobacterium tuberculosis H37Rv
gacaccguccagcagcu

SEQ ID NO: 1347575 - RNA, 15 nt, Mycobacterium tuberculosis H37Rv
gacaccggcggcauc

SEQ ID NO: 1347576 - RNA, 15 nt, Mycobacterium tuberculosis H37Rv
gacacgacgugcagg

SEQ ID NO: 1347577 - RNA, 19 nt, Mycobacterium tuberculosis H37Rv
gacacgagucgccagaccg

SEQ ID NO: 1347578 - RNA, 16 nt, Mycobacterium tuberculosis H37Rv
gacacgagucgccaga

SEQ ID NO: 1347579 - RNA, 18 nt, Mycobacterium tuberculosis H37Rv
gacaccuaccgagaucac

SEQ ID NO: 1347580 - RNA, 21 nt, Mycobacterium tuberculosis H37Rv
gacacguugcagcucgauccg

SEQ ID NO: 1347581 - RNA, 13 nt, Mycobacterium tuberculosis H37Rv
gacacggcucgcc

SEQ ID NO: 1347582 - RNA, 23 nt, Mycobacterium tuberculosis H37Rv
gacacucccgggugcgacgcgac

SEQ ID NO: 1347583 - RNA, 18 nt, Mycobacterium tuberculosis H37Rv
gacacgcugcaggcggcc

SEQ ID NO: 1347584 - RNA, 21 nt, Mycobacterium tuberculosis H37Rv
gacacgcgcgcucgcggguuc

SEQ ID NO: 1347585 - RNA, 19 nt, Mycobacterium tuberculosis H37Rv
gacacgcccuaacccugcc

SEQ ID NO: 1347586 - RNA, 22 nt, Mycobacterium tuberculosis H37Rv
gacacgccgaacgugcgguggc

SEQ ID NO: 1347587 - RNA, 22 nt, Mycobacterium tuberculosis H37Rv
gacacgccgauucgccgucgug

SEQ ID NO: 1347588 - RNA, 19 nt, Mycobacterium tuberculosis H37Rv
gacacagcaccguccucgg

SEQ ID NO: 1347589 - RNA, 15 nt, Mycobacterium tuberculosis H37Rv
gacacauugaccagg

SEQ ID NO: 1347590 - RNA, 16 nt, Mycobacterium tuberculosis H37Rv
gacacauugaccaggu

SEQ ID NO: 1347591 - RNA, 13 nt, Mycobacterium tuberculosis H37Rv
gacaccagcucga

SEQ ID NO: 1347592 - RNA, 12 nt, Mycobacterium tuberculosis H37Rv
gacaccaggccc

SEQ ID NO: 1347593 - RNA, 12 nt, Mycobacterium tuberculosis H37Rv
gacaccaccucg

SEQ ID NO: 1347594 - RNA, 16 nt, Mycobacterium tuberculosis H37Rv
gacacccucgggcccg

SEQ ID NO: 1347595 - RNA, 18 nt, Mycobacterium tuberculosis H37Rv
gacaccccggaaucccca

SEQ ID NO: 1347596 - RNA, 23 nt, Mycobacterium tuberculosis H37Rv
gacaccaucuccgccgucgccac

SEQ ID NO: 1347597 - RNA, 23 nt, Mycobacterium tuberculosis H37Rv
gacaccauuggccuaggacaccg

SEQ ID NO: 1347598 - RNA, 17 nt, Mycobacterium tuberculosis H37Rv
gacacccaccaacaccc

SEQ ID NO: 1347599 - RNA, 15 nt, Mycobacterium tuberculosis H37Rv
gacacccaucgaccg

SEQ ID NO: 1347600 - RNA, 16 nt, Mycobacterium tuberculosis H37Rv
gacagccccgccgccc

SEQ ID NO: 1347601 - RNA, 18 nt, Mycobacterium tuberculosis H37Rv
gacagccccgcggccagc

SEQ ID NO: 1347602 - RNA, 22 nt, Mycobacterium tuberculosis H37Rv
gacagcccuaucagccgagaca

SEQ ID NO: 1347603 - RNA, 14 nt, Mycobacterium tuberculosis H37Rv
gacagccccgccgc

SEQ ID NO: 1347604 - RNA, 18 nt, Mycobacterium tuberculosis H37Rv
gacagcugcacacagagg

SEQ ID NO: 1347605 - RNA, 20 nt, Mycobacterium tuberculosis H37Rv
gacagcgugccgaacaggga

SEQ ID NO: 1347606 - RNA, 22 nt, Mycobacterium tuberculosis H37Rv
gacagcguaucucccaacggca

SEQ ID NO: 1347607 - RNA, 20 nt, Mycobacterium tuberculosis H37Rv
gacagcuaucccaggggcac

SEQ ID NO: 1347608 - RNA, 17 nt, Mycobacterium tuberculosis H37Rv
gacagcgucucggaggc

SEQ ID NO: 1347609 - RNA, 15 nt, Mycobacterium tuberculosis H37Rv
gacagcgggagcagc

SEQ ID NO: 1347610 - RNA, 17 nt, Mycobacterium tuberculosis H37Rv
gacagcgccuuguuggc

SEQ ID NO: 1347611 - RNA, 12 nt, Mycobacterium tuberculosis H37Rv
gacagcgcggcg

SEQ ID NO: 1347612 - RNA, 22 nt, Mycobacterium tuberculosis H37Rv
gacagcggcaaucgggucugga

SEQ ID NO: 1347613 - RNA, 14 nt, Mycobacterium tuberculosis H37Rv
gacagacagcaccg

SEQ ID NO: 1347614 - RNA, 20 nt, Mycobacterium tuberculosis H37Rv
gacagacccccagacaaaga

SEQ ID NO: 1347615 - RNA, 23 nt, Mycobacterium tuberculosis H37Rv
gacacugcgaaggaccagagcuc

SEQ ID NO: 1347616 - RNA, 14 nt, Mycobacterium tuberculosis H37Rv
gacacugugcgccu

SEQ ID NO: 1347617 - RNA, 19 nt, Mycobacterium tuberculosis H37Rv
gacacuugaagugugacaa

SEQ ID NO: 1347618 - RNA, 16 nt, Mycobacterium tuberculosis H37Rv
gacagcagcgccaccc

SEQ ID NO: 1347619 - RNA, 21 nt, Mycobacterium tuberculosis H37Rv
gacagcaggaaaaagggcuuc

SEQ ID NO: 1347620 - RNA, 23 nt, Mycobacterium tuberculosis H37Rv
gacagcacgccaggcaugccgcc

SEQ ID NO: 1347621 - RNA, 20 nt, Mycobacterium tuberculosis H37Rv
gacagaugugguaccagccc

SEQ ID NO: 1347622 - RNA, 22 nt, Mycobacterium tuberculosis H37Rv
gacagaugugguaccagcccgc

SEQ ID NO: 1347623 - RNA, 17 nt, Mycobacterium tuberculosis H37Rv
gacaagucggcgcuggc

SEQ ID NO: 1347624 - RNA, 16 nt, Mycobacterium tuberculosis H37Rv
gacaaggcgauugucg

SEQ ID NO: 1347625 - RNA, 16 nt, Mycobacterium tuberculosis H37Rv
gacaaggugcgcuggg

SEQ ID NO: 1347626 - RNA, 14 nt, Mycobacterium tuberculosis H37Rv
gacaauucacgagg

SEQ ID NO: 1347627 - RNA, 19 nt, Mycobacterium tuberculosis H37Rv
gacaaugucggcgaugcgu

SEQ ID NO: 1347628 - RNA, 17 nt, Mycobacterium tuberculosis H37Rv
gacaauggacaccaacc

SEQ ID NO: 1347629 - RNA, 21 nt, Mycobacterium tuberculosis H37Rv
gacaaucucggcguugccgcc

SEQ ID NO: 1347630 - RNA, 15 nt, Mycobacterium tuberculosis H37Rv
gacaaccuggggcca

SEQ ID NO: 1347631 - RNA, 15 nt, Mycobacterium tuberculosis H37Rv
gacaacgaugucacc

SEQ ID NO: 1347632 - RNA, 22 nt, Mycobacterium tuberculosis H37Rv
gacaacgaugucacccucccgc

SEQ ID NO: 1347633 - RNA, 17 nt, Mycobacterium tuberculosis H37Rv
gacaacgcugggcggcu

SEQ ID NO: 1347634 - RNA, 19 nt, Mycobacterium tuberculosis H37Rv
gacaaccgcccgccaggcc

SEQ ID NO: 1347635 - RNA, 18 nt, Mycobacterium tuberculosis H37Rv
gacaaccccuugccuucc

SEQ ID NO: 1347636 - RNA, 21 nt, Mycobacterium tuberculosis H37Rv
gacaacaggccgucgaugauc

SEQ ID NO: 1347637 - RNA, 19 nt, Mycobacterium tuberculosis H37Rv
gacaacuaucgucgugucg

SEQ ID NO: 1347638 - RNA, 20 nt, Mycobacterium tuberculosis H37Rv
gacaacugguggcccggggc

SEQ ID NO: 1347639 - RNA, 13 nt, Mycobacterium tuberculosis H37Rv
gacaacaccacgg

SEQ ID NO: 1347640 - RNA, 14 nt, Mycobacterium tuberculosis H37Rv
gacaacagcuugga

SEQ ID NO: 1347641 - RNA, 13 nt, Mycobacterium tuberculosis H37Rv
gacaacagccagc

SEQ ID NO: 1347642 - RNA, 23 nt, Mycobacterium tuberculosis H37Rv
gacaacagagucaccgcgcuggu

SEQ ID NO: 1347643 - RNA, 23 nt, Mycobacterium tuberculosis H37Rv
gacaaagcgcgcuggcuacccac

SEQ ID NO: 1347644 - RNA, 18 nt, Mycobacterium tuberculosis H37Rv
gacaaacggcgacccagc

SEQ ID NO: 1347645 - RNA, 19 nt, Mycobacterium tuberculosis H37Rv
gacaaacggcgacccagcg

SEQ ID NO: 1347646 - RNA, 13 nt, Mycobacterium tuberculosis H37Rv
gacaaaccacaga

SEQ ID NO: 1347647 - RNA, 13 nt, Mycobacterium tuberculosis H37Rv
gacaaacagcgcc

SEQ ID NO: 1347648 - RNA, 13 nt, Mycobacterium tuberculosis H37Rv
cuuuggugucgcu

SEQ ID NO: 1347649 - RNA, 19 nt, Mycobacterium tuberculosis H37Rv
gaccaccgaaauacccagc

SEQ ID NO: 1347650 - RNA, 15 nt, Mycobacterium tuberculosis H37Rv
gaccaccagcgccga

SEQ ID NO: 1347651 - RNA, 22 nt, Mycobacterium tuberculosis H37Rv
gaccaccagcgccgacccguac

SEQ ID NO: 1347652 - RNA, 15 nt, Mycobacterium tuberculosis H37Rv
gaccacgaccgucuc

SEQ ID NO: 1347653 - RNA, 16 nt, Mycobacterium tuberculosis H37Rv
gaccacgaaccgggug

SEQ ID NO: 1347654 - RNA, 21 nt, Mycobacterium tuberculosis H37Rv
gaccacgaaccgggugccgga

SEQ ID NO: 1347655 - RNA, 23 nt, Mycobacterium tuberculosis H37Rv
gaccacgaacgcgcgcagccggg

SEQ ID NO: 1347656 - RNA, 13 nt, Mycobacterium tuberculosis H37Rv
gaccaccugguuu

SEQ ID NO: 1347657 - RNA, 12 nt, Mycobacterium tuberculosis H37Rv
gaccaccugguu

SEQ ID NO: 1347658 - RNA, 21 nt, Mycobacterium tuberculosis H37Rv
gaccaccgggccgacagcacg

SEQ ID NO: 1347659 - RNA, 23 nt, Mycobacterium tuberculosis H37Rv
gaccaccgggccgacagcacgcc

SEQ ID NO: 1347660 - RNA, 19 nt, Mycobacterium tuberculosis H37Rv
gaccaccggguagccggcg

SEQ ID NO: 1347661 - RNA, 16 nt, Mycobacterium tuberculosis H37Rv
gaccaccugcaugugu

SEQ ID NO: 1347662 - RNA, 16 nt, Mycobacterium tuberculosis H37Rv
gaccaccgcugagccg

SEQ ID NO: 1347663 - RNA, 22 nt, Mycobacterium tuberculosis H37Rv
gaccaccgccgacaggccggcc

SEQ ID NO: 1347664 - RNA, 15 nt, Mycobacterium tuberculosis H37Rv
gaccaccgccggccc

SEQ ID NO: 1347665 - RNA, 13 nt, Mycobacterium tuberculosis H37Rv
gaccacggcaccg

SEQ ID NO: 1347666 - RNA, 16 nt, Mycobacterium tuberculosis H37Rv
gaccacgcaccgcccc

SEQ ID NO: 1347667 - RNA, 14 nt, Mycobacterium tuberculosis H37Rv
gaccacgcaccgcc

SEQ ID NO: 1347668 - RNA, 18 nt, Mycobacterium tuberculosis H37Rv
gaccacgcaccgccccgc

SEQ ID NO: 1347669 - RNA, 22 nt, Mycobacterium tuberculosis H37Rv
gaccacucgccggcggacgccc

SEQ ID NO: 1347670 - RNA, 19 nt, Mycobacterium tuberculosis H37Rv
gaccacuugcagcacaacg

SEQ ID NO: 1347671 - RNA, 15 nt, Mycobacterium tuberculosis H37Rv
gaccagaacgccaga

SEQ ID NO: 1347672 - RNA, 16 nt, Mycobacterium tuberculosis H37Rv
gaccagaaucucgccg

SEQ ID NO: 1347673 - RNA, 15 nt, Mycobacterium tuberculosis H37Rv
gaccaagguguccag

SEQ ID NO: 1347674 - RNA, 14 nt, Mycobacterium tuberculosis H37Rv
gaccaacgccaacg

SEQ ID NO: 1347675 - RNA, 23 nt, Mycobacterium tuberculosis H37Rv
gaccaacggggcagucaacuccc

SEQ ID NO: 1347676 - RNA, 23 nt, Mycobacterium tuberculosis H37Rv
gaccaacauguugucgucgccgc

SEQ ID NO: 1347677 - RNA, 20 nt, Mycobacterium tuberculosis H37Rv
gaccaacaccccccccaccc

SEQ ID NO: 1347678 - RNA, 17 nt, Mycobacterium tuberculosis H37Rv
gaccaaugcguugacgu

SEQ ID NO: 1347679 - RNA, 21 nt, Mycobacterium tuberculosis H37Rv
gaccaccacuaggucgccggc

SEQ ID NO: 1347680 - RNA, 13 nt, Mycobacterium tuberculosis H37Rv
gaccaccaccgcc

SEQ ID NO: 1347681 - RNA, 22 nt, Mycobacterium tuberculosis H37Rv
gaccaccagcaucguggccgca

SEQ ID NO: 1347682 - RNA, 20 nt, Mycobacterium tuberculosis H37Rv
gaccacaaccgugagcacca

SEQ ID NO: 1347683 - RNA, 14 nt, Mycobacterium tuberculosis H37Rv
gaccaggccagagc

SEQ ID NO: 1347684 - RNA, 19 nt, Mycobacterium tuberculosis H37Rv
gaccaggccgcgcgcaccg

SEQ ID NO: 1347685 - RNA, 18 nt, Mycobacterium tuberculosis H37Rv
gaccagcugccggcgacc

SEQ ID NO: 1347686 - RNA, 22 nt, Mycobacterium tuberculosis H37Rv
gaccaggaaguagaugagcaga

SEQ ID NO: 1347687 - RNA, 20 nt, Mycobacterium tuberculosis H37Rv
gaccaggaacggcucggccg

SEQ ID NO: 1347688 - RNA, 17 nt, Mycobacterium tuberculosis H37Rv
gaccaggaagcagguga

SEQ ID NO: 1347689 - RNA, 22 nt, Mycobacterium tuberculosis H37Rv
gaccaggaaugucuccaguagc

SEQ ID NO: 1347690 - RNA, 14 nt, Mycobacterium tuberculosis H37Rv
gaccagggcagcgg

SEQ ID NO: 1347691 - RNA, 16 nt, Mycobacterium tuberculosis H37Rv
gaccagggcagcggcc

SEQ ID NO: 1347692 - RNA, 23 nt, Mycobacterium tuberculosis H37Rv
gaccagggcagcggccagggcac

SEQ ID NO: 1347693 - RNA, 16 nt, Mycobacterium tuberculosis H37Rv
gaccagggucugcuca

SEQ ID NO: 1347694 - RNA, 16 nt, Mycobacterium tuberculosis H37Rv
gaccagguagaccagg

SEQ ID NO: 1347695 - RNA, 18 nt, Mycobacterium tuberculosis H37Rv
gaccagugaccgcagucc

SEQ ID NO: 1347696 - RNA, 21 nt, Mycobacterium tuberculosis H37Rv
gaccagcaggcccuggccacc

SEQ ID NO: 1347697 - RNA, 14 nt, Mycobacterium tuberculosis H37Rv
gaccagagcuucgc

SEQ ID NO: 1347698 - RNA, 16 nt, Mycobacterium tuberculosis H37Rv
gaccagauguaccuca

SEQ ID NO: 1347699 - RNA, 16 nt, Mycobacterium tuberculosis H37Rv
gaccagcagaccaagc

SEQ ID NO: 1347700 - RNA, 14 nt, Mycobacterium tuberculosis H37Rv
gaccagcagaucca

SEQ ID NO: 1347701 - RNA, 15 nt, Mycobacterium tuberculosis H37Rv
gaccagcgggcggcc

SEQ ID NO: 1347702 - RNA, 19 nt, Mycobacterium tuberculosis H37Rv
gaccagccgaucaucaccg

SEQ ID NO: 1347703 - RNA, 18 nt, Mycobacterium tuberculosis H37Rv
gaccagccgaucaucacc

SEQ ID NO: 1347704 - RNA, 16 nt, Mycobacterium tuberculosis H37Rv
gacauucguccgggca

SEQ ID NO: 1347705 - RNA, 18 nt, Mycobacterium tuberculosis H37Rv
gacaugguccgaccagcg

SEQ ID NO: 1347706 - RNA, 16 nt, Mycobacterium tuberculosis H37Rv
gacaugguccgaccag

SEQ ID NO: 1347707 - RNA, 17 nt, Mycobacterium tuberculosis H37Rv
gacaugucgcugccgcc

SEQ ID NO: 1347708 - RNA, 12 nt, Mycobacterium tuberculosis H37Rv
gacauccagauc

SEQ ID NO: 1347709 - RNA, 19 nt, Mycobacterium tuberculosis H37Rv
gacauccagaugcccagca

SEQ ID NO: 1347710 - RNA, 20 nt, Mycobacterium tuberculosis H37Rv
gacauccgcuuacggguguc

SEQ ID NO: 1347711 - RNA, 14 nt, Mycobacterium tuberculosis H37Rv
gacauccgaugcgu

SEQ ID NO: 1347712 - RNA, 18 nt, Mycobacterium tuberculosis H37Rv
gacaucgggcggcaccgc

SEQ ID NO: 1347713 - RNA, 16 nt, Mycobacterium tuberculosis H37Rv
gacaucgggccgccga

SEQ ID NO: 1347714 - RNA, 19 nt, Mycobacterium tuberculosis H37Rv
gacaucgggccgccgagcu

SEQ ID NO: 1347715 - RNA, 22 nt, Mycobacterium tuberculosis H37Rv
gacaugagcgccacgccgaggc

SEQ ID NO: 1347716 - RNA, 19 nt, Mycobacterium tuberculosis H37Rv
gacaugacagccccgccgc

SEQ ID NO: 1347717 - RNA, 21 nt, Mycobacterium tuberculosis H37Rv
gacaugcaggugaugagugcg

SEQ ID NO: 1347718 - RNA, 21 nt, Mycobacterium tuberculosis H37Rv
gacaugagcgccacgccgagg

SEQ ID NO: 1347719 - RNA, 19 nt, Mycobacterium tuberculosis H37Rv
gacaugcaggaauggguga

SEQ ID NO: 1347720 - RNA, 21 nt, Mycobacterium tuberculosis H37Rv
gacaucggucagcauggggua

SEQ ID NO: 1347721 - RNA, 21 nt, Mycobacterium tuberculosis H37Rv
gacaucggucagcgggcacgc

SEQ ID NO: 1347722 - RNA, 17 nt, Mycobacterium tuberculosis H37Rv
gacaggaucgugguagg

SEQ ID NO: 1347723 - RNA, 18 nt, Mycobacterium tuberculosis H37Rv
gacaggccggccaccagu

SEQ ID NO: 1347724 - RNA, 14 nt, Mycobacterium tuberculosis H37Rv
gacaggcggcggcc

SEQ ID NO: 1347725 - RNA, 13 nt, Mycobacterium tuberculosis H37Rv
gacagggccgcuc

SEQ ID NO: 1347726 - RNA, 21 nt, Mycobacterium tuberculosis H37Rv
gacagggugcgcuugcggccg

SEQ ID NO: 1347727 - RNA, 15 nt, Mycobacterium tuberculosis H37Rv
gacagucaacagggc

SEQ ID NO: 1347728 - RNA, 18 nt, Mycobacterium tuberculosis H37Rv
gacaggugccagaccagg

SEQ ID NO: 1347729 - RNA, 18 nt, Mycobacterium tuberculosis H37Rv
gacaggugcuaggaggag

SEQ ID NO: 1347730 - RNA, 20 nt, Mycobacterium tuberculosis H37Rv
gacagguagucgccggucag

SEQ ID NO: 1347731 - RNA, 22 nt, Mycobacterium tuberculosis H37Rv
gacagguagucgccggucaggc

SEQ ID NO: 1347732 - RNA, 23 nt, Mycobacterium tuberculosis H37Rv
gacaggucgcccaacaccgcgcc

SEQ ID NO: 1347733 - RNA, 19 nt, Mycobacterium tuberculosis H37Rv
gacaguuggcagcgcuggc

SEQ ID NO: 1347734 - RNA, 22 nt, Mycobacterium tuberculosis H37Rv
gacaguuuuuccgugccgacca

SEQ ID NO: 1347735 - RNA, 20 nt, Mycobacterium tuberculosis H37Rv
gacaguucguuaccacauac

SEQ ID NO: 1347736 - RNA, 21 nt, Mycobacterium tuberculosis H37Rv
gacagugugaagaccaccgcc

SEQ ID NO: 1347737 - RNA, 14 nt, Mycobacterium tuberculosis H37Rv
gacagugcugccuu

SEQ ID NO: 1347738 - RNA, 21 nt, Mycobacterium tuberculosis H37Rv
cguugccguuggugccgccug

SEQ ID NO: 1347739 - RNA, 20 nt, Mycobacterium tuberculosis H37Rv
cguugccgccguugccgccg

SEQ ID NO: 1347740 - RNA, 20 nt, Mycobacterium tuberculosis H37Rv
cguugccgccgucgccgccg

SEQ ID NO: 1347741 - RNA, 20 nt, Mycobacterium tuberculosis H37Rv
cguugccgccggcgccgccg

SEQ ID NO: 1347742 - RNA, 21 nt, Mycobacterium tuberculosis H37Rv
cguugcggaaucagcacccca

SEQ ID NO: 1347743 - RNA, 19 nt, Mycobacterium tuberculosis H37Rv
cguugcgccucuuccuggc

SEQ ID NO: 1347744 - RNA, 21 nt, Mycobacterium tuberculosis H37Rv
cguugcgccucuuccuggcgu

SEQ ID NO: 1347745 - RNA, 20 nt, Mycobacterium tuberculosis H37Rv
cguugcaggugaacaacagc

SEQ ID NO: 1347746 - RNA, 21 nt, Mycobacterium tuberculosis H37Rv
cguugcagaccaccagugagg

SEQ ID NO: 1347747 - RNA, 15 nt, Mycobacterium tuberculosis H37Rv
cguugcacagcuugg

SEQ ID NO: 1347748 - RNA, 15 nt, Mycobacterium tuberculosis H37Rv
cguugauucgggagg

SEQ ID NO: 1347749 - RNA, 15 nt, Mycobacterium tuberculosis H37Rv
cguugcacagcagcg

SEQ ID NO: 1347750 - RNA, 12 nt, Mycobacterium tuberculosis H37Rv
cguugccaccgg

SEQ ID NO: 1347751 - RNA, 22 nt, Mycobacterium tuberculosis H37Rv
cguugcccccauugccgccguc

SEQ ID NO: 1347752 - RNA, 17 nt, Mycobacterium tuberculosis H37Rv
cguugcccgcgaaggca

SEQ ID NO: 1347753 - RNA, 18 nt, Mycobacterium tuberculosis H37Rv
cguugccgccgaagccga

SEQ ID NO: 1347754 - RNA, 16 nt, Mycobacterium tuberculosis H37Rv
cguugccgccggcgcc

SEQ ID NO: 1347755 - RNA, 19 nt, Mycobacterium tuberculosis H37Rv
cguugccgcccacuagcag

SEQ ID NO: 1347756 - RNA, 13 nt, Mycobacterium tuberculosis H37Rv
cguugccgcccgu

SEQ ID NO: 1347757 - RNA, 22 nt, Mycobacterium tuberculosis H37Rv
cguugccgaucgcuccggcccu

SEQ ID NO: 1347758 - RNA, 21 nt, Mycobacterium tuberculosis H37Rv
cguugccgccagcgccaccgu

SEQ ID NO: 1347759 - RNA, 16 nt, Mycobacterium tuberculosis H37Rv
cguugcccuccuucuc

SEQ ID NO: 1347760 - RNA, 19 nt, Mycobacterium tuberculosis H37Rv
cguugccgaaacccgaguu

SEQ ID NO: 1347761 - RNA, 16 nt, Mycobacterium tuberculosis H37Rv
cguugaugaccgccgc

SEQ ID NO: 1347762 - RNA, 16 nt, Mycobacterium tuberculosis H37Rv
cguugaucgucucggc

SEQ ID NO: 1347763 - RNA, 11 nt, Mycobacterium tuberculosis H37Rv
cguugaggccg

SEQ ID NO: 1347764 - RNA, 14 nt, Mycobacterium tuberculosis H37Rv
cguugaccucuucg

SEQ ID NO: 1347765 - RNA, 22 nt, Mycobacterium tuberculosis H37Rv
cguugacggcuucggcagccgc

SEQ ID NO: 1347766 - RNA, 20 nt, Mycobacterium tuberculosis H37Rv
cguugacucugcguccacca

SEQ ID NO: 1347767 - RNA, 17 nt, Mycobacterium tuberculosis H37Rv
cguugaagcccaacagc

SEQ ID NO: 1347768 - RNA, 19 nt, Mycobacterium tuberculosis H37Rv
cguugaagacggccaccgg

SEQ ID NO: 1347769 - RNA, 18 nt, Mycobacterium tuberculosis H37Rv
cguugaagaauccggccc

SEQ ID NO: 1347770 - RNA, 23 nt, Mycobacterium tuberculosis H37Rv
cguugaccagaaccuggagccgu

SEQ ID NO: 1347771 - RNA, 14 nt, Mycobacterium tuberculosis H37Rv
cguucgugagcggc

SEQ ID NO: 1347772 - RNA, 18 nt, Mycobacterium tuberculosis H37Rv
cguucgucguaguccagg

SEQ ID NO: 1347773 - RNA, 18 nt, Mycobacterium tuberculosis H37Rv
cguucgagagccccgacc

SEQ ID NO: 1347774 - RNA, 21 nt, Mycobacterium tuberculosis H37Rv
cguucgagagccccgaccagc

SEQ ID NO: 1347775 - RNA, 23 nt, Mycobacterium tuberculosis H37Rv
cguucgggugagcacccagcggc

SEQ ID NO: 1347776 - RNA, 18 nt, Mycobacterium tuberculosis H37Rv
cguucgggccguccuccc

SEQ ID NO: 1347777 - RNA, 16 nt, Mycobacterium tuberculosis H37Rv
cguucgggcuccagca

SEQ ID NO: 1347778 - RNA, 20 nt, Mycobacterium tuberculosis H37Rv
cguucggggccccgcggcgc

SEQ ID NO: 1347779 - RNA, 23 nt, Mycobacterium tuberculosis H37Rv
cguucggcgcccgcucggccgca

SEQ ID NO: 1347780 - RNA, 21 nt, Mycobacterium tuberculosis H37Rv
cguuccucgacguaggccagg

SEQ ID NO: 1347781 - RNA, 21 nt, Mycobacterium tuberculosis H37Rv
cguuccugaucgagcgccagc

SEQ ID NO: 1347782 - RNA, 15 nt, Mycobacterium tuberculosis H37Rv
cguuccgggccggcg

SEQ ID NO: 1347783 - RNA, 15 nt, Mycobacterium tuberculosis H37Rv
cguucaugcggcggc

SEQ ID NO: 1347784 - RNA, 16 nt, Mycobacterium tuberculosis H37Rv
cguucaugcggcggcg

SEQ ID NO: 1347785 - RNA, 18 nt, Mycobacterium tuberculosis H37Rv
cguucaugaucggcagaa

SEQ ID NO: 1347786 - RNA, 15 nt, Mycobacterium tuberculosis H37Rv
cguuccgccgccucg

SEQ ID NO: 1347787 - RNA, 23 nt, Mycobacterium tuberculosis H37Rv
cguccaccacaccugcggcugcu

SEQ ID NO: 1347788 - RNA, 16 nt, Mycobacterium tuberculosis H37Rv
cguccaauagcugaca

SEQ ID NO: 1347789 - RNA, 20 nt, Mycobacterium tuberculosis H37Rv
cguccaagaacggaugccgg

SEQ ID NO: 1347790 - RNA, 18 nt, Mycobacterium tuberculosis H37Rv
cguccaagccagcguugg

SEQ ID NO: 1347791 - RNA, 12 nt, Mycobacterium tuberculosis H37Rv
cguccaacccag

SEQ ID NO: 1347792 - RNA, 23 nt, Mycobacterium tuberculosis H37Rv
cguccaaccaaggacgaacgcgc

SEQ ID NO: 1347793 - RNA, 15 nt, Mycobacterium tuberculosis H37Rv
cguccaccagccggu

SEQ ID NO: 1347794 - RNA, 24 nt, Mycobacterium tuberculosis H37Rv
cguccaccgacguggccagcccgc

SEQ ID NO: 1347795 - RNA, 12 nt, Mycobacterium tuberculosis H37Rv
cguccaccagcc

SEQ ID NO: 1347796 - RNA, 13 nt, Mycobacterium tuberculosis H37Rv
cguuguccaccgc

SEQ ID NO: 1347797 - RNA, 19 nt, Mycobacterium tuberculosis H37Rv
cguugcuauucgccagcgc

SEQ ID NO: 1347798 - RNA, 18 nt, Mycobacterium tuberculosis H37Rv
cguugcguagcaggucga

SEQ ID NO: 1347799 - RNA, 15 nt, Mycobacterium tuberculosis H37Rv
cguuuaucagcaaga

SEQ ID NO: 1347800 - RNA, 17 nt, Mycobacterium tuberculosis H37Rv
cguuguggcguguggcu

SEQ ID NO: 1347801 - RNA, 18 nt, Mycobacterium tuberculosis H37Rv
cguugugugccagcgugg

SEQ ID NO: 1347802 - RNA, 15 nt, Mycobacterium tuberculosis H37Rv
cguuuugcggcccgg

SEQ ID NO: 1347803 - RNA, 16 nt, Mycobacterium tuberculosis H37Rv
cguuuucgccgauccc

SEQ ID NO: 1347804 - RNA, 14 nt, Mycobacterium tuberculosis H37Rv
cguuuuccagccga

SEQ ID NO: 1347805 - RNA, 14 nt, Mycobacterium tuberculosis H37Rv
cuaaagcuaaaccc

SEQ ID NO: 1347806 - RNA, 18 nt, Mycobacterium tuberculosis H37Rv
cuaccaaaucgacacccu

SEQ ID NO: 1347807 - RNA, 18 nt, Mycobacterium tuberculosis H37Rv
cuacaggguuggcagcaa

SEQ ID NO: 1347808 - RNA, 22 nt, Mycobacterium tuberculosis H37Rv
cuacacccauuacugagcuucc

SEQ ID NO: 1347809 - RNA, 23 nt, Mycobacterium tuberculosis H37Rv
cuacaccugcggcgucaaaucca

SEQ ID NO: 1347810 - RNA, 16 nt, Mycobacterium tuberculosis H37Rv
cuaauucggggccgcg

SEQ ID NO: 1347811 - RNA, 22 nt, Mycobacterium tuberculosis H37Rv
cuaacucgacccguaauugguu

SEQ ID NO: 1347812 - RNA, 12 nt, Mycobacterium tuberculosis H37Rv
cuaacucccccg

SEQ ID NO: 1347813 - RNA, 13 nt, Mycobacterium tuberculosis H37Rv
cuacccgggccag

SEQ ID NO: 1347814 - RNA, 17 nt, Mycobacterium tuberculosis H37Rv
cuaccgaugaaccaggc

SEQ ID NO: 1347815 - RNA, 23 nt, Mycobacterium tuberculosis H37Rv
cuaccgaacaguaggccuccgcu

SEQ ID NO: 1347816 - RNA, 17 nt, Mycobacterium tuberculosis H37Rv
cuaccgcaggugccacc

SEQ ID NO: 1347817 - RNA, 23 nt, Mycobacterium tuberculosis H37Rv
cuacucauccagaagccggccac

SEQ ID NO: 1347818 - RNA, 18 nt, Mycobacterium tuberculosis H37Rv
cuacugauagacccuggg

SEQ ID NO: 1347819 - RNA, 12 nt, Mycobacterium tuberculosis H37Rv
cuacucgcggcc

SEQ ID NO: 1347820 - RNA, 15 nt, Mycobacterium tuberculosis H37Rv
cuacucgcggccggc

SEQ ID NO: 1347821 - RNA, 21 nt, Mycobacterium tuberculosis H37Rv
cuacucgugaccgucgggccc

SEQ ID NO: 1347822 - RNA, 17 nt, Mycobacterium tuberculosis H37Rv
cuagaccgggcgguugg

SEQ ID NO: 1347823 - RNA, 15 nt, Mycobacterium tuberculosis H37Rv
cuacuuuuccacccg

SEQ ID NO: 1347824 - RNA, 17 nt, Mycobacterium tuberculosis H37Rv
cuagcggcucaccgcgc

SEQ ID NO: 1347825 - RNA, 22 nt, Mycobacterium tuberculosis H37Rv
cuagcgguauuugaugagcaac

SEQ ID NO: 1347826 - RNA, 19 nt, Mycobacterium tuberculosis H37Rv
cuagugacugguauuuccc

SEQ ID NO: 1347827 - RNA, 13 nt, Mycobacterium tuberculosis H37Rv
cuagucaccuuga

SEQ ID NO: 1347828 - RNA, 16 nt, Mycobacterium tuberculosis H37Rv
cuaguccggcacugcg

SEQ ID NO: 1347829 - RNA, 23 nt, Mycobacterium tuberculosis H37Rv
cuagggcagcagcccgggcagcc

SEQ ID NO: 1347830 - RNA, 15 nt, Mycobacterium tuberculosis H37Rv
cuagggcagcagccc

SEQ ID NO: 1347831 - RNA, 16 nt, Mycobacterium tuberculosis H37Rv
cuagggugagcccggg

SEQ ID NO: 1347832 - RNA, 19 nt, Mycobacterium tuberculosis H37Rv
cuagguccgaacuugacga

SEQ ID NO: 1347833 - RNA, 19 nt, Mycobacterium tuberculosis H37Rv
cuagguucgaguccuggua

SEQ ID NO: 1347834 - RNA, 23 nt, Mycobacterium tuberculosis H37Rv
cuaggugugcgacgacggcgccg

SEQ ID NO: 1347835 - RNA, 16 nt, Mycobacterium tuberculosis H37Rv
cuaugccccggagcca

SEQ ID NO: 1347836 - RNA, 23 nt, Mycobacterium tuberculosis H37Rv
cuaucguugugcggacaucaccg

SEQ ID NO: 1347837 - RNA, 16 nt, Mycobacterium tuberculosis H37Rv
cuaguucgagcugcca

SEQ ID NO: 1347838 - RNA, 16 nt, Mycobacterium tuberculosis H37Rv
cuaguugacgcagccc

SEQ ID NO: 1347839 - RNA, 22 nt, Mycobacterium tuberculosis H37Rv
cuaguugcaacggguacacccg

SEQ ID NO: 1347840 - RNA, 22 nt, Mycobacterium tuberculosis H37Rv
cucacccagcugggucccgcug

SEQ ID NO: 1347841 - RNA, 15 nt, Mycobacterium tuberculosis H37Rv
cucacacuggcuuug

SEQ ID NO: 1347842 - RNA, 19 nt, Mycobacterium tuberculosis H37Rv
cucacccggcgucucgcag

SEQ ID NO: 1347843 - RNA, 23 nt, Mycobacterium tuberculosis H37Rv
cucaccgaacgcgaugcgccauu

SEQ ID NO: 1347844 - RNA, 16 nt, Mycobacterium tuberculosis H37Rv
cucacccgggcagccu

SEQ ID NO: 1347845 - RNA, 14 nt, Mycobacterium tuberculosis H37Rv
cucacgcagcgcca

SEQ ID NO: 1347846 - RNA, 19 nt, Mycobacterium tuberculosis H37Rv
cucacgacuggcgcccagc

SEQ ID NO: 1347847 - RNA, 19 nt, Mycobacterium tuberculosis H37Rv
cucacgcugaagccgcugg

SEQ ID NO: 1347848 - RNA, 19 nt, Mycobacterium tuberculosis H37Rv
cucacgcgggucguuacca

SEQ ID NO: 1347849 - RNA, 21 nt, Mycobacterium tuberculosis H37Rv
cucaagauuuccaucgcaaug

SEQ ID NO: 1347850 - RNA, 15 nt, Mycobacterium tuberculosis H37Rv
cucaagauuuccauc

SEQ ID NO: 1347851 - RNA, 13 nt, Mycobacterium tuberculosis H37Rv
cucaacgggccgc

SEQ ID NO: 1347852 - RNA, 15 nt, Mycobacterium tuberculosis H37Rv
cucaacaccaggccg

SEQ ID NO: 1347853 - RNA, 16 nt, Mycobacterium tuberculosis H37Rv
cucaacgaucgcgccg

SEQ ID NO: 1347854 - RNA, 16 nt, Mycobacterium tuberculosis H37Rv
cucaacgacaccauag

SEQ ID NO: 1347855 - RNA, 18 nt, Mycobacterium tuberculosis H37Rv
cucaacgacaccauaggc

SEQ ID NO: 1347856 - RNA, 14 nt, Mycobacterium tuberculosis H37Rv
cucaacaccagcaa

SEQ ID NO: 1347857 - RNA, 15 nt, Mycobacterium tuberculosis H37Rv
cucaugcccgggaug

SEQ ID NO: 1347858 - RNA, 23 nt, Mycobacterium tuberculosis H37Rv
cucaucccgagaucaccuuggca

SEQ ID NO: 1347859 - RNA, 22 nt, Mycobacterium tuberculosis H37Rv
cucauccaccgauggcgcgcuc

SEQ ID NO: 1347860 - RNA, 13 nt, Mycobacterium tuberculosis H37Rv
cuccaagcaauuc

SEQ ID NO: 1347861 - RNA, 16 nt, Mycobacterium tuberculosis H37Rv
cuccaagcucgacaac

SEQ ID NO: 1347862 - RNA, 14 nt, Mycobacterium tuberculosis H37Rv
cuccaacaacucca

SEQ ID NO: 1347863 - RNA, 17 nt, Mycobacterium tuberculosis H37Rv
cucauuggcauugccca

SEQ ID NO: 1347864 - RNA, 14 nt, Mycobacterium tuberculosis H37Rv
cucauuccccggaa

SEQ ID NO: 1347865 - RNA, 16 nt, Mycobacterium tuberculosis H37Rv
cucauagugcaggucg

SEQ ID NO: 1347866 - RNA, 20 nt, Mycobacterium tuberculosis H37Rv
cucagcgguggcguggugga

SEQ ID NO: 1347867 - RNA, 15 nt, Mycobacterium tuberculosis H37Rv
cucagcggcucgccu

SEQ ID NO: 1347868 - RNA, 22 nt, Mycobacterium tuberculosis H37Rv
cucagcggcccgcugcgcggcc

SEQ ID NO: 1347869 - RNA, 13 nt, Mycobacterium tuberculosis H37Rv
cucagcgcgcgcc

SEQ ID NO: 1347870 - RNA, 12 nt, Mycobacterium tuberculosis H37Rv
cucagcgcggcc

SEQ ID NO: 1347871 - RNA, 22 nt, Mycobacterium tuberculosis H37Rv
cucacugugguaggccggggcg

SEQ ID NO: 1347872 - RNA, 22 nt, Mycobacterium tuberculosis H37Rv
cucacucgccgaaucgcugacc

SEQ ID NO: 1347873 - RNA, 19 nt, Mycobacterium tuberculosis H37Rv
cuccccgaucugcuccucg

SEQ ID NO: 1347874 - RNA, 13 nt, Mycobacterium tuberculosis H37Rv
cuccccgccggaa

SEQ ID NO: 1347875 - RNA, 13 nt, Mycobacterium tuberculosis H37Rv
cuccccgccgggc

SEQ ID NO: 1347876 - RNA, 19 nt, Mycobacterium tuberculosis H37Rv
cuccaccgcguccaggugc

SEQ ID NO: 1347877 - RNA, 16 nt, Mycobacterium tuberculosis H37Rv
cuccccguccugccag

SEQ ID NO: 1347878 - RNA, 15 nt, Mycobacterium tuberculosis H37Rv
cuccccguccugcca

SEQ ID NO: 1347879 - RNA, 19 nt, Mycobacterium tuberculosis H37Rv
cuccaccaacucgacgugc

SEQ ID NO: 1347880 - RNA, 14 nt, Mycobacterium tuberculosis H37Rv
cuccaccaccgacg

SEQ ID NO: 1347881 - RNA, 22 nt, Mycobacterium tuberculosis H37Rv
cuccacccaccuggaucagcgu

SEQ ID NO: 1347882 - RNA, 20 nt, Mycobacterium tuberculosis H37Rv
cuccaccgaaaaguccgccg

SEQ ID NO: 1347883 - RNA, 15 nt, Mycobacterium tuberculosis H37Rv
cucccgucucgacag

SEQ ID NO: 1347884 - RNA, 23 nt, Mycobacterium tuberculosis H37Rv
cucccguuuggcugucugcccgc

SEQ ID NO: 1347885 - RNA, 18 nt, Mycobacterium tuberculosis H37Rv
cuccgaaucugccggccg

SEQ ID NO: 1347886 - RNA, 14 nt, Mycobacterium tuberculosis H37Rv
cuccgacggccgcg

SEQ ID NO: 1347887 - RNA, 20 nt, Mycobacterium tuberculosis H37Rv
cuccgacgggggucgggcgu

SEQ ID NO: 1347888 - RNA, 19 nt, Mycobacterium tuberculosis H37Rv
cucccgguugggguggcgg

SEQ ID NO: 1347889 - RNA, 13 nt, Mycobacterium tuberculosis H37Rv
cucccgggccgcc

SEQ ID NO: 1347890 - RNA, 14 nt, Mycobacterium tuberculosis H37Rv
cucccgggccgccg

SEQ ID NO: 1347891 - RNA, 14 nt, Mycobacterium tuberculosis H37Rv
cucccggccgcacc

SEQ ID NO: 1347892 - RNA, 13 nt, Mycobacterium tuberculosis H37Rv
cucccgugcuggc

SEQ ID NO: 1347893 - RNA, 15 nt, Mycobacterium tuberculosis H37Rv
cuccgcgagcccggc

SEQ ID NO: 1347894 - RNA, 16 nt, Mycobacterium tuberculosis H37Rv
cuccgccgucgccacc

SEQ ID NO: 1347895 - RNA, 13 nt, Mycobacterium tuberculosis H37Rv
cuccgccugcccc

SEQ ID NO: 1347896 - RNA, 23 nt, Mycobacterium tuberculosis H37Rv
cuccgaugugccgauuggccugc

SEQ ID NO: 1347897 - RNA, 24 nt, Mycobacterium tuberculosis H37Rv
cuccgccggcaccuccggcaccgc

SEQ ID NO: 1347898 - RNA, 22 nt, Mycobacterium tuberculosis H37Rv
cuccgccggguuggcgccggcc

SEQ ID NO: 1347899 - RNA, 23 nt, Mycobacterium tuberculosis H37Rv
cuccgccggguuggcgccggcca

SEQ ID NO: 1347900 - RNA, 24 nt, Mycobacterium tuberculosis H37Rv
cuccgccggguuggcgccggccag

SEQ ID NO: 1347901 - RNA, 18 nt, Mycobacterium tuberculosis H37Rv
cuccgaugccgacggcgc

SEQ ID NO: 1347902 - RNA, 20 nt, Mycobacterium tuberculosis H37Rv
cuccgagcacaggaucaccc

SEQ ID NO: 1347903 - RNA, 19 nt, Mycobacterium tuberculosis H37Rv
cuccucacggauccgccgg

SEQ ID NO: 1347904 - RNA, 15 nt, Mycobacterium tuberculosis H37Rv
cuccucagccaccgc

SEQ ID NO: 1347905 - RNA, 17 nt, Mycobacterium tuberculosis H37Rv
cuccguaacgccaagcu

SEQ ID NO: 1347906 - RNA, 19 nt, Mycobacterium tuberculosis H37Rv
cuccgucggccaggccacg

SEQ ID NO: 1347907 - RNA, 22 nt, Mycobacterium tuberculosis H37Rv
cuccguaacgccaagcucggcc

SEQ ID NO: 1347908 - RNA, 23 nt, Mycobacterium tuberculosis H37Rv
cuccguaacgccaagcucggccc

SEQ ID NO: 1347909 - RNA, 21 nt, Mycobacterium tuberculosis H37Rv
cuccgguggccaacaccgcca

SEQ ID NO: 1347910 - RNA, 15 nt, Mycobacterium tuberculosis H37Rv
cuccgcguugggcac

SEQ ID NO: 1347911 - RNA, 20 nt, Mycobacterium tuberculosis H37Rv
cuccgcggcgaaccagcgcg

SEQ ID NO: 1347912 - RNA, 15 nt, Mycobacterium tuberculosis H37Rv
cuccgcggcgcagca

SEQ ID NO: 1347913 - RNA, 21 nt, Mycobacterium tuberculosis H37Rv
cuccgcguagaguguccccgg

SEQ ID NO: 1347914 - RNA, 21 nt, Mycobacterium tuberculosis H37Rv
cuccgcggcucaaucuccucc

SEQ ID NO: 1347915 - RNA, 22 nt, Mycobacterium tuberculosis H37Rv
cuccgcgggguugauugacccg

SEQ ID NO: 1347916 - RNA, 14 nt, Mycobacterium tuberculosis H37Rv
cuccgcgccgccga

SEQ ID NO: 1347917 - RNA, 14 nt, Mycobacterium tuberculosis H37Rv
cuccgcugccgccc

SEQ ID NO: 1347918 - RNA, 16 nt, Mycobacterium tuberculosis H37Rv
cuccgcugccgcccgc

SEQ ID NO: 1347919 - RNA, 13 nt, Mycobacterium tuberculosis H37Rv
cuccgcugccgcc

SEQ ID NO: 1347920 - RNA, 13 nt, Mycobacterium tuberculosis H37Rv
cuccggaaccacu

SEQ ID NO: 1347921 - RNA, 16 nt, Mycobacterium tuberculosis H37Rv
cuccggaaagcucucg

SEQ ID NO: 1347922 - RNA, 19 nt, Mycobacterium tuberculosis H37Rv
cuccgcugaugagccgcag

SEQ ID NO: 1347923 - RNA, 19 nt, Mycobacterium tuberculosis H37Rv
cuccggcaccaacgccacc

SEQ ID NO: 1347924 - RNA, 17 nt, Mycobacterium tuberculosis H37Rv
cuccggcaacagcacca

SEQ ID NO: 1347925 - RNA, 23 nt, Mycobacterium tuberculosis H37Rv
cuccggauaacccagcggcgcca

SEQ ID NO: 1347926 - RNA, 20 nt, Mycobacterium tuberculosis H37Rv
cuccggauccucggccgcca

SEQ ID NO: 1347927 - RNA, 13 nt, Mycobacterium tuberculosis H37Rv
cuccggacgcacg

SEQ ID NO: 1347928 - RNA, 14 nt, Mycobacterium tuberculosis H37Rv
cuccuccugugcga

SEQ ID NO: 1347929 - RNA, 23 nt, Mycobacterium tuberculosis H37Rv
cuccucgugcacgcacagcccga

SEQ ID NO: 1347930 - RNA, 17 nt, Mycobacterium tuberculosis H37Rv
cuccucgugcacgcaca

SEQ ID NO: 1347931 - RNA, 21 nt, Mycobacterium tuberculosis H37Rv
cuccucgucgguuccgggcgc

SEQ ID NO: 1347932 - RNA, 14 nt, Mycobacterium tuberculosis H37Rv
cuccucgucgcucc

SEQ ID NO: 1347933 - RNA, 14 nt, Mycobacterium tuberculosis H37Rv
cuccuccggcacca

SEQ ID NO: 1347934 - RNA, 16 nt, Mycobacterium tuberculosis H37Rv
cuccuccaccagugcc

SEQ ID NO: 1347935 - RNA, 14 nt, Mycobacterium tuberculosis H37Rv
cuccuccagagaca

SEQ ID NO: 1347936 - RNA, 23 nt, Mycobacterium tuberculosis H37Rv
cuccucagccaccgcggucagcu

SEQ ID NO: 1347937 - RNA, 20 nt, Mycobacterium tuberculosis H37Rv
cuccucauagagcggcacca

SEQ ID NO: 1347938 - RNA, 21 nt, Mycobacterium tuberculosis H37Rv
cuccugcggcaccgcugagga

SEQ ID NO: 1347939 - RNA, 15 nt, Mycobacterium tuberculosis H37Rv
cuccugcggcaccgc

SEQ ID NO: 1347940 - RNA, 14 nt, Mycobacterium tuberculosis H37Rv
cuccugaacgaaau

SEQ ID NO: 1347941 - RNA, 11 nt, Mycobacterium tuberculosis H37Rv
cuccugcucgu

SEQ ID NO: 1347942 - RNA, 21 nt, Mycobacterium tuberculosis H37Rv
cucgagggauguagugcugcu

SEQ ID NO: 1347943 - RNA, 15 nt, Mycobacterium tuberculosis H37Rv
cucgauccacugccg

SEQ ID NO: 1347944 - RNA, 15 nt, Mycobacterium tuberculosis H37Rv
cucgagcaugcccag

SEQ ID NO: 1347945 - RNA, 16 nt, Mycobacterium tuberculosis H37Rv
cucgagcaugcccagc

SEQ ID NO: 1347946 - RNA, 19 nt, Mycobacterium tuberculosis H37Rv
cucgagcccgcguucagga

SEQ ID NO: 1347947 - RNA, 17 nt, Mycobacterium tuberculosis H37Rv
cucgagcaggcgcacca

SEQ ID NO: 1347948 - RNA, 21 nt, Mycobacterium tuberculosis H37Rv
cucgaugacaucggucagcgg

SEQ ID NO: 1347949 - RNA, 24 nt, Mycobacterium tuberculosis H37Rv
cucgauccacugccgcgcgcccgc

SEQ ID NO: 1347950 - RNA, 23 nt, Mycobacterium tuberculosis H37Rv
cucgcacucguugccgaccaugc

SEQ ID NO: 1347951 - RNA, 16 nt, Mycobacterium tuberculosis H37Rv
cucgcacagcaccacg

SEQ ID NO: 1347952 - RNA, 14 nt, Mycobacterium tuberculosis H37Rv
cucgcacagccgcu

SEQ ID NO: 1347953 - RNA, 14 nt, Mycobacterium tuberculosis H37Rv
cucgcaccaccacg

SEQ ID NO: 1347954 - RNA, 22 nt, Mycobacterium tuberculosis H37Rv
cucgcccccucuagcgccucgc

SEQ ID NO: 1347955 - RNA, 19 nt, Mycobacterium tuberculosis H37Rv
cucgcauguucuccacgcc

SEQ ID NO: 1347956 - RNA, 11 nt, Mycobacterium tuberculosis H37Rv
cucgcccaggg

SEQ ID NO: 1347957 - RNA, 18 nt, Mycobacterium tuberculosis H37Rv
cucgcaggcgcagauucc

SEQ ID NO: 1347958 - RNA, 21 nt, Mycobacterium tuberculosis H37Rv
cucgccgaaaagggcgacagc

SEQ ID NO: 1347959 - RNA, 19 nt, Mycobacterium tuberculosis H37Rv
cucgccgaaaucggccagc

SEQ ID NO: 1347960 - RNA, 16 nt, Mycobacterium tuberculosis H37Rv
cucgcccuugaccgaa

SEQ ID NO: 1347961 - RNA, 22 nt, Mycobacterium tuberculosis H37Rv
cucgcccugagaacacguucgg

SEQ ID NO: 1347962 - RNA, 15 nt, Mycobacterium tuberculosis H37Rv
cucgcccgccgccac

SEQ ID NO: 1347963 - RNA, 13 nt, Mycobacterium tuberculosis H37Rv
cucgcagccacgc

SEQ ID NO: 1347964 - RNA, 12 nt, Mycobacterium tuberculosis H37Rv
cucgccgccgcu

SEQ ID NO: 1347965 - RNA, 18 nt, Mycobacterium tuberculosis H37Rv
cucgccgcacgccggcau

SEQ ID NO: 1347966 - RNA, 16 nt, Mycobacterium tuberculosis H37Rv
cucgccgcacgccggc

SEQ ID NO: 1347967 - RNA, 23 nt, Mycobacterium tuberculosis H37Rv
cucgccgaggccuaccaggcgcg

SEQ ID NO: 1347968 - RNA, 16 nt, Mycobacterium tuberculosis H37Rv
cucgccgaccuuggcg

SEQ ID NO: 1347969 - RNA, 21 nt, Mycobacterium tuberculosis H37Rv
cucgccgucauagcaggccuc

SEQ ID NO: 1347970 - RNA, 14 nt, Mycobacterium tuberculosis H37Rv
cucgccgccgcugu

SEQ ID NO: 1347971 - RNA, 17 nt, Mycobacterium tuberculosis H37Rv
cucgccgcgcaccgacc

SEQ ID NO: 1347972 - RNA, 23 nt, Mycobacterium tuberculosis H37Rv
cuccuggcaaccgaauugaacug

SEQ ID NO: 1347973 - RNA, 16 nt, Mycobacterium tuberculosis H37Rv
cuccuggcaaccgaau

SEQ ID NO: 1347974 - RNA, 14 nt, Mycobacterium tuberculosis H37Rv
cuccuggucaaccg

SEQ ID NO: 1347975 - RNA, 20 nt, Mycobacterium tuberculosis H37Rv
cuccuguaacugcuccuggu

SEQ ID NO: 1347976 - RNA, 18 nt, Mycobacterium tuberculosis H37Rv
cuccuggcgaaugucgcu

SEQ ID NO: 1347977 - RNA, 22 nt, Mycobacterium tuberculosis H37Rv
cuccuuaucgucgacgccgauc

SEQ ID NO: 1347978 - RNA, 19 nt, Mycobacterium tuberculosis H37Rv
cucgaaaccguggccaucg

SEQ ID NO: 1347979 - RNA, 23 nt, Mycobacterium tuberculosis H37Rv
cuccuugggcgacgcggcgccgc

SEQ ID NO: 1347980 - RNA, 16 nt, Mycobacterium tuberculosis H37Rv
cuccuugugccugcug

SEQ ID NO: 1347981 - RNA, 14 nt, Mycobacterium tuberculosis H37Rv
cuccuugagccggg

SEQ ID NO: 1347982 - RNA, 17 nt, Mycobacterium tuberculosis H37Rv
cuccuugaaccgggaca

SEQ ID NO: 1347983 - RNA, 13 nt, Mycobacterium tuberculosis H37Rv
cuccuugagguca

SEQ ID NO: 1347984 - RNA, 14 nt, Mycobacterium tuberculosis H37Rv
cucgaacgccgccc

SEQ ID NO: 1347985 - RNA, 15 nt, Mycobacterium tuberculosis H37Rv
cucgaaguuggcuuu

SEQ ID NO: 1347986 - RNA, 16 nt, Mycobacterium tuberculosis H37Rv
cucgaacucggcggcc

SEQ ID NO: 1347987 - RNA, 20 nt, Mycobacterium tuberculosis H37Rv
cucgaacucggcggccagcg

SEQ ID NO: 1347988 - RNA, 16 nt, Mycobacterium tuberculosis H37Rv
cucgacgaggccacgg

SEQ ID NO: 1347989 - RNA, 16 nt, Mycobacterium tuberculosis H37Rv
cucgacgaucagcacg

SEQ ID NO: 1347990 - RNA, 16 nt, Mycobacterium tuberculosis H37Rv
cucgacgacgggcgcc

SEQ ID NO: 1347991 - RNA, 18 nt, Mycobacterium tuberculosis H37Rv
cucgacgaucugcagcac

SEQ ID NO: 1347992 - RNA, 17 nt, Mycobacterium tuberculosis H37Rv
cucgaccucagacagcu

SEQ ID NO: 1347993 - RNA, 16 nt, Mycobacterium tuberculosis H37Rv
cucgaccgucaccgga

SEQ ID NO: 1347994 - RNA, 15 nt, Mycobacterium tuberculosis H37Rv
cucgaccgccagccg

SEQ ID NO: 1347995 - RNA, 15 nt, Mycobacterium tuberculosis H37Rv
cucgaccgauagcug

SEQ ID NO: 1347996 - RNA, 20 nt, Mycobacterium tuberculosis H37Rv
cucgacccggcgcagcaacg

SEQ ID NO: 1347997 - RNA, 14 nt, Mycobacterium tuberculosis H37Rv
cucgaauacaccuu

SEQ ID NO: 1347998 - RNA, 20 nt, Mycobacterium tuberculosis H37Rv
cucgaaucgucacggacccu

SEQ ID NO: 1347999 - RNA, 17 nt, Mycobacterium tuberculosis H37Rv
cucggcgguaaaugccu

SEQ ID NO: 1348000 - RNA, 21 nt, Mycobacterium tuberculosis H37Rv
cucggcgguaaaugccugccc

SEQ ID NO: 1348001 - RNA, 18 nt, Mycobacterium tuberculosis H37Rv
cucggcggugccgcggcu

SEQ ID NO: 1348002 - RNA, 17 nt, Mycobacterium tuberculosis H37Rv
cucggcggucgggagau

SEQ ID NO: 1348003 - RNA, 21 nt, Mycobacterium tuberculosis H37Rv
cucggcgggggaccccgccag

SEQ ID NO: 1348004 - RNA, 15 nt, Mycobacterium tuberculosis H37Rv
cucggcggccucgcu

SEQ ID NO: 1348005 - RNA, 21 nt, Mycobacterium tuberculosis H37Rv
cucggcggccucgcugcucag

SEQ ID NO: 1348006 - RNA, 12 nt, Mycobacterium tuberculosis H37Rv
cucggcggccuc

SEQ ID NO: 1348007 - RNA, 21 nt, Mycobacterium tuberculosis H37Rv
cucggcggccuuaggugacca

SEQ ID NO: 1348008 - RNA, 17 nt, Mycobacterium tuberculosis H37Rv
cucggcgagcucaguga

SEQ ID NO: 1348009 - RNA, 14 nt, Mycobacterium tuberculosis H37Rv
cucggcgagcucag

SEQ ID NO: 1348010 - RNA, 15 nt, Mycobacterium tuberculosis H37Rv
cucggcgagccgcuc

SEQ ID NO: 1348011 - RNA, 22 nt, Mycobacterium tuberculosis H37Rv
cucggcgaucaauugcccggca

SEQ ID NO: 1348012 - RNA, 17 nt, Mycobacterium tuberculosis H37Rv
cucggcgaguucggcag

SEQ ID NO: 1348013 - RNA, 15 nt, Mycobacterium tuberculosis H37Rv
cucggcggccagcga

SEQ ID NO: 1348014 - RNA, 14 nt, Mycobacterium tuberculosis H37Rv
cucggcggcccggc

SEQ ID NO: 1348015 - RNA, 17 nt, Mycobacterium tuberculosis H37Rv
cucggcggccagcuccc

SEQ ID NO: 1348016 - RNA, 16 nt, Mycobacterium tuberculosis H37Rv
cucggcggccagcgcg

SEQ ID NO: 1348017 - RNA, 23 nt, Mycobacterium tuberculosis H37Rv
cucggugauguagggcugcuccu

SEQ ID NO: 1348018 - RNA, 14 nt, Mycobacterium tuberculosis H37Rv
cucggugcagcagc

SEQ ID NO: 1348019 - RNA, 19 nt, Mycobacterium tuberculosis H37Rv
cucggugcagcagcgcgcg

SEQ ID NO: 1348020 - RNA, 21 nt, Mycobacterium tuberculosis H37Rv
cucggugaucucgcgcuccca

SEQ ID NO: 1348021 - RNA, 15 nt, Mycobacterium tuberculosis H37Rv
cucgguaggccggca

SEQ ID NO: 1348022 - RNA, 16 nt, Mycobacterium tuberculosis H37Rv
cucgguaggccggcaa

SEQ ID NO: 1348023 - RNA, 15 nt, Mycobacterium tuberculosis H37Rv
cucggggaacaccgc

SEQ ID NO: 1348024 - RNA, 16 nt, Mycobacterium tuberculosis H37Rv
cucggggcugucggcg

SEQ ID NO: 1348025 - RNA, 17 nt, Mycobacterium tuberculosis H37Rv
cucggguaccggcggca

SEQ ID NO: 1348026 - RNA, 19 nt, Mycobacterium tuberculosis H37Rv
cucggguccaaccacgagc

SEQ ID NO: 1348027 - RNA, 15 nt, Mycobacterium tuberculosis H37Rv
cucgggcgaagccgc

SEQ ID NO: 1348028 - RNA, 19 nt, Mycobacterium tuberculosis H37Rv
cucgggcgggucggcggcc

SEQ ID NO: 1348029 - RNA, 23 nt, Mycobacterium tuberculosis H37Rv
cucggccacgaacccucagccgc

SEQ ID NO: 1348030 - RNA, 18 nt, Mycobacterium tuberculosis H37Rv
cucggccaccagcgcccg

SEQ ID NO: 1348031 - RNA, 19 nt, Mycobacterium tuberculosis H37Rv
cucggcaugcagccccacu

SEQ ID NO: 1348032 - RNA, 17 nt, Mycobacterium tuberculosis H37Rv
cucggccgugaccgagc

SEQ ID NO: 1348033 - RNA, 18 nt, Mycobacterium tuberculosis H37Rv
cucggcgaccugcucgcu

SEQ ID NO: 1348034 - RNA, 14 nt, Mycobacterium tuberculosis H37Rv
cucggcgaccuggc

SEQ ID NO: 1348035 - RNA, 14 nt, Mycobacterium tuberculosis H37Rv
cucggccagcgccu

SEQ ID NO: 1348036 - RNA, 19 nt, Mycobacterium tuberculosis H37Rv
cucggcgagcaccacccca

SEQ ID NO: 1348037 - RNA, 23 nt, Mycobacterium tuberculosis H37Rv
cucggcgagcaccaccccagcgg

SEQ ID NO: 1348038 - RNA, 15 nt, Mycobacterium tuberculosis H37Rv
cucggcauccaggcu

SEQ ID NO: 1348039 - RNA, 16 nt, Mycobacterium tuberculosis H37Rv
cucggcauccaggcug

SEQ ID NO: 1348040 - RNA, 11 nt, Mycobacterium tuberculosis H37Rv
cucggcaggcc

SEQ ID NO: 1348041 - RNA, 12 nt, Mycobacterium tuberculosis H37Rv
cucggcaccaca

SEQ ID NO: 1348042 - RNA, 22 nt, Mycobacterium tuberculosis H37Rv
cucggcaagucgacgccgcagc

SEQ ID NO: 1348043 - RNA, 18 nt, Mycobacterium tuberculosis H37Rv
cucgcgcaaggcgccgca

SEQ ID NO: 1348044 - RNA, 23 nt, Mycobacterium tuberculosis H37Rv
cucgcgaggcucgcguggccgcc

SEQ ID NO: 1348045 - RNA, 15 nt, Mycobacterium tuberculosis H37Rv
cucgcgacaucaccg

SEQ ID NO: 1348046 - RNA, 19 nt, Mycobacterium tuberculosis H37Rv
cucgccugcacgcccggcg

SEQ ID NO: 1348047 - RNA, 19 nt, Mycobacterium tuberculosis H37Rv
cucgucggcgacggccagc

SEQ ID NO: 1348048 - RNA, 18 nt, Mycobacterium tuberculosis H37Rv
cucgucgcgggccaccgc

SEQ ID NO: 1348049 - RNA, 23 nt, Mycobacterium tuberculosis H37Rv
cucgucgcgggccaccgcuguca

SEQ ID NO: 1348050 - RNA, 15 nt, Mycobacterium tuberculosis H37Rv
cucgucgcgucgcca

SEQ ID NO: 1348051 - RNA, 17 nt, Mycobacterium tuberculosis H37Rv
cucgucgcgggccaccg

SEQ ID NO: 1348052 - RNA, 15 nt, Mycobacterium tuberculosis H37Rv
cucgucggucaccga

SEQ ID NO: 1348053 - RNA, 15 nt, Mycobacterium tuberculosis H37Rv
cucgucggugcgcgc

SEQ ID NO: 1348054 - RNA, 21 nt, Mycobacterium tuberculosis H37Rv
cucgucggcgccggcggccgc

SEQ ID NO: 1348055 - RNA, 22 nt, Mycobacterium tuberculosis H37Rv
cucguccaagccggccacgcau

SEQ ID NO: 1348056 - RNA, 21 nt, Mycobacterium tuberculosis H37Rv
cucguccaccacaccugcggc

SEQ ID NO: 1348057 - RNA, 20 nt, Mycobacterium tuberculosis H37Rv
cucguccaagccggccacgc

SEQ ID NO: 1348058 - RNA, 13 nt, Mycobacterium tuberculosis H37Rv
cucguccagcaac

SEQ ID NO: 1348059 - RNA, 15 nt, Mycobacterium tuberculosis H37Rv
cucguccagcaaccu

SEQ ID NO: 1348060 - RNA, 21 nt, Mycobacterium tuberculosis H37Rv
cucgucgccgguggcacccgc

SEQ ID NO: 1348061 - RNA, 16 nt, Mycobacterium tuberculosis H37Rv
cucguccaagccggcc

SEQ ID NO: 1348062 - RNA, 19 nt, Mycobacterium tuberculosis H37Rv
cucggugcggugauuccag

SEQ ID NO: 1348063 - RNA, 13 nt, Mycobacterium tuberculosis H37Rv
cucggugccggcc

SEQ ID NO: 1348064 - RNA, 17 nt, Mycobacterium tuberculosis H37Rv
cucggugaucaccauga

SEQ ID NO: 1348065 - RNA, 14 nt, Mycobacterium tuberculosis H37Rv
cucguagagcaccg

SEQ ID NO: 1348066 - RNA, 16 nt, Mycobacterium tuberculosis H37Rv
cucguagagcaccgca

SEQ ID NO: 1348067 - RNA, 17 nt, Mycobacterium tuberculosis H37Rv
cucguagacuugcugcu

SEQ ID NO: 1348068 - RNA, 22 nt, Mycobacterium tuberculosis H37Rv
cucgguggugaccaaguagucg

SEQ ID NO: 1348069 - RNA, 21 nt, Mycobacterium tuberculosis H37Rv
cucgguggucuuggcccggcg

SEQ ID NO: 1348070 - RNA, 15 nt, Mycobacterium tuberculosis H37Rv
cucguaggugccgaa

SEQ ID NO: 1348071 - RNA, 21 nt, Mycobacterium tuberculosis H37Rv
cucguaggugccgaagaugac

SEQ ID NO: 1348072 - RNA, 17 nt, Mycobacterium tuberculosis H37Rv
cucggugucggccgcgu

SEQ ID NO: 1348073 - RNA, 21 nt, Mycobacterium tuberculosis H37Rv
cucgucgugagucacccggcc

SEQ ID NO: 1348074 - RNA, 16 nt, Mycobacterium tuberculosis H37Rv
cucgucgucgauccag

SEQ ID NO: 1348075 - RNA, 15 nt, Mycobacterium tuberculosis H37Rv
cucgucguccggcca

SEQ ID NO: 1348076 - RNA, 15 nt, Mycobacterium tuberculosis H37Rv
cucgucggugucggu

SEQ ID NO: 1348077 - RNA, 23 nt, Mycobacterium tuberculosis H37Rv
cucgucggugugccagugcugca

SEQ ID NO: 1348078 - RNA, 20 nt, Mycobacterium tuberculosis H37Rv
cucguguuguugaagcccga

SEQ ID NO: 1348079 - RNA, 20 nt, Mycobacterium tuberculosis H37Rv
cucguguccggggaccucgg

SEQ ID NO: 1348080 - RNA, 14 nt, Mycobacterium tuberculosis H37Rv
cucgugucugccuc

SEQ ID NO: 1348081 - RNA, 20 nt, Mycobacterium tuberculosis H37Rv
cucguuagaguaggccacca

SEQ ID NO: 1348082 - RNA, 24 nt, Mycobacterium tuberculosis H37Rv
cucguucagcgucgacugaacggu

SEQ ID NO: 1348083 - RNA, 17 nt, Mycobacterium tuberculosis H37Rv
cucguucauguccaccg

SEQ ID NO: 1348084 - RNA, 22 nt, Mycobacterium tuberculosis H37Rv
cucguugcguugcaucagcacg

SEQ ID NO: 1348085 - RNA, 18 nt, Mycobacterium tuberculosis H37Rv
cucuagauauggaccgcc

SEQ ID NO: 1348086 - RNA, 15 nt, Mycobacterium tuberculosis H37Rv
cucuagcaaagccag

SEQ ID NO: 1348087 - RNA, 17 nt, Mycobacterium tuberculosis H37Rv
cucuagcucgaacaggu

SEQ ID NO: 1348088 - RNA, 23 nt, Mycobacterium tuberculosis H37Rv
cucuagcgccucgccggccaccc

SEQ ID NO: 1348089 - RNA, 22 nt, Mycobacterium tuberculosis H37Rv
cucugcgucugcucaccagcgg

SEQ ID NO: 1348090 - RNA, 14 nt, Mycobacterium tuberculosis H37Rv
cucugcgccaggcg

SEQ ID NO: 1348091 - RNA, 15 nt, Mycobacterium tuberculosis H37Rv
cucugcgccacagca

SEQ ID NO: 1348092 - RNA, 22 nt, Mycobacterium tuberculosis H37Rv
cucugcgagcguggacuugagu

SEQ ID NO: 1348093 - RNA, 20 nt, Mycobacterium tuberculosis H37Rv
cucugguggcgcugaagccg

SEQ ID NO: 1348094 - RNA, 20 nt, Mycobacterium tuberculosis H37Rv
cucuggugacggugaagccg

SEQ ID NO: 1348095 - RNA, 19 nt, Mycobacterium tuberculosis H37Rv
cucugagcgggcgggccug

SEQ ID NO: 1348096 - RNA, 14 nt, Mycobacterium tuberculosis H37Rv
cucugaccagccgg

SEQ ID NO: 1348097 - RNA, 22 nt, Mycobacterium tuberculosis H37Rv
cucugccacgcguuccuccagc

SEQ ID NO: 1348098 - RNA, 13 nt, Mycobacterium tuberculosis H37Rv
cucuccguccucg

SEQ ID NO: 1348099 - RNA, 16 nt, Mycobacterium tuberculosis H37Rv
cucucggcacccggca

SEQ ID NO: 1348100 - RNA, 18 nt, Mycobacterium tuberculosis H37Rv
cucucggucaguuccucu

SEQ ID NO: 1348101 - RNA, 17 nt, Mycobacterium tuberculosis H37Rv
cucucggcacccggcag

SEQ ID NO: 1348102 - RNA, 21 nt, Mycobacterium tuberculosis H37Rv
cucucuucgcgcgcugggcgc

SEQ ID NO: 1348103 - RNA, 18 nt, Mycobacterium tuberculosis H37Rv
cucucguggauggccgcc

SEQ ID NO: 1348104 - RNA, 19 nt, Mycobacterium tuberculosis H37Rv
cucucguggauggccgcca

SEQ ID NO: 1348105 - RNA, 21 nt, Mycobacterium tuberculosis H37Rv
cucucggugaacgccgccccg

SEQ ID NO: 1348106 - RNA, 14 nt, Mycobacterium tuberculosis H37Rv
cucucugcgccagg

SEQ ID NO: 1348107 - RNA, 15 nt, Mycobacterium tuberculosis H37Rv
cucucugcgccaggc

SEQ ID NO: 1348108 - RNA, 14 nt, Mycobacterium tuberculosis H37Rv
cucuccggcauccu

SEQ ID NO: 1348109 - RNA, 14 nt, Mycobacterium tuberculosis H37Rv
cucuuccauuaggc

SEQ ID NO: 1348110 - RNA, 20 nt, Mycobacterium tuberculosis H37Rv
cucuucgaugaagcugguga

SEQ ID NO: 1348111 - RNA, 20 nt, Mycobacterium tuberculosis H37Rv
cucuuccuggcgugagccga

SEQ ID NO: 1348112 - RNA, 22 nt, Mycobacterium tuberculosis H37Rv
cucuucaggcccucgggacugc

SEQ ID NO: 1348113 - RNA, 17 nt, Mycobacterium tuberculosis H37Rv
cucugucuucagcugcg

SEQ ID NO: 1348114 - RNA, 19 nt, Mycobacterium tuberculosis H37Rv
cucugucuucagcugcgga

SEQ ID NO: 1348115 - RNA, 21 nt, Mycobacterium tuberculosis H37Rv
cucugguuuuacacaccagcg

SEQ ID NO: 1348116 - RNA, 23 nt, Mycobacterium tuberculosis H37Rv
cucugguuuuacacaccagcggu

SEQ ID NO: 1348117 - RNA, 17 nt, Mycobacterium tuberculosis H37Rv
cucuucgggugcagcca

SEQ ID NO: 1348118 - RNA, 16 nt, Mycobacterium tuberculosis H37Rv
cucuucgggugcagcc

SEQ ID NO: 1348119 - RNA, 21 nt, Mycobacterium tuberculosis H37Rv
cucuucggucagggugggcuc

SEQ ID NO: 1348120 - RNA, 20 nt, Mycobacterium tuberculosis H37Rv
cucuucggucagggugggcu

SEQ ID NO: 1348121 - RNA, 13 nt, Mycobacterium tuberculosis H37Rv
cucuucggcacca

SEQ ID NO: 1348122 - RNA, 21 nt, Mycobacterium tuberculosis H37Rv
cucuugcgggcagccgcccgc

SEQ ID NO: 1348123 - RNA, 13 nt, Mycobacterium tuberculosis H37Rv
cucuugcccuucu

SEQ ID NO: 1348124 - RNA, 23 nt, Mycobacterium tuberculosis H37Rv
cugaaaccuugcggcagaccaag

SEQ ID NO: 1348125 - RNA, 18 nt, Mycobacterium tuberculosis H37Rv
cugaaauaagggccggcg

SEQ ID NO: 1348126 - RNA, 19 nt, Mycobacterium tuberculosis H37Rv
cugaaccggccgcgacgac

SEQ ID NO: 1348127 - RNA, 20 nt, Mycobacterium tuberculosis H37Rv
cugaacacgaauccggccac

SEQ ID NO: 1348128 - RNA, 18 nt, Mycobacterium tuberculosis H37Rv
cugaacauuccggcaccu

SEQ ID NO: 1348129 - RNA, 19 nt, Mycobacterium tuberculosis H37Rv
cugaacauuccggcaccuc

SEQ ID NO: 1348130 - RNA, 20 nt, Mycobacterium tuberculosis H37Rv
cugaacauuccggcaccucc

SEQ ID NO: 1348131 - RNA, 16 nt, Mycobacterium tuberculosis H37Rv
cugaacgguuucuuuc

SEQ ID NO: 1348132 - RNA, 13 nt, Mycobacterium tuberculosis H37Rv
cugaagccagcgc

SEQ ID NO: 1348133 - RNA, 18 nt, Mycobacterium tuberculosis H37Rv
cugaagccagcgcagcac

SEQ ID NO: 1348134 - RNA, 19 nt, Mycobacterium tuberculosis H37Rv
cugaagccagcgcagcacc

SEQ ID NO: 1348135 - RNA, 15 nt, Mycobacterium tuberculosis H37Rv
cugaagagcggagcc

SEQ ID NO: 1348136 - RNA, 21 nt, Mycobacterium tuberculosis H37Rv
cugacagaccgggcaccagaa

SEQ ID NO: 1348137 - RNA, 18 nt, Mycobacterium tuberculosis H37Rv
cugacacgcccgcgagcu

SEQ ID NO: 1348138 - RNA, 17 nt, Mycobacterium tuberculosis H37Rv
cugacaccgaaccgccg

SEQ ID NO: 1348139 - RNA, 20 nt, Mycobacterium tuberculosis H37Rv
cugacaccgaaccgccgcug

SEQ ID NO: 1348140 - RNA, 20 nt, Mycobacterium tuberculosis H37Rv
cugacaagccuuaccccgca

SEQ ID NO: 1348141 - RNA, 21 nt, Mycobacterium tuberculosis H37Rv
cugacaacggccacaugccac

SEQ ID NO: 1348142 - RNA, 14 nt, Mycobacterium tuberculosis H37Rv
cugacaucggccaa

SEQ ID NO: 1348143 - RNA, 18 nt, Mycobacterium tuberculosis H37Rv
cugacaguccccagacag

SEQ ID NO: 1348144 - RNA, 21 nt, Mycobacterium tuberculosis H37Rv
cugaccaacucguggaacucc

SEQ ID NO: 1348145 - RNA, 18 nt, Mycobacterium tuberculosis H37Rv
cugaccgaagaagcccga

SEQ ID NO: 1348146 - RNA, 20 nt, Mycobacterium tuberculosis H37Rv
cugaccgguucccgggcagc

SEQ ID NO: 1348147 - RNA, 13 nt, Mycobacterium tuberculosis H37Rv
cugaccgccaccc

SEQ ID NO: 1348148 - RNA, 18 nt, Mycobacterium tuberculosis H37Rv
cugacccccugacggcau

SEQ ID NO: 1348149 - RNA, 16 nt, Mycobacterium tuberculosis H37Rv
cugaaggccagccaac

SEQ ID NO: 1348150 - RNA, 20 nt, Mycobacterium tuberculosis H37Rv
cugaagguggcgaacccggu

SEQ ID NO: 1348151 - RNA, 17 nt, Mycobacterium tuberculosis H37Rv
cugacgcccuccuggcg

SEQ ID NO: 1348152 - RNA, 18 nt, Mycobacterium tuberculosis H37Rv
cugacgccccgccacaau

SEQ ID NO: 1348153 - RNA, 13 nt, Mycobacterium tuberculosis H37Rv
cugacgccauuca

SEQ ID NO: 1348154 - RNA, 13 nt, Mycobacterium tuberculosis H37Rv
cugacgacugggc

SEQ ID NO: 1348155 - RNA, 14 nt, Mycobacterium tuberculosis H37Rv
cugacgacugggcg

SEQ ID NO: 1348156 - RNA, 17 nt, Mycobacterium tuberculosis H37Rv
cugacgaccggcuaccg

SEQ ID NO: 1348157 - RNA, 21 nt, Mycobacterium tuberculosis H37Rv
cugacgacgagggccagcagc

SEQ ID NO: 1348158 - RNA, 20 nt, Mycobacterium tuberculosis H37Rv
cugacgacugggcgcccaag

SEQ ID NO: 1348159 - RNA, 20 nt, Mycobacterium tuberculosis H37Rv
cugacgaucauugcacccac

SEQ ID NO: 1348160 - RNA, 17 nt, Mycobacterium tuberculosis H37Rv
cugaccuucaggcccug

SEQ ID NO: 1348161 - RNA, 19 nt, Mycobacterium tuberculosis H37Rv
cugaccuucaggcccugcc

SEQ ID NO: 1348162 - RNA, 21 nt, Mycobacterium tuberculosis H37Rv
cugacgaaggucuccggcaag

SEQ ID NO: 1348163 - RNA, 21 nt, Mycobacterium tuberculosis H37Rv
cugaccucgucaaucaccacc

SEQ ID NO: 1348164 - RNA, 22 nt, Mycobacterium tuberculosis H37Rv
cugaccucgucaaucaccaccg

SEQ ID NO: 1348165 - RNA, 16 nt, Mycobacterium tuberculosis H37Rv
cugacguuaccgccgc

SEQ ID NO: 1348166 - RNA, 22 nt, Mycobacterium tuberculosis H37Rv
cugacgguucggucggggagcu

SEQ ID NO: 1348167 - RNA, 13 nt, Mycobacterium tuberculosis H37Rv
cugacggugguga

SEQ ID NO: 1348168 - RNA, 15 nt, Mycobacterium tuberculosis H37Rv
cugacgugaagcaga

SEQ ID NO: 1348169 - RNA, 22 nt, Mycobacterium tuberculosis H37Rv
cugacgcgucagcggcgagcag

SEQ ID NO: 1348170 - RNA, 19 nt, Mycobacterium tuberculosis H37Rv
cugacgcucggucgccacc

SEQ ID NO: 1348171 - RNA, 18 nt, Mycobacterium tuberculosis H37Rv
cugacggccauggacgcc

SEQ ID NO: 1348172 - RNA, 12 nt, Mycobacterium tuberculosis H37Rv
cugacgcugcag

SEQ ID NO: 1348173 - RNA, 17 nt, Mycobacterium tuberculosis H37Rv
cugacggugcaggacca

SEQ ID NO: 1348174 - RNA, 16 nt, Mycobacterium tuberculosis H37Rv
cugagcgccaggccgc

SEQ ID NO: 1348175 - RNA, 16 nt, Mycobacterium tuberculosis H37Rv
cugagcgcggguggca

SEQ ID NO: 1348176 - RNA, 23 nt, Mycobacterium tuberculosis H37Rv
cugagcgccaggccgcacagcac

SEQ ID NO: 1348177 - RNA, 14 nt, Mycobacterium tuberculosis H37Rv
cugagcgacugcag

SEQ ID NO: 1348178 - RNA, 16 nt, Mycobacterium tuberculosis H37Rv
cugagcgagcucccgg

SEQ ID NO: 1348179 - RNA, 21 nt, Mycobacterium tuberculosis H37Rv
cugagcgagcucccgggcgcu

SEQ ID NO: 1348180 - RNA, 18 nt, Mycobacterium tuberculosis H37Rv
cugagccaccaacaccgc

SEQ ID NO: 1348181 - RNA, 20 nt, Mycobacterium tuberculosis H37Rv
cugagccccccgagcccgcc

SEQ ID NO: 1348182 - RNA, 11 nt, Mycobacterium tuberculosis H37Rv
cugagcccgcc

SEQ ID NO: 1348183 - RNA, 20 nt, Mycobacterium tuberculosis H37Rv
cugagccgcucaucgauccc

SEQ ID NO: 1348184 - RNA, 15 nt, Mycobacterium tuberculosis H37Rv
cugagcagcgcggcc

SEQ ID NO: 1348185 - RNA, 16 nt, Mycobacterium tuberculosis H37Rv
cugagaugaugcguga

SEQ ID NO: 1348186 - RNA, 14 nt, Mycobacterium tuberculosis H37Rv
cugagaugggccac

SEQ ID NO: 1348187 - RNA, 15 nt, Mycobacterium tuberculosis H37Rv
cugagaugggccacc

SEQ ID NO: 1348188 - RNA, 16 nt, Mycobacterium tuberculosis H37Rv
cugagaugggccaccc

SEQ ID NO: 1348189 - RNA, 17 nt, Mycobacterium tuberculosis H37Rv
cugagaugggccacccg

SEQ ID NO: 1348190 - RNA, 16 nt, Mycobacterium tuberculosis H37Rv
cugagaccucagccgg

SEQ ID NO: 1348191 - RNA, 23 nt, Mycobacterium tuberculosis H37Rv
cugccagaucggucggccaaagc

SEQ ID NO: 1348192 - RNA, 16 nt, Mycobacterium tuberculosis H37Rv
cugccaaugcugcagg

SEQ ID NO: 1348193 - RNA, 20 nt, Mycobacterium tuberculosis H37Rv
cugccaacgcccguguugaa

SEQ ID NO: 1348194 - RNA, 12 nt, Mycobacterium tuberculosis H37Rv
cugccagcaccc

SEQ ID NO: 1348195 - RNA, 13 nt, Mycobacterium tuberculosis H37Rv
cugccagccaugg

SEQ ID NO: 1348196 - RNA, 15 nt, Mycobacterium tuberculosis H37Rv
cugccagccauggcc

SEQ ID NO: 1348197 - RNA, 16 nt, Mycobacterium tuberculosis H37Rv
cugccagcguugcgga

SEQ ID NO: 1348198 - RNA, 21 nt, Mycobacterium tuberculosis H37Rv
cugccauugccugggcgaccg

SEQ ID NO: 1348199 - RNA, 13 nt, Mycobacterium tuberculosis H37Rv
cugccauugccug

SEQ ID NO: 1348200 - RNA, 15 nt, Mycobacterium tuberculosis H37Rv
cugcccccgcgcgca

SEQ ID NO: 1348201 - RNA, 23 nt, Mycobacterium tuberculosis H37Rv
cugcccacgcggauaucuugcgc

SEQ ID NO: 1348202 - RNA, 22 nt, Mycobacterium tuberculosis H37Rv
cugcccaccgcagcaucccugg

SEQ ID NO: 1348203 - RNA, 20 nt, Mycobacterium tuberculosis H37Rv
cugcccaaaagcgcggcaac

SEQ ID NO: 1348204 - RNA, 18 nt, Mycobacterium tuberculosis H37Rv
cugcccaaaaggaagacc

SEQ ID NO: 1348205 - RNA, 20 nt, Mycobacterium tuberculosis H37Rv
cugccgcacacgcgugcacg

SEQ ID NO: 1348206 - RNA, 19 nt, Mycobacterium tuberculosis H37Rv
cugccgcaguucaucgaga

SEQ ID NO: 1348207 - RNA, 15 nt, Mycobacterium tuberculosis H37Rv
cugccgcacccgguc

SEQ ID NO: 1348208 - RNA, 15 nt, Mycobacterium tuberculosis H37Rv
cugcccgcccagccc

SEQ ID NO: 1348209 - RNA, 15 nt, Mycobacterium tuberculosis H37Rv
cugcccgccagcgcc

SEQ ID NO: 1348210 - RNA, 16 nt, Mycobacterium tuberculosis H37Rv
cugcccgccagcgccg

SEQ ID NO: 1348211 - RNA, 16 nt, Mycobacterium tuberculosis H37Rv
cugccccgcaucgccc

SEQ ID NO: 1348212 - RNA, 15 nt, Mycobacterium tuberculosis H37Rv
cugccccgccaccuc

SEQ ID NO: 1348213 - RNA, 22 nt, Mycobacterium tuberculosis H37Rv
cugcccgaugaucugugccgcu

SEQ ID NO: 1348214 - RNA, 21 nt, Mycobacterium tuberculosis H37Rv
cugcagcucacgacuggcgcc

SEQ ID NO: 1348215 - RNA, 20 nt, Mycobacterium tuberculosis H37Rv
cugcagcgucaagggcuggg

SEQ ID NO: 1348216 - RNA, 18 nt, Mycobacterium tuberculosis H37Rv
cugcagcucgggcaggga

SEQ ID NO: 1348217 - RNA, 15 nt, Mycobacterium tuberculosis H37Rv
cugcagcgagaccuc

SEQ ID NO: 1348218 - RNA, 19 nt, Mycobacterium tuberculosis H37Rv
cugcagcgaugacgaccaa

SEQ ID NO: 1348219 - RNA, 16 nt, Mycobacterium tuberculosis H37Rv
cugcauccuccucguc

SEQ ID NO: 1348220 - RNA, 16 nt, Mycobacterium tuberculosis H37Rv
cugccaagcgaccucg

SEQ ID NO: 1348221 - RNA, 19 nt, Mycobacterium tuberculosis H37Rv
cugccaaaagggcggcagc

SEQ ID NO: 1348222 - RNA, 14 nt, Mycobacterium tuberculosis H37Rv
cugcacccgccagg

SEQ ID NO: 1348223 - RNA, 23 nt, Mycobacterium tuberculosis H37Rv
cugcaccuggcgcagcaacucga

SEQ ID NO: 1348224 - RNA, 16 nt, Mycobacterium tuberculosis H37Rv
cugcaccggcaggcgg

SEQ ID NO: 1348225 - RNA, 15 nt, Mycobacterium tuberculosis H37Rv
cugcaccgucacguc

SEQ ID NO: 1348226 - RNA, 19 nt, Mycobacterium tuberculosis H37Rv
cugcagcacgacgugcguc

SEQ ID NO: 1348227 - RNA, 23 nt, Mycobacterium tuberculosis H37Rv
cugcaacgauugaacucugguga

SEQ ID NO: 1348228 - RNA, 22 nt, Mycobacterium tuberculosis H37Rv
cugcaacacgcgaugcacgccc

SEQ ID NO: 1348229 - RNA, 13 nt, Mycobacterium tuberculosis H37Rv
cugcacacugccg

SEQ ID NO: 1348230 - RNA, 16 nt, Mycobacterium tuberculosis H37Rv
cugcacaccaccgccg

SEQ ID NO: 1348231 - RNA, 21 nt, Mycobacterium tuberculosis H37Rv
cugcacagcagcgucaucagg

SEQ ID NO: 1348232 - RNA, 17 nt, Mycobacterium tuberculosis H37Rv
cugcacauucagcgccg

SEQ ID NO: 1348233 - RNA, 23 nt, Mycobacterium tuberculosis H37Rv
cugcacccaggcaucggugagcc

SEQ ID NO: 1348234 - RNA, 20 nt, Mycobacterium tuberculosis H37Rv
cugcaccacggcggccaccu

SEQ ID NO: 1348235 - RNA, 13 nt, Mycobacterium tuberculosis H37Rv
cugaugggucagg

SEQ ID NO: 1348236 - RNA, 17 nt, Mycobacterium tuberculosis H37Rv
cugaugggcgaauugca

SEQ ID NO: 1348237 - RNA, 13 nt, Mycobacterium tuberculosis H37Rv
cugauugaagccc

SEQ ID NO: 1348238 - RNA, 14 nt, Mycobacterium tuberculosis H37Rv
cugauugaagcccc

SEQ ID NO: 1348239 - RNA, 19 nt, Mycobacterium tuberculosis H37Rv
cugagcgucgucgccggcg

SEQ ID NO: 1348240 - RNA, 20 nt, Mycobacterium tuberculosis H37Rv
cugcguaguugauggccccg

SEQ ID NO: 1348241 - RNA, 12 nt, Mycobacterium tuberculosis H37Rv
cugcggcugcuu

SEQ ID NO: 1348242 - RNA, 13 nt, Mycobacterium tuberculosis H37Rv
cugcggcuccggc

SEQ ID NO: 1348243 - RNA, 16 nt, Mycobacterium tuberculosis H37Rv
cugcggcucagaaccc

SEQ ID NO: 1348244 - RNA, 18 nt, Mycobacterium tuberculosis H37Rv
cugcggcucgcugaucug

SEQ ID NO: 1348245 - RNA, 20 nt, Mycobacterium tuberculosis H37Rv
cugcggcgcccggucgagcc

SEQ ID NO: 1348246 - RNA, 18 nt, Mycobacterium tuberculosis H37Rv
cugcggcgucguugagga

SEQ ID NO: 1348247 - RNA, 12 nt, Mycobacterium tuberculosis H37Rv
cugcggcggcuu

SEQ ID NO: 1348248 - RNA, 21 nt, Mycobacterium tuberculosis H37Rv
cugcggcggcuuuggccgccg

SEQ ID NO: 1348249 - RNA, 23 nt, Mycobacterium tuberculosis H37Rv
cugcggauuaagucggcggccuu

SEQ ID NO: 1348250 - RNA, 18 nt, Mycobacterium tuberculosis H37Rv
cugcggaucguggcgccc

SEQ ID NO: 1348251 - RNA, 21 nt, Mycobacterium tuberculosis H37Rv
cugcggaucggacaacacggc

SEQ ID NO: 1348252 - RNA, 18 nt, Mycobacterium tuberculosis H37Rv
cugcggcagcgcggccaa

SEQ ID NO: 1348253 - RNA, 17 nt, Mycobacterium tuberculosis H37Rv
cugcggcccacaccagc

SEQ ID NO: 1348254 - RNA, 17 nt, Mycobacterium tuberculosis H37Rv
cugcggccagcgcggcg

SEQ ID NO: 1348255 - RNA, 13 nt, Mycobacterium tuberculosis H37Rv
cugcggccacggu

SEQ ID NO: 1348256 - RNA, 21 nt, Mycobacterium tuberculosis H37Rv
cugcggccgauauccaaugcc

SEQ ID NO: 1348257 - RNA, 15 nt, Mycobacterium tuberculosis H37Rv
cugcggccgcgaggu

SEQ ID NO: 1348258 - RNA, 13 nt, Mycobacterium tuberculosis H37Rv
cugcggccgcgcc

SEQ ID NO: 1348259 - RNA, 20 nt, Mycobacterium tuberculosis H37Rv
cugcgccgcccgcgccaccg

SEQ ID NO: 1348260 - RNA, 15 nt, Mycobacterium tuberculosis H37Rv
cugcgccgggcucgc

SEQ ID NO: 1348261 - RNA, 16 nt, Mycobacterium tuberculosis H37Rv
cugcgccgcgcgcggc

SEQ ID NO: 1348262 - RNA, 15 nt, Mycobacterium tuberculosis H37Rv
cugcgccguucgcuc

SEQ ID NO: 1348263 - RNA, 21 nt, Mycobacterium tuberculosis H37Rv
cugcgccguucgcucccccgc

SEQ ID NO: 1348264 - RNA, 19 nt, Mycobacterium tuberculosis H37Rv
cugcgccggugccggccau

SEQ ID NO: 1348265 - RNA, 23 nt, Mycobacterium tuberculosis H37Rv
cugcgccgucaacaccauggugg

SEQ ID NO: 1348266 - RNA, 18 nt, Mycobacterium tuberculosis H37Rv
cugcgccgucgcagccag

SEQ ID NO: 1348267 - RNA, 14 nt, Mycobacterium tuberculosis H37Rv
cugcgccgccggcg

SEQ ID NO: 1348268 - RNA, 17 nt, Mycobacterium tuberculosis H37Rv
cugcgccaggggcacca

SEQ ID NO: 1348269 - RNA, 16 nt, Mycobacterium tuberculosis H37Rv
cugcgccagcaacagc

SEQ ID NO: 1348270 - RNA, 22 nt, Mycobacterium tuberculosis H37Rv
cugcggauccaccacgcuggcc

SEQ ID NO: 1348271 - RNA, 16 nt, Mycobacterium tuberculosis H37Rv
cugcggauccaccacg

SEQ ID NO: 1348272 - RNA, 13 nt, Mycobacterium tuberculosis H37Rv
cugcgcugcacca

SEQ ID NO: 1348273 - RNA, 22 nt, Mycobacterium tuberculosis H37Rv
cugcgccucggcggccagcucg

SEQ ID NO: 1348274 - RNA, 21 nt, Mycobacterium tuberculosis H37Rv
cugcgccucggcggccagcuc

SEQ ID NO: 1348275 - RNA, 12 nt, Mycobacterium tuberculosis H37Rv
cugcgcaccugg

SEQ ID NO: 1348276 - RNA, 20 nt, Mycobacterium tuberculosis H37Rv
cugcgcaauagcgacagcag

SEQ ID NO: 1348277 - RNA, 15 nt, Mycobacterium tuberculosis H37Rv
cugcgcaaauuugaa

SEQ ID NO: 1348278 - RNA, 21 nt, Mycobacterium tuberculosis H37Rv
cugcgcagaaucgccugcgac

SEQ ID NO: 1348279 - RNA, 16 nt, Mycobacterium tuberculosis H37Rv
cugcgccacagcagcg

SEQ ID NO: 1348280 - RNA, 16 nt, Mycobacterium tuberculosis H37Rv
cugcgaucgcgagcga

SEQ ID NO: 1348281 - RNA, 17 nt, Mycobacterium tuberculosis H37Rv
cugcgacgagcccaccg

SEQ ID NO: 1348282 - RNA, 16 nt, Mycobacterium tuberculosis H37Rv
cugcgacugugaaucu

SEQ ID NO: 1348283 - RNA, 19 nt, Mycobacterium tuberculosis H37Rv
cugcgagauguccucccau

SEQ ID NO: 1348284 - RNA, 14 nt, Mycobacterium tuberculosis H37Rv
cugcgagcgcagcg

SEQ ID NO: 1348285 - RNA, 21 nt, Mycobacterium tuberculosis H37Rv
cugcgaaugcugggcccgcca

SEQ ID NO: 1348286 - RNA, 19 nt, Mycobacterium tuberculosis H37Rv
cugcgaaucuccgcgcggu

SEQ ID NO: 1348287 - RNA, 15 nt, Mycobacterium tuberculosis H37Rv
cugcgacacaacggg

SEQ ID NO: 1348288 - RNA, 16 nt, Mycobacterium tuberculosis H37Rv
cugcgaccgucccggc

SEQ ID NO: 1348289 - RNA, 19 nt, Mycobacterium tuberculosis H37Rv
cugccgcaugcgcuccggc

SEQ ID NO: 1348290 - RNA, 13 nt, Mycobacterium tuberculosis H37Rv
cugccgccggccc

SEQ ID NO: 1348291 - RNA, 16 nt, Mycobacterium tuberculosis H37Rv
cugccgccggugccgc

SEQ ID NO: 1348292 - RNA, 14 nt, Mycobacterium tuberculosis H37Rv
cugccgcgaugagc

SEQ ID NO: 1348293 - RNA, 16 nt, Mycobacterium tuberculosis H37Rv
cugccgccgagcuggc

SEQ ID NO: 1348294 - RNA, 15 nt, Mycobacterium tuberculosis H37Rv
cugccgcccuugccg

SEQ ID NO: 1348295 - RNA, 21 nt, Mycobacterium tuberculosis H37Rv
cugccgcccuugccgcccgcu

SEQ ID NO: 1348296 - RNA, 15 nt, Mycobacterium tuberculosis H37Rv
cugccgccgagcugg

SEQ ID NO: 1348297 - RNA, 19 nt, Mycobacterium tuberculosis H37Rv
cugccgccgcuccaugaca

SEQ ID NO: 1348298 - RNA, 23 nt, Mycobacterium tuberculosis H37Rv
cugcgaagaguccuuaaacgucg

SEQ ID NO: 1348299 - RNA, 16 nt, Mycobacterium tuberculosis H37Rv
cugcgaaacgccaccg

SEQ ID NO: 1348300 - RNA, 13 nt, Mycobacterium tuberculosis H37Rv
cugccgcgcggcg

SEQ ID NO: 1348301 - RNA, 15 nt, Mycobacterium tuberculosis H37Rv
cugccuuaccaaccg

SEQ ID NO: 1348302 - RNA, 16 nt, Mycobacterium tuberculosis H37Rv
cugccuuaccaaccgg

SEQ ID NO: 1348303 - RNA, 17 nt, Mycobacterium tuberculosis H37Rv
cugccgcggcugccauc

SEQ ID NO: 1348304 - RNA, 15 nt, Mycobacterium tuberculosis H37Rv
cugccgcgcgcccgc

SEQ ID NO: 1348305 - RNA, 19 nt, Mycobacterium tuberculosis H37Rv
cugccuuacacgccuggcu

SEQ ID NO: 1348306 - RNA, 17 nt, Mycobacterium tuberculosis H37Rv
cugcuggaucucggugg

SEQ ID NO: 1348307 - RNA, 14 nt, Mycobacterium tuberculosis H37Rv
cugcuggagcagcu

SEQ ID NO: 1348308 - RNA, 19 nt, Mycobacterium tuberculosis H37Rv
cugcuggccgcggccucgu

SEQ ID NO: 1348309 - RNA, 12 nt, Mycobacterium tuberculosis H37Rv
cugcuggcgcuc

SEQ ID NO: 1348310 - RNA, 12 nt, Mycobacterium tuberculosis H37Rv
cugcugcagcaa

SEQ ID NO: 1348311 - RNA, 13 nt, Mycobacterium tuberculosis H37Rv
cugcugcagccug

SEQ ID NO: 1348312 - RNA, 16 nt, Mycobacterium tuberculosis H37Rv
cugcugcagcgaugcg

SEQ ID NO: 1348313 - RNA, 13 nt, Mycobacterium tuberculosis H37Rv
cugcugagcugcu

SEQ ID NO: 1348314 - RNA, 17 nt, Mycobacterium tuberculosis H37Rv
cugcugaccugcauggg

SEQ ID NO: 1348315 - RNA, 20 nt, Mycobacterium tuberculosis H37Rv
cugcugccauugccgauggu

SEQ ID NO: 1348316 - RNA, 19 nt, Mycobacterium tuberculosis H37Rv
cugcugccgcaccggugcu

SEQ ID NO: 1348317 - RNA, 11 nt, Mycobacterium tuberculosis H37Rv
cugcuccugga

SEQ ID NO: 1348318 - RNA, 20 nt, Mycobacterium tuberculosis H37Rv
cugcuccucggucagcgggg

SEQ ID NO: 1348319 - RNA, 13 nt, Mycobacterium tuberculosis H37Rv
cugcuccucgguc

SEQ ID NO: 1348320 - RNA, 16 nt, Mycobacterium tuberculosis H37Rv
cugcucgccaggccua

SEQ ID NO: 1348321 - RNA, 15 nt, Mycobacterium tuberculosis H37Rv
cugcucgccagccgg

SEQ ID NO: 1348322 - RNA, 15 nt, Mycobacterium tuberculosis H37Rv
cugcucgccaggcaa

SEQ ID NO: 1348323 - RNA, 16 nt, Mycobacterium tuberculosis H37Rv
cugcucgccaggcaag

SEQ ID NO: 1348324 - RNA, 15 nt, Mycobacterium tuberculosis H37Rv
cugcucgccaggccu

SEQ ID NO: 1348325 - RNA, 17 nt, Mycobacterium tuberculosis H37Rv
cugcucgcacagcacca

SEQ ID NO: 1348326 - RNA, 17 nt, Mycobacterium tuberculosis H37Rv
cugcucgauacggcccu

SEQ ID NO: 1348327 - RNA, 19 nt, Mycobacterium tuberculosis H37Rv
cugcgucugcucgcgcagg

SEQ ID NO: 1348328 - RNA, 16 nt, Mycobacterium tuberculosis H37Rv
cugcgucugcucacca

SEQ ID NO: 1348329 - RNA, 13 nt, Mycobacterium tuberculosis H37Rv
cugcgucugcucg

SEQ ID NO: 1348330 - RNA, 17 nt, Mycobacterium tuberculosis H37Rv
cugcgucggcggcuucc

SEQ ID NO: 1348331 - RNA, 23 nt, Mycobacterium tuberculosis H37Rv
cugcgucccggaaaaagucaccu

SEQ ID NO: 1348332 - RNA, 13 nt, Mycobacterium tuberculosis H37Rv
cugcuccaggcgc

SEQ ID NO: 1348333 - RNA, 14 nt, Mycobacterium tuberculosis H37Rv
cugcuccaggcgcg

SEQ ID NO: 1348334 - RNA, 18 nt, Mycobacterium tuberculosis H37Rv
cugcgucgucugcagacc

SEQ ID NO: 1348335 - RNA, 14 nt, Mycobacterium tuberculosis H37Rv
cugcuccgcgccgc

SEQ ID NO: 1348336 - RNA, 15 nt, Mycobacterium tuberculosis H37Rv
cugcuccgcugucac

SEQ ID NO: 1348337 - RNA, 18 nt, Mycobacterium tuberculosis H37Rv
cugcucccgaaaagcgcc

SEQ ID NO: 1348338 - RNA, 19 nt, Mycobacterium tuberculosis H37Rv
cugcucuuuuagccacaau

SEQ ID NO: 1348339 - RNA, 19 nt, Mycobacterium tuberculosis H37Rv
cugcugaaauccuagggug

SEQ ID NO: 1348340 - RNA, 15 nt, Mycobacterium tuberculosis H37Rv
cugcucggcgcggug

SEQ ID NO: 1348341 - RNA, 16 nt, Mycobacterium tuberculosis H37Rv
cugcucgcuggugaac

SEQ ID NO: 1348342 - RNA, 15 nt, Mycobacterium tuberculosis H37Rv
cugcucgcgcccgcu

SEQ ID NO: 1348343 - RNA, 21 nt, Mycobacterium tuberculosis H37Rv
cugcucgcgcaaggcgccgca

SEQ ID NO: 1348344 - RNA, 21 nt, Mycobacterium tuberculosis H37Rv
cugcucggcggugccgcggcu

SEQ ID NO: 1348345 - RNA, 17 nt, Mycobacterium tuberculosis H37Rv
cugcucgucuuggcggc

SEQ ID NO: 1348346 - RNA, 14 nt, Mycobacterium tuberculosis H37Rv
cugcucgucggcca

SEQ ID NO: 1348347 - RNA, 16 nt, Mycobacterium tuberculosis H37Rv
cugcucgucggcgccg

SEQ ID NO: 1348348 - RNA, 23 nt, Mycobacterium tuberculosis H37Rv
cugcucgucggucaccgaaugcg

SEQ ID NO: 1348349 - RNA, 17 nt, Mycobacterium tuberculosis H37Rv
cuggcagaccaacgcuc

SEQ ID NO: 1348350 - RNA, 16 nt, Mycobacterium tuberculosis H37Rv
cuggcagaccaacgcu

SEQ ID NO: 1348351 - RNA, 18 nt, Mycobacterium tuberculosis H37Rv
cuggcagcggccuccggg

SEQ ID NO: 1348352 - RNA, 15 nt, Mycobacterium tuberculosis H37Rv
cuggcagcggccucc

SEQ ID NO: 1348353 - RNA, 16 nt, Mycobacterium tuberculosis H37Rv
cuggcagcggccuccg

SEQ ID NO: 1348354 - RNA, 21 nt, Mycobacterium tuberculosis H37Rv
cuggccacucccagccaaccc

SEQ ID NO: 1348355 - RNA, 13 nt, Mycobacterium tuberculosis H37Rv
cuggccaguccga

SEQ ID NO: 1348356 - RNA, 21 nt, Mycobacterium tuberculosis H37Rv
cuggccagguugccgucggcc

SEQ ID NO: 1348357 - RNA, 17 nt, Mycobacterium tuberculosis H37Rv
cuggccagcagagcggc

SEQ ID NO: 1348358 - RNA, 23 nt, Mycobacterium tuberculosis H37Rv
cuggccgaauaacagcaggcauu

SEQ ID NO: 1348359 - RNA, 14 nt, Mycobacterium tuberculosis H37Rv
cuggccgaagcccg

SEQ ID NO: 1348360 - RNA, 22 nt, Mycobacterium tuberculosis H37Rv
cuggcccuuguuggccugcaac

SEQ ID NO: 1348361 - RNA, 14 nt, Mycobacterium tuberculosis H37Rv
cuggccgacucgag

SEQ ID NO: 1348362 - RNA, 13 nt, Mycobacterium tuberculosis H37Rv
cuggccgccagau

SEQ ID NO: 1348363 - RNA, 13 nt, Mycobacterium tuberculosis H37Rv
cuggccgccggcg

SEQ ID NO: 1348364 - RNA, 11 nt, Mycobacterium tuberculosis H37Rv
cuggccgcgau

SEQ ID NO: 1348365 - RNA, 17 nt, Mycobacterium tuberculosis H37Rv
cuggccgccuccgcggc

SEQ ID NO: 1348366 - RNA, 14 nt, Mycobacterium tuberculosis H37Rv
cuggccgcccggcg

SEQ ID NO: 1348367 - RNA, 21 nt, Mycobacterium tuberculosis H37Rv
cuggccggguuccagcggcac

SEQ ID NO: 1348368 - RNA, 16 nt, Mycobacterium tuberculosis H37Rv
cuggccgggaccgccc

SEQ ID NO: 1348369 - RNA, 21 nt, Mycobacterium tuberculosis H37Rv
cuggccgggaccgccccggcc

SEQ ID NO: 1348370 - RNA, 22 nt, Mycobacterium tuberculosis H37Rv
cuggccgcgccucggucugcuc

SEQ ID NO: 1348371 - RNA, 14 nt, Mycobacterium tuberculosis H37Rv
cuggcgaacaguga

SEQ ID NO: 1348372 - RNA, 22 nt, Mycobacterium tuberculosis H37Rv
cuggccuuugagcgcggccacc

SEQ ID NO: 1348373 - RNA, 17 nt, Mycobacterium tuberculosis H37Rv
cuggccuuugagcgcgg

SEQ ID NO: 1348374 - RNA, 18 nt, Mycobacterium tuberculosis H37Rv
cuggcgaaggacaacagc

SEQ ID NO: 1348375 - RNA, 20 nt, Mycobacterium tuberculosis H37Rv
cuggccuuggcaguccagcc

SEQ ID NO: 1348376 - RNA, 13 nt, Mycobacterium tuberculosis H37Rv
cuggccuuggcga

SEQ ID NO: 1348377 - RNA, 19 nt, Mycobacterium tuberculosis H37Rv
cuggcgacgacgacaccgc

SEQ ID NO: 1348378 - RNA, 12 nt, Mycobacterium tuberculosis H37Rv
cuggauggcgcu

SEQ ID NO: 1348379 - RNA, 23 nt, Mycobacterium tuberculosis H37Rv
cuggauguaguuggcgaccugcg

SEQ ID NO: 1348380 - RNA, 15 nt, Mycobacterium tuberculosis H37Rv
cuggaugccgaucgg

SEQ ID NO: 1348381 - RNA, 16 nt, Mycobacterium tuberculosis H37Rv
cuggcaacgccgcgcc

SEQ ID NO: 1348382 - RNA, 22 nt, Mycobacterium tuberculosis H37Rv
cuggcaaaguaucgcagcaucu

SEQ ID NO: 1348383 - RNA, 15 nt, Mycobacterium tuberculosis H37Rv
cuggaucagcgucgg

SEQ ID NO: 1348384 - RNA, 23 nt, Mycobacterium tuberculosis H37Rv
cuggcuugggccagcgcaucuuu

SEQ ID NO: 1348385 - RNA, 19 nt, Mycobacterium tuberculosis H37Rv
cuggcuggugauggccauc

SEQ ID NO: 1348386 - RNA, 15 nt, Mycobacterium tuberculosis H37Rv
cuggcugagcacugc

SEQ ID NO: 1348387 - RNA, 13 nt, Mycobacterium tuberculosis H37Rv
cuggcugaccgaa

SEQ ID NO: 1348388 - RNA, 21 nt, Mycobacterium tuberculosis H37Rv
cuggcugaacauuccggcacc

SEQ ID NO: 1348389 - RNA, 23 nt, Mycobacterium tuberculosis H37Rv
cuggcgucgucuucgguuaaggu

SEQ ID NO: 1348390 - RNA, 15 nt, Mycobacterium tuberculosis H37Rv
cuggcgcccccgcca

SEQ ID NO: 1348391 - RNA, 19 nt, Mycobacterium tuberculosis H37Rv
cuggcgcccgggucccggc

SEQ ID NO: 1348392 - RNA, 15 nt, Mycobacterium tuberculosis H37Rv
cuggcgcagcgccuc

SEQ ID NO: 1348393 - RNA, 15 nt, Mycobacterium tuberculosis H37Rv
cuggcuacgccuccu

SEQ ID NO: 1348394 - RNA, 24 nt, Mycobacterium tuberculosis H37Rv
cuggcuaucugauccagccgcguc

SEQ ID NO: 1348395 - RNA, 23 nt, Mycobacterium tuberculosis H37Rv
cuggcguuguugacgaucacccc

SEQ ID NO: 1348396 - RNA, 16 nt, Mycobacterium tuberculosis H37Rv
cuggcuccggccaggg

SEQ ID NO: 1348397 - RNA, 24 nt, Mycobacterium tuberculosis H37Rv
cugggcgguagcuuccgcgacgcu

SEQ ID NO: 1348398 - RNA, 15 nt, Mycobacterium tuberculosis H37Rv
cugggcgcuggaggc

SEQ ID NO: 1348399 - RNA, 22 nt, Mycobacterium tuberculosis H37Rv
cugggcgcuggaggccaccacc

SEQ ID NO: 1348400 - RNA, 14 nt, Mycobacterium tuberculosis H37Rv
cugggcggccgggc

SEQ ID NO: 1348401 - RNA, 15 nt, Mycobacterium tuberculosis H37Rv
cugggcgcgcuggcg

SEQ ID NO: 1348402 - RNA, 22 nt, Mycobacterium tuberculosis H37Rv
cugggccggugcgaauggugca

SEQ ID NO: 1348403 - RNA, 16 nt, Mycobacterium tuberculosis H37Rv
cugggccgccgcccug

SEQ ID NO: 1348404 - RNA, 13 nt, Mycobacterium tuberculosis H37Rv
cugggccgcacaa

SEQ ID NO: 1348405 - RNA, 16 nt, Mycobacterium tuberculosis H37Rv
cugggccgagcgcgcc

SEQ ID NO: 1348406 - RNA, 19 nt, Mycobacterium tuberculosis H37Rv
cugggcccgagcgcgcgcu

SEQ ID NO: 1348407 - RNA, 18 nt, Mycobacterium tuberculosis H37Rv
cugggcccgccagcccag

SEQ ID NO: 1348408 - RNA, 23 nt, Mycobacterium tuberculosis H37Rv
cugggcccccaaucagugcagcg

SEQ ID NO: 1348409 - RNA, 14 nt, Mycobacterium tuberculosis H37Rv
cugggcugccggcc

SEQ ID NO: 1348410 - RNA, 16 nt, Mycobacterium tuberculosis H37Rv
cuggggguaccucccg

SEQ ID NO: 1348411 - RNA, 20 nt, Mycobacterium tuberculosis H37Rv
cuggggguggcagcgcggcc

SEQ ID NO: 1348412 - RNA, 20 nt, Mycobacterium tuberculosis H37Rv
cuggggugcugcgcgcggcg

SEQ ID NO: 1348413 - RNA, 23 nt, Mycobacterium tuberculosis H37Rv
cuggggugcugcgcgcggcggcc

SEQ ID NO: 1348414 - RNA, 16 nt, Mycobacterium tuberculosis H37Rv
cuggggugaacuccau

SEQ ID NO: 1348415 - RNA, 23 nt, Mycobacterium tuberculosis H37Rv
cugggcaucaccgccgcggccgc

SEQ ID NO: 1348416 - RNA, 20 nt, Mycobacterium tuberculosis H37Rv
cugggcacucggcccggccc

SEQ ID NO: 1348417 - RNA, 15 nt, Mycobacterium tuberculosis H37Rv
cugggcaccggcggu

SEQ ID NO: 1348418 - RNA, 17 nt, Mycobacterium tuberculosis H37Rv
cugggccagcagccguu

SEQ ID NO: 1348419 - RNA, 19 nt, Mycobacterium tuberculosis H37Rv
cugggcaaugacuugcgac

SEQ ID NO: 1348420 - RNA, 18 nt, Mycobacterium tuberculosis H37Rv
cugggcaaguucugcgcu

SEQ ID NO: 1348421 - RNA, 14 nt, Mycobacterium tuberculosis H37Rv
cugggacggcggca

SEQ ID NO: 1348422 - RNA, 17 nt, Mycobacterium tuberculosis H37Rv
cugguguagccgagcac

SEQ ID NO: 1348423 - RNA, 20 nt, Mycobacterium tuberculosis H37Rv
cugguguagaccgaaauggu

SEQ ID NO: 1348424 - RNA, 19 nt, Mycobacterium tuberculosis H37Rv
cuggugggggagcggccgc

SEQ ID NO: 1348425 - RNA, 19 nt, Mycobacterium tuberculosis H37Rv
cugguggcggcacuggccc

SEQ ID NO: 1348426 - RNA, 23 nt, Mycobacterium tuberculosis H37Rv
cugguggcgcugaagccgacgau

SEQ ID NO: 1348427 - RNA, 15 nt, Mycobacterium tuberculosis H37Rv
cugguggcagacaug

SEQ ID NO: 1348428 - RNA, 16 nt, Mycobacterium tuberculosis H37Rv
cugguggcagcgcacc

SEQ ID NO: 1348429 - RNA, 19 nt, Mycobacterium tuberculosis H37Rv
cuggugcguagcccacccg

SEQ ID NO: 1348430 - RNA, 22 nt, Mycobacterium tuberculosis H37Rv
cuggguucccgaugugaacgca

SEQ ID NO: 1348431 - RNA, 17 nt, Mycobacterium tuberculosis H37Rv
cugguugcgccacugcg

SEQ ID NO: 1348432 - RNA, 13 nt, Mycobacterium tuberculosis H37Rv
cugguuggcuucu

SEQ ID NO: 1348433 - RNA, 19 nt, Mycobacterium tuberculosis H37Rv
cugguugggccagcuccug

SEQ ID NO: 1348434 - RNA, 16 nt, Mycobacterium tuberculosis H37Rv
cugguguuucaggcag

SEQ ID NO: 1348435 - RNA, 17 nt, Mycobacterium tuberculosis H37Rv
cugguucggguuggaga

SEQ ID NO: 1348436 - RNA, 15 nt, Mycobacterium tuberculosis H37Rv
cugguguugaugagc

SEQ ID NO: 1348437 - RNA, 20 nt, Mycobacterium tuberculosis H37Rv
cuggugugacgauccccauu

SEQ ID NO: 1348438 - RNA, 13 nt, Mycobacterium tuberculosis H37Rv
cuggugugucccg

SEQ ID NO: 1348439 - RNA, 15 nt, Mycobacterium tuberculosis H37Rv
cuguaggcgaccaga

SEQ ID NO: 1348440 - RNA, 17 nt, Mycobacterium tuberculosis H37Rv
cugucauguccugggcc

SEQ ID NO: 1348441 - RNA, 16 nt, Mycobacterium tuberculosis H37Rv
cuguccacguccagcc

SEQ ID NO: 1348442 - RNA, 18 nt, Mycobacterium tuberculosis H37Rv
cuguccacguccagcccg

SEQ ID NO: 1348443 - RNA, 15 nt, Mycobacterium tuberculosis H37Rv
cuguccaggucuggg

SEQ ID NO: 1348444 - RNA, 23 nt, Mycobacterium tuberculosis H37Rv
cuguccaggucugggcuuugcag

SEQ ID NO: 1348445 - RNA, 21 nt, Mycobacterium tuberculosis H37Rv
cuguagcgaaugaucuugcca

SEQ ID NO: 1348446 - RNA, 13 nt, Mycobacterium tuberculosis H37Rv
cuguccgguggaa

SEQ ID NO: 1348447 - RNA, 21 nt, Mycobacterium tuberculosis H37Rv
cugucgauggacaaggugugg

SEQ ID NO: 1348448 - RNA, 21 nt, Mycobacterium tuberculosis H37Rv
cugugaaucucacgacgccuu

SEQ ID NO: 1348449 - RNA, 20 nt, Mycobacterium tuberculosis H37Rv
cugucgauggacaaggugug

SEQ ID NO: 1348450 - RNA, 23 nt, Mycobacterium tuberculosis H37Rv
cugugacacccgagggccugacg

SEQ ID NO: 1348451 - RNA, 19 nt, Mycobacterium tuberculosis H37Rv
cugugacacccgagggccu

SEQ ID NO: 1348452 - RNA, 15 nt, Mycobacterium tuberculosis H37Rv
cugugccagcagcag

SEQ ID NO: 1348453 - RNA, 23 nt, Mycobacterium tuberculosis H37Rv
cugugauuucggucugguugggc

SEQ ID NO: 1348454 - RNA, 16 nt, Mycobacterium tuberculosis H37Rv
cugugcccgaucagcc

SEQ ID NO: 1348455 - RNA, 16 nt, Mycobacterium tuberculosis H37Rv
cugugccccagggcag

SEQ ID NO: 1348456 - RNA, 21 nt, Mycobacterium tuberculosis H37Rv
cugugccgcugcauccgcagc

SEQ ID NO: 1348457 - RNA, 17 nt, Mycobacterium tuberculosis H37Rv
cugugcucacggcggcg

SEQ ID NO: 1348458 - RNA, 15 nt, Mycobacterium tuberculosis H37Rv
cugugcgcagacauc

SEQ ID NO: 1348459 - RNA, 13 nt, Mycobacterium tuberculosis H37Rv
cugugcgccgcag

SEQ ID NO: 1348460 - RNA, 21 nt, Mycobacterium tuberculosis H37Rv
cugugcgccgcagccugcaac

SEQ ID NO: 1348461 - RNA, 15 nt, Mycobacterium tuberculosis H37Rv
cugugucguggucga

SEQ ID NO: 1348462 - RNA, 17 nt, Mycobacterium tuberculosis H37Rv
cugugucugcucgcgcc

SEQ ID NO: 1348463 - RNA, 16 nt, Mycobacterium tuberculosis H37Rv
cugugguggugauggg

SEQ ID NO: 1348464 - RNA, 20 nt, Mycobacterium tuberculosis H37Rv
cuguggcgcgcaugguggcu

SEQ ID NO: 1348465 - RNA, 22 nt, Mycobacterium tuberculosis H37Rv
cuguggucgcugcugccgcacc

SEQ ID NO: 1348466 - RNA, 20 nt, Mycobacterium tuberculosis H37Rv
cuguuacuccgacggcccgg

SEQ ID NO: 1348467 - RNA, 19 nt, Mycobacterium tuberculosis H37Rv
cuguuacuccgacggcccg

SEQ ID NO: 1348468 - RNA, 17 nt, Mycobacterium tuberculosis H37Rv
cuugaccgcugcccagu

SEQ ID NO: 1348469 - RNA, 16 nt, Mycobacterium tuberculosis H37Rv
cuugaccgcugcccag

SEQ ID NO: 1348470 - RNA, 17 nt, Mycobacterium tuberculosis H37Rv
cuugacgcgcaacgccg

SEQ ID NO: 1348471 - RNA, 22 nt, Mycobacterium tuberculosis H37Rv
cuugacgcggccacauaccacc

SEQ ID NO: 1348472 - RNA, 14 nt, Mycobacterium tuberculosis H37Rv
cuugaccagcagcu

SEQ ID NO: 1348473 - RNA, 12 nt, Mycobacterium tuberculosis H37Rv
cuugaccagcag

SEQ ID NO: 1348474 - RNA, 12 nt, Mycobacterium tuberculosis H37Rv
cuugaccgccug

SEQ ID NO: 1348475 - RNA, 21 nt, Mycobacterium tuberculosis H37Rv
cuugacccuugggcaccaccc

SEQ ID NO: 1348476 - RNA, 22 nt, Mycobacterium tuberculosis H37Rv
cuugaccgcggugacucggccu

SEQ ID NO: 1348477 - RNA, 15 nt, Mycobacterium tuberculosis H37Rv
cuugaccccuggccg

SEQ ID NO: 1348478 - RNA, 13 nt, Mycobacterium tuberculosis H37Rv
cuugaccagagca

SEQ ID NO: 1348479 - RNA, 14 nt, Mycobacterium tuberculosis H37Rv
cuucuuugccggcg

SEQ ID NO: 1348480 - RNA, 20 nt, Mycobacterium tuberculosis H37Rv
cuugaagaaacccugcugcg

SEQ ID NO: 1348481 - RNA, 13 nt, Mycobacterium tuberculosis H37Rv
cuugagacgccgg

SEQ ID NO: 1348482 - RNA, 20 nt, Mycobacterium tuberculosis H37Rv
cuugaucucggcgagcaccg

SEQ ID NO: 1348483 - RNA, 16 nt, Mycobacterium tuberculosis H37Rv
cuugcccgcgcagcac

SEQ ID NO: 1348484 - RNA, 17 nt, Mycobacterium tuberculosis H37Rv
cuugcccgagcccagcc

SEQ ID NO: 1348485 - RNA, 23 nt, Mycobacterium tuberculosis H37Rv
cuugccacggcgauuccuccggu

SEQ ID NO: 1348486 - RNA, 23 nt, Mycobacterium tuberculosis H37Rv
cuugcccaagaucucgcgggccc

SEQ ID NO: 1348487 - RNA, 22 nt, Mycobacterium tuberculosis H37Rv
cuugccaaucgccgucagcacc

SEQ ID NO: 1348488 - RNA, 23 nt, Mycobacterium tuberculosis H37Rv
cuugccaaucgccgucagcaccg

SEQ ID NO: 1348489 - RNA, 16 nt, Mycobacterium tuberculosis H37Rv
cuugggccugggccgc

SEQ ID NO: 1348490 - RNA, 12 nt, Mycobacterium tuberculosis H37Rv
cuugggccaggc

SEQ ID NO: 1348491 - RNA, 12 nt, Mycobacterium tuberculosis H37Rv
cuugggcuucga

SEQ ID NO: 1348492 - RNA, 17 nt, Mycobacterium tuberculosis H37Rv
cuugggcuugcgccgga

SEQ ID NO: 1348493 - RNA, 21 nt, Mycobacterium tuberculosis H37Rv
cuuggggcguuguugggcgag

SEQ ID NO: 1348494 - RNA, 23 nt, Mycobacterium tuberculosis H37Rv
cuugggcgucgucuugaccgcuu

SEQ ID NO: 1348495 - RNA, 21 nt, Mycobacterium tuberculosis H37Rv
cuugggcgacgcggcgccgcc

SEQ ID NO: 1348496 - RNA, 14 nt, Mycobacterium tuberculosis H37Rv
cuugggucuccgga

SEQ ID NO: 1348497 - RNA, 16 nt, Mycobacterium tuberculosis H37Rv
cuugguagccggccgc

SEQ ID NO: 1348498 - RNA, 17 nt, Mycobacterium tuberculosis H37Rv
cuugguagccggccgcu

SEQ ID NO: 1348499 - RNA, 23 nt, Mycobacterium tuberculosis H37Rv
cuuggcuucgacgcuuccugggu

SEQ ID NO: 1348500 - RNA, 14 nt, Mycobacterium tuberculosis H37Rv
cuugggaaacccgg

SEQ ID NO: 1348501 - RNA, 19 nt, Mycobacterium tuberculosis H37Rv
cuugggauugcgggccugc

SEQ ID NO: 1348502 - RNA, 22 nt, Mycobacterium tuberculosis H37Rv
cuuggcugugauguuguucagc

SEQ ID NO: 1348503 - RNA, 24 nt, Mycobacterium tuberculosis H37Rv
cuuggcgugaccuaccuccucggc

SEQ ID NO: 1348504 - RNA, 22 nt, Mycobacterium tuberculosis H37Rv
cuuggcgucgacacccaccaac

SEQ ID NO: 1348505 - RNA, 18 nt, Mycobacterium tuberculosis H37Rv
cuuggcggccuuugucgc

SEQ ID NO: 1348506 - RNA, 12 nt, Mycobacterium tuberculosis H37Rv
cuuggcggccuu

SEQ ID NO: 1348507 - RNA, 12 nt, Mycobacterium tuberculosis H37Rv
cuuggcgggcgc

SEQ ID NO: 1348508 - RNA, 13 nt, Mycobacterium tuberculosis H37Rv
cuuggucgccgcu

SEQ ID NO: 1348509 - RNA, 13 nt, Mycobacterium tuberculosis H37Rv
cuuggucgccggc

SEQ ID NO: 1348510 - RNA, 17 nt, Mycobacterium tuberculosis H37Rv
cuuggucaccuucuugg

SEQ ID NO: 1348511 - RNA, 15 nt, Mycobacterium tuberculosis H37Rv
cuuggucaccuucuu

SEQ ID NO: 1348512 - RNA, 22 nt, Mycobacterium tuberculosis H37Rv
cuuggucaaaaagcucggcccu

SEQ ID NO: 1348513 - RNA, 14 nt, Mycobacterium tuberculosis H37Rv
cuuggucaccuucu

SEQ ID NO: 1348514 - RNA, 21 nt, Mycobacterium tuberculosis H37Rv
cuuggucagugugaacugucc

SEQ ID NO: 1348515 - RNA, 16 nt, Mycobacterium tuberculosis H37Rv
cuugguggcguggccc

SEQ ID NO: 1348516 - RNA, 21 nt, Mycobacterium tuberculosis H37Rv
cuuggugcccaaggcagaccc

SEQ ID NO: 1348517 - RNA, 20 nt, Mycobacterium tuberculosis H37Rv
cuugguuagccgcggcccgc

SEQ ID NO: 1348518 - RNA, 21 nt, Mycobacterium tuberculosis H37Rv
cuuguaucccucggggaacac

SEQ ID NO: 1348519 - RNA, 20 nt, Mycobacterium tuberculosis H37Rv
cuuguauaggccguugaucg

SEQ ID NO: 1348520 - RNA, 19 nt, Mycobacterium tuberculosis H37Rv
cuuggcgcgguccuccaga

SEQ ID NO: 1348521 - RNA, 17 nt, Mycobacterium tuberculosis H37Rv
cuuggcgauccaggcca

SEQ ID NO: 1348522 - RNA, 14 nt, Mycobacterium tuberculosis H37Rv
cuuggccaccaucg

SEQ ID NO: 1348523 - RNA, 18 nt, Mycobacterium tuberculosis H37Rv
cuuggcaggugccuucuu

SEQ ID NO: 1348524 - RNA, 14 nt, Mycobacterium tuberculosis H37Rv
cuuggccagcagcc

SEQ ID NO: 1348525 - RNA, 18 nt, Mycobacterium tuberculosis H37Rv
cuuggccagacccaccac

SEQ ID NO: 1348526 - RNA, 12 nt, Mycobacterium tuberculosis H37Rv
cuuggccgcgca

SEQ ID NO: 1348527 - RNA, 19 nt, Mycobacterium tuberculosis H37Rv
cuuggccaggaagucccgg

SEQ ID NO: 1348528 - RNA, 14 nt, Mycobacterium tuberculosis H37Rv
cuuggcaagccaag

SEQ ID NO: 1348529 - RNA, 14 nt, Mycobacterium tuberculosis H37Rv
cuuggaucgguugg

SEQ ID NO: 1348530 - RNA, 18 nt, Mycobacterium tuberculosis H37Rv
cuugcgcagccgcagccg

SEQ ID NO: 1348531 - RNA, 21 nt, Mycobacterium tuberculosis H37Rv
cuugcgaucggcacuuagccc

SEQ ID NO: 1348532 - RNA, 19 nt, Mycobacterium tuberculosis H37Rv
cuugcgaccccggcugcgc

SEQ ID NO: 1348533 - RNA, 18 nt, Mycobacterium tuberculosis H37Rv
cuugccgcccgcuccgcc

SEQ ID NO: 1348534 - RNA, 16 nt, Mycobacterium tuberculosis H37Rv
cuugccgccuuggccc

SEQ ID NO: 1348535 - RNA, 18 nt, Mycobacterium tuberculosis H37Rv
cuugccgccagccccagc

SEQ ID NO: 1348536 - RNA, 15 nt, Mycobacterium tuberculosis H37Rv
cuugccgccagcccc

SEQ ID NO: 1348537 - RNA, 16 nt, Mycobacterium tuberculosis H37Rv
cuugccgccggccccg

SEQ ID NO: 1348538 - RNA, 19 nt, Mycobacterium tuberculosis H37Rv
cuugccgccggccccgccg

SEQ ID NO: 1348539 - RNA, 21 nt, Mycobacterium tuberculosis H37Rv
cuugccgccggcuccgccagc

SEQ ID NO: 1348540 - RNA, 14 nt, Mycobacterium tuberculosis H37Rv
cuuucagcaggaga

SEQ ID NO: 1348541 - RNA, 23 nt, Mycobacterium tuberculosis H37Rv
cuugucgggcaccgguuugacgu

SEQ ID NO: 1348542 - RNA, 15 nt, Mycobacterium tuberculosis H37Rv
cuugucgaccacgac

SEQ ID NO: 1348543 - RNA, 14 nt, Mycobacterium tuberculosis H37Rv
cuugucgccggcau

SEQ ID NO: 1348544 - RNA, 14 nt, Mycobacterium tuberculosis H37Rv
cuugucggccccgg

SEQ ID NO: 1348545 - RNA, 14 nt, Mycobacterium tuberculosis H37Rv
cuuugaucgcccgg

SEQ ID NO: 1348546 - RNA, 13 nt, Mycobacterium tuberculosis H37Rv
cuuugcccgccgc

SEQ ID NO: 1348547 - RNA, 22 nt, Mycobacterium tuberculosis H37Rv
cuuugcgaaucggcccgugcca

SEQ ID NO: 1348548 - RNA, 18 nt, Mycobacterium tuberculosis H37Rv
cuuuggaguuugauucca

SEQ ID NO: 1348549 - RNA, 18 nt, Mycobacterium tuberculosis H37Rv
cuuugcgguaagccggcg

SEQ ID NO: 1348550 - RNA, 14 nt, Mycobacterium tuberculosis H37Rv
cuuugcguucccau

SEQ ID NO: 1348551 - RNA, 17 nt, Mycobacterium tuberculosis H37Rv
cuuugcuugccgcauac

SEQ ID NO: 1348552 - RNA, 19 nt, Mycobacterium tuberculosis H37Rv
cuuuccagaguucccgaaa

SEQ ID NO: 1348553 - RNA, 18 nt, Mycobacterium tuberculosis H37Rv
cuuugacgcccggcaccc

SEQ ID NO: 1348554 - RNA, 20 nt, Mycobacterium tuberculosis H37Rv
cuuugacccguuccacgccg

SEQ ID NO: 1348555 - RNA, 19 nt, Mycobacterium tuberculosis H37Rv
cuuugacaccggucggcag

SEQ ID NO: 1348556 - RNA, 18 nt, Mycobacterium tuberculosis H37Rv
cuuugagugccgugucga

SEQ ID NO: 1348557 - RNA, 18 nt, Mycobacterium tuberculosis H37Rv
cuuugagaauucgccaag

SEQ ID NO: 1348558 - RNA, 20 nt, Mycobacterium tuberculosis H37Rv
cuuagcgccguugccgccac

SEQ ID NO: 1348559 - RNA, 19 nt, Mycobacterium tuberculosis H37Rv
cuuagcccggccgcggccc

SEQ ID NO: 1348560 - RNA, 14 nt, Mycobacterium tuberculosis H37Rv
cuuagcggcuuggc

SEQ ID NO: 1348561 - RNA, 16 nt, Mycobacterium tuberculosis H37Rv
cuuaggcacucccgga

SEQ ID NO: 1348562 - RNA, 18 nt, Mycobacterium tuberculosis H37Rv
cuuaggacccaauguggu

SEQ ID NO: 1348563 - RNA, 16 nt, Mycobacterium tuberculosis H37Rv
cuguuccagcgucugc

SEQ ID NO: 1348564 - RNA, 16 nt, Mycobacterium tuberculosis H37Rv
cuguucgauaagcagc

SEQ ID NO: 1348565 - RNA, 16 nt, Mycobacterium tuberculosis H37Rv
cuuaacacaugcaagu

SEQ ID NO: 1348566 - RNA, 17 nt, Mycobacterium tuberculosis H37Rv
cuuaagccggcgcggcg

SEQ ID NO: 1348567 - RNA, 21 nt, Mycobacterium tuberculosis H37Rv
cuuaagcgaacccgagccgcc

SEQ ID NO: 1348568 - RNA, 21 nt, Mycobacterium tuberculosis H37Rv
cuucaagauuaccgaagcccg

SEQ ID NO: 1348569 - RNA, 13 nt, Mycobacterium tuberculosis H37Rv
cuucaccuggugu

SEQ ID NO: 1348570 - RNA, 13 nt, Mycobacterium tuberculosis H37Rv
cuucaccuggaag

SEQ ID NO: 1348571 - RNA, 24 nt, Mycobacterium tuberculosis H37Rv
cuucaccuggaaggucagcgcccu

SEQ ID NO: 1348572 - RNA, 14 nt, Mycobacterium tuberculosis H37Rv
cuucaccagcugcg

SEQ ID NO: 1348573 - RNA, 14 nt, Mycobacterium tuberculosis H37Rv
cuucaccgccuugg

SEQ ID NO: 1348574 - RNA, 12 nt, Mycobacterium tuberculosis H37Rv
cuucaaugcugg

SEQ ID NO: 1348575 - RNA, 12 nt, Mycobacterium tuberculosis H37Rv
cuuaugcgcggu

SEQ ID NO: 1348576 - RNA, 19 nt, Mycobacterium tuberculosis H37Rv
cuuauugccgagcucggcu

SEQ ID NO: 1348577 - RNA, 20 nt, Mycobacterium tuberculosis H37Rv
cuuauuggacugcagcgugu

SEQ ID NO: 1348578 - RNA, 13 nt, Mycobacterium tuberculosis H37Rv
cuucggguccagc

SEQ ID NO: 1348579 - RNA, 15 nt, Mycobacterium tuberculosis H37Rv
cuucggguccagcgg

SEQ ID NO: 1348580 - RNA, 19 nt, Mycobacterium tuberculosis H37Rv
cuucggguccagcggccgc

SEQ ID NO: 1348581 - RNA, 17 nt, Mycobacterium tuberculosis H37Rv
cuucgggugugacgcgc

SEQ ID NO: 1348582 - RNA, 13 nt, Mycobacterium tuberculosis H37Rv
cuucgggaacgcu

SEQ ID NO: 1348583 - RNA, 12 nt, Mycobacterium tuberculosis H37Rv
cuucgggcggcg

SEQ ID NO: 1348584 - RNA, 22 nt, Mycobacterium tuberculosis H37Rv
cuucgggcgucauccgcggcag

SEQ ID NO: 1348585 - RNA, 18 nt, Mycobacterium tuberculosis H37Rv
cuucggggugcacgcgga

SEQ ID NO: 1348586 - RNA, 19 nt, Mycobacterium tuberculosis H37Rv
cuucggcggugcccagcag

SEQ ID NO: 1348587 - RNA, 23 nt, Mycobacterium tuberculosis H37Rv
cuucggcggucagcggcugggcg

SEQ ID NO: 1348588 - RNA, 19 nt, Mycobacterium tuberculosis H37Rv
cuucggacagcagccggcg

SEQ ID NO: 1348589 - RNA, 18 nt, Mycobacterium tuberculosis H37Rv
cuucggacuggggcacgc

SEQ ID NO: 1348590 - RNA, 15 nt, Mycobacterium tuberculosis H37Rv
cuucggccagaucac

SEQ ID NO: 1348591 - RNA, 12 nt, Mycobacterium tuberculosis H37Rv
cuucggccgcac

SEQ ID NO: 1348592 - RNA, 22 nt, Mycobacterium tuberculosis H37Rv
cuucgaccaucaccacggccgc

SEQ ID NO: 1348593 - RNA, 14 nt, Mycobacterium tuberculosis H37Rv
cuucgacagcggcg

SEQ ID NO: 1348594 - RNA, 21 nt, Mycobacterium tuberculosis H37Rv
cuucgaaccguuucgccggcg

SEQ ID NO: 1348595 - RNA, 15 nt, Mycobacterium tuberculosis H37Rv
cuucgagccggcggc

SEQ ID NO: 1348596 - RNA, 16 nt, Mycobacterium tuberculosis H37Rv
cuucgagccggcggcc

SEQ ID NO: 1348597 - RNA, 15 nt, Mycobacterium tuberculosis H37Rv
cuucgacguugcgga

SEQ ID NO: 1348598 - RNA, 18 nt, Mycobacterium tuberculosis H37Rv
cuucgaguuuggugucga

SEQ ID NO: 1348599 - RNA, 20 nt, Mycobacterium tuberculosis H37Rv
cuucgaucagcggcaguucc

SEQ ID NO: 1348600 - RNA, 18 nt, Mycobacterium tuberculosis H37Rv
cuucgcuaccuucuuggc

SEQ ID NO: 1348601 - RNA, 14 nt, Mycobacterium tuberculosis H37Rv
cuucgugcaccaca

SEQ ID NO: 1348602 - RNA, 15 nt, Mycobacterium tuberculosis H37Rv
cuucguggccuugac

SEQ ID NO: 1348603 - RNA, 15 nt, Mycobacterium tuberculosis H37Rv
cuucguugucggcgg

SEQ ID NO: 1348604 - RNA, 16 nt, Mycobacterium tuberculosis H37Rv
cuucgucggccggcac

SEQ ID NO: 1348605 - RNA, 21 nt, Mycobacterium tuberculosis H37Rv
cuucgucgccgaacagcgacg

SEQ ID NO: 1348606 - RNA, 16 nt, Mycobacterium tuberculosis H37Rv
cuucgguguagcccag

SEQ ID NO: 1348607 - RNA, 22 nt, Mycobacterium tuberculosis H37Rv
cuucggugguuccggcuggugg

SEQ ID NO: 1348608 - RNA, 12 nt, Mycobacterium tuberculosis H37Rv
cuucggugaucu

SEQ ID NO: 1348609 - RNA, 15 nt, Mycobacterium tuberculosis H37Rv
cuucguagcggccgc

SEQ ID NO: 1348610 - RNA, 17 nt, Mycobacterium tuberculosis H37Rv
cuucccgcgcgagccgc

SEQ ID NO: 1348611 - RNA, 23 nt, Mycobacterium tuberculosis H37Rv
cuucccuccagauaccaccgccg

SEQ ID NO: 1348612 - RNA, 16 nt, Mycobacterium tuberculosis H37Rv
cuucccggaagcgccg

SEQ ID NO: 1348613 - RNA, 15 nt, Mycobacterium tuberculosis H37Rv
cuucccccgguccgg

SEQ ID NO: 1348614 - RNA, 19 nt, Mycobacterium tuberculosis H37Rv
cuuccuggguuggcaucca

SEQ ID NO: 1348615 - RNA, 23 nt, Mycobacterium tuberculosis H37Rv
cuuccuggguugugccgcccugg

SEQ ID NO: 1348616 - RNA, 19 nt, Mycobacterium tuberculosis H37Rv
cuuccgguucaucggcaug

SEQ ID NO: 1348617 - RNA, 21 nt, Mycobacterium tuberculosis H37Rv
cuuccaauugauaggccccga

SEQ ID NO: 1348618 - RNA, 21 nt, Mycobacterium tuberculosis H37Rv
cuuccacugacgucucaucaa

SEQ ID NO: 1348619 - RNA, 17 nt, Mycobacterium tuberculosis H37Rv
cuuccagccacagcccg

SEQ ID NO: 1348620 - RNA, 19 nt, Mycobacterium tuberculosis H37Rv
cuuccagccacagcccggc

SEQ ID NO: 1348621 - RNA, 22 nt, Mycobacterium tuberculosis H37Rv
cuuccagccacagcccggcggc

SEQ ID NO: 1348622 - RNA, 20 nt, Mycobacterium tuberculosis H37Rv
cuucacuguugcccuuggga

SEQ ID NO: 1348623 - RNA, 20 nt, Mycobacterium tuberculosis H37Rv
cuucaucgccucgaggacca

SEQ ID NO: 1348624 - RNA, 20 nt, Mycobacterium tuberculosis H37Rv
cuuccaacucggcggccagc

SEQ ID NO: 1348625 - RNA, 15 nt, Mycobacterium tuberculosis H37Rv
cuuccaacaccaacg

SEQ ID NO: 1348626 - RNA, 23 nt, Mycobacterium tuberculosis H37Rv
cuucaucuucgaggucugguaga

SEQ ID NO: 1348627 - RNA, 12 nt, Mycobacterium tuberculosis H37Rv
cgcagcgcggcu

SEQ ID NO: 1348628 - RNA, 14 nt, Mycobacterium tuberculosis H37Rv
cgcagcggcggcaa

SEQ ID NO: 1348629 - RNA, 12 nt, Mycobacterium tuberculosis H37Rv
cgcagcgccugc

SEQ ID NO: 1348630 - RNA, 14 nt, Mycobacterium tuberculosis H37Rv
cgcagcgccagcgg

SEQ ID NO: 1348631 - RNA, 22 nt, Mycobacterium tuberculosis H37Rv
cgcagcgacgggaaagccaccu

SEQ ID NO: 1348632 - RNA, 16 nt, Mycobacterium tuberculosis H37Rv
cgcagcgguccgccgc

SEQ ID NO: 1348633 - RNA, 19 nt, Mycobacterium tuberculosis H37Rv
cgcaggaucgaguugcggu

SEQ ID NO: 1348634 - RNA, 23 nt, Mycobacterium tuberculosis H37Rv
cgcaggauucugcugaccaugac

SEQ ID NO: 1348635 - RNA, 23 nt, Mycobacterium tuberculosis H37Rv
cgcaggaauucgccauagcgggc

SEQ ID NO: 1348636 - RNA, 19 nt, Mycobacterium tuberculosis H37Rv
cgcaggaauucgccauagc

SEQ ID NO: 1348637 - RNA, 22 nt, Mycobacterium tuberculosis H37Rv
cgcaggaauucgccauagcggg

SEQ ID NO: 1348638 - RNA, 15 nt, Mycobacterium tuberculosis H37Rv
cgcaggacgcugccg

SEQ ID NO: 1348639 - RNA, 21 nt, Mycobacterium tuberculosis H37Rv
cgcaguuggcaccagccggug

SEQ ID NO: 1348640 - RNA, 15 nt, Mycobacterium tuberculosis H37Rv
cgcaguuggcaccag

SEQ ID NO: 1348641 - RNA, 21 nt, Mycobacterium tuberculosis H37Rv
cgcaguccgguuacgcucgcg

SEQ ID NO: 1348642 - RNA, 15 nt, Mycobacterium tuberculosis H37Rv
cgcaggcucagcugg

SEQ ID NO: 1348643 - RNA, 18 nt, Mycobacterium tuberculosis H37Rv
cgcaggcucaccgagccg

SEQ ID NO: 1348644 - RNA, 18 nt, Mycobacterium tuberculosis H37Rv
cgcagggacugugggggc

SEQ ID NO: 1348645 - RNA, 15 nt, Mycobacterium tuberculosis H37Rv
cgcagggaucacccc

SEQ ID NO: 1348646 - RNA, 20 nt, Mycobacterium tuberculosis H37Rv
cgcaggcuuccagccacagc

SEQ ID NO: 1348647 - RNA, 15 nt, Mycobacterium tuberculosis H37Rv
cgcagccggcccguc

SEQ ID NO: 1348648 - RNA, 18 nt, Mycobacterium tuberculosis H37Rv
cgcagccgggcaccaccc

SEQ ID NO: 1348649 - RNA, 15 nt, Mycobacterium tuberculosis H37Rv
cgcagccgcggggcc

SEQ ID NO: 1348650 - RNA, 21 nt, Mycobacterium tuberculosis H37Rv
cgcagccgguuaauggaauga

SEQ ID NO: 1348651 - RNA, 20 nt, Mycobacterium tuberculosis H37Rv
cgcagccuggucgcgcagcu

SEQ ID NO: 1348652 - RNA, 19 nt, Mycobacterium tuberculosis H37Rv
cgcagcccgugacugguga

SEQ ID NO: 1348653 - RNA, 13 nt, Mycobacterium tuberculosis H37Rv
cgcagcccgccgg

SEQ ID NO: 1348654 - RNA, 19 nt, Mycobacterium tuberculosis H37Rv
cgcagccgaucgagcagga

SEQ ID NO: 1348655 - RNA, 14 nt, Mycobacterium tuberculosis H37Rv
cgcagccgccucaa

SEQ ID NO: 1348656 - RNA, 23 nt, Mycobacterium tuberculosis H37Rv
cgcagccgccucaaugaccaccg

SEQ ID NO: 1348657 - RNA, 20 nt, Mycobacterium tuberculosis H37Rv
cgcagccaaguccgcccgcc

SEQ ID NO: 1348658 - RNA, 22 nt, Mycobacterium tuberculosis H37Rv
cgcagccaaguccgcccgccga

SEQ ID NO: 1348659 - RNA, 21 nt, Mycobacterium tuberculosis H37Rv
cgcagccacguuacgcucgcg

SEQ ID NO: 1348660 - RNA, 17 nt, Mycobacterium tuberculosis H37Rv
cgcagcaucuccgccgg

SEQ ID NO: 1348661 - RNA, 16 nt, Mycobacterium tuberculosis H37Rv
cgcagcaucuccgccg

SEQ ID NO: 1348662 - RNA, 13 nt, Mycobacterium tuberculosis H37Rv
cgcagccagaucu

SEQ ID NO: 1348663 - RNA, 12 nt, Mycobacterium tuberculosis H37Rv
cgcagccagcgc

SEQ ID NO: 1348664 - RNA, 17 nt, Mycobacterium tuberculosis H37Rv
cgcagccagcugaacac

SEQ ID NO: 1348665 - RNA, 14 nt, Mycobacterium tuberculosis H37Rv
cgcagccagcgcca

SEQ ID NO: 1348666 - RNA, 17 nt, Mycobacterium tuberculosis H37Rv
cgcagcauccccgcagc

SEQ ID NO: 1348667 - RNA, 21 nt, Mycobacterium tuberculosis H37Rv
cgcagcauaaagaggucgggc

SEQ ID NO: 1348668 - RNA, 22 nt, Mycobacterium tuberculosis H37Rv
cgcacuuucuuccucggggcuc

SEQ ID NO: 1348669 - RNA, 16 nt, Mycobacterium tuberculosis H37Rv
cgcagaacaccaccgc

SEQ ID NO: 1348670 - RNA, 20 nt, Mycobacterium tuberculosis H37Rv
cgcacugguugggcgagacc

SEQ ID NO: 1348671 - RNA, 16 nt, Mycobacterium tuberculosis H37Rv
cgcacuggucaacacg

SEQ ID NO: 1348672 - RNA, 13 nt, Mycobacterium tuberculosis H37Rv
cgcacugccccgc

SEQ ID NO: 1348673 - RNA, 23 nt, Mycobacterium tuberculosis H37Rv
cgcacuucuuucgaaaugagguc

SEQ ID NO: 1348674 - RNA, 17 nt, Mycobacterium tuberculosis H37Rv
cgcacugaggcucaggu

SEQ ID NO: 1348675 - RNA, 20 nt, Mycobacterium tuberculosis H37Rv
cgcacugaugucacccgccc

SEQ ID NO: 1348676 - RNA, 22 nt, Mycobacterium tuberculosis H37Rv
cgcacugcuagucgugccgcgu

SEQ ID NO: 1348677 - RNA, 22 nt, Mycobacterium tuberculosis H37Rv
cgcaccacgagcagccgaugcu

SEQ ID NO: 1348678 - RNA, 16 nt, Mycobacterium tuberculosis H37Rv
cgcacaccugcgcggc

SEQ ID NO: 1348679 - RNA, 13 nt, Mycobacterium tuberculosis H37Rv
cgcacacuaccgc

SEQ ID NO: 1348680 - RNA, 12 nt, Mycobacterium tuberculosis H37Rv
cgcacagcacca

SEQ ID NO: 1348681 - RNA, 21 nt, Mycobacterium tuberculosis H37Rv
cgcaccagcugucgggcagcu

SEQ ID NO: 1348682 - RNA, 21 nt, Mycobacterium tuberculosis H37Rv
cgcaccccauacucggcggcu

SEQ ID NO: 1348683 - RNA, 19 nt, Mycobacterium tuberculosis H37Rv
cgcacccccgacaccgccg

SEQ ID NO: 1348684 - RNA, 12 nt, Mycobacterium tuberculosis H37Rv
cgcacccagccc

SEQ ID NO: 1348685 - RNA, 17 nt, Mycobacterium tuberculosis H37Rv
cgcacccccuccgcgau

SEQ ID NO: 1348686 - RNA, 20 nt, Mycobacterium tuberculosis H37Rv
cgcacccgaaacaccgucug

SEQ ID NO: 1348687 - RNA, 12 nt, Mycobacterium tuberculosis H37Rv
cgcacccgcucg

SEQ ID NO: 1348688 - RNA, 17 nt, Mycobacterium tuberculosis H37Rv
cgcacccguccggccgg

SEQ ID NO: 1348689 - RNA, 22 nt, Mycobacterium tuberculosis H37Rv
cgcacccguccggccgggcccu

SEQ ID NO: 1348690 - RNA, 17 nt, Mycobacterium tuberculosis H37Rv
cgcacccguucgugagc

SEQ ID NO: 1348691 - RNA, 21 nt, Mycobacterium tuberculosis H37Rv
cgcacccguugcucccacggc

SEQ ID NO: 1348692 - RNA, 19 nt, Mycobacterium tuberculosis H37Rv
cgcacccguugcgacaccu

SEQ ID NO: 1348693 - RNA, 14 nt, Mycobacterium tuberculosis H37Rv
cgcaccccgcccga

SEQ ID NO: 1348694 - RNA, 14 nt, Mycobacterium tuberculosis H37Rv
cgcaccuaugguca

SEQ ID NO: 1348695 - RNA, 18 nt, Mycobacterium tuberculosis H37Rv
cgcaccuacccugcgcgu

SEQ ID NO: 1348696 - RNA, 18 nt, Mycobacterium tuberculosis H37Rv
cgcaccgaaacgccgacc

SEQ ID NO: 1348697 - RNA, 15 nt, Mycobacterium tuberculosis H37Rv
cgcaccuacccugcg

SEQ ID NO: 1348698 - RNA, 22 nt, Mycobacterium tuberculosis H37Rv
cgcaccugcgcgcggccgcgcu

SEQ ID NO: 1348699 - RNA, 16 nt, Mycobacterium tuberculosis H37Rv
cgcaccugcgcgcggc

SEQ ID NO: 1348700 - RNA, 15 nt, Mycobacterium tuberculosis H37Rv
cgcacggcgccgacc

SEQ ID NO: 1348701 - RNA, 23 nt, Mycobacterium tuberculosis H37Rv
cgcacggccgggucgaacaggcc

SEQ ID NO: 1348702 - RNA, 13 nt, Mycobacterium tuberculosis H37Rv
cgcacggccaccg

SEQ ID NO: 1348703 - RNA, 23 nt, Mycobacterium tuberculosis H37Rv
cgcacggaaggcccggcgcggcc

SEQ ID NO: 1348704 - RNA, 18 nt, Mycobacterium tuberculosis H37Rv
cgcacucaccuugucaaa

SEQ ID NO: 1348705 - RNA, 23 nt, Mycobacterium tuberculosis H37Rv
cgcacggcgucggccaccgccug

SEQ ID NO: 1348706 - RNA, 14 nt, Mycobacterium tuberculosis H37Rv
cgcacuccacgauc

SEQ ID NO: 1348707 - RNA, 17 nt, Mycobacterium tuberculosis H37Rv
cgcacucagucugggga

SEQ ID NO: 1348708 - RNA, 22 nt, Mycobacterium tuberculosis H37Rv
cgcacucauagaacucgccgcu

SEQ ID NO: 1348709 - RNA, 18 nt, Mycobacterium tuberculosis H37Rv
cgcacgcgguucaccacg

SEQ ID NO: 1348710 - RNA, 21 nt, Mycobacterium tuberculosis H37Rv
cgcacgcgaaaugccugcgcg

SEQ ID NO: 1348711 - RNA, 15 nt, Mycobacterium tuberculosis H37Rv
cgcaagucuccucga

SEQ ID NO: 1348712 - RNA, 17 nt, Mycobacterium tuberculosis H37Rv
cgcaagguugccaacgc

SEQ ID NO: 1348713 - RNA, 18 nt, Mycobacterium tuberculosis H37Rv
cgcaagguugccaacgcc

SEQ ID NO: 1348714 - RNA, 23 nt, Mycobacterium tuberculosis H37Rv
cgcaauaagggagaccgcggccg

SEQ ID NO: 1348715 - RNA, 19 nt, Mycobacterium tuberculosis H37Rv
cgcaauauccuccagcagg

SEQ ID NO: 1348716 - RNA, 13 nt, Mycobacterium tuberculosis H37Rv
cgcacaccgaccc

SEQ ID NO: 1348717 - RNA, 19 nt, Mycobacterium tuberculosis H37Rv
cgcaacaccgccaacuccu

SEQ ID NO: 1348718 - RNA, 14 nt, Mycobacterium tuberculosis H37Rv
cgcaacaccgugca

SEQ ID NO: 1348719 - RNA, 19 nt, Mycobacterium tuberculosis H37Rv
cgcaaauugcaacagagcg

SEQ ID NO: 1348720 - RNA, 17 nt, Mycobacterium tuberculosis H37Rv
cgcaacucgaccacuuc

SEQ ID NO: 1348721 - RNA, 21 nt, Mycobacterium tuberculosis H37Rv
cgcaacgcuucggcagcuccc

SEQ ID NO: 1348722 - RNA, 18 nt, Mycobacterium tuberculosis H37Rv
cgcaacgcuucggcagcu

SEQ ID NO: 1348723 - RNA, 18 nt, Mycobacterium tuberculosis H37Rv
cgcaacgggucggguccc

SEQ ID NO: 1348724 - RNA, 14 nt, Mycobacterium tuberculosis H37Rv
cgcaacggaugugg

SEQ ID NO: 1348725 - RNA, 15 nt, Mycobacterium tuberculosis H37Rv
cgcaacggccagcgc

SEQ ID NO: 1348726 - RNA, 19 nt, Mycobacterium tuberculosis H37Rv
cgcaaaccacccgcaacac

SEQ ID NO: 1348727 - RNA, 22 nt, Mycobacterium tuberculosis H37Rv
cgcaaacucagacucugccgau

SEQ ID NO: 1348728 - RNA, 22 nt, Mycobacterium tuberculosis H37Rv
cgcaaauacuucauguagcggu

SEQ ID NO: 1348729 - RNA, 15 nt, Mycobacterium tuberculosis H37Rv
cgcaaaggccccggu

SEQ ID NO: 1348730 - RNA, 16 nt, Mycobacterium tuberculosis H37Rv
cgaucuugggccacgc

SEQ ID NO: 1348731 - RNA, 14 nt, Mycobacterium tuberculosis H37Rv
cgaucuuggccacc

SEQ ID NO: 1348732 - RNA, 16 nt, Mycobacterium tuberculosis H37Rv
cgaucuuggccaccgc

SEQ ID NO: 1348733 - RNA, 21 nt, Mycobacterium tuberculosis H37Rv
cgaucuggcguagugcucgcc

SEQ ID NO: 1348734 - RNA, 14 nt, Mycobacterium tuberculosis H37Rv
cgaucugcucgccc

SEQ ID NO: 1348735 - RNA, 14 nt, Mycobacterium tuberculosis H37Rv
cgaucugcgcguca

SEQ ID NO: 1348736 - RNA, 23 nt, Mycobacterium tuberculosis H37Rv
cgaucugcgcgucaggccagcgc

SEQ ID NO: 1348737 - RNA, 21 nt, Mycobacterium tuberculosis H37Rv
cgaucugggcuuucagcaccg

SEQ ID NO: 1348738 - RNA, 16 nt, Mycobacterium tuberculosis H37Rv
cgaugacaggcuuggc

SEQ ID NO: 1348739 - RNA, 19 nt, Mycobacterium tuberculosis H37Rv
cgaugaccgaagagcgcgc

SEQ ID NO: 1348740 - RNA, 14 nt, Mycobacterium tuberculosis H37Rv
cgaugaccgcagca

SEQ ID NO: 1348741 - RNA, 18 nt, Mycobacterium tuberculosis H37Rv
cgaugaccucgucaaggu

SEQ ID NO: 1348742 - RNA, 20 nt, Mycobacterium tuberculosis H37Rv
cgaugaccuugcccaccagu

SEQ ID NO: 1348743 - RNA, 19 nt, Mycobacterium tuberculosis H37Rv
cgaugacgaacggacccgg

SEQ ID NO: 1348744 - RNA, 17 nt, Mycobacterium tuberculosis H37Rv
cgaugagcaugcccagc

SEQ ID NO: 1348745 - RNA, 19 nt, Mycobacterium tuberculosis H37Rv
cgaugacggugccgaccgc

SEQ ID NO: 1348746 - RNA, 19 nt, Mycobacterium tuberculosis H37Rv
cgaugacguacggcugugc

SEQ ID NO: 1348747 - RNA, 17 nt, Mycobacterium tuberculosis H37Rv
cgaucucggcggccgcg

SEQ ID NO: 1348748 - RNA, 22 nt, Mycobacterium tuberculosis H37Rv
cgaucucggcgagcaccacccc

SEQ ID NO: 1348749 - RNA, 21 nt, Mycobacterium tuberculosis H37Rv
cgaucucguggaucugccucu

SEQ ID NO: 1348750 - RNA, 16 nt, Mycobacterium tuberculosis H37Rv
cgaucugcccccgccg

SEQ ID NO: 1348751 - RNA, 14 nt, Mycobacterium tuberculosis H37Rv
cgaucucuccugga

SEQ ID NO: 1348752 - RNA, 21 nt, Mycobacterium tuberculosis H37Rv
cgaucugaagguguccgcugg

SEQ ID NO: 1348753 - RNA, 16 nt, Mycobacterium tuberculosis H37Rv
cgaucggcgcgccgau

SEQ ID NO: 1348754 - RNA, 14 nt, Mycobacterium tuberculosis H37Rv
cgaucggaccacca

SEQ ID NO: 1348755 - RNA, 19 nt, Mycobacterium tuberculosis H37Rv
cgaucgcguucugcaccag

SEQ ID NO: 1348756 - RNA, 16 nt, Mycobacterium tuberculosis H37Rv
cgaucgcguccgcgcu

SEQ ID NO: 1348757 - RNA, 21 nt, Mycobacterium tuberculosis H37Rv
cgaucgcguccgcgcucaacc

SEQ ID NO: 1348758 - RNA, 16 nt, Mycobacterium tuberculosis H37Rv
cgaucgcguccuccuc

SEQ ID NO: 1348759 - RNA, 16 nt, Mycobacterium tuberculosis H37Rv
cgaucgcguucugcac

SEQ ID NO: 1348760 - RNA, 15 nt, Mycobacterium tuberculosis H37Rv
cgaucgcgccgucgg

SEQ ID NO: 1348761 - RNA, 14 nt, Mycobacterium tuberculosis H37Rv
cgaucgcgccaggc

SEQ ID NO: 1348762 - RNA, 19 nt, Mycobacterium tuberculosis H37Rv
cgaucgugccccuagaguu

SEQ ID NO: 1348763 - RNA, 22 nt, Mycobacterium tuberculosis H37Rv
cgaucgucgagccgaucgcccg

SEQ ID NO: 1348764 - RNA, 19 nt, Mycobacterium tuberculosis H37Rv
cgaucggugcgggcgccgc

SEQ ID NO: 1348765 - RNA, 21 nt, Mycobacterium tuberculosis H37Rv
cgaucggugcgggcgccgcua

SEQ ID NO: 1348766 - RNA, 15 nt, Mycobacterium tuberculosis H37Rv
cgaucggugacgcgc

SEQ ID NO: 1348767 - RNA, 21 nt, Mycobacterium tuberculosis H37Rv
cgaucggugccgaagcugccc

SEQ ID NO: 1348768 - RNA, 21 nt, Mycobacterium tuberculosis H37Rv
cgaucggggcggugacuccgc

SEQ ID NO: 1348769 - RNA, 21 nt, Mycobacterium tuberculosis H37Rv
cgauggcaugggcuaccgaga

SEQ ID NO: 1348770 - RNA, 16 nt, Mycobacterium tuberculosis H37Rv
cgauggccaggcuggc

SEQ ID NO: 1348771 - RNA, 14 nt, Mycobacterium tuberculosis H37Rv
cgaugcgugccgac

SEQ ID NO: 1348772 - RNA, 20 nt, Mycobacterium tuberculosis H37Rv
cgaugcgugccgacccgcuu

SEQ ID NO: 1348773 - RNA, 21 nt, Mycobacterium tuberculosis H37Rv
cgaugcgugccgacccgcuuc

SEQ ID NO: 1348774 - RNA, 20 nt, Mycobacterium tuberculosis H37Rv
cgaugcgggccgccaggcgg

SEQ ID NO: 1348775 - RNA, 16 nt, Mycobacterium tuberculosis H37Rv
cgaugcgggccgccag

SEQ ID NO: 1348776 - RNA, 15 nt, Mycobacterium tuberculosis H37Rv
cgauggcaccacuac

SEQ ID NO: 1348777 - RNA, 23 nt, Mycobacterium tuberculosis H37Rv
cgaugguuauccccuggccaacc

SEQ ID NO: 1348778 - RNA, 21 nt, Mycobacterium tuberculosis H37Rv
cgaugguugaaccagucgacc

SEQ ID NO: 1348779 - RNA, 15 nt, Mycobacterium tuberculosis H37Rv
cgauggugugcagca

SEQ ID NO: 1348780 - RNA, 20 nt, Mycobacterium tuberculosis H37Rv
cgauggugccgacccgccgc

SEQ ID NO: 1348781 - RNA, 14 nt, Mycobacterium tuberculosis H37Rv
cgauggugaugggg

SEQ ID NO: 1348782 - RNA, 13 nt, Mycobacterium tuberculosis H37Rv
cgauggugccgac

SEQ ID NO: 1348783 - RNA, 23 nt, Mycobacterium tuberculosis H37Rv
cgauguacagcgggaucccgauc

SEQ ID NO: 1348784 - RNA, 16 nt, Mycobacterium tuberculosis H37Rv
cgaugguggccgccac

SEQ ID NO: 1348785 - RNA, 19 nt, Mycobacterium tuberculosis H37Rv
cgaugucagugaucaccaa

SEQ ID NO: 1348786 - RNA, 21 nt, Mycobacterium tuberculosis H37Rv
cgaugucagugaucaccaacc

SEQ ID NO: 1348787 - RNA, 17 nt, Mycobacterium tuberculosis H37Rv
cgaugucacccucccgc

SEQ ID NO: 1348788 - RNA, 13 nt, Mycobacterium tuberculosis H37Rv
cgaugcgcgccgg

SEQ ID NO: 1348789 - RNA, 16 nt, Mycobacterium tuberculosis H37Rv
cgaugcgcgccggcuu

SEQ ID NO: 1348790 - RNA, 22 nt, Mycobacterium tuberculosis H37Rv
cgaugcgcugcucacgcagcag

SEQ ID NO: 1348791 - RNA, 16 nt, Mycobacterium tuberculosis H37Rv
cgaugccagugcaucg

SEQ ID NO: 1348792 - RNA, 18 nt, Mycobacterium tuberculosis H37Rv
cgaugcaucggugcagcc

SEQ ID NO: 1348793 - RNA, 21 nt, Mycobacterium tuberculosis H37Rv
cgaugccacaucccacggugg

SEQ ID NO: 1348794 - RNA, 13 nt, Mycobacterium tuberculosis H37Rv
cgaugcacaaccg

SEQ ID NO: 1348795 - RNA, 14 nt, Mycobacterium tuberculosis H37Rv
cgaugcacaaccgc

SEQ ID NO: 1348796 - RNA, 16 nt, Mycobacterium tuberculosis H37Rv
cgaugcagccacauac

SEQ ID NO: 1348797 - RNA, 22 nt, Mycobacterium tuberculosis H37Rv
cgaugcagccacauacaggccc

SEQ ID NO: 1348798 - RNA, 21 nt, Mycobacterium tuberculosis H37Rv
cgaugagggugcucgucacca

SEQ ID NO: 1348799 - RNA, 19 nt, Mycobacterium tuberculosis H37Rv
cgaugagguggccgcgcag

SEQ ID NO: 1348800 - RNA, 19 nt, Mycobacterium tuberculosis H37Rv
cgaugagccgacggcggcg

SEQ ID NO: 1348801 - RNA, 14 nt, Mycobacterium tuberculosis H37Rv
cgaugaucaggguc

SEQ ID NO: 1348802 - RNA, 19 nt, Mycobacterium tuberculosis H37Rv
cgaugaucgccuucuuguu

SEQ ID NO: 1348803 - RNA, 15 nt, Mycobacterium tuberculosis H37Rv
cgaugauggacacca

SEQ ID NO: 1348804 - RNA, 18 nt, Mycobacterium tuberculosis H37Rv
cgaugaugcggcgcagcg

SEQ ID NO: 1348805 - RNA, 17 nt, Mycobacterium tuberculosis H37Rv
cgaugaugccggacagc

SEQ ID NO: 1348806 - RNA, 14 nt, Mycobacterium tuberculosis H37Rv
cgaugauguugagc

SEQ ID NO: 1348807 - RNA, 21 nt, Mycobacterium tuberculosis H37Rv
cgaugauguuuuccccgcccu

SEQ ID NO: 1348808 - RNA, 13 nt, Mycobacterium tuberculosis H37Rv
cgauccacaggcu

SEQ ID NO: 1348809 - RNA, 20 nt, Mycobacterium tuberculosis H37Rv
cgauccacggcgaugcagcc

SEQ ID NO: 1348810 - RNA, 21 nt, Mycobacterium tuberculosis H37Rv
cgauccaccaagcucgcaacc

SEQ ID NO: 1348811 - RNA, 15 nt, Mycobacterium tuberculosis H37Rv
cgaucaugagcagca

SEQ ID NO: 1348812 - RNA, 15 nt, Mycobacterium tuberculosis H37Rv
cgaucaggggcccac

SEQ ID NO: 1348813 - RNA, 16 nt, Mycobacterium tuberculosis H37Rv
cgaucagguacgccag

SEQ ID NO: 1348814 - RNA, 12 nt, Mycobacterium tuberculosis H37Rv
cgaucaggcugc

SEQ ID NO: 1348815 - RNA, 14 nt, Mycobacterium tuberculosis H37Rv
cgaucaggcugccg

SEQ ID NO: 1348816 - RNA, 18 nt, Mycobacterium tuberculosis H37Rv
cgaucagucgucuugaug

SEQ ID NO: 1348817 - RNA, 16 nt, Mycobacterium tuberculosis H37Rv
cgaucaucaccggcau

SEQ ID NO: 1348818 - RNA, 17 nt, Mycobacterium tuberculosis H37Rv
cgaucaucaggugcgcc

SEQ ID NO: 1348819 - RNA, 15 nt, Mycobacterium tuberculosis H37Rv
cgaucccgaucgcgc

SEQ ID NO: 1348820 - RNA, 17 nt, Mycobacterium tuberculosis H37Rv
cgaucccggcaacaacg

SEQ ID NO: 1348821 - RNA, 18 nt, Mycobacterium tuberculosis H37Rv
cgauccggaucccaccac

SEQ ID NO: 1348822 - RNA, 21 nt, Mycobacterium tuberculosis H37Rv
cgauccggaucccaccaccgc

SEQ ID NO: 1348823 - RNA, 16 nt, Mycobacterium tuberculosis H37Rv
cgauccgcacagcaac

SEQ ID NO: 1348824 - RNA, 19 nt, Mycobacterium tuberculosis H37Rv
cgauccccacaaucagccc

SEQ ID NO: 1348825 - RNA, 19 nt, Mycobacterium tuberculosis H37Rv
cgauccccagcaccacggu

SEQ ID NO: 1348826 - RNA, 17 nt, Mycobacterium tuberculosis H37Rv
cgaucccgcggccgggc

SEQ ID NO: 1348827 - RNA, 13 nt, Mycobacterium tuberculosis H37Rv
cgauccagggccg

SEQ ID NO: 1348828 - RNA, 17 nt, Mycobacterium tuberculosis H37Rv
cgaucccaacgcccggg

SEQ ID NO: 1348829 - RNA, 18 nt, Mycobacterium tuberculosis H37Rv
cgaucccaacgcccgggc

SEQ ID NO: 1348830 - RNA, 23 nt, Mycobacterium tuberculosis H37Rv
cgauccagcccaacucggccagc

SEQ ID NO: 1348831 - RNA, 15 nt, Mycobacterium tuberculosis H37Rv
cgauccugaccagcc

SEQ ID NO: 1348832 - RNA, 15 nt, Mycobacterium tuberculosis H37Rv
cgauccggcuccacc

SEQ ID NO: 1348833 - RNA, 22 nt, Mycobacterium tuberculosis H37Rv
cgaucgacaccgugaccgccgc

SEQ ID NO: 1348834 - RNA, 16 nt, Mycobacterium tuberculosis H37Rv
cgaucgacugcagccc

SEQ ID NO: 1348835 - RNA, 13 nt, Mycobacterium tuberculosis H37Rv
cgaucgagcagga

SEQ ID NO: 1348836 - RNA, 20 nt, Mycobacterium tuberculosis H37Rv
cgaucgacacccgcucggcc

SEQ ID NO: 1348837 - RNA, 16 nt, Mycobacterium tuberculosis H37Rv
cgaucgacacccgcuc

SEQ ID NO: 1348838 - RNA, 16 nt, Mycobacterium tuberculosis H37Rv
cgaucgccaacgacuc

SEQ ID NO: 1348839 - RNA, 20 nt, Mycobacterium tuberculosis H37Rv
cgaucgccgcuaacgcaccu

SEQ ID NO: 1348840 - RNA, 23 nt, Mycobacterium tuberculosis H37Rv
cgaucgcgagcgagccaacucca

SEQ ID NO: 1348841 - RNA, 14 nt, Mycobacterium tuberculosis H37Rv
cgaucgccgcgcug

SEQ ID NO: 1348842 - RNA, 13 nt, Mycobacterium tuberculosis H37Rv
cgauaaaugccgc

SEQ ID NO: 1348843 - RNA, 15 nt, Mycobacterium tuberculosis H37Rv
cgauaaaaaccaccc

SEQ ID NO: 1348844 - RNA, 22 nt, Mycobacterium tuberculosis H37Rv
cgauaaccuggcggucccgcau

SEQ ID NO: 1348845 - RNA, 16 nt, Mycobacterium tuberculosis H37Rv
cgauaaccucagcgcg

SEQ ID NO: 1348846 - RNA, 15 nt, Mycobacterium tuberculosis H37Rv
cgauauaccagggca

SEQ ID NO: 1348847 - RNA, 13 nt, Mycobacterium tuberculosis H37Rv
cgcccgcgccacc

SEQ ID NO: 1348848 - RNA, 16 nt, Mycobacterium tuberculosis H37Rv
cgcccgcgccaccggc

SEQ ID NO: 1348849 - RNA, 16 nt, Mycobacterium tuberculosis H37Rv
cgcccgcgccgccgcu

SEQ ID NO: 1348850 - RNA, 19 nt, Mycobacterium tuberculosis H37Rv
cgcccgcgccgccgccacc

SEQ ID NO: 1348851 - RNA, 14 nt, Mycobacterium tuberculosis H37Rv
cgcccgccucgacc

SEQ ID NO: 1348852 - RNA, 17 nt, Mycobacterium tuberculosis H37Rv
cgcccgccucugucuuc

SEQ ID NO: 1348853 - RNA, 15 nt, Mycobacterium tuberculosis H37Rv
cgcccgcgugacgcu

SEQ ID NO: 1348854 - RNA, 22 nt, Mycobacterium tuberculosis H37Rv
cgcccgcgggcaguggcagccc

SEQ ID NO: 1348855 - RNA, 17 nt, Mycobacterium tuberculosis H37Rv
cgcccgcgguccggcga

SEQ ID NO: 1348856 - RNA, 13 nt, Mycobacterium tuberculosis H37Rv
cgcccgcgccucc

SEQ ID NO: 1348857 - RNA, 14 nt, Mycobacterium tuberculosis H37Rv
cgcccgcgcggcca

SEQ ID NO: 1348858 - RNA, 13 nt, Mycobacterium tuberculosis H37Rv
cgcccgcacacag

SEQ ID NO: 1348859 - RNA, 23 nt, Mycobacterium tuberculosis H37Rv
cgcccgcaccagcugucgggcag

SEQ ID NO: 1348860 - RNA, 22 nt, Mycobacterium tuberculosis H37Rv
cgcccgcaagucggacgggucu

SEQ ID NO: 1348861 - RNA, 20 nt, Mycobacterium tuberculosis H37Rv
cgcccgcaauuguucgcggc

SEQ ID NO: 1348862 - RNA, 16 nt, Mycobacterium tuberculosis H37Rv
cgcccgccaucagccc

SEQ ID NO: 1348863 - RNA, 12 nt, Mycobacterium tuberculosis H37Rv
cgcccgccaccg

SEQ ID NO: 1348864 - RNA, 11 nt, Mycobacterium tuberculosis H37Rv
cgcccgccccg

SEQ ID NO: 1348865 - RNA, 14 nt, Mycobacterium tuberculosis H37Rv
cgcccgccccgcgc

SEQ ID NO: 1348866 - RNA, 13 nt, Mycobacterium tuberculosis H37Rv
cgcccgccgccac

SEQ ID NO: 1348867 - RNA, 22 nt, Mycobacterium tuberculosis H37Rv
cgcccggcccugagcugccgag

SEQ ID NO: 1348868 - RNA, 12 nt, Mycobacterium tuberculosis H37Rv
cgcccggccgca

SEQ ID NO: 1348869 - RNA, 13 nt, Mycobacterium tuberculosis H37Rv
cgcccggcccggc

SEQ ID NO: 1348870 - RNA, 22 nt, Mycobacterium tuberculosis H37Rv
cgcccggaaccggcgugcagca

SEQ ID NO: 1348871 - RNA, 21 nt, Mycobacterium tuberculosis H37Rv
cgcccggaaccggcgugcagc

SEQ ID NO: 1348872 - RNA, 19 nt, Mycobacterium tuberculosis H37Rv
cgcccggaaccggcgugca

SEQ ID NO: 1348873 - RNA, 16 nt, Mycobacterium tuberculosis H37Rv
cgcccgcucggccgca

SEQ ID NO: 1348874 - RNA, 21 nt, Mycobacterium tuberculosis H37Rv
cgcccgcugagcacucaugau

SEQ ID NO: 1348875 - RNA, 21 nt, Mycobacterium tuberculosis H37Rv
cgcccgcucgcgagcggcuga

SEQ ID NO: 1348876 - RNA, 17 nt, Mycobacterium tuberculosis H37Rv
cgcccggcguggugagc

SEQ ID NO: 1348877 - RNA, 22 nt, Mycobacterium tuberculosis H37Rv
cgcccggcguggcuucacccaa

SEQ ID NO: 1348878 - RNA, 20 nt, Mycobacterium tuberculosis H37Rv
cgcccggcgcuagcgccgcg

SEQ ID NO: 1348879 - RNA, 22 nt, Mycobacterium tuberculosis H37Rv
cgcccggcgcaagcgccgcgcu

SEQ ID NO: 1348880 - RNA, 20 nt, Mycobacterium tuberculosis H37Rv
cgcccggcgcaagcgccgcg

SEQ ID NO: 1348881 - RNA, 20 nt, Mycobacterium tuberculosis H37Rv
cgcccggccaagccggcgag

SEQ ID NO: 1348882 - RNA, 13 nt, Mycobacterium tuberculosis H37Rv
cgcccgggcggcg

SEQ ID NO: 1348883 - RNA, 21 nt, Mycobacterium tuberculosis H37Rv
cgcccgggcgaauccggcggg

SEQ ID NO: 1348884 - RNA, 12 nt, Mycobacterium tuberculosis H37Rv
cgcccgggcggc

SEQ ID NO: 1348885 - RNA, 22 nt, Mycobacterium tuberculosis H37Rv
cgcccgggcggaacgccggcac

SEQ ID NO: 1348886 - RNA, 18 nt, Mycobacterium tuberculosis H37Rv
cgcccgggcaccggccgg

SEQ ID NO: 1348887 - RNA, 22 nt, Mycobacterium tuberculosis H37Rv
cgcccggcugcgccgggcucgc

SEQ ID NO: 1348888 - RNA, 12 nt, Mycobacterium tuberculosis H37Rv
cgcccggcugcg

SEQ ID NO: 1348889 - RNA, 12 nt, Mycobacterium tuberculosis H37Rv
cgccccacccga

SEQ ID NO: 1348890 - RNA, 13 nt, Mycobacterium tuberculosis H37Rv
cgccccaccggcc

SEQ ID NO: 1348891 - RNA, 16 nt, Mycobacterium tuberculosis H37Rv
cgccccaccgcgccga

SEQ ID NO: 1348892 - RNA, 18 nt, Mycobacterium tuberculosis H37Rv
cgccccagccaugcugcu

SEQ ID NO: 1348893 - RNA, 22 nt, Mycobacterium tuberculosis H37Rv
cgcccauuggguaaccagcgcc

SEQ ID NO: 1348894 - RNA, 21 nt, Mycobacterium tuberculosis H37Rv
cgccccacaacaugcuggaga

SEQ ID NO: 1348895 - RNA, 11 nt, Mycobacterium tuberculosis H37Rv
cgcccccgcca

SEQ ID NO: 1348896 - RNA, 16 nt, Mycobacterium tuberculosis H37Rv
cgcccccagugcacgc

SEQ ID NO: 1348897 - RNA, 20 nt, Mycobacterium tuberculosis H37Rv
cgcccccauaacugcggccc

SEQ ID NO: 1348898 - RNA, 23 nt, Mycobacterium tuberculosis H37Rv
cgccccagggggcgugccgccgc

SEQ ID NO: 1348899 - RNA, 22 nt, Mycobacterium tuberculosis H37Rv
cgccccgauaaaaaccaccccc

SEQ ID NO: 1348900 - RNA, 18 nt, Mycobacterium tuberculosis H37Rv
cgcccccucuagcgccuc

SEQ ID NO: 1348901 - RNA, 14 nt, Mycobacterium tuberculosis H37Rv
cgcccccgccggcc

SEQ ID NO: 1348902 - RNA, 22 nt, Mycobacterium tuberculosis H37Rv
cgcccccgccauugccgccggc

SEQ ID NO: 1348903 - RNA, 12 nt, Mycobacterium tuberculosis H37Rv
cgcccccgcccg

SEQ ID NO: 1348904 - RNA, 17 nt, Mycobacterium tuberculosis H37Rv
cgccccgcguuggacaa

SEQ ID NO: 1348905 - RNA, 15 nt, Mycobacterium tuberculosis H37Rv
cgccccgaucggcca

SEQ ID NO: 1348906 - RNA, 20 nt, Mycobacterium tuberculosis H37Rv
cgccccgcagcugcgucccg

SEQ ID NO: 1348907 - RNA, 20 nt, Mycobacterium tuberculosis H37Rv
cgccccggcggcggcggccc

SEQ ID NO: 1348908 - RNA, 12 nt, Mycobacterium tuberculosis H37Rv
cgccccgcccgc

SEQ ID NO: 1348909 - RNA, 15 nt, Mycobacterium tuberculosis H37Rv
cgccccgggccacca

SEQ ID NO: 1348910 - RNA, 13 nt, Mycobacterium tuberculosis H37Rv
cgccccggcggcg

SEQ ID NO: 1348911 - RNA, 18 nt, Mycobacterium tuberculosis H37Rv
cgccccggcgcggccagc

SEQ ID NO: 1348912 - RNA, 16 nt, Mycobacterium tuberculosis H37Rv
cgccccggcgcggcca

SEQ ID NO: 1348913 - RNA, 17 nt, Mycobacterium tuberculosis H37Rv
cgcccgaagccgggccc

SEQ ID NO: 1348914 - RNA, 18 nt, Mycobacterium tuberculosis H37Rv
cgcccgaagccgggcccc

SEQ ID NO: 1348915 - RNA, 18 nt, Mycobacterium tuberculosis H37Rv
cgcccgaaucgccggcgg

SEQ ID NO: 1348916 - RNA, 14 nt, Mycobacterium tuberculosis H37Rv
cgcccgacacccgu

SEQ ID NO: 1348917 - RNA, 18 nt, Mycobacterium tuberculosis H37Rv
cgcccgacgaacagcggu

SEQ ID NO: 1348918 - RNA, 14 nt, Mycobacterium tuberculosis H37Rv
cgccccuggcaccu

SEQ ID NO: 1348919 - RNA, 16 nt, Mycobacterium tuberculosis H37Rv
cgccccugcacagcag

SEQ ID NO: 1348920 - RNA, 22 nt, Mycobacterium tuberculosis H37Rv
cgcccgacgagauugccgggcc

SEQ ID NO: 1348921 - RNA, 21 nt, Mycobacterium tuberculosis H37Rv
cgcccgagccggugccacugc

SEQ ID NO: 1348922 - RNA, 20 nt, Mycobacterium tuberculosis H37Rv
cgcccgaguuguggacgccc

SEQ ID NO: 1348923 - RNA, 20 nt, Mycobacterium tuberculosis H37Rv
cgcccgaguugaagaagccg

SEQ ID NO: 1348924 - RNA, 13 nt, Mycobacterium tuberculosis H37Rv
cgcccgaucggcg

SEQ ID NO: 1348925 - RNA, 18 nt, Mycobacterium tuberculosis H37Rv
cgcccgaggcacccgugc

SEQ ID NO: 1348926 - RNA, 19 nt, Mycobacterium tuberculosis H37Rv
cgcccgaggcgagacgcuc

SEQ ID NO: 1348927 - RNA, 15 nt, Mycobacterium tuberculosis H37Rv
cgccaucgguugacc

SEQ ID NO: 1348928 - RNA, 22 nt, Mycobacterium tuberculosis H37Rv
cgccaucgguugacccggcagc

SEQ ID NO: 1348929 - RNA, 20 nt, Mycobacterium tuberculosis H37Rv
cgccaucgucgaagaccuca

SEQ ID NO: 1348930 - RNA, 16 nt, Mycobacterium tuberculosis H37Rv
cgccaucgccuccagc

SEQ ID NO: 1348931 - RNA, 19 nt, Mycobacterium tuberculosis H37Rv
cgccaucgccgccaaccac

SEQ ID NO: 1348932 - RNA, 14 nt, Mycobacterium tuberculosis H37Rv
cgccaucgagcagc

SEQ ID NO: 1348933 - RNA, 22 nt, Mycobacterium tuberculosis H37Rv
cgccaugauggacagcugcggg

SEQ ID NO: 1348934 - RNA, 21 nt, Mycobacterium tuberculosis H37Rv
cgccaucauggcggcccgguc

SEQ ID NO: 1348935 - RNA, 22 nt, Mycobacterium tuberculosis H37Rv
cgccauccaugauggccgucag

SEQ ID NO: 1348936 - RNA, 13 nt, Mycobacterium tuberculosis H37Rv
cgccauccgccga

SEQ ID NO: 1348937 - RNA, 12 nt, Mycobacterium tuberculosis H37Rv
cgccaucagccg

SEQ ID NO: 1348938 - RNA, 17 nt, Mycobacterium tuberculosis H37Rv
cgccaucagccgcugcg

SEQ ID NO: 1348939 - RNA, 13 nt, Mycobacterium tuberculosis H37Rv
cgccauugccgcc

SEQ ID NO: 1348940 - RNA, 18 nt, Mycobacterium tuberculosis H37Rv
cgccauuggcgccgccga

SEQ ID NO: 1348941 - RNA, 14 nt, Mycobacterium tuberculosis H37Rv
cgcccaacgcgggu

SEQ ID NO: 1348942 - RNA, 14 nt, Mycobacterium tuberculosis H37Rv
cgcccaagcgcagc

SEQ ID NO: 1348943 - RNA, 21 nt, Mycobacterium tuberculosis H37Rv
cgcccacagcugacgagccgg

SEQ ID NO: 1348944 - RNA, 22 nt, Mycobacterium tuberculosis H37Rv
cgcccaauguccaggcgcgcac

SEQ ID NO: 1348945 - RNA, 16 nt, Mycobacterium tuberculosis H37Rv
cgcccaagguggcggc

SEQ ID NO: 1348946 - RNA, 19 nt, Mycobacterium tuberculosis H37Rv
cgccaugcgccaacccggc

SEQ ID NO: 1348947 - RNA, 16 nt, Mycobacterium tuberculosis H37Rv
cgccaugccgggaacc

SEQ ID NO: 1348948 - RNA, 15 nt, Mycobacterium tuberculosis H37Rv
cgccaugauggacag

SEQ ID NO: 1348949 - RNA, 17 nt, Mycobacterium tuberculosis H37Rv
cgccauggucgcugcgu

SEQ ID NO: 1348950 - RNA, 17 nt, Mycobacterium tuberculosis H37Rv
cgccauugagcucccgc

SEQ ID NO: 1348951 - RNA, 21 nt, Mycobacterium tuberculosis H37Rv
cgccauugaggaagccguugg

SEQ ID NO: 1348952 - RNA, 15 nt, Mycobacterium tuberculosis H37Rv
cgccauugacgccgu

SEQ ID NO: 1348953 - RNA, 15 nt, Mycobacterium tuberculosis H37Rv
cgccauucaucggca

SEQ ID NO: 1348954 - RNA, 16 nt, Mycobacterium tuberculosis H37Rv
cgccauucaucggcau

SEQ ID NO: 1348955 - RNA, 14 nt, Mycobacterium tuberculosis H37Rv
cgccaugucggcca

SEQ ID NO: 1348956 - RNA, 18 nt, Mycobacterium tuberculosis H37Rv
cgcccauggccaccaggg

SEQ ID NO: 1348957 - RNA, 19 nt, Mycobacterium tuberculosis H37Rv
cgcccagugcgcaacccag

SEQ ID NO: 1348958 - RNA, 21 nt, Mycobacterium tuberculosis H37Rv
cgcccagugcgcaacccagcc

SEQ ID NO: 1348959 - RNA, 18 nt, Mycobacterium tuberculosis H37Rv
cgcccagugcggccaccu

SEQ ID NO: 1348960 - RNA, 20 nt, Mycobacterium tuberculosis H37Rv
cgcccauagcugccggccca

SEQ ID NO: 1348961 - RNA, 13 nt, Mycobacterium tuberculosis H37Rv
cgcccagcucgau

SEQ ID NO: 1348962 - RNA, 15 nt, Mycobacterium tuberculosis H37Rv
cgcccagcagcaccu

SEQ ID NO: 1348963 - RNA, 15 nt, Mycobacterium tuberculosis H37Rv
cgcccagaccgccga

SEQ ID NO: 1348964 - RNA, 22 nt, Mycobacterium tuberculosis H37Rv
cgcccagagugaauccggcaua

SEQ ID NO: 1348965 - RNA, 18 nt, Mycobacterium tuberculosis H37Rv
cgcccagcacccuguucc

SEQ ID NO: 1348966 - RNA, 16 nt, Mycobacterium tuberculosis H37Rv
cgcccagcgacccggc

SEQ ID NO: 1348967 - RNA, 18 nt, Mycobacterium tuberculosis H37Rv
cgcccagcgacccggcca

SEQ ID NO: 1348968 - RNA, 20 nt, Mycobacterium tuberculosis H37Rv
cgcccagcgacccggccagc

SEQ ID NO: 1348969 - RNA, 18 nt, Mycobacterium tuberculosis H37Rv
cgcccacggcaccaccaa

SEQ ID NO: 1348970 - RNA, 19 nt, Mycobacterium tuberculosis H37Rv
cgcccacggcaccaccaag

SEQ ID NO: 1348971 - RNA, 20 nt, Mycobacterium tuberculosis H37Rv
cgcccaccucgaucgcgccg

SEQ ID NO: 1348972 - RNA, 23 nt, Mycobacterium tuberculosis H37Rv
cgcccaccguugcgaagaagaag

SEQ ID NO: 1348973 - RNA, 14 nt, Mycobacterium tuberculosis H37Rv
cgcccaccgggcgg

SEQ ID NO: 1348974 - RNA, 23 nt, Mycobacterium tuberculosis H37Rv
cgcccaccacacagccgcgcugc

SEQ ID NO: 1348975 - RNA, 14 nt, Mycobacterium tuberculosis H37Rv
cgcccaccacacag

SEQ ID NO: 1348976 - RNA, 13 nt, Mycobacterium tuberculosis H37Rv
cgcccaccaugau

SEQ ID NO: 1348977 - RNA, 18 nt, Mycobacterium tuberculosis H37Rv
cgccacuagcccugagcg

SEQ ID NO: 1348978 - RNA, 14 nt, Mycobacterium tuberculosis H37Rv
cgccagcaccagcg

SEQ ID NO: 1348979 - RNA, 21 nt, Mycobacterium tuberculosis H37Rv
cgccagcagaucuccggggcu

SEQ ID NO: 1348980 - RNA, 24 nt, Mycobacterium tuberculosis H37Rv
cgccacgguucgggcagcacccgc

SEQ ID NO: 1348981 - RNA, 15 nt, Mycobacterium tuberculosis H37Rv
cgccacgguuggucc

SEQ ID NO: 1348982 - RNA, 20 nt, Mycobacterium tuberculosis H37Rv
cgccacggucgccgaccacu

SEQ ID NO: 1348983 - RNA, 20 nt, Mycobacterium tuberculosis H37Rv
cgccacguacuccaccgcgc

SEQ ID NO: 1348984 - RNA, 20 nt, Mycobacterium tuberculosis H37Rv
cgccacguacuuggacgacc

SEQ ID NO: 1348985 - RNA, 23 nt, Mycobacterium tuberculosis H37Rv
cgccacgggcggccaccgcacgc

SEQ ID NO: 1348986 - RNA, 18 nt, Mycobacterium tuberculosis H37Rv
cgccacgggcggccaccg

SEQ ID NO: 1348987 - RNA, 19 nt, Mycobacterium tuberculosis H37Rv
cgccacggcggcuuccggc

SEQ ID NO: 1348988 - RNA, 13 nt, Mycobacterium tuberculosis H37Rv
cgccacgggcggc

SEQ ID NO: 1348989 - RNA, 17 nt, Mycobacterium tuberculosis H37Rv
cgccacgaccgcggcgg

SEQ ID NO: 1348990 - RNA, 20 nt, Mycobacterium tuberculosis H37Rv
cgccacgacgcccaccguug

SEQ ID NO: 1348991 - RNA, 21 nt, Mycobacterium tuberculosis H37Rv
cgccaccuuggcugggcccgc

SEQ ID NO: 1348992 - RNA, 19 nt, Mycobacterium tuberculosis H37Rv
cgccacgagcaacgggcga

SEQ ID NO: 1348993 - RNA, 22 nt, Mycobacterium tuberculosis H37Rv
cgccagcauugaagaagcccga

SEQ ID NO: 1348994 - RNA, 18 nt, Mycobacterium tuberculosis H37Rv
cgccagcagggccagacc

SEQ ID NO: 1348995 - RNA, 13 nt, Mycobacterium tuberculosis H37Rv
cgccagcagugcg

SEQ ID NO: 1348996 - RNA, 13 nt, Mycobacterium tuberculosis H37Rv
cgccagcccagca

SEQ ID NO: 1348997 - RNA, 14 nt, Mycobacterium tuberculosis H37Rv
cgccagccaggcga

SEQ ID NO: 1348998 - RNA, 13 nt, Mycobacterium tuberculosis H37Rv
cgccagccccagc

SEQ ID NO: 1348999 - RNA, 13 nt, Mycobacterium tuberculosis H37Rv
cgccagccaccac

SEQ ID NO: 1349000 - RNA, 13 nt, Mycobacterium tuberculosis H37Rv
cgccagccuccac

SEQ ID NO: 1349001 - RNA, 17 nt, Mycobacterium tuberculosis H37Rv
cgccagccuccaccagg

SEQ ID NO: 1349002 - RNA, 17 nt, Mycobacterium tuberculosis H37Rv
cgccagccugugcugcc

SEQ ID NO: 1349003 - RNA, 20 nt, Mycobacterium tuberculosis H37Rv
cgccagccugugcugccaac

SEQ ID NO: 1349004 - RNA, 14 nt, Mycobacterium tuberculosis H37Rv
cgccagccggccgc

SEQ ID NO: 1349005 - RNA, 19 nt, Mycobacterium tuberculosis H37Rv
cgccagccgguccagcagc

SEQ ID NO: 1349006 - RNA, 16 nt, Mycobacterium tuberculosis H37Rv
cgccagccccgcgccc

SEQ ID NO: 1349007 - RNA, 14 nt, Mycobacterium tuberculosis H37Rv
cgccagccccgccg

SEQ ID NO: 1349008 - RNA, 16 nt, Mycobacterium tuberculosis H37Rv
cgccagccccgccggg

SEQ ID NO: 1349009 - RNA, 16 nt, Mycobacterium tuberculosis H37Rv
cgccagccccacccgc

SEQ ID NO: 1349010 - RNA, 17 nt, Mycobacterium tuberculosis H37Rv
cgccagccccgcgccca

SEQ ID NO: 1349011 - RNA, 16 nt, Mycobacterium tuberculosis H37Rv
cgccacagccccaggg

SEQ ID NO: 1349012 - RNA, 14 nt, Mycobacterium tuberculosis H37Rv
cgccacaccgccgc

SEQ ID NO: 1349013 - RNA, 13 nt, Mycobacterium tuberculosis H37Rv
cgccacacccgug

SEQ ID NO: 1349014 - RNA, 22 nt, Mycobacterium tuberculosis H37Rv
cgccacacccaaaccggcccgc

SEQ ID NO: 1349015 - RNA, 17 nt, Mycobacterium tuberculosis H37Rv
cgccacagcacccacgc

SEQ ID NO: 1349016 - RNA, 22 nt, Mycobacterium tuberculosis H37Rv
cgccacaccggggcggccgacc

SEQ ID NO: 1349017 - RNA, 19 nt, Mycobacterium tuberculosis H37Rv
cgcauaacgcgaacccgcg

SEQ ID NO: 1349018 - RNA, 20 nt, Mycobacterium tuberculosis H37Rv
cgcauaauauuuucccgccu

SEQ ID NO: 1349019 - RNA, 12 nt, Mycobacterium tuberculosis H37Rv
cgccacaaagaa

SEQ ID NO: 1349020 - RNA, 16 nt, Mycobacterium tuberculosis H37Rv
cgccacaacggcggcg

SEQ ID NO: 1349021 - RNA, 15 nt, Mycobacterium tuberculosis H37Rv
cgccaaugcccaggu

SEQ ID NO: 1349022 - RNA, 18 nt, Mycobacterium tuberculosis H37Rv
cgccaccaucaccgccuu

SEQ ID NO: 1349023 - RNA, 23 nt, Mycobacterium tuberculosis H37Rv
cgccaccauccccggcaacaaag

SEQ ID NO: 1349024 - RNA, 19 nt, Mycobacterium tuberculosis H37Rv
cgccacccccaaccgccgg

SEQ ID NO: 1349025 - RNA, 17 nt, Mycobacterium tuberculosis H37Rv
cgccacccagcaccagg

SEQ ID NO: 1349026 - RNA, 13 nt, Mycobacterium tuberculosis H37Rv
cgccaccacccgg

SEQ ID NO: 1349027 - RNA, 18 nt, Mycobacterium tuberculosis H37Rv
cgccaccacccaggccau

SEQ ID NO: 1349028 - RNA, 14 nt, Mycobacterium tuberculosis H37Rv
cgccaccaccaggg

SEQ ID NO: 1349029 - RNA, 16 nt, Mycobacterium tuberculosis H37Rv
cgccaccaccagggca

SEQ ID NO: 1349030 - RNA, 13 nt, Mycobacterium tuberculosis H37Rv
cgccaccaccucc

SEQ ID NO: 1349031 - RNA, 14 nt, Mycobacterium tuberculosis H37Rv
cgccaccaccggcg

SEQ ID NO: 1349032 - RNA, 19 nt, Mycobacterium tuberculosis H37Rv
cgccaccagcaccgccgcu

SEQ ID NO: 1349033 - RNA, 13 nt, Mycobacterium tuberculosis H37Rv
cgccaccacgccg

SEQ ID NO: 1349034 - RNA, 24 nt, Mycobacterium tuberculosis H37Rv
cgccaccggcgccaccggcgccgc

SEQ ID NO: 1349035 - RNA, 19 nt, Mycobacterium tuberculosis H37Rv
cgccaccggcgccgcccgc

SEQ ID NO: 1349036 - RNA, 22 nt, Mycobacterium tuberculosis H37Rv
cgccaccggcgccgcccgcgcc

SEQ ID NO: 1349037 - RNA, 19 nt, Mycobacterium tuberculosis H37Rv
cgccaccggcgccaccggc

SEQ ID NO: 1349038 - RNA, 20 nt, Mycobacterium tuberculosis H37Rv
cgccaccgcgucacuucccg

SEQ ID NO: 1349039 - RNA, 12 nt, Mycobacterium tuberculosis H37Rv
cgccaccggcgu

SEQ ID NO: 1349040 - RNA, 19 nt, Mycobacterium tuberculosis H37Rv
cgccaccggcaccgccugc

SEQ ID NO: 1349041 - RNA, 23 nt, Mycobacterium tuberculosis H37Rv
cgccaccggcaccgccugcgccg

SEQ ID NO: 1349042 - RNA, 14 nt, Mycobacterium tuberculosis H37Rv
cgccaccggcgcca

SEQ ID NO: 1349043 - RNA, 14 nt, Mycobacterium tuberculosis H37Rv
cgccaccgcggccu

SEQ ID NO: 1349044 - RNA, 22 nt, Mycobacterium tuberculosis H37Rv
cgccaccucgccggccgucagc

SEQ ID NO: 1349045 - RNA, 19 nt, Mycobacterium tuberculosis H37Rv
cgccaccgucgcugcccgc

SEQ ID NO: 1349046 - RNA, 20 nt, Mycobacterium tuberculosis H37Rv
cgccaccggguucaccgagg

SEQ ID NO: 1349047 - RNA, 19 nt, Mycobacterium tuberculosis H37Rv
cgccaccucgacgcacacc

SEQ ID NO: 1349048 - RNA, 14 nt, Mycobacterium tuberculosis H37Rv
cgccaccucgccgg

SEQ ID NO: 1349049 - RNA, 18 nt, Mycobacterium tuberculosis H37Rv
cgccaccgugguggacga

SEQ ID NO: 1349050 - RNA, 19 nt, Mycobacterium tuberculosis H37Rv
cgccaccguuugcgcaccg

SEQ ID NO: 1349051 - RNA, 18 nt, Mycobacterium tuberculosis H37Rv
cgccaccucccagggcuc

SEQ ID NO: 1349052 - RNA, 12 nt, Mycobacterium tuberculosis H37Rv
cgccagggcggc

SEQ ID NO: 1349053 - RNA, 18 nt, Mycobacterium tuberculosis H37Rv
cgccagggccgccgaagc

SEQ ID NO: 1349054 - RNA, 23 nt, Mycobacterium tuberculosis H37Rv
cgccagggaucuagaggcggccc

SEQ ID NO: 1349055 - RNA, 16 nt, Mycobacterium tuberculosis H37Rv
cgccagggcacguggc

SEQ ID NO: 1349056 - RNA, 21 nt, Mycobacterium tuberculosis H37Rv
cgccagggcccuagccggcgc

SEQ ID NO: 1349057 - RNA, 23 nt, Mycobacterium tuberculosis H37Rv
cgccagggagcgcagcgccggca

SEQ ID NO: 1349058 - RNA, 14 nt, Mycobacterium tuberculosis H37Rv
cgccagggccaucu

SEQ ID NO: 1349059 - RNA, 15 nt, Mycobacterium tuberculosis H37Rv
cgccagggucgcgag

SEQ ID NO: 1349060 - RNA, 12 nt, Mycobacterium tuberculosis H37Rv
cgccaggucauc

SEQ ID NO: 1349061 - RNA, 19 nt, Mycobacterium tuberculosis H37Rv
cgccaggugcagcaccagc

SEQ ID NO: 1349062 - RNA, 21 nt, Mycobacterium tuberculosis H37Rv
cgccagguacucggugcacag

SEQ ID NO: 1349063 - RNA, 15 nt, Mycobacterium tuberculosis H37Rv
cgccaggucggcgga

SEQ ID NO: 1349064 - RNA, 15 nt, Mycobacterium tuberculosis H37Rv
cgccaggucggcggg

SEQ ID NO: 1349065 - RNA, 21 nt, Mycobacterium tuberculosis H37Rv
cgccaguauggccgccaccgc

SEQ ID NO: 1349066 - RNA, 16 nt, Mycobacterium tuberculosis H37Rv
cgccaguauggccgcc

SEQ ID NO: 1349067 - RNA, 15 nt, Mycobacterium tuberculosis H37Rv
cgccaguaggcuucg

SEQ ID NO: 1349068 - RNA, 21 nt, Mycobacterium tuberculosis H37Rv
cgccaguaccacuguuacggc

SEQ ID NO: 1349069 - RNA, 15 nt, Mycobacterium tuberculosis H37Rv
cgccagguggccgcu

SEQ ID NO: 1349070 - RNA, 16 nt, Mycobacterium tuberculosis H37Rv
cgccagucccggcgca

SEQ ID NO: 1349071 - RNA, 22 nt, Mycobacterium tuberculosis H37Rv
cgccagucccggcgcacaaaca

SEQ ID NO: 1349072 - RNA, 19 nt, Mycobacterium tuberculosis H37Rv
cgccaucacaucggccucu

SEQ ID NO: 1349073 - RNA, 16 nt, Mycobacterium tuberculosis H37Rv
cgccauagcgggcggu

SEQ ID NO: 1349074 - RNA, 13 nt, Mycobacterium tuberculosis H37Rv
cgccauaccggcu

SEQ ID NO: 1349075 - RNA, 20 nt, Mycobacterium tuberculosis H37Rv
cgccagucgcaggaucggcg

SEQ ID NO: 1349076 - RNA, 12 nt, Mycobacterium tuberculosis H37Rv
cgccaguggcca

SEQ ID NO: 1349077 - RNA, 15 nt, Mycobacterium tuberculosis H37Rv
cgccaguggccacca

SEQ ID NO: 1349078 - RNA, 17 nt, Mycobacterium tuberculosis H37Rv
cgccaguggccaccauc

SEQ ID NO: 1349079 - RNA, 16 nt, Mycobacterium tuberculosis H37Rv
cgccagugcggucucg

SEQ ID NO: 1349080 - RNA, 20 nt, Mycobacterium tuberculosis H37Rv
cgccaguguugcgcugcggc

SEQ ID NO: 1349081 - RNA, 15 nt, Mycobacterium tuberculosis H37Rv
cgccaguucgcgcca

SEQ ID NO: 1349082 - RNA, 15 nt, Mycobacterium tuberculosis H37Rv
cgccaguucggcggg

SEQ ID NO: 1349083 - RNA, 19 nt, Mycobacterium tuberculosis H37Rv
cgccaguucggcgggagcu

SEQ ID NO: 1349084 - RNA, 21 nt, Mycobacterium tuberculosis H37Rv
cgccaguucggcgggagcugc

SEQ ID NO: 1349085 - RNA, 21 nt, Mycobacterium tuberculosis H37Rv
cgccagcgagcauaccgccgc

SEQ ID NO: 1349086 - RNA, 20 nt, Mycobacterium tuberculosis H37Rv
cgccagcgauaucggcggcu

SEQ ID NO: 1349087 - RNA, 17 nt, Mycobacterium tuberculosis H37Rv
cgccagcgccgccgcga

SEQ ID NO: 1349088 - RNA, 18 nt, Mycobacterium tuberculosis H37Rv
cgccagcgccgccggcac

SEQ ID NO: 1349089 - RNA, 22 nt, Mycobacterium tuberculosis H37Rv
cgccagcgccgccggcaccucc

SEQ ID NO: 1349090 - RNA, 18 nt, Mycobacterium tuberculosis H37Rv
cgccagcgccgccggcgc

SEQ ID NO: 1349091 - RNA, 16 nt, Mycobacterium tuberculosis H37Rv
cgccagcgccgcugaa

SEQ ID NO: 1349092 - RNA, 19 nt, Mycobacterium tuberculosis H37Rv
cgccagcgccgcugaagcc

SEQ ID NO: 1349093 - RNA, 13 nt, Mycobacterium tuberculosis H37Rv
cgccagcgccgga

SEQ ID NO: 1349094 - RNA, 22 nt, Mycobacterium tuberculosis H37Rv
cgccagcgagcauaccgccgcu

SEQ ID NO: 1349095 - RNA, 16 nt, Mycobacterium tuberculosis H37Rv
cgccagcgccgccacc

SEQ ID NO: 1349096 - RNA, 15 nt, Mycobacterium tuberculosis H37Rv
cgccagcgccgccga

SEQ ID NO: 1349097 - RNA, 13 nt, Mycobacterium tuberculosis H37Rv
cgccagcgccggc

SEQ ID NO: 1349098 - RNA, 14 nt, Mycobacterium tuberculosis H37Rv
cgccagcgccggcc

SEQ ID NO: 1349099 - RNA, 13 nt, Mycobacterium tuberculosis H37Rv
cgccagcgcgccg

SEQ ID NO: 1349100 - RNA, 18 nt, Mycobacterium tuberculosis H37Rv
cgccagcggcagcggcgu

SEQ ID NO: 1349101 - RNA, 16 nt, Mycobacterium tuberculosis H37Rv
cgccagcggcgcgacc

SEQ ID NO: 1349102 - RNA, 12 nt, Mycobacterium tuberculosis H37Rv
cgccagcggcgc

SEQ ID NO: 1349103 - RNA, 23 nt, Mycobacterium tuberculosis H37Rv
cgccagcggccgcuccaccucgg

SEQ ID NO: 1349104 - RNA, 13 nt, Mycobacterium tuberculosis H37Rv
cgccagcggcccu

SEQ ID NO: 1349105 - RNA, 14 nt, Mycobacterium tuberculosis H37Rv
cgccagcggcagcg

SEQ ID NO: 1349106 - RNA, 17 nt, Mycobacterium tuberculosis H37Rv
cgccagcggguccccgg

SEQ ID NO: 1349107 - RNA, 19 nt, Mycobacterium tuberculosis H37Rv
cgccagcgguggaccaccg

SEQ ID NO: 1349108 - RNA, 11 nt, Mycobacterium tuberculosis H37Rv
cgccaggaacc

SEQ ID NO: 1349109 - RNA, 14 nt, Mycobacterium tuberculosis H37Rv
cgccagcugcgcag

SEQ ID NO: 1349110 - RNA, 20 nt, Mycobacterium tuberculosis H37Rv
cgccagcugacacccgcagc

SEQ ID NO: 1349111 - RNA, 18 nt, Mycobacterium tuberculosis H37Rv
cgccagcucgccggccgg

SEQ ID NO: 1349112 - RNA, 18 nt, Mycobacterium tuberculosis H37Rv
cgccagcucacggacgcu

SEQ ID NO: 1349113 - RNA, 15 nt, Mycobacterium tuberculosis H37Rv
cgccaggccgcgcga

SEQ ID NO: 1349114 - RNA, 20 nt, Mycobacterium tuberculosis H37Rv
cgccaggccguugccccguc

SEQ ID NO: 1349115 - RNA, 16 nt, Mycobacterium tuberculosis H37Rv
cgccaggcgcuuggcc

SEQ ID NO: 1349116 - RNA, 19 nt, Mycobacterium tuberculosis H37Rv
cgccaggcuugcggcaccc

SEQ ID NO: 1349117 - RNA, 13 nt, Mycobacterium tuberculosis H37Rv
cgccaggcaagcc

SEQ ID NO: 1349118 - RNA, 13 nt, Mycobacterium tuberculosis H37Rv
cgccaggccacgu

SEQ ID NO: 1349119 - RNA, 21 nt, Mycobacterium tuberculosis H37Rv
cgccaggccgaccgcgcacau

SEQ ID NO: 1349120 - RNA, 16 nt, Mycobacterium tuberculosis H37Rv
cgccgaguucugcugg

SEQ ID NO: 1349121 - RNA, 18 nt, Mycobacterium tuberculosis H37Rv
cgccgauacaacgcggcu

SEQ ID NO: 1349122 - RNA, 21 nt, Mycobacterium tuberculosis H37Rv
cgccgauacuucaucggcaca

SEQ ID NO: 1349123 - RNA, 17 nt, Mycobacterium tuberculosis H37Rv
cgccgauaccggcggcg

SEQ ID NO: 1349124 - RNA, 21 nt, Mycobacterium tuberculosis H37Rv
cgccgauaccgugcaccucca

SEQ ID NO: 1349125 - RNA, 14 nt, Mycobacterium tuberculosis H37Rv
cgccgauaccggcg

SEQ ID NO: 1349126 - RNA, 18 nt, Mycobacterium tuberculosis H37Rv
cgccgauaccgccggccc

SEQ ID NO: 1349127 - RNA, 15 nt, Mycobacterium tuberculosis H37Rv
cgccgauacccagcg

SEQ ID NO: 1349128 - RNA, 17 nt, Mycobacterium tuberculosis H37Rv
cgccgauacccagcggg

SEQ ID NO: 1349129 - RNA, 22 nt, Mycobacterium tuberculosis H37Rv
cgccgagcugguugacggcgaa

SEQ ID NO: 1349130 - RNA, 15 nt, Mycobacterium tuberculosis H37Rv
cgccgaucaccgcug

SEQ ID NO: 1349131 - RNA, 18 nt, Mycobacterium tuberculosis H37Rv
cgccgaucgcggcggccu

SEQ ID NO: 1349132 - RNA, 20 nt, Mycobacterium tuberculosis H37Rv
cgccgauguuggcagggcca

SEQ ID NO: 1349133 - RNA, 18 nt, Mycobacterium tuberculosis H37Rv
cgccgauguggccggcga

SEQ ID NO: 1349134 - RNA, 16 nt, Mycobacterium tuberculosis H37Rv
cgccgaucccggcggu

SEQ ID NO: 1349135 - RNA, 18 nt, Mycobacterium tuberculosis H37Rv
cgccgaugccgccggcac

SEQ ID NO: 1349136 - RNA, 15 nt, Mycobacterium tuberculosis H37Rv
cgccgaugccggcca

SEQ ID NO: 1349137 - RNA, 18 nt, Mycobacterium tuberculosis H37Rv
cgccgaugaugcggcgca

SEQ ID NO: 1349138 - RNA, 18 nt, Mycobacterium tuberculosis H37Rv
cgccgcagggccgcgcgc

SEQ ID NO: 1349139 - RNA, 14 nt, Mycobacterium tuberculosis H37Rv
cgccgcagggccgc

SEQ ID NO: 1349140 - RNA, 18 nt, Mycobacterium tuberculosis H37Rv
cgccgcagguucaacgcg

SEQ ID NO: 1349141 - RNA, 21 nt, Mycobacterium tuberculosis H37Rv
cgccgccaccgaagccgccgg

SEQ ID NO: 1349142 - RNA, 15 nt, Mycobacterium tuberculosis H37Rv
cgccgccaccggcgc

SEQ ID NO: 1349143 - RNA, 17 nt, Mycobacterium tuberculosis H37Rv
cgccgccaccggcgccg

SEQ ID NO: 1349144 - RNA, 19 nt, Mycobacterium tuberculosis H37Rv
cgccgccaccagcgcacgc

SEQ ID NO: 1349145 - RNA, 13 nt, Mycobacterium tuberculosis H37Rv
cgccgccacccgg

SEQ ID NO: 1349146 - RNA, 20 nt, Mycobacterium tuberculosis H37Rv
cgccgccaagcucggccacc

SEQ ID NO: 1349147 - RNA, 15 nt, Mycobacterium tuberculosis H37Rv
cgccgccaccagcgc

SEQ ID NO: 1349148 - RNA, 16 nt, Mycobacterium tuberculosis H37Rv
cgccgccacagcaccc

SEQ ID NO: 1349149 - RNA, 15 nt, Mycobacterium tuberculosis H37Rv
cgccgauuccaccgc

SEQ ID NO: 1349150 - RNA, 16 nt, Mycobacterium tuberculosis H37Rv
cgccgcaaucagacgg

SEQ ID NO: 1349151 - RNA, 13 nt, Mycobacterium tuberculosis H37Rv
cgccgcacccggg

SEQ ID NO: 1349152 - RNA, 17 nt, Mycobacterium tuberculosis H37Rv
cgccgcagacgccgacu

SEQ ID NO: 1349153 - RNA, 21 nt, Mycobacterium tuberculosis H37Rv
cgccgcagaugggccuccacc

SEQ ID NO: 1349154 - RNA, 15 nt, Mycobacterium tuberculosis H37Rv
cgccgcacgccgacc

SEQ ID NO: 1349155 - RNA, 23 nt, Mycobacterium tuberculosis H37Rv
cgccgcacgcuagccgacagcuc

SEQ ID NO: 1349156 - RNA, 18 nt, Mycobacterium tuberculosis H37Rv
cgccgcacggcgacgcca

SEQ ID NO: 1349157 - RNA, 20 nt, Mycobacterium tuberculosis H37Rv
cgccgcagcuccccgaccga

SEQ ID NO: 1349158 - RNA, 13 nt, Mycobacterium tuberculosis H37Rv
cgccgcagcgucc

SEQ ID NO: 1349159 - RNA, 21 nt, Mycobacterium tuberculosis H37Rv
cgccgcagcaggugcaucgcc

SEQ ID NO: 1349160 - RNA, 15 nt, Mycobacterium tuberculosis H37Rv
cgccgccgccgccgg

SEQ ID NO: 1349161 - RNA, 18 nt, Mycobacterium tuberculosis H37Rv
cgccgccgccgccggcgc

SEQ ID NO: 1349162 - RNA, 22 nt, Mycobacterium tuberculosis H37Rv
cgccgccgcgagcgccggccgc

SEQ ID NO: 1349163 - RNA, 12 nt, Mycobacterium tuberculosis H37Rv
cgccgccgccga

SEQ ID NO: 1349164 - RNA, 22 nt, Mycobacterium tuberculosis H37Rv
cgccgccggaagcgccggccga

SEQ ID NO: 1349165 - RNA, 18 nt, Mycobacterium tuberculosis H37Rv
cgccgccggcaccgccgg

SEQ ID NO: 1349166 - RNA, 23 nt, Mycobacterium tuberculosis H37Rv
cgccgccgcgacgcacugccccg

SEQ ID NO: 1349167 - RNA, 16 nt, Mycobacterium tuberculosis H37Rv
cgccgccggcaccucc

SEQ ID NO: 1349168 - RNA, 19 nt, Mycobacterium tuberculosis H37Rv
cgccgccggcaccgccggc

SEQ ID NO: 1349169 - RNA, 21 nt, Mycobacterium tuberculosis H37Rv
cgccgccggcaccgccggcac

SEQ ID NO: 1349170 - RNA, 13 nt, Mycobacterium tuberculosis H37Rv
cgccgccggcccc

SEQ ID NO: 1349171 - RNA, 15 nt, Mycobacterium tuberculosis H37Rv
cgccgccggccccgc

SEQ ID NO: 1349172 - RNA, 17 nt, Mycobacterium tuberculosis H37Rv
cgccgccgcugccgccc

SEQ ID NO: 1349173 - RNA, 18 nt, Mycobacterium tuberculosis H37Rv
cgccgccgcuaccgccgg

SEQ ID NO: 1349174 - RNA, 13 nt, Mycobacterium tuberculosis H37Rv
cgccgccgcgggc

SEQ ID NO: 1349175 - RNA, 19 nt, Mycobacterium tuberculosis H37Rv
cgccgccggugccgcccga

SEQ ID NO: 1349176 - RNA, 20 nt, Mycobacterium tuberculosis H37Rv
cgccgccggugccaccgacg

SEQ ID NO: 1349177 - RNA, 18 nt, Mycobacterium tuberculosis H37Rv
cgccgccguccagcgccg

SEQ ID NO: 1349178 - RNA, 22 nt, Mycobacterium tuberculosis H37Rv
cgccgccguccagcgccgcggc

SEQ ID NO: 1349179 - RNA, 16 nt, Mycobacterium tuberculosis H37Rv
cgccgccgguccccuc

SEQ ID NO: 1349180 - RNA, 14 nt, Mycobacterium tuberculosis H37Rv
cgccgccggucccc

SEQ ID NO: 1349181 - RNA, 14 nt, Mycobacterium tuberculosis H37Rv
cgccgccggcgccc

SEQ ID NO: 1349182 - RNA, 19 nt, Mycobacterium tuberculosis H37Rv
cgccgccggcgccgcccgc

SEQ ID NO: 1349183 - RNA, 17 nt, Mycobacterium tuberculosis H37Rv
cgccgccggccgccagc

SEQ ID NO: 1349184 - RNA, 20 nt, Mycobacterium tuberculosis H37Rv
cgccgccggaagcgccggcc

SEQ ID NO: 1349185 - RNA, 13 nt, Mycobacterium tuberculosis H37Rv
cgccgccggccgc

SEQ ID NO: 1349186 - RNA, 14 nt, Mycobacterium tuberculosis H37Rv
cgccgccggccgcc

SEQ ID NO: 1349187 - RNA, 13 nt, Mycobacterium tuberculosis H37Rv
cgccgccggcgcg

SEQ ID NO: 1349188 - RNA, 17 nt, Mycobacterium tuberculosis H37Rv
cgccgccagcaccaccg

SEQ ID NO: 1349189 - RNA, 19 nt, Mycobacterium tuberculosis H37Rv
cgccgccagcaccucggcc

SEQ ID NO: 1349190 - RNA, 13 nt, Mycobacterium tuberculosis H37Rv
cgccgccagcaga

SEQ ID NO: 1349191 - RNA, 18 nt, Mycobacterium tuberculosis H37Rv
cgccgccagcgccgccgg

SEQ ID NO: 1349192 - RNA, 19 nt, Mycobacterium tuberculosis H37Rv
cgccgccagcgccgccggc

SEQ ID NO: 1349193 - RNA, 17 nt, Mycobacterium tuberculosis H37Rv
cgccgccagguccgccg

SEQ ID NO: 1349194 - RNA, 13 nt, Mycobacterium tuberculosis H37Rv
cgccgccauugcc

SEQ ID NO: 1349195 - RNA, 21 nt, Mycobacterium tuberculosis H37Rv
cgccgccauuaggcgcggugc

SEQ ID NO: 1349196 - RNA, 15 nt, Mycobacterium tuberculosis H37Rv
cgccgccaucacgca

SEQ ID NO: 1349197 - RNA, 13 nt, Mycobacterium tuberculosis H37Rv
cgccgccaucagc

SEQ ID NO: 1349198 - RNA, 15 nt, Mycobacterium tuberculosis H37Rv
cgccgccaucagccc

SEQ ID NO: 1349199 - RNA, 24 nt, Mycobacterium tuberculosis H37Rv
cgccgccccauacuugcgccgacu

SEQ ID NO: 1349200 - RNA, 15 nt, Mycobacterium tuberculosis H37Rv
cgccgccccggcgcu

SEQ ID NO: 1349201 - RNA, 21 nt, Mycobacterium tuberculosis H37Rv
cgccgcccgcagggccgccgc

SEQ ID NO: 1349202 - RNA, 18 nt, Mycobacterium tuberculosis H37Rv
cgccgccgacgccgccgg

SEQ ID NO: 1349203 - RNA, 19 nt, Mycobacterium tuberculosis H37Rv
cgccgccgaaaaccucgcc

SEQ ID NO: 1349204 - RNA, 19 nt, Mycobacterium tuberculosis H37Rv
cgccgcccuugccgccggc

SEQ ID NO: 1349205 - RNA, 22 nt, Mycobacterium tuberculosis H37Rv
cgccgcccuugccgccggcccc

SEQ ID NO: 1349206 - RNA, 18 nt, Mycobacterium tuberculosis H37Rv
cgccgcccgcuccuccgg

SEQ ID NO: 1349207 - RNA, 23 nt, Mycobacterium tuberculosis H37Rv
cgccgaccugguaugccgcccgc

SEQ ID NO: 1349208 - RNA, 24 nt, Mycobacterium tuberculosis H37Rv
cgccgacgaacaguugcggcuggc

SEQ ID NO: 1349209 - RNA, 17 nt, Mycobacterium tuberculosis H37Rv
cgccgacgaccgccugc

SEQ ID NO: 1349210 - RNA, 22 nt, Mycobacterium tuberculosis H37Rv
cgccgacccgggggcgcccggg

SEQ ID NO: 1349211 - RNA, 16 nt, Mycobacterium tuberculosis H37Rv
cgccgacccgggggcg

SEQ ID NO: 1349212 - RNA, 14 nt, Mycobacterium tuberculosis H37Rv
cgccgacccggggg

SEQ ID NO: 1349213 - RNA, 15 nt, Mycobacterium tuberculosis H37Rv
cgccgaccgcgccgc

SEQ ID NO: 1349214 - RNA, 16 nt, Mycobacterium tuberculosis H37Rv
cgccgaccgacgucgc

SEQ ID NO: 1349215 - RNA, 19 nt, Mycobacterium tuberculosis H37Rv
cgccgaccggagccgccgg

SEQ ID NO: 1349216 - RNA, 16 nt, Mycobacterium tuberculosis H37Rv
cgccgacgaugacgcg

SEQ ID NO: 1349217 - RNA, 22 nt, Mycobacterium tuberculosis H37Rv
cgccgacgccgccggccccgcc

SEQ ID NO: 1349218 - RNA, 17 nt, Mycobacterium tuberculosis H37Rv
cgccgacgccguugccc

SEQ ID NO: 1349219 - RNA, 17 nt, Mycobacterium tuberculosis H37Rv
cgccgacggccagcagg

SEQ ID NO: 1349220 - RNA, 21 nt, Mycobacterium tuberculosis H37Rv
cgccgagcaaggggaucugag

SEQ ID NO: 1349221 - RNA, 22 nt, Mycobacterium tuberculosis H37Rv
cgccgagaugcugcacccggag

SEQ ID NO: 1349222 - RNA, 18 nt, Mycobacterium tuberculosis H37Rv
cgccgagcggaccaccgc

SEQ ID NO: 1349223 - RNA, 16 nt, Mycobacterium tuberculosis H37Rv
cgccgagccagcaccc

SEQ ID NO: 1349224 - RNA, 17 nt, Mycobacterium tuberculosis H37Rv
cgccgacuccccgccgg

SEQ ID NO: 1349225 - RNA, 14 nt, Mycobacterium tuberculosis H37Rv
cgccgacuccccgc

SEQ ID NO: 1349226 - RNA, 20 nt, Mycobacterium tuberculosis H37Rv
cgccgacgucgacgccggcc

SEQ ID NO: 1349227 - RNA, 23 nt, Mycobacterium tuberculosis H37Rv
cgccgagaacgauguccgcgcga

SEQ ID NO: 1349228 - RNA, 20 nt, Mycobacterium tuberculosis H37Rv
cgccgagaagacgcaaaagc

SEQ ID NO: 1349229 - RNA, 16 nt, Mycobacterium tuberculosis H37Rv
cgccgagaccgccgcu

SEQ ID NO: 1349230 - RNA, 16 nt, Mycobacterium tuberculosis H37Rv
cgccgagagcaccgcu

SEQ ID NO: 1349231 - RNA, 18 nt, Mycobacterium tuberculosis H37Rv
cgccgagaugcugcaccc

SEQ ID NO: 1349232 - RNA, 16 nt, Mycobacterium tuberculosis H37Rv
cgccgaagccgcgcau

SEQ ID NO: 1349233 - RNA, 16 nt, Mycobacterium tuberculosis H37Rv
cgccgaacgccaccac

SEQ ID NO: 1349234 - RNA, 21 nt, Mycobacterium tuberculosis H37Rv
cgccgaacgugcaaccacggc

SEQ ID NO: 1349235 - RNA, 15 nt, Mycobacterium tuberculosis H37Rv
cgccgaagccggacc

SEQ ID NO: 1349236 - RNA, 20 nt, Mycobacterium tuberculosis H37Rv
cgccgaaggcgggggagccc

SEQ ID NO: 1349237 - RNA, 23 nt, Mycobacterium tuberculosis H37Rv
cgccgaaguagccgaccggcagc

SEQ ID NO: 1349238 - RNA, 14 nt, Mycobacterium tuberculosis H37Rv
cgccgaaagccuug

SEQ ID NO: 1349239 - RNA, 19 nt, Mycobacterium tuberculosis H37Rv
cgccgaaacucaccagcac

SEQ ID NO: 1349240 - RNA, 17 nt, Mycobacterium tuberculosis H37Rv
cgccgaaaaugccgccc

SEQ ID NO: 1349241 - RNA, 18 nt, Mycobacterium tuberculosis H37Rv
cgccgaaaaugccgccca

SEQ ID NO: 1349242 - RNA, 16 nt, Mycobacterium tuberculosis H37Rv
cgccgaaacagcaccc

SEQ ID NO: 1349243 - RNA, 22 nt, Mycobacterium tuberculosis H37Rv
cgccgaaaccacuuccggcgug

SEQ ID NO: 1349244 - RNA, 19 nt, Mycobacterium tuberculosis H37Rv
cgccgaacagcagcccgcc

SEQ ID NO: 1349245 - RNA, 20 nt, Mycobacterium tuberculosis H37Rv
cgccgaacagcagcccgccc

SEQ ID NO: 1349246 - RNA, 17 nt, Mycobacterium tuberculosis H37Rv
cgccgaaccaguaauac

SEQ ID NO: 1349247 - RNA, 14 nt, Mycobacterium tuberculosis H37Rv
cgccgacaccaccg

SEQ ID NO: 1349248 - RNA, 16 nt, Mycobacterium tuberculosis H37Rv
cgccgaaucgcugacc

SEQ ID NO: 1349249 - RNA, 22 nt, Mycobacterium tuberculosis H37Rv
cgccgaaucggcaguugaacuc

SEQ ID NO: 1349250 - RNA, 21 nt, Mycobacterium tuberculosis H37Rv
cgccgacaccaccggcgccgc

SEQ ID NO: 1349251 - RNA, 16 nt, Mycobacterium tuberculosis H37Rv
cgccgacaaccccgcc

SEQ ID NO: 1349252 - RNA, 16 nt, Mycobacterium tuberculosis H37Rv
cgccgacaccgggccc

SEQ ID NO: 1349253 - RNA, 16 nt, Mycobacterium tuberculosis H37Rv
cgccgacaggccggcc

SEQ ID NO: 1349254 - RNA, 13 nt, Mycobacterium tuberculosis H37Rv
cgccgaccaccgc

SEQ ID NO: 1349255 - RNA, 19 nt, Mycobacterium tuberculosis H37Rv
cgccgaccacauuccgcag

SEQ ID NO: 1349256 - RNA, 13 nt, Mycobacterium tuberculosis H37Rv
cgccgaccagcac

SEQ ID NO: 1349257 - RNA, 13 nt, Mycobacterium tuberculosis H37Rv
cgccgacccgcgc

SEQ ID NO: 1349258 - RNA, 17 nt, Mycobacterium tuberculosis H37Rv
cgccgacccgcgcgccg

SEQ ID NO: 1349259 - RNA, 20 nt, Mycobacterium tuberculosis H37Rv
cgcccucggcgaccuggcuc

SEQ ID NO: 1349260 - RNA, 16 nt, Mycobacterium tuberculosis H37Rv
cgcccucgucgcgggc

SEQ ID NO: 1349261 - RNA, 14 nt, Mycobacterium tuberculosis H37Rv
cgcccucccugggg

SEQ ID NO: 1349262 - RNA, 18 nt, Mycobacterium tuberculosis H37Rv
cgcccugaagggccgccu

SEQ ID NO: 1349263 - RNA, 16 nt, Mycobacterium tuberculosis H37Rv
cgcccugaccgcccgc

SEQ ID NO: 1349264 - RNA, 23 nt, Mycobacterium tuberculosis H37Rv
cgcccucaccgccugugccgccg

SEQ ID NO: 1349265 - RNA, 17 nt, Mycobacterium tuberculosis H37Rv
cgcccuaacccugcccu

SEQ ID NO: 1349266 - RNA, 18 nt, Mycobacterium tuberculosis H37Rv
cgcccucagccgcggcca

SEQ ID NO: 1349267 - RNA, 15 nt, Mycobacterium tuberculosis H37Rv
cgcccucagccgcgg

SEQ ID NO: 1349268 - RNA, 21 nt, Mycobacterium tuberculosis H37Rv
cgcccuagcuggugcgcccga

SEQ ID NO: 1349269 - RNA, 15 nt, Mycobacterium tuberculosis H37Rv
cgcccucccgggccc

SEQ ID NO: 1349270 - RNA, 14 nt, Mycobacterium tuberculosis H37Rv
cgcccucagccgcg

SEQ ID NO: 1349271 - RNA, 16 nt, Mycobacterium tuberculosis H37Rv
cgcccgucgcugggag

SEQ ID NO: 1349272 - RNA, 16 nt, Mycobacterium tuberculosis H37Rv
cgcccgugccgcccgc

SEQ ID NO: 1349273 - RNA, 18 nt, Mycobacterium tuberculosis H37Rv
cgcccgugccgcccgcgc

SEQ ID NO: 1349274 - RNA, 15 nt, Mycobacterium tuberculosis H37Rv
cgcccgugccgcccu

SEQ ID NO: 1349275 - RNA, 16 nt, Mycobacterium tuberculosis H37Rv
cgcccgugccgcccuc

SEQ ID NO: 1349276 - RNA, 15 nt, Mycobacterium tuberculosis H37Rv
cgcccgucuccagca

SEQ ID NO: 1349277 - RNA, 19 nt, Mycobacterium tuberculosis H37Rv
cgcccggugcuaaccgacg

SEQ ID NO: 1349278 - RNA, 20 nt, Mycobacterium tuberculosis H37Rv
cgcccggucucgacggcggc

SEQ ID NO: 1349279 - RNA, 19 nt, Mycobacterium tuberculosis H37Rv
cgcccgucccgccggcccc

SEQ ID NO: 1349280 - RNA, 11 nt, Mycobacterium tuberculosis H37Rv
cgcccugggcg

SEQ ID NO: 1349281 - RNA, 16 nt, Mycobacterium tuberculosis H37Rv
cgcccuggccgcccug

SEQ ID NO: 1349282 - RNA, 14 nt, Mycobacterium tuberculosis H37Rv
cgcccuggccgccc

SEQ ID NO: 1349283 - RNA, 12 nt, Mycobacterium tuberculosis H37Rv
cgcccugcggau

SEQ ID NO: 1349284 - RNA, 17 nt, Mycobacterium tuberculosis H37Rv
cgcccuguucggcccga

SEQ ID NO: 1349285 - RNA, 22 nt, Mycobacterium tuberculosis H37Rv
cgcccuguccggguagcggcgc

SEQ ID NO: 1349286 - RNA, 14 nt, Mycobacterium tuberculosis H37Rv
cgcccugggcgccg

SEQ ID NO: 1349287 - RNA, 21 nt, Mycobacterium tuberculosis H37Rv
cgcccugguccaggcccuggc

SEQ ID NO: 1349288 - RNA, 14 nt, Mycobacterium tuberculosis H37Rv
cgcccuugccgccg

SEQ ID NO: 1349289 - RNA, 15 nt, Mycobacterium tuberculosis H37Rv
cgcccuugccgccga

SEQ ID NO: 1349290 - RNA, 21 nt, Mycobacterium tuberculosis H37Rv
cgcccuugccgccggccccgc

SEQ ID NO: 1349291 - RNA, 16 nt, Mycobacterium tuberculosis H37Rv
cgcccuugccuccggc

SEQ ID NO: 1349292 - RNA, 19 nt, Mycobacterium tuberculosis H37Rv
cgcccuugccgccagcccc

SEQ ID NO: 1349293 - RNA, 22 nt, Mycobacterium tuberculosis H37Rv
cgcccuugccgccagccccagc

SEQ ID NO: 1349294 - RNA, 15 nt, Mycobacterium tuberculosis H37Rv
cgcccuugccgcccg

SEQ ID NO: 1349295 - RNA, 10 nt, Mycobacterium tuberculosis H37Rv
cgcccuugcc

SEQ ID NO: 1349296 - RNA, 13 nt, Mycobacterium tuberculosis H37Rv
cgccgccuggacg

SEQ ID NO: 1349297 - RNA, 15 nt, Mycobacterium tuberculosis H37Rv
cgccgccuggacgcc

SEQ ID NO: 1349298 - RNA, 22 nt, Mycobacterium tuberculosis H37Rv
cgccgccuucuucucggcgagc

SEQ ID NO: 1349299 - RNA, 15 nt, Mycobacterium tuberculosis H37Rv
cgccgccugcuccuc

SEQ ID NO: 1349300 - RNA, 20 nt, Mycobacterium tuberculosis H37Rv
cgccgcgaagcgcucggcag

SEQ ID NO: 1349301 - RNA, 21 nt, Mycobacterium tuberculosis H37Rv
cgccgcgaacuccagcagccc

SEQ ID NO: 1349302 - RNA, 16 nt, Mycobacterium tuberculosis H37Rv
cgccgcgaacuccagc

SEQ ID NO: 1349303 - RNA, 16 nt, Mycobacterium tuberculosis H37Rv
cgccgcgaccgcgagc

SEQ ID NO: 1349304 - RNA, 20 nt, Mycobacterium tuberculosis H37Rv
cgccgcgaaggggugcccgg

SEQ ID NO: 1349305 - RNA, 21 nt, Mycobacterium tuberculosis H37Rv
cgccgcgaaggggugcccggc

SEQ ID NO: 1349306 - RNA, 21 nt, Mycobacterium tuberculosis H37Rv
cgccgcgaaugucgccgccug

SEQ ID NO: 1349307 - RNA, 19 nt, Mycobacterium tuberculosis H37Rv
cgccgccguugccgccguc

SEQ ID NO: 1349308 - RNA, 22 nt, Mycobacterium tuberculosis H37Rv
cgccgccguucccgccggcccc

SEQ ID NO: 1349309 - RNA, 23 nt, Mycobacterium tuberculosis H37Rv
cgccgccguucccgccggccccg

SEQ ID NO: 1349310 - RNA, 17 nt, Mycobacterium tuberculosis H37Rv
cgccgccguugccgccg

SEQ ID NO: 1349311 - RNA, 17 nt, Mycobacterium tuberculosis H37Rv
cgccgccguugccgcca

SEQ ID NO: 1349312 - RNA, 16 nt, Mycobacterium tuberculosis H37Rv
cgccgcgcccggcgcu

SEQ ID NO: 1349313 - RNA, 13 nt, Mycobacterium tuberculosis H37Rv
cgccgcgcccggc

SEQ ID NO: 1349314 - RNA, 15 nt, Mycobacterium tuberculosis H37Rv
cgccgcgccggcggc

SEQ ID NO: 1349315 - RNA, 16 nt, Mycobacterium tuberculosis H37Rv
cgccgcgccggcggcc

SEQ ID NO: 1349316 - RNA, 20 nt, Mycobacterium tuberculosis H37Rv
cgccgcgccggcggccaccu

SEQ ID NO: 1349317 - RNA, 16 nt, Mycobacterium tuberculosis H37Rv
cgccgcgccgcgccgc

SEQ ID NO: 1349318 - RNA, 19 nt, Mycobacterium tuberculosis H37Rv
cgccgcgcaucgcggccga

SEQ ID NO: 1349319 - RNA, 15 nt, Mycobacterium tuberculosis H37Rv
cgccgcgcagcgagg

SEQ ID NO: 1349320 - RNA, 16 nt, Mycobacterium tuberculosis H37Rv
cgccgcgagcgccggc

SEQ ID NO: 1349321 - RNA, 17 nt, Mycobacterium tuberculosis H37Rv
cgccgcgcagccggccc

SEQ ID NO: 1349322 - RNA, 15 nt, Mycobacterium tuberculosis H37Rv
cgccgcgcagccgcu

SEQ ID NO: 1349323 - RNA, 14 nt, Mycobacterium tuberculosis H37Rv
cgccgcgcagccgg

SEQ ID NO: 1349324 - RNA, 16 nt, Mycobacterium tuberculosis H37Rv
cgccgcgauggccccu

SEQ ID NO: 1349325 - RNA, 19 nt, Mycobacterium tuberculosis H37Rv
cgccgcggcgcccggcgga

SEQ ID NO: 1349326 - RNA, 16 nt, Mycobacterium tuberculosis H37Rv
cgccgcggcgcccggc

SEQ ID NO: 1349327 - RNA, 16 nt, Mycobacterium tuberculosis H37Rv
cgccgcgggcgccggu

SEQ ID NO: 1349328 - RNA, 19 nt, Mycobacterium tuberculosis H37Rv
cgccgcgugcugcggcugg

SEQ ID NO: 1349329 - RNA, 19 nt, Mycobacterium tuberculosis H37Rv
cgccgcgucuaccaaccgg

SEQ ID NO: 1349330 - RNA, 12 nt, Mycobacterium tuberculosis H37Rv
cgccgcgcguca

SEQ ID NO: 1349331 - RNA, 16 nt, Mycobacterium tuberculosis H37Rv
cgccgcgcgucgcgag

SEQ ID NO: 1349332 - RNA, 20 nt, Mycobacterium tuberculosis H37Rv
cgccgcgcguucggcgcuga

SEQ ID NO: 1349333 - RNA, 14 nt, Mycobacterium tuberculosis H37Rv
cgccgcgcucgacg

SEQ ID NO: 1349334 - RNA, 22 nt, Mycobacterium tuberculosis H37Rv
cgccgcgcgcauuuuucgccag

SEQ ID NO: 1349335 - RNA, 18 nt, Mycobacterium tuberculosis H37Rv
cgccgcgcgacaggcccu

SEQ ID NO: 1349336 - RNA, 12 nt, Mycobacterium tuberculosis H37Rv
cgccgcgccggc

SEQ ID NO: 1349337 - RNA, 12 nt, Mycobacterium tuberculosis H37Rv
cgccgcggcgcc

SEQ ID NO: 1349338 - RNA, 18 nt, Mycobacterium tuberculosis H37Rv
cgccgcggccgccguccc

SEQ ID NO: 1349339 - RNA, 13 nt, Mycobacterium tuberculosis H37Rv
cgccgcggccgcc

SEQ ID NO: 1349340 - RNA, 15 nt, Mycobacterium tuberculosis H37Rv
cgccgcggccggcgc

SEQ ID NO: 1349341 - RNA, 22 nt, Mycobacterium tuberculosis H37Rv
cgccgcggaguaggccgcgccc

SEQ ID NO: 1349342 - RNA, 20 nt, Mycobacterium tuberculosis H37Rv
cgccggacccgucgagcagc

SEQ ID NO: 1349343 - RNA, 19 nt, Mycobacterium tuberculosis H37Rv
cgccggacccgucgagcag

SEQ ID NO: 1349344 - RNA, 16 nt, Mycobacterium tuberculosis H37Rv
cgccggacugcggccc

SEQ ID NO: 1349345 - RNA, 20 nt, Mycobacterium tuberculosis H37Rv
cgccggagaucgucgcguag

SEQ ID NO: 1349346 - RNA, 18 nt, Mycobacterium tuberculosis H37Rv
cgccggaggucgggcggc

SEQ ID NO: 1349347 - RNA, 18 nt, Mycobacterium tuberculosis H37Rv
cgccggaugacaccgacc

SEQ ID NO: 1349348 - RNA, 20 nt, Mycobacterium tuberculosis H37Rv
cgccggaugcugucagcagc

SEQ ID NO: 1349349 - RNA, 21 nt, Mycobacterium tuberculosis H37Rv
cgccggaugcugucagcagcc

SEQ ID NO: 1349350 - RNA, 16 nt, Mycobacterium tuberculosis H37Rv
cgccggauccgccaga

SEQ ID NO: 1349351 - RNA, 17 nt, Mycobacterium tuberculosis H37Rv
cgccggauagcgcagcu

SEQ ID NO: 1349352 - RNA, 23 nt, Mycobacterium tuberculosis H37Rv
cgccggauagcaccggcacccgc

SEQ ID NO: 1349353 - RNA, 17 nt, Mycobacterium tuberculosis H37Rv
cgccggaguuuccccua

SEQ ID NO: 1349354 - RNA, 21 nt, Mycobacterium tuberculosis H37Rv
cgccggaguugaagaagcccg

SEQ ID NO: 1349355 - RNA, 21 nt, Mycobacterium tuberculosis H37Rv
cgccggccauaccgcucgccg

SEQ ID NO: 1349356 - RNA, 16 nt, Mycobacterium tuberculosis H37Rv
cgccggccagcggcca

SEQ ID NO: 1349357 - RNA, 14 nt, Mycobacterium tuberculosis H37Rv
cgccggccacgacc

SEQ ID NO: 1349358 - RNA, 14 nt, Mycobacterium tuberculosis H37Rv
cgccggccacccgc

SEQ ID NO: 1349359 - RNA, 13 nt, Mycobacterium tuberculosis H37Rv
cgccggccacccg

SEQ ID NO: 1349360 - RNA, 20 nt, Mycobacterium tuberculosis H37Rv
cgccggccagcacuccgcgg

SEQ ID NO: 1349361 - RNA, 16 nt, Mycobacterium tuberculosis H37Rv
cgccggcaucgcgcaa

SEQ ID NO: 1349362 - RNA, 17 nt, Mycobacterium tuberculosis H37Rv
cgccggccaagaccgcg

SEQ ID NO: 1349363 - RNA, 23 nt, Mycobacterium tuberculosis H37Rv
cgccggccaagaccgcggcccgc

SEQ ID NO: 1349364 - RNA, 22 nt, Mycobacterium tuberculosis H37Rv
cgccggcaucgucgacgcccga

SEQ ID NO: 1349365 - RNA, 16 nt, Mycobacterium tuberculosis H37Rv
cgccggcaucuccacc

SEQ ID NO: 1349366 - RNA, 23 nt, Mycobacterium tuberculosis H37Rv
cgccggcaccggggcugcccgcg

SEQ ID NO: 1349367 - RNA, 16 nt, Mycobacterium tuberculosis H37Rv
cgccggcaccgccagu

SEQ ID NO: 1349368 - RNA, 15 nt, Mycobacterium tuberculosis H37Rv
cgccggcaccgccgc

SEQ ID NO: 1349369 - RNA, 17 nt, Mycobacterium tuberculosis H37Rv
cgccggcaccgccgccc

SEQ ID NO: 1349370 - RNA, 16 nt, Mycobacterium tuberculosis H37Rv
cgccggcaccgccggc

SEQ ID NO: 1349371 - RNA, 18 nt, Mycobacterium tuberculosis H37Rv
cgccggcaccggggcugc

SEQ ID NO: 1349372 - RNA, 13 nt, Mycobacterium tuberculosis H37Rv
cgccgcuggcaau

SEQ ID NO: 1349373 - RNA, 16 nt, Mycobacterium tuberculosis H37Rv
cgccgcuggccagcac

SEQ ID NO: 1349374 - RNA, 20 nt, Mycobacterium tuberculosis H37Rv
cgccgcuggagaucacgccg

SEQ ID NO: 1349375 - RNA, 20 nt, Mycobacterium tuberculosis H37Rv
cgccgcuuucgccggcgcca

SEQ ID NO: 1349376 - RNA, 17 nt, Mycobacterium tuberculosis H37Rv
cgccggaaagcccgucg

SEQ ID NO: 1349377 - RNA, 14 nt, Mycobacterium tuberculosis H37Rv
cgccggaccagagc

SEQ ID NO: 1349378 - RNA, 20 nt, Mycobacterium tuberculosis H37Rv
cgccggacaaaccgggcggc

SEQ ID NO: 1349379 - RNA, 21 nt, Mycobacterium tuberculosis H37Rv
cgccggacccgccggguccgc

SEQ ID NO: 1349380 - RNA, 13 nt, Mycobacterium tuberculosis H37Rv
cgccggacccgcc

SEQ ID NO: 1349381 - RNA, 20 nt, Mycobacterium tuberculosis H37Rv
cgccgcucgguccccgcagc

SEQ ID NO: 1349382 - RNA, 17 nt, Mycobacterium tuberculosis H37Rv
cgccgcugacuccugcg

SEQ ID NO: 1349383 - RNA, 19 nt, Mycobacterium tuberculosis H37Rv
cgccgcuacgccggcccga

SEQ ID NO: 1349384 - RNA, 17 nt, Mycobacterium tuberculosis H37Rv
cgccgcuaccgcccgcg

SEQ ID NO: 1349385 - RNA, 20 nt, Mycobacterium tuberculosis H37Rv
cgccgcguuuauaccucgcc

SEQ ID NO: 1349386 - RNA, 20 nt, Mycobacterium tuberculosis H37Rv
cgccgcuaacgcaccugcgc

SEQ ID NO: 1349387 - RNA, 18 nt, Mycobacterium tuberculosis H37Rv
cgccgcguugucggcgcu

SEQ ID NO: 1349388 - RNA, 22 nt, Mycobacterium tuberculosis H37Rv
cgccgcguugucggcgcucccc

SEQ ID NO: 1349389 - RNA, 21 nt, Mycobacterium tuberculosis H37Rv
cgccgcuaggugacgccgcca

SEQ ID NO: 1349390 - RNA, 14 nt, Mycobacterium tuberculosis H37Rv
cgccgcuacgccgg

SEQ ID NO: 1349391 - RNA, 15 nt, Mycobacterium tuberculosis H37Rv
cgccgcuacgccggc

SEQ ID NO: 1349392 - RNA, 17 nt, Mycobacterium tuberculosis H37Rv
cgccgcucauccagcgc

SEQ ID NO: 1349393 - RNA, 15 nt, Mycobacterium tuberculosis H37Rv
cgccgcucacggggc

SEQ ID NO: 1349394 - RNA, 24 nt, Mycobacterium tuberculosis H37Rv
cgccgcuaugaggcagucguugau

SEQ ID NO: 1349395 - RNA, 14 nt, Mycobacterium tuberculosis H37Rv
cgccggcccgcggg

SEQ ID NO: 1349396 - RNA, 13 nt, Mycobacterium tuberculosis H37Rv
cgccggccgccag

SEQ ID NO: 1349397 - RNA, 14 nt, Mycobacterium tuberculosis H37Rv
cgccggccgccagc

SEQ ID NO: 1349398 - RNA, 15 nt, Mycobacterium tuberculosis H37Rv
cgccggccccgccag

SEQ ID NO: 1349399 - RNA, 16 nt, Mycobacterium tuberculosis H37Rv
cgccggccccgccggc

SEQ ID NO: 1349400 - RNA, 18 nt, Mycobacterium tuberculosis H37Rv
cgccggccccgccggccc

SEQ ID NO: 1349401 - RNA, 15 nt, Mycobacterium tuberculosis H37Rv
cgccggccccgccga

SEQ ID NO: 1349402 - RNA, 16 nt, Mycobacterium tuberculosis H37Rv
cgccggccccgccgcu

SEQ ID NO: 1349403 - RNA, 13 nt, Mycobacterium tuberculosis H37Rv
cgccggccccgcc

SEQ ID NO: 1349404 - RNA, 14 nt, Mycobacterium tuberculosis H37Rv
cgccggccccgcca

SEQ ID NO: 1349405 - RNA, 21 nt, Mycobacterium tuberculosis H37Rv
cgccggccccaccggugccgc

SEQ ID NO: 1349406 - RNA, 15 nt, Mycobacterium tuberculosis H37Rv
cgccggccgucagca

SEQ ID NO: 1349407 - RNA, 19 nt, Mycobacterium tuberculosis H37Rv
cgccggccuggccgccaga

SEQ ID NO: 1349408 - RNA, 14 nt, Mycobacterium tuberculosis H37Rv
cgccggccgcgcag

SEQ ID NO: 1349409 - RNA, 12 nt, Mycobacterium tuberculosis H37Rv
cgccggccggcc

SEQ ID NO: 1349410 - RNA, 13 nt, Mycobacterium tuberculosis H37Rv
cgccggcgcgccg

SEQ ID NO: 1349411 - RNA, 17 nt, Mycobacterium tuberculosis H37Rv
cgccggcgccgcccgcg

SEQ ID NO: 1349412 - RNA, 18 nt, Mycobacterium tuberculosis H37Rv
cgccggcgccgcccgcgc

SEQ ID NO: 1349413 - RNA, 18 nt, Mycobacterium tuberculosis H37Rv
cgccggcgccggugccgc

SEQ ID NO: 1349414 - RNA, 20 nt, Mycobacterium tuberculosis H37Rv
cgccggcgcugaucgcgaag

SEQ ID NO: 1349415 - RNA, 15 nt, Mycobacterium tuberculosis H37Rv
cgccggcggacgccc

SEQ ID NO: 1349416 - RNA, 22 nt, Mycobacterium tuberculosis H37Rv
cgccggcgccacccgcgccgcc

SEQ ID NO: 1349417 - RNA, 16 nt, Mycobacterium tuberculosis H37Rv
cgccggcgccagcaga

SEQ ID NO: 1349418 - RNA, 17 nt, Mycobacterium tuberculosis H37Rv
cgccggcgccagcagau

SEQ ID NO: 1349419 - RNA, 18 nt, Mycobacterium tuberculosis H37Rv
cgccggcgccagcgccgc

SEQ ID NO: 1349420 - RNA, 17 nt, Mycobacterium tuberculosis H37Rv
cgccggcgccacccgcg

SEQ ID NO: 1349421 - RNA, 15 nt, Mycobacterium tuberculosis H37Rv
cgccggcgccacccg

SEQ ID NO: 1349422 - RNA, 15 nt, Mycobacterium tuberculosis H37Rv
cgccggcgcccaggc

SEQ ID NO: 1349423 - RNA, 13 nt, Mycobacterium tuberculosis H37Rv
cgccggcgccgcc

SEQ ID NO: 1349424 - RNA, 15 nt, Mycobacterium tuberculosis H37Rv
cgccggcgcccccgu

SEQ ID NO: 1349425 - RNA, 16 nt, Mycobacterium tuberculosis H37Rv
cgccggcgacugcagc

SEQ ID NO: 1349426 - RNA, 15 nt, Mycobacterium tuberculosis H37Rv
cgccggcgacaccgc

SEQ ID NO: 1349427 - RNA, 19 nt, Mycobacterium tuberculosis H37Rv
cgccggcgaugccgguggg

SEQ ID NO: 1349428 - RNA, 12 nt, Mycobacterium tuberculosis H37Rv
cgccggccuggc

SEQ ID NO: 1349429 - RNA, 18 nt, Mycobacterium tuberculosis H37Rv
cgccggcguccggagccc

SEQ ID NO: 1349430 - RNA, 21 nt, Mycobacterium tuberculosis H37Rv
cgccggcgguagucggccagc

SEQ ID NO: 1349431 - RNA, 13 nt, Mycobacterium tuberculosis H37Rv
cgccggcggcggu

SEQ ID NO: 1349432 - RNA, 20 nt, Mycobacterium tuberculosis H37Rv
cgccggcgggacgggggcug

SEQ ID NO: 1349433 - RNA, 13 nt, Mycobacterium tuberculosis H37Rv
cgccggcggccgc

SEQ ID NO: 1349434 - RNA, 23 nt, Mycobacterium tuberculosis H37Rv
cgccggcguccggagccccuguc

SEQ ID NO: 1349435 - RNA, 21 nt, Mycobacterium tuberculosis H37Rv
cgccggcgucgacccugccca

SEQ ID NO: 1349436 - RNA, 15 nt, Mycobacterium tuberculosis H37Rv
cgccggcugcgccag

SEQ ID NO: 1349437 - RNA, 16 nt, Mycobacterium tuberculosis H37Rv
cgccggcuucgcccag

SEQ ID NO: 1349438 - RNA, 15 nt, Mycobacterium tuberculosis H37Rv
cgccggcuccgcagc

SEQ ID NO: 1349439 - RNA, 15 nt, Mycobacterium tuberculosis H37Rv
cgccggcuccgccac

SEQ ID NO: 1349440 - RNA, 16 nt, Mycobacterium tuberculosis H37Rv
cgccggcuccgccagc

SEQ ID NO: 1349441 - RNA, 21 nt, Mycobacterium tuberculosis H37Rv
cgccggcuccgccagcgccgc

SEQ ID NO: 1349442 - RNA, 14 nt, Mycobacterium tuberculosis H37Rv
cgccggcuccgccg

SEQ ID NO: 1349443 - RNA, 21 nt, Mycobacterium tuberculosis H37Rv
cgccgggcuuaggccgcggca

SEQ ID NO: 1349444 - RNA, 18 nt, Mycobacterium tuberculosis H37Rv
cgccgggcuuaggccgcg

SEQ ID NO: 1349445 - RNA, 22 nt, Mycobacterium tuberculosis H37Rv
cgccgggcucagcugggccgcu

SEQ ID NO: 1349446 - RNA, 21 nt, Mycobacterium tuberculosis H37Rv
cgccgggcguccgccggcgag

SEQ ID NO: 1349447 - RNA, 15 nt, Mycobacterium tuberculosis H37Rv
cgccgggcggccgcg

SEQ ID NO: 1349448 - RNA, 14 nt, Mycobacterium tuberculosis H37Rv
cgccgggcggcggu

SEQ ID NO: 1349449 - RNA, 19 nt, Mycobacterium tuberculosis H37Rv
cgccgggccccggggugcc

SEQ ID NO: 1349450 - RNA, 17 nt, Mycobacterium tuberculosis H37Rv
cgccgggaugccggccc

SEQ ID NO: 1349451 - RNA, 19 nt, Mycobacterium tuberculosis H37Rv
cgccgggaaacaccggcuu

SEQ ID NO: 1349452 - RNA, 20 nt, Mycobacterium tuberculosis H37Rv
cgccggggacgccgcggcgc

SEQ ID NO: 1349453 - RNA, 17 nt, Mycobacterium tuberculosis H37Rv
cgccgggguagacgccc

SEQ ID NO: 1349454 - RNA, 18 nt, Mycobacterium tuberculosis H37Rv
cgccggggggcugcugcu

SEQ ID NO: 1349455 - RNA, 16 nt, Mycobacterium tuberculosis H37Rv
cgccgggggcgccgcc

SEQ ID NO: 1349456 - RNA, 20 nt, Mycobacterium tuberculosis H37Rv
cgccgguaacuguccgcccg

SEQ ID NO: 1349457 - RNA, 18 nt, Mycobacterium tuberculosis H37Rv
cgccggguccgccgggcc

SEQ ID NO: 1349458 - RNA, 21 nt, Mycobacterium tuberculosis H37Rv
cgccgggucagcccggcgcga

SEQ ID NO: 1349459 - RNA, 20 nt, Mycobacterium tuberculosis H37Rv
cgccggguuggcgccggcca

SEQ ID NO: 1349460 - RNA, 15 nt, Mycobacterium tuberculosis H37Rv
cgccgggugcgccgu

SEQ ID NO: 1349461 - RNA, 17 nt, Mycobacterium tuberculosis H37Rv
cgccggugacgaugacc

SEQ ID NO: 1349462 - RNA, 22 nt, Mycobacterium tuberculosis H37Rv
cgccggugaggcgaccggacga

SEQ ID NO: 1349463 - RNA, 22 nt, Mycobacterium tuberculosis H37Rv
cgccggugccgccugcgccgcc

SEQ ID NO: 1349464 - RNA, 21 nt, Mycobacterium tuberculosis H37Rv
cgccggugccgccggugccgc

SEQ ID NO: 1349465 - RNA, 19 nt, Mycobacterium tuberculosis H37Rv
cgccggugccgaugaccga

SEQ ID NO: 1349466 - RNA, 15 nt, Mycobacterium tuberculosis H37Rv
cgccggugccgccau

SEQ ID NO: 1349467 - RNA, 15 nt, Mycobacterium tuberculosis H37Rv
cgccggugccgcccg

SEQ ID NO: 1349468 - RNA, 15 nt, Mycobacterium tuberculosis H37Rv
cgccggugccgccgc

SEQ ID NO: 1349469 - RNA, 19 nt, Mycobacterium tuberculosis H37Rv
cgccggugccaccggcugg

SEQ ID NO: 1349470 - RNA, 23 nt, Mycobacterium tuberculosis H37Rv
cgccggucagcaauacggcggcg

SEQ ID NO: 1349471 - RNA, 17 nt, Mycobacterium tuberculosis H37Rv
cgccgguccccgccggc

SEQ ID NO: 1349472 - RNA, 19 nt, Mycobacterium tuberculosis H37Rv
cgccgguccccgccggcgg

SEQ ID NO: 1349473 - RNA, 18 nt, Mycobacterium tuberculosis H37Rv
cgccggucaggccgccgc

SEQ ID NO: 1349474 - RNA, 13 nt, Mycobacterium tuberculosis H37Rv
cgccggucgccgg

SEQ ID NO: 1349475 - RNA, 18 nt, Mycobacterium tuberculosis H37Rv
cgccgguuccgccggccc

SEQ ID NO: 1349476 - RNA, 22 nt, Mycobacterium tuberculosis H37Rv
cgccgguucccgaucaggcggg

SEQ ID NO: 1349477 - RNA, 22 nt, Mycobacterium tuberculosis H37Rv
cgccgguggugccggcgccgcc

SEQ ID NO: 1349478 - RNA, 21 nt, Mycobacterium tuberculosis H37Rv
cgccgguggugccggcgccgc

SEQ ID NO: 1349479 - RNA, 13 nt, Mycobacterium tuberculosis H37Rv
cgccggugucggg

SEQ ID NO: 1349480 - RNA, 16 nt, Mycobacterium tuberculosis H37Rv
cgccgguggccgcgcu

SEQ ID NO: 1349481 - RNA, 21 nt, Mycobacterium tuberculosis H37Rv
cgccgguggucacgccgugug

SEQ ID NO: 1349482 - RNA, 22 nt, Mycobacterium tuberculosis H37Rv
cgccgguggucagguuggcacg

SEQ ID NO: 1349483 - RNA, 21 nt, Mycobacterium tuberculosis H37Rv
cgccgguggcagagccgccgu

SEQ ID NO: 1349484 - RNA, 15 nt, Mycobacterium tuberculosis H37Rv
cgccgguggcacggc

SEQ ID NO: 1349485 - RNA, 17 nt, Mycobacterium tuberculosis H37Rv
cgccgguggcacggccc

SEQ ID NO: 1349486 - RNA, 15 nt, Mycobacterium tuberculosis H37Rv
cgccggugcggcggg

SEQ ID NO: 1349487 - RNA, 23 nt, Mycobacterium tuberculosis H37Rv
cgccggugccaguacucggccag

SEQ ID NO: 1349488 - RNA, 15 nt, Mycobacterium tuberculosis H37Rv
cgccgucagcccagg

SEQ ID NO: 1349489 - RNA, 16 nt, Mycobacterium tuberculosis H37Rv
cgccgucagcaccgcu

SEQ ID NO: 1349490 - RNA, 18 nt, Mycobacterium tuberculosis H37Rv
cgccguccccgccgccgu

SEQ ID NO: 1349491 - RNA, 18 nt, Mycobacterium tuberculosis H37Rv
cgccgucaccgcugagcc

SEQ ID NO: 1349492 - RNA, 16 nt, Mycobacterium tuberculosis H37Rv
cgccguagagcuggug

SEQ ID NO: 1349493 - RNA, 19 nt, Mycobacterium tuberculosis H37Rv
cgccguagcgcagcgccuc

SEQ ID NO: 1349494 - RNA, 15 nt, Mycobacterium tuberculosis H37Rv
cgccguagagccgcu

SEQ ID NO: 1349495 - RNA, 15 nt, Mycobacterium tuberculosis H37Rv
cgccgucacccccga

SEQ ID NO: 1349496 - RNA, 15 nt, Mycobacterium tuberculosis H37Rv
cgccgucacgcacgc

SEQ ID NO: 1349497 - RNA, 14 nt, Mycobacterium tuberculosis H37Rv
cgccuugcgggccu

SEQ ID NO: 1349498 - RNA, 16 nt, Mycobacterium tuberculosis H37Rv
cgccuuggccaccauc

SEQ ID NO: 1349499 - RNA, 13 nt, Mycobacterium tuberculosis H37Rv
cgccuuggccagc

SEQ ID NO: 1349500 - RNA, 15 nt, Mycobacterium tuberculosis H37Rv
cgccuuggccagcgc

SEQ ID NO: 1349501 - RNA, 14 nt, Mycobacterium tuberculosis H37Rv
cgccuuggcacccu

SEQ ID NO: 1349502 - RNA, 17 nt, Mycobacterium tuberculosis H37Rv
cgccuuggcacccuccg

SEQ ID NO: 1349503 - RNA, 17 nt, Mycobacterium tuberculosis H37Rv
cgccuuggucgccgccu

SEQ ID NO: 1349504 - RNA, 15 nt, Mycobacterium tuberculosis H37Rv
cgccuuggcgcccgc

SEQ ID NO: 1349505 - RNA, 16 nt, Mycobacterium tuberculosis H37Rv
cgccuuugccgccggc

SEQ ID NO: 1349506 - RNA, 21 nt, Mycobacterium tuberculosis H37Rv
cgccuuugccgccggcaccgc

SEQ ID NO: 1349507 - RNA, 17 nt, Mycobacterium tuberculosis H37Rv
cgccuuuuuucgccgcc

SEQ ID NO: 1349508 - RNA, 18 nt, Mycobacterium tuberculosis H37Rv
cgccuuuuuucgccgccu

SEQ ID NO: 1349509 - RNA, 13 nt, Mycobacterium tuberculosis H37Rv
cgccuugaccaca

SEQ ID NO: 1349510 - RNA, 23 nt, Mycobacterium tuberculosis H37Rv
cgccuugacgaucgagcugacga

SEQ ID NO: 1349511 - RNA, 20 nt, Mycobacterium tuberculosis H37Rv
cgccuugacugaacucaaca

SEQ ID NO: 1349512 - RNA, 18 nt, Mycobacterium tuberculosis H37Rv
cgccuucuucgcggcggu

SEQ ID NO: 1349513 - RNA, 21 nt, Mycobacterium tuberculosis H37Rv
cgccuucuuggcaggugccuu

SEQ ID NO: 1349514 - RNA, 15 nt, Mycobacterium tuberculosis H37Rv
cgccuucgccgccgc

SEQ ID NO: 1349515 - RNA, 21 nt, Mycobacterium tuberculosis H37Rv
cgccuucuccggcgucacggc

SEQ ID NO: 1349516 - RNA, 18 nt, Mycobacterium tuberculosis H37Rv
cgccuuccagcccgagca

SEQ ID NO: 1349517 - RNA, 16 nt, Mycobacterium tuberculosis H37Rv
cgcgaaugucgccgcc

SEQ ID NO: 1349518 - RNA, 23 nt, Mycobacterium tuberculosis H37Rv
cgcgaaggauuugauaggcgcgc

SEQ ID NO: 1349519 - RNA, 14 nt, Mycobacterium tuberculosis H37Rv
cgcgaagcugcggg

SEQ ID NO: 1349520 - RNA, 14 nt, Mycobacterium tuberculosis H37Rv
cgcgaagccaccag

SEQ ID NO: 1349521 - RNA, 18 nt, Mycobacterium tuberculosis H37Rv
cgcgaacuccagcagccc

SEQ ID NO: 1349522 - RNA, 16 nt, Mycobacterium tuberculosis H37Rv
cgcgaacuccagcagc

SEQ ID NO: 1349523 - RNA, 20 nt, Mycobacterium tuberculosis H37Rv
cgcgaagaacgacgccaccg

SEQ ID NO: 1349524 - RNA, 13 nt, Mycobacterium tuberculosis H37Rv
cgcgaacccgcga

SEQ ID NO: 1349525 - RNA, 14 nt, Mycobacterium tuberculosis H37Rv
cgcgaacaucgcca

SEQ ID NO: 1349526 - RNA, 17 nt, Mycobacterium tuberculosis H37Rv
cgcgaacaucgccagcg

SEQ ID NO: 1349527 - RNA, 18 nt, Mycobacterium tuberculosis H37Rv
cgcgaacgcggccaccac

SEQ ID NO: 1349528 - RNA, 12 nt, Mycobacterium tuberculosis H37Rv
cgcgaacacccg

SEQ ID NO: 1349529 - RNA, 14 nt, Mycobacterium tuberculosis H37Rv
cgcgaaaccgccgu

SEQ ID NO: 1349530 - RNA, 22 nt, Mycobacterium tuberculosis H37Rv
cgccugcugguaccgggcucca

SEQ ID NO: 1349531 - RNA, 16 nt, Mycobacterium tuberculosis H37Rv
cgccugcuggccgcgg

SEQ ID NO: 1349532 - RNA, 13 nt, Mycobacterium tuberculosis H37Rv
cgccugcggcggu

SEQ ID NO: 1349533 - RNA, 22 nt, Mycobacterium tuberculosis H37Rv
cgccugcggcgguuacggucaa

SEQ ID NO: 1349534 - RNA, 13 nt, Mycobacterium tuberculosis H37Rv
cgccugccacagc

SEQ ID NO: 1349535 - RNA, 15 nt, Mycobacterium tuberculosis H37Rv
cgccugcccgaacca

SEQ ID NO: 1349536 - RNA, 16 nt, Mycobacterium tuberculosis H37Rv
cgccugccaccggcgc

SEQ ID NO: 1349537 - RNA, 22 nt, Mycobacterium tuberculosis H37Rv
cgccugcagguuuccggccugc

SEQ ID NO: 1349538 - RNA, 18 nt, Mycobacterium tuberculosis H37Rv
cgccugcccggcccgcuc

SEQ ID NO: 1349539 - RNA, 22 nt, Mycobacterium tuberculosis H37Rv
cgccugcccccgcgcgcacggc

SEQ ID NO: 1349540 - RNA, 23 nt, Mycobacterium tuberculosis H37Rv
cgccugcgacuaagggcacucca

SEQ ID NO: 1349541 - RNA, 18 nt, Mycobacterium tuberculosis H37Rv
cgccugcgccgcccgcgc

SEQ ID NO: 1349542 - RNA, 16 nt, Mycobacterium tuberculosis H37Rv
cgccugcgccgccagc

SEQ ID NO: 1349543 - RNA, 14 nt, Mycobacterium tuberculosis H37Rv
cgccuguaccggcg

SEQ ID NO: 1349544 - RNA, 19 nt, Mycobacterium tuberculosis H37Rv
cgccuggacgccgccggag

SEQ ID NO: 1349545 - RNA, 21 nt, Mycobacterium tuberculosis H37Rv
cgccuggcuacgcgcgcccga

SEQ ID NO: 1349546 - RNA, 17 nt, Mycobacterium tuberculosis H37Rv
cgccuggcuacgcgcgc

SEQ ID NO: 1349547 - RNA, 17 nt, Mycobacterium tuberculosis H37Rv
cgccuggcggcgccgca

SEQ ID NO: 1349548 - RNA, 19 nt, Mycobacterium tuberculosis H37Rv
cgccugugccgccggcgcc

SEQ ID NO: 1349549 - RNA, 22 nt, Mycobacterium tuberculosis H37Rv
cgccuucacgcuggccuccagc

SEQ ID NO: 1349550 - RNA, 17 nt, Mycobacterium tuberculosis H37Rv
cgccuucacgcuggccu

SEQ ID NO: 1349551 - RNA, 14 nt, Mycobacterium tuberculosis H37Rv
cgccucugcucagc

SEQ ID NO: 1349552 - RNA, 16 nt, Mycobacterium tuberculosis H37Rv
cgccucugcgaucagu

SEQ ID NO: 1349553 - RNA, 16 nt, Mycobacterium tuberculosis H37Rv
cgccucgugaguugac

SEQ ID NO: 1349554 - RNA, 23 nt, Mycobacterium tuberculosis H37Rv
cgccucgggcaccuggucggccg

SEQ ID NO: 1349555 - RNA, 17 nt, Mycobacterium tuberculosis H37Rv
cgccucggaccagaccc

SEQ ID NO: 1349556 - RNA, 14 nt, Mycobacterium tuberculosis H37Rv
cgccucggcggcca

SEQ ID NO: 1349557 - RNA, 16 nt, Mycobacterium tuberculosis H37Rv
cgccucggcggccagc

SEQ ID NO: 1349558 - RNA, 14 nt, Mycobacterium tuberculosis H37Rv
cgccugacccggcg

SEQ ID NO: 1349559 - RNA, 15 nt, Mycobacterium tuberculosis H37Rv
cgccugaccgccacc

SEQ ID NO: 1349560 - RNA, 14 nt, Mycobacterium tuberculosis H37Rv
cgccugagcggccu

SEQ ID NO: 1349561 - RNA, 16 nt, Mycobacterium tuberculosis H37Rv
cgccucugcucagccg

SEQ ID NO: 1349562 - RNA, 16 nt, Mycobacterium tuberculosis H37Rv
cgccugcacgcccggc

SEQ ID NO: 1349563 - RNA, 14 nt, Mycobacterium tuberculosis H37Rv
cgccugcacccggc

SEQ ID NO: 1349564 - RNA, 16 nt, Mycobacterium tuberculosis H37Rv
cgccugcacccggcga

SEQ ID NO: 1349565 - RNA, 22 nt, Mycobacterium tuberculosis H37Rv
cgccugcaccgccgccgcccgu

SEQ ID NO: 1349566 - RNA, 19 nt, Mycobacterium tuberculosis H37Rv
cgccugaugcggccggcgc

SEQ ID NO: 1349567 - RNA, 20 nt, Mycobacterium tuberculosis H37Rv
cgccugaugcggccggcgcc

SEQ ID NO: 1349568 - RNA, 14 nt, Mycobacterium tuberculosis H37Rv
cgccuccagcacca

SEQ ID NO: 1349569 - RNA, 20 nt, Mycobacterium tuberculosis H37Rv
cgccuccagcagguccgcgg

SEQ ID NO: 1349570 - RNA, 20 nt, Mycobacterium tuberculosis H37Rv
cgccuccaggcgccacccga

SEQ ID NO: 1349571 - RNA, 15 nt, Mycobacterium tuberculosis H37Rv
cgccuccgccgaggc

SEQ ID NO: 1349572 - RNA, 16 nt, Mycobacterium tuberculosis H37Rv
cgccuccugccgccgc

SEQ ID NO: 1349573 - RNA, 15 nt, Mycobacterium tuberculosis H37Rv
cgccuccgccugccc

SEQ ID NO: 1349574 - RNA, 14 nt, Mycobacterium tuberculosis H37Rv
cgccuccgcggcau

SEQ ID NO: 1349575 - RNA, 21 nt, Mycobacterium tuberculosis H37Rv
cgccuccggauccucggccgc

SEQ ID NO: 1349576 - RNA, 22 nt, Mycobacterium tuberculosis H37Rv
cgccuccggauccucggccgcc

SEQ ID NO: 1349577 - RNA, 19 nt, Mycobacterium tuberculosis H37Rv
cgccuccggcaccuccagc

SEQ ID NO: 1349578 - RNA, 17 nt, Mycobacterium tuberculosis H37Rv
cgccucgccggccaccc

SEQ ID NO: 1349579 - RNA, 13 nt, Mycobacterium tuberculosis H37Rv
cgccucgccgaag

SEQ ID NO: 1349580 - RNA, 14 nt, Mycobacterium tuberculosis H37Rv
cgccucgccaucca

SEQ ID NO: 1349581 - RNA, 19 nt, Mycobacterium tuberculosis H37Rv
cgccucgccggccacccgc

SEQ ID NO: 1349582 - RNA, 19 nt, Mycobacterium tuberculosis H37Rv
cgccucgccggccgccagc

SEQ ID NO: 1349583 - RNA, 23 nt, Mycobacterium tuberculosis H37Rv
cgccucgagguauucgcgcagca

SEQ ID NO: 1349584 - RNA, 23 nt, Mycobacterium tuberculosis H37Rv
cgccucgauaucgucgggagagu

SEQ ID NO: 1349585 - RNA, 18 nt, Mycobacterium tuberculosis H37Rv
cgccucgaccgccagccc

SEQ ID NO: 1349586 - RNA, 17 nt, Mycobacterium tuberculosis H37Rv
cgccucgaggaccacca

SEQ ID NO: 1349587 - RNA, 16 nt, Mycobacterium tuberculosis H37Rv
cgccucgaccgccagc

SEQ ID NO: 1349588 - RNA, 12 nt, Mycobacterium tuberculosis H37Rv
cgccuccgccga

SEQ ID NO: 1349589 - RNA, 17 nt, Mycobacterium tuberculosis H37Rv
cgccucgacacccagcc

SEQ ID NO: 1349590 - RNA, 15 nt, Mycobacterium tuberculosis H37Rv
cgccguuaccgccgu

SEQ ID NO: 1349591 - RNA, 18 nt, Mycobacterium tuberculosis H37Rv
cgccgugugccacggggc

SEQ ID NO: 1349592 - RNA, 18 nt, Mycobacterium tuberculosis H37Rv
cgccgugugugcggcggu

SEQ ID NO: 1349593 - RNA, 13 nt, Mycobacterium tuberculosis H37Rv
cgccgugcggguu

SEQ ID NO: 1349594 - RNA, 15 nt, Mycobacterium tuberculosis H37Rv
cgccgugcugcggcg

SEQ ID NO: 1349595 - RNA, 23 nt, Mycobacterium tuberculosis H37Rv
cgccguggccugaaacggcugca

SEQ ID NO: 1349596 - RNA, 20 nt, Mycobacterium tuberculosis H37Rv
cgccgucgccacgcccagcg

SEQ ID NO: 1349597 - RNA, 15 nt, Mycobacterium tuberculosis H37Rv
cgccgucgccgccgc

SEQ ID NO: 1349598 - RNA, 16 nt, Mycobacterium tuberculosis H37Rv
cgccgucgccgccggc

SEQ ID NO: 1349599 - RNA, 12 nt, Mycobacterium tuberculosis H37Rv
cgccgucggcgc

SEQ ID NO: 1349600 - RNA, 18 nt, Mycobacterium tuberculosis H37Rv
cgccgucgagcacgguga

SEQ ID NO: 1349601 - RNA, 17 nt, Mycobacterium tuberculosis H37Rv
cgccgucgacgcggccg

SEQ ID NO: 1349602 - RNA, 17 nt, Mycobacterium tuberculosis H37Rv
cgccgucgaccggcggg

SEQ ID NO: 1349603 - RNA, 22 nt, Mycobacterium tuberculosis H37Rv
cgccgucgacaacaaacccggc

SEQ ID NO: 1349604 - RNA, 23 nt, Mycobacterium tuberculosis H37Rv
cgccgucguacucgaccgcgagc

SEQ ID NO: 1349605 - RNA, 13 nt, Mycobacterium tuberculosis H37Rv
cgccgucgggccu

SEQ ID NO: 1349606 - RNA, 21 nt, Mycobacterium tuberculosis H37Rv
cgccgucguugugccggucga

SEQ ID NO: 1349607 - RNA, 21 nt, Mycobacterium tuberculosis H37Rv
cgccgucggguccgcggcccu

SEQ ID NO: 1349608 - RNA, 19 nt, Mycobacterium tuberculosis H37Rv
cgccgucggguuccuccuc

SEQ ID NO: 1349609 - RNA, 20 nt, Mycobacterium tuberculosis H37Rv
cgccgugacccauucucggc

SEQ ID NO: 1349610 - RNA, 20 nt, Mycobacterium tuberculosis H37Rv
cgccgucuuggcccgguccg

SEQ ID NO: 1349611 - RNA, 16 nt, Mycobacterium tuberculosis H37Rv
cgccgucucgcggugc

SEQ ID NO: 1349612 - RNA, 16 nt, Mycobacterium tuberculosis H37Rv
cgccgucucugccacg

SEQ ID NO: 1349613 - RNA, 23 nt, Mycobacterium tuberculosis H37Rv
cgccucaaugaccaccgggcgcu

SEQ ID NO: 1349614 - RNA, 17 nt, Mycobacterium tuberculosis H37Rv
cgccucaaugaccaccg

SEQ ID NO: 1349615 - RNA, 19 nt, Mycobacterium tuberculosis H37Rv
cgccucaaugaccaccggg

SEQ ID NO: 1349616 - RNA, 17 nt, Mycobacterium tuberculosis H37Rv
cgccucaagcucgccgg

SEQ ID NO: 1349617 - RNA, 22 nt, Mycobacterium tuberculosis H37Rv
cgccuagcgagcgcacaccggc

SEQ ID NO: 1349618 - RNA, 14 nt, Mycobacterium tuberculosis H37Rv
cgccguugccgccu

SEQ ID NO: 1349619 - RNA, 15 nt, Mycobacterium tuberculosis H37Rv
cgccguugccgccgu

SEQ ID NO: 1349620 - RNA, 17 nt, Mycobacterium tuberculosis H37Rv
cgccguugccgccgccu

SEQ ID NO: 1349621 - RNA, 18 nt, Mycobacterium tuberculosis H37Rv
cgccguugccgccagcgc

SEQ ID NO: 1349622 - RNA, 15 nt, Mycobacterium tuberculosis H37Rv
cgccguugccggcuu

SEQ ID NO: 1349623 - RNA, 15 nt, Mycobacterium tuberculosis H37Rv
cgccguugccggcca

SEQ ID NO: 1349624 - RNA, 14 nt, Mycobacterium tuberculosis H37Rv
cgccguuggcaccg

SEQ ID NO: 1349625 - RNA, 19 nt, Mycobacterium tuberculosis H37Rv
cgccguugggccgcgcccu

SEQ ID NO: 1349626 - RNA, 15 nt, Mycobacterium tuberculosis H37Rv
cgccguugggccgcg

SEQ ID NO: 1349627 - RNA, 15 nt, Mycobacterium tuberculosis H37Rv
cgccguugucggcgg

SEQ ID NO: 1349628 - RNA, 21 nt, Mycobacterium tuberculosis H37Rv
cgccguuuccgccgccgccau

SEQ ID NO: 1349629 - RNA, 18 nt, Mycobacterium tuberculosis H37Rv
cgccguucccacccacgc

SEQ ID NO: 1349630 - RNA, 16 nt, Mycobacterium tuberculosis H37Rv
cgccguucccgccggc

SEQ ID NO: 1349631 - RNA, 21 nt, Mycobacterium tuberculosis H37Rv
cgccguugaacggcaccagcg

SEQ ID NO: 1349632 - RNA, 16 nt, Mycobacterium tuberculosis H37Rv
cgccguucgucgugga

SEQ ID NO: 1349633 - RNA, 22 nt, Mycobacterium tuberculosis H37Rv
cgccguugaugucggcagguac

SEQ ID NO: 1349634 - RNA, 18 nt, Mycobacterium tuberculosis H37Rv
cgccguugaugucggcag

SEQ ID NO: 1349635 - RNA, 15 nt, Mycobacterium tuberculosis H37Rv
cgccguugacgccgu

SEQ ID NO: 1349636 - RNA, 20 nt, Mycobacterium tuberculosis H37Rv
cgccguugccgauccccagg

SEQ ID NO: 1349637 - RNA, 21 nt, Mycobacterium tuberculosis H37Rv
cgccguugccgauccccaggc

SEQ ID NO: 1349638 - RNA, 21 nt, Mycobacterium tuberculosis H37Rv
cgccguugccgaucagcccgg

SEQ ID NO: 1349639 - RNA, 19 nt, Mycobacterium tuberculosis H37Rv
cgccguugccgaucagccc

SEQ ID NO: 1349640 - RNA, 15 nt, Mycobacterium tuberculosis H37Rv
cgcgauguccaggug

SEQ ID NO: 1349641 - RNA, 17 nt, Mycobacterium tuberculosis H37Rv
cgcgauguccagguggc

SEQ ID NO: 1349642 - RNA, 14 nt, Mycobacterium tuberculosis H37Rv
cgcgaugcuucccg

SEQ ID NO: 1349643 - RNA, 14 nt, Mycobacterium tuberculosis H37Rv
cgcgauggacccaa

SEQ ID NO: 1349644 - RNA, 21 nt, Mycobacterium tuberculosis H37Rv
cgcgauguccucgagcaccgc

SEQ ID NO: 1349645 - RNA, 20 nt, Mycobacterium tuberculosis H37Rv
cgcgauuagcaaaccgaccg

SEQ ID NO: 1349646 - RNA, 13 nt, Mycobacterium tuberculosis H37Rv
cgcgauucagaca

SEQ ID NO: 1349647 - RNA, 14 nt, Mycobacterium tuberculosis H37Rv
cgcgcaacccugcc

SEQ ID NO: 1349648 - RNA, 16 nt, Mycobacterium tuberculosis H37Rv
cgcgcaacccggacga

SEQ ID NO: 1349649 - RNA, 17 nt, Mycobacterium tuberculosis H37Rv
cgcgcaaaugccugcug

SEQ ID NO: 1349650 - RNA, 16 nt, Mycobacterium tuberculosis H37Rv
cgcgcaacacauccag

SEQ ID NO: 1349651 - RNA, 18 nt, Mycobacterium tuberculosis H37Rv
cgcgcaaaugccugcugg

SEQ ID NO: 1349652 - RNA, 16 nt, Mycobacterium tuberculosis H37Rv
cgcgcacccagcccag

SEQ ID NO: 1349653 - RNA, 15 nt, Mycobacterium tuberculosis H37Rv
cgcgcaccccggcau

SEQ ID NO: 1349654 - RNA, 13 nt, Mycobacterium tuberculosis H37Rv
cgcgcaccaccgc

SEQ ID NO: 1349655 - RNA, 17 nt, Mycobacterium tuberculosis H37Rv
cgcgcaccaacaccagc

SEQ ID NO: 1349656 - RNA, 16 nt, Mycobacterium tuberculosis H37Rv
cgcgcaccaacaccag

SEQ ID NO: 1349657 - RNA, 15 nt, Mycobacterium tuberculosis H37Rv
cgcgcaaggcgccgc

SEQ ID NO: 1349658 - RNA, 21 nt, Mycobacterium tuberculosis H37Rv
cgcgcaacguacgcacgcagc

SEQ ID NO: 1349659 - RNA, 17 nt, Mycobacterium tuberculosis H37Rv
cgcgcaacguagccagc

SEQ ID NO: 1349660 - RNA, 23 nt, Mycobacterium tuberculosis H37Rv
cgcgauagauacccgcggcagca

SEQ ID NO: 1349661 - RNA, 16 nt, Mycobacterium tuberculosis H37Rv
cgcgaucagcgcgcac

SEQ ID NO: 1349662 - RNA, 20 nt, Mycobacterium tuberculosis H37Rv
cgcgaucaccucgccacacu

SEQ ID NO: 1349663 - RNA, 14 nt, Mycobacterium tuberculosis H37Rv
cgcgaucaccgacg

SEQ ID NO: 1349664 - RNA, 21 nt, Mycobacterium tuberculosis H37Rv
cgcgaucaccgacgaugccgc

SEQ ID NO: 1349665 - RNA, 16 nt, Mycobacterium tuberculosis H37Rv
cgcgaucaccgagucg

SEQ ID NO: 1349666 - RNA, 19 nt, Mycobacterium tuberculosis H37Rv
cgcgagguugaccaccagc

SEQ ID NO: 1349667 - RNA, 23 nt, Mycobacterium tuberculosis H37Rv
cgcgagguugaccaccagcgugc

SEQ ID NO: 1349668 - RNA, 21 nt, Mycobacterium tuberculosis H37Rv
cgcgaggucggcggcgcaggu

SEQ ID NO: 1349669 - RNA, 22 nt, Mycobacterium tuberculosis H37Rv
cgcgaguaagcgaacagcggca

SEQ ID NO: 1349670 - RNA, 21 nt, Mycobacterium tuberculosis H37Rv
cgcgaucaugguggggaccgc

SEQ ID NO: 1349671 - RNA, 15 nt, Mycobacterium tuberculosis H37Rv
cgcgauccgcgcgca

SEQ ID NO: 1349672 - RNA, 13 nt, Mycobacterium tuberculosis H37Rv
cgcgaucgcagug

SEQ ID NO: 1349673 - RNA, 20 nt, Mycobacterium tuberculosis H37Rv
cgcgaucgggcccagcagcg

SEQ ID NO: 1349674 - RNA, 14 nt, Mycobacterium tuberculosis H37Rv
cgcgaucgggccgg

SEQ ID NO: 1349675 - RNA, 19 nt, Mycobacterium tuberculosis H37Rv
cgcgaucgucacggaggcc

SEQ ID NO: 1349676 - RNA, 14 nt, Mycobacterium tuberculosis H37Rv
cgcgaugaccucgg

SEQ ID NO: 1349677 - RNA, 14 nt, Mycobacterium tuberculosis H37Rv
cgcgaucucggagc

SEQ ID NO: 1349678 - RNA, 16 nt, Mycobacterium tuberculosis H37Rv
cgcgaucucggagcgc

SEQ ID NO: 1349679 - RNA, 13 nt, Mycobacterium tuberculosis H37Rv
cgcgaucgcgccc

SEQ ID NO: 1349680 - RNA, 16 nt, Mycobacterium tuberculosis H37Rv
cgcgaucugcucgccc

SEQ ID NO: 1349681 - RNA, 15 nt, Mycobacterium tuberculosis H37Rv
cgcgaugcgcaccag

SEQ ID NO: 1349682 - RNA, 13 nt, Mycobacterium tuberculosis H37Rv
cgcgaugagcggc

SEQ ID NO: 1349683 - RNA, 18 nt, Mycobacterium tuberculosis H37Rv
cgcgagcagacgcagaag

SEQ ID NO: 1349684 - RNA, 23 nt, Mycobacterium tuberculosis H37Rv
cgcgagaucgggccggccgccgc

SEQ ID NO: 1349685 - RNA, 15 nt, Mycobacterium tuberculosis H37Rv
cgcgagcaacaccag

SEQ ID NO: 1349686 - RNA, 15 nt, Mycobacterium tuberculosis H37Rv
cgcgagccagcugcu

SEQ ID NO: 1349687 - RNA, 23 nt, Mycobacterium tuberculosis H37Rv
cgcgagcccggccucggcgagca

SEQ ID NO: 1349688 - RNA, 15 nt, Mycobacterium tuberculosis H37Rv
cgcgagcgcggcgga

SEQ ID NO: 1349689 - RNA, 13 nt, Mycobacterium tuberculosis H37Rv
cgcgagcgcgcga

SEQ ID NO: 1349690 - RNA, 18 nt, Mycobacterium tuberculosis H37Rv
cgcgaggucggcggcgca

SEQ ID NO: 1349691 - RNA, 21 nt, Mycobacterium tuberculosis H37Rv
cgcgagcuuggccagcagcag

SEQ ID NO: 1349692 - RNA, 13 nt, Mycobacterium tuberculosis H37Rv
cgcgaggaacgcc

SEQ ID NO: 1349693 - RNA, 17 nt, Mycobacterium tuberculosis H37Rv
cgcgacuagacgccgcc

SEQ ID NO: 1349694 - RNA, 20 nt, Mycobacterium tuberculosis H37Rv
cgcgacuaccaucgccgccc

SEQ ID NO: 1349695 - RNA, 15 nt, Mycobacterium tuberculosis H37Rv
cgcgagaacacccgu

SEQ ID NO: 1349696 - RNA, 15 nt, Mycobacterium tuberculosis H37Rv
cgcgacguagacgac

SEQ ID NO: 1349697 - RNA, 16 nt, Mycobacterium tuberculosis H37Rv
cgcgacguccaccagc

SEQ ID NO: 1349698 - RNA, 13 nt, Mycobacterium tuberculosis H37Rv
cgcgacgcggggc

SEQ ID NO: 1349699 - RNA, 15 nt, Mycobacterium tuberculosis H37Rv
cgcgacgcggggcuc

SEQ ID NO: 1349700 - RNA, 21 nt, Mycobacterium tuberculosis H37Rv
cgcgacgcucgcugcagcagg

SEQ ID NO: 1349701 - RNA, 13 nt, Mycobacterium tuberculosis H37Rv
cgcgacggcgccc

SEQ ID NO: 1349702 - RNA, 14 nt, Mycobacterium tuberculosis H37Rv
cgcgacgagcaugc

SEQ ID NO: 1349703 - RNA, 15 nt, Mycobacterium tuberculosis H37Rv
cgcgacgaucgucca

SEQ ID NO: 1349704 - RNA, 20 nt, Mycobacterium tuberculosis H37Rv
cgcgaccgucagggucaccu

SEQ ID NO: 1349705 - RNA, 14 nt, Mycobacterium tuberculosis H37Rv
cgcgacccgcgcaa

SEQ ID NO: 1349706 - RNA, 12 nt, Mycobacterium tuberculosis H37Rv
cgcgaccaggaa

SEQ ID NO: 1349707 - RNA, 23 nt, Mycobacterium tuberculosis H37Rv
cgcgaccccugguagcacccacg

SEQ ID NO: 1349708 - RNA, 13 nt, Mycobacterium tuberculosis H37Rv
cgcgaccacccgc

SEQ ID NO: 1349709 - RNA, 19 nt, Mycobacterium tuberculosis H37Rv
cgcgaccacgcaccgcccc

SEQ ID NO: 1349710 - RNA, 17 nt, Mycobacterium tuberculosis H37Rv
cgcgaccaccgccgagc

SEQ ID NO: 1349711 - RNA, 16 nt, Mycobacterium tuberculosis H37Rv
cgcgaccagccagcga

SEQ ID NO: 1349712 - RNA, 14 nt, Mycobacterium tuberculosis H37Rv
cgcgaccagcgccg

SEQ ID NO: 1349713 - RNA, 15 nt, Mycobacterium tuberculosis H37Rv
cgcgaccagcgccgc

SEQ ID NO: 1349714 - RNA, 21 nt, Mycobacterium tuberculosis H37Rv
cgcgaccagcgccgcacccgc

SEQ ID NO: 1349715 - RNA, 17 nt, Mycobacterium tuberculosis H37Rv
cgcgacacgcggcccga

SEQ ID NO: 1349716 - RNA, 13 nt, Mycobacterium tuberculosis H37Rv
cgcgacacgcggc

SEQ ID NO: 1349717 - RNA, 15 nt, Mycobacterium tuberculosis H37Rv
cgcgacacgcggccc

SEQ ID NO: 1349718 - RNA, 15 nt, Mycobacterium tuberculosis H37Rv
cgcgaaugucgccgc

SEQ ID NO: 1349719 - RNA, 23 nt, Mycobacterium tuberculosis H37Rv
cgcgacacgccggcgggcugucg

SEQ ID NO: 1349720 - RNA, 22 nt, Mycobacterium tuberculosis H37Rv
cgcgacaaaguucgacgagaag

SEQ ID NO: 1349721 - RNA, 16 nt, Mycobacterium tuberculosis H37Rv
cgcgacacacgccgcc

SEQ ID NO: 1349722 - RNA, 16 nt, Mycobacterium tuberculosis H37Rv
cgcgcaucaucgccca

SEQ ID NO: 1349723 - RNA, 21 nt, Mycobacterium tuberculosis H37Rv
cgcgcagguagcgccgcacuu

SEQ ID NO: 1349724 - RNA, 21 nt, Mycobacterium tuberculosis H37Rv
cgcgcauucgggaucggccgg

SEQ ID NO: 1349725 - RNA, 20 nt, Mycobacterium tuberculosis H37Rv
cgcgcaucaucgcccaccgc

SEQ ID NO: 1349726 - RNA, 14 nt, Mycobacterium tuberculosis H37Rv
cgcgcauccgcagc

SEQ ID NO: 1349727 - RNA, 17 nt, Mycobacterium tuberculosis H37Rv
cgcgcaucugucgcgcg

SEQ ID NO: 1349728 - RNA, 19 nt, Mycobacterium tuberculosis H37Rv
cgcgcaucugucgcgcggc

SEQ ID NO: 1349729 - RNA, 15 nt, Mycobacterium tuberculosis H37Rv
cgcgccaccagcacc

SEQ ID NO: 1349730 - RNA, 16 nt, Mycobacterium tuberculosis H37Rv
cgcgccacccagcacc

SEQ ID NO: 1349731 - RNA, 11 nt, Mycobacterium tuberculosis H37Rv
cgcgccaccga

SEQ ID NO: 1349732 - RNA, 20 nt, Mycobacterium tuberculosis H37Rv
cgcgccaaacaccccggccu

SEQ ID NO: 1349733 - RNA, 20 nt, Mycobacterium tuberculosis H37Rv
cgcgcauugccgacgcgcgg

SEQ ID NO: 1349734 - RNA, 21 nt, Mycobacterium tuberculosis H37Rv
cgcgcauugccgacgcgcggc

SEQ ID NO: 1349735 - RNA, 17 nt, Mycobacterium tuberculosis H37Rv
cgcgcauuucguggcgc

SEQ ID NO: 1349736 - RNA, 18 nt, Mycobacterium tuberculosis H37Rv
cgcgcaucgccuccucga

SEQ ID NO: 1349737 - RNA, 23 nt, Mycobacterium tuberculosis H37Rv
cgcgccaccgagcccuccagggc

SEQ ID NO: 1349738 - RNA, 16 nt, Mycobacterium tuberculosis H37Rv
cgcgccacgcacccgg

SEQ ID NO: 1349739 - RNA, 14 nt, Mycobacterium tuberculosis H37Rv
cgcgccagccucca

SEQ ID NO: 1349740 - RNA, 16 nt, Mycobacterium tuberculosis H37Rv
cgcgcaccggaucgcc

SEQ ID NO: 1349741 - RNA, 18 nt, Mycobacterium tuberculosis H37Rv
cgcgcacgacaacuucgc

SEQ ID NO: 1349742 - RNA, 16 nt, Mycobacterium tuberculosis H37Rv
cgcgcacgccaccggg

SEQ ID NO: 1349743 - RNA, 19 nt, Mycobacterium tuberculosis H37Rv
cgcgcagaucguccaccgc

SEQ ID NO: 1349744 - RNA, 23 nt, Mycobacterium tuberculosis H37Rv
cgcgcagaaagucgcgcgcgaac

SEQ ID NO: 1349745 - RNA, 19 nt, Mycobacterium tuberculosis H37Rv
cgcgcagcugccgcacccc

SEQ ID NO: 1349746 - RNA, 22 nt, Mycobacterium tuberculosis H37Rv
cgcgcaggcuuccagccacagc

SEQ ID NO: 1349747 - RNA, 17 nt, Mycobacterium tuberculosis H37Rv
cgcgcagcgucaaaccu

SEQ ID NO: 1349748 - RNA, 14 nt, Mycobacterium tuberculosis H37Rv
cgcgcagcuccacc

SEQ ID NO: 1349749 - RNA, 22 nt, Mycobacterium tuberculosis H37Rv
cgcgcagcaucuccgccggucc

SEQ ID NO: 1349750 - RNA, 15 nt, Mycobacterium tuberculosis H37Rv
cgcgccgcggcccgc

SEQ ID NO: 1349751 - RNA, 13 nt, Mycobacterium tuberculosis H37Rv
cgcgccgcgcauc

SEQ ID NO: 1349752 - RNA, 13 nt, Mycobacterium tuberculosis H37Rv
cgcgccgcgccgc

SEQ ID NO: 1349753 - RNA, 15 nt, Mycobacterium tuberculosis H37Rv
cgcgccgcgccgccu

SEQ ID NO: 1349754 - RNA, 15 nt, Mycobacterium tuberculosis H37Rv
cgcgccgccagcgcc

SEQ ID NO: 1349755 - RNA, 16 nt, Mycobacterium tuberculosis H37Rv
cgcgccgccagcgccg

SEQ ID NO: 1349756 - RNA, 23 nt, Mycobacterium tuberculosis H37Rv
cgcgccgccagcgccgccggcac

SEQ ID NO: 1349757 - RNA, 17 nt, Mycobacterium tuberculosis H37Rv
cgcgccgauuccaccgc

SEQ ID NO: 1349758 - RNA, 23 nt, Mycobacterium tuberculosis H37Rv
cgcgccgaguugcccgggucggc

SEQ ID NO: 1349759 - RNA, 17 nt, Mycobacterium tuberculosis H37Rv
cgcgccgaguugcccgg

SEQ ID NO: 1349760 - RNA, 19 nt, Mycobacterium tuberculosis H37Rv
cgcgccgaccaccgcugcg

SEQ ID NO: 1349761 - RNA, 16 nt, Mycobacterium tuberculosis H37Rv
cgcgcccgagaccggc

SEQ ID NO: 1349762 - RNA, 19 nt, Mycobacterium tuberculosis H37Rv
cgcgcccgggcauccuuca

SEQ ID NO: 1349763 - RNA, 19 nt, Mycobacterium tuberculosis H37Rv
cgcgcccgggcggaacgcc

SEQ ID NO: 1349764 - RNA, 14 nt, Mycobacterium tuberculosis H37Rv
cgcgcccuagcugg

SEQ ID NO: 1349765 - RNA, 20 nt, Mycobacterium tuberculosis H37Rv
cgcgcccuagcuggugcgcc

SEQ ID NO: 1349766 - RNA, 21 nt, Mycobacterium tuberculosis H37Rv
cgcgcccgccaucagcccggc

SEQ ID NO: 1349767 - RNA, 13 nt, Mycobacterium tuberculosis H37Rv
cgcgcccgcgggc

SEQ ID NO: 1349768 - RNA, 19 nt, Mycobacterium tuberculosis H37Rv
cgcgccccagacgcgcagg

SEQ ID NO: 1349769 - RNA, 16 nt, Mycobacterium tuberculosis H37Rv
cgcgcccaccccggcc

SEQ ID NO: 1349770 - RNA, 22 nt, Mycobacterium tuberculosis H37Rv
cgcgccaggcgcgaucgcgccc

SEQ ID NO: 1349771 - RNA, 17 nt, Mycobacterium tuberculosis H37Rv
cgguugucgcagcgcac

SEQ ID NO: 1349772 - RNA, 17 nt, Mycobacterium tuberculosis H37Rv
cgguugugcgcgcgccc

SEQ ID NO: 1349773 - RNA, 18 nt, Mycobacterium tuberculosis H37Rv
cgguugggguggcggugc

SEQ ID NO: 1349774 - RNA, 22 nt, Mycobacterium tuberculosis H37Rv
cgguuggccagccacagccgac

SEQ ID NO: 1349775 - RNA, 15 nt, Mycobacterium tuberculosis H37Rv
cgguuggccagccac

SEQ ID NO: 1349776 - RNA, 13 nt, Mycobacterium tuberculosis H37Rv
cgguuggcagugg

SEQ ID NO: 1349777 - RNA, 14 nt, Mycobacterium tuberculosis H37Rv
cgguugccggcggc

SEQ ID NO: 1349778 - RNA, 15 nt, Mycobacterium tuberculosis H37Rv
cgguugccccgaccg

SEQ ID NO: 1349779 - RNA, 15 nt, Mycobacterium tuberculosis H37Rv
cgguugcccccaggg

SEQ ID NO: 1349780 - RNA, 16 nt, Mycobacterium tuberculosis H37Rv
cgguugccuucuuggc

SEQ ID NO: 1349781 - RNA, 20 nt, Mycobacterium tuberculosis H37Rv
cgguuuccuccggcagcagc

SEQ ID NO: 1349782 - RNA, 18 nt, Mycobacterium tuberculosis H37Rv
cgguuguggaaccacggc

SEQ ID NO: 1349783 - RNA, 16 nt, Mycobacterium tuberculosis H37Rv
cgguuugcguccuggu

SEQ ID NO: 1349784 - RNA, 13 nt, Mycobacterium tuberculosis H37Rv
cgguuugcagcgg

SEQ ID NO: 1349785 - RNA, 16 nt, Mycobacterium tuberculosis H37Rv
cgguuuucggcugccg

SEQ ID NO: 1349786 - RNA, 14 nt, Mycobacterium tuberculosis H37Rv
cguaaccggcagcg

SEQ ID NO: 1349787 - RNA, 15 nt, Mycobacterium tuberculosis H37Rv
cguaacgccgcucau

SEQ ID NO: 1349788 - RNA, 22 nt, Mycobacterium tuberculosis H37Rv
cggugggcuuggcgccgaugcc

SEQ ID NO: 1349789 - RNA, 15 nt, Mycobacterium tuberculosis H37Rv
cgguggguagccagc

SEQ ID NO: 1349790 - RNA, 17 nt, Mycobacterium tuberculosis H37Rv
cggugggcacagccagu

SEQ ID NO: 1349791 - RNA, 15 nt, Mycobacterium tuberculosis H37Rv
cggugggcgguccgc

SEQ ID NO: 1349792 - RNA, 17 nt, Mycobacterium tuberculosis H37Rv
cgguggucccccgcagc

SEQ ID NO: 1349793 - RNA, 22 nt, Mycobacterium tuberculosis H37Rv
cggugguagcggacagcucgcg

SEQ ID NO: 1349794 - RNA, 19 nt, Mycobacterium tuberculosis H37Rv
cggugguaggacgccagca

SEQ ID NO: 1349795 - RNA, 19 nt, Mycobacterium tuberculosis H37Rv
cggugguacgugcgagccc

SEQ ID NO: 1349796 - RNA, 15 nt, Mycobacterium tuberculosis H37Rv
cggugggugcgacac

SEQ ID NO: 1349797 - RNA, 23 nt, Mycobacterium tuberculosis H37Rv
cggugucaguccgacaccacgga

SEQ ID NO: 1349798 - RNA, 18 nt, Mycobacterium tuberculosis H37Rv
cgguggucugcgcggugc

SEQ ID NO: 1349799 - RNA, 16 nt, Mycobacterium tuberculosis H37Rv
cgguggucggcgcgcc

SEQ ID NO: 1349800 - RNA, 16 nt, Mycobacterium tuberculosis H37Rv
cggugucccgcgaggc

SEQ ID NO: 1349801 - RNA, 15 nt, Mycobacterium tuberculosis H37Rv
cgguguccagccacg

SEQ ID NO: 1349802 - RNA, 15 nt, Mycobacterium tuberculosis H37Rv
cgguguccagugcau

SEQ ID NO: 1349803 - RNA, 15 nt, Mycobacterium tuberculosis H37Rv
cggugucgcgaugcu

SEQ ID NO: 1349804 - RNA, 17 nt, Mycobacterium tuberculosis H37Rv
cggugucgggcugucag

SEQ ID NO: 1349805 - RNA, 22 nt, Mycobacterium tuberculosis H37Rv
cggugucguucggcgaggacgg

SEQ ID NO: 1349806 - RNA, 19 nt, Mycobacterium tuberculosis H37Rv
cggugucgggcuggguggc

SEQ ID NO: 1349807 - RNA, 20 nt, Mycobacterium tuberculosis H37Rv
cggugucugcaaagucgggg

SEQ ID NO: 1349808 - RNA, 18 nt, Mycobacterium tuberculosis H37Rv
cggugugccagugcugca

SEQ ID NO: 1349809 - RNA, 21 nt, Mycobacterium tuberculosis H37Rv
cggugugcaucgacucacgga

SEQ ID NO: 1349810 - RNA, 18 nt, Mycobacterium tuberculosis H37Rv
cggugugcggcgcaugca

SEQ ID NO: 1349811 - RNA, 20 nt, Mycobacterium tuberculosis H37Rv
cggugcacacugaccccgcc

SEQ ID NO: 1349812 - RNA, 21 nt, Mycobacterium tuberculosis H37Rv
cggugcacggcgcuaccagcc

SEQ ID NO: 1349813 - RNA, 18 nt, Mycobacterium tuberculosis H37Rv
cggugcacgagcggacag

SEQ ID NO: 1349814 - RNA, 14 nt, Mycobacterium tuberculosis H37Rv
cggugcagcccgcc

SEQ ID NO: 1349815 - RNA, 22 nt, Mycobacterium tuberculosis H37Rv
cggugcagcacgugugcgggca

SEQ ID NO: 1349816 - RNA, 12 nt, Mycobacterium tuberculosis H37Rv
cggugcagcacg

SEQ ID NO: 1349817 - RNA, 12 nt, Mycobacterium tuberculosis H37Rv
cggugcccacca

SEQ ID NO: 1349818 - RNA, 17 nt, Mycobacterium tuberculosis H37Rv
cggugccagcacuccac

SEQ ID NO: 1349819 - RNA, 18 nt, Mycobacterium tuberculosis H37Rv
cggugccgaagcugccca

SEQ ID NO: 1349820 - RNA, 12 nt, Mycobacterium tuberculosis H37Rv
cggugccaccgg

SEQ ID NO: 1349821 - RNA, 12 nt, Mycobacterium tuberculosis H37Rv
cggugccaccag

SEQ ID NO: 1349822 - RNA, 19 nt, Mycobacterium tuberculosis H37Rv
cggugccacguucgcgggc

SEQ ID NO: 1349823 - RNA, 23 nt, Mycobacterium tuberculosis H37Rv
cggugccacggugacccuggugg

SEQ ID NO: 1349824 - RNA, 18 nt, Mycobacterium tuberculosis H37Rv
cgguggagcgcgggaugu

SEQ ID NO: 1349825 - RNA, 15 nt, Mycobacterium tuberculosis H37Rv
cgguggagcgcgccu

SEQ ID NO: 1349826 - RNA, 16 nt, Mycobacterium tuberculosis H37Rv
cgguggccaacaccgc

SEQ ID NO: 1349827 - RNA, 14 nt, Mycobacterium tuberculosis H37Rv
cgguggcacgcuga

SEQ ID NO: 1349828 - RNA, 12 nt, Mycobacterium tuberculosis H37Rv
cgguggcaccau

SEQ ID NO: 1349829 - RNA, 20 nt, Mycobacterium tuberculosis H37Rv
cgguggccaacaccgccagc

SEQ ID NO: 1349830 - RNA, 16 nt, Mycobacterium tuberculosis H37Rv
cgguggccaucgcgcg

SEQ ID NO: 1349831 - RNA, 21 nt, Mycobacterium tuberculosis H37Rv
cgguggccaucgcgcggacca

SEQ ID NO: 1349832 - RNA, 15 nt, Mycobacterium tuberculosis H37Rv
cgguggccgcggcgg

SEQ ID NO: 1349833 - RNA, 16 nt, Mycobacterium tuberculosis H37Rv
cgguccugccaaugcu

SEQ ID NO: 1349834 - RNA, 18 nt, Mycobacterium tuberculosis H37Rv
cgguccugcucgcacagc

SEQ ID NO: 1349835 - RNA, 23 nt, Mycobacterium tuberculosis H37Rv
cgguccggcgaaaagacugcgcc

SEQ ID NO: 1349836 - RNA, 16 nt, Mycobacterium tuberculosis H37Rv
cgguccgccgcagacc

SEQ ID NO: 1349837 - RNA, 16 nt, Mycobacterium tuberculosis H37Rv
cgguccggcccaccag

SEQ ID NO: 1349838 - RNA, 15 nt, Mycobacterium tuberculosis H37Rv
cgguccggcccgggg

SEQ ID NO: 1349839 - RNA, 22 nt, Mycobacterium tuberculosis H37Rv
cgguccgguacucguccgcggg

SEQ ID NO: 1349840 - RNA, 23 nt, Mycobacterium tuberculosis H37Rv
cggucccaugugcccgcacccgc

SEQ ID NO: 1349841 - RNA, 16 nt, Mycobacterium tuberculosis H37Rv
cggucccgcauauccg

SEQ ID NO: 1349842 - RNA, 17 nt, Mycobacterium tuberculosis H37Rv
cggucccguugccgccc

SEQ ID NO: 1349843 - RNA, 21 nt, Mycobacterium tuberculosis H37Rv
cggucccuuuguggggccggg

SEQ ID NO: 1349844 - RNA, 15 nt, Mycobacterium tuberculosis H37Rv
cgguccgccacggcg

SEQ ID NO: 1349845 - RNA, 18 nt, Mycobacterium tuberculosis H37Rv
cgguccgccacggcgggc

SEQ ID NO: 1349846 - RNA, 13 nt, Mycobacterium tuberculosis H37Rv
cgguccgccgccu

SEQ ID NO: 1349847 - RNA, 21 nt, Mycobacterium tuberculosis H37Rv
cgguccagccaacgggaacaa

SEQ ID NO: 1349848 - RNA, 18 nt, Mycobacterium tuberculosis H37Rv
cgguccagccaccgccgc

SEQ ID NO: 1349849 - RNA, 17 nt, Mycobacterium tuberculosis H37Rv
cgguccagacaucagug

SEQ ID NO: 1349850 - RNA, 15 nt, Mycobacterium tuberculosis H37Rv
cgguccagcgccggc

SEQ ID NO: 1349851 - RNA, 20 nt, Mycobacterium tuberculosis H37Rv
cgguccagccgguccagacc

SEQ ID NO: 1349852 - RNA, 13 nt, Mycobacterium tuberculosis H37Rv
cgguccagggccu

SEQ ID NO: 1349853 - RNA, 17 nt, Mycobacterium tuberculosis H37Rv
cgguccauggacggcca

SEQ ID NO: 1349854 - RNA, 19 nt, Mycobacterium tuberculosis H37Rv
cgguccauucguccgcggu

SEQ ID NO: 1349855 - RNA, 15 nt, Mycobacterium tuberculosis H37Rv
cgguccagggccugu

SEQ ID NO: 1349856 - RNA, 13 nt, Mycobacterium tuberculosis H37Rv
cgguccaucccga

SEQ ID NO: 1349857 - RNA, 16 nt, Mycobacterium tuberculosis H37Rv
cgguccaucccgagcu

SEQ ID NO: 1349858 - RNA, 22 nt, Mycobacterium tuberculosis H37Rv
cgguccaaaacaccgccagcuc

SEQ ID NO: 1349859 - RNA, 20 nt, Mycobacterium tuberculosis H37Rv
cgguccaaaacaccgccagc

SEQ ID NO: 1349860 - RNA, 17 nt, Mycobacterium tuberculosis H37Rv
cggucauccggccgucg

SEQ ID NO: 1349861 - RNA, 14 nt, Mycobacterium tuberculosis H37Rv
cgguccaccggccc

SEQ ID NO: 1349862 - RNA, 22 nt, Mycobacterium tuberculosis H37Rv
cgguccacugucagcgauccuc

SEQ ID NO: 1349863 - RNA, 15 nt, Mycobacterium tuberculosis H37Rv
cgggucgaugacgcc

SEQ ID NO: 1349864 - RNA, 13 nt, Mycobacterium tuberculosis H37Rv
cgggucgccgcca

SEQ ID NO: 1349865 - RNA, 17 nt, Mycobacterium tuberculosis H37Rv
cgggucgcaccccggcg

SEQ ID NO: 1349866 - RNA, 20 nt, Mycobacterium tuberculosis H37Rv
cggguccgccgggccccggg

SEQ ID NO: 1349867 - RNA, 18 nt, Mycobacterium tuberculosis H37Rv
cggguccuauccgggccc

SEQ ID NO: 1349868 - RNA, 16 nt, Mycobacterium tuberculosis H37Rv
cggguccucgcggagc

SEQ ID NO: 1349869 - RNA, 16 nt, Mycobacterium tuberculosis H37Rv
cggguccgacagcccc

SEQ ID NO: 1349870 - RNA, 19 nt, Mycobacterium tuberculosis H37Rv
cggguccgacagccccggc

SEQ ID NO: 1349871 - RNA, 14 nt, Mycobacterium tuberculosis H37Rv
cggguccgccgggc

SEQ ID NO: 1349872 - RNA, 15 nt, Mycobacterium tuberculosis H37Rv
cggguccgccgggcc

SEQ ID NO: 1349873 - RNA, 15 nt, Mycobacterium tuberculosis H37Rv
cggucacacgccagc

SEQ ID NO: 1349874 - RNA, 16 nt, Mycobacterium tuberculosis H37Rv
cggucacacgccagcc

SEQ ID NO: 1349875 - RNA, 18 nt, Mycobacterium tuberculosis H37Rv
cggucaaucccggccagg

SEQ ID NO: 1349876 - RNA, 21 nt, Mycobacterium tuberculosis H37Rv
cggucaaucccggccaggggc

SEQ ID NO: 1349877 - RNA, 18 nt, Mycobacterium tuberculosis H37Rv
cggucaaggugcgccgcc

SEQ ID NO: 1349878 - RNA, 20 nt, Mycobacterium tuberculosis H37Rv
cggucaaggugcgccgccau

SEQ ID NO: 1349879 - RNA, 14 nt, Mycobacterium tuberculosis H37Rv
cggucacgguggug

SEQ ID NO: 1349880 - RNA, 13 nt, Mycobacterium tuberculosis H37Rv
cggucacgcugug

SEQ ID NO: 1349881 - RNA, 14 nt, Mycobacterium tuberculosis H37Rv
cggucacccgugcu

SEQ ID NO: 1349882 - RNA, 23 nt, Mycobacterium tuberculosis H37Rv
cggucagugggacgggcgcgucc

SEQ ID NO: 1349883 - RNA, 22 nt, Mycobacterium tuberculosis H37Rv
cggucauagucgaauggcaaca

SEQ ID NO: 1349884 - RNA, 21 nt, Mycobacterium tuberculosis H37Rv
cggucaggcucauccgccggg

SEQ ID NO: 1349885 - RNA, 16 nt, Mycobacterium tuberculosis H37Rv
cggucggugaacccgc

SEQ ID NO: 1349886 - RNA, 20 nt, Mycobacterium tuberculosis H37Rv
cggucgguacccgcacccgu

SEQ ID NO: 1349887 - RNA, 15 nt, Mycobacterium tuberculosis H37Rv
cggugaccucaccaa

SEQ ID NO: 1349888 - RNA, 15 nt, Mycobacterium tuberculosis H37Rv
cggucuccgcugaug

SEQ ID NO: 1349889 - RNA, 18 nt, Mycobacterium tuberculosis H37Rv
cggucuccgcccgcgggc

SEQ ID NO: 1349890 - RNA, 22 nt, Mycobacterium tuberculosis H37Rv
cggucuccaccaccgacgagga

SEQ ID NO: 1349891 - RNA, 19 nt, Mycobacterium tuberculosis H37Rv
cggucucacguugugagcc

SEQ ID NO: 1349892 - RNA, 18 nt, Mycobacterium tuberculosis H37Rv
cggugaccacuugcagca

SEQ ID NO: 1349893 - RNA, 21 nt, Mycobacterium tuberculosis H37Rv
cggugcacaacgcccaccacg

SEQ ID NO: 1349894 - RNA, 20 nt, Mycobacterium tuberculosis H37Rv
cggugauggugugcagcagc

SEQ ID NO: 1349895 - RNA, 21 nt, Mycobacterium tuberculosis H37Rv
cggugauggccgaccagccga

SEQ ID NO: 1349896 - RNA, 16 nt, Mycobacterium tuberculosis H37Rv
cggugaugggggagcc

SEQ ID NO: 1349897 - RNA, 16 nt, Mycobacterium tuberculosis H37Rv
cggugauggccgacca

SEQ ID NO: 1349898 - RNA, 17 nt, Mycobacterium tuberculosis H37Rv
cggugagaagaagccca

SEQ ID NO: 1349899 - RNA, 14 nt, Mycobacterium tuberculosis H37Rv
cggugaugaagcgc

SEQ ID NO: 1349900 - RNA, 23 nt, Mycobacterium tuberculosis H37Rv
cggugaugaacgacauccggccg

SEQ ID NO: 1349901 - RNA, 20 nt, Mycobacterium tuberculosis H37Rv
cggugaugaacgacauccgg

SEQ ID NO: 1349902 - RNA, 21 nt, Mycobacterium tuberculosis H37Rv
cggugaucuugccggccagca

SEQ ID NO: 1349903 - RNA, 22 nt, Mycobacterium tuberculosis H37Rv
cggugaucuugccggccagcag

SEQ ID NO: 1349904 - RNA, 16 nt, Mycobacterium tuberculosis H37Rv
cggugacuccgcgcgc

SEQ ID NO: 1349905 - RNA, 19 nt, Mycobacterium tuberculosis H37Rv
cggugacucggccuccgcc

SEQ ID NO: 1349906 - RNA, 19 nt, Mycobacterium tuberculosis H37Rv
cggugacguuggcaggcag

SEQ ID NO: 1349907 - RNA, 17 nt, Mycobacterium tuberculosis H37Rv
cggugacggggcugacc

SEQ ID NO: 1349908 - RNA, 23 nt, Mycobacterium tuberculosis H37Rv
cggugacgccagccuggccaucg

SEQ ID NO: 1349909 - RNA, 14 nt, Mycobacterium tuberculosis H37Rv
cggugacgaagagc

SEQ ID NO: 1349910 - RNA, 18 nt, Mycobacterium tuberculosis H37Rv
cggucgggggcagcgccu

SEQ ID NO: 1349911 - RNA, 16 nt, Mycobacterium tuberculosis H37Rv
cggucggguccaacgc

SEQ ID NO: 1349912 - RNA, 18 nt, Mycobacterium tuberculosis H37Rv
cggucggggauccgaccu

SEQ ID NO: 1349913 - RNA, 20 nt, Mycobacterium tuberculosis H37Rv
cggucggccauccaccgcag

SEQ ID NO: 1349914 - RNA, 22 nt, Mycobacterium tuberculosis H37Rv
cggucggcgaccaccagcgccg

SEQ ID NO: 1349915 - RNA, 18 nt, Mycobacterium tuberculosis H37Rv
cggucggcgacguagacg

SEQ ID NO: 1349916 - RNA, 23 nt, Mycobacterium tuberculosis H37Rv
cggucgcucgauggauccaaccg

SEQ ID NO: 1349917 - RNA, 24 nt, Mycobacterium tuberculosis H37Rv
cggucgccucaccggcgcgagcag

SEQ ID NO: 1349918 - RNA, 15 nt, Mycobacterium tuberculosis H37Rv
cggucggacggccau

SEQ ID NO: 1349919 - RNA, 20 nt, Mycobacterium tuberculosis H37Rv
cggucggaccacccggcgcg

SEQ ID NO: 1349920 - RNA, 15 nt, Mycobacterium tuberculosis H37Rv
cggucgcugaugagc

SEQ ID NO: 1349921 - RNA, 13 nt, Mycobacterium tuberculosis H37Rv
cggucggccaggc

SEQ ID NO: 1349922 - RNA, 14 nt, Mycobacterium tuberculosis H37Rv
cggucgccgcgcgu

SEQ ID NO: 1349923 - RNA, 13 nt, Mycobacterium tuberculosis H37Rv
cggucgccgcgcg

SEQ ID NO: 1349924 - RNA, 19 nt, Mycobacterium tuberculosis H37Rv
cggucgcagcagaccacaa

SEQ ID NO: 1349925 - RNA, 20 nt, Mycobacterium tuberculosis H37Rv
cggucgcacuuggcccccga

SEQ ID NO: 1349926 - RNA, 15 nt, Mycobacterium tuberculosis H37Rv
cggucgcagcagacc

SEQ ID NO: 1349927 - RNA, 19 nt, Mycobacterium tuberculosis H37Rv
cggucgauguccgcagcac

SEQ ID NO: 1349928 - RNA, 21 nt, Mycobacterium tuberculosis H37Rv
cggucgccaccgccggcagca

SEQ ID NO: 1349929 - RNA, 13 nt, Mycobacterium tuberculosis H37Rv
cggucgccaccgc

SEQ ID NO: 1349930 - RNA, 15 nt, Mycobacterium tuberculosis H37Rv
cggucgccaccgccg

SEQ ID NO: 1349931 - RNA, 15 nt, Mycobacterium tuberculosis H37Rv
cggucgacuccagca

SEQ ID NO: 1349932 - RNA, 19 nt, Mycobacterium tuberculosis H37Rv
cggucgacuccagcaccag

SEQ ID NO: 1349933 - RNA, 22 nt, Mycobacterium tuberculosis H37Rv
cggucgacuccagcaccagcac

SEQ ID NO: 1349934 - RNA, 16 nt, Mycobacterium tuberculosis H37Rv
cggucgaagagguggg

SEQ ID NO: 1349935 - RNA, 15 nt, Mycobacterium tuberculosis H37Rv
cggucgaccugagcc

SEQ ID NO: 1349936 - RNA, 14 nt, Mycobacterium tuberculosis H37Rv
cggucgagcucgua

SEQ ID NO: 1349937 - RNA, 23 nt, Mycobacterium tuberculosis H37Rv
cggucgaagcuggcacgcagagc

SEQ ID NO: 1349938 - RNA, 14 nt, Mycobacterium tuberculosis H37Rv
cggucgaugaccuc

SEQ ID NO: 1349939 - RNA, 15 nt, Mycobacterium tuberculosis H37Rv
cguagcgggggagcg

SEQ ID NO: 1349940 - RNA, 23 nt, Mycobacterium tuberculosis H37Rv
cguagcggcuccgggaugaagcu

SEQ ID NO: 1349941 - RNA, 21 nt, Mycobacterium tuberculosis H37Rv
cguagcugcgcagcgcaaaca

SEQ ID NO: 1349942 - RNA, 16 nt, Mycobacterium tuberculosis H37Rv
cguagcggcggcgccc

SEQ ID NO: 1349943 - RNA, 20 nt, Mycobacterium tuberculosis H37Rv
cguagcgcccaccguagacg

SEQ ID NO: 1349944 - RNA, 18 nt, Mycobacterium tuberculosis H37Rv
cguaggacaccaccgugg

SEQ ID NO: 1349945 - RNA, 16 nt, Mycobacterium tuberculosis H37Rv
cguaggacucggcgga

SEQ ID NO: 1349946 - RNA, 12 nt, Mycobacterium tuberculosis H37Rv
cguaggcacccc

SEQ ID NO: 1349947 - RNA, 20 nt, Mycobacterium tuberculosis H37Rv
cguaggcguacaccagggug

SEQ ID NO: 1349948 - RNA, 14 nt, Mycobacterium tuberculosis H37Rv
cguaggcggcggcc

SEQ ID NO: 1349949 - RNA, 13 nt, Mycobacterium tuberculosis H37Rv
cguaggcggcggc

SEQ ID NO: 1349950 - RNA, 22 nt, Mycobacterium tuberculosis H37Rv
cguaggcgcuaggaacgccacc

SEQ ID NO: 1349951 - RNA, 17 nt, Mycobacterium tuberculosis H37Rv
cguaggcggcgacccgc

SEQ ID NO: 1349952 - RNA, 19 nt, Mycobacterium tuberculosis H37Rv
cguagagcaugccgcccgc

SEQ ID NO: 1349953 - RNA, 13 nt, Mycobacterium tuberculosis H37Rv
cguagagcagcag

SEQ ID NO: 1349954 - RNA, 22 nt, Mycobacterium tuberculosis H37Rv
cguagagucguuuggcgccgcc

SEQ ID NO: 1349955 - RNA, 14 nt, Mycobacterium tuberculosis H37Rv
cguagaccagcagg

SEQ ID NO: 1349956 - RNA, 19 nt, Mycobacterium tuberculosis H37Rv
cguagaccagcaggcccug

SEQ ID NO: 1349957 - RNA, 14 nt, Mycobacterium tuberculosis H37Rv
cguagacccacagu

SEQ ID NO: 1349958 - RNA, 21 nt, Mycobacterium tuberculosis H37Rv
cguagaaucggcucagcaacg

SEQ ID NO: 1349959 - RNA, 15 nt, Mycobacterium tuberculosis H37Rv
cguagacgccgagca

SEQ ID NO: 1349960 - RNA, 13 nt, Mycobacterium tuberculosis H37Rv
cguagaccagcag

SEQ ID NO: 1349961 - RNA, 23 nt, Mycobacterium tuberculosis H37Rv
cguagacgacaucgucaucagcg

SEQ ID NO: 1349962 - RNA, 22 nt, Mycobacterium tuberculosis H37Rv
cguagaaccggggugaggcuuc

SEQ ID NO: 1349963 - RNA, 15 nt, Mycobacterium tuberculosis H37Rv
cguagcaccacaucg

SEQ ID NO: 1349964 - RNA, 14 nt, Mycobacterium tuberculosis H37Rv
cguagccagcagcg

SEQ ID NO: 1349965 - RNA, 16 nt, Mycobacterium tuberculosis H37Rv
cguagcccugcucagc

SEQ ID NO: 1349966 - RNA, 19 nt, Mycobacterium tuberculosis H37Rv
cguagcccacccggguggg

SEQ ID NO: 1349967 - RNA, 18 nt, Mycobacterium tuberculosis H37Rv
cguagcccacccgggugg

SEQ ID NO: 1349968 - RNA, 16 nt, Mycobacterium tuberculosis H37Rv
cguagcccacgacgaa

SEQ ID NO: 1349969 - RNA, 12 nt, Mycobacterium tuberculosis H37Rv
cguagcccaggu

SEQ ID NO: 1349970 - RNA, 14 nt, Mycobacterium tuberculosis H37Rv
cguagucguagcag

SEQ ID NO: 1349971 - RNA, 21 nt, Mycobacterium tuberculosis H37Rv
cguagucgucuucgucauggc

SEQ ID NO: 1349972 - RNA, 16 nt, Mycobacterium tuberculosis H37Rv
cguagugcucgccggc

SEQ ID NO: 1349973 - RNA, 18 nt, Mycobacterium tuberculosis H37Rv
cguagucggcggugcaga

SEQ ID NO: 1349974 - RNA, 15 nt, Mycobacterium tuberculosis H37Rv
cguaggugcacaacc

SEQ ID NO: 1349975 - RNA, 16 nt, Mycobacterium tuberculosis H37Rv
cguagguggccggcuu

SEQ ID NO: 1349976 - RNA, 23 nt, Mycobacterium tuberculosis H37Rv
cguagguggccggcuugcaguga

SEQ ID NO: 1349977 - RNA, 20 nt, Mycobacterium tuberculosis H37Rv
cguaucacgguugccgcgau

SEQ ID NO: 1349978 - RNA, 14 nt, Mycobacterium tuberculosis H37Rv
cguauccacggucg

SEQ ID NO: 1349979 - RNA, 13 nt, Mycobacterium tuberculosis H37Rv
cguaucccagaua

SEQ ID NO: 1349980 - RNA, 17 nt, Mycobacterium tuberculosis H37Rv
cguauaggucagaauug

SEQ ID NO: 1349981 - RNA, 23 nt, Mycobacterium tuberculosis H37Rv
cguauaggucagaauugugugca

SEQ ID NO: 1349982 - RNA, 19 nt, Mycobacterium tuberculosis H37Rv
cguaugccguggccgccau

SEQ ID NO: 1349983 - RNA, 15 nt, Mycobacterium tuberculosis H37Rv
cguauugccaaagcc

SEQ ID NO: 1349984 - RNA, 15 nt, Mycobacterium tuberculosis H37Rv
cguauugcggccugu

SEQ ID NO: 1349985 - RNA, 16 nt, Mycobacterium tuberculosis H37Rv
cguauucggccgcgag

SEQ ID NO: 1349986 - RNA, 16 nt, Mycobacterium tuberculosis H37Rv
cgucagcgggcagcag

SEQ ID NO: 1349987 - RNA, 13 nt, Mycobacterium tuberculosis H37Rv
cgucagcggcggc

SEQ ID NO: 1349988 - RNA, 12 nt, Mycobacterium tuberculosis H37Rv
cgucagcgccgc

SEQ ID NO: 1349989 - RNA, 14 nt, Mycobacterium tuberculosis H37Rv
cgucagcgcgccgu

SEQ ID NO: 1349990 - RNA, 18 nt, Mycobacterium tuberculosis H37Rv
cgucagcgccgcgcgcgc

SEQ ID NO: 1349991 - RNA, 14 nt, Mycobacterium tuberculosis H37Rv
cgucagcgccgcug

SEQ ID NO: 1349992 - RNA, 15 nt, Mycobacterium tuberculosis H37Rv
cgucaggaaccaccc

SEQ ID NO: 1349993 - RNA, 20 nt, Mycobacterium tuberculosis H37Rv
cgucaggcacaacgcgacgc

SEQ ID NO: 1349994 - RNA, 14 nt, Mycobacterium tuberculosis H37Rv
cgucagcaccgcua

SEQ ID NO: 1349995 - RNA, 16 nt, Mycobacterium tuberculosis H37Rv
cgucagauccggccgu

SEQ ID NO: 1349996 - RNA, 13 nt, Mycobacterium tuberculosis H37Rv
cgucagcccaggu

SEQ ID NO: 1349997 - RNA, 20 nt, Mycobacterium tuberculosis H37Rv
cgucauggcccgaucgaccg

SEQ ID NO: 1349998 - RNA, 18 nt, Mycobacterium tuberculosis H37Rv
cgucaugcccaucuccaa

SEQ ID NO: 1349999 - RNA, 21 nt, Mycobacterium tuberculosis H37Rv
cgucaucggcuggccgcgccu

SEQ ID NO: 1350000 - RNA, 15 nt, Mycobacterium tuberculosis H37Rv
cgucaucggggccug

SEQ ID NO: 1350001 - RNA, 12 nt, Mycobacterium tuberculosis H37Rv
cgucauccaccg

SEQ ID NO: 1350002 - RNA, 13 nt, Mycobacterium tuberculosis H37Rv
cgucaguugagaa

SEQ ID NO: 1350003 - RNA, 22 nt, Mycobacterium tuberculosis H37Rv
cgucaguucggugugcggcgca

SEQ ID NO: 1350004 - RNA, 17 nt, Mycobacterium tuberculosis H37Rv
cgucagugccccgcagc

SEQ ID NO: 1350005 - RNA, 15 nt, Mycobacterium tuberculosis H37Rv
cgucaguagccacgc

SEQ ID NO: 1350006 - RNA, 19 nt, Mycobacterium tuberculosis H37Rv
cgucagguggccaaugccu

SEQ ID NO: 1350007 - RNA, 21 nt, Mycobacterium tuberculosis H37Rv
cgucaagagugcucagcgcgc

SEQ ID NO: 1350008 - RNA, 19 nt, Mycobacterium tuberculosis H37Rv
cgucaagccacacccggcg

SEQ ID NO: 1350009 - RNA, 23 nt, Mycobacterium tuberculosis H37Rv
cgucaagagugcucagcgcgcgc

SEQ ID NO: 1350010 - RNA, 18 nt, Mycobacterium tuberculosis H37Rv
cgucaaacgacagcccua

SEQ ID NO: 1350011 - RNA, 22 nt, Mycobacterium tuberculosis H37Rv
cgucaaacgcaaagacagcgcg

SEQ ID NO: 1350012 - RNA, 21 nt, Mycobacterium tuberculosis H37Rv
cgucaaacccagcgacgcggc

SEQ ID NO: 1350013 - RNA, 17 nt, Mycobacterium tuberculosis H37Rv
cgucaaccacggccgcc

SEQ ID NO: 1350014 - RNA, 16 nt, Mycobacterium tuberculosis H37Rv
cgucaaccacggccgc

SEQ ID NO: 1350015 - RNA, 19 nt, Mycobacterium tuberculosis H37Rv
cgucaaccgaucggucguc

SEQ ID NO: 1350016 - RNA, 23 nt, Mycobacterium tuberculosis H37Rv
cgucaaccugcgcaucaccacug

SEQ ID NO: 1350017 - RNA, 15 nt, Mycobacterium tuberculosis H37Rv
cgucaaucaccaccg

SEQ ID NO: 1350018 - RNA, 15 nt, Mycobacterium tuberculosis H37Rv
cgucacaccagcggg

SEQ ID NO: 1350019 - RNA, 20 nt, Mycobacterium tuberculosis H37Rv
cgucacaagucgacacgccg

SEQ ID NO: 1350020 - RNA, 16 nt, Mycobacterium tuberculosis H37Rv
cgucacaguucugccu

SEQ ID NO: 1350021 - RNA, 14 nt, Mycobacterium tuberculosis H37Rv
cgucaccaccgccg

SEQ ID NO: 1350022 - RNA, 17 nt, Mycobacterium tuberculosis H37Rv
cgucaccgaugcgccgg

SEQ ID NO: 1350023 - RNA, 20 nt, Mycobacterium tuberculosis H37Rv
cgucaccgaugcgccggacc

SEQ ID NO: 1350024 - RNA, 13 nt, Mycobacterium tuberculosis H37Rv
cgucaccccgguc

SEQ ID NO: 1350025 - RNA, 23 nt, Mycobacterium tuberculosis H37Rv
cgucaccggaggccgccgcgccg

SEQ ID NO: 1350026 - RNA, 16 nt, Mycobacterium tuberculosis H37Rv
cgucaccggaggccgc

SEQ ID NO: 1350027 - RNA, 15 nt, Mycobacterium tuberculosis H37Rv
cgucaccgcgcggcu

SEQ ID NO: 1350028 - RNA, 13 nt, Mycobacterium tuberculosis H37Rv
cgucaccgcugag

SEQ ID NO: 1350029 - RNA, 20 nt, Mycobacterium tuberculosis H37Rv
cgucaccgcgaccagccagc

SEQ ID NO: 1350030 - RNA, 22 nt, Mycobacterium tuberculosis H37Rv
cgucaccgccguugccgccggc

SEQ ID NO: 1350031 - RNA, 22 nt, Mycobacterium tuberculosis H37Rv
cgucaccguuguucccauagcc

SEQ ID NO: 1350032 - RNA, 17 nt, Mycobacterium tuberculosis H37Rv
cgucaccucaccgaacg

SEQ ID NO: 1350033 - RNA, 23 nt, Mycobacterium tuberculosis H37Rv
cgucaccguacgggacgaagacc

SEQ ID NO: 1350034 - RNA, 17 nt, Mycobacterium tuberculosis H37Rv
cgucaccguguugcacg

SEQ ID NO: 1350035 - RNA, 17 nt, Mycobacterium tuberculosis H37Rv
cgucacgugucccgcau

SEQ ID NO: 1350036 - RNA, 19 nt, Mycobacterium tuberculosis H37Rv
cgucacguaauuccccagg

SEQ ID NO: 1350037 - RNA, 20 nt, Mycobacterium tuberculosis H37Rv
cgucacguaauuccccaggu

SEQ ID NO: 1350038 - RNA, 21 nt, Mycobacterium tuberculosis H37Rv
cgucacgcggguugcgcggcu

SEQ ID NO: 1350039 - RNA, 16 nt, Mycobacterium tuberculosis H37Rv
cgucacgcaaccggcg

SEQ ID NO: 1350040 - RNA, 18 nt, Mycobacterium tuberculosis H37Rv
cgucacgcaaccggcgga

SEQ ID NO: 1350041 - RNA, 21 nt, Mycobacterium tuberculosis H37Rv
cggccuucgggugugacgcgc

SEQ ID NO: 1350042 - RNA, 16 nt, Mycobacterium tuberculosis H37Rv
cggccuggggcagccg

SEQ ID NO: 1350043 - RNA, 17 nt, Mycobacterium tuberculosis H37Rv
cggccugggccagccgc

SEQ ID NO: 1350044 - RNA, 11 nt, Mycobacterium tuberculosis H37Rv
cggccuggggc

SEQ ID NO: 1350045 - RNA, 15 nt, Mycobacterium tuberculosis H37Rv
cggccuugccgccgg

SEQ ID NO: 1350046 - RNA, 16 nt, Mycobacterium tuberculosis H37Rv
cggccuugccgccggc

SEQ ID NO: 1350047 - RNA, 15 nt, Mycobacterium tuberculosis H37Rv
cggccuugccaccgg

SEQ ID NO: 1350048 - RNA, 19 nt, Mycobacterium tuberculosis H37Rv
cggccuugaucaccgugcg

SEQ ID NO: 1350049 - RNA, 13 nt, Mycobacterium tuberculosis H37Rv
cggcgcggaacgc

SEQ ID NO: 1350050 - RNA, 14 nt, Mycobacterium tuberculosis H37Rv
cggcgcggaacgcg

SEQ ID NO: 1350051 - RNA, 15 nt, Mycobacterium tuberculosis H37Rv
cggcgcggccggccg

SEQ ID NO: 1350052 - RNA, 16 nt, Mycobacterium tuberculosis H37Rv
cggcgcggccggccgc

SEQ ID NO: 1350053 - RNA, 15 nt, Mycobacterium tuberculosis H37Rv
cggcgcggccagcuc

SEQ ID NO: 1350054 - RNA, 15 nt, Mycobacterium tuberculosis H37Rv
cggcgcggccgcagc

SEQ ID NO: 1350055 - RNA, 14 nt, Mycobacterium tuberculosis H37Rv
cggcgcggagugcc

SEQ ID NO: 1350056 - RNA, 19 nt, Mycobacterium tuberculosis H37Rv
cggcggccgccaucagccg

SEQ ID NO: 1350057 - RNA, 12 nt, Mycobacterium tuberculosis H37Rv
cggcggccgccc

SEQ ID NO: 1350058 - RNA, 16 nt, Mycobacterium tuberculosis H37Rv
cggcggccgcgauggc

SEQ ID NO: 1350059 - RNA, 16 nt, Mycobacterium tuberculosis H37Rv
cggcggcccgcagccc

SEQ ID NO: 1350060 - RNA, 14 nt, Mycobacterium tuberculosis H37Rv
cggcggccgcagcg

SEQ ID NO: 1350061 - RNA, 18 nt, Mycobacterium tuberculosis H37Rv
cggcggccgcagcggcca

SEQ ID NO: 1350062 - RNA, 22 nt, Mycobacterium tuberculosis H37Rv
cggcggccagcuccagcgccgc

SEQ ID NO: 1350063 - RNA, 20 nt, Mycobacterium tuberculosis H37Rv
cggcggcaugggucgugcag

SEQ ID NO: 1350064 - RNA, 20 nt, Mycobacterium tuberculosis H37Rv
cggcggccaaggucgaccca

SEQ ID NO: 1350065 - RNA, 17 nt, Mycobacterium tuberculosis H37Rv
cggcgcuccacugacca

SEQ ID NO: 1350066 - RNA, 18 nt, Mycobacterium tuberculosis H37Rv
cggcgcucuugcucacca

SEQ ID NO: 1350067 - RNA, 20 nt, Mycobacterium tuberculosis H37Rv
cggcgcucgucgaucuccuc

SEQ ID NO: 1350068 - RNA, 19 nt, Mycobacterium tuberculosis H37Rv
cggcggacaccucgggcgc

SEQ ID NO: 1350069 - RNA, 18 nt, Mycobacterium tuberculosis H37Rv
cggcgcugaucgcgaagc

SEQ ID NO: 1350070 - RNA, 13 nt, Mycobacterium tuberculosis H37Rv
cggcgcugaucgc

SEQ ID NO: 1350071 - RNA, 20 nt, Mycobacterium tuberculosis H37Rv
cggcggagcgggccagcacc

SEQ ID NO: 1350072 - RNA, 15 nt, Mycobacterium tuberculosis H37Rv
cggcggagcgggcca

SEQ ID NO: 1350073 - RNA, 19 nt, Mycobacterium tuberculosis H37Rv
cggcggacugagagauggu

SEQ ID NO: 1350074 - RNA, 14 nt, Mycobacterium tuberculosis H37Rv
cggcggaccgcagc

SEQ ID NO: 1350075 - RNA, 15 nt, Mycobacterium tuberculosis H37Rv
cggcggacgcgggug

SEQ ID NO: 1350076 - RNA, 16 nt, Mycobacterium tuberculosis H37Rv
cggcggacgcgggugc

SEQ ID NO: 1350077 - RNA, 20 nt, Mycobacterium tuberculosis H37Rv
cggcggaucccgaggcgccc

SEQ ID NO: 1350078 - RNA, 14 nt, Mycobacterium tuberculosis H37Rv
cggcggcuuggccg

SEQ ID NO: 1350079 - RNA, 18 nt, Mycobacterium tuberculosis H37Rv
cggcggcuuggccgcccc

SEQ ID NO: 1350080 - RNA, 20 nt, Mycobacterium tuberculosis H37Rv
cggcggcuucguggcggcgc

SEQ ID NO: 1350081 - RNA, 22 nt, Mycobacterium tuberculosis H37Rv
cggcggcuucguggcggcgcgc

SEQ ID NO: 1350082 - RNA, 17 nt, Mycobacterium tuberculosis H37Rv
cggcggcugucggccgg

SEQ ID NO: 1350083 - RNA, 19 nt, Mycobacterium tuberculosis H37Rv
cggcggcuguugcggcggc

SEQ ID NO: 1350084 - RNA, 24 nt, Mycobacterium tuberculosis H37Rv
cggcggcucccauggcgcgagcag

SEQ ID NO: 1350085 - RNA, 12 nt, Mycobacterium tuberculosis H37Rv
cggcggcggagg

SEQ ID NO: 1350086 - RNA, 16 nt, Mycobacterium tuberculosis H37Rv
cggcggcggccaggau

SEQ ID NO: 1350087 - RNA, 15 nt, Mycobacterium tuberculosis H37Rv
cggcggcggcggccc

SEQ ID NO: 1350088 - RNA, 16 nt, Mycobacterium tuberculosis H37Rv
cggcggcggugcgccc

SEQ ID NO: 1350089 - RNA, 19 nt, Mycobacterium tuberculosis H37Rv
cggcggcggugcgccccgc

SEQ ID NO: 1350090 - RNA, 22 nt, Mycobacterium tuberculosis H37Rv
cggcggcggugcgccccgcguu

SEQ ID NO: 1350091 - RNA, 16 nt, Mycobacterium tuberculosis H37Rv
cggcggcggucugaga

SEQ ID NO: 1350092 - RNA, 16 nt, Mycobacterium tuberculosis H37Rv
cggcggccuugcgggc

SEQ ID NO: 1350093 - RNA, 21 nt, Mycobacterium tuberculosis H37Rv
cggcggcgaacagccccaggg

SEQ ID NO: 1350094 - RNA, 23 nt, Mycobacterium tuberculosis H37Rv
cggcggcgagaaucccgggccgu

SEQ ID NO: 1350095 - RNA, 22 nt, Mycobacterium tuberculosis H37Rv
cggcggcgaggcgagucaccgg

SEQ ID NO: 1350096 - RNA, 17 nt, Mycobacterium tuberculosis H37Rv
cggcggccuucggccgg

SEQ ID NO: 1350097 - RNA, 22 nt, Mycobacterium tuberculosis H37Rv
cggcggccuucggccggcgugu

SEQ ID NO: 1350098 - RNA, 19 nt, Mycobacterium tuberculosis H37Rv
cggcggccguggcuggacc

SEQ ID NO: 1350099 - RNA, 14 nt, Mycobacterium tuberculosis H37Rv
cggcggcgccgccc

SEQ ID NO: 1350100 - RNA, 12 nt, Mycobacterium tuberculosis H37Rv
cggcggcgcccc

SEQ ID NO: 1350101 - RNA, 18 nt, Mycobacterium tuberculosis H37Rv
cggcggcgcuggcgggca

SEQ ID NO: 1350102 - RNA, 16 nt, Mycobacterium tuberculosis H37Rv
cggcguaaccggcagc

SEQ ID NO: 1350103 - RNA, 20 nt, Mycobacterium tuberculosis H37Rv
cggcguacaaaccgucgggg

SEQ ID NO: 1350104 - RNA, 18 nt, Mycobacterium tuberculosis H37Rv
cggcgguucugcggccgc

SEQ ID NO: 1350105 - RNA, 12 nt, Mycobacterium tuberculosis H37Rv
cggcggucugua

SEQ ID NO: 1350106 - RNA, 19 nt, Mycobacterium tuberculosis H37Rv
cggcggugaaaucgcacag

SEQ ID NO: 1350107 - RNA, 19 nt, Mycobacterium tuberculosis H37Rv
cggcggucuuggcgcgccc

SEQ ID NO: 1350108 - RNA, 17 nt, Mycobacterium tuberculosis H37Rv
cggcgguccggaugcgc

SEQ ID NO: 1350109 - RNA, 17 nt, Mycobacterium tuberculosis H37Rv
cggcggucugcagugca

SEQ ID NO: 1350110 - RNA, 22 nt, Mycobacterium tuberculosis H37Rv
cggcggucucgucaaccugcgc

SEQ ID NO: 1350111 - RNA, 22 nt, Mycobacterium tuberculosis H37Rv
cggcgguauuuugccggauucu

SEQ ID NO: 1350112 - RNA, 17 nt, Mycobacterium tuberculosis H37Rv
cggcgguccgcgcgacc

SEQ ID NO: 1350113 - RNA, 18 nt, Mycobacterium tuberculosis H37Rv
cggcgguccgcgcgacca

SEQ ID NO: 1350114 - RNA, 22 nt, Mycobacterium tuberculosis H37Rv
cggcgggaacccuugccacgaa

SEQ ID NO: 1350115 - RNA, 14 nt, Mycobacterium tuberculosis H37Rv
cggcgggacgucgc

SEQ ID NO: 1350116 - RNA, 17 nt, Mycobacterium tuberculosis H37Rv
cggcgggaugcgcgccc

SEQ ID NO: 1350117 - RNA, 11 nt, Mycobacterium tuberculosis H37Rv
cggcgggcagc

SEQ ID NO: 1350118 - RNA, 20 nt, Mycobacterium tuberculosis H37Rv
cggcgguagccgaccagcgc

SEQ ID NO: 1350119 - RNA, 21 nt, Mycobacterium tuberculosis H37Rv
cggcgguaguacucgcgcagg

SEQ ID NO: 1350120 - RNA, 19 nt, Mycobacterium tuberculosis H37Rv
cggcgggcggugggcagca

SEQ ID NO: 1350121 - RNA, 17 nt, Mycobacterium tuberculosis H37Rv
cggcgguaacggcggua

SEQ ID NO: 1350122 - RNA, 14 nt, Mycobacterium tuberculosis H37Rv
cggcgggcggcagc

SEQ ID NO: 1350123 - RNA, 14 nt, Mycobacterium tuberculosis H37Rv
cggcgggcgagcca

SEQ ID NO: 1350124 - RNA, 12 nt, Mycobacterium tuberculosis H37Rv
cggcgggccacc

SEQ ID NO: 1350125 - RNA, 21 nt, Mycobacterium tuberculosis H37Rv
cggcucaccgcgcaucaucgc

SEQ ID NO: 1350126 - RNA, 16 nt, Mycobacterium tuberculosis H37Rv
cggcucaucccgaccc

SEQ ID NO: 1350127 - RNA, 15 nt, Mycobacterium tuberculosis H37Rv
cggcucaucgcagcc

SEQ ID NO: 1350128 - RNA, 22 nt, Mycobacterium tuberculosis H37Rv
cggcuccggacaccccgcacgg

SEQ ID NO: 1350129 - RNA, 16 nt, Mycobacterium tuberculosis H37Rv
cggcuccuccccggcc

SEQ ID NO: 1350130 - RNA, 14 nt, Mycobacterium tuberculosis H37Rv
cggcuccuccccgg

SEQ ID NO: 1350131 - RNA, 16 nt, Mycobacterium tuberculosis H37Rv
cggcuccggcggcagc

SEQ ID NO: 1350132 - RNA, 15 nt, Mycobacterium tuberculosis H37Rv
cggcucgccaccucg

SEQ ID NO: 1350133 - RNA, 13 nt, Mycobacterium tuberculosis H37Rv
cggcuaccgccga

SEQ ID NO: 1350134 - RNA, 22 nt, Mycobacterium tuberculosis H37Rv
cggcuaccgcgcucccggcguc

SEQ ID NO: 1350135 - RNA, 16 nt, Mycobacterium tuberculosis H37Rv
cggcuaccgcgcuccc

SEQ ID NO: 1350136 - RNA, 17 nt, Mycobacterium tuberculosis H37Rv
cggcuaccgccgaccgg

SEQ ID NO: 1350137 - RNA, 19 nt, Mycobacterium tuberculosis H37Rv
cggcuaccgcgcucccggc

SEQ ID NO: 1350138 - RNA, 17 nt, Mycobacterium tuberculosis H37Rv
cggcuacgccucggcgu

SEQ ID NO: 1350139 - RNA, 15 nt, Mycobacterium tuberculosis H37Rv
cggcuacggcugccc

SEQ ID NO: 1350140 - RNA, 18 nt, Mycobacterium tuberculosis H37Rv
cggcuacggccagugcca

SEQ ID NO: 1350141 - RNA, 16 nt, Mycobacterium tuberculosis H37Rv
cggcuaggccggccgg

SEQ ID NO: 1350142 - RNA, 20 nt, Mycobacterium tuberculosis H37Rv
cggcuauaucccgccccggg

SEQ ID NO: 1350143 - RNA, 20 nt, Mycobacterium tuberculosis H37Rv
cggcuagggcagcagcccgg

SEQ ID NO: 1350144 - RNA, 21 nt, Mycobacterium tuberculosis H37Rv
cggcuagggcagcagcccggg

SEQ ID NO: 1350145 - RNA, 17 nt, Mycobacterium tuberculosis H37Rv
cggcuauggcgccgcgg

SEQ ID NO: 1350146 - RNA, 21 nt, Mycobacterium tuberculosis H37Rv
cggcucaacaccgaguuccuc

SEQ ID NO: 1350147 - RNA, 22 nt, Mycobacterium tuberculosis H37Rv
cggcucaacaccgaguuccucu

SEQ ID NO: 1350148 - RNA, 16 nt, Mycobacterium tuberculosis H37Rv
cggcucacagcacagc

SEQ ID NO: 1350149 - RNA, 16 nt, Mycobacterium tuberculosis H37Rv
cggcucaccgcgcauc

SEQ ID NO: 1350150 - RNA, 19 nt, Mycobacterium tuberculosis H37Rv
cggcgugucucgucgcccc

SEQ ID NO: 1350151 - RNA, 16 nt, Mycobacterium tuberculosis H37Rv
cggcguuccgggccga

SEQ ID NO: 1350152 - RNA, 20 nt, Mycobacterium tuberculosis H37Rv
cggcguuccgggccgaucac

SEQ ID NO: 1350153 - RNA, 20 nt, Mycobacterium tuberculosis H37Rv
cggcgugucgccgccaccag

SEQ ID NO: 1350154 - RNA, 16 nt, Mycobacterium tuberculosis H37Rv
cggcgugucgggggcu

SEQ ID NO: 1350155 - RNA, 19 nt, Mycobacterium tuberculosis H37Rv
cggcgugucguugccaggg

SEQ ID NO: 1350156 - RNA, 22 nt, Mycobacterium tuberculosis H37Rv
cggcguggcuucacccaacccc

SEQ ID NO: 1350157 - RNA, 21 nt, Mycobacterium tuberculosis H37Rv
cggcguggucgcgcggcaccg

SEQ ID NO: 1350158 - RNA, 14 nt, Mycobacterium tuberculosis H37Rv
cggcgugcggacug

SEQ ID NO: 1350159 - RNA, 15 nt, Mycobacterium tuberculosis H37Rv
cggcgugcugugcuc

SEQ ID NO: 1350160 - RNA, 23 nt, Mycobacterium tuberculosis H37Rv
cggcguggcaguacaccggcgug

SEQ ID NO: 1350161 - RNA, 14 nt, Mycobacterium tuberculosis H37Rv
cggcguagacgucc

SEQ ID NO: 1350162 - RNA, 22 nt, Mycobacterium tuberculosis H37Rv
cggcguagaugcgcccggcgug

SEQ ID NO: 1350163 - RNA, 14 nt, Mycobacterium tuberculosis H37Rv
cggcuggggccgcu

SEQ ID NO: 1350164 - RNA, 20 nt, Mycobacterium tuberculosis H37Rv
cggcugcgacaggacgucgg

SEQ ID NO: 1350165 - RNA, 15 nt, Mycobacterium tuberculosis H37Rv
cggcuggucucuggc

SEQ ID NO: 1350166 - RNA, 21 nt, Mycobacterium tuberculosis H37Rv
cggcugggggauaccgcuggg

SEQ ID NO: 1350167 - RNA, 11 nt, Mycobacterium tuberculosis H37Rv
cggcugguugc

SEQ ID NO: 1350168 - RNA, 14 nt, Mycobacterium tuberculosis H37Rv
cggcugguggggga

SEQ ID NO: 1350169 - RNA, 17 nt, Mycobacterium tuberculosis H37Rv
cggcugcagccgaccga

SEQ ID NO: 1350170 - RNA, 23 nt, Mycobacterium tuberculosis H37Rv
cggcugcaaccagcggcacauca

SEQ ID NO: 1350171 - RNA, 20 nt, Mycobacterium tuberculosis H37Rv
cggcugcaaccagcggcaca

SEQ ID NO: 1350172 - RNA, 14 nt, Mycobacterium tuberculosis H37Rv
cggcugccgcggcu

SEQ ID NO: 1350173 - RNA, 16 nt, Mycobacterium tuberculosis H37Rv
cggcugccgcggcugc

SEQ ID NO: 1350174 - RNA, 16 nt, Mycobacterium tuberculosis H37Rv
cggcugccgcucgacc

SEQ ID NO: 1350175 - RNA, 14 nt, Mycobacterium tuberculosis H37Rv
cggcugcgccgggc

SEQ ID NO: 1350176 - RNA, 15 nt, Mycobacterium tuberculosis H37Rv
cggcugccaucccga

SEQ ID NO: 1350177 - RNA, 18 nt, Mycobacterium tuberculosis H37Rv
cggcugccagcgccgccg

SEQ ID NO: 1350178 - RNA, 21 nt, Mycobacterium tuberculosis H37Rv
cggcuuugacgcccggcaccc

SEQ ID NO: 1350179 - RNA, 19 nt, Mycobacterium tuberculosis H37Rv
cggcuuucccaccgcuucc

SEQ ID NO: 1350180 - RNA, 20 nt, Mycobacterium tuberculosis H37Rv
cggcuucgcccagagccgcu

SEQ ID NO: 1350181 - RNA, 13 nt, Mycobacterium tuberculosis H37Rv
cggcuucggcaga

SEQ ID NO: 1350182 - RNA, 21 nt, Mycobacterium tuberculosis H37Rv
cggcuucggguguucgcgcgc

SEQ ID NO: 1350183 - RNA, 16 nt, Mycobacterium tuberculosis H37Rv
cggcuucguccaccgc

SEQ ID NO: 1350184 - RNA, 23 nt, Mycobacterium tuberculosis H37Rv
cggcuuguccucacaugcccgga

SEQ ID NO: 1350185 - RNA, 18 nt, Mycobacterium tuberculosis H37Rv
cggcuucaguccggcccc

SEQ ID NO: 1350186 - RNA, 13 nt, Mycobacterium tuberculosis H37Rv
cggcuuccuccuc

SEQ ID NO: 1350187 - RNA, 15 nt, Mycobacterium tuberculosis H37Rv
cggcuucgacgucgg

SEQ ID NO: 1350188 - RNA, 19 nt, Mycobacterium tuberculosis H37Rv
cggcugucgugccucucgg

SEQ ID NO: 1350189 - RNA, 14 nt, Mycobacterium tuberculosis H37Rv
cgggccuccugcug

SEQ ID NO: 1350190 - RNA, 21 nt, Mycobacterium tuberculosis H37Rv
cgggccucaugcuaggccacc

SEQ ID NO: 1350191 - RNA, 17 nt, Mycobacterium tuberculosis H37Rv
cgggccguguccgccgg

SEQ ID NO: 1350192 - RNA, 15 nt, Mycobacterium tuberculosis H37Rv
cgggccguccuccca

SEQ ID NO: 1350193 - RNA, 20 nt, Mycobacterium tuberculosis H37Rv
cgggccguccggcgccugcu

SEQ ID NO: 1350194 - RNA, 23 nt, Mycobacterium tuberculosis H37Rv
cgggccguacacaccgagcaccu

SEQ ID NO: 1350195 - RNA, 19 nt, Mycobacterium tuberculosis H37Rv
cgggccggcgacuguccca

SEQ ID NO: 1350196 - RNA, 21 nt, Mycobacterium tuberculosis H37Rv
cgggccggaugacgcccaggg

SEQ ID NO: 1350197 - RNA, 23 nt, Mycobacterium tuberculosis H37Rv
cgggccggaugacgcccagggcg

SEQ ID NO: 1350198 - RNA, 15 nt, Mycobacterium tuberculosis H37Rv
cgggccggccgccgc

SEQ ID NO: 1350199 - RNA, 21 nt, Mycobacterium tuberculosis H37Rv
cgggccgcgguacccaccucc

SEQ ID NO: 1350200 - RNA, 14 nt, Mycobacterium tuberculosis H37Rv
cgggccgcggcggc

SEQ ID NO: 1350201 - RNA, 19 nt, Mycobacterium tuberculosis H37Rv
cgggccgcgcgcagagcgu

SEQ ID NO: 1350202 - RNA, 16 nt, Mycobacterium tuberculosis H37Rv
cgggccgcgcgggccg

SEQ ID NO: 1350203 - RNA, 13 nt, Mycobacterium tuberculosis H37Rv
cgggccgcgcggc

SEQ ID NO: 1350204 - RNA, 12 nt, Mycobacterium tuberculosis H37Rv
cgggccgcgcgc

SEQ ID NO: 1350205 - RNA, 13 nt, Mycobacterium tuberculosis H37Rv
cgggccgccgccc

SEQ ID NO: 1350206 - RNA, 14 nt, Mycobacterium tuberculosis H37Rv
cgggccgccgcccc

SEQ ID NO: 1350207 - RNA, 22 nt, Mycobacterium tuberculosis H37Rv
cgggccgagaucacgccgggcg

SEQ ID NO: 1350208 - RNA, 23 nt, Mycobacterium tuberculosis H37Rv
cgggccgaacacaccgggcgggc

SEQ ID NO: 1350209 - RNA, 20 nt, Mycobacterium tuberculosis H37Rv
cgggccgaucucuccggcgg

SEQ ID NO: 1350210 - RNA, 17 nt, Mycobacterium tuberculosis H37Rv
cgggcgaaacgcccggg

SEQ ID NO: 1350211 - RNA, 21 nt, Mycobacterium tuberculosis H37Rv
cgggccuuguucuuggccacc

SEQ ID NO: 1350212 - RNA, 22 nt, Mycobacterium tuberculosis H37Rv
cgggccuuguucuuggccaccc

SEQ ID NO: 1350213 - RNA, 23 nt, Mycobacterium tuberculosis H37Rv
cgggccuuguucuuggccacccc

SEQ ID NO: 1350214 - RNA, 16 nt, Mycobacterium tuberculosis H37Rv
cgggcgaccaccaccg

SEQ ID NO: 1350215 - RNA, 18 nt, Mycobacterium tuberculosis H37Rv
cgggcgaccaccaccgcc

SEQ ID NO: 1350216 - RNA, 15 nt, Mycobacterium tuberculosis H37Rv
cgggcgaccaacacg

SEQ ID NO: 1350217 - RNA, 18 nt, Mycobacterium tuberculosis H37Rv
cgggccuugcgcgcgcag

SEQ ID NO: 1350218 - RNA, 18 nt, Mycobacterium tuberculosis H37Rv
cgggccugcaccacggcg

SEQ ID NO: 1350219 - RNA, 16 nt, Mycobacterium tuberculosis H37Rv
cgggccuucagcucac

SEQ ID NO: 1350220 - RNA, 18 nt, Mycobacterium tuberculosis H37Rv
cgggccuucagcucacca

SEQ ID NO: 1350221 - RNA, 15 nt, Mycobacterium tuberculosis H37Rv
cgggccuucgccacu

SEQ ID NO: 1350222 - RNA, 15 nt, Mycobacterium tuberculosis H37Rv
cgggccuggccugcc

SEQ ID NO: 1350223 - RNA, 13 nt, Mycobacterium tuberculosis H37Rv
cgggccugaacca

SEQ ID NO: 1350224 - RNA, 20 nt, Mycobacterium tuberculosis H37Rv
cgggcgagcucgucgagcgc

SEQ ID NO: 1350225 - RNA, 21 nt, Mycobacterium tuberculosis H37Rv
cgggcgaguacaggcgcagcg

SEQ ID NO: 1350226 - RNA, 14 nt, Mycobacterium tuberculosis H37Rv
cgggcgaccaccac

SEQ ID NO: 1350227 - RNA, 20 nt, Mycobacterium tuberculosis H37Rv
cgggcgagaacccacgcaug

SEQ ID NO: 1350228 - RNA, 13 nt, Mycobacterium tuberculosis H37Rv
cgggcgaugcugg

SEQ ID NO: 1350229 - RNA, 14 nt, Mycobacterium tuberculosis H37Rv
cgggcgaugcuggg

SEQ ID NO: 1350230 - RNA, 14 nt, Mycobacterium tuberculosis H37Rv
cgggcgcaagcagc

SEQ ID NO: 1350231 - RNA, 22 nt, Mycobacterium tuberculosis H37Rv
cgggcgaucucgauguacagcg

SEQ ID NO: 1350232 - RNA, 21 nt, Mycobacterium tuberculosis H37Rv
cgggcgaucaaagccagcacc

SEQ ID NO: 1350233 - RNA, 23 nt, Mycobacterium tuberculosis H37Rv
cgggcgcaccagggagccguuca

SEQ ID NO: 1350234 - RNA, 15 nt, Mycobacterium tuberculosis H37Rv
cgggcgcaccaggga

SEQ ID NO: 1350235 - RNA, 17 nt, Mycobacterium tuberculosis H37Rv
cgggcgaucgccugggc

SEQ ID NO: 1350236 - RNA, 18 nt, Mycobacterium tuberculosis H37Rv
cgggcgaucgccugggcu

SEQ ID NO: 1350237 - RNA, 16 nt, Mycobacterium tuberculosis H37Rv
cgggcacaccgcaccu

SEQ ID NO: 1350238 - RNA, 21 nt, Mycobacterium tuberculosis H37Rv
cgggcacaauaggcuccagcg

SEQ ID NO: 1350239 - RNA, 15 nt, Mycobacterium tuberculosis H37Rv
cgggaauggacaggu

SEQ ID NO: 1350240 - RNA, 16 nt, Mycobacterium tuberculosis H37Rv
cgggcagcuggcgacg

SEQ ID NO: 1350241 - RNA, 14 nt, Mycobacterium tuberculosis H37Rv
cgggcacgccgccg

SEQ ID NO: 1350242 - RNA, 22 nt, Mycobacterium tuberculosis H37Rv
cgggcagcuguucggccaaccc

SEQ ID NO: 1350243 - RNA, 20 nt, Mycobacterium tuberculosis H37Rv
cgggcaggagcagcacgucg

SEQ ID NO: 1350244 - RNA, 14 nt, Mycobacterium tuberculosis H37Rv
cgggcacgcgaggc

SEQ ID NO: 1350245 - RNA, 14 nt, Mycobacterium tuberculosis H37Rv
cgggcaccuggucg

SEQ ID NO: 1350246 - RNA, 11 nt, Mycobacterium tuberculosis H37Rv
cggcuuuugcg

SEQ ID NO: 1350247 - RNA, 23 nt, Mycobacterium tuberculosis H37Rv
cgggaaggaaccgggcaaaucaa

SEQ ID NO: 1350248 - RNA, 13 nt, Mycobacterium tuberculosis H37Rv
cgggaauccggug

SEQ ID NO: 1350249 - RNA, 21 nt, Mycobacterium tuberculosis H37Rv
cgggaaucgcucgcgccaggu

SEQ ID NO: 1350250 - RNA, 14 nt, Mycobacterium tuberculosis H37Rv
cgggaaugaccuug

SEQ ID NO: 1350251 - RNA, 17 nt, Mycobacterium tuberculosis H37Rv
cgggcccgacgcguggc

SEQ ID NO: 1350252 - RNA, 21 nt, Mycobacterium tuberculosis H37Rv
cgggcccgcugggcuuggggc

SEQ ID NO: 1350253 - RNA, 19 nt, Mycobacterium tuberculosis H37Rv
cgggcccgccggccccgcc

SEQ ID NO: 1350254 - RNA, 17 nt, Mycobacterium tuberculosis H37Rv
cgggcccgccguccccg

SEQ ID NO: 1350255 - RNA, 19 nt, Mycobacterium tuberculosis H37Rv
cgggcccgccguccccgcc

SEQ ID NO: 1350256 - RNA, 14 nt, Mycobacterium tuberculosis H37Rv
cgggcccgcgcggc

SEQ ID NO: 1350257 - RNA, 13 nt, Mycobacterium tuberculosis H37Rv
cgggcccuccggc

SEQ ID NO: 1350258 - RNA, 22 nt, Mycobacterium tuberculosis H37Rv
cgggccauggguagccgcccag

SEQ ID NO: 1350259 - RNA, 20 nt, Mycobacterium tuberculosis H37Rv
cgggccauggguagccgccc

SEQ ID NO: 1350260 - RNA, 21 nt, Mycobacterium tuberculosis H37Rv
cgggcccacuugugacccggc

SEQ ID NO: 1350261 - RNA, 12 nt, Mycobacterium tuberculosis H37Rv
cgggcccagccg

SEQ ID NO: 1350262 - RNA, 13 nt, Mycobacterium tuberculosis H37Rv
cgggcccagccgg

SEQ ID NO: 1350263 - RNA, 14 nt, Mycobacterium tuberculosis H37Rv
cgggcccagcgcgc

SEQ ID NO: 1350264 - RNA, 19 nt, Mycobacterium tuberculosis H37Rv
cgggccccggggugccccc

SEQ ID NO: 1350265 - RNA, 17 nt, Mycobacterium tuberculosis H37Rv
cgggcccgccggccccg

SEQ ID NO: 1350266 - RNA, 17 nt, Mycobacterium tuberculosis H37Rv
cgggcaggccgcugggc

SEQ ID NO: 1350267 - RNA, 15 nt, Mycobacterium tuberculosis H37Rv
cgggcagguagcucg

SEQ ID NO: 1350268 - RNA, 19 nt, Mycobacterium tuberculosis H37Rv
cgggcagguagcucguuga

SEQ ID NO: 1350269 - RNA, 16 nt, Mycobacterium tuberculosis H37Rv
cgggcagugcgcggcg

SEQ ID NO: 1350270 - RNA, 21 nt, Mycobacterium tuberculosis H37Rv
cgggcaguggcagcccgucgg

SEQ ID NO: 1350271 - RNA, 18 nt, Mycobacterium tuberculosis H37Rv
cgggcaguucacgguuga

SEQ ID NO: 1350272 - RNA, 21 nt, Mycobacterium tuberculosis H37Rv
cgggcaguuuguucgcgaagc

SEQ ID NO: 1350273 - RNA, 15 nt, Mycobacterium tuberculosis H37Rv
cgggcaguugaccca

SEQ ID NO: 1350274 - RNA, 23 nt, Mycobacterium tuberculosis H37Rv
cgggccaucgcauccccagcaca

SEQ ID NO: 1350275 - RNA, 19 nt, Mycobacterium tuberculosis H37Rv
cgggccaguucgucggcgg

SEQ ID NO: 1350276 - RNA, 17 nt, Mycobacterium tuberculosis H37Rv
cgggguacccgguggca

SEQ ID NO: 1350277 - RNA, 18 nt, Mycobacterium tuberculosis H37Rv
cggggucagauccaggac

SEQ ID NO: 1350278 - RNA, 15 nt, Mycobacterium tuberculosis H37Rv
cgggguaggcccagc

SEQ ID NO: 1350279 - RNA, 16 nt, Mycobacterium tuberculosis H37Rv
cgggguaguugaggcc

SEQ ID NO: 1350280 - RNA, 18 nt, Mycobacterium tuberculosis H37Rv
cgggguccaucggggccg

SEQ ID NO: 1350281 - RNA, 23 nt, Mycobacterium tuberculosis H37Rv
cggggucgaacaugauccgccgg

SEQ ID NO: 1350282 - RNA, 14 nt, Mycobacterium tuberculosis H37Rv
cgggguccgaugcg

SEQ ID NO: 1350283 - RNA, 16 nt, Mycobacterium tuberculosis H37Rv
cggggugcgcgcgacc

SEQ ID NO: 1350284 - RNA, 16 nt, Mycobacterium tuberculosis H37Rv
cggggugagugaccac

SEQ ID NO: 1350285 - RNA, 19 nt, Mycobacterium tuberculosis H37Rv
cggggucuugacggcgcca

SEQ ID NO: 1350286 - RNA, 13 nt, Mycobacterium tuberculosis H37Rv
cgggguggcggca

SEQ ID NO: 1350287 - RNA, 12 nt, Mycobacterium tuberculosis H37Rv
cgggguggugga

SEQ ID NO: 1350288 - RNA, 22 nt, Mycobacterium tuberculosis H37Rv
cggguagccgucgaucccgguc

SEQ ID NO: 1350289 - RNA, 18 nt, Mycobacterium tuberculosis H37Rv
cggguagcggcgccgccc

SEQ ID NO: 1350290 - RNA, 19 nt, Mycobacterium tuberculosis H37Rv
cggguagaccaccugcaug

SEQ ID NO: 1350291 - RNA, 19 nt, Mycobacterium tuberculosis H37Rv
cgggucacccccggccagc

SEQ ID NO: 1350292 - RNA, 14 nt, Mycobacterium tuberculosis H37Rv
cgggucacccagau

SEQ ID NO: 1350293 - RNA, 22 nt, Mycobacterium tuberculosis H37Rv
cgggggcuuuuacgucugcucg

SEQ ID NO: 1350294 - RNA, 22 nt, Mycobacterium tuberculosis H37Rv
cggggggccggacugaagccgc

SEQ ID NO: 1350295 - RNA, 20 nt, Mycobacterium tuberculosis H37Rv
cgggggcuguccaccgaggc

SEQ ID NO: 1350296 - RNA, 21 nt, Mycobacterium tuberculosis H37Rv
cgggggcuuauguguccgcuc

SEQ ID NO: 1350297 - RNA, 13 nt, Mycobacterium tuberculosis H37Rv
cggggcgcccggc

SEQ ID NO: 1350298 - RNA, 19 nt, Mycobacterium tuberculosis H37Rv
cgggcuugagcgccgaugu

SEQ ID NO: 1350299 - RNA, 15 nt, Mycobacterium tuberculosis H37Rv
cgggcuucaacacac

SEQ ID NO: 1350300 - RNA, 16 nt, Mycobacterium tuberculosis H37Rv
cgggcuucagcacgcg

SEQ ID NO: 1350301 - RNA, 15 nt, Mycobacterium tuberculosis H37Rv
cgggcuugccguugg

SEQ ID NO: 1350302 - RNA, 12 nt, Mycobacterium tuberculosis H37Rv
cggggcgacgau

SEQ ID NO: 1350303 - RNA, 21 nt, Mycobacterium tuberculosis H37Rv
cggggcgacgauccgcacgau

SEQ ID NO: 1350304 - RNA, 19 nt, Mycobacterium tuberculosis H37Rv
cgggcucaacaccagccgg

SEQ ID NO: 1350305 - RNA, 18 nt, Mycobacterium tuberculosis H37Rv
cgggcuccccaagucgac

SEQ ID NO: 1350306 - RNA, 14 nt, Mycobacterium tuberculosis H37Rv
cgggcuccagcagc

SEQ ID NO: 1350307 - RNA, 17 nt, Mycobacterium tuberculosis H37Rv
cgggcuccagcagcgcc

SEQ ID NO: 1350308 - RNA, 12 nt, Mycobacterium tuberculosis H37Rv
cgggcucggcag

SEQ ID NO: 1350309 - RNA, 20 nt, Mycobacterium tuberculosis H37Rv
cgggcuccgugguugccgaa

SEQ ID NO: 1350310 - RNA, 15 nt, Mycobacterium tuberculosis H37Rv
cgggcuaccggcagc

SEQ ID NO: 1350311 - RNA, 22 nt, Mycobacterium tuberculosis H37Rv
cgggcguuuggacgggcgugcu

SEQ ID NO: 1350312 - RNA, 13 nt, Mycobacterium tuberculosis H37Rv
cgggcgugucggg

SEQ ID NO: 1350313 - RNA, 22 nt, Mycobacterium tuberculosis H37Rv
cgggcguuguuaucgaagcccg

SEQ ID NO: 1350314 - RNA, 16 nt, Mycobacterium tuberculosis H37Rv
cgggcguccgccggcg

SEQ ID NO: 1350315 - RNA, 21 nt, Mycobacterium tuberculosis H37Rv
cgggcgugcuacacccguaga

SEQ ID NO: 1350316 - RNA, 15 nt, Mycobacterium tuberculosis H37Rv
cgggcgugcucgccg

SEQ ID NO: 1350317 - RNA, 14 nt, Mycobacterium tuberculosis H37Rv
cgggcgugguaacc

SEQ ID NO: 1350318 - RNA, 15 nt, Mycobacterium tuberculosis H37Rv
cgggcgugggccgcu

SEQ ID NO: 1350319 - RNA, 17 nt, Mycobacterium tuberculosis H37Rv
cgggcggugggcagcag

SEQ ID NO: 1350320 - RNA, 16 nt, Mycobacterium tuberculosis H37Rv
cgggcggugggcagca

SEQ ID NO: 1350321 - RNA, 16 nt, Mycobacterium tuberculosis H37Rv
cgggcggucgagaugu

SEQ ID NO: 1350322 - RNA, 19 nt, Mycobacterium tuberculosis H37Rv
cgggcgucauccgcggcag

SEQ ID NO: 1350323 - RNA, 19 nt, Mycobacterium tuberculosis H37Rv
cgggcguacauucgggcgu

SEQ ID NO: 1350324 - RNA, 15 nt, Mycobacterium tuberculosis H37Rv
cgggcggugggcagc

SEQ ID NO: 1350325 - RNA, 22 nt, Mycobacterium tuberculosis H37Rv
cgggcgggcguccacgcugacc

SEQ ID NO: 1350326 - RNA, 14 nt, Mycobacterium tuberculosis H37Rv
cgggcggccaccgc

SEQ ID NO: 1350327 - RNA, 21 nt, Mycobacterium tuberculosis H37Rv
cgggcggcauccugcacgacc

SEQ ID NO: 1350328 - RNA, 14 nt, Mycobacterium tuberculosis H37Rv
cgggcgggaugacg

SEQ ID NO: 1350329 - RNA, 20 nt, Mycobacterium tuberculosis H37Rv
cgggcgcgguucgucggcga

SEQ ID NO: 1350330 - RNA, 21 nt, Mycobacterium tuberculosis H37Rv
cgggcgcuguagucgcgccuc

SEQ ID NO: 1350331 - RNA, 16 nt, Mycobacterium tuberculosis H37Rv
cgggcgcuggacggcg

SEQ ID NO: 1350332 - RNA, 20 nt, Mycobacterium tuberculosis H37Rv
cgggcggaaagcccgucggg

SEQ ID NO: 1350333 - RNA, 12 nt, Mycobacterium tuberculosis H37Rv
cgggcgcggggc

SEQ ID NO: 1350334 - RNA, 16 nt, Mycobacterium tuberculosis H37Rv
cgggcgcggggcggcc

SEQ ID NO: 1350335 - RNA, 14 nt, Mycobacterium tuberculosis H37Rv
cgggcgcgcguagc

SEQ ID NO: 1350336 - RNA, 11 nt, Mycobacterium tuberculosis H37Rv
cgggcgcgcuu

SEQ ID NO: 1350337 - RNA, 20 nt, Mycobacterium tuberculosis H37Rv
cgggcgccuuggucgccgcu

SEQ ID NO: 1350338 - RNA, 21 nt, Mycobacterium tuberculosis H37Rv
cgggcgccuuggucgccgccu

SEQ ID NO: 1350339 - RNA, 19 nt, Mycobacterium tuberculosis H37Rv
cgggcgccuuggucgccgc

SEQ ID NO: 1350340 - RNA, 15 nt, Mycobacterium tuberculosis H37Rv
cgggcgcgccggcca

SEQ ID NO: 1350341 - RNA, 22 nt, Mycobacterium tuberculosis H37Rv
cgggcgcgaggacgcugaucca

SEQ ID NO: 1350342 - RNA, 19 nt, Mycobacterium tuberculosis H37Rv
cgggcgccuuccaggcggg

SEQ ID NO: 1350343 - RNA, 13 nt, Mycobacterium tuberculosis H37Rv
cgggcgccgcagc

SEQ ID NO: 1350344 - RNA, 20 nt, Mycobacterium tuberculosis H37Rv
cgggcgcccuuaagccggcg

SEQ ID NO: 1350345 - RNA, 17 nt, Mycobacterium tuberculosis H37Rv
cgggcgccaacgggcug

SEQ ID NO: 1350346 - RNA, 19 nt, Mycobacterium tuberculosis H37Rv
cgggcgccccaccggcccg

SEQ ID NO: 1350347 - RNA, 22 nt, Mycobacterium tuberculosis H37Rv
cgggcgccaacgggcugccccu

SEQ ID NO: 1350348 - RNA, 17 nt, Mycobacterium tuberculosis H37Rv
cgcugaggaagcggcgg

SEQ ID NO: 1350349 - RNA, 19 nt, Mycobacterium tuberculosis H37Rv
cgcugaaucaccccggcgg

SEQ ID NO: 1350350 - RNA, 16 nt, Mycobacterium tuberculosis H37Rv
cgcugaugcaucccaa

SEQ ID NO: 1350351 - RNA, 22 nt, Mycobacterium tuberculosis H37Rv
cgcugauaguggcgcgcggcgc

SEQ ID NO: 1350352 - RNA, 18 nt, Mycobacterium tuberculosis H37Rv
cgcugccagccguucccc

SEQ ID NO: 1350353 - RNA, 16 nt, Mycobacterium tuberculosis H37Rv
cgcugccagcggccgg

SEQ ID NO: 1350354 - RNA, 13 nt, Mycobacterium tuberculosis H37Rv
cgcugccccgccg

SEQ ID NO: 1350355 - RNA, 14 nt, Mycobacterium tuberculosis H37Rv
cgcugccccgccgc

SEQ ID NO: 1350356 - RNA, 15 nt, Mycobacterium tuberculosis H37Rv
cgcugccaucgccuu

SEQ ID NO: 1350357 - RNA, 20 nt, Mycobacterium tuberculosis H37Rv
cgcugcccacggagggcagg

SEQ ID NO: 1350358 - RNA, 19 nt, Mycobacterium tuberculosis H37Rv
cgcugccagggugcgccgg

SEQ ID NO: 1350359 - RNA, 17 nt, Mycobacterium tuberculosis H37Rv
cgcugccccgccgccau

SEQ ID NO: 1350360 - RNA, 14 nt, Mycobacterium tuberculosis H37Rv
cgcugcccgccagc

SEQ ID NO: 1350361 - RNA, 15 nt, Mycobacterium tuberculosis H37Rv
cgcucggcggccagc

SEQ ID NO: 1350362 - RNA, 19 nt, Mycobacterium tuberculosis H37Rv
cgcucggcguccgcccagc

SEQ ID NO: 1350363 - RNA, 11 nt, Mycobacterium tuberculosis H37Rv
cgcucagggug

SEQ ID NO: 1350364 - RNA, 17 nt, Mycobacterium tuberculosis H37Rv
cgcucgucguccggcca

SEQ ID NO: 1350365 - RNA, 22 nt, Mycobacterium tuberculosis H37Rv
cgcucguuagcggcgggcacgc

SEQ ID NO: 1350366 - RNA, 22 nt, Mycobacterium tuberculosis H37Rv
cgcucggugcugcgccgauacg

SEQ ID NO: 1350367 - RNA, 21 nt, Mycobacterium tuberculosis H37Rv
cgcucgguuugcguccuggug

SEQ ID NO: 1350368 - RNA, 17 nt, Mycobacterium tuberculosis H37Rv
cgcucggucgccaccgc

SEQ ID NO: 1350369 - RNA, 15 nt, Mycobacterium tuberculosis H37Rv
cgcucgguccagccg

SEQ ID NO: 1350370 - RNA, 19 nt, Mycobacterium tuberculosis H37Rv
cgcucguugcguugcauca

SEQ ID NO: 1350371 - RNA, 20 nt, Mycobacterium tuberculosis H37Rv
cgcugaaguggcacaagcug

SEQ ID NO: 1350372 - RNA, 22 nt, Mycobacterium tuberculosis H37Rv
cgcugaacgcuguaagcaugcc

SEQ ID NO: 1350373 - RNA, 13 nt, Mycobacterium tuberculosis H37Rv
cgcugcgcggccc

SEQ ID NO: 1350374 - RNA, 18 nt, Mycobacterium tuberculosis H37Rv
cgcugcgcgacugauccu

SEQ ID NO: 1350375 - RNA, 16 nt, Mycobacterium tuberculosis H37Rv
cgcugccgcccuugcc

SEQ ID NO: 1350376 - RNA, 12 nt, Mycobacterium tuberculosis H37Rv
cgcugcggcggu

SEQ ID NO: 1350377 - RNA, 13 nt, Mycobacterium tuberculosis H37Rv
cgcugcggcggcu

SEQ ID NO: 1350378 - RNA, 18 nt, Mycobacterium tuberculosis H37Rv
cgcugcggcccacaccag

SEQ ID NO: 1350379 - RNA, 22 nt, Mycobacterium tuberculosis H37Rv
cgcugcucuuuuagccacaauc

SEQ ID NO: 1350380 - RNA, 13 nt, Mycobacterium tuberculosis H37Rv
cgcugcucacgca

SEQ ID NO: 1350381 - RNA, 16 nt, Mycobacterium tuberculosis H37Rv
cgcugcucacgcagca

SEQ ID NO: 1350382 - RNA, 12 nt, Mycobacterium tuberculosis H37Rv
cgcuggcccgcc

SEQ ID NO: 1350383 - RNA, 19 nt, Mycobacterium tuberculosis H37Rv
cgcuggccacgauccgcgg

SEQ ID NO: 1350384 - RNA, 15 nt, Mycobacterium tuberculosis H37Rv
cgcuggccagcccgg

SEQ ID NO: 1350385 - RNA, 22 nt, Mycobacterium tuberculosis H37Rv
cgcuggccucgucgcugcccau

SEQ ID NO: 1350386 - RNA, 15 nt, Mycobacterium tuberculosis H37Rv
cgcuggccuccugga

SEQ ID NO: 1350387 - RNA, 18 nt, Mycobacterium tuberculosis H37Rv
cgcuggccuccagcuugg

SEQ ID NO: 1350388 - RNA, 14 nt, Mycobacterium tuberculosis H37Rv
cgcuggcgccgccg

SEQ ID NO: 1350389 - RNA, 23 nt, Mycobacterium tuberculosis H37Rv
cgcuggcgcccccgacgacggca

SEQ ID NO: 1350390 - RNA, 14 nt, Mycobacterium tuberculosis H37Rv
cgcuggaggccacc

SEQ ID NO: 1350391 - RNA, 16 nt, Mycobacterium tuberculosis H37Rv
cgcuggaggccaccac

SEQ ID NO: 1350392 - RNA, 21 nt, Mycobacterium tuberculosis H37Rv
cgcuggcacacuccugcacca

SEQ ID NO: 1350393 - RNA, 22 nt, Mycobacterium tuberculosis H37Rv
cgcuggaucuucgacaggccac

SEQ ID NO: 1350394 - RNA, 16 nt, Mycobacterium tuberculosis H37Rv
cgcuggcaaucccgcg

SEQ ID NO: 1350395 - RNA, 21 nt, Mycobacterium tuberculosis H37Rv
cgcugcuugaggucccgugcg

SEQ ID NO: 1350396 - RNA, 15 nt, Mycobacterium tuberculosis H37Rv
cgcugcucuggacgg

SEQ ID NO: 1350397 - RNA, 21 nt, Mycobacterium tuberculosis H37Rv
cgcugcuggucuugccgugca

SEQ ID NO: 1350398 - RNA, 15 nt, Mycobacterium tuberculosis H37Rv
cggaaacaagcaagc

SEQ ID NO: 1350399 - RNA, 15 nt, Mycobacterium tuberculosis H37Rv
cggaaacccggccgc

SEQ ID NO: 1350400 - RNA, 20 nt, Mycobacterium tuberculosis H37Rv
cgcuugccccgccuuggcca

SEQ ID NO: 1350401 - RNA, 14 nt, Mycobacterium tuberculosis H37Rv
cgcuugccgcugag

SEQ ID NO: 1350402 - RNA, 14 nt, Mycobacterium tuberculosis H37Rv
cgcuggcgggcggc

SEQ ID NO: 1350403 - RNA, 13 nt, Mycobacterium tuberculosis H37Rv
cgcuggcggcgca

SEQ ID NO: 1350404 - RNA, 16 nt, Mycobacterium tuberculosis H37Rv
cgcuggcggcgcagcg

SEQ ID NO: 1350405 - RNA, 20 nt, Mycobacterium tuberculosis H37Rv
cgcuggcgggcacucagcag

SEQ ID NO: 1350406 - RNA, 14 nt, Mycobacterium tuberculosis H37Rv
cgcuggcgggcagc

SEQ ID NO: 1350407 - RNA, 19 nt, Mycobacterium tuberculosis H37Rv
cgcugggcgcgcucaucga

SEQ ID NO: 1350408 - RNA, 17 nt, Mycobacterium tuberculosis H37Rv
cgcuggguccccuccca

SEQ ID NO: 1350409 - RNA, 18 nt, Mycobacterium tuberculosis H37Rv
cgcugggcccaggagauc

SEQ ID NO: 1350410 - RNA, 19 nt, Mycobacterium tuberculosis H37Rv
cgcugggcccgagcgcgcg

SEQ ID NO: 1350411 - RNA, 22 nt, Mycobacterium tuberculosis H37Rv
cgcugggcgccgucgggccugc

SEQ ID NO: 1350412 - RNA, 19 nt, Mycobacterium tuberculosis H37Rv
cgcugggacgggcgcgucg

SEQ ID NO: 1350413 - RNA, 16 nt, Mycobacterium tuberculosis H37Rv
cgcugggacggucgcu

SEQ ID NO: 1350414 - RNA, 15 nt, Mycobacterium tuberculosis H37Rv
cgcuggucggcggcu

SEQ ID NO: 1350415 - RNA, 17 nt, Mycobacterium tuberculosis H37Rv
cgcuggucgaugccuuc

SEQ ID NO: 1350416 - RNA, 22 nt, Mycobacterium tuberculosis H37Rv
cgcuggugcgccacgccaccgc

SEQ ID NO: 1350417 - RNA, 14 nt, Mycobacterium tuberculosis H37Rv
cgcuggugcacggc

SEQ ID NO: 1350418 - RNA, 14 nt, Mycobacterium tuberculosis H37Rv
cgcuguggcucgac

SEQ ID NO: 1350419 - RNA, 13 nt, Mycobacterium tuberculosis H37Rv
cgcuguuccucga

SEQ ID NO: 1350420 - RNA, 19 nt, Mycobacterium tuberculosis H37Rv
cgcuguugcuggcgccccc

SEQ ID NO: 1350421 - RNA, 21 nt, Mycobacterium tuberculosis H37Rv
cgcuguugccaucgacgccgc

SEQ ID NO: 1350422 - RNA, 13 nt, Mycobacterium tuberculosis H37Rv
cgcuguuguuguc

SEQ ID NO: 1350423 - RNA, 22 nt, Mycobacterium tuberculosis H37Rv
cgcuuaacagcggguccuucug

SEQ ID NO: 1350424 - RNA, 13 nt, Mycobacterium tuberculosis H37Rv
cgcuguccagguc

SEQ ID NO: 1350425 - RNA, 18 nt, Mycobacterium tuberculosis H37Rv
cgcuguaggccagcccgg

SEQ ID NO: 1350426 - RNA, 19 nt, Mycobacterium tuberculosis H37Rv
cgcugucguaccgcucggc

SEQ ID NO: 1350427 - RNA, 13 nt, Mycobacterium tuberculosis H37Rv
cgcggggccgccg

SEQ ID NO: 1350428 - RNA, 14 nt, Mycobacterium tuberculosis H37Rv
cgcggggccgccgc

SEQ ID NO: 1350429 - RNA, 18 nt, Mycobacterium tuberculosis H37Rv
cgcggggcggcugcgggc

SEQ ID NO: 1350430 - RNA, 13 nt, Mycobacterium tuberculosis H37Rv
cgcggggccggcc

SEQ ID NO: 1350431 - RNA, 17 nt, Mycobacterium tuberculosis H37Rv
cgcggggccggccggca

SEQ ID NO: 1350432 - RNA, 16 nt, Mycobacterium tuberculosis H37Rv
cgcgggccgacgcagg

SEQ ID NO: 1350433 - RNA, 21 nt, Mycobacterium tuberculosis H37Rv
cgcgggccccaucgccuggau

SEQ ID NO: 1350434 - RNA, 18 nt, Mycobacterium tuberculosis H37Rv
cgcgggccagcaccucga

SEQ ID NO: 1350435 - RNA, 13 nt, Mycobacterium tuberculosis H37Rv
cgcgggccaccac

SEQ ID NO: 1350436 - RNA, 18 nt, Mycobacterium tuberculosis H37Rv
cgcgggcaguggcagccc

SEQ ID NO: 1350437 - RNA, 14 nt, Mycobacterium tuberculosis H37Rv
cgcgggccagcacc

SEQ ID NO: 1350438 - RNA, 15 nt, Mycobacterium tuberculosis H37Rv
cgcgggcaggucguu

SEQ ID NO: 1350439 - RNA, 14 nt, Mycobacterium tuberculosis H37Rv
cgcggggcucaacc

SEQ ID NO: 1350440 - RNA, 14 nt, Mycobacterium tuberculosis H37Rv
cgcgggguggcggc

SEQ ID NO: 1350441 - RNA, 20 nt, Mycobacterium tuberculosis H37Rv
cgcgggguugauugacccgu

SEQ ID NO: 1350442 - RNA, 16 nt, Mycobacterium tuberculosis H37Rv
cgcggggugcgcgcga

SEQ ID NO: 1350443 - RNA, 17 nt, Mycobacterium tuberculosis H37Rv
cgcggguguuccacacc

SEQ ID NO: 1350444 - RNA, 14 nt, Mycobacterium tuberculosis H37Rv
cgcggguggcgcca

SEQ ID NO: 1350445 - RNA, 19 nt, Mycobacterium tuberculosis H37Rv
cgcgggugccgggcaugau

SEQ ID NO: 1350446 - RNA, 19 nt, Mycobacterium tuberculosis H37Rv
cgcgggucguccggcggca

SEQ ID NO: 1350447 - RNA, 20 nt, Mycobacterium tuberculosis H37Rv
cgcgggugaugacgccgucg

SEQ ID NO: 1350448 - RNA, 23 nt, Mycobacterium tuberculosis H37Rv
cgcggguuugaucuccaccuucu

SEQ ID NO: 1350449 - RNA, 20 nt, Mycobacterium tuberculosis H37Rv
cgcggguguuccacaccagg

SEQ ID NO: 1350450 - RNA, 23 nt, Mycobacterium tuberculosis H37Rv
cgcggcugccagaaugggcggca

SEQ ID NO: 1350451 - RNA, 16 nt, Mycobacterium tuberculosis H37Rv
cgcggcugacaagccu

SEQ ID NO: 1350452 - RNA, 11 nt, Mycobacterium tuberculosis H37Rv
cgcggcugacg

SEQ ID NO: 1350453 - RNA, 22 nt, Mycobacterium tuberculosis H37Rv
cgcggcugacgguuugcggagc

SEQ ID NO: 1350454 - RNA, 22 nt, Mycobacterium tuberculosis H37Rv
cgcggcugugcccgaucagccg

SEQ ID NO: 1350455 - RNA, 17 nt, Mycobacterium tuberculosis H37Rv
cgcggcuucacugcuag

SEQ ID NO: 1350456 - RNA, 16 nt, Mycobacterium tuberculosis H37Rv
cgcggcuucaguccgg

SEQ ID NO: 1350457 - RNA, 17 nt, Mycobacterium tuberculosis H37Rv
cgcggcucaaucuccuc

SEQ ID NO: 1350458 - RNA, 17 nt, Mycobacterium tuberculosis H37Rv
cgcggcuauggcgccgc

SEQ ID NO: 1350459 - RNA, 20 nt, Mycobacterium tuberculosis H37Rv
cgcggcuaggccagcacggc

SEQ ID NO: 1350460 - RNA, 15 nt, Mycobacterium tuberculosis H37Rv
cgcggcgcggccgca

SEQ ID NO: 1350461 - RNA, 12 nt, Mycobacterium tuberculosis H37Rv
cgcggcgcggcc

SEQ ID NO: 1350462 - RNA, 13 nt, Mycobacterium tuberculosis H37Rv
cgcggcgccgcca

SEQ ID NO: 1350463 - RNA, 17 nt, Mycobacterium tuberculosis H37Rv
cgcggcgcccuggccgc

SEQ ID NO: 1350464 - RNA, 16 nt, Mycobacterium tuberculosis H37Rv
cgcggcgcccggcgga

SEQ ID NO: 1350465 - RNA, 17 nt, Mycobacterium tuberculosis H37Rv
cgcggcgcaggucgcgc

SEQ ID NO: 1350466 - RNA, 18 nt, Mycobacterium tuberculosis H37Rv
cgcggcgcaggucgcgca

SEQ ID NO: 1350467 - RNA, 20 nt, Mycobacterium tuberculosis H37Rv
cgcggcgcauuccggcgcca

SEQ ID NO: 1350468 - RNA, 20 nt, Mycobacterium tuberculosis H37Rv
cgcggcgcagcacggcggcc

SEQ ID NO: 1350469 - RNA, 18 nt, Mycobacterium tuberculosis H37Rv
cgcggcgauuacggccag

SEQ ID NO: 1350470 - RNA, 17 nt, Mycobacterium tuberculosis H37Rv
cgcggcgcacaacccgu

SEQ ID NO: 1350471 - RNA, 16 nt, Mycobacterium tuberculosis H37Rv
cgcggcgagcuccgau

SEQ ID NO: 1350472 - RNA, 12 nt, Mycobacterium tuberculosis H37Rv
cgcggcgaucac

SEQ ID NO: 1350473 - RNA, 12 nt, Mycobacterium tuberculosis H37Rv
cgcggccgggcc

SEQ ID NO: 1350474 - RNA, 15 nt, Mycobacterium tuberculosis H37Rv
cgcggccggccgccc

SEQ ID NO: 1350475 - RNA, 13 nt, Mycobacterium tuberculosis H37Rv
cgcggccgggcgc

SEQ ID NO: 1350476 - RNA, 16 nt, Mycobacterium tuberculosis H37Rv
cgcggccggcacgacc

SEQ ID NO: 1350477 - RNA, 21 nt, Mycobacterium tuberculosis H37Rv
cgcggccggaauacccggccc

SEQ ID NO: 1350478 - RNA, 16 nt, Mycobacterium tuberculosis H37Rv
cgcggccgcggugacg

SEQ ID NO: 1350479 - RNA, 19 nt, Mycobacterium tuberculosis H37Rv
cgcggccgccguccccgcc

SEQ ID NO: 1350480 - RNA, 12 nt, Mycobacterium tuberculosis H37Rv
cgcggccgcccc

SEQ ID NO: 1350481 - RNA, 18 nt, Mycobacterium tuberculosis H37Rv
cgcggccgcagccagcaa

SEQ ID NO: 1350482 - RNA, 16 nt, Mycobacterium tuberculosis H37Rv
cgcggccgcagccagc

SEQ ID NO: 1350483 - RNA, 21 nt, Mycobacterium tuberculosis H37Rv
cgcggcccgcucgaucggcag

SEQ ID NO: 1350484 - RNA, 22 nt, Mycobacterium tuberculosis H37Rv
cgcggcccggacgucggcggcc

SEQ ID NO: 1350485 - RNA, 21 nt, Mycobacterium tuberculosis H37Rv
cgcggccaaucagcccgccgg

SEQ ID NO: 1350486 - RNA, 18 nt, Mycobacterium tuberculosis H37Rv
cgcggccaauugcgccgc

SEQ ID NO: 1350487 - RNA, 18 nt, Mycobacterium tuberculosis H37Rv
cgcggcaucgacgcggcc

SEQ ID NO: 1350488 - RNA, 22 nt, Mycobacterium tuberculosis H37Rv
cgcggcaugcaaugcuggcggc

SEQ ID NO: 1350489 - RNA, 23 nt, Mycobacterium tuberculosis H37Rv
cgcggcaugcaaugcuggcggcg

SEQ ID NO: 1350490 - RNA, 22 nt, Mycobacterium tuberculosis H37Rv
cgcggcagguugcguugcagga

SEQ ID NO: 1350491 - RNA, 15 nt, Mycobacterium tuberculosis H37Rv
cgcggaugcauguca

SEQ ID NO: 1350492 - RNA, 22 nt, Mycobacterium tuberculosis H37Rv
cgcggcaaaguuggccgcccga

SEQ ID NO: 1350493 - RNA, 17 nt, Mycobacterium tuberculosis H37Rv
cgcgccgcuaaccggac

SEQ ID NO: 1350494 - RNA, 21 nt, Mycobacterium tuberculosis H37Rv
cgcgccgcggcccgcuccacg

SEQ ID NO: 1350495 - RNA, 20 nt, Mycobacterium tuberculosis H37Rv
cgcgccggcagacccgggcc

SEQ ID NO: 1350496 - RNA, 21 nt, Mycobacterium tuberculosis H37Rv
cgcgccggcagacccgggcca

SEQ ID NO: 1350497 - RNA, 22 nt, Mycobacterium tuberculosis H37Rv
cgcggaucgaccgccagcgccg

SEQ ID NO: 1350498 - RNA, 17 nt, Mycobacterium tuberculosis H37Rv
cgcggaucggcggccgc

SEQ ID NO: 1350499 - RNA, 22 nt, Mycobacterium tuberculosis H37Rv
cgcgccggcgggcgcgggcgcc

SEQ ID NO: 1350500 - RNA, 12 nt, Mycobacterium tuberculosis H37Rv
cgcgccggcggc

SEQ ID NO: 1350501 - RNA, 12 nt, Mycobacterium tuberculosis H37Rv
cgcgccggcggu

SEQ ID NO: 1350502 - RNA, 16 nt, Mycobacterium tuberculosis H37Rv
cgcucacugcagcgcc

SEQ ID NO: 1350503 - RNA, 17 nt, Mycobacterium tuberculosis H37Rv
cgcucacggcccgagcc

SEQ ID NO: 1350504 - RNA, 14 nt, Mycobacterium tuberculosis H37Rv
cgcucacggggcgu

SEQ ID NO: 1350505 - RNA, 13 nt, Mycobacterium tuberculosis H37Rv
cgcuauggcauua

SEQ ID NO: 1350506 - RNA, 14 nt, Mycobacterium tuberculosis H37Rv
cgcuauggcccggg

SEQ ID NO: 1350507 - RNA, 14 nt, Mycobacterium tuberculosis H37Rv
cgcuaugccccgga

SEQ ID NO: 1350508 - RNA, 17 nt, Mycobacterium tuberculosis H37Rv
cgcuacgcgcgcucgcu

SEQ ID NO: 1350509 - RNA, 22 nt, Mycobacterium tuberculosis H37Rv
cgcuaccgucaguagccacgcc

SEQ ID NO: 1350510 - RNA, 17 nt, Mycobacterium tuberculosis H37Rv
cgcuacguaaucagccc

SEQ ID NO: 1350511 - RNA, 20 nt, Mycobacterium tuberculosis H37Rv
cgcgugcagcggcgccgcca

SEQ ID NO: 1350512 - RNA, 15 nt, Mycobacterium tuberculosis H37Rv
cgcgugcaccgagcc

SEQ ID NO: 1350513 - RNA, 15 nt, Mycobacterium tuberculosis H37Rv
cgcgucggagccggg

SEQ ID NO: 1350514 - RNA, 17 nt, Mycobacterium tuberculosis H37Rv
cgcgugacgaccagccc

SEQ ID NO: 1350515 - RNA, 14 nt, Mycobacterium tuberculosis H37Rv
cgcgucgcgcgccu

SEQ ID NO: 1350516 - RNA, 16 nt, Mycobacterium tuberculosis H37Rv
cgcgugcggcugccag

SEQ ID NO: 1350517 - RNA, 20 nt, Mycobacterium tuberculosis H37Rv
cgcgugcggcugccagugcc

SEQ ID NO: 1350518 - RNA, 14 nt, Mycobacterium tuberculosis H37Rv
cgcgugcaggcugu

SEQ ID NO: 1350519 - RNA, 17 nt, Mycobacterium tuberculosis H37Rv
cgcgugccgcccgccuc

SEQ ID NO: 1350520 - RNA, 18 nt, Mycobacterium tuberculosis H37Rv
cgcgugccgcccgccucu

SEQ ID NO: 1350521 - RNA, 17 nt, Mycobacterium tuberculosis H37Rv
cgcgugcgcaucccgaa

SEQ ID NO: 1350522 - RNA, 23 nt, Mycobacterium tuberculosis H37Rv
cgcuaccgaacaguaggccuccg

SEQ ID NO: 1350523 - RNA, 16 nt, Mycobacterium tuberculosis H37Rv
cgcuaccgcccgcgcc

SEQ ID NO: 1350524 - RNA, 15 nt, Mycobacterium tuberculosis H37Rv
cgcuacccccgaugg

SEQ ID NO: 1350525 - RNA, 21 nt, Mycobacterium tuberculosis H37Rv
cgcuaccgcccgcgccaccgg

SEQ ID NO: 1350526 - RNA, 12 nt, Mycobacterium tuberculosis H37Rv
cgcuacccgcgc

SEQ ID NO: 1350527 - RNA, 16 nt, Mycobacterium tuberculosis H37Rv
cgcuacccgcgcgacc

SEQ ID NO: 1350528 - RNA, 22 nt, Mycobacterium tuberculosis H37Rv
cgcuaacagauuguccggccgg

SEQ ID NO: 1350529 - RNA, 23 nt, Mycobacterium tuberculosis H37Rv
cgcuaaaacgccagucgagcacc

SEQ ID NO: 1350530 - RNA, 15 nt, Mycobacterium tuberculosis H37Rv
cgcuaaagcuaaacc

SEQ ID NO: 1350531 - RNA, 14 nt, Mycobacterium tuberculosis H37Rv
cgcgucgccagaua

SEQ ID NO: 1350532 - RNA, 18 nt, Mycobacterium tuberculosis H37Rv
cgcgucgaguuuugcggc

SEQ ID NO: 1350533 - RNA, 20 nt, Mycobacterium tuberculosis H37Rv
cgcgucgaucguuccgcugg

SEQ ID NO: 1350534 - RNA, 14 nt, Mycobacterium tuberculosis H37Rv
cgcgucgagcagca

SEQ ID NO: 1350535 - RNA, 15 nt, Mycobacterium tuberculosis H37Rv
cgcgucgagcagcac

SEQ ID NO: 1350536 - RNA, 22 nt, Mycobacterium tuberculosis H37Rv
cgcgucgaacugggcgcccgcg

SEQ ID NO: 1350537 - RNA, 21 nt, Mycobacterium tuberculosis H37Rv
cgcguccgggcucgcgcucga

SEQ ID NO: 1350538 - RNA, 18 nt, Mycobacterium tuberculosis H37Rv
cgcguccgggcagccgcg

SEQ ID NO: 1350539 - RNA, 22 nt, Mycobacterium tuberculosis H37Rv
cgcguccgggcagccgcgccgc

SEQ ID NO: 1350540 - RNA, 12 nt, Mycobacterium tuberculosis H37Rv
cgcguccuccuc

SEQ ID NO: 1350541 - RNA, 20 nt, Mycobacterium tuberculosis H37Rv
cgcguccgcaggcgauugca

SEQ ID NO: 1350542 - RNA, 13 nt, Mycobacterium tuberculosis H37Rv
cgcgucccgccgc

SEQ ID NO: 1350543 - RNA, 15 nt, Mycobacterium tuberculosis H37Rv
cgcgucaggccagcg

SEQ ID NO: 1350544 - RNA, 17 nt, Mycobacterium tuberculosis H37Rv
cgcguccagcgcggccu

SEQ ID NO: 1350545 - RNA, 16 nt, Mycobacterium tuberculosis H37Rv
cgcgguuucggcguca

SEQ ID NO: 1350546 - RNA, 15 nt, Mycobacterium tuberculosis H37Rv
cgcggugacgccagc

SEQ ID NO: 1350547 - RNA, 16 nt, Mycobacterium tuberculosis H37Rv
cgcggugacggcggcu

SEQ ID NO: 1350548 - RNA, 22 nt, Mycobacterium tuberculosis H37Rv
cgcggucgugaucagcaggacg

SEQ ID NO: 1350549 - RNA, 19 nt, Mycobacterium tuberculosis H37Rv
cgcggucugcgccuucgcc

SEQ ID NO: 1350550 - RNA, 18 nt, Mycobacterium tuberculosis H37Rv
cgcggucgauguccgcag

SEQ ID NO: 1350551 - RNA, 17 nt, Mycobacterium tuberculosis H37Rv
cgcggucgcagcagacc

SEQ ID NO: 1350552 - RNA, 14 nt, Mycobacterium tuberculosis H37Rv
cgcggucggcagcg

SEQ ID NO: 1350553 - RNA, 19 nt, Mycobacterium tuberculosis H37Rv
cgcggucggaccacccggc

SEQ ID NO: 1350554 - RNA, 12 nt, Mycobacterium tuberculosis H37Rv
cgcggucggcag

SEQ ID NO: 1350555 - RNA, 15 nt, Mycobacterium tuberculosis H37Rv
cgcgguacugcgcag

SEQ ID NO: 1350556 - RNA, 21 nt, Mycobacterium tuberculosis H37Rv
cgcgguaccaucaccgcgcca

SEQ ID NO: 1350557 - RNA, 16 nt, Mycobacterium tuberculosis H37Rv
cgcgguagcucgucga

SEQ ID NO: 1350558 - RNA, 19 nt, Mycobacterium tuberculosis H37Rv
cgcggucgagguggcgggc

SEQ ID NO: 1350559 - RNA, 19 nt, Mycobacterium tuberculosis H37Rv
cgcggucagcucggcagca

SEQ ID NO: 1350560 - RNA, 18 nt, Mycobacterium tuberculosis H37Rv
cgcggucagcucggcagc

SEQ ID NO: 1350561 - RNA, 21 nt, Mycobacterium tuberculosis H37Rv
cgcggucagccauguccgcag

SEQ ID NO: 1350562 - RNA, 24 nt, Mycobacterium tuberculosis H37Rv
cggccaggucgacaccgcggugcc

SEQ ID NO: 1350563 - RNA, 24 nt, Mycobacterium tuberculosis H37Rv
cggccaggucgcgauagccgccgc

SEQ ID NO: 1350564 - RNA, 16 nt, Mycobacterium tuberculosis H37Rv
cggccaguccaagcug

SEQ ID NO: 1350565 - RNA, 16 nt, Mycobacterium tuberculosis H37Rv
cggccaguccgcgcgc

SEQ ID NO: 1350566 - RNA, 12 nt, Mycobacterium tuberculosis H37Rv
cggccagugaca

SEQ ID NO: 1350567 - RNA, 16 nt, Mycobacterium tuberculosis H37Rv
cggccagugccaucgc

SEQ ID NO: 1350568 - RNA, 15 nt, Mycobacterium tuberculosis H37Rv
cggccaguccgggga

SEQ ID NO: 1350569 - RNA, 12 nt, Mycobacterium tuberculosis H37Rv
cggcccagcccu

SEQ ID NO: 1350570 - RNA, 15 nt, Mycobacterium tuberculosis H37Rv
cggcccaccaggccc

SEQ ID NO: 1350571 - RNA, 17 nt, Mycobacterium tuberculosis H37Rv
cggcccaccggucgcgc

SEQ ID NO: 1350572 - RNA, 21 nt, Mycobacterium tuberculosis H37Rv
cggcccacaccagcgcagcau

SEQ ID NO: 1350573 - RNA, 21 nt, Mycobacterium tuberculosis H37Rv
cggccauuagcagcacccggg

SEQ ID NO: 1350574 - RNA, 23 nt, Mycobacterium tuberculosis H37Rv
cggccauuagcagcacccgggcc

SEQ ID NO: 1350575 - RNA, 16 nt, Mycobacterium tuberculosis H37Rv
cggccauguagccguu

SEQ ID NO: 1350576 - RNA, 22 nt, Mycobacterium tuberculosis H37Rv
cggccaguucggcggccgccgc

SEQ ID NO: 1350577 - RNA, 20 nt, Mycobacterium tuberculosis H37Rv
cggccauguugcccugcaac

SEQ ID NO: 1350578 - RNA, 16 nt, Mycobacterium tuberculosis H37Rv
cggccagugcgcgcgu

SEQ ID NO: 1350579 - RNA, 12 nt, Mycobacterium tuberculosis H37Rv
cggccagcagcg

SEQ ID NO: 1350580 - RNA, 13 nt, Mycobacterium tuberculosis H37Rv
cggccagcccagc

SEQ ID NO: 1350581 - RNA, 16 nt, Mycobacterium tuberculosis H37Rv
cggccagcgcaccgcc

SEQ ID NO: 1350582 - RNA, 13 nt, Mycobacterium tuberculosis H37Rv
cggccagccgcuc

SEQ ID NO: 1350583 - RNA, 20 nt, Mycobacterium tuberculosis H37Rv
cggcaucgccgagguggaca

SEQ ID NO: 1350584 - RNA, 13 nt, Mycobacterium tuberculosis H37Rv
cggcaucgagcag

SEQ ID NO: 1350585 - RNA, 20 nt, Mycobacterium tuberculosis H37Rv
cggcaucgaguucggcccgc

SEQ ID NO: 1350586 - RNA, 17 nt, Mycobacterium tuberculosis H37Rv
cggcaucgacugccagc

SEQ ID NO: 1350587 - RNA, 20 nt, Mycobacterium tuberculosis H37Rv
cggcaucgagacgcacggcc

SEQ ID NO: 1350588 - RNA, 23 nt, Mycobacterium tuberculosis H37Rv
cggcauccucugaaccugcugag

SEQ ID NO: 1350589 - RNA, 19 nt, Mycobacterium tuberculosis H37Rv
cggcaucccggccgcucag

SEQ ID NO: 1350590 - RNA, 18 nt, Mycobacterium tuberculosis H37Rv
cggcauccacaccgaccg

SEQ ID NO: 1350591 - RNA, 15 nt, Mycobacterium tuberculosis H37Rv
cggcaucggccagcc

SEQ ID NO: 1350592 - RNA, 13 nt, Mycobacterium tuberculosis H37Rv
cggcaucgcgggc

SEQ ID NO: 1350593 - RNA, 18 nt, Mycobacterium tuberculosis H37Rv
cggcaucgcgggcggcgc

SEQ ID NO: 1350594 - RNA, 15 nt, Mycobacterium tuberculosis H37Rv
cggccagcagcagau

SEQ ID NO: 1350595 - RNA, 16 nt, Mycobacterium tuberculosis H37Rv
cggcaucggugguaac

SEQ ID NO: 1350596 - RNA, 13 nt, Mycobacterium tuberculosis H37Rv
cggcaucgggggc

SEQ ID NO: 1350597 - RNA, 18 nt, Mycobacterium tuberculosis H37Rv
cggccagcagcagugcca

SEQ ID NO: 1350598 - RNA, 16 nt, Mycobacterium tuberculosis H37Rv
cggcccgagccgcuag

SEQ ID NO: 1350599 - RNA, 16 nt, Mycobacterium tuberculosis H37Rv
cggcccgauccagugg

SEQ ID NO: 1350600 - RNA, 19 nt, Mycobacterium tuberculosis H37Rv
cggcccgcacggccgcagc

SEQ ID NO: 1350601 - RNA, 14 nt, Mycobacterium tuberculosis H37Rv
cggccccggccgcg

SEQ ID NO: 1350602 - RNA, 16 nt, Mycobacterium tuberculosis H37Rv
cggccccggccgcguc

SEQ ID NO: 1350603 - RNA, 13 nt, Mycobacterium tuberculosis H37Rv
cggccccggccgc

SEQ ID NO: 1350604 - RNA, 18 nt, Mycobacterium tuberculosis H37Rv
cggccccgccggccccgc

SEQ ID NO: 1350605 - RNA, 20 nt, Mycobacterium tuberculosis H37Rv
cggccccgccgaugccgccg

SEQ ID NO: 1350606 - RNA, 14 nt, Mycobacterium tuberculosis H37Rv
cggccccgcgcagc

SEQ ID NO: 1350607 - RNA, 16 nt, Mycobacterium tuberculosis H37Rv
cggcccccggucgagc

SEQ ID NO: 1350608 - RNA, 12 nt, Mycobacterium tuberculosis H37Rv
cggcccgcgggc

SEQ ID NO: 1350609 - RNA, 13 nt, Mycobacterium tuberculosis H37Rv
cggcccgcucagc

SEQ ID NO: 1350610 - RNA, 13 nt, Mycobacterium tuberculosis H37Rv
cggcccgcuccac

SEQ ID NO: 1350611 - RNA, 17 nt, Mycobacterium tuberculosis H37Rv
cggcccgcugcgcggcc

SEQ ID NO: 1350612 - RNA, 18 nt, Mycobacterium tuberculosis H37Rv
cggcccgcugcgcggccc

SEQ ID NO: 1350613 - RNA, 15 nt, Mycobacterium tuberculosis H37Rv
cggcccgcagcagca

SEQ ID NO: 1350614 - RNA, 19 nt, Mycobacterium tuberculosis H37Rv
cggcccgcagcccgccggg

SEQ ID NO: 1350615 - RNA, 20 nt, Mycobacterium tuberculosis H37Rv
cggcccgcauccgcaccgaa

SEQ ID NO: 1350616 - RNA, 20 nt, Mycobacterium tuberculosis H37Rv
cggcccgcagcccgccgggc

SEQ ID NO: 1350617 - RNA, 20 nt, Mycobacterium tuberculosis H37Rv
cggcccgccguccggcgccc

SEQ ID NO: 1350618 - RNA, 23 nt, Mycobacterium tuberculosis H37Rv
cggccgauacagaucuggguucc

SEQ ID NO: 1350619 - RNA, 17 nt, Mycobacterium tuberculosis H37Rv
cggccgagcgcaccgcu

SEQ ID NO: 1350620 - RNA, 18 nt, Mycobacterium tuberculosis H37Rv
cggccgaggucacccggu

SEQ ID NO: 1350621 - RNA, 22 nt, Mycobacterium tuberculosis H37Rv
cggccgagggauugccgugcuc

SEQ ID NO: 1350622 - RNA, 23 nt, Mycobacterium tuberculosis H37Rv
cggccgagucgauugccaccgag

SEQ ID NO: 1350623 - RNA, 13 nt, Mycobacterium tuberculosis H37Rv
cggccgagcgcac

SEQ ID NO: 1350624 - RNA, 15 nt, Mycobacterium tuberculosis H37Rv
cggccgaccgcgacc

SEQ ID NO: 1350625 - RNA, 13 nt, Mycobacterium tuberculosis H37Rv
cggccgaaugcgc

SEQ ID NO: 1350626 - RNA, 15 nt, Mycobacterium tuberculosis H37Rv
cggccgacacgccga

SEQ ID NO: 1350627 - RNA, 16 nt, Mycobacterium tuberculosis H37Rv
cggccgaacgccucgc

SEQ ID NO: 1350628 - RNA, 13 nt, Mycobacterium tuberculosis H37Rv
cggcccugccgcc

SEQ ID NO: 1350629 - RNA, 14 nt, Mycobacterium tuberculosis H37Rv
cggcccuccaccgg

SEQ ID NO: 1350630 - RNA, 21 nt, Mycobacterium tuberculosis H37Rv
cggcccucgaauucggccggc

SEQ ID NO: 1350631 - RNA, 24 nt, Mycobacterium tuberculosis H37Rv
cggcccucgaugccgcguagcugg

SEQ ID NO: 1350632 - RNA, 15 nt, Mycobacterium tuberculosis H37Rv
cggccgaaacuucgc

SEQ ID NO: 1350633 - RNA, 12 nt, Mycobacterium tuberculosis H37Rv
cggcccuggaca

SEQ ID NO: 1350634 - RNA, 15 nt, Mycobacterium tuberculosis H37Rv
cggcccggcucggug

SEQ ID NO: 1350635 - RNA, 13 nt, Mycobacterium tuberculosis H37Rv
cggcccggggacg

SEQ ID NO: 1350636 - RNA, 19 nt, Mycobacterium tuberculosis H37Rv
cggcccgggucagcgaccu

SEQ ID NO: 1350637 - RNA, 17 nt, Mycobacterium tuberculosis H37Rv
cggcccgguccagcccc

SEQ ID NO: 1350638 - RNA, 22 nt, Mycobacterium tuberculosis H37Rv
cggcccgguugggugugcccgg

SEQ ID NO: 1350639 - RNA, 19 nt, Mycobacterium tuberculosis H37Rv
cggccgcagccagcaaguc

SEQ ID NO: 1350640 - RNA, 19 nt, Mycobacterium tuberculosis H37Rv
cggccgcagcggccagccc

SEQ ID NO: 1350641 - RNA, 15 nt, Mycobacterium tuberculosis H37Rv
cggccgcagcggcca

SEQ ID NO: 1350642 - RNA, 21 nt, Mycobacterium tuberculosis H37Rv
cggccgcaucgcccaacaacg

SEQ ID NO: 1350643 - RNA, 16 nt, Mycobacterium tuberculosis H37Rv
cggccgccagccccac

SEQ ID NO: 1350644 - RNA, 19 nt, Mycobacterium tuberculosis H37Rv
cggccgccagcgcgccgau

SEQ ID NO: 1350645 - RNA, 14 nt, Mycobacterium tuberculosis H37Rv
cggccgccccaggc

SEQ ID NO: 1350646 - RNA, 17 nt, Mycobacterium tuberculosis H37Rv
cggccgccccaggcugg

SEQ ID NO: 1350647 - RNA, 18 nt, Mycobacterium tuberculosis H37Rv
cggccgccgcgucgacua

SEQ ID NO: 1350648 - RNA, 15 nt, Mycobacterium tuberculosis H37Rv
cggccgccguccccg

SEQ ID NO: 1350649 - RNA, 22 nt, Mycobacterium tuberculosis H37Rv
cggccgccgaccggagccgccg

SEQ ID NO: 1350650 - RNA, 9 nt, Mycobacterium tuberculosis H37Rv
cggccgccg

SEQ ID NO: 1350651 - RNA, 19 nt, Mycobacterium tuberculosis H37Rv
cggccgcggucggccacca

SEQ ID NO: 1350652 - RNA, 22 nt, Mycobacterium tuberculosis H37Rv
cggccgcggucggccaccaacu

SEQ ID NO: 1350653 - RNA, 17 nt, Mycobacterium tuberculosis H37Rv
cggccgcgggucccggc

SEQ ID NO: 1350654 - RNA, 13 nt, Mycobacterium tuberculosis H37Rv
cggccgcgugcuc

SEQ ID NO: 1350655 - RNA, 19 nt, Mycobacterium tuberculosis H37Rv
cggccgcuauggcccgggc

SEQ ID NO: 1350656 - RNA, 16 nt, Mycobacterium tuberculosis H37Rv
cggccgcucaccccgc

SEQ ID NO: 1350657 - RNA, 17 nt, Mycobacterium tuberculosis H37Rv
cggccgcgggcgcgcag

SEQ ID NO: 1350658 - RNA, 18 nt, Mycobacterium tuberculosis H37Rv
cggccgcgggcgcgcagg

SEQ ID NO: 1350659 - RNA, 14 nt, Mycobacterium tuberculosis H37Rv
cggccgcggccucc

SEQ ID NO: 1350660 - RNA, 18 nt, Mycobacterium tuberculosis H37Rv
cggccgcggcgcggcggg

SEQ ID NO: 1350661 - RNA, 23 nt, Mycobacterium tuberculosis H37Rv
cggccgcggaugcucaggucacc

SEQ ID NO: 1350662 - RNA, 17 nt, Mycobacterium tuberculosis H37Rv
cggccgcgccggccccg

SEQ ID NO: 1350663 - RNA, 16 nt, Mycobacterium tuberculosis H37Rv
cggccgcgccggcccc

SEQ ID NO: 1350664 - RNA, 17 nt, Mycobacterium tuberculosis H37Rv
cggccgccuucuccggc

SEQ ID NO: 1350665 - RNA, 16 nt, Mycobacterium tuberculosis H37Rv
cggccgcgaccagcgc

SEQ ID NO: 1350666 - RNA, 15 nt, Mycobacterium tuberculosis H37Rv
cggccgggacggcga

SEQ ID NO: 1350667 - RNA, 14 nt, Mycobacterium tuberculosis H37Rv
cggccggcgucagc

SEQ ID NO: 1350668 - RNA, 20 nt, Mycobacterium tuberculosis H37Rv
cggccgggcgggcggccgau

SEQ ID NO: 1350669 - RNA, 17 nt, Mycobacterium tuberculosis H37Rv
cggccggggccacccgc

SEQ ID NO: 1350670 - RNA, 20 nt, Mycobacterium tuberculosis H37Rv
cggccggccgcccgcucgau

SEQ ID NO: 1350671 - RNA, 13 nt, Mycobacterium tuberculosis H37Rv
cggccggcccggg

SEQ ID NO: 1350672 - RNA, 17 nt, Mycobacterium tuberculosis H37Rv
cggccggcgccggcgcg

SEQ ID NO: 1350673 - RNA, 19 nt, Mycobacterium tuberculosis H37Rv
cggccggcaguccgagcuu

SEQ ID NO: 1350674 - RNA, 23 nt, Mycobacterium tuberculosis H37Rv
cggccggauguugaccggcucga

SEQ ID NO: 1350675 - RNA, 20 nt, Mycobacterium tuberculosis H37Rv
cggccggcaccccacggcca

SEQ ID NO: 1350676 - RNA, 13 nt, Mycobacterium tuberculosis H37Rv
cggccggcacccc

SEQ ID NO: 1350677 - RNA, 20 nt, Mycobacterium tuberculosis H37Rv
cggccggagccgccggcccc

SEQ ID NO: 1350678 - RNA, 22 nt, Mycobacterium tuberculosis H37Rv
cggccggagccgccggccccgc

SEQ ID NO: 1350679 - RNA, 23 nt, Mycobacterium tuberculosis H37Rv
cggccggaugagcgaacgccagu

SEQ ID NO: 1350680 - RNA, 17 nt, Mycobacterium tuberculosis H37Rv
cggccggaacgcccggc

SEQ ID NO: 1350681 - RNA, 15 nt, Mycobacterium tuberculosis H37Rv
cggccggagccgccg

SEQ ID NO: 1350682 - RNA, 20 nt, Mycobacterium tuberculosis H37Rv
cggccggaauacccggccca

SEQ ID NO: 1350683 - RNA, 13 nt, Mycobacterium tuberculosis H37Rv
cggccggagccgc

SEQ ID NO: 1350684 - RNA, 19 nt, Mycobacterium tuberculosis H37Rv
cggccgcucaccccgcgcu

SEQ ID NO: 1350685 - RNA, 22 nt, Mycobacterium tuberculosis H37Rv
cggccgcguaaaccggcugacc

SEQ ID NO: 1350686 - RNA, 12 nt, Mycobacterium tuberculosis H37Rv
cggccgcucggg

SEQ ID NO: 1350687 - RNA, 14 nt, Mycobacterium tuberculosis H37Rv
cggccgcucgggcc

SEQ ID NO: 1350688 - RNA, 19 nt, Mycobacterium tuberculosis H37Rv
cggccgcuccaccucggcg

SEQ ID NO: 1350689 - RNA, 16 nt, Mycobacterium tuberculosis H37Rv
cggccugcucgggggc

SEQ ID NO: 1350690 - RNA, 16 nt, Mycobacterium tuberculosis H37Rv
cggccuggcacccggg

SEQ ID NO: 1350691 - RNA, 15 nt, Mycobacterium tuberculosis H37Rv
cggccugggccagcc

SEQ ID NO: 1350692 - RNA, 13 nt, Mycobacterium tuberculosis H37Rv
cggccugcggcac

SEQ ID NO: 1350693 - RNA, 17 nt, Mycobacterium tuberculosis H37Rv
cggccugcucgcagauc

SEQ ID NO: 1350694 - RNA, 16 nt, Mycobacterium tuberculosis H37Rv
cggccugcgccggcgc

SEQ ID NO: 1350695 - RNA, 14 nt, Mycobacterium tuberculosis H37Rv
cggccugcggcaac

SEQ ID NO: 1350696 - RNA, 18 nt, Mycobacterium tuberculosis H37Rv
cggccugcgaacacgcga

SEQ ID NO: 1350697 - RNA, 15 nt, Mycobacterium tuberculosis H37Rv
cggccugccgcucgc

SEQ ID NO: 1350698 - RNA, 14 nt, Mycobacterium tuberculosis H37Rv
cggccugcgcgacc

SEQ ID NO: 1350699 - RNA, 21 nt, Mycobacterium tuberculosis H37Rv
cggccucgcugcucagcaacg

SEQ ID NO: 1350700 - RNA, 18 nt, Mycobacterium tuberculosis H37Rv
cggccucggcggucgccu

SEQ ID NO: 1350701 - RNA, 15 nt, Mycobacterium tuberculosis H37Rv
cggccuccuccccga

SEQ ID NO: 1350702 - RNA, 22 nt, Mycobacterium tuberculosis H37Rv
cggccugaccggucacccgugc

SEQ ID NO: 1350703 - RNA, 20 nt, Mycobacterium tuberculosis H37Rv
cggccugaccggcucgccgg

SEQ ID NO: 1350704 - RNA, 13 nt, Mycobacterium tuberculosis H37Rv
cggccugagcggc

SEQ ID NO: 1350705 - RNA, 19 nt, Mycobacterium tuberculosis H37Rv
cggccggugaugaucgcgc

SEQ ID NO: 1350706 - RNA, 19 nt, Mycobacterium tuberculosis H37Rv
cggccgguuggccagccac

SEQ ID NO: 1350707 - RNA, 23 nt, Mycobacterium tuberculosis H37Rv
cggccguagugcacgucggcggg

SEQ ID NO: 1350708 - RNA, 17 nt, Mycobacterium tuberculosis H37Rv
cggccggguggcccggc

SEQ ID NO: 1350709 - RNA, 21 nt, Mycobacterium tuberculosis H37Rv
cggccggguuaucggcagcag

SEQ ID NO: 1350710 - RNA, 18 nt, Mycobacterium tuberculosis H37Rv
cggccggguuaucggcag

SEQ ID NO: 1350711 - RNA, 22 nt, Mycobacterium tuberculosis H37Rv
cggccgguagaucuucggccgc

SEQ ID NO: 1350712 - RNA, 23 nt, Mycobacterium tuberculosis H37Rv
cggccgguagaucuucggccgca

SEQ ID NO: 1350713 - RNA, 19 nt, Mycobacterium tuberculosis H37Rv
cggccgguaguagcugacc

SEQ ID NO: 1350714 - RNA, 22 nt, Mycobacterium tuberculosis H37Rv
cggccguccuuuccaggagaga

SEQ ID NO: 1350715 - RNA, 15 nt, Mycobacterium tuberculosis H37Rv
cggccgucgcgggac

SEQ ID NO: 1350716 - RNA, 14 nt, Mycobacterium tuberculosis H37Rv
cggccgucggcggg

SEQ ID NO: 1350717 - RNA, 20 nt, Mycobacterium tuberculosis H37Rv
cggccgugaacggcgcgggc

SEQ ID NO: 1350718 - RNA, 16 nt, Mycobacterium tuberculosis H37Rv
cggccgucccgcgagc

SEQ ID NO: 1350719 - RNA, 12 nt, Mycobacterium tuberculosis H37Rv
cggccuccacca

SEQ ID NO: 1350720 - RNA, 17 nt, Mycobacterium tuberculosis H37Rv
cggccucccgggccgcc

SEQ ID NO: 1350721 - RNA, 19 nt, Mycobacterium tuberculosis H37Rv
cggccucccgggccgccgc

SEQ ID NO: 1350722 - RNA, 14 nt, Mycobacterium tuberculosis H37Rv
cggccgugucgggc

SEQ ID NO: 1350723 - RNA, 15 nt, Mycobacterium tuberculosis H37Rv
cggcaggauucccuc

SEQ ID NO: 1350724 - RNA, 21 nt, Mycobacterium tuberculosis H37Rv
cggcaggcccgacggcgccca

SEQ ID NO: 1350725 - RNA, 20 nt, Mycobacterium tuberculosis H37Rv
cggcaggcccgacggcgccc

SEQ ID NO: 1350726 - RNA, 15 nt, Mycobacterium tuberculosis H37Rv
cggcaggcagggcag

SEQ ID NO: 1350727 - RNA, 16 nt, Mycobacterium tuberculosis H37Rv
cggcaggcccggaggg

SEQ ID NO: 1350728 - RNA, 20 nt, Mycobacterium tuberculosis H37Rv
cggcaggcuggcgagggcug

SEQ ID NO: 1350729 - RNA, 14 nt, Mycobacterium tuberculosis H37Rv
cggcaggcggccgc

SEQ ID NO: 1350730 - RNA, 17 nt, Mycobacterium tuberculosis H37Rv
cggcaggcggccgccgg

SEQ ID NO: 1350731 - RNA, 21 nt, Mycobacterium tuberculosis H37Rv
cggcagcgaaaggagcuccau

SEQ ID NO: 1350732 - RNA, 20 nt, Mycobacterium tuberculosis H37Rv
cggcagcgacgccggcccga

SEQ ID NO: 1350733 - RNA, 17 nt, Mycobacterium tuberculosis H37Rv
cggcaggaaugccgcgg

SEQ ID NO: 1350734 - RNA, 16 nt, Mycobacterium tuberculosis H37Rv
cggcagcggcgccgcc

SEQ ID NO: 1350735 - RNA, 13 nt, Mycobacterium tuberculosis H37Rv
cggcagcggcgcc

SEQ ID NO: 1350736 - RNA, 16 nt, Mycobacterium tuberculosis H37Rv
cggcagugcugcagac

SEQ ID NO: 1350737 - RNA, 15 nt, Mycobacterium tuberculosis H37Rv
cggcagggcggugcc

SEQ ID NO: 1350738 - RNA, 16 nt, Mycobacterium tuberculosis H37Rv
cggcagggcggugcca

SEQ ID NO: 1350739 - RNA, 14 nt, Mycobacterium tuberculosis H37Rv
cggcagggccugga

SEQ ID NO: 1350740 - RNA, 15 nt, Mycobacterium tuberculosis H37Rv
cggcagggccuggaa

SEQ ID NO: 1350741 - RNA, 20 nt, Mycobacterium tuberculosis H37Rv
cggcauaccgaacagcaccu

SEQ ID NO: 1350742 - RNA, 17 nt, Mycobacterium tuberculosis H37Rv
cggcauaacccuggccg

SEQ ID NO: 1350743 - RNA, 18 nt, Mycobacterium tuberculosis H37Rv
cggcaguucgcggccauc

SEQ ID NO: 1350744 - RNA, 16 nt, Mycobacterium tuberculosis H37Rv
cggcauagcgggucag

SEQ ID NO: 1350745 - RNA, 20 nt, Mycobacterium tuberculosis H37Rv
cggcauaucgauucgggcgu

SEQ ID NO: 1350746 - RNA, 23 nt, Mycobacterium tuberculosis H37Rv
cggcauaucgauucgggcgucgg

SEQ ID NO: 1350747 - RNA, 20 nt, Mycobacterium tuberculosis H37Rv
cggcacuggugcccgacccg

SEQ ID NO: 1350748 - RNA, 15 nt, Mycobacterium tuberculosis H37Rv
cggcacuuagcccga

SEQ ID NO: 1350749 - RNA, 13 nt, Mycobacterium tuberculosis H37Rv
cggcacugaccgc

SEQ ID NO: 1350750 - RNA, 13 nt, Mycobacterium tuberculosis H37Rv
cggcacuggcccc

SEQ ID NO: 1350751 - RNA, 14 nt, Mycobacterium tuberculosis H37Rv
cggcacuggccccg

SEQ ID NO: 1350752 - RNA, 16 nt, Mycobacterium tuberculosis H37Rv
cggcacucccuggggu

SEQ ID NO: 1350753 - RNA, 16 nt, Mycobacterium tuberculosis H37Rv
cggcacgccggcggcg

SEQ ID NO: 1350754 - RNA, 20 nt, Mycobacterium tuberculosis H37Rv
cggcacgccggccgcgcuga

SEQ ID NO: 1350755 - RNA, 13 nt, Mycobacterium tuberculosis H37Rv
cggcaccuccgcc

SEQ ID NO: 1350756 - RNA, 20 nt, Mycobacterium tuberculosis H37Rv
cggcaccuccggcaccgccc

SEQ ID NO: 1350757 - RNA, 19 nt, Mycobacterium tuberculosis H37Rv
cggcaccgauggcgcaccg

SEQ ID NO: 1350758 - RNA, 18 nt, Mycobacterium tuberculosis H37Rv
cggcacgaccgcucccgg

SEQ ID NO: 1350759 - RNA, 18 nt, Mycobacterium tuberculosis H37Rv
cggcacccugcggcaccu

SEQ ID NO: 1350760 - RNA, 18 nt, Mycobacterium tuberculosis H37Rv
cggcaccgaaacgcgcgg

SEQ ID NO: 1350761 - RNA, 21 nt, Mycobacterium tuberculosis H37Rv
cggcacccggugagaagaagc

SEQ ID NO: 1350762 - RNA, 16 nt, Mycobacterium tuberculosis H37Rv
cggcacccugcggcac

SEQ ID NO: 1350763 - RNA, 17 nt, Mycobacterium tuberculosis H37Rv
cggcaccgcccuugccg

SEQ ID NO: 1350764 - RNA, 11 nt, Mycobacterium tuberculosis H37Rv
cggcaccgccg

SEQ ID NO: 1350765 - RNA, 13 nt, Mycobacterium tuberculosis H37Rv
cggcaccgcagcg

SEQ ID NO: 1350766 - RNA, 22 nt, Mycobacterium tuberculosis H37Rv
cggcaccgcagcggaacugggc

SEQ ID NO: 1350767 - RNA, 12 nt, Mycobacterium tuberculosis H37Rv
cggcacccggca

SEQ ID NO: 1350768 - RNA, 22 nt, Mycobacterium tuberculosis H37Rv
cggcacccgacucgucggccug

SEQ ID NO: 1350769 - RNA, 22 nt, Mycobacterium tuberculosis H37Rv
cggcacccgcacggccuccgga

SEQ ID NO: 1350770 - RNA, 18 nt, Mycobacterium tuberculosis H37Rv
cggcaaaguuggccgccc

SEQ ID NO: 1350771 - RNA, 12 nt, Mycobacterium tuberculosis H37Rv
cggcaaaggcgc

SEQ ID NO: 1350772 - RNA, 15 nt, Mycobacterium tuberculosis H37Rv
cggcaaacgcgcagg

SEQ ID NO: 1350773 - RNA, 20 nt, Mycobacterium tuberculosis H37Rv
cggcaacaucgagcgccagc

SEQ ID NO: 1350774 - RNA, 21 nt, Mycobacterium tuberculosis H37Rv
cggcaacaucgagcgccagcc

SEQ ID NO: 1350775 - RNA, 16 nt, Mycobacterium tuberculosis H37Rv
cggcaacagcaccagu

SEQ ID NO: 1350776 - RNA, 23 nt, Mycobacterium tuberculosis H37Rv
cggcaacagcgccaagacgucgg

SEQ ID NO: 1350777 - RNA, 14 nt, Mycobacterium tuberculosis H37Rv
cggcaacagcacca

SEQ ID NO: 1350778 - RNA, 14 nt, Mycobacterium tuberculosis H37Rv
cggcaacaccaccu

SEQ ID NO: 1350779 - RNA, 15 nt, Mycobacterium tuberculosis H37Rv
cggcaccagcggcac

SEQ ID NO: 1350780 - RNA, 16 nt, Mycobacterium tuberculosis H37Rv
cggcaccccacggcca

SEQ ID NO: 1350781 - RNA, 17 nt, Mycobacterium tuberculosis H37Rv
cggcaccccggccacuu

SEQ ID NO: 1350782 - RNA, 22 nt, Mycobacterium tuberculosis H37Rv
cggcacccgaaaacugaccccc

SEQ ID NO: 1350783 - RNA, 15 nt, Mycobacterium tuberculosis H37Rv
cggcacccaguucca

SEQ ID NO: 1350784 - RNA, 20 nt, Mycobacterium tuberculosis H37Rv
cggcaccccacgccugccga

SEQ ID NO: 1350785 - RNA, 19 nt, Mycobacterium tuberculosis H37Rv
cggcaccagguugccgagg

SEQ ID NO: 1350786 - RNA, 21 nt, Mycobacterium tuberculosis H37Rv
cggcacauugaucgacggcca

SEQ ID NO: 1350787 - RNA, 20 nt, Mycobacterium tuberculosis H37Rv
cggcaccaccgcgaccucgc

SEQ ID NO: 1350788 - RNA, 14 nt, Mycobacterium tuberculosis H37Rv
cggcaccaccgcga

SEQ ID NO: 1350789 - RNA, 15 nt, Mycobacterium tuberculosis H37Rv
cggaucugguccagu

SEQ ID NO: 1350790 - RNA, 16 nt, Mycobacterium tuberculosis H37Rv
cggaugacgcccaggg

SEQ ID NO: 1350791 - RNA, 23 nt, Mycobacterium tuberculosis H37Rv
cggaucgggcaccccgaccacca

SEQ ID NO: 1350792 - RNA, 15 nt, Mycobacterium tuberculosis H37Rv
cggaucggcgccgca

SEQ ID NO: 1350793 - RNA, 18 nt, Mycobacterium tuberculosis H37Rv
cggaucggcucgccaccu

SEQ ID NO: 1350794 - RNA, 17 nt, Mycobacterium tuberculosis H37Rv
cggaugcagugacagca

SEQ ID NO: 1350795 - RNA, 17 nt, Mycobacterium tuberculosis H37Rv
cggaugccggucggcgu

SEQ ID NO: 1350796 - RNA, 20 nt, Mycobacterium tuberculosis H37Rv
cggaugcgauggccgacgcu

SEQ ID NO: 1350797 - RNA, 19 nt, Mycobacterium tuberculosis H37Rv
cggaugcgcaaccgcggcc

SEQ ID NO: 1350798 - RNA, 24 nt, Mycobacterium tuberculosis H37Rv
cggauggaaggcggccaggugcag

SEQ ID NO: 1350799 - RNA, 15 nt, Mycobacterium tuberculosis H37Rv
cggaugcugucagca

SEQ ID NO: 1350800 - RNA, 17 nt, Mycobacterium tuberculosis H37Rv
cggauggaaggcggcca

SEQ ID NO: 1350801 - RNA, 13 nt, Mycobacterium tuberculosis H37Rv
cggauggccucgg

SEQ ID NO: 1350802 - RNA, 23 nt, Mycobacterium tuberculosis H37Rv
cggaugcguuggccccaggaucg

SEQ ID NO: 1350803 - RNA, 13 nt, Mycobacterium tuberculosis H37Rv
cggauggcggcca

SEQ ID NO: 1350804 - RNA, 16 nt, Mycobacterium tuberculosis H37Rv
cggcaaaccugagucc

SEQ ID NO: 1350805 - RNA, 21 nt, Mycobacterium tuberculosis H37Rv
cggcaaaccugaguccggcac

SEQ ID NO: 1350806 - RNA, 14 nt, Mycobacterium tuberculosis H37Rv
cggcaaacacugcg

SEQ ID NO: 1350807 - RNA, 14 nt, Mycobacterium tuberculosis H37Rv
cggauucgaaggca

SEQ ID NO: 1350808 - RNA, 17 nt, Mycobacterium tuberculosis H37Rv
cggauucccgcccagca

SEQ ID NO: 1350809 - RNA, 18 nt, Mycobacterium tuberculosis H37Rv
cggauucuucggugaaga

SEQ ID NO: 1350810 - RNA, 14 nt, Mycobacterium tuberculosis H37Rv
cggauucuccgccc

SEQ ID NO: 1350811 - RNA, 17 nt, Mycobacterium tuberculosis H37Rv
cggauguguucuccugc

SEQ ID NO: 1350812 - RNA, 17 nt, Mycobacterium tuberculosis H37Rv
cggaugucucggcacca

SEQ ID NO: 1350813 - RNA, 17 nt, Mycobacterium tuberculosis H37Rv
cggaaccguacgccaga

SEQ ID NO: 1350814 - RNA, 18 nt, Mycobacterium tuberculosis H37Rv
cggaaccggcgugcagca

SEQ ID NO: 1350815 - RNA, 13 nt, Mycobacterium tuberculosis H37Rv
cggaacggccagg

SEQ ID NO: 1350816 - RNA, 20 nt, Mycobacterium tuberculosis H37Rv
cggaacgccuaacgcguagc

SEQ ID NO: 1350817 - RNA, 20 nt, Mycobacterium tuberculosis H37Rv
cggaacgccgagcacgccga

SEQ ID NO: 1350818 - RNA, 13 nt, Mycobacterium tuberculosis H37Rv
cggaaaggcuucc

SEQ ID NO: 1350819 - RNA, 21 nt, Mycobacterium tuberculosis H37Rv
cggaaaggccgcggugauggg

SEQ ID NO: 1350820 - RNA, 15 nt, Mycobacterium tuberculosis H37Rv
cggaacugcgcaaca

SEQ ID NO: 1350821 - RNA, 22 nt, Mycobacterium tuberculosis H37Rv
cggaacguuccugcacagacag

SEQ ID NO: 1350822 - RNA, 18 nt, Mycobacterium tuberculosis H37Rv
cggagaucauggcgagcg

SEQ ID NO: 1350823 - RNA, 18 nt, Mycobacterium tuberculosis H37Rv
cggagaucgagaucaccu

SEQ ID NO: 1350824 - RNA, 15 nt, Mycobacterium tuberculosis H37Rv
cggauaaccggcaug

SEQ ID NO: 1350825 - RNA, 16 nt, Mycobacterium tuberculosis H37Rv
cggaucgcgcugcggg

SEQ ID NO: 1350826 - RNA, 18 nt, Mycobacterium tuberculosis H37Rv
cggaucgcgagcgccgcu

SEQ ID NO: 1350827 - RNA, 21 nt, Mycobacterium tuberculosis H37Rv
cggagcucuugcgggcagccg

SEQ ID NO: 1350828 - RNA, 23 nt, Mycobacterium tuberculosis H37Rv
cggagcggggaaguuggcugagc

SEQ ID NO: 1350829 - RNA, 21 nt, Mycobacterium tuberculosis H37Rv
cggaguugucgacggccaccc

SEQ ID NO: 1350830 - RNA, 17 nt, Mycobacterium tuberculosis H37Rv
cggaguuuccccuacca

SEQ ID NO: 1350831 - RNA, 14 nt, Mycobacterium tuberculosis H37Rv
cggagcgccgagcu

SEQ ID NO: 1350832 - RNA, 12 nt, Mycobacterium tuberculosis H37Rv
cggagccgucgc

SEQ ID NO: 1350833 - RNA, 10 nt, Mycobacterium tuberculosis H37Rv
cggagccaga

SEQ ID NO: 1350834 - RNA, 12 nt, Mycobacterium tuberculosis H37Rv
cggagccaggac

SEQ ID NO: 1350835 - RNA, 15 nt, Mycobacterium tuberculosis H37Rv
cggagccaggacgac

SEQ ID NO: 1350836 - RNA, 24 nt, Mycobacterium tuberculosis H37Rv
cggagcaauuccacgaucggcuca

SEQ ID NO: 1350837 - RNA, 16 nt, Mycobacterium tuberculosis H37Rv
cggagccggccaccuc

SEQ ID NO: 1350838 - RNA, 19 nt, Mycobacterium tuberculosis H37Rv
cggagcccgacucuccggc

SEQ ID NO: 1350839 - RNA, 17 nt, Mycobacterium tuberculosis H37Rv
cggagccgaacccaagg

SEQ ID NO: 1350840 - RNA, 19 nt, Mycobacterium tuberculosis H37Rv
cggagccgccggccccgcc

SEQ ID NO: 1350841 - RNA, 18 nt, Mycobacterium tuberculosis H37Rv
ccacugcgagcgccggcu

SEQ ID NO: 1350842 - RNA, 20 nt, Mycobacterium tuberculosis H37Rv
ccacugccggcagcgccccc

SEQ ID NO: 1350843 - RNA, 17 nt, Mycobacterium tuberculosis H37Rv
ccacuggauggcucgcc

SEQ ID NO: 1350844 - RNA, 18 nt, Mycobacterium tuberculosis H37Rv
ccacugcaucacgccguc

SEQ ID NO: 1350845 - RNA, 15 nt, Mycobacterium tuberculosis H37Rv
ccacugccagccgug

SEQ ID NO: 1350846 - RNA, 18 nt, Mycobacterium tuberculosis H37Rv
ccacugccguugccgccg

SEQ ID NO: 1350847 - RNA, 22 nt, Mycobacterium tuberculosis H37Rv
ccacugccgcgcgcccgccuca

SEQ ID NO: 1350848 - RNA, 19 nt, Mycobacterium tuberculosis H37Rv
ccacugccgcgcgcccgcc

SEQ ID NO: 1350849 - RNA, 14 nt, Mycobacterium tuberculosis H37Rv
ccacugggccugcc

SEQ ID NO: 1350850 - RNA, 21 nt, Mycobacterium tuberculosis H37Rv
ccacuggugcagcgccgacag

SEQ ID NO: 1350851 - RNA, 16 nt, Mycobacterium tuberculosis H37Rv
ccacuggugcagcgcc

SEQ ID NO: 1350852 - RNA, 17 nt, Mycobacterium tuberculosis H37Rv
ccacuggugaucugguc

SEQ ID NO: 1350853 - RNA, 17 nt, Mycobacterium tuberculosis H37Rv
ccacuuagcuggcgggg

SEQ ID NO: 1350854 - RNA, 19 nt, Mycobacterium tuberculosis H37Rv
ccacuguuggugccgccac

SEQ ID NO: 1350855 - RNA, 18 nt, Mycobacterium tuberculosis H37Rv
ccacuguuucugagcgcg

SEQ ID NO: 1350856 - RNA, 20 nt, Mycobacterium tuberculosis H37Rv
ccacuguuucugagcgcgcu

SEQ ID NO: 1350857 - RNA, 21 nt, Mycobacterium tuberculosis H37Rv
ccacuguuggugccgccacca

SEQ ID NO: 1350858 - RNA, 20 nt, Mycobacterium tuberculosis H37Rv
ccagaaggccgcaccgccac

SEQ ID NO: 1350859 - RNA, 16 nt, Mycobacterium tuberculosis H37Rv
ccagaacccggacagg

SEQ ID NO: 1350860 - RNA, 12 nt, Mycobacterium tuberculosis H37Rv
ccagaaccggcu

SEQ ID NO: 1350861 - RNA, 13 nt, Mycobacterium tuberculosis H37Rv
ccacuugcagcac

SEQ ID NO: 1350862 - RNA, 11 nt, Mycobacterium tuberculosis H37Rv
ccacuucuuca

SEQ ID NO: 1350863 - RNA, 17 nt, Mycobacterium tuberculosis H37Rv
ccacuucccgcuugagc

SEQ ID NO: 1350864 - RNA, 13 nt, Mycobacterium tuberculosis H37Rv
ccacuuccgggcg

SEQ ID NO: 1350865 - RNA, 18 nt, Mycobacterium tuberculosis H37Rv
ccacucgcucaggaacaa

SEQ ID NO: 1350866 - RNA, 14 nt, Mycobacterium tuberculosis H37Rv
ccacucggcccggc

SEQ ID NO: 1350867 - RNA, 17 nt, Mycobacterium tuberculosis H37Rv
ccacucggcccggcagg

SEQ ID NO: 1350868 - RNA, 16 nt, Mycobacterium tuberculosis H37Rv
ccacugagucugaugg

SEQ ID NO: 1350869 - RNA, 17 nt, Mycobacterium tuberculosis H37Rv
ccacucccgccccgcuc

SEQ ID NO: 1350870 - RNA, 15 nt, Mycobacterium tuberculosis H37Rv
ccacuccgguggcca

SEQ ID NO: 1350871 - RNA, 21 nt, Mycobacterium tuberculosis H37Rv
ccacucaggaucccgguggca

SEQ ID NO: 1350872 - RNA, 17 nt, Mycobacterium tuberculosis H37Rv
ccacgucaucuggcgcu

SEQ ID NO: 1350873 - RNA, 22 nt, Mycobacterium tuberculosis H37Rv
ccacgucaucuggcgcugcugg

SEQ ID NO: 1350874 - RNA, 21 nt, Mycobacterium tuberculosis H37Rv
ccacguugaugaugccggcgu

SEQ ID NO: 1350875 - RNA, 23 nt, Mycobacterium tuberculosis H37Rv
ccacgucccaggacuccggccgc

SEQ ID NO: 1350876 - RNA, 16 nt, Mycobacterium tuberculosis H37Rv
ccacguaauuccccag

SEQ ID NO: 1350877 - RNA, 19 nt, Mycobacterium tuberculosis H37Rv
ccacguccaacucggcccg

SEQ ID NO: 1350878 - RNA, 16 nt, Mycobacterium tuberculosis H37Rv
ccacguugcugaugcc

SEQ ID NO: 1350879 - RNA, 23 nt, Mycobacterium tuberculosis H37Rv
ccacgcggauaucuugcgcaugu

SEQ ID NO: 1350880 - RNA, 23 nt, Mycobacterium tuberculosis H37Rv
ccacgcguugacgaucuccgcca

SEQ ID NO: 1350881 - RNA, 20 nt, Mycobacterium tuberculosis H37Rv
ccacgguucgggcagcaccc

SEQ ID NO: 1350882 - RNA, 23 nt, Mycobacterium tuberculosis H37Rv
ccacgguuggccaccagcuggcg

SEQ ID NO: 1350883 - RNA, 18 nt, Mycobacterium tuberculosis H37Rv
ccacguacuccaccgcgc

SEQ ID NO: 1350884 - RNA, 21 nt, Mycobacterium tuberculosis H37Rv
ccacguacuuggacgacccgg

SEQ ID NO: 1350885 - RNA, 22 nt, Mycobacterium tuberculosis H37Rv
ccacguacuuggacgacccggg

SEQ ID NO: 1350886 - RNA, 16 nt, Mycobacterium tuberculosis H37Rv
ccacgaccucgggauc

SEQ ID NO: 1350887 - RNA, 22 nt, Mycobacterium tuberculosis H37Rv
ccacgcacaauacggucagcag

SEQ ID NO: 1350888 - RNA, 21 nt, Mycobacterium tuberculosis H37Rv
ccacgcaccgggugcagguga

SEQ ID NO: 1350889 - RNA, 16 nt, Mycobacterium tuberculosis H37Rv
ccacgcagcacggcac

SEQ ID NO: 1350890 - RNA, 14 nt, Mycobacterium tuberculosis H37Rv
ccacgcacugccgc

SEQ ID NO: 1350891 - RNA, 16 nt, Mycobacterium tuberculosis H37Rv
ccacgcagaaguugau

SEQ ID NO: 1350892 - RNA, 19 nt, Mycobacterium tuberculosis H37Rv
ccacgccgaccaucucacc

SEQ ID NO: 1350893 - RNA, 21 nt, Mycobacterium tuberculosis H37Rv
ccacgccgacuaguccgaggg

SEQ ID NO: 1350894 - RNA, 16 nt, Mycobacterium tuberculosis H37Rv
ccacgccgccggcgcu

SEQ ID NO: 1350895 - RNA, 11 nt, Mycobacterium tuberculosis H37Rv
ccacgccgccg

SEQ ID NO: 1350896 - RNA, 21 nt, Mycobacterium tuberculosis H37Rv
ccacgccguagcgcagcgccu

SEQ ID NO: 1350897 - RNA, 20 nt, Mycobacterium tuberculosis H37Rv
ccacgccgggcaaggccacc

SEQ ID NO: 1350898 - RNA, 20 nt, Mycobacterium tuberculosis H37Rv
ccaccuggugcaaccgugcc

SEQ ID NO: 1350899 - RNA, 12 nt, Mycobacterium tuberculosis H37Rv
ccaccugggcgg

SEQ ID NO: 1350900 - RNA, 20 nt, Mycobacterium tuberculosis H37Rv
ccaccuguugcccuugcgca

SEQ ID NO: 1350901 - RNA, 22 nt, Mycobacterium tuberculosis H37Rv
ccacgaacugaucgaccgccuc

SEQ ID NO: 1350902 - RNA, 20 nt, Mycobacterium tuberculosis H37Rv
ccacgacgucgucguccucg

SEQ ID NO: 1350903 - RNA, 22 nt, Mycobacterium tuberculosis H37Rv
ccacgacacuaggggcggggcu

SEQ ID NO: 1350904 - RNA, 21 nt, Mycobacterium tuberculosis H37Rv
ccacgaacgcuuccagcgugu

SEQ ID NO: 1350905 - RNA, 18 nt, Mycobacterium tuberculosis H37Rv
ccaccgguuaaccuccag

SEQ ID NO: 1350906 - RNA, 17 nt, Mycobacterium tuberculosis H37Rv
ccaccgguuauggcauu

SEQ ID NO: 1350907 - RNA, 14 nt, Mycobacterium tuberculosis H37Rv
ccaccugcuccgcu

SEQ ID NO: 1350908 - RNA, 19 nt, Mycobacterium tuberculosis H37Rv
ccaccgguaccgccggcuc

SEQ ID NO: 1350909 - RNA, 16 nt, Mycobacterium tuberculosis H37Rv
ccaccgguaccgccac

SEQ ID NO: 1350910 - RNA, 21 nt, Mycobacterium tuberculosis H37Rv
ccaccggugagcgcagcuuga

SEQ ID NO: 1350911 - RNA, 16 nt, Mycobacterium tuberculosis H37Rv
ccaccgggccgacagc

SEQ ID NO: 1350912 - RNA, 22 nt, Mycobacterium tuberculosis H37Rv
ccacccgacaacgcugggcggc

SEQ ID NO: 1350913 - RNA, 16 nt, Mycobacterium tuberculosis H37Rv
ccacccgcaccgccgg

SEQ ID NO: 1350914 - RNA, 23 nt, Mycobacterium tuberculosis H37Rv
ccacccgcacuccaagucacagc

SEQ ID NO: 1350915 - RNA, 14 nt, Mycobacterium tuberculosis H37Rv
ccacccgccacggu

SEQ ID NO: 1350916 - RNA, 19 nt, Mycobacterium tuberculosis H37Rv
ccaccgccaccacccaggc

SEQ ID NO: 1350917 - RNA, 21 nt, Mycobacterium tuberculosis H37Rv
ccaccgauucggcgacgaacu

SEQ ID NO: 1350918 - RNA, 16 nt, Mycobacterium tuberculosis H37Rv
ccaccgauaccgucag

SEQ ID NO: 1350919 - RNA, 22 nt, Mycobacterium tuberculosis H37Rv
ccaccgauaccgucagcgccgc

SEQ ID NO: 1350920 - RNA, 22 nt, Mycobacterium tuberculosis H37Rv
ccacccgcgccgccagcgccgc

SEQ ID NO: 1350921 - RNA, 13 nt, Mycobacterium tuberculosis H37Rv
ccacccgcggcgc

SEQ ID NO: 1350922 - RNA, 13 nt, Mycobacterium tuberculosis H37Rv
ccacccggccgcg

SEQ ID NO: 1350923 - RNA, 16 nt, Mycobacterium tuberculosis H37Rv
ccaccggcaccgcugc

SEQ ID NO: 1350924 - RNA, 17 nt, Mycobacterium tuberculosis H37Rv
ccaccggcaccggccgu

SEQ ID NO: 1350925 - RNA, 23 nt, Mycobacterium tuberculosis H37Rv
ccaccgcucgucguccggccacg

SEQ ID NO: 1350926 - RNA, 21 nt, Mycobacterium tuberculosis H37Rv
ccaccgcucgucguccggcca

SEQ ID NO: 1350927 - RNA, 18 nt, Mycobacterium tuberculosis H37Rv
ccaccgcguuggccacac

SEQ ID NO: 1350928 - RNA, 13 nt, Mycobacterium tuberculosis H37Rv
ccaccgcuggauc

SEQ ID NO: 1350929 - RNA, 18 nt, Mycobacterium tuberculosis H37Rv
ccaccgcugccggcagcg

SEQ ID NO: 1350930 - RNA, 20 nt, Mycobacterium tuberculosis H37Rv
ccaccggaauccgggccgcc

SEQ ID NO: 1350931 - RNA, 16 nt, Mycobacterium tuberculosis H37Rv
ccaccggcgccgccgg

SEQ ID NO: 1350932 - RNA, 19 nt, Mycobacterium tuberculosis H37Rv
ccaccggcgccgccggcac

SEQ ID NO: 1350933 - RNA, 21 nt, Mycobacterium tuberculosis H37Rv
ccaccggcgccggaguugaag

SEQ ID NO: 1350934 - RNA, 22 nt, Mycobacterium tuberculosis H37Rv
ccaccggcgucgacgucggccc

SEQ ID NO: 1350935 - RNA, 23 nt, Mycobacterium tuberculosis H37Rv
ccaccggcgucugcccgcccagc

SEQ ID NO: 1350936 - RNA, 15 nt, Mycobacterium tuberculosis H37Rv
ccaccggcugcaacc

SEQ ID NO: 1350937 - RNA, 15 nt, Mycobacterium tuberculosis H37Rv
ccaccggcgccgccc

SEQ ID NO: 1350938 - RNA, 12 nt, Mycobacterium tuberculosis H37Rv
ccaccggcuggu

SEQ ID NO: 1350939 - RNA, 15 nt, Mycobacterium tuberculosis H37Rv
ccaccggcacgguga

SEQ ID NO: 1350940 - RNA, 20 nt, Mycobacterium tuberculosis H37Rv
ccaccggcaccgccugcgcc

SEQ ID NO: 1350941 - RNA, 12 nt, Mycobacterium tuberculosis H37Rv
ccaccggccacc

SEQ ID NO: 1350942 - RNA, 14 nt, Mycobacterium tuberculosis H37Rv
ccaccggccagugg

SEQ ID NO: 1350943 - RNA, 22 nt, Mycobacterium tuberculosis H37Rv
ccaccggccgucccgcgagcag

SEQ ID NO: 1350944 - RNA, 13 nt, Mycobacterium tuberculosis H37Rv
ccaccgcgaccuc

SEQ ID NO: 1350945 - RNA, 15 nt, Mycobacterium tuberculosis H37Rv
ccaccgcgacuuugc

SEQ ID NO: 1350946 - RNA, 18 nt, Mycobacterium tuberculosis H37Rv
ccaccgcgagcagaggau

SEQ ID NO: 1350947 - RNA, 18 nt, Mycobacterium tuberculosis H37Rv
ccaccgccuggaucagcg

SEQ ID NO: 1350948 - RNA, 19 nt, Mycobacterium tuberculosis H37Rv
ccaccgccggugccgccau

SEQ ID NO: 1350949 - RNA, 21 nt, Mycobacterium tuberculosis H37Rv
ccaccgcggucagcucggcag

SEQ ID NO: 1350950 - RNA, 15 nt, Mycobacterium tuberculosis H37Rv
ccaccgcgcggcgca

SEQ ID NO: 1350951 - RNA, 12 nt, Mycobacterium tuberculosis H37Rv
ccaccgccgcca

SEQ ID NO: 1350952 - RNA, 13 nt, Mycobacterium tuberculosis H37Rv
ccaccgccgccac

SEQ ID NO: 1350953 - RNA, 16 nt, Mycobacterium tuberculosis H37Rv
ccaccgccgccugccc

SEQ ID NO: 1350954 - RNA, 17 nt, Mycobacterium tuberculosis H37Rv
ccaccgccgccugcccg

SEQ ID NO: 1350955 - RNA, 12 nt, Mycobacterium tuberculosis H37Rv
ccaccgccgcug

SEQ ID NO: 1350956 - RNA, 16 nt, Mycobacterium tuberculosis H37Rv
ccaccgccgccgccac

SEQ ID NO: 1350957 - RNA, 13 nt, Mycobacterium tuberculosis H37Rv
ccaccgccgccgg

SEQ ID NO: 1350958 - RNA, 12 nt, Mycobacterium tuberculosis H37Rv
ccaccgccgccg

SEQ ID NO: 1350959 - RNA, 16 nt, Mycobacterium tuberculosis H37Rv
ccagauugccugggcg

SEQ ID NO: 1350960 - RNA, 17 nt, Mycobacterium tuberculosis H37Rv
ccagauuggcgcugccc

SEQ ID NO: 1350961 - RNA, 20 nt, Mycobacterium tuberculosis H37Rv
ccagauuggcgcugcccgcc

SEQ ID NO: 1350962 - RNA, 14 nt, Mycobacterium tuberculosis H37Rv
ccagauugguugau

SEQ ID NO: 1350963 - RNA, 12 nt, Mycobacterium tuberculosis H37Rv
ccagauggccac

SEQ ID NO: 1350964 - RNA, 17 nt, Mycobacterium tuberculosis H37Rv
ccagauccacgccgacc

SEQ ID NO: 1350965 - RNA, 23 nt, Mycobacterium tuberculosis H37Rv
ccagaugccgguaacgaacagcg

SEQ ID NO: 1350966 - RNA, 18 nt, Mycobacterium tuberculosis H37Rv
ccagauccgguccaccgc

SEQ ID NO: 1350967 - RNA, 22 nt, Mycobacterium tuberculosis H37Rv
ccagauccgucagcuuggaccc

SEQ ID NO: 1350968 - RNA, 18 nt, Mycobacterium tuberculosis H37Rv
ccagaugcugguguugau

SEQ ID NO: 1350969 - RNA, 17 nt, Mycobacterium tuberculosis H37Rv
ccagauaccaccgccgc

SEQ ID NO: 1350970 - RNA, 23 nt, Mycobacterium tuberculosis H37Rv
ccagauacaucgggaucugggcu

SEQ ID NO: 1350971 - RNA, 13 nt, Mycobacterium tuberculosis H37Rv
ccagauacccgcg

SEQ ID NO: 1350972 - RNA, 15 nt, Mycobacterium tuberculosis H37Rv
ccagauaauccuggu

SEQ ID NO: 1350973 - RNA, 19 nt, Mycobacterium tuberculosis H37Rv
ccagaguucccgaaacccg

SEQ ID NO: 1350974 - RNA, 17 nt, Mycobacterium tuberculosis H37Rv
ccagcaccaccacccga

SEQ ID NO: 1350975 - RNA, 22 nt, Mycobacterium tuberculosis H37Rv
ccagcacauucugcagcgucuc

SEQ ID NO: 1350976 - RNA, 16 nt, Mycobacterium tuberculosis H37Rv
ccagcaccacggccag

SEQ ID NO: 1350977 - RNA, 19 nt, Mycobacterium tuberculosis H37Rv
ccagcaccacggccagcgg

SEQ ID NO: 1350978 - RNA, 17 nt, Mycobacterium tuberculosis H37Rv
ccagcaaaggggugugu

SEQ ID NO: 1350979 - RNA, 15 nt, Mycobacterium tuberculosis H37Rv
ccagcaacaccagau

SEQ ID NO: 1350980 - RNA, 15 nt, Mycobacterium tuberculosis H37Rv
ccagcaacagcgagc

SEQ ID NO: 1350981 - RNA, 14 nt, Mycobacterium tuberculosis H37Rv
ccagcacgaccucg

SEQ ID NO: 1350982 - RNA, 12 nt, Mycobacterium tuberculosis H37Rv
ccagcaccagcg

SEQ ID NO: 1350983 - RNA, 13 nt, Mycobacterium tuberculosis H37Rv
ccagcaccaccgc

SEQ ID NO: 1350984 - RNA, 13 nt, Mycobacterium tuberculosis H37Rv
ccagcaccggugg

SEQ ID NO: 1350985 - RNA, 14 nt, Mycobacterium tuberculosis H37Rv
ccagcagcaccgac

SEQ ID NO: 1350986 - RNA, 15 nt, Mycobacterium tuberculosis H37Rv
ccagcagcaccaacu

SEQ ID NO: 1350987 - RNA, 12 nt, Mycobacterium tuberculosis H37Rv
ccagcagcaacc

SEQ ID NO: 1350988 - RNA, 14 nt, Mycobacterium tuberculosis H37Rv
ccagcacggccacg

SEQ ID NO: 1350989 - RNA, 20 nt, Mycobacterium tuberculosis H37Rv
ccagcagauccaggcgucgg

SEQ ID NO: 1350990 - RNA, 15 nt, Mycobacterium tuberculosis H37Rv
ccagcagcagugcca

SEQ ID NO: 1350991 - RNA, 13 nt, Mycobacterium tuberculosis H37Rv
ccagcagcggcuc

SEQ ID NO: 1350992 - RNA, 14 nt, Mycobacterium tuberculosis H37Rv
ccagcagcagcgcu

SEQ ID NO: 1350993 - RNA, 16 nt, Mycobacterium tuberculosis H37Rv
ccagcagcagcgcuuc

SEQ ID NO: 1350994 - RNA, 14 nt, Mycobacterium tuberculosis H37Rv
ccagcagcagcgcc

SEQ ID NO: 1350995 - RNA, 15 nt, Mycobacterium tuberculosis H37Rv
ccagcagcagcgccg

SEQ ID NO: 1350996 - RNA, 16 nt, Mycobacterium tuberculosis H37Rv
ccagcagcagcgccgc

SEQ ID NO: 1350997 - RNA, 14 nt, Mycobacterium tuberculosis H37Rv
ccagcagcucggcc

SEQ ID NO: 1350998 - RNA, 18 nt, Mycobacterium tuberculosis H37Rv
ccagcagcugaaaauagg

SEQ ID NO: 1350999 - RNA, 24 nt, Mycobacterium tuberculosis H37Rv
ccagcagcucgccggcacgcagcc

SEQ ID NO: 1351000 - RNA, 14 nt, Mycobacterium tuberculosis H37Rv
ccagcagcucgccg

SEQ ID NO: 1351001 - RNA, 21 nt, Mycobacterium tuberculosis H37Rv
ccagcaggccgggcgcaagca

SEQ ID NO: 1351002 - RNA, 17 nt, Mycobacterium tuberculosis H37Rv
ccagcagggccaccacc

SEQ ID NO: 1351003 - RNA, 15 nt, Mycobacterium tuberculosis H37Rv
ccagcaggccacugc

SEQ ID NO: 1351004 - RNA, 21 nt, Mycobacterium tuberculosis H37Rv
ccagcgauaucggcggcuugg

SEQ ID NO: 1351005 - RNA, 16 nt, Mycobacterium tuberculosis H37Rv
ccagcgaggccagcgg

SEQ ID NO: 1351006 - RNA, 14 nt, Mycobacterium tuberculosis H37Rv
ccagcgaggccagc

SEQ ID NO: 1351007 - RNA, 15 nt, Mycobacterium tuberculosis H37Rv
ccagcgaggagcagg

SEQ ID NO: 1351008 - RNA, 16 nt, Mycobacterium tuberculosis H37Rv
ccagcgcaaccuccgc

SEQ ID NO: 1351009 - RNA, 12 nt, Mycobacterium tuberculosis H37Rv
ccagcgcagccg

SEQ ID NO: 1351010 - RNA, 14 nt, Mycobacterium tuberculosis H37Rv
ccagcgcagcagcg

SEQ ID NO: 1351011 - RNA, 23 nt, Mycobacterium tuberculosis H37Rv
ccagcgcacuacucgaacaaccc

SEQ ID NO: 1351012 - RNA, 22 nt, Mycobacterium tuberculosis H37Rv
ccagcgcacggaccaucgccag

SEQ ID NO: 1351013 - RNA, 14 nt, Mycobacterium tuberculosis H37Rv
ccagcgcaccgccg

SEQ ID NO: 1351014 - RNA, 16 nt, Mycobacterium tuberculosis H37Rv
ccagcgaauccaggcc

SEQ ID NO: 1351015 - RNA, 17 nt, Mycobacterium tuberculosis H37Rv
ccagcgaauccaggccg

SEQ ID NO: 1351016 - RNA, 20 nt, Mycobacterium tuberculosis H37Rv
ccagcgaauccagccgcgcg

SEQ ID NO: 1351017 - RNA, 17 nt, Mycobacterium tuberculosis H37Rv
ccagcgaauccagccgc

SEQ ID NO: 1351018 - RNA, 18 nt, Mycobacterium tuberculosis H37Rv
ccagcgaaucacccgcga

SEQ ID NO: 1351019 - RNA, 18 nt, Mycobacterium tuberculosis H37Rv
ccagcgaauccaggccgu

SEQ ID NO: 1351020 - RNA, 23 nt, Mycobacterium tuberculosis H37Rv
ccagcgacaacaccacggugccg

SEQ ID NO: 1351021 - RNA, 17 nt, Mycobacterium tuberculosis H37Rv
ccagcgacaugcccgcc

SEQ ID NO: 1351022 - RNA, 18 nt, Mycobacterium tuberculosis H37Rv
ccagcgacaugcccgcca

SEQ ID NO: 1351023 - RNA, 19 nt, Mycobacterium tuberculosis H37Rv
ccagcgagcauaccgccgc

SEQ ID NO: 1351024 - RNA, 14 nt, Mycobacterium tuberculosis H37Rv
ccagcgagcccagc

SEQ ID NO: 1351025 - RNA, 20 nt, Mycobacterium tuberculosis H37Rv
ccagcgagcccagcugcgcc

SEQ ID NO: 1351026 - RNA, 14 nt, Mycobacterium tuberculosis H37Rv
ccagcgacccggcc

SEQ ID NO: 1351027 - RNA, 17 nt, Mycobacterium tuberculosis H37Rv
ccagcgacccggccagc

SEQ ID NO: 1351028 - RNA, 22 nt, Mycobacterium tuberculosis H37Rv
ccagccuuggacgugcgcgcca

SEQ ID NO: 1351029 - RNA, 12 nt, Mycobacterium tuberculosis H37Rv
ccagccugugcu

SEQ ID NO: 1351030 - RNA, 21 nt, Mycobacterium tuberculosis H37Rv
ccagccuggccaucgagggca

SEQ ID NO: 1351031 - RNA, 20 nt, Mycobacterium tuberculosis H37Rv
ccagccgguccagcagcucg

SEQ ID NO: 1351032 - RNA, 18 nt, Mycobacterium tuberculosis H37Rv
ccagccgguccagaccca

SEQ ID NO: 1351033 - RNA, 17 nt, Mycobacterium tuberculosis H37Rv
ccagccgguccagcagc

SEQ ID NO: 1351034 - RNA, 13 nt, Mycobacterium tuberculosis H37Rv
ccagccggccuca

SEQ ID NO: 1351035 - RNA, 15 nt, Mycobacterium tuberculosis H37Rv
ccagccgcuccacgu

SEQ ID NO: 1351036 - RNA, 17 nt, Mycobacterium tuberculosis H37Rv
ccagccggcagcagcgg

SEQ ID NO: 1351037 - RNA, 17 nt, Mycobacterium tuberculosis H37Rv
ccagccguggcggcggg

SEQ ID NO: 1351038 - RNA, 13 nt, Mycobacterium tuberculosis H37Rv
ccagccgguccag

SEQ ID NO: 1351039 - RNA, 15 nt, Mycobacterium tuberculosis H37Rv
ccagccggucgucgc

SEQ ID NO: 1351040 - RNA, 14 nt, Mycobacterium tuberculosis H37Rv
ccagccgucggcgc

SEQ ID NO: 1351041 - RNA, 20 nt, Mycobacterium tuberculosis H37Rv
ccagccgucgucagguggcc

SEQ ID NO: 1351042 - RNA, 16 nt, Mycobacterium tuberculosis H37Rv
ccagccgugcggcggc

SEQ ID NO: 1351043 - RNA, 23 nt, Mycobacterium tuberculosis H37Rv
ccagcagugcgguaaagaucuug

SEQ ID NO: 1351044 - RNA, 20 nt, Mycobacterium tuberculosis H37Rv
ccagcagguuccacggccag

SEQ ID NO: 1351045 - RNA, 18 nt, Mycobacterium tuberculosis H37Rv
ccagcaggucgucggcgu

SEQ ID NO: 1351046 - RNA, 20 nt, Mycobacterium tuberculosis H37Rv
ccagcagguaguuaccauau

SEQ ID NO: 1351047 - RNA, 17 nt, Mycobacterium tuberculosis H37Rv
ccagcccagcggcuggu

SEQ ID NO: 1351048 - RNA, 13 nt, Mycobacterium tuberculosis H37Rv
ccagcccagcacg

SEQ ID NO: 1351049 - RNA, 17 nt, Mycobacterium tuberculosis H37Rv
ccagcccagauccagca

SEQ ID NO: 1351050 - RNA, 16 nt, Mycobacterium tuberculosis H37Rv
ccagcccagccgccag

SEQ ID NO: 1351051 - RNA, 19 nt, Mycobacterium tuberculosis H37Rv
ccagcccagccgccagccc

SEQ ID NO: 1351052 - RNA, 13 nt, Mycobacterium tuberculosis H37Rv
ccagcccggccgg

SEQ ID NO: 1351053 - RNA, 17 nt, Mycobacterium tuberculosis H37Rv
ccagcccggcccagugg

SEQ ID NO: 1351054 - RNA, 14 nt, Mycobacterium tuberculosis H37Rv
ccagcccggccgcc

SEQ ID NO: 1351055 - RNA, 18 nt, Mycobacterium tuberculosis H37Rv
ccagcccuguuugacugc

SEQ ID NO: 1351056 - RNA, 24 nt, Mycobacterium tuberculosis H37Rv
ccagccgaagaaccggucgcagug

SEQ ID NO: 1351057 - RNA, 13 nt, Mycobacterium tuberculosis H37Rv
ccagccgacguac

SEQ ID NO: 1351058 - RNA, 16 nt, Mycobacterium tuberculosis H37Rv
ccagcccguccggccc

SEQ ID NO: 1351059 - RNA, 20 nt, Mycobacterium tuberculosis H37Rv
ccagcccguugcaggacgcc

SEQ ID NO: 1351060 - RNA, 17 nt, Mycobacterium tuberculosis H37Rv
ccagccgcgcgccggcc

SEQ ID NO: 1351061 - RNA, 14 nt, Mycobacterium tuberculosis H37Rv
ccagccgcgcgucc

SEQ ID NO: 1351062 - RNA, 16 nt, Mycobacterium tuberculosis H37Rv
ccagccggaaccggac

SEQ ID NO: 1351063 - RNA, 13 nt, Mycobacterium tuberculosis H37Rv
ccagccggaccgc

SEQ ID NO: 1351064 - RNA, 15 nt, Mycobacterium tuberculosis H37Rv
ccagccgccccggcu

SEQ ID NO: 1351065 - RNA, 14 nt, Mycobacterium tuberculosis H37Rv
ccagccgcgccagc

SEQ ID NO: 1351066 - RNA, 19 nt, Mycobacterium tuberculosis H37Rv
ccaucaacugcaucaccac

SEQ ID NO: 1351067 - RNA, 17 nt, Mycobacterium tuberculosis H37Rv
ccauaugggggaaagcu

SEQ ID NO: 1351068 - RNA, 17 nt, Mycobacterium tuberculosis H37Rv
ccauaauucgcccgcuc

SEQ ID NO: 1351069 - RNA, 16 nt, Mycobacterium tuberculosis H37Rv
ccaucaaggccaccuc

SEQ ID NO: 1351070 - RNA, 15 nt, Mycobacterium tuberculosis H37Rv
ccaucacggucagcu

SEQ ID NO: 1351071 - RNA, 16 nt, Mycobacterium tuberculosis H37Rv
ccaucacggucagcuc

SEQ ID NO: 1351072 - RNA, 16 nt, Mycobacterium tuberculosis H37Rv
ccaucagaaccuccuc

SEQ ID NO: 1351073 - RNA, 22 nt, Mycobacterium tuberculosis H37Rv
ccaucagaaugccuggcccguc

SEQ ID NO: 1351074 - RNA, 19 nt, Mycobacterium tuberculosis H37Rv
ccaucagagacagcagcgu

SEQ ID NO: 1351075 - RNA, 19 nt, Mycobacterium tuberculosis H37Rv
ccaucgggcgcgguaacca

SEQ ID NO: 1351076 - RNA, 20 nt, Mycobacterium tuberculosis H37Rv
ccaucggguccgaaguacug

SEQ ID NO: 1351077 - RNA, 13 nt, Mycobacterium tuberculosis H37Rv
ccaucuugaccaa

SEQ ID NO: 1351078 - RNA, 17 nt, Mycobacterium tuberculosis H37Rv
ccaucgaggcgaucacc

SEQ ID NO: 1351079 - RNA, 15 nt, Mycobacterium tuberculosis H37Rv
ccaucgaguccacca

SEQ ID NO: 1351080 - RNA, 18 nt, Mycobacterium tuberculosis H37Rv
ccaucgaguccaccaccu

SEQ ID NO: 1351081 - RNA, 22 nt, Mycobacterium tuberculosis H37Rv
ccaucgccaccgcgucacuucc

SEQ ID NO: 1351082 - RNA, 18 nt, Mycobacterium tuberculosis H37Rv
ccaucggcuaggccggcc

SEQ ID NO: 1351083 - RNA, 23 nt, Mycobacterium tuberculosis H37Rv
ccaucgcauccccagcacaacca

SEQ ID NO: 1351084 - RNA, 15 nt, Mycobacterium tuberculosis H37Rv
ccaucaugugcgcga

SEQ ID NO: 1351085 - RNA, 15 nt, Mycobacterium tuberculosis H37Rv
ccaucaucaccucuc

SEQ ID NO: 1351086 - RNA, 16 nt, Mycobacterium tuberculosis H37Rv
ccauccgauggcccgg

SEQ ID NO: 1351087 - RNA, 18 nt, Mycobacterium tuberculosis H37Rv
ccaucccgaucccggcca

SEQ ID NO: 1351088 - RNA, 20 nt, Mycobacterium tuberculosis H37Rv
ccaucccgaucccggccagc

SEQ ID NO: 1351089 - RNA, 16 nt, Mycobacterium tuberculosis H37Rv
ccaucccgaucccggc

SEQ ID NO: 1351090 - RNA, 21 nt, Mycobacterium tuberculosis H37Rv
ccaucccucgaaaaccguggu

SEQ ID NO: 1351091 - RNA, 15 nt, Mycobacterium tuberculosis H37Rv
ccaucccggcgccgc

SEQ ID NO: 1351092 - RNA, 22 nt, Mycobacterium tuberculosis H37Rv
ccaucccugaaauaccaguccg

SEQ ID NO: 1351093 - RNA, 16 nt, Mycobacterium tuberculosis H37Rv
ccagugcgguggcagg

SEQ ID NO: 1351094 - RNA, 14 nt, Mycobacterium tuberculosis H37Rv
ccagugcggccacc

SEQ ID NO: 1351095 - RNA, 23 nt, Mycobacterium tuberculosis H37Rv
ccagugcgcagaacaccaccgcc

SEQ ID NO: 1351096 - RNA, 20 nt, Mycobacterium tuberculosis H37Rv
ccagugcgcagaacaccacc

SEQ ID NO: 1351097 - RNA, 20 nt, Mycobacterium tuberculosis H37Rv
ccagugcgcaacccagccgc

SEQ ID NO: 1351098 - RNA, 22 nt, Mycobacterium tuberculosis H37Rv
ccagugccguuucgaucugcac

SEQ ID NO: 1351099 - RNA, 17 nt, Mycobacterium tuberculosis H37Rv
ccaguucggcggccgcc

SEQ ID NO: 1351100 - RNA, 22 nt, Mycobacterium tuberculosis H37Rv
ccaguucgcgccacgcacccgg

SEQ ID NO: 1351101 - RNA, 12 nt, Mycobacterium tuberculosis H37Rv
ccagugagcccg

SEQ ID NO: 1351102 - RNA, 20 nt, Mycobacterium tuberculosis H37Rv
ccagugagguaucccggucu

SEQ ID NO: 1351103 - RNA, 15 nt, Mycobacterium tuberculosis H37Rv
ccagugccgcccacc

SEQ ID NO: 1351104 - RNA, 23 nt, Mycobacterium tuberculosis H37Rv
ccagugccgcccaccacacagcc

SEQ ID NO: 1351105 - RNA, 17 nt, Mycobacterium tuberculosis H37Rv
ccagugccagaacccgg

SEQ ID NO: 1351106 - RNA, 17 nt, Mycobacterium tuberculosis H37Rv
ccagugccaccugggcg

SEQ ID NO: 1351107 - RNA, 21 nt, Mycobacterium tuberculosis H37Rv
ccaguugcguuguccaccauc

SEQ ID NO: 1351108 - RNA, 13 nt, Mycobacterium tuberculosis H37Rv
ccaguugcacauc

SEQ ID NO: 1351109 - RNA, 14 nt, Mycobacterium tuberculosis H37Rv
ccaguucugcagga

SEQ ID NO: 1351110 - RNA, 19 nt, Mycobacterium tuberculosis H37Rv
ccaguuucaucaugugguc

SEQ ID NO: 1351111 - RNA, 17 nt, Mycobacterium tuberculosis H37Rv
ccagucgaucgcggccc

SEQ ID NO: 1351112 - RNA, 19 nt, Mycobacterium tuberculosis H37Rv
ccaguccaugugcccaggu

SEQ ID NO: 1351113 - RNA, 23 nt, Mycobacterium tuberculosis H37Rv
ccaguccgaugguaugcccgccg

SEQ ID NO: 1351114 - RNA, 21 nt, Mycobacterium tuberculosis H37Rv
ccagugaccgcagucccagca

SEQ ID NO: 1351115 - RNA, 22 nt, Mycobacterium tuberculosis H37Rv
ccagugaacgcgcgugcagcca

SEQ ID NO: 1351116 - RNA, 16 nt, Mycobacterium tuberculosis H37Rv
ccagucguuccgccgc

SEQ ID NO: 1351117 - RNA, 15 nt, Mycobacterium tuberculosis H37Rv
ccagucgcgcagcgu

SEQ ID NO: 1351118 - RNA, 16 nt, Mycobacterium tuberculosis H37Rv
ccaggucggcguugau

SEQ ID NO: 1351119 - RNA, 18 nt, Mycobacterium tuberculosis H37Rv
ccaggucggccaccgugg

SEQ ID NO: 1351120 - RNA, 12 nt, Mycobacterium tuberculosis H37Rv
ccaggucggcca

SEQ ID NO: 1351121 - RNA, 14 nt, Mycobacterium tuberculosis H37Rv
ccaggucggucagg

SEQ ID NO: 1351122 - RNA, 12 nt, Mycobacterium tuberculosis H37Rv
ccaggucugcgg

SEQ ID NO: 1351123 - RNA, 14 nt, Mycobacterium tuberculosis H37Rv
ccaggucugcggug

SEQ ID NO: 1351124 - RNA, 16 nt, Mycobacterium tuberculosis H37Rv
ccaguagaucgccucg

SEQ ID NO: 1351125 - RNA, 22 nt, Mycobacterium tuberculosis H37Rv
ccaggucuccaucaaccgcgcu

SEQ ID NO: 1351126 - RNA, 15 nt, Mycobacterium tuberculosis H37Rv
ccaggucuccaucaa

SEQ ID NO: 1351127 - RNA, 12 nt, Mycobacterium tuberculosis H37Rv
ccaggucggcga

SEQ ID NO: 1351128 - RNA, 12 nt, Mycobacterium tuberculosis H37Rv
ccaggucggcgg

SEQ ID NO: 1351129 - RNA, 21 nt, Mycobacterium tuberculosis H37Rv
ccaggucgcgauagccgccgc

SEQ ID NO: 1351130 - RNA, 23 nt, Mycobacterium tuberculosis H37Rv
ccaggucgcgauagccgccgcgg

SEQ ID NO: 1351131 - RNA, 21 nt, Mycobacterium tuberculosis H37Rv
ccaggucgauaccggcgugca

SEQ ID NO: 1351132 - RNA, 20 nt, Mycobacterium tuberculosis H37Rv
ccaggucgcauucugcugcc

SEQ ID NO: 1351133 - RNA, 22 nt, Mycobacterium tuberculosis H37Rv
ccaggucgcauucugcugccag

SEQ ID NO: 1351134 - RNA, 19 nt, Mycobacterium tuberculosis H37Rv
ccaguaggcuucgaccgug

SEQ ID NO: 1351135 - RNA, 17 nt, Mycobacterium tuberculosis H37Rv
ccagucacgcccaccac

SEQ ID NO: 1351136 - RNA, 16 nt, Mycobacterium tuberculosis H37Rv
ccagggucugcucauc

SEQ ID NO: 1351137 - RNA, 18 nt, Mycobacterium tuberculosis H37Rv
ccagggucgaugucgucg

SEQ ID NO: 1351138 - RNA, 20 nt, Mycobacterium tuberculosis H37Rv
ccagggucgcgagcccgcca

SEQ ID NO: 1351139 - RNA, 14 nt, Mycobacterium tuberculosis H37Rv
ccagggucccgccg

SEQ ID NO: 1351140 - RNA, 15 nt, Mycobacterium tuberculosis H37Rv
ccagggucccgccgc

SEQ ID NO: 1351141 - RNA, 19 nt, Mycobacterium tuberculosis H37Rv
ccagggggcgugccgccgc

SEQ ID NO: 1351142 - RNA, 17 nt, Mycobacterium tuberculosis H37Rv
ccagggggcgugccgcc

SEQ ID NO: 1351143 - RNA, 17 nt, Mycobacterium tuberculosis H37Rv
ccaggcugguccgggug

SEQ ID NO: 1351144 - RNA, 14 nt, Mycobacterium tuberculosis H37Rv
ccaggggauugccc

SEQ ID NO: 1351145 - RNA, 13 nt, Mycobacterium tuberculosis H37Rv
ccagguccacauc

SEQ ID NO: 1351146 - RNA, 15 nt, Mycobacterium tuberculosis H37Rv
ccagguccaccccgc

SEQ ID NO: 1351147 - RNA, 15 nt, Mycobacterium tuberculosis H37Rv
ccagguccgccggug

SEQ ID NO: 1351148 - RNA, 19 nt, Mycobacterium tuberculosis H37Rv
ccaggucaacgacguugau

SEQ ID NO: 1351149 - RNA, 15 nt, Mycobacterium tuberculosis H37Rv
ccagguagucgacca

SEQ ID NO: 1351150 - RNA, 21 nt, Mycobacterium tuberculosis H37Rv
ccagggugcccucggccgccu

SEQ ID NO: 1351151 - RNA, 21 nt, Mycobacterium tuberculosis H37Rv
ccaggcuaauagcucgccggc

SEQ ID NO: 1351152 - RNA, 22 nt, Mycobacterium tuberculosis H37Rv
ccaggcggugacguggugggcu

SEQ ID NO: 1351153 - RNA, 21 nt, Mycobacterium tuberculosis H37Rv
ccaggcgguacgggucgccgg

SEQ ID NO: 1351154 - RNA, 17 nt, Mycobacterium tuberculosis H37Rv
ccaggcgcuuggccgga

SEQ ID NO: 1351155 - RNA, 22 nt, Mycobacterium tuberculosis H37Rv
ccaggcggcaaggacggagccc

SEQ ID NO: 1351156 - RNA, 14 nt, Mycobacterium tuberculosis H37Rv
ccaggcgcugcagc

SEQ ID NO: 1351157 - RNA, 17 nt, Mycobacterium tuberculosis H37Rv
ccaggccguagcccacg

SEQ ID NO: 1351158 - RNA, 18 nt, Mycobacterium tuberculosis H37Rv
ccaggccggcacccacca

SEQ ID NO: 1351159 - RNA, 20 nt, Mycobacterium tuberculosis H37Rv
ccaggccgcgcgacaacccg

SEQ ID NO: 1351160 - RNA, 13 nt, Mycobacterium tuberculosis H37Rv
ccaggccggcccg

SEQ ID NO: 1351161 - RNA, 16 nt, Mycobacterium tuberculosis H37Rv
ccaggccgagcucguu

SEQ ID NO: 1351162 - RNA, 21 nt, Mycobacterium tuberculosis H37Rv
ccaggccgagcucguugcugg

SEQ ID NO: 1351163 - RNA, 13 nt, Mycobacterium tuberculosis H37Rv
ccaggccgccgcc

SEQ ID NO: 1351164 - RNA, 22 nt, Mycobacterium tuberculosis H37Rv
ccagcucgcgcacccagcccag

SEQ ID NO: 1351165 - RNA, 13 nt, Mycobacterium tuberculosis H37Rv
ccagcucggcggg

SEQ ID NO: 1351166 - RNA, 16 nt, Mycobacterium tuberculosis H37Rv
ccagcucgggcgcgcg

SEQ ID NO: 1351167 - RNA, 20 nt, Mycobacterium tuberculosis H37Rv
ccagcugcagcagacccggu

SEQ ID NO: 1351168 - RNA, 22 nt, Mycobacterium tuberculosis H37Rv
ccagcugcagcagacccggugg

SEQ ID NO: 1351169 - RNA, 15 nt, Mycobacterium tuberculosis H37Rv
ccagcuggacuccgg

SEQ ID NO: 1351170 - RNA, 22 nt, Mycobacterium tuberculosis H37Rv
ccagcugcgccgaacgcuccag

SEQ ID NO: 1351171 - RNA, 18 nt, Mycobacterium tuberculosis H37Rv
ccagcugcgagucgucgc

SEQ ID NO: 1351172 - RNA, 17 nt, Mycobacterium tuberculosis H37Rv
ccagcugcgcgggcgag

SEQ ID NO: 1351173 - RNA, 19 nt, Mycobacterium tuberculosis H37Rv
ccaggacggcuaccaccgc

SEQ ID NO: 1351174 - RNA, 17 nt, Mycobacterium tuberculosis H37Rv
ccaggacgaguccuagc

SEQ ID NO: 1351175 - RNA, 12 nt, Mycobacterium tuberculosis H37Rv
ccaggacaccuu

SEQ ID NO: 1351176 - RNA, 16 nt, Mycobacterium tuberculosis H37Rv
ccaggacguggucggg

SEQ ID NO: 1351177 - RNA, 19 nt, Mycobacterium tuberculosis H37Rv
ccaggacgguugguccgcc

SEQ ID NO: 1351178 - RNA, 22 nt, Mycobacterium tuberculosis H37Rv
ccaggaugaauuuggugaagug

SEQ ID NO: 1351179 - RNA, 17 nt, Mycobacterium tuberculosis H37Rv
ccaggaaugucuccagu

SEQ ID NO: 1351180 - RNA, 12 nt, Mycobacterium tuberculosis H37Rv
ccaggaaguccc

SEQ ID NO: 1351181 - RNA, 22 nt, Mycobacterium tuberculosis H37Rv
ccaggaagcacaugcucggccu

SEQ ID NO: 1351182 - RNA, 17 nt, Mycobacterium tuberculosis H37Rv
ccaggcccgacacggcg

SEQ ID NO: 1351183 - RNA, 20 nt, Mycobacterium tuberculosis H37Rv
ccaggcccgacacggcggcu

SEQ ID NO: 1351184 - RNA, 19 nt, Mycobacterium tuberculosis H37Rv
ccaggcccaucucgggcag

SEQ ID NO: 1351185 - RNA, 15 nt, Mycobacterium tuberculosis H37Rv
ccaggcccuggccag

SEQ ID NO: 1351186 - RNA, 16 nt, Mycobacterium tuberculosis H37Rv
ccaggcccuggccagc

SEQ ID NO: 1351187 - RNA, 22 nt, Mycobacterium tuberculosis H37Rv
ccaggccagggcgguggccacc

SEQ ID NO: 1351188 - RNA, 15 nt, Mycobacterium tuberculosis H37Rv
ccaggccaccggcug

SEQ ID NO: 1351189 - RNA, 20 nt, Mycobacterium tuberculosis H37Rv
ccaggccaccggcugcaacc

SEQ ID NO: 1351190 - RNA, 14 nt, Mycobacterium tuberculosis H37Rv
ccaggccagagccg

SEQ ID NO: 1351191 - RNA, 17 nt, Mycobacterium tuberculosis H37Rv
ccaggccagagccgccc

SEQ ID NO: 1351192 - RNA, 18 nt, Mycobacterium tuberculosis H37Rv
ccaggccagagccgcccu

SEQ ID NO: 1351193 - RNA, 22 nt, Mycobacterium tuberculosis H37Rv
ccaggccagagccgcccuugcc

SEQ ID NO: 1351194 - RNA, 17 nt, Mycobacterium tuberculosis H37Rv
ccaggccagugccaccu

SEQ ID NO: 1351195 - RNA, 13 nt, Mycobacterium tuberculosis H37Rv
ccaggccaacggc

SEQ ID NO: 1351196 - RNA, 21 nt, Mycobacterium tuberculosis H37Rv
ccaggauguguugccagauca

SEQ ID NO: 1351197 - RNA, 15 nt, Mycobacterium tuberculosis H37Rv
ccaggauugccgccg

SEQ ID NO: 1351198 - RNA, 16 nt, Mycobacterium tuberculosis H37Rv
ccagcgguagcugccc

SEQ ID NO: 1351199 - RNA, 21 nt, Mycobacterium tuberculosis H37Rv
ccagcggggucuugacggcgc

SEQ ID NO: 1351200 - RNA, 23 nt, Mycobacterium tuberculosis H37Rv
ccagcggucggcgaccaccagcg

SEQ ID NO: 1351201 - RNA, 18 nt, Mycobacterium tuberculosis H37Rv
ccagcggucagccggcca

SEQ ID NO: 1351202 - RNA, 22 nt, Mycobacterium tuberculosis H37Rv
ccagcggucggcgaccaccagc

SEQ ID NO: 1351203 - RNA, 17 nt, Mycobacterium tuberculosis H37Rv
ccagcggucagccggcc

SEQ ID NO: 1351204 - RNA, 21 nt, Mycobacterium tuberculosis H37Rv
ccagcgggaucugacccagca

SEQ ID NO: 1351205 - RNA, 17 nt, Mycobacterium tuberculosis H37Rv
ccagcgcuccagcaccc

SEQ ID NO: 1351206 - RNA, 16 nt, Mycobacterium tuberculosis H37Rv
ccagcgcuagccgggc

SEQ ID NO: 1351207 - RNA, 16 nt, Mycobacterium tuberculosis H37Rv
ccagcgcuucggccug

SEQ ID NO: 1351208 - RNA, 20 nt, Mycobacterium tuberculosis H37Rv
ccagcggcacacccaucacc

SEQ ID NO: 1351209 - RNA, 19 nt, Mycobacterium tuberculosis H37Rv
ccagcggcaauggccagca

SEQ ID NO: 1351210 - RNA, 17 nt, Mycobacterium tuberculosis H37Rv
ccagcggaagcgguuga

SEQ ID NO: 1351211 - RNA, 17 nt, Mycobacterium tuberculosis H37Rv
ccagcgcuucgucggcc

SEQ ID NO: 1351212 - RNA, 16 nt, Mycobacterium tuberculosis H37Rv
ccagcgucgacacacc

SEQ ID NO: 1351213 - RNA, 15 nt, Mycobacterium tuberculosis H37Rv
ccagcgucgccgcca

SEQ ID NO: 1351214 - RNA, 14 nt, Mycobacterium tuberculosis H37Rv
ccagcguccuggcg

SEQ ID NO: 1351215 - RNA, 21 nt, Mycobacterium tuberculosis H37Rv
ccagcguccagccgcccucgg

SEQ ID NO: 1351216 - RNA, 17 nt, Mycobacterium tuberculosis H37Rv
ccagcgucgacacaccc

SEQ ID NO: 1351217 - RNA, 18 nt, Mycobacterium tuberculosis H37Rv
ccagcgucgacacaccca

SEQ ID NO: 1351218 - RNA, 22 nt, Mycobacterium tuberculosis H37Rv
ccagcgucgacacacccacugg

SEQ ID NO: 1351219 - RNA, 20 nt, Mycobacterium tuberculosis H37Rv
ccagcucgcgcacccagccc

SEQ ID NO: 1351220 - RNA, 18 nt, Mycobacterium tuberculosis H37Rv
ccagcucgcgcacccagc

SEQ ID NO: 1351221 - RNA, 18 nt, Mycobacterium tuberculosis H37Rv
ccagcucgcugcgcgccc

SEQ ID NO: 1351222 - RNA, 18 nt, Mycobacterium tuberculosis H37Rv
ccagcucggcaccgagcu

SEQ ID NO: 1351223 - RNA, 19 nt, Mycobacterium tuberculosis H37Rv
ccagcucgcgggccgcguc

SEQ ID NO: 1351224 - RNA, 17 nt, Mycobacterium tuberculosis H37Rv
ccagcuccugcaugccg

SEQ ID NO: 1351225 - RNA, 13 nt, Mycobacterium tuberculosis H37Rv
ccagcuccugcau

SEQ ID NO: 1351226 - RNA, 21 nt, Mycobacterium tuberculosis H37Rv
ccagcucgagguccucagcga

SEQ ID NO: 1351227 - RNA, 18 nt, Mycobacterium tuberculosis H37Rv
ccagcgcccccagcagcu

SEQ ID NO: 1351228 - RNA, 14 nt, Mycobacterium tuberculosis H37Rv
ccagcgcccggcca

SEQ ID NO: 1351229 - RNA, 15 nt, Mycobacterium tuberculosis H37Rv
ccagcgccagugccu

SEQ ID NO: 1351230 - RNA, 19 nt, Mycobacterium tuberculosis H37Rv
ccagcgcauuuuccacauc

SEQ ID NO: 1351231 - RNA, 17 nt, Mycobacterium tuberculosis H37Rv
ccagcgccuccagcacc

SEQ ID NO: 1351232 - RNA, 17 nt, Mycobacterium tuberculosis H37Rv
ccagcgccucggcaucg

SEQ ID NO: 1351233 - RNA, 15 nt, Mycobacterium tuberculosis H37Rv
ccagcgccugcgccc

SEQ ID NO: 1351234 - RNA, 18 nt, Mycobacterium tuberculosis H37Rv
ccagcgccgccggcaccu

SEQ ID NO: 1351235 - RNA, 22 nt, Mycobacterium tuberculosis H37Rv
ccagcgccgccggcaccucccu

SEQ ID NO: 1351236 - RNA, 13 nt, Mycobacterium tuberculosis H37Rv
ccagcgccgccac

SEQ ID NO: 1351237 - RNA, 13 nt, Mycobacterium tuberculosis H37Rv
ccagcgccgcagu

SEQ ID NO: 1351238 - RNA, 23 nt, Mycobacterium tuberculosis H37Rv
ccagcgcgagcccgaaccaccgc

SEQ ID NO: 1351239 - RNA, 20 nt, Mycobacterium tuberculosis H37Rv
ccagcgcgacguccaccagc

SEQ ID NO: 1351240 - RNA, 14 nt, Mycobacterium tuberculosis H37Rv
ccagcgccugcgcg

SEQ ID NO: 1351241 - RNA, 15 nt, Mycobacterium tuberculosis H37Rv
ccagcgccucgguga

SEQ ID NO: 1351242 - RNA, 13 nt, Mycobacterium tuberculosis H37Rv
ccagcgcgagccc

SEQ ID NO: 1351243 - RNA, 18 nt, Mycobacterium tuberculosis H37Rv
ccagcgcgccacccagca

SEQ ID NO: 1351244 - RNA, 23 nt, Mycobacterium tuberculosis H37Rv
ccagcgcggcgcgcggggccucg

SEQ ID NO: 1351245 - RNA, 22 nt, Mycobacterium tuberculosis H37Rv
ccagcgcggccauuagcagcac

SEQ ID NO: 1351246 - RNA, 11 nt, Mycobacterium tuberculosis H37Rv
ccagcgcggcc

SEQ ID NO: 1351247 - RNA, 18 nt, Mycobacterium tuberculosis H37Rv
ccagcgcgcgcugagccg

SEQ ID NO: 1351248 - RNA, 14 nt, Mycobacterium tuberculosis H37Rv
ccagcgcggcgucg

SEQ ID NO: 1351249 - RNA, 17 nt, Mycobacterium tuberculosis H37Rv
ccagcgcgucucguuga

SEQ ID NO: 1351250 - RNA, 18 nt, Mycobacterium tuberculosis H37Rv
ccccgcuggucgaccggc

SEQ ID NO: 1351251 - RNA, 18 nt, Mycobacterium tuberculosis H37Rv
ccccuccuucggugaggu

SEQ ID NO: 1351252 - RNA, 11 nt, Mycobacterium tuberculosis H37Rv
ccccgcggcgg

SEQ ID NO: 1351253 - RNA, 21 nt, Mycobacterium tuberculosis H37Rv
ccccgcuacgcgcgcucgcuc

SEQ ID NO: 1351254 - RNA, 19 nt, Mycobacterium tuberculosis H37Rv
ccccgcucgaccagacgcu

SEQ ID NO: 1351255 - RNA, 17 nt, Mycobacterium tuberculosis H37Rv
ccccgcgaaguugcggg

SEQ ID NO: 1351256 - RNA, 15 nt, Mycobacterium tuberculosis H37Rv
ccccgccguugccgc

SEQ ID NO: 1351257 - RNA, 23 nt, Mycobacterium tuberculosis H37Rv
ccccgcgauuggaaugguggugc

SEQ ID NO: 1351258 - RNA, 16 nt, Mycobacterium tuberculosis H37Rv
ccccgccggggccgcc

SEQ ID NO: 1351259 - RNA, 20 nt, Mycobacterium tuberculosis H37Rv
ccccgcgcggugcccugccg

SEQ ID NO: 1351260 - RNA, 13 nt, Mycobacterium tuberculosis H37Rv
ccccgccggccgg

SEQ ID NO: 1351261 - RNA, 11 nt, Mycobacterium tuberculosis H37Rv
ccccgccgcua

SEQ ID NO: 1351262 - RNA, 14 nt, Mycobacterium tuberculosis H37Rv
ccccugccacagcg

SEQ ID NO: 1351263 - RNA, 21 nt, Mycobacterium tuberculosis H37Rv
ccccucgucgucaucgagcgg

SEQ ID NO: 1351264 - RNA, 16 nt, Mycobacterium tuberculosis H37Rv
ccccucggccgcccgu

SEQ ID NO: 1351265 - RNA, 22 nt, Mycobacterium tuberculosis H37Rv
ccccucuugucuagcggucgcu

SEQ ID NO: 1351266 - RNA, 17 nt, Mycobacterium tuberculosis H37Rv
ccccuugaccgcugccc

SEQ ID NO: 1351267 - RNA, 13 nt, Mycobacterium tuberculosis H37Rv
ccccugccacagc

SEQ ID NO: 1351268 - RNA, 17 nt, Mycobacterium tuberculosis H37Rv
cccgacgccagcugccc

SEQ ID NO: 1351269 - RNA, 20 nt, Mycobacterium tuberculosis H37Rv
cccgacuguagaaaacccgu

SEQ ID NO: 1351270 - RNA, 15 nt, Mycobacterium tuberculosis H37Rv
cccgacgucgcggag

SEQ ID NO: 1351271 - RNA, 20 nt, Mycobacterium tuberculosis H37Rv
cccgacggguaucccguccc

SEQ ID NO: 1351272 - RNA, 18 nt, Mycobacterium tuberculosis H37Rv
cccgacgccagcugcccg

SEQ ID NO: 1351273 - RNA, 22 nt, Mycobacterium tuberculosis H37Rv
cccgacgaccauucgagagccu

SEQ ID NO: 1351274 - RNA, 23 nt, Mycobacterium tuberculosis H37Rv
cccgacgagucgccgcgggcagc

SEQ ID NO: 1351275 - RNA, 20 nt, Mycobacterium tuberculosis H37Rv
cccgacgagauacggccacc

SEQ ID NO: 1351276 - RNA, 22 nt, Mycobacterium tuberculosis H37Rv
cccgacaugguccgaccagcgg

SEQ ID NO: 1351277 - RNA, 16 nt, Mycobacterium tuberculosis H37Rv
cccgaccgccaccgcc

SEQ ID NO: 1351278 - RNA, 12 nt, Mycobacterium tuberculosis H37Rv
cccgaccgccga

SEQ ID NO: 1351279 - RNA, 15 nt, Mycobacterium tuberculosis H37Rv
cccgaccagcaccag

SEQ ID NO: 1351280 - RNA, 14 nt, Mycobacterium tuberculosis H37Rv
cccgaccagcacca

SEQ ID NO: 1351281 - RNA, 20 nt, Mycobacterium tuberculosis H37Rv
cccgacccgccgacgccgcc

SEQ ID NO: 1351282 - RNA, 21 nt, Mycobacterium tuberculosis H37Rv
cccgaaguagaagcccaggac

SEQ ID NO: 1351283 - RNA, 17 nt, Mycobacterium tuberculosis H37Rv
cccgaagaugaccucgg

SEQ ID NO: 1351284 - RNA, 17 nt, Mycobacterium tuberculosis H37Rv
cccgaagaucuccuccu

SEQ ID NO: 1351285 - RNA, 17 nt, Mycobacterium tuberculosis H37Rv
cccgacaccgccccgcc

SEQ ID NO: 1351286 - RNA, 19 nt, Mycobacterium tuberculosis H37Rv
cccgacaccguccagcagc

SEQ ID NO: 1351287 - RNA, 19 nt, Mycobacterium tuberculosis H37Rv
cccgauugaccuucgacaa

SEQ ID NO: 1351288 - RNA, 11 nt, Mycobacterium tuberculosis H37Rv
cccgauucugg

SEQ ID NO: 1351289 - RNA, 20 nt, Mycobacterium tuberculosis H37Rv
cccgcaacccguauggcggc

SEQ ID NO: 1351290 - RNA, 19 nt, Mycobacterium tuberculosis H37Rv
cccgauggcgucgccggcc

SEQ ID NO: 1351291 - RNA, 21 nt, Mycobacterium tuberculosis H37Rv
cccgaugccgugccgggccag

SEQ ID NO: 1351292 - RNA, 14 nt, Mycobacterium tuberculosis H37Rv
cccgcaccaccggc

SEQ ID NO: 1351293 - RNA, 17 nt, Mycobacterium tuberculosis H37Rv
cccgcaaugcgcgcgau

SEQ ID NO: 1351294 - RNA, 21 nt, Mycobacterium tuberculosis H37Rv
cccgcacgcucggcgugucgg

SEQ ID NO: 1351295 - RNA, 12 nt, Mycobacterium tuberculosis H37Rv
cccgcacgcggg

SEQ ID NO: 1351296 - RNA, 14 nt, Mycobacterium tuberculosis H37Rv
cccgcacugccgcc

SEQ ID NO: 1351297 - RNA, 17 nt, Mycobacterium tuberculosis H37Rv
cccgcacggccuccgga

SEQ ID NO: 1351298 - RNA, 21 nt, Mycobacterium tuberculosis H37Rv
cccgcaccccggccgcgcgca

SEQ ID NO: 1351299 - RNA, 13 nt, Mycobacterium tuberculosis H37Rv
cccgcaccccggc

SEQ ID NO: 1351300 - RNA, 14 nt, Mycobacterium tuberculosis H37Rv
cccgcaccccggcc

SEQ ID NO: 1351301 - RNA, 13 nt, Mycobacterium tuberculosis H37Rv
cccgcaccgccgg

SEQ ID NO: 1351302 - RNA, 14 nt, Mycobacterium tuberculosis H37Rv
cccgcaccucaccg

SEQ ID NO: 1351303 - RNA, 20 nt, Mycobacterium tuberculosis H37Rv
cccgcacgaguuaccggugg

SEQ ID NO: 1351304 - RNA, 19 nt, Mycobacterium tuberculosis H37Rv
cccgaguuguugcugcccc

SEQ ID NO: 1351305 - RNA, 18 nt, Mycobacterium tuberculosis H37Rv
cccgaguuguugcugccc

SEQ ID NO: 1351306 - RNA, 22 nt, Mycobacterium tuberculosis H37Rv
cccgaguuguggacgcccgagu

SEQ ID NO: 1351307 - RNA, 22 nt, Mycobacterium tuberculosis H37Rv
cccgaguugaaggugccggcgu

SEQ ID NO: 1351308 - RNA, 15 nt, Mycobacterium tuberculosis H37Rv
cccgaguugaagaag

SEQ ID NO: 1351309 - RNA, 17 nt, Mycobacterium tuberculosis H37Rv
cccgauacgccaccggc

SEQ ID NO: 1351310 - RNA, 16 nt, Mycobacterium tuberculosis H37Rv
cccgauacggccggcc

SEQ ID NO: 1351311 - RNA, 14 nt, Mycobacterium tuberculosis H37Rv
cccgauccuggcca

SEQ ID NO: 1351312 - RNA, 17 nt, Mycobacterium tuberculosis H37Rv
cccgauaguucuggccc

SEQ ID NO: 1351313 - RNA, 15 nt, Mycobacterium tuberculosis H37Rv
cccgaugaccgccuu

SEQ ID NO: 1351314 - RNA, 20 nt, Mycobacterium tuberculosis H37Rv
cccgauccuggccacuccca

SEQ ID NO: 1351315 - RNA, 14 nt, Mycobacterium tuberculosis H37Rv
cccgagcgcgcgcu

SEQ ID NO: 1351316 - RNA, 14 nt, Mycobacterium tuberculosis H37Rv
cccgagcccgccag

SEQ ID NO: 1351317 - RNA, 16 nt, Mycobacterium tuberculosis H37Rv
cccgagaguggacgug

SEQ ID NO: 1351318 - RNA, 18 nt, Mycobacterium tuberculosis H37Rv
cccgagaccggcaccggc

SEQ ID NO: 1351319 - RNA, 22 nt, Mycobacterium tuberculosis H37Rv
cccgagcccagccgggcacccu

SEQ ID NO: 1351320 - RNA, 20 nt, Mycobacterium tuberculosis H37Rv
cccgagcccagcgccuccag

SEQ ID NO: 1351321 - RNA, 15 nt, Mycobacterium tuberculosis H37Rv
cccgagggcggcagc

SEQ ID NO: 1351322 - RNA, 20 nt, Mycobacterium tuberculosis H37Rv
cccgaggugccggggcccca

SEQ ID NO: 1351323 - RNA, 21 nt, Mycobacterium tuberculosis H37Rv
cccgaggcgcccaacaggcgg

SEQ ID NO: 1351324 - RNA, 17 nt, Mycobacterium tuberculosis H37Rv
cccgaguucgcaaugcc

SEQ ID NO: 1351325 - RNA, 16 nt, Mycobacterium tuberculosis H37Rv
cccgagucugcgagca

SEQ ID NO: 1351326 - RNA, 21 nt, Mycobacterium tuberculosis H37Rv
cccgagcgaugcgaccgacuu

SEQ ID NO: 1351327 - RNA, 15 nt, Mycobacterium tuberculosis H37Rv
cccgagcucaccgca

SEQ ID NO: 1351328 - RNA, 20 nt, Mycobacterium tuberculosis H37Rv
cccgagcuccgcggcgagcu

SEQ ID NO: 1351329 - RNA, 15 nt, Mycobacterium tuberculosis H37Rv
cccgagcucgggugc

SEQ ID NO: 1351330 - RNA, 23 nt, Mycobacterium tuberculosis H37Rv
ccccaagcgccugagcggccucg

SEQ ID NO: 1351331 - RNA, 15 nt, Mycobacterium tuberculosis H37Rv
ccccaagcccgauuc

SEQ ID NO: 1351332 - RNA, 13 nt, Mycobacterium tuberculosis H37Rv
ccccaacaucccg

SEQ ID NO: 1351333 - RNA, 22 nt, Mycobacterium tuberculosis H37Rv
ccccaacccuaaaccagccacc

SEQ ID NO: 1351334 - RNA, 13 nt, Mycobacterium tuberculosis H37Rv
ccccacccaccac

SEQ ID NO: 1351335 - RNA, 17 nt, Mycobacterium tuberculosis H37Rv
ccccacccaccacagga

SEQ ID NO: 1351336 - RNA, 14 nt, Mycobacterium tuberculosis H37Rv
ccccaccggugccg

SEQ ID NO: 1351337 - RNA, 15 nt, Mycobacterium tuberculosis H37Rv
ccccaccggcacccc

SEQ ID NO: 1351338 - RNA, 12 nt, Mycobacterium tuberculosis H37Rv
ccccacggccag

SEQ ID NO: 1351339 - RNA, 16 nt, Mycobacterium tuberculosis H37Rv
cccauucccaacacag

SEQ ID NO: 1351340 - RNA, 23 nt, Mycobacterium tuberculosis H37Rv
cccauucccaacacagccgucgc

SEQ ID NO: 1351341 - RNA, 20 nt, Mycobacterium tuberculosis H37Rv
cccaugucggcgcgccgcac

SEQ ID NO: 1351342 - RNA, 17 nt, Mycobacterium tuberculosis H37Rv
cccaugucggcgcgccg

SEQ ID NO: 1351343 - RNA, 16 nt, Mycobacterium tuberculosis H37Rv
cccagggugucuguga

SEQ ID NO: 1351344 - RNA, 18 nt, Mycobacterium tuberculosis H37Rv
cccaugcgccagcgagcg

SEQ ID NO: 1351345 - RNA, 23 nt, Mycobacterium tuberculosis H37Rv
cccaugcgguuuggaucacccgc

SEQ ID NO: 1351346 - RNA, 15 nt, Mycobacterium tuberculosis H37Rv
cccaugccgucgggu

SEQ ID NO: 1351347 - RNA, 12 nt, Mycobacterium tuberculosis H37Rv
cccauggcauuc

SEQ ID NO: 1351348 - RNA, 15 nt, Mycobacterium tuberculosis H37Rv
cccauggcuccgccc

SEQ ID NO: 1351349 - RNA, 19 nt, Mycobacterium tuberculosis H37Rv
cccauggcuccgcccagga

SEQ ID NO: 1351350 - RNA, 17 nt, Mycobacterium tuberculosis H37Rv
cccaugggguauggugu

SEQ ID NO: 1351351 - RNA, 16 nt, Mycobacterium tuberculosis H37Rv
ccccagaccgccacac

SEQ ID NO: 1351352 - RNA, 22 nt, Mycobacterium tuberculosis H37Rv
ccccacuggugcagcgccgaca

SEQ ID NO: 1351353 - RNA, 19 nt, Mycobacterium tuberculosis H37Rv
ccccacuggugcagcgccg

SEQ ID NO: 1351354 - RNA, 14 nt, Mycobacterium tuberculosis H37Rv
ccccagcacccggc

SEQ ID NO: 1351355 - RNA, 13 nt, Mycobacterium tuberculosis H37Rv
ccccagcagcugc

SEQ ID NO: 1351356 - RNA, 19 nt, Mycobacterium tuberculosis H37Rv
ccccagcacaaccagcugu

SEQ ID NO: 1351357 - RNA, 22 nt, Mycobacterium tuberculosis H37Rv
ccccagcaucuuuggcggccgc

SEQ ID NO: 1351358 - RNA, 21 nt, Mycobacterium tuberculosis H37Rv
cccccagacaauccgccgccg

SEQ ID NO: 1351359 - RNA, 17 nt, Mycobacterium tuberculosis H37Rv
cccccagcgccgccgcg

SEQ ID NO: 1351360 - RNA, 12 nt, Mycobacterium tuberculosis H37Rv
cccccaggcgaa

SEQ ID NO: 1351361 - RNA, 14 nt, Mycobacterium tuberculosis H37Rv
cccccagccgcggc

SEQ ID NO: 1351362 - RNA, 12 nt, Mycobacterium tuberculosis H37Rv
cccccagcgccc

SEQ ID NO: 1351363 - RNA, 12 nt, Mycobacterium tuberculosis H37Rv
cccccagcagcu

SEQ ID NO: 1351364 - RNA, 22 nt, Mycobacterium tuberculosis H37Rv
cccccgauggcgucgccggccc

SEQ ID NO: 1351365 - RNA, 20 nt, Mycobacterium tuberculosis H37Rv
cccccgauggcgucgccggc

SEQ ID NO: 1351366 - RNA, 22 nt, Mycobacterium tuberculosis H37Rv
cccccgauagcgaccgcggccc

SEQ ID NO: 1351367 - RNA, 14 nt, Mycobacterium tuberculosis H37Rv
ccccccgggcccgc

SEQ ID NO: 1351368 - RNA, 14 nt, Mycobacterium tuberculosis H37Rv
ccccccgagcccgc

SEQ ID NO: 1351369 - RNA, 23 nt, Mycobacterium tuberculosis H37Rv
ccccgauaaaaaccacccccacc

SEQ ID NO: 1351370 - RNA, 21 nt, Mycobacterium tuberculosis H37Rv
cccccgagcccgccagcgccg

SEQ ID NO: 1351371 - RNA, 18 nt, Mycobacterium tuberculosis H37Rv
ccccgagauccguccgcu

SEQ ID NO: 1351372 - RNA, 13 nt, Mycobacterium tuberculosis H37Rv
ccccgagcccgcc

SEQ ID NO: 1351373 - RNA, 17 nt, Mycobacterium tuberculosis H37Rv
ccccgagcggagccgcc

SEQ ID NO: 1351374 - RNA, 16 nt, Mycobacterium tuberculosis H37Rv
ccccgagcugucggcu

SEQ ID NO: 1351375 - RNA, 17 nt, Mycobacterium tuberculosis H37Rv
ccccgacugcgcccaua

SEQ ID NO: 1351376 - RNA, 20 nt, Mycobacterium tuberculosis H37Rv
ccccgacggacuccggccgg

SEQ ID NO: 1351377 - RNA, 22 nt, Mycobacterium tuberculosis H37Rv
ccccgacggacuccggccggcc

SEQ ID NO: 1351378 - RNA, 18 nt, Mycobacterium tuberculosis H37Rv
cccccgcacgcucggcgu

SEQ ID NO: 1351379 - RNA, 17 nt, Mycobacterium tuberculosis H37Rv
ccccgcauugccgucgg

SEQ ID NO: 1351380 - RNA, 11 nt, Mycobacterium tuberculosis H37Rv
ccccgcagcuc

SEQ ID NO: 1351381 - RNA, 15 nt, Mycobacterium tuberculosis H37Rv
ccccgcagcugcguc

SEQ ID NO: 1351382 - RNA, 21 nt, Mycobacterium tuberculosis H37Rv
ccccgcagccagaucuccccg

SEQ ID NO: 1351383 - RNA, 13 nt, Mycobacterium tuberculosis H37Rv
ccccgaucugcuc

SEQ ID NO: 1351384 - RNA, 12 nt, Mycobacterium tuberculosis H37Rv
ccccgaucaggc

SEQ ID NO: 1351385 - RNA, 15 nt, Mycobacterium tuberculosis H37Rv
ccccgaucaggccga

SEQ ID NO: 1351386 - RNA, 13 nt, Mycobacterium tuberculosis H37Rv
ccccgcccggcca

SEQ ID NO: 1351387 - RNA, 16 nt, Mycobacterium tuberculosis H37Rv
ccccgcccggccagcu

SEQ ID NO: 1351388 - RNA, 12 nt, Mycobacterium tuberculosis H37Rv
ccccgccgccac

SEQ ID NO: 1351389 - RNA, 11 nt, Mycobacterium tuberculosis H37Rv
ccccgccgccc

SEQ ID NO: 1351390 - RNA, 18 nt, Mycobacterium tuberculosis H37Rv
ccccgcccuugccgccag

SEQ ID NO: 1351391 - RNA, 19 nt, Mycobacterium tuberculosis H37Rv
ccccgcccuugccgccagc

SEQ ID NO: 1351392 - RNA, 12 nt, Mycobacterium tuberculosis H37Rv
ccccgccgccug

SEQ ID NO: 1351393 - RNA, 13 nt, Mycobacterium tuberculosis H37Rv
ccccgccagcgcc

SEQ ID NO: 1351394 - RNA, 15 nt, Mycobacterium tuberculosis H37Rv
ccccgccaccucgcc

SEQ ID NO: 1351395 - RNA, 20 nt, Mycobacterium tuberculosis H37Rv
cccagcgucugugucccguc

SEQ ID NO: 1351396 - RNA, 21 nt, Mycobacterium tuberculosis H37Rv
cccagcuagguccgaacuuga

SEQ ID NO: 1351397 - RNA, 22 nt, Mycobacterium tuberculosis H37Rv
cccaggcacaacaucgccgcag

SEQ ID NO: 1351398 - RNA, 16 nt, Mycobacterium tuberculosis H37Rv
cccagcguucccgccg

SEQ ID NO: 1351399 - RNA, 21 nt, Mycobacterium tuberculosis H37Rv
cccagcgugcccgccaccggc

SEQ ID NO: 1351400 - RNA, 16 nt, Mycobacterium tuberculosis H37Rv
cccagcgugcccgcca

SEQ ID NO: 1351401 - RNA, 22 nt, Mycobacterium tuberculosis H37Rv
cccagcggcugguugcgccacu

SEQ ID NO: 1351402 - RNA, 19 nt, Mycobacterium tuberculosis H37Rv
cccagcgguugacccucgg

SEQ ID NO: 1351403 - RNA, 14 nt, Mycobacterium tuberculosis H37Rv
cccagcgguugacc

SEQ ID NO: 1351404 - RNA, 17 nt, Mycobacterium tuberculosis H37Rv
cccaggccaagguggcc

SEQ ID NO: 1351405 - RNA, 18 nt, Mycobacterium tuberculosis H37Rv
cccagggggcgugccgcc

SEQ ID NO: 1351406 - RNA, 15 nt, Mycobacterium tuberculosis H37Rv
cccagggggcgugcc

SEQ ID NO: 1351407 - RNA, 13 nt, Mycobacterium tuberculosis H37Rv
cccaggggcaccg

SEQ ID NO: 1351408 - RNA, 21 nt, Mycobacterium tuberculosis H37Rv
cccagcgaugcgcucacugca

SEQ ID NO: 1351409 - RNA, 17 nt, Mycobacterium tuberculosis H37Rv
cccagcgaaucacccgc

SEQ ID NO: 1351410 - RNA, 14 nt, Mycobacterium tuberculosis H37Rv
cccagcgacccggc

SEQ ID NO: 1351411 - RNA, 20 nt, Mycobacterium tuberculosis H37Rv
cccagcgacccggccagcgg

SEQ ID NO: 1351412 - RNA, 23 nt, Mycobacterium tuberculosis H37Rv
cccagcgacgcggccagcggcaa

SEQ ID NO: 1351413 - RNA, 19 nt, Mycobacterium tuberculosis H37Rv
cccagcgacucggccagga

SEQ ID NO: 1351414 - RNA, 17 nt, Mycobacterium tuberculosis H37Rv
cccagcgcagcagcggc

SEQ ID NO: 1351415 - RNA, 23 nt, Mycobacterium tuberculosis H37Rv
cccagcgcacggaccaucgccag

SEQ ID NO: 1351416 - RNA, 15 nt, Mycobacterium tuberculosis H37Rv
cccagcgcagcagcg

SEQ ID NO: 1351417 - RNA, 12 nt, Mycobacterium tuberculosis H37Rv
cccagcgcagcg

SEQ ID NO: 1351418 - RNA, 14 nt, Mycobacterium tuberculosis H37Rv
cccagcgcccccag

SEQ ID NO: 1351419 - RNA, 15 nt, Mycobacterium tuberculosis H37Rv
cccagcgccuccagc

SEQ ID NO: 1351420 - RNA, 15 nt, Mycobacterium tuberculosis H37Rv
cccagcgccgcacag

SEQ ID NO: 1351421 - RNA, 21 nt, Mycobacterium tuberculosis H37Rv
cccagcgccgcaguggaugca

SEQ ID NO: 1351422 - RNA, 14 nt, Mycobacterium tuberculosis H37Rv
cccagcgcccggcc

SEQ ID NO: 1351423 - RNA, 13 nt, Mycobacterium tuberculosis H37Rv
cccagcgccgccg

SEQ ID NO: 1351424 - RNA, 17 nt, Mycobacterium tuberculosis H37Rv
cccagcgcccgcgcggc

SEQ ID NO: 1351425 - RNA, 18 nt, Mycobacterium tuberculosis H37Rv
cccagcgcccgccggcau

SEQ ID NO: 1351426 - RNA, 22 nt, Mycobacterium tuberculosis H37Rv
cccagcgcccccagcagcugcg

SEQ ID NO: 1351427 - RNA, 23 nt, Mycobacterium tuberculosis H37Rv
cccagcggagccacucggcccgg

SEQ ID NO: 1351428 - RNA, 15 nt, Mycobacterium tuberculosis H37Rv
cccagcaccacggug

SEQ ID NO: 1351429 - RNA, 13 nt, Mycobacterium tuberculosis H37Rv
cccacuccagcag

SEQ ID NO: 1351430 - RNA, 15 nt, Mycobacterium tuberculosis H37Rv
cccagcacccggcuu

SEQ ID NO: 1351431 - RNA, 14 nt, Mycobacterium tuberculosis H37Rv
cccagcacccggcu

SEQ ID NO: 1351432 - RNA, 18 nt, Mycobacterium tuberculosis H37Rv
cccagcagcaccugcacc

SEQ ID NO: 1351433 - RNA, 20 nt, Mycobacterium tuberculosis H37Rv
cccagcagcaccugcaccgc

SEQ ID NO: 1351434 - RNA, 12 nt, Mycobacterium tuberculosis H37Rv
cccagcagacca

SEQ ID NO: 1351435 - RNA, 19 nt, Mycobacterium tuberculosis H37Rv
cccacggcacccaauccgg

SEQ ID NO: 1351436 - RNA, 23 nt, Mycobacterium tuberculosis H37Rv
cccacggcgagaaaaugacccac

SEQ ID NO: 1351437 - RNA, 16 nt, Mycobacterium tuberculosis H37Rv
cccacggccggccgcu

SEQ ID NO: 1351438 - RNA, 13 nt, Mycobacterium tuberculosis H37Rv
cccacgggccggc

SEQ ID NO: 1351439 - RNA, 14 nt, Mycobacterium tuberculosis H37Rv
cccacgggccggcc

SEQ ID NO: 1351440 - RNA, 23 nt, Mycobacterium tuberculosis H37Rv
cccagcagguuccacggccaggu

SEQ ID NO: 1351441 - RNA, 13 nt, Mycobacterium tuberculosis H37Rv
cccagccccgacu

SEQ ID NO: 1351442 - RNA, 13 nt, Mycobacterium tuberculosis H37Rv
cccagcccggcgu

SEQ ID NO: 1351443 - RNA, 14 nt, Mycobacterium tuberculosis H37Rv
cccagcccggccca

SEQ ID NO: 1351444 - RNA, 21 nt, Mycobacterium tuberculosis H37Rv
cccagcacccccugcaccguc

SEQ ID NO: 1351445 - RNA, 12 nt, Mycobacterium tuberculosis H37Rv
cccagcagcggc

SEQ ID NO: 1351446 - RNA, 14 nt, Mycobacterium tuberculosis H37Rv
cccagcagggugug

SEQ ID NO: 1351447 - RNA, 15 nt, Mycobacterium tuberculosis H37Rv
cccagcagggugugc

SEQ ID NO: 1351448 - RNA, 13 nt, Mycobacterium tuberculosis H37Rv
cccagccgcgcca

SEQ ID NO: 1351449 - RNA, 14 nt, Mycobacterium tuberculosis H37Rv
cccagccgcgccag

SEQ ID NO: 1351450 - RNA, 12 nt, Mycobacterium tuberculosis H37Rv
cccagccgcagc

SEQ ID NO: 1351451 - RNA, 13 nt, Mycobacterium tuberculosis H37Rv
cccagccggcagc

SEQ ID NO: 1351452 - RNA, 17 nt, Mycobacterium tuberculosis H37Rv
cccagccggcagcagcg

SEQ ID NO: 1351453 - RNA, 14 nt, Mycobacterium tuberculosis H37Rv
cccagccggcagca

SEQ ID NO: 1351454 - RNA, 19 nt, Mycobacterium tuberculosis H37Rv
cccagccggguggacaccu

SEQ ID NO: 1351455 - RNA, 21 nt, Mycobacterium tuberculosis H37Rv
cccacaagcgauggcaccacu

SEQ ID NO: 1351456 - RNA, 17 nt, Mycobacterium tuberculosis H37Rv
cccaaccgaaccgcguu

SEQ ID NO: 1351457 - RNA, 15 nt, Mycobacterium tuberculosis H37Rv
cccacaccagcgcag

SEQ ID NO: 1351458 - RNA, 12 nt, Mycobacterium tuberculosis H37Rv
cccacaccuugg

SEQ ID NO: 1351459 - RNA, 17 nt, Mycobacterium tuberculosis H37Rv
cccaaagcgccagcagc

SEQ ID NO: 1351460 - RNA, 14 nt, Mycobacterium tuberculosis H37Rv
cccaccacaccaag

SEQ ID NO: 1351461 - RNA, 11 nt, Mycobacterium tuberculosis H37Rv
cccaccaccac

SEQ ID NO: 1351462 - RNA, 12 nt, Mycobacterium tuberculosis H37Rv
cccaccacacag

SEQ ID NO: 1351463 - RNA, 14 nt, Mycobacterium tuberculosis H37Rv
cccaccacacagcc

SEQ ID NO: 1351464 - RNA, 17 nt, Mycobacterium tuberculosis H37Rv
cccaccgcgccgagcag

SEQ ID NO: 1351465 - RNA, 13 nt, Mycobacterium tuberculosis H37Rv
cccaccgcgccga

SEQ ID NO: 1351466 - RNA, 13 nt, Mycobacterium tuberculosis H37Rv
cccaccagcgcag

SEQ ID NO: 1351467 - RNA, 15 nt, Mycobacterium tuberculosis H37Rv
cccaccagcggcggc

SEQ ID NO: 1351468 - RNA, 21 nt, Mycobacterium tuberculosis H37Rv
cccaccguugcgaagaagaag

SEQ ID NO: 1351469 - RNA, 17 nt, Mycobacterium tuberculosis H37Rv
cccaccggugccgcccg

SEQ ID NO: 1351470 - RNA, 16 nt, Mycobacterium tuberculosis H37Rv
cccaccgguaccgcca

SEQ ID NO: 1351471 - RNA, 18 nt, Mycobacterium tuberculosis H37Rv
cccaccggugccgcccgc

SEQ ID NO: 1351472 - RNA, 12 nt, Mycobacterium tuberculosis H37Rv
cccaccggcccg

SEQ ID NO: 1351473 - RNA, 22 nt, Mycobacterium tuberculosis H37Rv
cccacgcugcccacgggccggc

SEQ ID NO: 1351474 - RNA, 21 nt, Mycobacterium tuberculosis H37Rv
cccacgcgcacucgaccagga

SEQ ID NO: 1351475 - RNA, 22 nt, Mycobacterium tuberculosis H37Rv
cccacgccugccgaaacgccga

SEQ ID NO: 1351476 - RNA, 12 nt, Mycobacterium tuberculosis H37Rv
cccacgccgccg

SEQ ID NO: 1351477 - RNA, 17 nt, Mycobacterium tuberculosis H37Rv
ccauugacauugagguc

SEQ ID NO: 1351478 - RNA, 14 nt, Mycobacterium tuberculosis H37Rv
ccauugccgccguc

SEQ ID NO: 1351479 - RNA, 13 nt, Mycobacterium tuberculosis H37Rv
cccgcgccgcccg

SEQ ID NO: 1351480 - RNA, 20 nt, Mycobacterium tuberculosis H37Rv
cccgcgccgcccgcgccccc

SEQ ID NO: 1351481 - RNA, 12 nt, Mycobacterium tuberculosis H37Rv
cccgcgccgccc

SEQ ID NO: 1351482 - RNA, 14 nt, Mycobacterium tuberculosis H37Rv
cccgcgccggccgc

SEQ ID NO: 1351483 - RNA, 19 nt, Mycobacterium tuberculosis H37Rv
cccgcgccggccgcacgcc

SEQ ID NO: 1351484 - RNA, 19 nt, Mycobacterium tuberculosis H37Rv
cccgcgccaccagcaccgc

SEQ ID NO: 1351485 - RNA, 16 nt, Mycobacterium tuberculosis H37Rv
cccgcgaugcgcacca

SEQ ID NO: 1351486 - RNA, 17 nt, Mycobacterium tuberculosis H37Rv
cccgcgauucgcggcag

SEQ ID NO: 1351487 - RNA, 21 nt, Mycobacterium tuberculosis H37Rv
cccgcgauuggaaugguggug

SEQ ID NO: 1351488 - RNA, 13 nt, Mycobacterium tuberculosis H37Rv
cccgcgcagcacu

SEQ ID NO: 1351489 - RNA, 14 nt, Mycobacterium tuberculosis H37Rv
cccgcgcaaccggc

SEQ ID NO: 1351490 - RNA, 16 nt, Mycobacterium tuberculosis H37Rv
cccgcgcaaccggccg

SEQ ID NO: 1351491 - RNA, 18 nt, Mycobacterium tuberculosis H37Rv
cccgcgaacgaucccgcc

SEQ ID NO: 1351492 - RNA, 22 nt, Mycobacterium tuberculosis H37Rv
cccgcgagaucgggccggccgc

SEQ ID NO: 1351493 - RNA, 17 nt, Mycobacterium tuberculosis H37Rv
cccgcgaggacagcugg

SEQ ID NO: 1351494 - RNA, 13 nt, Mycobacterium tuberculosis H37Rv
cccgccuuggcca

SEQ ID NO: 1351495 - RNA, 18 nt, Mycobacterium tuberculosis H37Rv
cccgccugaccgccaccg

SEQ ID NO: 1351496 - RNA, 19 nt, Mycobacterium tuberculosis H37Rv
cccgccguuuccgccgccg

SEQ ID NO: 1351497 - RNA, 20 nt, Mycobacterium tuberculosis H37Rv
cccgccucgaccgccagccc

SEQ ID NO: 1351498 - RNA, 13 nt, Mycobacterium tuberculosis H37Rv
cccgccguagacc

SEQ ID NO: 1351499 - RNA, 14 nt, Mycobacterium tuberculosis H37Rv
cccgccgucacccc

SEQ ID NO: 1351500 - RNA, 18 nt, Mycobacterium tuberculosis H37Rv
cccgccguccggcgccca

SEQ ID NO: 1351501 - RNA, 18 nt, Mycobacterium tuberculosis H37Rv
cccgccguccccgccgcc

SEQ ID NO: 1351502 - RNA, 19 nt, Mycobacterium tuberculosis H37Rv
cccgccguccccgccgccg

SEQ ID NO: 1351503 - RNA, 21 nt, Mycobacterium tuberculosis H37Rv
cccgccguugaacggcaccag

SEQ ID NO: 1351504 - RNA, 16 nt, Mycobacterium tuberculosis H37Rv
cccgccguugccaccg

SEQ ID NO: 1351505 - RNA, 14 nt, Mycobacterium tuberculosis H37Rv
cccgccgggcucca

SEQ ID NO: 1351506 - RNA, 18 nt, Mycobacterium tuberculosis H37Rv
cccgccgggcuccacguc

SEQ ID NO: 1351507 - RNA, 13 nt, Mycobacterium tuberculosis H37Rv
cccgccggggccg

SEQ ID NO: 1351508 - RNA, 18 nt, Mycobacterium tuberculosis H37Rv
cccgccggccccgccguu

SEQ ID NO: 1351509 - RNA, 21 nt, Mycobacterium tuberculosis H37Rv
cccgccggccgcgccggcccc

SEQ ID NO: 1351510 - RNA, 15 nt, Mycobacterium tuberculosis H37Rv
cccgccggcuccgcc

SEQ ID NO: 1351511 - RNA, 20 nt, Mycobacterium tuberculosis H37Rv
cccgccggcuccgccacugg

SEQ ID NO: 1351512 - RNA, 15 nt, Mycobacterium tuberculosis H37Rv
cccgccggacccgcc

SEQ ID NO: 1351513 - RNA, 13 nt, Mycobacterium tuberculosis H37Rv
cccgccgcgcccg

SEQ ID NO: 1351514 - RNA, 12 nt, Mycobacterium tuberculosis H37Rv
cccgccggcccc

SEQ ID NO: 1351515 - RNA, 11 nt, Mycobacterium tuberculosis H37Rv
cccgccggcaa

SEQ ID NO: 1351516 - RNA, 15 nt, Mycobacterium tuberculosis H37Rv
cccgccggcaacauc

SEQ ID NO: 1351517 - RNA, 22 nt, Mycobacterium tuberculosis H37Rv
cccgccgcgaacuccagcagcc

SEQ ID NO: 1351518 - RNA, 22 nt, Mycobacterium tuberculosis H37Rv
cccgccgccugcuggagcagcu

SEQ ID NO: 1351519 - RNA, 16 nt, Mycobacterium tuberculosis H37Rv
cccgccgaugccgccg

SEQ ID NO: 1351520 - RNA, 13 nt, Mycobacterium tuberculosis H37Rv
cccgccgcacgca

SEQ ID NO: 1351521 - RNA, 15 nt, Mycobacterium tuberculosis H37Rv
cccgccgccaccagc

SEQ ID NO: 1351522 - RNA, 13 nt, Mycobacterium tuberculosis H37Rv
cccgccgagcgcg

SEQ ID NO: 1351523 - RNA, 22 nt, Mycobacterium tuberculosis H37Rv
cccgccgagcggugccggcgua

SEQ ID NO: 1351524 - RNA, 16 nt, Mycobacterium tuberculosis H37Rv
cccgccgacgaccgcc

SEQ ID NO: 1351525 - RNA, 18 nt, Mycobacterium tuberculosis H37Rv
cccgccgacgaccgccug

SEQ ID NO: 1351526 - RNA, 18 nt, Mycobacterium tuberculosis H37Rv
cccgccgacgccgccggc

SEQ ID NO: 1351527 - RNA, 21 nt, Mycobacterium tuberculosis H37Rv
cccgccgacgccgccggcccc

SEQ ID NO: 1351528 - RNA, 22 nt, Mycobacterium tuberculosis H37Rv
cccgccgacgccgccggccccg

SEQ ID NO: 1351529 - RNA, 18 nt, Mycobacterium tuberculosis H37Rv
cccgcaucgucgccgacc

SEQ ID NO: 1351530 - RNA, 21 nt, Mycobacterium tuberculosis H37Rv
cccgcaggucgaucugcgcca

SEQ ID NO: 1351531 - RNA, 23 nt, Mycobacterium tuberculosis H37Rv
cccgcagaccgguuucuucggcc

SEQ ID NO: 1351532 - RNA, 21 nt, Mycobacterium tuberculosis H37Rv
cccgcagccaaguccgcccgc

SEQ ID NO: 1351533 - RNA, 22 nt, Mycobacterium tuberculosis H37Rv
cccgcagccaaguccgcccgcc

SEQ ID NO: 1351534 - RNA, 23 nt, Mycobacterium tuberculosis H37Rv
cccgcagccgcgaguccaggcug

SEQ ID NO: 1351535 - RNA, 14 nt, Mycobacterium tuberculosis H37Rv
cccgcagccgcgag

SEQ ID NO: 1351536 - RNA, 19 nt, Mycobacterium tuberculosis H37Rv
cccgcagcucgaccaggaa

SEQ ID NO: 1351537 - RNA, 19 nt, Mycobacterium tuberculosis H37Rv
cccgcagcuaucuccaugc

SEQ ID NO: 1351538 - RNA, 20 nt, Mycobacterium tuberculosis H37Rv
cccgcagcgccuaccagcac

SEQ ID NO: 1351539 - RNA, 19 nt, Mycobacterium tuberculosis H37Rv
cccgcaugccggcgcacca

SEQ ID NO: 1351540 - RNA, 14 nt, Mycobacterium tuberculosis H37Rv
cccgccacaccaac

SEQ ID NO: 1351541 - RNA, 18 nt, Mycobacterium tuberculosis H37Rv
cccgcauugccaacgccc

SEQ ID NO: 1351542 - RNA, 22 nt, Mycobacterium tuberculosis H37Rv
cccgccacgguucgggcagcac

SEQ ID NO: 1351543 - RNA, 20 nt, Mycobacterium tuberculosis H37Rv
cccgccacgguucgggcagc

SEQ ID NO: 1351544 - RNA, 16 nt, Mycobacterium tuberculosis H37Rv
cccgccacgucgccgg

SEQ ID NO: 1351545 - RNA, 24 nt, Mycobacterium tuberculosis H37Rv
cccgccacgucgccggcuaccgcc

SEQ ID NO: 1351546 - RNA, 14 nt, Mycobacterium tuberculosis H37Rv
cccgccaccgaaca

SEQ ID NO: 1351547 - RNA, 18 nt, Mycobacterium tuberculosis H37Rv
cccgccaccucgccggcc

SEQ ID NO: 1351548 - RNA, 14 nt, Mycobacterium tuberculosis H37Rv
cccgccaccggguu

SEQ ID NO: 1351549 - RNA, 15 nt, Mycobacterium tuberculosis H37Rv
cccgccagcgccgcu

SEQ ID NO: 1351550 - RNA, 15 nt, Mycobacterium tuberculosis H37Rv
cccgccagcgccgcc

SEQ ID NO: 1351551 - RNA, 13 nt, Mycobacterium tuberculosis H37Rv
cccgccagcgccg

SEQ ID NO: 1351552 - RNA, 13 nt, Mycobacterium tuberculosis H37Rv
cccgccaggaucu

SEQ ID NO: 1351553 - RNA, 15 nt, Mycobacterium tuberculosis H37Rv
cccgccagcggcagc

SEQ ID NO: 1351554 - RNA, 17 nt, Mycobacterium tuberculosis H37Rv
cccgccagggcggcauc

SEQ ID NO: 1351555 - RNA, 15 nt, Mycobacterium tuberculosis H37Rv
cccgccaugcggcgc

SEQ ID NO: 1351556 - RNA, 14 nt, Mycobacterium tuberculosis H37Rv
cccgccauccgccg

SEQ ID NO: 1351557 - RNA, 13 nt, Mycobacterium tuberculosis H37Rv
cccgcccaaugcg

SEQ ID NO: 1351558 - RNA, 13 nt, Mycobacterium tuberculosis H37Rv
cccgcccacggca

SEQ ID NO: 1351559 - RNA, 21 nt, Mycobacterium tuberculosis H37Rv
cccgcccaagguggcggccag

SEQ ID NO: 1351560 - RNA, 12 nt, Mycobacterium tuberculosis H37Rv
cccgccccgacc

SEQ ID NO: 1351561 - RNA, 18 nt, Mycobacterium tuberculosis H37Rv
cccgccccgggccaccag

SEQ ID NO: 1351562 - RNA, 18 nt, Mycobacterium tuberculosis H37Rv
cccgcccacggcaccacc

SEQ ID NO: 1351563 - RNA, 13 nt, Mycobacterium tuberculosis H37Rv
cccgcccagcagc

SEQ ID NO: 1351564 - RNA, 16 nt, Mycobacterium tuberculosis H37Rv
cccgcccaggcgucca

SEQ ID NO: 1351565 - RNA, 21 nt, Mycobacterium tuberculosis H37Rv
cccgcccgacgugaagccaag

SEQ ID NO: 1351566 - RNA, 16 nt, Mycobacterium tuberculosis H37Rv
cccgcccgagccgcug

SEQ ID NO: 1351567 - RNA, 14 nt, Mycobacterium tuberculosis H37Rv
cccgcccggcaguu

SEQ ID NO: 1351568 - RNA, 17 nt, Mycobacterium tuberculosis H37Rv
cccgcccuugccgccag

SEQ ID NO: 1351569 - RNA, 18 nt, Mycobacterium tuberculosis H37Rv
cccgcccugaccgcccgc

SEQ ID NO: 1351570 - RNA, 16 nt, Mycobacterium tuberculosis H37Rv
cccgcccuugccgccg

SEQ ID NO: 1351571 - RNA, 19 nt, Mycobacterium tuberculosis H37Rv
cccgccgaccgacaccacc

SEQ ID NO: 1351572 - RNA, 21 nt, Mycobacterium tuberculosis H37Rv
cccgcugggcuuggggccgga

SEQ ID NO: 1351573 - RNA, 15 nt, Mycobacterium tuberculosis H37Rv
cccgcuggcccgcca

SEQ ID NO: 1351574 - RNA, 16 nt, Mycobacterium tuberculosis H37Rv
cccgcugccacccauc

SEQ ID NO: 1351575 - RNA, 17 nt, Mycobacterium tuberculosis H37Rv
cccgcucacgcucaccc

SEQ ID NO: 1351576 - RNA, 20 nt, Mycobacterium tuberculosis H37Rv
cccgcuacgcgcgcucgcuc

SEQ ID NO: 1351577 - RNA, 21 nt, Mycobacterium tuberculosis H37Rv
cccgcuccgccgucgccgccg

SEQ ID NO: 1351578 - RNA, 17 nt, Mycobacterium tuberculosis H37Rv
cccgcuccgcgccgccc

SEQ ID NO: 1351579 - RNA, 12 nt, Mycobacterium tuberculosis H37Rv
cccgcuccgcgg

SEQ ID NO: 1351580 - RNA, 17 nt, Mycobacterium tuberculosis H37Rv
cccgcucgcccgccgcc

SEQ ID NO: 1351581 - RNA, 16 nt, Mycobacterium tuberculosis H37Rv
cccgcucggccgccgg

SEQ ID NO: 1351582 - RNA, 18 nt, Mycobacterium tuberculosis H37Rv
cccgcucgcgagcggcug

SEQ ID NO: 1351583 - RNA, 19 nt, Mycobacterium tuberculosis H37Rv
cccgcucguaggaccucag

SEQ ID NO: 1351584 - RNA, 23 nt, Mycobacterium tuberculosis H37Rv
cccgcucgcccgccgccaccagc

SEQ ID NO: 1351585 - RNA, 15 nt, Mycobacterium tuberculosis H37Rv
cccgcucggccgccg

SEQ ID NO: 1351586 - RNA, 14 nt, Mycobacterium tuberculosis H37Rv
cccgcguucgagag

SEQ ID NO: 1351587 - RNA, 21 nt, Mycobacterium tuberculosis H37Rv
cccgcguucgagagccccgac

SEQ ID NO: 1351588 - RNA, 20 nt, Mycobacterium tuberculosis H37Rv
cccgcgucgagugccgccac

SEQ ID NO: 1351589 - RNA, 19 nt, Mycobacterium tuberculosis H37Rv
cccgcguaccacggugguc

SEQ ID NO: 1351590 - RNA, 16 nt, Mycobacterium tuberculosis H37Rv
cccgcguaugccagga

SEQ ID NO: 1351591 - RNA, 20 nt, Mycobacterium tuberculosis H37Rv
cccgcgggcaguggcagccc

SEQ ID NO: 1351592 - RNA, 18 nt, Mycobacterium tuberculosis H37Rv
cccgcggugacgccagcc

SEQ ID NO: 1351593 - RNA, 21 nt, Mycobacterium tuberculosis H37Rv
cccgcggugacgagcacaugc

SEQ ID NO: 1351594 - RNA, 23 nt, Mycobacterium tuberculosis H37Rv
cccgcggcgccguugccgccguu

SEQ ID NO: 1351595 - RNA, 22 nt, Mycobacterium tuberculosis H37Rv
cccgcggcgaaccgucucgccc

SEQ ID NO: 1351596 - RNA, 15 nt, Mycobacterium tuberculosis H37Rv
cccgcggcgccaccc

SEQ ID NO: 1351597 - RNA, 17 nt, Mycobacterium tuberculosis H37Rv
cccgcggcgccacccgc

SEQ ID NO: 1351598 - RNA, 24 nt, Mycobacterium tuberculosis H37Rv
cccgcggcgccacccgcgccgcca

SEQ ID NO: 1351599 - RNA, 14 nt, Mycobacterium tuberculosis H37Rv
cccgcggccgggcc

SEQ ID NO: 1351600 - RNA, 23 nt, Mycobacterium tuberculosis H37Rv
cccgcggcaacgcggucugcucc

SEQ ID NO: 1351601 - RNA, 16 nt, Mycobacterium tuberculosis H37Rv
cccgcggaccgcaacg

SEQ ID NO: 1351602 - RNA, 19 nt, Mycobacterium tuberculosis H37Rv
cccgcgcugagcacgcgga

SEQ ID NO: 1351603 - RNA, 16 nt, Mycobacterium tuberculosis H37Rv
cccgcggaauccgcgg

SEQ ID NO: 1351604 - RNA, 13 nt, Mycobacterium tuberculosis H37Rv
cccgcggccagca

SEQ ID NO: 1351605 - RNA, 11 nt, Mycobacterium tuberculosis H37Rv
cccgcgcgucg

SEQ ID NO: 1351606 - RNA, 17 nt, Mycobacterium tuberculosis H37Rv
cccgcgcgucgcccagu

SEQ ID NO: 1351607 - RNA, 15 nt, Mycobacterium tuberculosis H37Rv
cccgcgcgagccgcu

SEQ ID NO: 1351608 - RNA, 17 nt, Mycobacterium tuberculosis H37Rv
cccgcgccuuggcaccc

SEQ ID NO: 1351609 - RNA, 18 nt, Mycobacterium tuberculosis H37Rv
cccgcgccuccguugccc

SEQ ID NO: 1351610 - RNA, 13 nt, Mycobacterium tuberculosis H37Rv
cccgcgcgcacca

SEQ ID NO: 1351611 - RNA, 21 nt, Mycobacterium tuberculosis H37Rv
cccggcagcaucggucacacc

SEQ ID NO: 1351612 - RNA, 15 nt, Mycobacterium tuberculosis H37Rv
cccggcagaugcagc

SEQ ID NO: 1351613 - RNA, 16 nt, Mycobacterium tuberculosis H37Rv
cccggcagcacgugga

SEQ ID NO: 1351614 - RNA, 23 nt, Mycobacterium tuberculosis H37Rv
cccggcagcgugcggggcgccug

SEQ ID NO: 1351615 - RNA, 15 nt, Mycobacterium tuberculosis H37Rv
cccggcaccccuuug

SEQ ID NO: 1351616 - RNA, 17 nt, Mycobacterium tuberculosis H37Rv
cccggcaccccuuugac

SEQ ID NO: 1351617 - RNA, 12 nt, Mycobacterium tuberculosis H37Rv
cccggcaccgcg

SEQ ID NO: 1351618 - RNA, 17 nt, Mycobacterium tuberculosis H37Rv
cccggcacggugucgcg

SEQ ID NO: 1351619 - RNA, 19 nt, Mycobacterium tuberculosis H37Rv
cccggcaaacuccagcuug

SEQ ID NO: 1351620 - RNA, 21 nt, Mycobacterium tuberculosis H37Rv
cccggaugucgugcgggcgca

SEQ ID NO: 1351621 - RNA, 14 nt, Mycobacterium tuberculosis H37Rv
cccggcacacccuc

SEQ ID NO: 1351622 - RNA, 15 nt, Mycobacterium tuberculosis H37Rv
cccggccaggggcgc

SEQ ID NO: 1351623 - RNA, 14 nt, Mycobacterium tuberculosis H37Rv
cccggccaggccga

SEQ ID NO: 1351624 - RNA, 21 nt, Mycobacterium tuberculosis H37Rv
cccggccauagcccgagcgcu

SEQ ID NO: 1351625 - RNA, 12 nt, Mycobacterium tuberculosis H37Rv
cccggcauacaa

SEQ ID NO: 1351626 - RNA, 16 nt, Mycobacterium tuberculosis H37Rv
cccggccaaccaccaa

SEQ ID NO: 1351627 - RNA, 17 nt, Mycobacterium tuberculosis H37Rv
cccggccaaccaccaac

SEQ ID NO: 1351628 - RNA, 17 nt, Mycobacterium tuberculosis H37Rv
cccggcauugcccgagc

SEQ ID NO: 1351629 - RNA, 21 nt, Mycobacterium tuberculosis H37Rv
cccggcauugcccgagcccag

SEQ ID NO: 1351630 - RNA, 21 nt, Mycobacterium tuberculosis H37Rv
cccggccaccagcaugccugc

SEQ ID NO: 1351631 - RNA, 19 nt, Mycobacterium tuberculosis H37Rv
cccgcuuuuucccggcggc

SEQ ID NO: 1351632 - RNA, 18 nt, Mycobacterium tuberculosis H37Rv
cccgcuuuuucccggcgg

SEQ ID NO: 1351633 - RNA, 16 nt, Mycobacterium tuberculosis H37Rv
cccgcuuugcacugug

SEQ ID NO: 1351634 - RNA, 12 nt, Mycobacterium tuberculosis H37Rv
cccgcuucgccc

SEQ ID NO: 1351635 - RNA, 15 nt, Mycobacterium tuberculosis H37Rv
cccgcuucagcacgg

SEQ ID NO: 1351636 - RNA, 19 nt, Mycobacterium tuberculosis H37Rv
cccggaaucgucgcggccg

SEQ ID NO: 1351637 - RNA, 21 nt, Mycobacterium tuberculosis H37Rv
cccggaaugcccgagcaggac

SEQ ID NO: 1351638 - RNA, 23 nt, Mycobacterium tuberculosis H37Rv
cccggaaucgcgaaacagcuugc

SEQ ID NO: 1351639 - RNA, 17 nt, Mycobacterium tuberculosis H37Rv
cccggaagcgccggccc

SEQ ID NO: 1351640 - RNA, 20 nt, Mycobacterium tuberculosis H37Rv
cccggaccgcggccaccgcc

SEQ ID NO: 1351641 - RNA, 22 nt, Mycobacterium tuberculosis H37Rv
cccggaccgcggccaccgccug

SEQ ID NO: 1351642 - RNA, 18 nt, Mycobacterium tuberculosis H37Rv
cccggaccgucguggcgg

SEQ ID NO: 1351643 - RNA, 22 nt, Mycobacterium tuberculosis H37Rv
cccggacuccaaagccgugcca

SEQ ID NO: 1351644 - RNA, 17 nt, Mycobacterium tuberculosis H37Rv
cccggacgauggcgucg

SEQ ID NO: 1351645 - RNA, 15 nt, Mycobacterium tuberculosis H37Rv
cccggagcacccggg

SEQ ID NO: 1351646 - RNA, 17 nt, Mycobacterium tuberculosis H37Rv
cccggacguaggcaccc

SEQ ID NO: 1351647 - RNA, 17 nt, Mycobacterium tuberculosis H37Rv
cccggagccgccaggug

SEQ ID NO: 1351648 - RNA, 24 nt, Mycobacterium tuberculosis H37Rv
cccggagccgccaggugcucgucg

SEQ ID NO: 1351649 - RNA, 18 nt, Mycobacterium tuberculosis H37Rv
cccggcgaugcagccggg

SEQ ID NO: 1351650 - RNA, 16 nt, Mycobacterium tuberculosis H37Rv
cccggcgcaagcgccg

SEQ ID NO: 1351651 - RNA, 14 nt, Mycobacterium tuberculosis H37Rv
cccggccggcccgg

SEQ ID NO: 1351652 - RNA, 15 nt, Mycobacterium tuberculosis H37Rv
cccggccuugccgcc

SEQ ID NO: 1351653 - RNA, 16 nt, Mycobacterium tuberculosis H37Rv
cccggccuugccaccg

SEQ ID NO: 1351654 - RNA, 15 nt, Mycobacterium tuberculosis H37Rv
cccggccuugccacc

SEQ ID NO: 1351655 - RNA, 17 nt, Mycobacterium tuberculosis H37Rv
cccggccuggagcagcc

SEQ ID NO: 1351656 - RNA, 16 nt, Mycobacterium tuberculosis H37Rv
cccggcgagcacccgc

SEQ ID NO: 1351657 - RNA, 19 nt, Mycobacterium tuberculosis H37Rv
cccggcgacggcguagccg

SEQ ID NO: 1351658 - RNA, 14 nt, Mycobacterium tuberculosis H37Rv
cccggcccgccacc

SEQ ID NO: 1351659 - RNA, 18 nt, Mycobacterium tuberculosis H37Rv
cccggccgaacgccucgc

SEQ ID NO: 1351660 - RNA, 12 nt, Mycobacterium tuberculosis H37Rv
cccggccgccga

SEQ ID NO: 1351661 - RNA, 15 nt, Mycobacterium tuberculosis H37Rv
cccggccgaucucgg

SEQ ID NO: 1351662 - RNA, 11 nt, Mycobacterium tuberculosis H37Rv
cccggccgcca

SEQ ID NO: 1351663 - RNA, 16 nt, Mycobacterium tuberculosis H37Rv
cccggccguugggcca

SEQ ID NO: 1351664 - RNA, 14 nt, Mycobacterium tuberculosis H37Rv
cccggccugcgucg

SEQ ID NO: 1351665 - RNA, 19 nt, Mycobacterium tuberculosis H37Rv
cccggccgggucgagugcg

SEQ ID NO: 1351666 - RNA, 19 nt, Mycobacterium tuberculosis H37Rv
cccggccggucgagacgcu

SEQ ID NO: 1351667 - RNA, 15 nt, Mycobacterium tuberculosis H37Rv
cccggccgcggccca

SEQ ID NO: 1351668 - RNA, 18 nt, Mycobacterium tuberculosis H37Rv
cccggccgcgcacccguc

SEQ ID NO: 1351669 - RNA, 17 nt, Mycobacterium tuberculosis H37Rv
cccggcgugucgccgcc

SEQ ID NO: 1351670 - RNA, 21 nt, Mycobacterium tuberculosis H37Rv
cccggcguauugcaccgccag

SEQ ID NO: 1351671 - RNA, 22 nt, Mycobacterium tuberculosis H37Rv
cccggcguauugcaccgccagg

SEQ ID NO: 1351672 - RNA, 16 nt, Mycobacterium tuberculosis H37Rv
cccggcguccgaccgg

SEQ ID NO: 1351673 - RNA, 17 nt, Mycobacterium tuberculosis H37Rv
cccggcgggcggugggc

SEQ ID NO: 1351674 - RNA, 18 nt, Mycobacterium tuberculosis H37Rv
cccggcgggcggugggca

SEQ ID NO: 1351675 - RNA, 14 nt, Mycobacterium tuberculosis H37Rv
cccggcggcgcgcc

SEQ ID NO: 1351676 - RNA, 19 nt, Mycobacterium tuberculosis H37Rv
cccggcgguuggugcagcg

SEQ ID NO: 1351677 - RNA, 15 nt, Mycobacterium tuberculosis H37Rv
cccggcgguaccgcc

SEQ ID NO: 1351678 - RNA, 21 nt, Mycobacterium tuberculosis H37Rv
cccggcugccagcgccgccgc

SEQ ID NO: 1351679 - RNA, 20 nt, Mycobacterium tuberculosis H37Rv
cccggcugaucuaccagugg

SEQ ID NO: 1351680 - RNA, 17 nt, Mycobacterium tuberculosis H37Rv
cccggcugccagcgccg

SEQ ID NO: 1351681 - RNA, 15 nt, Mycobacterium tuberculosis H37Rv
cccggcucggccagc

SEQ ID NO: 1351682 - RNA, 18 nt, Mycobacterium tuberculosis H37Rv
cccggcucggccagccag

SEQ ID NO: 1351683 - RNA, 13 nt, Mycobacterium tuberculosis H37Rv
cccggcucggcag

SEQ ID NO: 1351684 - RNA, 14 nt, Mycobacterium tuberculosis H37Rv
cccggcugggaucg

SEQ ID NO: 1351685 - RNA, 19 nt, Mycobacterium tuberculosis H37Rv
cccggcuccuccccggccc

SEQ ID NO: 1351686 - RNA, 18 nt, Mycobacterium tuberculosis H37Rv
cccggcucucuucgcgcg

SEQ ID NO: 1351687 - RNA, 21 nt, Mycobacterium tuberculosis H37Rv
cccggcucucuucgcgcgcug

SEQ ID NO: 1351688 - RNA, 14 nt, Mycobacterium tuberculosis H37Rv
cccggcucacagca

SEQ ID NO: 1351689 - RNA, 23 nt, Mycobacterium tuberculosis H37Rv
cccggcgcgaugguuauccccug

SEQ ID NO: 1351690 - RNA, 12 nt, Mycobacterium tuberculosis H37Rv
cccggcgcgcca

SEQ ID NO: 1351691 - RNA, 15 nt, Mycobacterium tuberculosis H37Rv
cccggcgcggccgca

SEQ ID NO: 1351692 - RNA, 18 nt, Mycobacterium tuberculosis H37Rv
cccggcgcuagcgccgcg

SEQ ID NO: 1351693 - RNA, 16 nt, Mycobacterium tuberculosis H37Rv
cccggcgcuagcgccg

SEQ ID NO: 1351694 - RNA, 17 nt, Mycobacterium tuberculosis H37Rv
cccggcggccaucccgc

SEQ ID NO: 1351695 - RNA, 22 nt, Mycobacterium tuberculosis H37Rv
cccggcggaucccgaggcgccc

SEQ ID NO: 1351696 - RNA, 19 nt, Mycobacterium tuberculosis H37Rv
cccggcgggcccgccggcc

SEQ ID NO: 1351697 - RNA, 20 nt, Mycobacterium tuberculosis H37Rv
cccggcgggcccgccggccc

SEQ ID NO: 1351698 - RNA, 21 nt, Mycobacterium tuberculosis H37Rv
cccggcgggcccgccggcccc

SEQ ID NO: 1351699 - RNA, 13 nt, Mycobacterium tuberculosis H37Rv
cccggggugccga

SEQ ID NO: 1351700 - RNA, 16 nt, Mycobacterium tuberculosis H37Rv
cccgggguguucgucg

SEQ ID NO: 1351701 - RNA, 21 nt, Mycobacterium tuberculosis H37Rv
cccggguccaagaaccacgac

SEQ ID NO: 1351702 - RNA, 19 nt, Mycobacterium tuberculosis H37Rv
cccgggucggcacgacccg

SEQ ID NO: 1351703 - RNA, 13 nt, Mycobacterium tuberculosis H37Rv
cccgggugcugug

SEQ ID NO: 1351704 - RNA, 15 nt, Mycobacterium tuberculosis H37Rv
cccggguggcccgga

SEQ ID NO: 1351705 - RNA, 17 nt, Mycobacterium tuberculosis H37Rv
cccgggugggccaguga

SEQ ID NO: 1351706 - RNA, 18 nt, Mycobacterium tuberculosis H37Rv
cccgggguccaucggggc

SEQ ID NO: 1351707 - RNA, 15 nt, Mycobacterium tuberculosis H37Rv
cccggggccgcaacc

SEQ ID NO: 1351708 - RNA, 17 nt, Mycobacterium tuberculosis H37Rv
cccggggcgcacagcug

SEQ ID NO: 1351709 - RNA, 16 nt, Mycobacterium tuberculosis H37Rv
cccggggcgcucgcgc

SEQ ID NO: 1351710 - RNA, 20 nt, Mycobacterium tuberculosis H37Rv
cccggggcgcucgcgcgcug

SEQ ID NO: 1351711 - RNA, 16 nt, Mycobacterium tuberculosis H37Rv
cccgggcugccgccca

SEQ ID NO: 1351712 - RNA, 20 nt, Mycobacterium tuberculosis H37Rv
cccgggcgggauccacccag

SEQ ID NO: 1351713 - RNA, 20 nt, Mycobacterium tuberculosis H37Rv
cccgggcggaacgccggcac

SEQ ID NO: 1351714 - RNA, 20 nt, Mycobacterium tuberculosis H37Rv
cccgggcggccagcugcagc

SEQ ID NO: 1351715 - RNA, 20 nt, Mycobacterium tuberculosis H37Rv
cccgggcggcggccugggcc

SEQ ID NO: 1351716 - RNA, 17 nt, Mycobacterium tuberculosis H37Rv
cccggcuuuugcgccca

SEQ ID NO: 1351717 - RNA, 14 nt, Mycobacterium tuberculosis H37Rv
cccgggaugcuccc

SEQ ID NO: 1351718 - RNA, 17 nt, Mycobacterium tuberculosis H37Rv
cccgggaaggaaccggg

SEQ ID NO: 1351719 - RNA, 16 nt, Mycobacterium tuberculosis H37Rv
cccgggcccgucgucg

SEQ ID NO: 1351720 - RNA, 13 nt, Mycobacterium tuberculosis H37Rv
cccgggcccgccg

SEQ ID NO: 1351721 - RNA, 20 nt, Mycobacterium tuberculosis H37Rv
cccgggcgagcgcggccugc

SEQ ID NO: 1351722 - RNA, 18 nt, Mycobacterium tuberculosis H37Rv
cccgggccugggacggcg

SEQ ID NO: 1351723 - RNA, 17 nt, Mycobacterium tuberculosis H37Rv
cccgggcagccugcugc

SEQ ID NO: 1351724 - RNA, 13 nt, Mycobacterium tuberculosis H37Rv
cccgggccgccag

SEQ ID NO: 1351725 - RNA, 14 nt, Mycobacterium tuberculosis H37Rv
cccgguguccagcc

SEQ ID NO: 1351726 - RNA, 14 nt, Mycobacterium tuberculosis H37Rv
cccgguguccagug

SEQ ID NO: 1351727 - RNA, 24 nt, Mycobacterium tuberculosis H37Rv
cccgguggacagaaucgaccgccg

SEQ ID NO: 1351728 - RNA, 23 nt, Mycobacterium tuberculosis H37Rv
cccggugccguuggagccgccac

SEQ ID NO: 1351729 - RNA, 16 nt, Mycobacterium tuberculosis H37Rv
cccggugccgcagcag

SEQ ID NO: 1351730 - RNA, 14 nt, Mycobacterium tuberculosis H37Rv
cccggugccgcagc

SEQ ID NO: 1351731 - RNA, 14 nt, Mycobacterium tuberculosis H37Rv
cccggugcucaagc

SEQ ID NO: 1351732 - RNA, 16 nt, Mycobacterium tuberculosis H37Rv
cccgguggacagaauc

SEQ ID NO: 1351733 - RNA, 19 nt, Mycobacterium tuberculosis H37Rv
cccggugcggaucugcugc

SEQ ID NO: 1351734 - RNA, 15 nt, Mycobacterium tuberculosis H37Rv
cccggucggcagcug

SEQ ID NO: 1351735 - RNA, 17 nt, Mycobacterium tuberculosis H37Rv
cccggucggcagcuggg

SEQ ID NO: 1351736 - RNA, 11 nt, Mycobacterium tuberculosis H37Rv
cccggucucga

SEQ ID NO: 1351737 - RNA, 19 nt, Mycobacterium tuberculosis H37Rv
cccggucucgacggcggcc

SEQ ID NO: 1351738 - RNA, 12 nt, Mycobacterium tuberculosis H37Rv
cccggugacaag

SEQ ID NO: 1351739 - RNA, 22 nt, Mycobacterium tuberculosis H37Rv
cccggucgggcgcggggcggcc

SEQ ID NO: 1351740 - RNA, 15 nt, Mycobacterium tuberculosis H37Rv
cccggugagaagaag

SEQ ID NO: 1351741 - RNA, 19 nt, Mycobacterium tuberculosis H37Rv
cccgguaccgcccgcaccg

SEQ ID NO: 1351742 - RNA, 16 nt, Mycobacterium tuberculosis H37Rv
cccgggucggcacgac

SEQ ID NO: 1351743 - RNA, 19 nt, Mycobacterium tuberculosis H37Rv
cccggucaggacggcaccc

SEQ ID NO: 1351744 - RNA, 22 nt, Mycobacterium tuberculosis H37Rv
cccgguccggcccggggacgcc

SEQ ID NO: 1351745 - RNA, 22 nt, Mycobacterium tuberculosis H37Rv
cccgguccugcucgcacagcac

SEQ ID NO: 1351746 - RNA, 23 nt, Mycobacterium tuberculosis H37Rv
cccggucgagccagcggagcagc

SEQ ID NO: 1351747 - RNA, 18 nt, Mycobacterium tuberculosis H37Rv
cccggucgcacuuggccc

SEQ ID NO: 1351748 - RNA, 15 nt, Mycobacterium tuberculosis H37Rv
cccgguccagcccca

SEQ ID NO: 1351749 - RNA, 22 nt, Mycobacterium tuberculosis H37Rv
cccgguguucaucacgccgccg

SEQ ID NO: 1351750 - RNA, 15 nt, Mycobacterium tuberculosis H37Rv
cccgguucagcgcug

SEQ ID NO: 1351751 - RNA, 23 nt, Mycobacterium tuberculosis H37Rv
cccgguguugagcgaacccgcgu

SEQ ID NO: 1351752 - RNA, 17 nt, Mycobacterium tuberculosis H37Rv
cccgguucgacgucugc

SEQ ID NO: 1351753 - RNA, 21 nt, Mycobacterium tuberculosis H37Rv
cccgguucgacgucugcccag

SEQ ID NO: 1351754 - RNA, 19 nt, Mycobacterium tuberculosis H37Rv
cccgguugugcgcgcgccc

SEQ ID NO: 1351755 - RNA, 18 nt, Mycobacterium tuberculosis H37Rv
cccgguugugcgcgcgcc

SEQ ID NO: 1351756 - RNA, 22 nt, Mycobacterium tuberculosis H37Rv
cccguacccacgacgggccgag

SEQ ID NO: 1351757 - RNA, 15 nt, Mycobacterium tuberculosis H37Rv
cccguacgccggcgg

SEQ ID NO: 1351758 - RNA, 16 nt, Mycobacterium tuberculosis H37Rv
cccguauaaccggcca

SEQ ID NO: 1351759 - RNA, 13 nt, Mycobacterium tuberculosis H37Rv
cccgucaccgccg

SEQ ID NO: 1351760 - RNA, 13 nt, Mycobacterium tuberculosis H37Rv
cccgucacgcccg

SEQ ID NO: 1351761 - RNA, 12 nt, Mycobacterium tuberculosis H37Rv
cccgucccccgc

SEQ ID NO: 1351762 - RNA, 19 nt, Mycobacterium tuberculosis H37Rv
cccguccgcgcccaccggc

SEQ ID NO: 1351763 - RNA, 12 nt, Mycobacterium tuberculosis H37Rv
cccgucccgccg

SEQ ID NO: 1351764 - RNA, 13 nt, Mycobacterium tuberculosis H37Rv
cccgucgccgccc

SEQ ID NO: 1351765 - RNA, 17 nt, Mycobacterium tuberculosis H37Rv
cccgucgagcagcaugu

SEQ ID NO: 1351766 - RNA, 14 nt, Mycobacterium tuberculosis H37Rv
cccgucgagcagca

SEQ ID NO: 1351767 - RNA, 17 nt, Mycobacterium tuberculosis H37Rv
cccguuaugcgccgccc

SEQ ID NO: 1351768 - RNA, 16 nt, Mycobacterium tuberculosis H37Rv
cccguuaugcgccgcc

SEQ ID NO: 1351769 - RNA, 13 nt, Mycobacterium tuberculosis H37Rv
cccguugcaggug

SEQ ID NO: 1351770 - RNA, 13 nt, Mycobacterium tuberculosis H37Rv
cccguugccgccc

SEQ ID NO: 1351771 - RNA, 23 nt, Mycobacterium tuberculosis H37Rv
cccguuguccagaacggcgauca

SEQ ID NO: 1351772 - RNA, 20 nt, Mycobacterium tuberculosis H37Rv
cccguuucaagucccuucau

SEQ ID NO: 1351773 - RNA, 18 nt, Mycobacterium tuberculosis H37Rv
cccgugccgcccgcgccg

SEQ ID NO: 1351774 - RNA, 22 nt, Mycobacterium tuberculosis H37Rv
cccgugccgucaacgauggugg

SEQ ID NO: 1351775 - RNA, 15 nt, Mycobacterium tuberculosis H37Rv
cccgugccgucgccc

SEQ ID NO: 1351776 - RNA, 13 nt, Mycobacterium tuberculosis H37Rv
cccgugccuggcc

SEQ ID NO: 1351777 - RNA, 13 nt, Mycobacterium tuberculosis H37Rv
cccgugccacagc

SEQ ID NO: 1351778 - RNA, 15 nt, Mycobacterium tuberculosis H37Rv
cccgugcgcgcgcag

SEQ ID NO: 1351779 - RNA, 18 nt, Mycobacterium tuberculosis H37Rv
cccgugcgcgcgcagcug

SEQ ID NO: 1351780 - RNA, 15 nt, Mycobacterium tuberculosis H37Rv
cccguggaaagugcg

SEQ ID NO: 1351781 - RNA, 17 nt, Mycobacterium tuberculosis H37Rv
cccguggaaagugcguc

SEQ ID NO: 1351782 - RNA, 14 nt, Mycobacterium tuberculosis H37Rv
cccgucggcgugcg

SEQ ID NO: 1351783 - RNA, 18 nt, Mycobacterium tuberculosis H37Rv
cccgugacauucugcagc

SEQ ID NO: 1351784 - RNA, 21 nt, Mycobacterium tuberculosis H37Rv
cccgugauccgccgacagccc

SEQ ID NO: 1351785 - RNA, 15 nt, Mycobacterium tuberculosis H37Rv
cccgugauccgccga

SEQ ID NO: 1351786 - RNA, 18 nt, Mycobacterium tuberculosis H37Rv
cccgucgcgaaucugcgc

SEQ ID NO: 1351787 - RNA, 20 nt, Mycobacterium tuberculosis H37Rv
cccuccuuuguccucccgga

SEQ ID NO: 1351788 - RNA, 19 nt, Mycobacterium tuberculosis H37Rv
cccucgaauucggccggcg

SEQ ID NO: 1351789 - RNA, 16 nt, Mycobacterium tuberculosis H37Rv
cccuccucgaccgcgg

SEQ ID NO: 1351790 - RNA, 16 nt, Mycobacterium tuberculosis H37Rv
cccuccgggcgcacca

SEQ ID NO: 1351791 - RNA, 15 nt, Mycobacterium tuberculosis H37Rv
cccuccgugggcagc

SEQ ID NO: 1351792 - RNA, 23 nt, Mycobacterium tuberculosis H37Rv
cccuccgugggcagcgcgcccga

SEQ ID NO: 1351793 - RNA, 16 nt, Mycobacterium tuberculosis H37Rv
cccuccgagcacagga

SEQ ID NO: 1351794 - RNA, 12 nt, Mycobacterium tuberculosis H37Rv
cccuccgcagcu

SEQ ID NO: 1351795 - RNA, 15 nt, Mycobacterium tuberculosis H37Rv
cccucccgggcccgc

SEQ ID NO: 1351796 - RNA, 16 nt, Mycobacterium tuberculosis H37Rv
cccucccaccagcggc

SEQ ID NO: 1351797 - RNA, 18 nt, Mycobacterium tuberculosis H37Rv
cccuccagauaccaccgc

SEQ ID NO: 1351798 - RNA, 19 nt, Mycobacterium tuberculosis H37Rv
cccuccagauaccaccgcc

SEQ ID NO: 1351799 - RNA, 14 nt, Mycobacterium tuberculosis H37Rv
cccuccagcacgcc

SEQ ID NO: 1351800 - RNA, 20 nt, Mycobacterium tuberculosis H37Rv
cccuccagggcccugcuggc

SEQ ID NO: 1351801 - RNA, 22 nt, Mycobacterium tuberculosis H37Rv
cccucaccgcgagggcgcgugu

SEQ ID NO: 1351802 - RNA, 12 nt, Mycobacterium tuberculosis H37Rv
cccucagccgcg

SEQ ID NO: 1351803 - RNA, 21 nt, Mycobacterium tuberculosis H37Rv
cccuagggcggugccgccgga

SEQ ID NO: 1351804 - RNA, 17 nt, Mycobacterium tuberculosis H37Rv
cccuacgcagcgcggcu

SEQ ID NO: 1351805 - RNA, 13 nt, Mycobacterium tuberculosis H37Rv
cccuaacuccccc

SEQ ID NO: 1351806 - RNA, 15 nt, Mycobacterium tuberculosis H37Rv
ccgccagccuggucu

SEQ ID NO: 1351807 - RNA, 19 nt, Mycobacterium tuberculosis H37Rv
ccgccagccgcgagccggu

SEQ ID NO: 1351808 - RNA, 21 nt, Mycobacterium tuberculosis H37Rv
ccgccagccgguccagcagcu

SEQ ID NO: 1351809 - RNA, 16 nt, Mycobacterium tuberculosis H37Rv
ccgccagccgcgagcc

SEQ ID NO: 1351810 - RNA, 13 nt, Mycobacterium tuberculosis H37Rv
ccgccagcgccgc

SEQ ID NO: 1351811 - RNA, 15 nt, Mycobacterium tuberculosis H37Rv
ccgccagcgccaccg

SEQ ID NO: 1351812 - RNA, 16 nt, Mycobacterium tuberculosis H37Rv
ccgccagcgccgccgc

SEQ ID NO: 1351813 - RNA, 12 nt, Mycobacterium tuberculosis H37Rv
ccgccagcccca

SEQ ID NO: 1351814 - RNA, 18 nt, Mycobacterium tuberculosis H37Rv
ccgccagcccagcacgcu

SEQ ID NO: 1351815 - RNA, 16 nt, Mycobacterium tuberculosis H37Rv
ccgccagcagggccag

SEQ ID NO: 1351816 - RNA, 16 nt, Mycobacterium tuberculosis H37Rv
ccgccagcugggcagc

SEQ ID NO: 1351817 - RNA, 16 nt, Mycobacterium tuberculosis H37Rv
ccgccagcugcgcagc

SEQ ID NO: 1351818 - RNA, 14 nt, Mycobacterium tuberculosis H37Rv
ccgccagcggcagc

SEQ ID NO: 1351819 - RNA, 20 nt, Mycobacterium tuberculosis H37Rv
ccgccaggaacucggcccac

SEQ ID NO: 1351820 - RNA, 21 nt, Mycobacterium tuberculosis H37Rv
ccgccagguccgccggugccg

SEQ ID NO: 1351821 - RNA, 21 nt, Mycobacterium tuberculosis H37Rv
ccgccaggucgaggcaggccu

SEQ ID NO: 1351822 - RNA, 18 nt, Mycobacterium tuberculosis H37Rv
ccgccagguguucgccgg

SEQ ID NO: 1351823 - RNA, 19 nt, Mycobacterium tuberculosis H37Rv
ccgccacgguucgggcagc

SEQ ID NO: 1351824 - RNA, 20 nt, Mycobacterium tuberculosis H37Rv
ccgccacguaauuccccagg

SEQ ID NO: 1351825 - RNA, 22 nt, Mycobacterium tuberculosis H37Rv
ccgccacguaauuccccagggg

SEQ ID NO: 1351826 - RNA, 19 nt, Mycobacterium tuberculosis H37Rv
ccgccacgguacauccaga

SEQ ID NO: 1351827 - RNA, 20 nt, Mycobacterium tuberculosis H37Rv
ccgccacgggcggccaccgc

SEQ ID NO: 1351828 - RNA, 14 nt, Mycobacterium tuberculosis H37Rv
ccgccacugcuggg

SEQ ID NO: 1351829 - RNA, 17 nt, Mycobacterium tuberculosis H37Rv
ccgccagaccgcggcgg

SEQ ID NO: 1351830 - RNA, 18 nt, Mycobacterium tuberculosis H37Rv
ccgccagaucucgcgcgc

SEQ ID NO: 1351831 - RNA, 15 nt, Mycobacterium tuberculosis H37Rv
ccgccagcaccaccg

SEQ ID NO: 1351832 - RNA, 20 nt, Mycobacterium tuberculosis H37Rv
ccgccagauugccugacaac

SEQ ID NO: 1351833 - RNA, 17 nt, Mycobacterium tuberculosis H37Rv
ccgccaccuuggcguug

SEQ ID NO: 1351834 - RNA, 15 nt, Mycobacterium tuberculosis H37Rv
ccgccaccucgccgg

SEQ ID NO: 1351835 - RNA, 18 nt, Mycobacterium tuberculosis H37Rv
ccgccaccucccagggcu

SEQ ID NO: 1351836 - RNA, 19 nt, Mycobacterium tuberculosis H37Rv
ccgccacggaucgcggcgg

SEQ ID NO: 1351837 - RNA, 14 nt, Mycobacterium tuberculosis H37Rv
ccgccacgggcggc

SEQ ID NO: 1351838 - RNA, 14 nt, Mycobacterium tuberculosis H37Rv
ccgccaccgccacc

SEQ ID NO: 1351839 - RNA, 11 nt, Mycobacterium tuberculosis H37Rv
ccgccacccuu

SEQ ID NO: 1351840 - RNA, 20 nt, Mycobacterium tuberculosis H37Rv
ccgccacccuuggcccggug

SEQ ID NO: 1351841 - RNA, 20 nt, Mycobacterium tuberculosis H37Rv
ccgccacccgccaacgccaa

SEQ ID NO: 1351842 - RNA, 14 nt, Mycobacterium tuberculosis H37Rv
ccgccaccgcgagc

SEQ ID NO: 1351843 - RNA, 16 nt, Mycobacterium tuberculosis H37Rv
ccgccaccgccaccgc

SEQ ID NO: 1351844 - RNA, 16 nt, Mycobacterium tuberculosis H37Rv
ccgccaccgcggccug

SEQ ID NO: 1351845 - RNA, 22 nt, Mycobacterium tuberculosis H37Rv
ccgcccacaugaacgaccaccg

SEQ ID NO: 1351846 - RNA, 23 nt, Mycobacterium tuberculosis H37Rv
ccgcccacaugaacgaccaccgc

SEQ ID NO: 1351847 - RNA, 22 nt, Mycobacterium tuberculosis H37Rv
ccgcccaccacacagccgcgcu

SEQ ID NO: 1351848 - RNA, 20 nt, Mycobacterium tuberculosis H37Rv
ccgcccaccacacagccgcg

SEQ ID NO: 1351849 - RNA, 17 nt, Mycobacterium tuberculosis H37Rv
ccgcccaagccgccggc

SEQ ID NO: 1351850 - RNA, 18 nt, Mycobacterium tuberculosis H37Rv
ccgccauugccgccgucg

SEQ ID NO: 1351851 - RNA, 16 nt, Mycobacterium tuberculosis H37Rv
ccgccauugccguccg

SEQ ID NO: 1351852 - RNA, 16 nt, Mycobacterium tuberculosis H37Rv
ccgcccagaccgccga

SEQ ID NO: 1351853 - RNA, 18 nt, Mycobacterium tuberculosis H37Rv
ccgcccagaccgccgacg

SEQ ID NO: 1351854 - RNA, 17 nt, Mycobacterium tuberculosis H37Rv
ccgcccaccggucgccg

SEQ ID NO: 1351855 - RNA, 13 nt, Mycobacterium tuberculosis H37Rv
ccgcccagcagca

SEQ ID NO: 1351856 - RNA, 14 nt, Mycobacterium tuberculosis H37Rv
ccgcccgcccaccu

SEQ ID NO: 1351857 - RNA, 15 nt, Mycobacterium tuberculosis H37Rv
ccgcccgccagcgau

SEQ ID NO: 1351858 - RNA, 15 nt, Mycobacterium tuberculosis H37Rv
ccgcccgccaggccg

SEQ ID NO: 1351859 - RNA, 15 nt, Mycobacterium tuberculosis H37Rv
ccgcccagccgcagc

SEQ ID NO: 1351860 - RNA, 19 nt, Mycobacterium tuberculosis H37Rv
ccgcccagcagcaccugca

SEQ ID NO: 1351861 - RNA, 21 nt, Mycobacterium tuberculosis H37Rv
ccgccauccgauggcccggcu

SEQ ID NO: 1351862 - RNA, 11 nt, Mycobacterium tuberculosis H37Rv
ccgccaucccc

SEQ ID NO: 1351863 - RNA, 20 nt, Mycobacterium tuberculosis H37Rv
ccgccaucaucgcuuggccu

SEQ ID NO: 1351864 - RNA, 14 nt, Mycobacterium tuberculosis H37Rv
ccgccaucagcccg

SEQ ID NO: 1351865 - RNA, 15 nt, Mycobacterium tuberculosis H37Rv
ccgccagucccccgc

SEQ ID NO: 1351866 - RNA, 20 nt, Mycobacterium tuberculosis H37Rv
ccgcccggaaaggccgcggu

SEQ ID NO: 1351867 - RNA, 13 nt, Mycobacterium tuberculosis H37Rv
ccgcccggccagc

SEQ ID NO: 1351868 - RNA, 14 nt, Mycobacterium tuberculosis H37Rv
ccgcccggcccggc

SEQ ID NO: 1351869 - RNA, 12 nt, Mycobacterium tuberculosis H37Rv
ccgcccggcccg

SEQ ID NO: 1351870 - RNA, 15 nt, Mycobacterium tuberculosis H37Rv
ccgcccgcuccuccg

SEQ ID NO: 1351871 - RNA, 17 nt, Mycobacterium tuberculosis H37Rv
ccgcccgcugcggcggc

SEQ ID NO: 1351872 - RNA, 13 nt, Mycobacterium tuberculosis H37Rv
ccgcccagccgca

SEQ ID NO: 1351873 - RNA, 17 nt, Mycobacterium tuberculosis H37Rv
ccgcccgcgccgcccgc

SEQ ID NO: 1351874 - RNA, 15 nt, Mycobacterium tuberculosis H37Rv
ccgcccgcgccuccg

SEQ ID NO: 1351875 - RNA, 16 nt, Mycobacterium tuberculosis H37Rv
ccgcccgcgccuccgu

SEQ ID NO: 1351876 - RNA, 17 nt, Mycobacterium tuberculosis H37Rv
ccgcccuugccgccagc

SEQ ID NO: 1351877 - RNA, 17 nt, Mycobacterium tuberculosis H37Rv
ccgcccuugccgcccgc

SEQ ID NO: 1351878 - RNA, 16 nt, Mycobacterium tuberculosis H37Rv
ccgcccuugccgccgg

SEQ ID NO: 1351879 - RNA, 19 nt, Mycobacterium tuberculosis H37Rv
ccgcccuugccgccggccc

SEQ ID NO: 1351880 - RNA, 21 nt, Mycobacterium tuberculosis H37Rv
ccgcccuugccgccggccccg

SEQ ID NO: 1351881 - RNA, 14 nt, Mycobacterium tuberculosis H37Rv
ccgccgagcuggcg

SEQ ID NO: 1351882 - RNA, 18 nt, Mycobacterium tuberculosis H37Rv
ccgccgagcggugccggc

SEQ ID NO: 1351883 - RNA, 21 nt, Mycobacterium tuberculosis H37Rv
ccgccgaaacucaccagcacc

SEQ ID NO: 1351884 - RNA, 22 nt, Mycobacterium tuberculosis H37Rv
ccgccgaaagcaucaccaccgc

SEQ ID NO: 1351885 - RNA, 14 nt, Mycobacterium tuberculosis H37Rv
ccgccgaaaaccuc

SEQ ID NO: 1351886 - RNA, 22 nt, Mycobacterium tuberculosis H37Rv
ccgccgaaaaccucgaaaccgu

SEQ ID NO: 1351887 - RNA, 20 nt, Mycobacterium tuberculosis H37Rv
ccgccgaaacucaccagcac

SEQ ID NO: 1351888 - RNA, 16 nt, Mycobacterium tuberculosis H37Rv
ccgccgaacagcugga

SEQ ID NO: 1351889 - RNA, 21 nt, Mycobacterium tuberculosis H37Rv
ccgccgauaccgccggcccca

SEQ ID NO: 1351890 - RNA, 17 nt, Mycobacterium tuberculosis H37Rv
ccgccgaugccaccgcu

SEQ ID NO: 1351891 - RNA, 18 nt, Mycobacterium tuberculosis H37Rv
ccgccgaugccaccgcuu

SEQ ID NO: 1351892 - RNA, 18 nt, Mycobacterium tuberculosis H37Rv
ccgccgaugccgccgccg

SEQ ID NO: 1351893 - RNA, 16 nt, Mycobacterium tuberculosis H37Rv
ccgccgaugccaccgc

SEQ ID NO: 1351894 - RNA, 13 nt, Mycobacterium tuberculosis H37Rv
ccgccgagcuggc

SEQ ID NO: 1351895 - RNA, 18 nt, Mycobacterium tuberculosis H37Rv
ccgccgaugaugcggcgc

SEQ ID NO: 1351896 - RNA, 21 nt, Mycobacterium tuberculosis H37Rv
ccgccgaugaugcggcgcagc

SEQ ID NO: 1351897 - RNA, 22 nt, Mycobacterium tuberculosis H37Rv
ccgccgaucccgucgggcacac

SEQ ID NO: 1351898 - RNA, 21 nt, Mycobacterium tuberculosis H37Rv
ccgcaccugggcggcgcgaag

SEQ ID NO: 1351899 - RNA, 13 nt, Mycobacterium tuberculosis H37Rv
ccgcaccgugccg

SEQ ID NO: 1351900 - RNA, 15 nt, Mycobacterium tuberculosis H37Rv
ccgcaccggcggcgc

SEQ ID NO: 1351901 - RNA, 21 nt, Mycobacterium tuberculosis H37Rv
ccgcaccggaucaccgcgccc

SEQ ID NO: 1351902 - RNA, 17 nt, Mycobacterium tuberculosis H37Rv
ccgcaccggaucggcua

SEQ ID NO: 1351903 - RNA, 14 nt, Mycobacterium tuberculosis H37Rv
ccgcacccggccgc

SEQ ID NO: 1351904 - RNA, 17 nt, Mycobacterium tuberculosis H37Rv
ccgcacccgcucgucgg

SEQ ID NO: 1351905 - RNA, 20 nt, Mycobacterium tuberculosis H37Rv
ccgcaccaagcagcgaccag

SEQ ID NO: 1351906 - RNA, 22 nt, Mycobacterium tuberculosis H37Rv
ccgcacagcggauucggcgucg

SEQ ID NO: 1351907 - RNA, 17 nt, Mycobacterium tuberculosis H37Rv
ccgcacccguugcuccc

SEQ ID NO: 1351908 - RNA, 15 nt, Mycobacterium tuberculosis H37Rv
ccgcaccgcugaccc

SEQ ID NO: 1351909 - RNA, 17 nt, Mycobacterium tuberculosis H37Rv
ccgcaccgauuuccucu

SEQ ID NO: 1351910 - RNA, 16 nt, Mycobacterium tuberculosis H37Rv
ccgaugguacccgcgc

SEQ ID NO: 1351911 - RNA, 18 nt, Mycobacterium tuberculosis H37Rv
ccgaugguacccgcgccg

SEQ ID NO: 1351912 - RNA, 17 nt, Mycobacterium tuberculosis H37Rv
ccgauggcgucgccggc

SEQ ID NO: 1351913 - RNA, 16 nt, Mycobacterium tuberculosis H37Rv
ccgauggcuaccuugg

SEQ ID NO: 1351914 - RNA, 22 nt, Mycobacterium tuberculosis H37Rv
ccgauggaugggcugcgcgucg

SEQ ID NO: 1351915 - RNA, 17 nt, Mycobacterium tuberculosis H37Rv
ccgauggaugggcugcg

SEQ ID NO: 1351916 - RNA, 18 nt, Mycobacterium tuberculosis H37Rv
ccgcaaugacgucgucgg

SEQ ID NO: 1351917 - RNA, 17 nt, Mycobacterium tuberculosis H37Rv
ccgcaauggcggccuug

SEQ ID NO: 1351918 - RNA, 14 nt, Mycobacterium tuberculosis H37Rv
ccgcaaucugcuug

SEQ ID NO: 1351919 - RNA, 22 nt, Mycobacterium tuberculosis H37Rv
ccgcacaccugcgcggcgugcg

SEQ ID NO: 1351920 - RNA, 17 nt, Mycobacterium tuberculosis H37Rv
ccgcacaagcccagccc

SEQ ID NO: 1351921 - RNA, 18 nt, Mycobacterium tuberculosis H37Rv
ccgcagaucaccgccagc

SEQ ID NO: 1351922 - RNA, 21 nt, Mycobacterium tuberculosis H37Rv
ccgcagagcaccgcgaacagc

SEQ ID NO: 1351923 - RNA, 23 nt, Mycobacterium tuberculosis H37Rv
ccgcagagcaccgcgaacagcac

SEQ ID NO: 1351924 - RNA, 16 nt, Mycobacterium tuberculosis H37Rv
ccgcagacgccgucug

SEQ ID NO: 1351925 - RNA, 17 nt, Mycobacterium tuberculosis H37Rv
ccgcagacgccgucuga

SEQ ID NO: 1351926 - RNA, 18 nt, Mycobacterium tuberculosis H37Rv
ccgcagacguccugggcc

SEQ ID NO: 1351927 - RNA, 15 nt, Mycobacterium tuberculosis H37Rv
ccgcagauccccgcc

SEQ ID NO: 1351928 - RNA, 21 nt, Mycobacterium tuberculosis H37Rv
ccgcagaucaccgccagcugg

SEQ ID NO: 1351929 - RNA, 13 nt, Mycobacterium tuberculosis H37Rv
ccgcagaugggcc

SEQ ID NO: 1351930 - RNA, 14 nt, Mycobacterium tuberculosis H37Rv
ccgcagcgccaccc

SEQ ID NO: 1351931 - RNA, 20 nt, Mycobacterium tuberculosis H37Rv
ccgcagcgaagaccagcggc

SEQ ID NO: 1351932 - RNA, 23 nt, Mycobacterium tuberculosis H37Rv
ccgcagcgcgaaggucagcgacu

SEQ ID NO: 1351933 - RNA, 23 nt, Mycobacterium tuberculosis H37Rv
ccgcagcgcuuccaggucagaga

SEQ ID NO: 1351934 - RNA, 22 nt, Mycobacterium tuberculosis H37Rv
ccgcagcgcgaaggucagcgac

SEQ ID NO: 1351935 - RNA, 16 nt, Mycobacterium tuberculosis H37Rv
ccgcacgcuggcgggc

SEQ ID NO: 1351936 - RNA, 16 nt, Mycobacterium tuberculosis H37Rv
ccgcacggaugucgcc

SEQ ID NO: 1351937 - RNA, 22 nt, Mycobacterium tuberculosis H37Rv
ccgcacggaggcggaccaggcc

SEQ ID NO: 1351938 - RNA, 20 nt, Mycobacterium tuberculosis H37Rv
ccgcagaaugucguaggcgc

SEQ ID NO: 1351939 - RNA, 13 nt, Mycobacterium tuberculosis H37Rv
ccgcacggccucc

SEQ ID NO: 1351940 - RNA, 19 nt, Mycobacterium tuberculosis H37Rv
ccgcacgccgaccggcccg

SEQ ID NO: 1351941 - RNA, 17 nt, Mycobacterium tuberculosis H37Rv
ccgcacgccgaccggcc

SEQ ID NO: 1351942 - RNA, 15 nt, Mycobacterium tuberculosis H37Rv
ccgcacgccgaccag

SEQ ID NO: 1351943 - RNA, 15 nt, Mycobacterium tuberculosis H37Rv
ccgcacgccgaccgg

SEQ ID NO: 1351944 - RNA, 17 nt, Mycobacterium tuberculosis H37Rv
ccgcacgcacggcgugu

SEQ ID NO: 1351945 - RNA, 12 nt, Mycobacterium tuberculosis H37Rv
ccgccaccaccg

SEQ ID NO: 1351946 - RNA, 18 nt, Mycobacterium tuberculosis H37Rv
ccgccacacggggccgcc

SEQ ID NO: 1351947 - RNA, 15 nt, Mycobacterium tuberculosis H37Rv
ccgccacaccgccgc

SEQ ID NO: 1351948 - RNA, 15 nt, Mycobacterium tuberculosis H37Rv
ccgccacacggggcc

SEQ ID NO: 1351949 - RNA, 18 nt, Mycobacterium tuberculosis H37Rv
ccgccacaacggcggcgc

SEQ ID NO: 1351950 - RNA, 23 nt, Mycobacterium tuberculosis H37Rv
ccgccaauuacagcuugcgcagc

SEQ ID NO: 1351951 - RNA, 15 nt, Mycobacterium tuberculosis H37Rv
ccgccaccacgguca

SEQ ID NO: 1351952 - RNA, 17 nt, Mycobacterium tuberculosis H37Rv
ccgccaccacgccgucg

SEQ ID NO: 1351953 - RNA, 20 nt, Mycobacterium tuberculosis H37Rv
ccgccaccaccgcugccggc

SEQ ID NO: 1351954 - RNA, 21 nt, Mycobacterium tuberculosis H37Rv
ccgccaccaucgccucggcgc

SEQ ID NO: 1351955 - RNA, 12 nt, Mycobacterium tuberculosis H37Rv
ccgccaccagcu

SEQ ID NO: 1351956 - RNA, 11 nt, Mycobacterium tuberculosis H37Rv
ccgccacccgc

SEQ ID NO: 1351957 - RNA, 12 nt, Mycobacterium tuberculosis H37Rv
ccgccacccgca

SEQ ID NO: 1351958 - RNA, 12 nt, Mycobacterium tuberculosis H37Rv
ccgccacccgcc

SEQ ID NO: 1351959 - RNA, 17 nt, Mycobacterium tuberculosis H37Rv
ccgccaacuccucagcc

SEQ ID NO: 1351960 - RNA, 16 nt, Mycobacterium tuberculosis H37Rv
ccgccaacuccucagc

SEQ ID NO: 1351961 - RNA, 23 nt, Mycobacterium tuberculosis H37Rv
ccgcauugccaacgcccacguua

SEQ ID NO: 1351962 - RNA, 19 nt, Mycobacterium tuberculosis H37Rv
ccgcaugccacggcaagcc

SEQ ID NO: 1351963 - RNA, 17 nt, Mycobacterium tuberculosis H37Rv
ccgcaugcgcuccggcg

SEQ ID NO: 1351964 - RNA, 14 nt, Mycobacterium tuberculosis H37Rv
ccgcaugcccugga

SEQ ID NO: 1351965 - RNA, 21 nt, Mycobacterium tuberculosis H37Rv
ccgcauggcgcggguccagcc

SEQ ID NO: 1351966 - RNA, 15 nt, Mycobacterium tuberculosis H37Rv
ccgcauucggacgcc

SEQ ID NO: 1351967 - RNA, 13 nt, Mycobacterium tuberculosis H37Rv
ccgcauugccaac

SEQ ID NO: 1351968 - RNA, 19 nt, Mycobacterium tuberculosis H37Rv
ccgcaucggugucuuccuc

SEQ ID NO: 1351969 - RNA, 20 nt, Mycobacterium tuberculosis H37Rv
ccgcaucgggcuugcgcagc

SEQ ID NO: 1351970 - RNA, 14 nt, Mycobacterium tuberculosis H37Rv
ccgcaucgccucac

SEQ ID NO: 1351971 - RNA, 20 nt, Mycobacterium tuberculosis H37Rv
ccgcaucauagacagggccg

SEQ ID NO: 1351972 - RNA, 12 nt, Mycobacterium tuberculosis H37Rv
ccgcauccacgu

SEQ ID NO: 1351973 - RNA, 20 nt, Mycobacterium tuberculosis H37Rv
ccgcauccacgucgcccagg

SEQ ID NO: 1351974 - RNA, 22 nt, Mycobacterium tuberculosis H37Rv
ccgcagcgucagcgcggcgucu

SEQ ID NO: 1351975 - RNA, 16 nt, Mycobacterium tuberculosis H37Rv
ccgcauaggccccgcc

SEQ ID NO: 1351976 - RNA, 21 nt, Mycobacterium tuberculosis H37Rv
ccgcauaggccccgccagcgc

SEQ ID NO: 1351977 - RNA, 13 nt, Mycobacterium tuberculosis H37Rv
cccucggccgccc

SEQ ID NO: 1351978 - RNA, 14 nt, Mycobacterium tuberculosis H37Rv
cccucggccgcccg

SEQ ID NO: 1351979 - RNA, 19 nt, Mycobacterium tuberculosis H37Rv
cccuugcucguccaggucg

SEQ ID NO: 1351980 - RNA, 13 nt, Mycobacterium tuberculosis H37Rv
cccuuggccagca

SEQ ID NO: 1351981 - RNA, 22 nt, Mycobacterium tuberculosis H37Rv
cccucgcuguuggccgguccca

SEQ ID NO: 1351982 - RNA, 21 nt, Mycobacterium tuberculosis H37Rv
cccucggagggggaccucuuc

SEQ ID NO: 1351983 - RNA, 15 nt, Mycobacterium tuberculosis H37Rv
cccucgcgcgcgucg

SEQ ID NO: 1351984 - RNA, 18 nt, Mycobacterium tuberculosis H37Rv
cccucggcacggucgccc

SEQ ID NO: 1351985 - RNA, 20 nt, Mycobacterium tuberculosis H37Rv
cccucgaugccgcguagcug

SEQ ID NO: 1351986 - RNA, 20 nt, Mycobacterium tuberculosis H37Rv
cccucgaucacggcggcccc

SEQ ID NO: 1351987 - RNA, 13 nt, Mycobacterium tuberculosis H37Rv
cccucgcaaccgg

SEQ ID NO: 1351988 - RNA, 14 nt, Mycobacterium tuberculosis H37Rv
cccuuuacaccccc

SEQ ID NO: 1351989 - RNA, 23 nt, Mycobacterium tuberculosis H37Rv
cccuuucgcgccgcgaggcaccg

SEQ ID NO: 1351990 - RNA, 23 nt, Mycobacterium tuberculosis H37Rv
cccuugugaacggugucaacggc

SEQ ID NO: 1351991 - RNA, 19 nt, Mycobacterium tuberculosis H37Rv
cccuuguucccgaaacccg

SEQ ID NO: 1351992 - RNA, 15 nt, Mycobacterium tuberculosis H37Rv
ccgaacaccacaccg

SEQ ID NO: 1351993 - RNA, 18 nt, Mycobacterium tuberculosis H37Rv
ccgaacaccacaccgagc

SEQ ID NO: 1351994 - RNA, 11 nt, Mycobacterium tuberculosis H37Rv
ccgaacaccga

SEQ ID NO: 1351995 - RNA, 19 nt, Mycobacterium tuberculosis H37Rv
ccgaacaccggcuccagca

SEQ ID NO: 1351996 - RNA, 21 nt, Mycobacterium tuberculosis H37Rv
ccgaaccgcguuaugccaggc

SEQ ID NO: 1351997 - RNA, 19 nt, Mycobacterium tuberculosis H37Rv
ccgaaccgucagcggcaac

SEQ ID NO: 1351998 - RNA, 18 nt, Mycobacterium tuberculosis H37Rv
ccgaaccggcgcauuccc

SEQ ID NO: 1351999 - RNA, 18 nt, Mycobacterium tuberculosis H37Rv
ccgaacacgcuggagaug

SEQ ID NO: 1352000 - RNA, 16 nt, Mycobacterium tuberculosis H37Rv
ccgaaccggcaccagc

SEQ ID NO: 1352001 - RNA, 11 nt, Mycobacterium tuberculosis H37Rv
ccgaagcccga

SEQ ID NO: 1352002 - RNA, 14 nt, Mycobacterium tuberculosis H37Rv
ccgaagcccgagcu

SEQ ID NO: 1352003 - RNA, 14 nt, Mycobacterium tuberculosis H37Rv
ccgaacugggcgau

SEQ ID NO: 1352004 - RNA, 22 nt, Mycobacterium tuberculosis H37Rv
ccgaacgcgagguuccaguugg

SEQ ID NO: 1352005 - RNA, 23 nt, Mycobacterium tuberculosis H37Rv
ccgaacgugcaaccacggcggca

SEQ ID NO: 1352006 - RNA, 21 nt, Mycobacterium tuberculosis H37Rv
ccgaacgcacgucgaggcggc

SEQ ID NO: 1352007 - RNA, 21 nt, Mycobacterium tuberculosis H37Rv
ccgaacgacggguccgggcca

SEQ ID NO: 1352008 - RNA, 23 nt, Mycobacterium tuberculosis H37Rv
ccgaacgcacgucgaggcggcag

SEQ ID NO: 1352009 - RNA, 15 nt, Mycobacterium tuberculosis H37Rv
ccgaacgccaccacc

SEQ ID NO: 1352010 - RNA, 19 nt, Mycobacterium tuberculosis H37Rv
cccuuuucccugccuucuu

SEQ ID NO: 1352011 - RNA, 17 nt, Mycobacterium tuberculosis H37Rv
cccuuugcacgguggca

SEQ ID NO: 1352012 - RNA, 20 nt, Mycobacterium tuberculosis H37Rv
ccgaaaucaccucaccaguc

SEQ ID NO: 1352013 - RNA, 23 nt, Mycobacterium tuberculosis H37Rv
ccgaaaucaguugcgcuccaaca

SEQ ID NO: 1352014 - RNA, 13 nt, Mycobacterium tuberculosis H37Rv
ccgaaagccaggc

SEQ ID NO: 1352015 - RNA, 22 nt, Mycobacterium tuberculosis H37Rv
ccgacaugguccgaccagcggc

SEQ ID NO: 1352016 - RNA, 19 nt, Mycobacterium tuberculosis H37Rv
ccgacaugguccgaccagc

SEQ ID NO: 1352017 - RNA, 20 nt, Mycobacterium tuberculosis H37Rv
ccgaccaauucgcaaucggc

SEQ ID NO: 1352018 - RNA, 12 nt, Mycobacterium tuberculosis H37Rv
ccgaccaccaga

SEQ ID NO: 1352019 - RNA, 15 nt, Mycobacterium tuberculosis H37Rv
ccgaccagcacccgc

SEQ ID NO: 1352020 - RNA, 12 nt, Mycobacterium tuberculosis H37Rv
ccgaccagcaga

SEQ ID NO: 1352021 - RNA, 16 nt, Mycobacterium tuberculosis H37Rv
ccgaccagcgcggcac

SEQ ID NO: 1352022 - RNA, 21 nt, Mycobacterium tuberculosis H37Rv
ccgaccaggccagagccgccc

SEQ ID NO: 1352023 - RNA, 15 nt, Mycobacterium tuberculosis H37Rv
ccgacccaacgacca

SEQ ID NO: 1352024 - RNA, 20 nt, Mycobacterium tuberculosis H37Rv
ccgacccaacgaccaccacc

SEQ ID NO: 1352025 - RNA, 18 nt, Mycobacterium tuberculosis H37Rv
ccgacaguuuaccgugcc

SEQ ID NO: 1352026 - RNA, 21 nt, Mycobacterium tuberculosis H37Rv
ccgacaguccgcgccggcggg

SEQ ID NO: 1352027 - RNA, 14 nt, Mycobacterium tuberculosis H37Rv
ccgacaggccggcc

SEQ ID NO: 1352028 - RNA, 22 nt, Mycobacterium tuberculosis H37Rv
ccgacaguuuaccgugccgccc

SEQ ID NO: 1352029 - RNA, 21 nt, Mycobacterium tuberculosis H37Rv
ccgacauggcggugcgcagcu

SEQ ID NO: 1352030 - RNA, 14 nt, Mycobacterium tuberculosis H37Rv
ccgacaguccgcgc

SEQ ID NO: 1352031 - RNA, 12 nt, Mycobacterium tuberculosis H37Rv
ccgacagccccg

SEQ ID NO: 1352032 - RNA, 13 nt, Mycobacterium tuberculosis H37Rv
ccgacagccccgg

SEQ ID NO: 1352033 - RNA, 14 nt, Mycobacterium tuberculosis H37Rv
ccgacagcagccgg

SEQ ID NO: 1352034 - RNA, 15 nt, Mycobacterium tuberculosis H37Rv
ccgacacguugcagc

SEQ ID NO: 1352035 - RNA, 22 nt, Mycobacterium tuberculosis H37Rv
ccgacagggacccgagaucacc

SEQ ID NO: 1352036 - RNA, 15 nt, Mycobacterium tuberculosis H37Rv
ccgaagcggucgcgc

SEQ ID NO: 1352037 - RNA, 15 nt, Mycobacterium tuberculosis H37Rv
ccgaagccgggcccc

SEQ ID NO: 1352038 - RNA, 19 nt, Mycobacterium tuberculosis H37Rv
ccgaagccgaccggguuga

SEQ ID NO: 1352039 - RNA, 22 nt, Mycobacterium tuberculosis H37Rv
ccgaagcgcccguuggccaaga

SEQ ID NO: 1352040 - RNA, 14 nt, Mycobacterium tuberculosis H37Rv
ccgaagcggaucug

SEQ ID NO: 1352041 - RNA, 19 nt, Mycobacterium tuberculosis H37Rv
ccgaauuguuguaacccgu

SEQ ID NO: 1352042 - RNA, 15 nt, Mycobacterium tuberculosis H37Rv
ccgaacugccgcgcc

SEQ ID NO: 1352043 - RNA, 21 nt, Mycobacterium tuberculosis H37Rv
ccgacaacgacgucgccgacc

SEQ ID NO: 1352044 - RNA, 18 nt, Mycobacterium tuberculosis H37Rv
ccgacaagaauggccgcc

SEQ ID NO: 1352045 - RNA, 14 nt, Mycobacterium tuberculosis H37Rv
ccgacacccucggg

SEQ ID NO: 1352046 - RNA, 14 nt, Mycobacterium tuberculosis H37Rv
ccgacaccggcggc

SEQ ID NO: 1352047 - RNA, 15 nt, Mycobacterium tuberculosis H37Rv
ccgacaccggcggca

SEQ ID NO: 1352048 - RNA, 17 nt, Mycobacterium tuberculosis H37Rv
ccgacaccggcggcauc

SEQ ID NO: 1352049 - RNA, 23 nt, Mycobacterium tuberculosis H37Rv
ccgacaccggcugaccgacccgg

SEQ ID NO: 1352050 - RNA, 13 nt, Mycobacterium tuberculosis H37Rv
ccgacacggcucg

SEQ ID NO: 1352051 - RNA, 21 nt, Mycobacterium tuberculosis H37Rv
ccgacacggugcugccguugg

SEQ ID NO: 1352052 - RNA, 15 nt, Mycobacterium tuberculosis H37Rv
ccgacacgccguugg

SEQ ID NO: 1352053 - RNA, 18 nt, Mycobacterium tuberculosis H37Rv
ccgacacccccggugccg

SEQ ID NO: 1352054 - RNA, 15 nt, Mycobacterium tuberculosis H37Rv
ccgacgggccgucgc

SEQ ID NO: 1352055 - RNA, 20 nt, Mycobacterium tuberculosis H37Rv
ccgacgggccgucgccgucc

SEQ ID NO: 1352056 - RNA, 16 nt, Mycobacterium tuberculosis H37Rv
ccgacggcgcccagcg

SEQ ID NO: 1352057 - RNA, 18 nt, Mycobacterium tuberculosis H37Rv
ccgacggacuucccgcgc

SEQ ID NO: 1352058 - RNA, 18 nt, Mycobacterium tuberculosis H37Rv
ccgacggaaugucagccg

SEQ ID NO: 1352059 - RNA, 19 nt, Mycobacterium tuberculosis H37Rv
ccgaccucguucgucacca

SEQ ID NO: 1352060 - RNA, 18 nt, Mycobacterium tuberculosis H37Rv
ccgaccgucgucgugcag

SEQ ID NO: 1352061 - RNA, 15 nt, Mycobacterium tuberculosis H37Rv
ccgacgcgucggcga

SEQ ID NO: 1352062 - RNA, 17 nt, Mycobacterium tuberculosis H37Rv
ccgacgcgggccgcgaa

SEQ ID NO: 1352063 - RNA, 11 nt, Mycobacterium tuberculosis H37Rv
ccgaccuggac

SEQ ID NO: 1352064 - RNA, 16 nt, Mycobacterium tuberculosis H37Rv
ccgaccgaaagccgca

SEQ ID NO: 1352065 - RNA, 14 nt, Mycobacterium tuberculosis H37Rv
ccgaccgcgcccgc

SEQ ID NO: 1352066 - RNA, 20 nt, Mycobacterium tuberculosis H37Rv
ccgaccgguacccguagcac

SEQ ID NO: 1352067 - RNA, 22 nt, Mycobacterium tuberculosis H37Rv
ccgaccgguacccguagcacca

SEQ ID NO: 1352068 - RNA, 17 nt, Mycobacterium tuberculosis H37Rv
ccgaccggucuggcgau

SEQ ID NO: 1352069 - RNA, 16 nt, Mycobacterium tuberculosis H37Rv
ccgaccggagccgccg

SEQ ID NO: 1352070 - RNA, 15 nt, Mycobacterium tuberculosis H37Rv
ccgaccggcacccgc

SEQ ID NO: 1352071 - RNA, 14 nt, Mycobacterium tuberculosis H37Rv
ccgaccccgacggc

SEQ ID NO: 1352072 - RNA, 14 nt, Mycobacterium tuberculosis H37Rv
ccgacccgccgcgc

SEQ ID NO: 1352073 - RNA, 12 nt, Mycobacterium tuberculosis H37Rv
ccgaccccgcgc

SEQ ID NO: 1352074 - RNA, 19 nt, Mycobacterium tuberculosis H37Rv
ccgaccccgccgagcgcgc

SEQ ID NO: 1352075 - RNA, 17 nt, Mycobacterium tuberculosis H37Rv
ccgacccguaccagccc

SEQ ID NO: 1352076 - RNA, 15 nt, Mycobacterium tuberculosis H37Rv
ccgacccgcgcgccg

SEQ ID NO: 1352077 - RNA, 17 nt, Mycobacterium tuberculosis H37Rv
ccgacccgccgcgcccg

SEQ ID NO: 1352078 - RNA, 14 nt, Mycobacterium tuberculosis H37Rv
ccgacccgggcgag

SEQ ID NO: 1352079 - RNA, 18 nt, Mycobacterium tuberculosis H37Rv
ccgacccgcugccaccca

SEQ ID NO: 1352080 - RNA, 20 nt, Mycobacterium tuberculosis H37Rv
ccgacccgcuucgcccggcu

SEQ ID NO: 1352081 - RNA, 14 nt, Mycobacterium tuberculosis H37Rv
ccgagcacucggcc

SEQ ID NO: 1352082 - RNA, 16 nt, Mycobacterium tuberculosis H37Rv
ccgagcacuccggagc

SEQ ID NO: 1352083 - RNA, 16 nt, Mycobacterium tuberculosis H37Rv
ccgagcacgggcagau

SEQ ID NO: 1352084 - RNA, 22 nt, Mycobacterium tuberculosis H37Rv
ccgagcacggguagcguccagg

SEQ ID NO: 1352085 - RNA, 15 nt, Mycobacterium tuberculosis H37Rv
ccgagcccagcgccu

SEQ ID NO: 1352086 - RNA, 14 nt, Mycobacterium tuberculosis H37Rv
ccgagcccagccgg

SEQ ID NO: 1352087 - RNA, 18 nt, Mycobacterium tuberculosis H37Rv
ccgagcccgaugguggug

SEQ ID NO: 1352088 - RNA, 14 nt, Mycobacterium tuberculosis H37Rv
ccgagcccgccagc

SEQ ID NO: 1352089 - RNA, 16 nt, Mycobacterium tuberculosis H37Rv
ccgagcccgccagcgc

SEQ ID NO: 1352090 - RNA, 15 nt, Mycobacterium tuberculosis H37Rv
ccgagcccgcugcgc

SEQ ID NO: 1352091 - RNA, 15 nt, Mycobacterium tuberculosis H37Rv
ccgagcggaccaccg

SEQ ID NO: 1352092 - RNA, 16 nt, Mycobacterium tuberculosis H37Rv
ccgagcggagccgccg

SEQ ID NO: 1352093 - RNA, 17 nt, Mycobacterium tuberculosis H37Rv
ccgagcggagccgccga

SEQ ID NO: 1352094 - RNA, 19 nt, Mycobacterium tuberculosis H37Rv
ccgagcgcuugaccccgcc

SEQ ID NO: 1352095 - RNA, 20 nt, Mycobacterium tuberculosis H37Rv
ccgagcgcuugaccccgccg

SEQ ID NO: 1352096 - RNA, 23 nt, Mycobacterium tuberculosis H37Rv
ccgacgggcgaaauuccgggccu

SEQ ID NO: 1352097 - RNA, 21 nt, Mycobacterium tuberculosis H37Rv
ccgacgggauagacgaccccg

SEQ ID NO: 1352098 - RNA, 19 nt, Mycobacterium tuberculosis H37Rv
ccgacucggcaccgcggcc

SEQ ID NO: 1352099 - RNA, 21 nt, Mycobacterium tuberculosis H37Rv
ccgacucgucggccugguacu

SEQ ID NO: 1352100 - RNA, 23 nt, Mycobacterium tuberculosis H37Rv
ccgacuccggcaggcccgacggc

SEQ ID NO: 1352101 - RNA, 15 nt, Mycobacterium tuberculosis H37Rv
ccgacugcacuugaa

SEQ ID NO: 1352102 - RNA, 13 nt, Mycobacterium tuberculosis H37Rv
ccgacugccgcgg

SEQ ID NO: 1352103 - RNA, 19 nt, Mycobacterium tuberculosis H37Rv
ccgacugggcgcgacccca

SEQ ID NO: 1352104 - RNA, 21 nt, Mycobacterium tuberculosis H37Rv
ccgacugggcgcgaccccagg

SEQ ID NO: 1352105 - RNA, 15 nt, Mycobacterium tuberculosis H37Rv
ccgacugcgggccag

SEQ ID NO: 1352106 - RNA, 16 nt, Mycobacterium tuberculosis H37Rv
ccgacugcgggccagc

SEQ ID NO: 1352107 - RNA, 21 nt, Mycobacterium tuberculosis H37Rv
ccgacuggccccgccagcggc

SEQ ID NO: 1352108 - RNA, 18 nt, Mycobacterium tuberculosis H37Rv
ccgacugccgcgggcagc

SEQ ID NO: 1352109 - RNA, 15 nt, Mycobacterium tuberculosis H37Rv
ccgacuucaagacag

SEQ ID NO: 1352110 - RNA, 15 nt, Mycobacterium tuberculosis H37Rv
ccgacuucuccaggc

SEQ ID NO: 1352111 - RNA, 18 nt, Mycobacterium tuberculosis H37Rv
ccgagcacgccgagcccg

SEQ ID NO: 1352112 - RNA, 17 nt, Mycobacterium tuberculosis H37Rv
ccgacuguagaaaaccc

SEQ ID NO: 1352113 - RNA, 15 nt, Mycobacterium tuberculosis H37Rv
ccgagcguccggugg

SEQ ID NO: 1352114 - RNA, 13 nt, Mycobacterium tuberculosis H37Rv
ccgagcgugaagu

SEQ ID NO: 1352115 - RNA, 20 nt, Mycobacterium tuberculosis H37Rv
ccgagcgguugccuucuugg

SEQ ID NO: 1352116 - RNA, 22 nt, Mycobacterium tuberculosis H37Rv
ccgagcucaccaaggucggcga

SEQ ID NO: 1352117 - RNA, 23 nt, Mycobacterium tuberculosis H37Rv
ccgagcggucaacgaguugcgga

SEQ ID NO: 1352118 - RNA, 13 nt, Mycobacterium tuberculosis H37Rv
ccgagcggcggca

SEQ ID NO: 1352119 - RNA, 13 nt, Mycobacterium tuberculosis H37Rv
ccgaggcacccgu

SEQ ID NO: 1352120 - RNA, 19 nt, Mycobacterium tuberculosis H37Rv
ccgaggcacccgugccgcc

SEQ ID NO: 1352121 - RNA, 21 nt, Mycobacterium tuberculosis H37Rv
ccgaggacgccggcgccgcca

SEQ ID NO: 1352122 - RNA, 15 nt, Mycobacterium tuberculosis H37Rv
ccgaggacgccggcg

SEQ ID NO: 1352123 - RNA, 16 nt, Mycobacterium tuberculosis H37Rv
ccgaggacgccggcgc

SEQ ID NO: 1352124 - RNA, 20 nt, Mycobacterium tuberculosis H37Rv
ccgaggaucucgcgguccag

SEQ ID NO: 1352125 - RNA, 14 nt, Mycobacterium tuberculosis H37Rv
ccgaggagggccgc

SEQ ID NO: 1352126 - RNA, 18 nt, Mycobacterium tuberculosis H37Rv
ccgaggugccggggcccc

SEQ ID NO: 1352127 - RNA, 23 nt, Mycobacterium tuberculosis H37Rv
ccgaguagaagauggcaccgccc

SEQ ID NO: 1352128 - RNA, 22 nt, Mycobacterium tuberculosis H37Rv
ccgaggccuaccaggcgcggcc

SEQ ID NO: 1352129 - RNA, 16 nt, Mycobacterium tuberculosis H37Rv
ccgaggccugacugaa

SEQ ID NO: 1352130 - RNA, 15 nt, Mycobacterium tuberculosis H37Rv
ccgaggcgagacgcu

SEQ ID NO: 1352131 - RNA, 18 nt, Mycobacterium tuberculosis H37Rv
ccgaggccaugcucgcca

SEQ ID NO: 1352132 - RNA, 20 nt, Mycobacterium tuberculosis H37Rv
ccgaggucgguucggccgga

SEQ ID NO: 1352133 - RNA, 12 nt, Mycobacterium tuberculosis H37Rv
ccgaggucggcc

SEQ ID NO: 1352134 - RNA, 14 nt, Mycobacterium tuberculosis H37Rv
ccgaggcgcccaac

SEQ ID NO: 1352135 - RNA, 21 nt, Mycobacterium tuberculosis H37Rv
ccgaugcgugccgacccgcuu

SEQ ID NO: 1352136 - RNA, 22 nt, Mycobacterium tuberculosis H37Rv
ccgaugcguucgggcuccagca

SEQ ID NO: 1352137 - RNA, 14 nt, Mycobacterium tuberculosis H37Rv
ccgaugcugcgggc

SEQ ID NO: 1352138 - RNA, 21 nt, Mycobacterium tuberculosis H37Rv
ccgaugcgccggaccagcucc

SEQ ID NO: 1352139 - RNA, 15 nt, Mycobacterium tuberculosis H37Rv
ccgaucgacacccgc

SEQ ID NO: 1352140 - RNA, 18 nt, Mycobacterium tuberculosis H37Rv
ccgaucgaacagugccug

SEQ ID NO: 1352141 - RNA, 22 nt, Mycobacterium tuberculosis H37Rv
ccgaucgaucagcaacucggcc

SEQ ID NO: 1352142 - RNA, 14 nt, Mycobacterium tuberculosis H37Rv
ccgaucgacugcag

SEQ ID NO: 1352143 - RNA, 13 nt, Mycobacterium tuberculosis H37Rv
ccgaucccgucgg

SEQ ID NO: 1352144 - RNA, 16 nt, Mycobacterium tuberculosis H37Rv
ccgauccgcacagcaa

SEQ ID NO: 1352145 - RNA, 12 nt, Mycobacterium tuberculosis H37Rv
ccgaucccgccc

SEQ ID NO: 1352146 - RNA, 16 nt, Mycobacterium tuberculosis H37Rv
ccgaucccggcgagca

SEQ ID NO: 1352147 - RNA, 13 nt, Mycobacterium tuberculosis H37Rv
ccgauccagcagg

SEQ ID NO: 1352148 - RNA, 23 nt, Mycobacterium tuberculosis H37Rv
ccgauccagugguaggccgccgg

SEQ ID NO: 1352149 - RNA, 15 nt, Mycobacterium tuberculosis H37Rv
ccgauccaggaguga

SEQ ID NO: 1352150 - RNA, 14 nt, Mycobacterium tuberculosis H37Rv
ccgauauaccaggg

SEQ ID NO: 1352151 - RNA, 19 nt, Mycobacterium tuberculosis H37Rv
ccgauaccggcggcgagcg

SEQ ID NO: 1352152 - RNA, 16 nt, Mycobacterium tuberculosis H37Rv
ccgauaccgugcaccu

SEQ ID NO: 1352153 - RNA, 21 nt, Mycobacterium tuberculosis H37Rv
ccgauagcgaccgcggccccg

SEQ ID NO: 1352154 - RNA, 15 nt, Mycobacterium tuberculosis H37Rv
ccgauacccagcggg

SEQ ID NO: 1352155 - RNA, 19 nt, Mycobacterium tuberculosis H37Rv
ccgauagacgugucauccc

SEQ ID NO: 1352156 - RNA, 16 nt, Mycobacterium tuberculosis H37Rv
ccgagucgacggccag

SEQ ID NO: 1352157 - RNA, 16 nt, Mycobacterium tuberculosis H37Rv
ccgaguccggcgagcu

SEQ ID NO: 1352158 - RNA, 20 nt, Mycobacterium tuberculosis H37Rv
ccgcggcgaucuuggaucgg

SEQ ID NO: 1352159 - RNA, 20 nt, Mycobacterium tuberculosis H37Rv
ccgcggucggaccacccggc

SEQ ID NO: 1352160 - RNA, 14 nt, Mycobacterium tuberculosis H37Rv
ccgcggucggacca

SEQ ID NO: 1352161 - RNA, 14 nt, Mycobacterium tuberculosis H37Rv
ccgcggcgccaccc

SEQ ID NO: 1352162 - RNA, 15 nt, Mycobacterium tuberculosis H37Rv
ccgcggcgccacccg

SEQ ID NO: 1352163 - RNA, 18 nt, Mycobacterium tuberculosis H37Rv
ccgcggcgccacccgcgc

SEQ ID NO: 1352164 - RNA, 18 nt, Mycobacterium tuberculosis H37Rv
ccgcgguggggucgacgc

SEQ ID NO: 1352165 - RNA, 17 nt, Mycobacterium tuberculosis H37Rv
ccgcgguggcggcgagc

SEQ ID NO: 1352166 - RNA, 19 nt, Mycobacterium tuberculosis H37Rv
ccgcggugacucggccucc

SEQ ID NO: 1352167 - RNA, 22 nt, Mycobacterium tuberculosis H37Rv
ccgcggucugcgccuucgccag

SEQ ID NO: 1352168 - RNA, 13 nt, Mycobacterium tuberculosis H37Rv
ccgcggucggcgu

SEQ ID NO: 1352169 - RNA, 13 nt, Mycobacterium tuberculosis H37Rv
ccgcggucggcga

SEQ ID NO: 1352170 - RNA, 20 nt, Mycobacterium tuberculosis H37Rv
ccgcggucggccaccaacuc

SEQ ID NO: 1352171 - RNA, 12 nt, Mycobacterium tuberculosis H37Rv
ccgcggucggcc

SEQ ID NO: 1352172 - RNA, 21 nt, Mycobacterium tuberculosis H37Rv
ccgcggaucaccaucgccgcc

SEQ ID NO: 1352173 - RNA, 20 nt, Mycobacterium tuberculosis H37Rv
ccgcggaucaccaucgccgc

SEQ ID NO: 1352174 - RNA, 21 nt, Mycobacterium tuberculosis H37Rv
ccgcggaucgaccgccagcgc

SEQ ID NO: 1352175 - RNA, 15 nt, Mycobacterium tuberculosis H37Rv
ccgcggcaccgcccc

SEQ ID NO: 1352176 - RNA, 16 nt, Mycobacterium tuberculosis H37Rv
ccgcggcaccgccccg

SEQ ID NO: 1352177 - RNA, 16 nt, Mycobacterium tuberculosis H37Rv
ccgcggcaugauuuuu

SEQ ID NO: 1352178 - RNA, 17 nt, Mycobacterium tuberculosis H37Rv
ccgcggcaugcaaugcu

SEQ ID NO: 1352179 - RNA, 18 nt, Mycobacterium tuberculosis H37Rv
ccgcggccacaucgccag

SEQ ID NO: 1352180 - RNA, 16 nt, Mycobacterium tuberculosis H37Rv
ccgcggccaccgccgc

SEQ ID NO: 1352181 - RNA, 14 nt, Mycobacterium tuberculosis H37Rv
ccgcggccagcggg

SEQ ID NO: 1352182 - RNA, 15 nt, Mycobacterium tuberculosis H37Rv
ccgcggccgggccgc

SEQ ID NO: 1352183 - RNA, 20 nt, Mycobacterium tuberculosis H37Rv
ccgcggccggguggcccggc

SEQ ID NO: 1352184 - RNA, 23 nt, Mycobacterium tuberculosis H37Rv
ccgcggccuuggcggccgcgacc

SEQ ID NO: 1352185 - RNA, 23 nt, Mycobacterium tuberculosis H37Rv
ccgcggcccgcucgaucggcagc

SEQ ID NO: 1352186 - RNA, 13 nt, Mycobacterium tuberculosis H37Rv
ccgcggccggcgc

SEQ ID NO: 1352187 - RNA, 12 nt, Mycobacterium tuberculosis H37Rv
ccgcggcagggc

SEQ ID NO: 1352188 - RNA, 20 nt, Mycobacterium tuberculosis H37Rv
ccgcuaccccagccggcagc

SEQ ID NO: 1352189 - RNA, 21 nt, Mycobacterium tuberculosis H37Rv
ccgcuacccggacagggcggc

SEQ ID NO: 1352190 - RNA, 14 nt, Mycobacterium tuberculosis H37Rv
ccgcuacgcgcgcu

SEQ ID NO: 1352191 - RNA, 18 nt, Mycobacterium tuberculosis H37Rv
ccgcuaccgcccgcgcca

SEQ ID NO: 1352192 - RNA, 20 nt, Mycobacterium tuberculosis H37Rv
ccgcuaggugacgccgccag

SEQ ID NO: 1352193 - RNA, 22 nt, Mycobacterium tuberculosis H37Rv
ccgcucagggugcgccgcagca

SEQ ID NO: 1352194 - RNA, 20 nt, Mycobacterium tuberculosis H37Rv
ccgcucagggugcgccgcag

SEQ ID NO: 1352195 - RNA, 14 nt, Mycobacterium tuberculosis H37Rv
ccgcucauccagcg

SEQ ID NO: 1352196 - RNA, 14 nt, Mycobacterium tuberculosis H37Rv
ccgcgugcgucagc

SEQ ID NO: 1352197 - RNA, 13 nt, Mycobacterium tuberculosis H37Rv
ccgcgugccgccc

SEQ ID NO: 1352198 - RNA, 13 nt, Mycobacterium tuberculosis H37Rv
ccgcguggcuggc

SEQ ID NO: 1352199 - RNA, 20 nt, Mycobacterium tuberculosis H37Rv
ccgcgugcucgagcaccucg

SEQ ID NO: 1352200 - RNA, 19 nt, Mycobacterium tuberculosis H37Rv
ccgcuaccaacgcaacacg

SEQ ID NO: 1352201 - RNA, 18 nt, Mycobacterium tuberculosis H37Rv
ccgcguuaugccaggcgc

SEQ ID NO: 1352202 - RNA, 12 nt, Mycobacterium tuberculosis H37Rv
ccgcgucgccgg

SEQ ID NO: 1352203 - RNA, 14 nt, Mycobacterium tuberculosis H37Rv
ccgcgucgucggcc

SEQ ID NO: 1352204 - RNA, 12 nt, Mycobacterium tuberculosis H37Rv
ccgcgucggcgu

SEQ ID NO: 1352205 - RNA, 16 nt, Mycobacterium tuberculosis H37Rv
ccgcgucggccgcgcu

SEQ ID NO: 1352206 - RNA, 22 nt, Mycobacterium tuberculosis H37Rv
ccgcgucuuggugcgcgucagc

SEQ ID NO: 1352207 - RNA, 13 nt, Mycobacterium tuberculosis H37Rv
ccgcgucugcucg

SEQ ID NO: 1352208 - RNA, 17 nt, Mycobacterium tuberculosis H37Rv
ccgcugauagcggucgg

SEQ ID NO: 1352209 - RNA, 23 nt, Mycobacterium tuberculosis H37Rv
ccgcugaugagccgcagaugcac

SEQ ID NO: 1352210 - RNA, 18 nt, Mycobacterium tuberculosis H37Rv
ccgcugaucugccgccgc

SEQ ID NO: 1352211 - RNA, 19 nt, Mycobacterium tuberculosis H37Rv
ccgcugaucagauccucga

SEQ ID NO: 1352212 - RNA, 17 nt, Mycobacterium tuberculosis H37Rv
ccgcugaugcuggccag

SEQ ID NO: 1352213 - RNA, 15 nt, Mycobacterium tuberculosis H37Rv
ccgcucggccgucag

SEQ ID NO: 1352214 - RNA, 14 nt, Mycobacterium tuberculosis H37Rv
ccgcucggccgcag

SEQ ID NO: 1352215 - RNA, 17 nt, Mycobacterium tuberculosis H37Rv
ccgcugaccccggcagc

SEQ ID NO: 1352216 - RNA, 16 nt, Mycobacterium tuberculosis H37Rv
ccgcucggaguugagc

SEQ ID NO: 1352217 - RNA, 14 nt, Mycobacterium tuberculosis H37Rv
ccgcugagcccugc

SEQ ID NO: 1352218 - RNA, 18 nt, Mycobacterium tuberculosis H37Rv
ccgcugagccagcuccac

SEQ ID NO: 1352219 - RNA, 13 nt, Mycobacterium tuberculosis H37Rv
ccgcugagcccug

SEQ ID NO: 1352220 - RNA, 16 nt, Mycobacterium tuberculosis H37Rv
ccgcugagccagcucc

SEQ ID NO: 1352221 - RNA, 17 nt, Mycobacterium tuberculosis H37Rv
ccgcugacuccugcggc

SEQ ID NO: 1352222 - RNA, 14 nt, Mycobacterium tuberculosis H37Rv
ccgcugacuccugc

SEQ ID NO: 1352223 - RNA, 14 nt, Mycobacterium tuberculosis H37Rv
ccgcucgcacagcc

SEQ ID NO: 1352224 - RNA, 17 nt, Mycobacterium tuberculosis H37Rv
ccgcucgaucggcagcc

SEQ ID NO: 1352225 - RNA, 17 nt, Mycobacterium tuberculosis H37Rv
ccgcucgacggcccgcc

SEQ ID NO: 1352226 - RNA, 20 nt, Mycobacterium tuberculosis H37Rv
ccgcucgccgguaggcggcc

SEQ ID NO: 1352227 - RNA, 13 nt, Mycobacterium tuberculosis H37Rv
ccgcuccgccguc

SEQ ID NO: 1352228 - RNA, 21 nt, Mycobacterium tuberculosis H37Rv
ccgcucccucuacacccggac

SEQ ID NO: 1352229 - RNA, 14 nt, Mycobacterium tuberculosis H37Rv
ccgcuccgccgucg

SEQ ID NO: 1352230 - RNA, 19 nt, Mycobacterium tuberculosis H37Rv
ccgcugucaccccugggcg

SEQ ID NO: 1352231 - RNA, 14 nt, Mycobacterium tuberculosis H37Rv
ccgcuucgcccggc

SEQ ID NO: 1352232 - RNA, 14 nt, Mycobacterium tuberculosis H37Rv
ccgcugggugacca

SEQ ID NO: 1352233 - RNA, 19 nt, Mycobacterium tuberculosis H37Rv
ccgcuggucguggcggugc

SEQ ID NO: 1352234 - RNA, 18 nt, Mycobacterium tuberculosis H37Rv
ccgcugcguaguguucug

SEQ ID NO: 1352235 - RNA, 19 nt, Mycobacterium tuberculosis H37Rv
ccgcugcggugccggcccu

SEQ ID NO: 1352236 - RNA, 23 nt, Mycobacterium tuberculosis H37Rv
ccgcugcuagugcgggccgugac

SEQ ID NO: 1352237 - RNA, 17 nt, Mycobacterium tuberculosis H37Rv
ccgcugcggugccggcc

SEQ ID NO: 1352238 - RNA, 19 nt, Mycobacterium tuberculosis H37Rv
ccgcugcugcugcccccca

SEQ ID NO: 1352239 - RNA, 21 nt, Mycobacterium tuberculosis H37Rv
ccgcugcgccgucgcagccag

SEQ ID NO: 1352240 - RNA, 16 nt, Mycobacterium tuberculosis H37Rv
ccgcugcggcaccacc

SEQ ID NO: 1352241 - RNA, 20 nt, Mycobacterium tuberculosis H37Rv
ccgcugcggcaccacccggc

SEQ ID NO: 1352242 - RNA, 19 nt, Mycobacterium tuberculosis H37Rv
ccgcugcggguagccgucg

SEQ ID NO: 1352243 - RNA, 15 nt, Mycobacterium tuberculosis H37Rv
ccgcgacauccgcgg

SEQ ID NO: 1352244 - RNA, 20 nt, Mycobacterium tuberculosis H37Rv
ccgcgacauccgcggcaugc

SEQ ID NO: 1352245 - RNA, 16 nt, Mycobacterium tuberculosis H37Rv
ccgcgaauucccagga

SEQ ID NO: 1352246 - RNA, 23 nt, Mycobacterium tuberculosis H37Rv
ccgcgaauucggcauaacccugg

SEQ ID NO: 1352247 - RNA, 21 nt, Mycobacterium tuberculosis H37Rv
ccgcgaccccugguagcaccc

SEQ ID NO: 1352248 - RNA, 12 nt, Mycobacterium tuberculosis H37Rv
ccgcgacccggc

SEQ ID NO: 1352249 - RNA, 19 nt, Mycobacterium tuberculosis H37Rv
ccgcgaaguugcgggugau

SEQ ID NO: 1352250 - RNA, 20 nt, Mycobacterium tuberculosis H37Rv
ccgcgaaggggugcccggcg

SEQ ID NO: 1352251 - RNA, 23 nt, Mycobacterium tuberculosis H37Rv
ccgcgaagcugcgggucucgcug

SEQ ID NO: 1352252 - RNA, 20 nt, Mycobacterium tuberculosis H37Rv
ccgcgaccgcgcacggcugg

SEQ ID NO: 1352253 - RNA, 19 nt, Mycobacterium tuberculosis H37Rv
ccgcgaccgcgaccgcauu

SEQ ID NO: 1352254 - RNA, 12 nt, Mycobacterium tuberculosis H37Rv
ccgcgaccucgc

SEQ ID NO: 1352255 - RNA, 18 nt, Mycobacterium tuberculosis H37Rv
ccgcgaccucgcggcgcu

SEQ ID NO: 1352256 - RNA, 14 nt, Mycobacterium tuberculosis H37Rv
ccgcgaccgccucg

SEQ ID NO: 1352257 - RNA, 16 nt, Mycobacterium tuberculosis H37Rv
ccgcgaccagcgccgc

SEQ ID NO: 1352258 - RNA, 21 nt, Mycobacterium tuberculosis H37Rv
ccgcgaccagcgccgcacccg

SEQ ID NO: 1352259 - RNA, 13 nt, Mycobacterium tuberculosis H37Rv
ccgcgacgacacg

SEQ ID NO: 1352260 - RNA, 21 nt, Mycobacterium tuberculosis H37Rv
ccgcgauggugcgccgggcgu

SEQ ID NO: 1352261 - RNA, 20 nt, Mycobacterium tuberculosis H37Rv
ccgcgauggccgcgugcagc

SEQ ID NO: 1352262 - RNA, 17 nt, Mycobacterium tuberculosis H37Rv
ccgccuuugcccgccgc

SEQ ID NO: 1352263 - RNA, 17 nt, Mycobacterium tuberculosis H37Rv
ccgccuuugccgccggc

SEQ ID NO: 1352264 - RNA, 14 nt, Mycobacterium tuberculosis H37Rv
ccgccuuugccccc

SEQ ID NO: 1352265 - RNA, 15 nt, Mycobacterium tuberculosis H37Rv
ccgccuuugcccccg

SEQ ID NO: 1352266 - RNA, 19 nt, Mycobacterium tuberculosis H37Rv
ccgccugugccgccggcgc

SEQ ID NO: 1352267 - RNA, 14 nt, Mycobacterium tuberculosis H37Rv
ccgccuggagcugu

SEQ ID NO: 1352268 - RNA, 21 nt, Mycobacterium tuberculosis H37Rv
ccgccuggagcuguggcgggc

SEQ ID NO: 1352269 - RNA, 14 nt, Mycobacterium tuberculosis H37Rv
ccgccugcgccgcc

SEQ ID NO: 1352270 - RNA, 23 nt, Mycobacterium tuberculosis H37Rv
ccgccgccccacaacaugcugga

SEQ ID NO: 1352271 - RNA, 22 nt, Mycobacterium tuberculosis H37Rv
ccgccgcccugguccaggcccu

SEQ ID NO: 1352272 - RNA, 21 nt, Mycobacterium tuberculosis H37Rv
ccgccgccgaagcgaugccgu

SEQ ID NO: 1352273 - RNA, 22 nt, Mycobacterium tuberculosis H37Rv
ccgccgauguagacgguggcgc

SEQ ID NO: 1352274 - RNA, 13 nt, Mycobacterium tuberculosis H37Rv
ccgccgcccccgc

SEQ ID NO: 1352275 - RNA, 14 nt, Mycobacterium tuberculosis H37Rv
ccgccgcccccgcc

SEQ ID NO: 1352276 - RNA, 13 nt, Mycobacterium tuberculosis H37Rv
ccgccgcccagcg

SEQ ID NO: 1352277 - RNA, 17 nt, Mycobacterium tuberculosis H37Rv
ccgccgccugcccggcc

SEQ ID NO: 1352278 - RNA, 15 nt, Mycobacterium tuberculosis H37Rv
ccgccgccgacgaag

SEQ ID NO: 1352279 - RNA, 13 nt, Mycobacterium tuberculosis H37Rv
ccgccgccgccgc

SEQ ID NO: 1352280 - RNA, 16 nt, Mycobacterium tuberculosis H37Rv
ccgccgccgccgcgua

SEQ ID NO: 1352281 - RNA, 18 nt, Mycobacterium tuberculosis H37Rv
ccgcgcuucacagccacc

SEQ ID NO: 1352282 - RNA, 22 nt, Mycobacterium tuberculosis H37Rv
ccgcgcuggucggagaccagcg

SEQ ID NO: 1352283 - RNA, 19 nt, Mycobacterium tuberculosis H37Rv
ccgcgcuugguccugcggu

SEQ ID NO: 1352284 - RNA, 14 nt, Mycobacterium tuberculosis H37Rv
ccgcgcugagcacg

SEQ ID NO: 1352285 - RNA, 23 nt, Mycobacterium tuberculosis H37Rv
ccgcggacucgggcaggccccac

SEQ ID NO: 1352286 - RNA, 19 nt, Mycobacterium tuberculosis H37Rv
ccgcggacuugcgagccgu

SEQ ID NO: 1352287 - RNA, 20 nt, Mycobacterium tuberculosis H37Rv
ccgcggaccggcgucggcug

SEQ ID NO: 1352288 - RNA, 22 nt, Mycobacterium tuberculosis H37Rv
ccgcggacgugccggucccccc

SEQ ID NO: 1352289 - RNA, 18 nt, Mycobacterium tuberculosis H37Rv
ccgcggaggcggccagcc

SEQ ID NO: 1352290 - RNA, 17 nt, Mycobacterium tuberculosis H37Rv
ccgcggaggcggccagc

SEQ ID NO: 1352291 - RNA, 23 nt, Mycobacterium tuberculosis H37Rv
ccgcggaggcggccagccuaccg

SEQ ID NO: 1352292 - RNA, 17 nt, Mycobacterium tuberculosis H37Rv
ccgcggauaggccgcgc

SEQ ID NO: 1352293 - RNA, 20 nt, Mycobacterium tuberculosis H37Rv
ccgcgcguucggcgagcagc

SEQ ID NO: 1352294 - RNA, 15 nt, Mycobacterium tuberculosis H37Rv
ccgcgcguucggcgc

SEQ ID NO: 1352295 - RNA, 20 nt, Mycobacterium tuberculosis H37Rv
ccgcgcguaauccgagcgcg

SEQ ID NO: 1352296 - RNA, 13 nt, Mycobacterium tuberculosis H37Rv
ccgcgcucccggc

SEQ ID NO: 1352297 - RNA, 23 nt, Mycobacterium tuberculosis H37Rv
ccgcgcucgcacccgcucggcgc

SEQ ID NO: 1352298 - RNA, 23 nt, Mycobacterium tuberculosis H37Rv
ccgcgcucaucugcgcgcggaag

SEQ ID NO: 1352299 - RNA, 20 nt, Mycobacterium tuberculosis H37Rv
ccgcgcucaccggggccguc

SEQ ID NO: 1352300 - RNA, 21 nt, Mycobacterium tuberculosis H37Rv
ccgcgcucaccggggccgucg

SEQ ID NO: 1352301 - RNA, 18 nt, Mycobacterium tuberculosis H37Rv
ccgcgcguccgucggcga

SEQ ID NO: 1352302 - RNA, 23 nt, Mycobacterium tuberculosis H37Rv
ccgcgcggcggugucacgaccca

SEQ ID NO: 1352303 - RNA, 16 nt, Mycobacterium tuberculosis H37Rv
ccgcgcgggccgccgc

SEQ ID NO: 1352304 - RNA, 14 nt, Mycobacterium tuberculosis H37Rv
ccgcgcggcgcagc

SEQ ID NO: 1352305 - RNA, 17 nt, Mycobacterium tuberculosis H37Rv
ccgcgcggcgagagccu

SEQ ID NO: 1352306 - RNA, 15 nt, Mycobacterium tuberculosis H37Rv
ccgcgcgcggacagc

SEQ ID NO: 1352307 - RNA, 16 nt, Mycobacterium tuberculosis H37Rv
ccgcgcgcggacagca

SEQ ID NO: 1352308 - RNA, 17 nt, Mycobacterium tuberculosis H37Rv
ccgcgcgcucgagcagg

SEQ ID NO: 1352309 - RNA, 15 nt, Mycobacterium tuberculosis H37Rv
ccgcgcgccggcggu

SEQ ID NO: 1352310 - RNA, 17 nt, Mycobacterium tuberculosis H37Rv
ccgcgccagccuccacc

SEQ ID NO: 1352311 - RNA, 20 nt, Mycobacterium tuberculosis H37Rv
ccgcgccagccuccaccagg

SEQ ID NO: 1352312 - RNA, 15 nt, Mycobacterium tuberculosis H37Rv
ccggcgaaccccagc

SEQ ID NO: 1352313 - RNA, 19 nt, Mycobacterium tuberculosis H37Rv
ccggcgaagccggccggga

SEQ ID NO: 1352314 - RNA, 15 nt, Mycobacterium tuberculosis H37Rv
ccggcgaagccggcc

SEQ ID NO: 1352315 - RNA, 17 nt, Mycobacterium tuberculosis H37Rv
ccggccuuuacccgggc

SEQ ID NO: 1352316 - RNA, 21 nt, Mycobacterium tuberculosis H37Rv
ccggccuuuacccgggcggcg

SEQ ID NO: 1352317 - RNA, 17 nt, Mycobacterium tuberculosis H37Rv
ccggccuuuccagcacc

SEQ ID NO: 1352318 - RNA, 17 nt, Mycobacterium tuberculosis H37Rv
ccggccuuggcggcggc

SEQ ID NO: 1352319 - RNA, 21 nt, Mycobacterium tuberculosis H37Rv
ccggcgaaaagacugcgccgc

SEQ ID NO: 1352320 - RNA, 22 nt, Mycobacterium tuberculosis H37Rv
ccggcgaaaagacugcgccgcc

SEQ ID NO: 1352321 - RNA, 16 nt, Mycobacterium tuberculosis H37Rv
ccggccuugccgccgg

SEQ ID NO: 1352322 - RNA, 22 nt, Mycobacterium tuberculosis H37Rv
ccggccuucaaggaagccgcgg

SEQ ID NO: 1352323 - RNA, 20 nt, Mycobacterium tuberculosis H37Rv
ccggcgaauacgaccgucgc

SEQ ID NO: 1352324 - RNA, 16 nt, Mycobacterium tuberculosis H37Rv
ccggcgaaggccagca

SEQ ID NO: 1352325 - RNA, 17 nt, Mycobacterium tuberculosis H37Rv
ccggcgacgggucgggc

SEQ ID NO: 1352326 - RNA, 13 nt, Mycobacterium tuberculosis H37Rv
ccggcgacgccgg

SEQ ID NO: 1352327 - RNA, 19 nt, Mycobacterium tuberculosis H37Rv
ccggcgacgcuaccgccgg

SEQ ID NO: 1352328 - RNA, 20 nt, Mycobacterium tuberculosis H37Rv
ccggcgaccggcgagcccgc

SEQ ID NO: 1352329 - RNA, 19 nt, Mycobacterium tuberculosis H37Rv
ccggcgagugcugucgucu

SEQ ID NO: 1352330 - RNA, 19 nt, Mycobacterium tuberculosis H37Rv
ccggcgagggccacggcug

SEQ ID NO: 1352331 - RNA, 22 nt, Mycobacterium tuberculosis H37Rv
ccggcgagugguccagccagau

SEQ ID NO: 1352332 - RNA, 12 nt, Mycobacterium tuberculosis H37Rv
ccggcgagcucg

SEQ ID NO: 1352333 - RNA, 22 nt, Mycobacterium tuberculosis H37Rv
ccggcgagcccgcaucgcacca

SEQ ID NO: 1352334 - RNA, 22 nt, Mycobacterium tuberculosis H37Rv
ccggcgagcacccgcuggucga

SEQ ID NO: 1352335 - RNA, 15 nt, Mycobacterium tuberculosis H37Rv
ccggcgagcacccgc

SEQ ID NO: 1352336 - RNA, 19 nt, Mycobacterium tuberculosis H37Rv
ccggccgacgaacagcggu

SEQ ID NO: 1352337 - RNA, 23 nt, Mycobacterium tuberculosis H37Rv
ccggccgcacgccgaccagcacc

SEQ ID NO: 1352338 - RNA, 21 nt, Mycobacterium tuberculosis H37Rv
ccggccgcacgccggccagcg

SEQ ID NO: 1352339 - RNA, 14 nt, Mycobacterium tuberculosis H37Rv
ccggccgccagcgc

SEQ ID NO: 1352340 - RNA, 15 nt, Mycobacterium tuberculosis H37Rv
ccggccgccaucauc

SEQ ID NO: 1352341 - RNA, 13 nt, Mycobacterium tuberculosis H37Rv
ccggccgccgaaa

SEQ ID NO: 1352342 - RNA, 22 nt, Mycobacterium tuberculosis H37Rv
ccggccgccgcgggacaccacc

SEQ ID NO: 1352343 - RNA, 15 nt, Mycobacterium tuberculosis H37Rv
ccggccggccuagcc

SEQ ID NO: 1352344 - RNA, 20 nt, Mycobacterium tuberculosis H37Rv
ccggccgcguaaaccggcug

SEQ ID NO: 1352345 - RNA, 15 nt, Mycobacterium tuberculosis H37Rv
ccggccgcucacccc

SEQ ID NO: 1352346 - RNA, 16 nt, Mycobacterium tuberculosis H37Rv
ccggccgcgccggccc

SEQ ID NO: 1352347 - RNA, 11 nt, Mycobacterium tuberculosis H37Rv
ccggccgcgcg

SEQ ID NO: 1352348 - RNA, 14 nt, Mycobacterium tuberculosis H37Rv
ccggccgcgggcgu

SEQ ID NO: 1352349 - RNA, 14 nt, Mycobacterium tuberculosis H37Rv
ccggccgucgacgc

SEQ ID NO: 1352350 - RNA, 20 nt, Mycobacterium tuberculosis H37Rv
ccggccgucgacgcaugggu

SEQ ID NO: 1352351 - RNA, 20 nt, Mycobacterium tuberculosis H37Rv
ccggccgucccgcgagcagc

SEQ ID NO: 1352352 - RNA, 16 nt, Mycobacterium tuberculosis H37Rv
ccggccguugggaaac

SEQ ID NO: 1352353 - RNA, 14 nt, Mycobacterium tuberculosis H37Rv
ccggccggugccag

SEQ ID NO: 1352354 - RNA, 17 nt, Mycobacterium tuberculosis H37Rv
ccggccgguggccagca

SEQ ID NO: 1352355 - RNA, 21 nt, Mycobacterium tuberculosis H37Rv
ccggccgguuggccagccaca

SEQ ID NO: 1352356 - RNA, 22 nt, Mycobacterium tuberculosis H37Rv
ccggccgguuggccagccacag

SEQ ID NO: 1352357 - RNA, 18 nt, Mycobacterium tuberculosis H37Rv
ccggccgguuggccagcc

SEQ ID NO: 1352358 - RNA, 22 nt, Mycobacterium tuberculosis H37Rv
ccggccgguucuuggcguugau

SEQ ID NO: 1352359 - RNA, 20 nt, Mycobacterium tuberculosis H37Rv
ccggccucgccgaagcgggc

SEQ ID NO: 1352360 - RNA, 17 nt, Mycobacterium tuberculosis H37Rv
ccggccuagccgauggc

SEQ ID NO: 1352361 - RNA, 20 nt, Mycobacterium tuberculosis H37Rv
ccggcgauuaccggcacgcc

SEQ ID NO: 1352362 - RNA, 19 nt, Mycobacterium tuberculosis H37Rv
ccggcgcaagcgccgcgcu

SEQ ID NO: 1352363 - RNA, 16 nt, Mycobacterium tuberculosis H37Rv
ccggcgcaagcgccgc

SEQ ID NO: 1352364 - RNA, 23 nt, Mycobacterium tuberculosis H37Rv
ccggcgcacgaaaccgcagcgcg

SEQ ID NO: 1352365 - RNA, 19 nt, Mycobacterium tuberculosis H37Rv
ccggcgccaccggcgccgc

SEQ ID NO: 1352366 - RNA, 16 nt, Mycobacterium tuberculosis H37Rv
ccggcgccaccgccgc

SEQ ID NO: 1352367 - RNA, 14 nt, Mycobacterium tuberculosis H37Rv
ccggcgccaccggc

SEQ ID NO: 1352368 - RNA, 14 nt, Mycobacterium tuberculosis H37Rv
ccggcgccacccgc

SEQ ID NO: 1352369 - RNA, 20 nt, Mycobacterium tuberculosis H37Rv
ccggcgccacccgcgccgcc

SEQ ID NO: 1352370 - RNA, 14 nt, Mycobacterium tuberculosis H37Rv
ccggcgccaccgcc

SEQ ID NO: 1352371 - RNA, 22 nt, Mycobacterium tuberculosis H37Rv
ccggcgcagguucucggugccg

SEQ ID NO: 1352372 - RNA, 22 nt, Mycobacterium tuberculosis H37Rv
ccggcgcaguagccgaccagga

SEQ ID NO: 1352373 - RNA, 18 nt, Mycobacterium tuberculosis H37Rv
ccggcgcagugcagguca

SEQ ID NO: 1352374 - RNA, 16 nt, Mycobacterium tuberculosis H37Rv
ccggcgcagguucucg

SEQ ID NO: 1352375 - RNA, 13 nt, Mycobacterium tuberculosis H37Rv
ccggcgccgccgg

SEQ ID NO: 1352376 - RNA, 19 nt, Mycobacterium tuberculosis H37Rv
ccggcgccgccgucgccgc

SEQ ID NO: 1352377 - RNA, 12 nt, Mycobacterium tuberculosis H37Rv
ccggcgccgccc

SEQ ID NO: 1352378 - RNA, 13 nt, Mycobacterium tuberculosis H37Rv
ccggcgccgcccu

SEQ ID NO: 1352379 - RNA, 13 nt, Mycobacterium tuberculosis H37Rv
ccggcgccgccag

SEQ ID NO: 1352380 - RNA, 17 nt, Mycobacterium tuberculosis H37Rv
ccggcgccgcaccaagc

SEQ ID NO: 1352381 - RNA, 15 nt, Mycobacterium tuberculosis H37Rv
ccggcgcccaggccg

SEQ ID NO: 1352382 - RNA, 15 nt, Mycobacterium tuberculosis H37Rv
ccggcgcccgccgcg

SEQ ID NO: 1352383 - RNA, 22 nt, Mycobacterium tuberculosis H37Rv
ccggcgcccacaucgucggcgg

SEQ ID NO: 1352384 - RNA, 13 nt, Mycobacterium tuberculosis H37Rv
ccggcgcccaggc

SEQ ID NO: 1352385 - RNA, 14 nt, Mycobacterium tuberculosis H37Rv
ccggcgcccaggcc

SEQ ID NO: 1352386 - RNA, 18 nt, Mycobacterium tuberculosis H37Rv
ccggcgccagcgccgcca

SEQ ID NO: 1352387 - RNA, 13 nt, Mycobacterium tuberculosis H37Rv
ccggcgcggccgc

SEQ ID NO: 1352388 - RNA, 14 nt, Mycobacterium tuberculosis H37Rv
ccggcgcggccagc

SEQ ID NO: 1352389 - RNA, 16 nt, Mycobacterium tuberculosis H37Rv
ccggcgcugcugccau

SEQ ID NO: 1352390 - RNA, 15 nt, Mycobacterium tuberculosis H37Rv
ccggcggaagcggcg

SEQ ID NO: 1352391 - RNA, 20 nt, Mycobacterium tuberculosis H37Rv
ccggcgcuccacugaccagg

SEQ ID NO: 1352392 - RNA, 12 nt, Mycobacterium tuberculosis H37Rv
ccggcgcugccc

SEQ ID NO: 1352393 - RNA, 19 nt, Mycobacterium tuberculosis H37Rv
ccggcgcuagcgccgcgcu

SEQ ID NO: 1352394 - RNA, 22 nt, Mycobacterium tuberculosis H37Rv
ccggcgcggagugcccagggcc

SEQ ID NO: 1352395 - RNA, 21 nt, Mycobacterium tuberculosis H37Rv
ccggcgcgccccaccgcgccg

SEQ ID NO: 1352396 - RNA, 15 nt, Mycobacterium tuberculosis H37Rv
ccggcgcgccccgcc

SEQ ID NO: 1352397 - RNA, 17 nt, Mycobacterium tuberculosis H37Rv
ccggcgcgccccgccgc

SEQ ID NO: 1352398 - RNA, 19 nt, Mycobacterium tuberculosis H37Rv
ccggcgcgccccaccgcgc

SEQ ID NO: 1352399 - RNA, 17 nt, Mycobacterium tuberculosis H37Rv
ccggcgcgccccaccgc

SEQ ID NO: 1352400 - RNA, 15 nt, Mycobacterium tuberculosis H37Rv
ccggcgcgauccccg

SEQ ID NO: 1352401 - RNA, 23 nt, Mycobacterium tuberculosis H37Rv
ccggcgccuccggcaccuccagc

SEQ ID NO: 1352402 - RNA, 22 nt, Mycobacterium tuberculosis H37Rv
ccggcgccugcugcggccaggg

SEQ ID NO: 1352403 - RNA, 18 nt, Mycobacterium tuberculosis H37Rv
ccggcgccggcgcgucgg

SEQ ID NO: 1352404 - RNA, 17 nt, Mycobacterium tuberculosis H37Rv
ccggcgccggagccgcc

SEQ ID NO: 1352405 - RNA, 17 nt, Mycobacterium tuberculosis H37Rv
ccggcgccggaguugaa

SEQ ID NO: 1352406 - RNA, 13 nt, Mycobacterium tuberculosis H37Rv
ccggcaccacgau

SEQ ID NO: 1352407 - RNA, 23 nt, Mycobacterium tuberculosis H37Rv
ccggcacauugaucgacggccag

SEQ ID NO: 1352408 - RNA, 14 nt, Mycobacterium tuberculosis H37Rv
ccggcacacccucc

SEQ ID NO: 1352409 - RNA, 16 nt, Mycobacterium tuberculosis H37Rv
ccggcacacggccuug

SEQ ID NO: 1352410 - RNA, 15 nt, Mycobacterium tuberculosis H37Rv
ccggcaaugccgcgg

SEQ ID NO: 1352411 - RNA, 16 nt, Mycobacterium tuberculosis H37Rv
ccggcaaugccacggu

SEQ ID NO: 1352412 - RNA, 20 nt, Mycobacterium tuberculosis H37Rv
ccggcaacaucgagcgccag

SEQ ID NO: 1352413 - RNA, 17 nt, Mycobacterium tuberculosis H37Rv
ccggcaacagcucgccu

SEQ ID NO: 1352414 - RNA, 18 nt, Mycobacterium tuberculosis H37Rv
ccggauuuguauuagacu

SEQ ID NO: 1352415 - RNA, 17 nt, Mycobacterium tuberculosis H37Rv
ccggcauacaucgccuu

SEQ ID NO: 1352416 - RNA, 20 nt, Mycobacterium tuberculosis H37Rv
ccggcaguucgcggccaucg

SEQ ID NO: 1352417 - RNA, 15 nt, Mycobacterium tuberculosis H37Rv
ccggcaccccuuuga

SEQ ID NO: 1352418 - RNA, 19 nt, Mycobacterium tuberculosis H37Rv
ccggcaccagcggcaccgc

SEQ ID NO: 1352419 - RNA, 14 nt, Mycobacterium tuberculosis H37Rv
ccggcaccagcggc

SEQ ID NO: 1352420 - RNA, 13 nt, Mycobacterium tuberculosis H37Rv
ccggcaccagcgg

SEQ ID NO: 1352421 - RNA, 13 nt, Mycobacterium tuberculosis H37Rv
ccggccacggucc

SEQ ID NO: 1352422 - RNA, 21 nt, Mycobacterium tuberculosis H37Rv
ccggcaucgucgacgcccgau

SEQ ID NO: 1352423 - RNA, 15 nt, Mycobacterium tuberculosis H37Rv
ccggcaucggucagc

SEQ ID NO: 1352424 - RNA, 16 nt, Mycobacterium tuberculosis H37Rv
ccggcaucgucgacgc

SEQ ID NO: 1352425 - RNA, 18 nt, Mycobacterium tuberculosis H37Rv
ccggcccaccagcgcagc

SEQ ID NO: 1352426 - RNA, 12 nt, Mycobacterium tuberculosis H37Rv
ccggcccaagga

SEQ ID NO: 1352427 - RNA, 14 nt, Mycobacterium tuberculosis H37Rv
ccggccagccgcgg

SEQ ID NO: 1352428 - RNA, 20 nt, Mycobacterium tuberculosis H37Rv
ccggccagccgacgcggcgg

SEQ ID NO: 1352429 - RNA, 22 nt, Mycobacterium tuberculosis H37Rv
ccggccagcagguccgccaccg

SEQ ID NO: 1352430 - RNA, 16 nt, Mycobacterium tuberculosis H37Rv
ccggccacuccaguac

SEQ ID NO: 1352431 - RNA, 22 nt, Mycobacterium tuberculosis H37Rv
ccggccacgucgaugugcgccc

SEQ ID NO: 1352432 - RNA, 18 nt, Mycobacterium tuberculosis H37Rv
ccggccacgguccggccc

SEQ ID NO: 1352433 - RNA, 17 nt, Mycobacterium tuberculosis H37Rv
ccggccacuacggccug

SEQ ID NO: 1352434 - RNA, 15 nt, Mycobacterium tuberculosis H37Rv
ccggccagauggugg

SEQ ID NO: 1352435 - RNA, 17 nt, Mycobacterium tuberculosis H37Rv
ccggccccccgacuccg

SEQ ID NO: 1352436 - RNA, 17 nt, Mycobacterium tuberculosis H37Rv
ccggcccgaagaucucc

SEQ ID NO: 1352437 - RNA, 21 nt, Mycobacterium tuberculosis H37Rv
ccggcccgaagaucuccuccu

SEQ ID NO: 1352438 - RNA, 15 nt, Mycobacterium tuberculosis H37Rv
ccggcccgccacccc

SEQ ID NO: 1352439 - RNA, 19 nt, Mycobacterium tuberculosis H37Rv
ccggcccgcauccgcaccg

SEQ ID NO: 1352440 - RNA, 22 nt, Mycobacterium tuberculosis H37Rv
ccggcccaucuucggacgccag

SEQ ID NO: 1352441 - RNA, 18 nt, Mycobacterium tuberculosis H37Rv
ccggccccgcaagcggau

SEQ ID NO: 1352442 - RNA, 16 nt, Mycobacterium tuberculosis H37Rv
ccggccccgccggcgc

SEQ ID NO: 1352443 - RNA, 21 nt, Mycobacterium tuberculosis H37Rv
ccggcccugccgccggccccg

SEQ ID NO: 1352444 - RNA, 16 nt, Mycobacterium tuberculosis H37Rv
ccggcccugcucggcc

SEQ ID NO: 1352445 - RNA, 12 nt, Mycobacterium tuberculosis H37Rv
ccggcccugcuc

SEQ ID NO: 1352446 - RNA, 14 nt, Mycobacterium tuberculosis H37Rv
ccggccgagccguu

SEQ ID NO: 1352447 - RNA, 23 nt, Mycobacterium tuberculosis H37Rv
ccggcccguagcguccgcgcccg

SEQ ID NO: 1352448 - RNA, 23 nt, Mycobacterium tuberculosis H37Rv
ccggcccggguaucgccaguggu

SEQ ID NO: 1352449 - RNA, 16 nt, Mycobacterium tuberculosis H37Rv
ccggcccgguccagcc

SEQ ID NO: 1352450 - RNA, 17 nt, Mycobacterium tuberculosis H37Rv
ccggcccgguccagccc

SEQ ID NO: 1352451 - RNA, 13 nt, Mycobacterium tuberculosis H37Rv
ccggauccucggc

SEQ ID NO: 1352452 - RNA, 17 nt, Mycobacterium tuberculosis H37Rv
ccggaucaucgccgcgg

SEQ ID NO: 1352453 - RNA, 16 nt, Mycobacterium tuberculosis H37Rv
ccggaucccagugcca

SEQ ID NO: 1352454 - RNA, 15 nt, Mycobacterium tuberculosis H37Rv
ccggauaggucgggc

SEQ ID NO: 1352455 - RNA, 11 nt, Mycobacterium tuberculosis H37Rv
ccggaguugaa

SEQ ID NO: 1352456 - RNA, 18 nt, Mycobacterium tuberculosis H37Rv
ccggaucgcucccgucuc

SEQ ID NO: 1352457 - RNA, 23 nt, Mycobacterium tuberculosis H37Rv
ccggaucgucgaacagcaccgcc

SEQ ID NO: 1352458 - RNA, 18 nt, Mycobacterium tuberculosis H37Rv
ccggaucggucggcacca

SEQ ID NO: 1352459 - RNA, 18 nt, Mycobacterium tuberculosis H37Rv
ccggauggguggccagca

SEQ ID NO: 1352460 - RNA, 22 nt, Mycobacterium tuberculosis H37Rv
ccggaugucgacgagcaccgcg

SEQ ID NO: 1352461 - RNA, 17 nt, Mycobacterium tuberculosis H37Rv
ccggauguauuccaggc

SEQ ID NO: 1352462 - RNA, 20 nt, Mycobacterium tuberculosis H37Rv
ccggaugucgugcgggcgca

SEQ ID NO: 1352463 - RNA, 17 nt, Mycobacterium tuberculosis H37Rv
ccggaugcugucagcag

SEQ ID NO: 1352464 - RNA, 20 nt, Mycobacterium tuberculosis H37Rv
ccggaccgcggccaccgccu

SEQ ID NO: 1352465 - RNA, 18 nt, Mycobacterium tuberculosis H37Rv
ccggacccaaagcacuuc

SEQ ID NO: 1352466 - RNA, 21 nt, Mycobacterium tuberculosis H37Rv
ccggaccaucgacaacgccuu

SEQ ID NO: 1352467 - RNA, 21 nt, Mycobacterium tuberculosis H37Rv
ccggaccgaagaccuccucgg

SEQ ID NO: 1352468 - RNA, 13 nt, Mycobacterium tuberculosis H37Rv
ccggaccaccagg

SEQ ID NO: 1352469 - RNA, 18 nt, Mycobacterium tuberculosis H37Rv
ccggaccaccgggccgac

SEQ ID NO: 1352470 - RNA, 13 nt, Mycobacterium tuberculosis H37Rv
ccgcuugcggggc

SEQ ID NO: 1352471 - RNA, 16 nt, Mycobacterium tuberculosis H37Rv
ccgcuugcggggccgg

SEQ ID NO: 1352472 - RNA, 15 nt, Mycobacterium tuberculosis H37Rv
ccgcuugccccgccu

SEQ ID NO: 1352473 - RNA, 19 nt, Mycobacterium tuberculosis H37Rv
ccggacgcugauugcgacc

SEQ ID NO: 1352474 - RNA, 22 nt, Mycobacterium tuberculosis H37Rv
ccggagccgcccaagccgccgg

SEQ ID NO: 1352475 - RNA, 16 nt, Mycobacterium tuberculosis H37Rv
ccggagccgccggccc

SEQ ID NO: 1352476 - RNA, 18 nt, Mycobacterium tuberculosis H37Rv
ccggagccgccggccccg

SEQ ID NO: 1352477 - RNA, 15 nt, Mycobacterium tuberculosis H37Rv
ccggaccuuguuggc

SEQ ID NO: 1352478 - RNA, 16 nt, Mycobacterium tuberculosis H37Rv
ccggacgaucagggug

SEQ ID NO: 1352479 - RNA, 22 nt, Mycobacterium tuberculosis H37Rv
ccggagccggugccgacggcgc

SEQ ID NO: 1352480 - RNA, 16 nt, Mycobacterium tuberculosis H37Rv
ccggagcggucagcgg

SEQ ID NO: 1352481 - RNA, 22 nt, Mycobacterium tuberculosis H37Rv
ccggagccccugucaacgccgc

SEQ ID NO: 1352482 - RNA, 15 nt, Mycobacterium tuberculosis H37Rv
ccguuggggccguuc

SEQ ID NO: 1352483 - RNA, 22 nt, Mycobacterium tuberculosis H37Rv
ccguuggcggcgguggccagcg

SEQ ID NO: 1352484 - RNA, 18 nt, Mycobacterium tuberculosis H37Rv
ccguuguggaccaucuuc

SEQ ID NO: 1352485 - RNA, 16 nt, Mycobacterium tuberculosis H37Rv
ccguugucgucggcgg

SEQ ID NO: 1352486 - RNA, 20 nt, Mycobacterium tuberculosis H37Rv
ccguucugucccggcgcgcc

SEQ ID NO: 1352487 - RNA, 20 nt, Mycobacterium tuberculosis H37Rv
ccguucuucgcgauguccuc

SEQ ID NO: 1352488 - RNA, 16 nt, Mycobacterium tuberculosis H37Rv
ccguugaacggcacca

SEQ ID NO: 1352489 - RNA, 21 nt, Mycobacterium tuberculosis H37Rv
ccguuggcgacguuggcggga

SEQ ID NO: 1352490 - RNA, 20 nt, Mycobacterium tuberculosis H37Rv
ccguugauaaaaaccuggcc

SEQ ID NO: 1352491 - RNA, 15 nt, Mycobacterium tuberculosis H37Rv
ccguuguggccgccu

SEQ ID NO: 1352492 - RNA, 15 nt, Mycobacterium tuberculosis H37Rv
ccuaaggcucaccag

SEQ ID NO: 1352493 - RNA, 19 nt, Mycobacterium tuberculosis H37Rv
ccguucgugagcggccagg

SEQ ID NO: 1352494 - RNA, 20 nt, Mycobacterium tuberculosis H37Rv
ccguucgugggcauugcggc

SEQ ID NO: 1352495 - RNA, 14 nt, Mycobacterium tuberculosis H37Rv
ccguucggggcgcg

SEQ ID NO: 1352496 - RNA, 13 nt, Mycobacterium tuberculosis H37Rv
ccguuagccaggu

SEQ ID NO: 1352497 - RNA, 16 nt, Mycobacterium tuberculosis H37Rv
ccguuaccgccgucgc

SEQ ID NO: 1352498 - RNA, 23 nt, Mycobacterium tuberculosis H37Rv
ccguggcugaaauaagggccggc

SEQ ID NO: 1352499 - RNA, 21 nt, Mycobacterium tuberculosis H37Rv
ccguggcggugagccgccagg

SEQ ID NO: 1352500 - RNA, 22 nt, Mycobacterium tuberculosis H37Rv
ccguggcggugagccgccagga

SEQ ID NO: 1352501 - RNA, 20 nt, Mycobacterium tuberculosis H37Rv
ccgugggguguggcggcggg

SEQ ID NO: 1352502 - RNA, 13 nt, Mycobacterium tuberculosis H37Rv
ccguggcgcccgc

SEQ ID NO: 1352503 - RNA, 18 nt, Mycobacterium tuberculosis H37Rv
ccguggcggccuccuccc

SEQ ID NO: 1352504 - RNA, 18 nt, Mycobacterium tuberculosis H37Rv
ccguggccgcacugcugg

SEQ ID NO: 1352505 - RNA, 13 nt, Mycobacterium tuberculosis H37Rv
ccguggccgcagg

SEQ ID NO: 1352506 - RNA, 15 nt, Mycobacterium tuberculosis H37Rv
ccgucgcgacgucgg

SEQ ID NO: 1352507 - RNA, 17 nt, Mycobacterium tuberculosis H37Rv
ccgucgcgacgucggcc

SEQ ID NO: 1352508 - RNA, 18 nt, Mycobacterium tuberculosis H37Rv
ccgucgcgacgucggccg

SEQ ID NO: 1352509 - RNA, 23 nt, Mycobacterium tuberculosis H37Rv
ccgugcagggcauugcggcccgc

SEQ ID NO: 1352510 - RNA, 16 nt, Mycobacterium tuberculosis H37Rv
ccgugcacgucagcgg

SEQ ID NO: 1352511 - RNA, 20 nt, Mycobacterium tuberculosis H37Rv
ccgugcaccagcucacccgg

SEQ ID NO: 1352512 - RNA, 15 nt, Mycobacterium tuberculosis H37Rv
ccgugcaccuccagg

SEQ ID NO: 1352513 - RNA, 22 nt, Mycobacterium tuberculosis H37Rv
ccgucgcccuuagggucgccgc

SEQ ID NO: 1352514 - RNA, 17 nt, Mycobacterium tuberculosis H37Rv
ccgucgcagagguauuc

SEQ ID NO: 1352515 - RNA, 18 nt, Mycobacterium tuberculosis H37Rv
ccgucgccgcccgugccg

SEQ ID NO: 1352516 - RNA, 12 nt, Mycobacterium tuberculosis H37Rv
ccgucgccgguc

SEQ ID NO: 1352517 - RNA, 12 nt, Mycobacterium tuberculosis H37Rv
ccgucgccuccg

SEQ ID NO: 1352518 - RNA, 14 nt, Mycobacterium tuberculosis H37Rv
ccgucgccuccgcu

SEQ ID NO: 1352519 - RNA, 12 nt, Mycobacterium tuberculosis H37Rv
ccgucgccgccg

SEQ ID NO: 1352520 - RNA, 12 nt, Mycobacterium tuberculosis H37Rv
ccgucgccgcca

SEQ ID NO: 1352521 - RNA, 19 nt, Mycobacterium tuberculosis H37Rv
ccguccucgcuauugggug

SEQ ID NO: 1352522 - RNA, 14 nt, Mycobacterium tuberculosis H37Rv
ccguccgucggcgc

SEQ ID NO: 1352523 - RNA, 14 nt, Mycobacterium tuberculosis H37Rv
ccguccgguccguc

SEQ ID NO: 1352524 - RNA, 19 nt, Mycobacterium tuberculosis H37Rv
ccucaaggagcccguccag

SEQ ID NO: 1352525 - RNA, 17 nt, Mycobacterium tuberculosis H37Rv
ccucaaggucggccagg

SEQ ID NO: 1352526 - RNA, 20 nt, Mycobacterium tuberculosis H37Rv
ccucaaggagcccguccagg

SEQ ID NO: 1352527 - RNA, 20 nt, Mycobacterium tuberculosis H37Rv
ccucaaggucggccaggcug

SEQ ID NO: 1352528 - RNA, 19 nt, Mycobacterium tuberculosis H37Rv
ccucaccgaucucgaccag

SEQ ID NO: 1352529 - RNA, 21 nt, Mycobacterium tuberculosis H37Rv
ccucaccgaucucgaccagcg

SEQ ID NO: 1352530 - RNA, 13 nt, Mycobacterium tuberculosis H37Rv
ccucacccagcug

SEQ ID NO: 1352531 - RNA, 16 nt, Mycobacterium tuberculosis H37Rv
ccucacaugcccggac

SEQ ID NO: 1352532 - RNA, 17 nt, Mycobacterium tuberculosis H37Rv
ccucaccaaccgcccga

SEQ ID NO: 1352533 - RNA, 22 nt, Mycobacterium tuberculosis H37Rv
ccuaugcugcccggcaaccugg

SEQ ID NO: 1352534 - RNA, 15 nt, Mycobacterium tuberculosis H37Rv
ccucaacgucccagc

SEQ ID NO: 1352535 - RNA, 14 nt, Mycobacterium tuberculosis H37Rv
ccuagguucgccac

SEQ ID NO: 1352536 - RNA, 22 nt, Mycobacterium tuberculosis H37Rv
ccuagguagucggccuccucgu

SEQ ID NO: 1352537 - RNA, 17 nt, Mycobacterium tuberculosis H37Rv
ccuagggcggcggcgcg

SEQ ID NO: 1352538 - RNA, 21 nt, Mycobacterium tuberculosis H37Rv
ccuaguccggcacugcggcca

SEQ ID NO: 1352539 - RNA, 20 nt, Mycobacterium tuberculosis H37Rv
ccuaguccggcacugcggcc

SEQ ID NO: 1352540 - RNA, 16 nt, Mycobacterium tuberculosis H37Rv
ccuaucgacaacaugc

SEQ ID NO: 1352541 - RNA, 13 nt, Mycobacterium tuberculosis H37Rv
ccuauccgggccc

SEQ ID NO: 1352542 - RNA, 17 nt, Mycobacterium tuberculosis H37Rv
ccuaugauucagccggc

SEQ ID NO: 1352543 - RNA, 17 nt, Mycobacterium tuberculosis H37Rv
ccuaucagugagccgcc

SEQ ID NO: 1352544 - RNA, 21 nt, Mycobacterium tuberculosis H37Rv
ccuaucagccgagacaccacg

SEQ ID NO: 1352545 - RNA, 18 nt, Mycobacterium tuberculosis H37Rv
ccuagccggcgcgcccca

SEQ ID NO: 1352546 - RNA, 11 nt, Mycobacterium tuberculosis H37Rv
ccuagcgcggc

SEQ ID NO: 1352547 - RNA, 23 nt, Mycobacterium tuberculosis H37Rv
ccuagcagggugccggcgccgcc

SEQ ID NO: 1352548 - RNA, 21 nt, Mycobacterium tuberculosis H37Rv
ccuagcagggugccggcgccg

SEQ ID NO: 1352549 - RNA, 22 nt, Mycobacterium tuberculosis H37Rv
ccuagauccaaacacccuugcc

SEQ ID NO: 1352550 - RNA, 15 nt, Mycobacterium tuberculosis H37Rv
ccgggccguagaaau

SEQ ID NO: 1352551 - RNA, 18 nt, Mycobacterium tuberculosis H37Rv
ccgggccuugcgcgcgca

SEQ ID NO: 1352552 - RNA, 13 nt, Mycobacterium tuberculosis H37Rv
ccgggccuggccu

SEQ ID NO: 1352553 - RNA, 16 nt, Mycobacterium tuberculosis H37Rv
ccgggcgagucccggc

SEQ ID NO: 1352554 - RNA, 22 nt, Mycobacterium tuberculosis H37Rv
ccgggcgaccaccaccgccgcc

SEQ ID NO: 1352555 - RNA, 15 nt, Mycobacterium tuberculosis H37Rv
ccgggcgcaagcagc

SEQ ID NO: 1352556 - RNA, 23 nt, Mycobacterium tuberculosis H37Rv
ccgggcgcucggucuccaccacc

SEQ ID NO: 1352557 - RNA, 14 nt, Mycobacterium tuberculosis H37Rv
ccggggcugcccgc

SEQ ID NO: 1352558 - RNA, 23 nt, Mycobacterium tuberculosis H37Rv
ccgggcgcuugcaccaggggcgc

SEQ ID NO: 1352559 - RNA, 12 nt, Mycobacterium tuberculosis H37Rv
ccgggggaacgg

SEQ ID NO: 1352560 - RNA, 21 nt, Mycobacterium tuberculosis H37Rv
ccggggcuggcuguggcgcgc

SEQ ID NO: 1352561 - RNA, 18 nt, Mycobacterium tuberculosis H37Rv
ccggggcugggggccggc

SEQ ID NO: 1352562 - RNA, 24 nt, Mycobacterium tuberculosis H37Rv
ccgggggacgauuccgcccacaug

SEQ ID NO: 1352563 - RNA, 13 nt, Mycobacterium tuberculosis H37Rv
ccggggggcugcu

SEQ ID NO: 1352564 - RNA, 13 nt, Mycobacterium tuberculosis H37Rv
ccgggggguugau

SEQ ID NO: 1352565 - RNA, 18 nt, Mycobacterium tuberculosis H37Rv
ccggggugcccggccgcc

SEQ ID NO: 1352566 - RNA, 22 nt, Mycobacterium tuberculosis H37Rv
ccggggugaaaaucgccaucgg

SEQ ID NO: 1352567 - RNA, 17 nt, Mycobacterium tuberculosis H37Rv
ccgggguagacgccccg

SEQ ID NO: 1352568 - RNA, 15 nt, Mycobacterium tuberculosis H37Rv
ccggggucggcccgc

SEQ ID NO: 1352569 - RNA, 21 nt, Mycobacterium tuberculosis H37Rv
ccgggccgaucaccccggugg

SEQ ID NO: 1352570 - RNA, 17 nt, Mycobacterium tuberculosis H37Rv
ccgggcagucaggccua

SEQ ID NO: 1352571 - RNA, 17 nt, Mycobacterium tuberculosis H37Rv
ccgggcaguccaggcac

SEQ ID NO: 1352572 - RNA, 20 nt, Mycobacterium tuberculosis H37Rv
ccgggcaguuuggcggcagg

SEQ ID NO: 1352573 - RNA, 21 nt, Mycobacterium tuberculosis H37Rv
ccgggccgccagggcccuagc

SEQ ID NO: 1352574 - RNA, 16 nt, Mycobacterium tuberculosis H37Rv
ccgggccgccgccccg

SEQ ID NO: 1352575 - RNA, 16 nt, Mycobacterium tuberculosis H37Rv
ccgggccgcggcggcc

SEQ ID NO: 1352576 - RNA, 15 nt, Mycobacterium tuberculosis H37Rv
ccgggcagccccucc

SEQ ID NO: 1352577 - RNA, 18 nt, Mycobacterium tuberculosis H37Rv
ccgggcagcugggcagga

SEQ ID NO: 1352578 - RNA, 14 nt, Mycobacterium tuberculosis H37Rv
ccgggcagccgcgc

SEQ ID NO: 1352579 - RNA, 23 nt, Mycobacterium tuberculosis H37Rv
ccgggcaccacuuggguggcgcc

SEQ ID NO: 1352580 - RNA, 18 nt, Mycobacterium tuberculosis H37Rv
ccgggcaccggccggugg

SEQ ID NO: 1352581 - RNA, 16 nt, Mycobacterium tuberculosis H37Rv
ccgggcaccgucggaa

SEQ ID NO: 1352582 - RNA, 20 nt, Mycobacterium tuberculosis H37Rv
ccgggaucucgaaggccgcc

SEQ ID NO: 1352583 - RNA, 17 nt, Mycobacterium tuberculosis H37Rv
ccggcggacaccucggg

SEQ ID NO: 1352584 - RNA, 16 nt, Mycobacterium tuberculosis H37Rv
ccgggauugccgucgg

SEQ ID NO: 1352585 - RNA, 17 nt, Mycobacterium tuberculosis H37Rv
ccgggcaaaucaagcac

SEQ ID NO: 1352586 - RNA, 17 nt, Mycobacterium tuberculosis H37Rv
ccgggauugccgccacc

SEQ ID NO: 1352587 - RNA, 18 nt, Mycobacterium tuberculosis H37Rv
ccgggaugugcggcugca

SEQ ID NO: 1352588 - RNA, 14 nt, Mycobacterium tuberculosis H37Rv
ccgggcaaggccac

SEQ ID NO: 1352589 - RNA, 20 nt, Mycobacterium tuberculosis H37Rv
ccgggcaacgcgaaccggcc

SEQ ID NO: 1352590 - RNA, 21 nt, Mycobacterium tuberculosis H37Rv
ccgggcaaaucaagcacagcc

SEQ ID NO: 1352591 - RNA, 13 nt, Mycobacterium tuberculosis H37Rv
ccgggcaaccagc

SEQ ID NO: 1352592 - RNA, 16 nt, Mycobacterium tuberculosis H37Rv
ccgguccagcccagcg

SEQ ID NO: 1352593 - RNA, 15 nt, Mycobacterium tuberculosis H37Rv
ccgguccagccccau

SEQ ID NO: 1352594 - RNA, 18 nt, Mycobacterium tuberculosis H37Rv
ccggucauggucagcaga

SEQ ID NO: 1352595 - RNA, 17 nt, Mycobacterium tuberculosis H37Rv
ccggucaucccaagcgu

SEQ ID NO: 1352596 - RNA, 13 nt, Mycobacterium tuberculosis H37Rv
ccgguccagaccc

SEQ ID NO: 1352597 - RNA, 18 nt, Mycobacterium tuberculosis H37Rv
ccggucauaccaagcgcg

SEQ ID NO: 1352598 - RNA, 15 nt, Mycobacterium tuberculosis H37Rv
ccggucaggccgccg

SEQ ID NO: 1352599 - RNA, 23 nt, Mycobacterium tuberculosis H37Rv
ccggucucgacggcggccgcgau

SEQ ID NO: 1352600 - RNA, 12 nt, Mycobacterium tuberculosis H37Rv
ccggugccgccu

SEQ ID NO: 1352601 - RNA, 15 nt, Mycobacterium tuberculosis H37Rv
ccggugccgccuccg

SEQ ID NO: 1352602 - RNA, 19 nt, Mycobacterium tuberculosis H37Rv
ccggucggugagccgugcc

SEQ ID NO: 1352603 - RNA, 16 nt, Mycobacterium tuberculosis H37Rv
ccggucggugagccgu

SEQ ID NO: 1352604 - RNA, 14 nt, Mycobacterium tuberculosis H37Rv
ccggucggcagcuu

SEQ ID NO: 1352605 - RNA, 14 nt, Mycobacterium tuberculosis H37Rv
ccggucggccagca

SEQ ID NO: 1352606 - RNA, 20 nt, Mycobacterium tuberculosis H37Rv
ccggucggccagcaagugcg

SEQ ID NO: 1352607 - RNA, 15 nt, Mycobacterium tuberculosis H37Rv
ccggucggcgguagc

SEQ ID NO: 1352608 - RNA, 16 nt, Mycobacterium tuberculosis H37Rv
ccggucggccaggccg

SEQ ID NO: 1352609 - RNA, 19 nt, Mycobacterium tuberculosis H37Rv
ccggucggccauccaccgc

SEQ ID NO: 1352610 - RNA, 20 nt, Mycobacterium tuberculosis H37Rv
ccgguacccguagcaccaca

SEQ ID NO: 1352611 - RNA, 20 nt, Mycobacterium tuberculosis H37Rv
ccgguacaacccccaggcgc

SEQ ID NO: 1352612 - RNA, 16 nt, Mycobacterium tuberculosis H37Rv
ccgguacacguccagu

SEQ ID NO: 1352613 - RNA, 22 nt, Mycobacterium tuberculosis H37Rv
ccggguguagcucggacccuca

SEQ ID NO: 1352614 - RNA, 19 nt, Mycobacterium tuberculosis H37Rv
ccgggugcgacgcgaccgc

SEQ ID NO: 1352615 - RNA, 21 nt, Mycobacterium tuberculosis H37Rv
ccgggugcgccguugccgccg

SEQ ID NO: 1352616 - RNA, 13 nt, Mycobacterium tuberculosis H37Rv
ccgggugccgcgc

SEQ ID NO: 1352617 - RNA, 14 nt, Mycobacterium tuberculosis H37Rv
ccgggugccgcgcc

SEQ ID NO: 1352618 - RNA, 22 nt, Mycobacterium tuberculosis H37Rv
ccgggugcaacggcguuggcgc

SEQ ID NO: 1352619 - RNA, 15 nt, Mycobacterium tuberculosis H37Rv
ccgggugcagaucgc

SEQ ID NO: 1352620 - RNA, 23 nt, Mycobacterium tuberculosis H37Rv
ccgggugcaacggcguuggcgcc

SEQ ID NO: 1352621 - RNA, 15 nt, Mycobacterium tuberculosis H37Rv
ccgggugccacaacc

SEQ ID NO: 1352622 - RNA, 20 nt, Mycobacterium tuberculosis H37Rv
ccgggugaaguuggcguggu

SEQ ID NO: 1352623 - RNA, 12 nt, Mycobacterium tuberculosis H37Rv
ccgggucggcga

SEQ ID NO: 1352624 - RNA, 17 nt, Mycobacterium tuberculosis H37Rv
ccggguccgccgggccc

SEQ ID NO: 1352625 - RNA, 23 nt, Mycobacterium tuberculosis H37Rv
ccggguccgccguugccgauccc

SEQ ID NO: 1352626 - RNA, 13 nt, Mycobacterium tuberculosis H37Rv
ccggguccaccgc

SEQ ID NO: 1352627 - RNA, 18 nt, Mycobacterium tuberculosis H37Rv
ccgggucgaugucggggc

SEQ ID NO: 1352628 - RNA, 22 nt, Mycobacterium tuberculosis H37Rv
ccgggucgaugucggggccguc

SEQ ID NO: 1352629 - RNA, 18 nt, Mycobacterium tuberculosis H37Rv
ccgggucgauuucgccgg

SEQ ID NO: 1352630 - RNA, 23 nt, Mycobacterium tuberculosis H37Rv
ccgggucccauuugccuugagcc

SEQ ID NO: 1352631 - RNA, 21 nt, Mycobacterium tuberculosis H37Rv
ccgguggcgccggggccgccg

SEQ ID NO: 1352632 - RNA, 22 nt, Mycobacterium tuberculosis H37Rv
ccgguggggucggucuggcugg

SEQ ID NO: 1352633 - RNA, 22 nt, Mycobacterium tuberculosis H37Rv
ccgguggggacccgcuccaagc

SEQ ID NO: 1352634 - RNA, 15 nt, Mycobacterium tuberculosis H37Rv
ccggugggggcggcg

SEQ ID NO: 1352635 - RNA, 15 nt, Mycobacterium tuberculosis H37Rv
ccggugggccgccca

SEQ ID NO: 1352636 - RNA, 13 nt, Mycobacterium tuberculosis H37Rv
ccggugggcggcu

SEQ ID NO: 1352637 - RNA, 14 nt, Mycobacterium tuberculosis H37Rv
ccgguggcgccgcc

SEQ ID NO: 1352638 - RNA, 15 nt, Mycobacterium tuberculosis H37Rv
ccgguggcgccgccg

SEQ ID NO: 1352639 - RNA, 19 nt, Mycobacterium tuberculosis H37Rv
ccgguggcgccgccgccaa

SEQ ID NO: 1352640 - RNA, 14 nt, Mycobacterium tuberculosis H37Rv
ccgguggucugcgc

SEQ ID NO: 1352641 - RNA, 15 nt, Mycobacterium tuberculosis H37Rv
ccgguggucaggaac

SEQ ID NO: 1352642 - RNA, 16 nt, Mycobacterium tuberculosis H37Rv
ccgguggugccggcgc

SEQ ID NO: 1352643 - RNA, 18 nt, Mycobacterium tuberculosis H37Rv
ccggugguggcgaccccg

SEQ ID NO: 1352644 - RNA, 17 nt, Mycobacterium tuberculosis H37Rv
ccgguggugggccgugg

SEQ ID NO: 1352645 - RNA, 15 nt, Mycobacterium tuberculosis H37Rv
ccgguguccagccac

SEQ ID NO: 1352646 - RNA, 17 nt, Mycobacterium tuberculosis H37Rv
ccgguggaauccaccag

SEQ ID NO: 1352647 - RNA, 19 nt, Mycobacterium tuberculosis H37Rv
ccgguguagcagcgccagc

SEQ ID NO: 1352648 - RNA, 22 nt, Mycobacterium tuberculosis H37Rv
ccggugucucccuugccgccau

SEQ ID NO: 1352649 - RNA, 14 nt, Mycobacterium tuberculosis H37Rv
ccgguggcccgccg

SEQ ID NO: 1352650 - RNA, 16 nt, Mycobacterium tuberculosis H37Rv
ccggugcugguccagg

SEQ ID NO: 1352651 - RNA, 17 nt, Mycobacterium tuberculosis H37Rv
ccgguggcagagccgcc

SEQ ID NO: 1352652 - RNA, 18 nt, Mycobacterium tuberculosis H37Rv
ccgguggcagagccgccg

SEQ ID NO: 1352653 - RNA, 19 nt, Mycobacterium tuberculosis H37Rv
ccgguggcagccugcugca

SEQ ID NO: 1352654 - RNA, 16 nt, Mycobacterium tuberculosis H37Rv
ccgguggcagggaacc

SEQ ID NO: 1352655 - RNA, 19 nt, Mycobacterium tuberculosis H37Rv
ccggugcugucgacgucgg

SEQ ID NO: 1352656 - RNA, 20 nt, Mycobacterium tuberculosis H37Rv
ccgguggcacggccccugcc

SEQ ID NO: 1352657 - RNA, 22 nt, Mycobacterium tuberculosis H37Rv
ccggugcuaaccgacgcugaag

SEQ ID NO: 1352658 - RNA, 18 nt, Mycobacterium tuberculosis H37Rv
ccggugcgguggugcgca

SEQ ID NO: 1352659 - RNA, 16 nt, Mycobacterium tuberculosis H37Rv
ccggugcgcagguacg

SEQ ID NO: 1352660 - RNA, 20 nt, Mycobacterium tuberculosis H37Rv
ccggugcgcgcugacccgcc

SEQ ID NO: 1352661 - RNA, 19 nt, Mycobacterium tuberculosis H37Rv
ccggugcggaucugcugcg

SEQ ID NO: 1352662 - RNA, 16 nt, Mycobacterium tuberculosis H37Rv
ccggugccgggcacca

SEQ ID NO: 1352663 - RNA, 22 nt, Mycobacterium tuberculosis H37Rv
ccggugccgcgguaggugcaug

SEQ ID NO: 1352664 - RNA, 13 nt, Mycobacterium tuberculosis H37Rv
ccggugccgcggu

SEQ ID NO: 1352665 - RNA, 24 nt, Mycobacterium tuberculosis H37Rv
ccggugccguuggagccgccaccg

SEQ ID NO: 1352666 - RNA, 15 nt, Mycobacterium tuberculosis H37Rv
ccggugccugcaacg

SEQ ID NO: 1352667 - RNA, 13 nt, Mycobacterium tuberculosis H37Rv
ccggugccguugg

SEQ ID NO: 1352668 - RNA, 18 nt, Mycobacterium tuberculosis H37Rv
ccgguucagggguggcgc

SEQ ID NO: 1352669 - RNA, 22 nt, Mycobacterium tuberculosis H37Rv
ccgguguucaucacgccgccgg

SEQ ID NO: 1352670 - RNA, 19 nt, Mycobacterium tuberculosis H37Rv
ccgguguuuccgaaacccg

SEQ ID NO: 1352671 - RNA, 11 nt, Mycobacterium tuberculosis H37Rv
ccgguguugau

SEQ ID NO: 1352672 - RNA, 16 nt, Mycobacterium tuberculosis H37Rv
ccgguguugccgccgg

SEQ ID NO: 1352673 - RNA, 23 nt, Mycobacterium tuberculosis H37Rv
ccgguguuguaggccgggccggc

SEQ ID NO: 1352674 - RNA, 17 nt, Mycobacterium tuberculosis H37Rv
ccguaagcaccagccag

SEQ ID NO: 1352675 - RNA, 19 nt, Mycobacterium tuberculosis H37Rv
ccgguuguggaaccacggc

SEQ ID NO: 1352676 - RNA, 18 nt, Mycobacterium tuberculosis H37Rv
ccgguuggcgcgggcgag

SEQ ID NO: 1352677 - RNA, 19 nt, Mycobacterium tuberculosis H37Rv
ccgguuucuucggccagcu

SEQ ID NO: 1352678 - RNA, 23 nt, Mycobacterium tuberculosis H37Rv
ccgguuugacguccagggccacg

SEQ ID NO: 1352679 - RNA, 15 nt, Mycobacterium tuberculosis H37Rv
ccgguuggccagcca

SEQ ID NO: 1352680 - RNA, 20 nt, Mycobacterium tuberculosis H37Rv
ccgguugcggucaucggcgc

SEQ ID NO: 1352681 - RNA, 20 nt, Mycobacterium tuberculosis H37Rv
ccgguugccguugcccucgg

SEQ ID NO: 1352682 - RNA, 18 nt, Mycobacterium tuberculosis H37Rv
ccgguugccaccugugcg

SEQ ID NO: 1352683 - RNA, 14 nt, Mycobacterium tuberculosis H37Rv
ccguauccaggcgu

SEQ ID NO: 1352684 - RNA, 17 nt, Mycobacterium tuberculosis H37Rv
ccguauugaccagcggg

SEQ ID NO: 1352685 - RNA, 13 nt, Mycobacterium tuberculosis H37Rv
ccgucaccgccga

SEQ ID NO: 1352686 - RNA, 13 nt, Mycobacterium tuberculosis H37Rv
ccgucacaggccg

SEQ ID NO: 1352687 - RNA, 14 nt, Mycobacterium tuberculosis H37Rv
ccgucaccaccgcc

SEQ ID NO: 1352688 - RNA, 16 nt, Mycobacterium tuberculosis H37Rv
ccgucaccgcgcggcu

SEQ ID NO: 1352689 - RNA, 14 nt, Mycobacterium tuberculosis H37Rv
ccgucaccgccggc

SEQ ID NO: 1352690 - RNA, 13 nt, Mycobacterium tuberculosis H37Rv
ccgucacgcccgc

SEQ ID NO: 1352691 - RNA, 22 nt, Mycobacterium tuberculosis H37Rv
ccgucaccggaauccccccugu

SEQ ID NO: 1352692 - RNA, 19 nt, Mycobacterium tuberculosis H37Rv
ccgucaccgccggcaccgc

SEQ ID NO: 1352693 - RNA, 20 nt, Mycobacterium tuberculosis H37Rv
ccgucaccgccgucaccgcc

SEQ ID NO: 1352694 - RNA, 18 nt, Mycobacterium tuberculosis H37Rv
ccguccaagccggcugca

SEQ ID NO: 1352695 - RNA, 14 nt, Mycobacterium tuberculosis H37Rv
ccgucauuggcuug

SEQ ID NO: 1352696 - RNA, 18 nt, Mycobacterium tuberculosis H37Rv
ccgucaugggcggcuucg

SEQ ID NO: 1352697 - RNA, 19 nt, Mycobacterium tuberculosis H37Rv
ccgucagggucagcuggga

SEQ ID NO: 1352698 - RNA, 14 nt, Mycobacterium tuberculosis H37Rv
ccgucccggccucg

SEQ ID NO: 1352699 - RNA, 14 nt, Mycobacterium tuberculosis H37Rv
ccguccccgcagcg

SEQ ID NO: 1352700 - RNA, 15 nt, Mycobacterium tuberculosis H37Rv
ccguccccgccgccg

SEQ ID NO: 1352701 - RNA, 19 nt, Mycobacterium tuberculosis H37Rv
ccgucccgauacggccggc

SEQ ID NO: 1352702 - RNA, 17 nt, Mycobacterium tuberculosis H37Rv
ccgucccgccggccccg

SEQ ID NO: 1352703 - RNA, 20 nt, Mycobacterium tuberculosis H37Rv
ccgucccgcgagcagcccgg

SEQ ID NO: 1352704 - RNA, 20 nt, Mycobacterium tuberculosis H37Rv
ccgucccagcugaccagcgu

SEQ ID NO: 1352705 - RNA, 21 nt, Mycobacterium tuberculosis H37Rv
ccgucccacgugugcggaagc

SEQ ID NO: 1352706 - RNA, 19 nt, Mycobacterium tuberculosis H37Rv
ccguccaggcgcugcagca

SEQ ID NO: 1352707 - RNA, 18 nt, Mycobacterium tuberculosis H37Rv
ccguccaggcgcugcagc

SEQ ID NO: 1352708 - RNA, 16 nt, Mycobacterium tuberculosis H37Rv
ccguccagcgccgcgg

SEQ ID NO: 1352709 - RNA, 19 nt, Mycobacterium tuberculosis H37Rv
ccguccagcgccgcggccc

SEQ ID NO: 1352710 - RNA, 20 nt, Mycobacterium tuberculosis H37Rv
ccugaccgcccgcacccccg

SEQ ID NO: 1352711 - RNA, 18 nt, Mycobacterium tuberculosis H37Rv
ccucuucgaucuguuccu

SEQ ID NO: 1352712 - RNA, 19 nt, Mycobacterium tuberculosis H37Rv
ccugacgaaggucuccggc

SEQ ID NO: 1352713 - RNA, 18 nt, Mycobacterium tuberculosis H37Rv
ccugaccggcucgccggc

SEQ ID NO: 1352714 - RNA, 17 nt, Mycobacterium tuberculosis H37Rv
ccugaccggcgguuuug

SEQ ID NO: 1352715 - RNA, 23 nt, Mycobacterium tuberculosis H37Rv
ccugacgcucggucgccaccgcc

SEQ ID NO: 1352716 - RNA, 21 nt, Mycobacterium tuberculosis H37Rv
ccugacggaaguacuccaugg

SEQ ID NO: 1352717 - RNA, 17 nt, Mycobacterium tuberculosis H37Rv
ccugacgguacagcucc

SEQ ID NO: 1352718 - RNA, 18 nt, Mycobacterium tuberculosis H37Rv
ccugacgguacagcucca

SEQ ID NO: 1352719 - RNA, 11 nt, Mycobacterium tuberculosis H37Rv
ccugagcagau

SEQ ID NO: 1352720 - RNA, 19 nt, Mycobacterium tuberculosis H37Rv
ccugacuuuugucacugcg

SEQ ID NO: 1352721 - RNA, 13 nt, Mycobacterium tuberculosis H37Rv
ccugagcucccgc

SEQ ID NO: 1352722 - RNA, 19 nt, Mycobacterium tuberculosis H37Rv
ccugauaugacuugcgcgc

SEQ ID NO: 1352723 - RNA, 16 nt, Mycobacterium tuberculosis H37Rv
ccugaucgagcgccag

SEQ ID NO: 1352724 - RNA, 13 nt, Mycobacterium tuberculosis H37Rv
ccugaugagggac

SEQ ID NO: 1352725 - RNA, 13 nt, Mycobacterium tuberculosis H37Rv
ccugauggacccg

SEQ ID NO: 1352726 - RNA, 17 nt, Mycobacterium tuberculosis H37Rv
ccugcagcccgggcagc

SEQ ID NO: 1352727 - RNA, 15 nt, Mycobacterium tuberculosis H37Rv
ccugauugaagcccc

SEQ ID NO: 1352728 - RNA, 18 nt, Mycobacterium tuberculosis H37Rv
ccugccaaugcugcaggu

SEQ ID NO: 1352729 - RNA, 12 nt, Mycobacterium tuberculosis H37Rv
ccugccacccgg

SEQ ID NO: 1352730 - RNA, 14 nt, Mycobacterium tuberculosis H37Rv
ccugccacagcgac

SEQ ID NO: 1352731 - RNA, 17 nt, Mycobacterium tuberculosis H37Rv
ccugccacagcgacagc

SEQ ID NO: 1352732 - RNA, 14 nt, Mycobacterium tuberculosis H37Rv
ccugccacccggcc

SEQ ID NO: 1352733 - RNA, 14 nt, Mycobacterium tuberculosis H37Rv
ccugccaccggcgc

SEQ ID NO: 1352734 - RNA, 20 nt, Mycobacterium tuberculosis H37Rv
ccugcaggaucaaaaccucg

SEQ ID NO: 1352735 - RNA, 14 nt, Mycobacterium tuberculosis H37Rv
ccugcagcucgggc

SEQ ID NO: 1352736 - RNA, 23 nt, Mycobacterium tuberculosis H37Rv
ccugcagcgaaacaccggccagc

SEQ ID NO: 1352737 - RNA, 15 nt, Mycobacterium tuberculosis H37Rv
ccugcaggccgccgg

SEQ ID NO: 1352738 - RNA, 12 nt, Mycobacterium tuberculosis H37Rv
ccucggccgcca

SEQ ID NO: 1352739 - RNA, 13 nt, Mycobacterium tuberculosis H37Rv
ccucggccgccug

SEQ ID NO: 1352740 - RNA, 13 nt, Mycobacterium tuberculosis H37Rv
ccucggccgcccg

SEQ ID NO: 1352741 - RNA, 18 nt, Mycobacterium tuberculosis H37Rv
ccucggccgccagcccca

SEQ ID NO: 1352742 - RNA, 15 nt, Mycobacterium tuberculosis H37Rv
ccucggcgaccuggc

SEQ ID NO: 1352743 - RNA, 18 nt, Mycobacterium tuberculosis H37Rv
ccucggcgaucaauugcc

SEQ ID NO: 1352744 - RNA, 13 nt, Mycobacterium tuberculosis H37Rv
ccucggccgccau

SEQ ID NO: 1352745 - RNA, 18 nt, Mycobacterium tuberculosis H37Rv
ccucggccucgucgugca

SEQ ID NO: 1352746 - RNA, 14 nt, Mycobacterium tuberculosis H37Rv
ccucggcaaccacc

SEQ ID NO: 1352747 - RNA, 21 nt, Mycobacterium tuberculosis H37Rv
ccucggccagcgucagcuguu

SEQ ID NO: 1352748 - RNA, 15 nt, Mycobacterium tuberculosis H37Rv
ccucggcaugcagcc

SEQ ID NO: 1352749 - RNA, 13 nt, Mycobacterium tuberculosis H37Rv
ccucggccacccg

SEQ ID NO: 1352750 - RNA, 19 nt, Mycobacterium tuberculosis H37Rv
ccucgucgaucgccgcgcc

SEQ ID NO: 1352751 - RNA, 22 nt, Mycobacterium tuberculosis H37Rv
ccucgucgcgggccaccgcugu

SEQ ID NO: 1352752 - RNA, 16 nt, Mycobacterium tuberculosis H37Rv
ccucgucgcucccggu

SEQ ID NO: 1352753 - RNA, 15 nt, Mycobacterium tuberculosis H37Rv
ccucgucgccgcggu

SEQ ID NO: 1352754 - RNA, 15 nt, Mycobacterium tuberculosis H37Rv
ccucgucgccuagcc

SEQ ID NO: 1352755 - RNA, 19 nt, Mycobacterium tuberculosis H37Rv
ccucgucgagcgugcgcac

SEQ ID NO: 1352756 - RNA, 16 nt, Mycobacterium tuberculosis H37Rv
ccucgucgauguucgc

SEQ ID NO: 1352757 - RNA, 19 nt, Mycobacterium tuberculosis H37Rv
ccucgucgagguccucguc

SEQ ID NO: 1352758 - RNA, 23 nt, Mycobacterium tuberculosis H37Rv
ccucguccugcgagaggugcugc

SEQ ID NO: 1352759 - RNA, 17 nt, Mycobacterium tuberculosis H37Rv
ccucgucaaucaccacc

SEQ ID NO: 1352760 - RNA, 16 nt, Mycobacterium tuberculosis H37Rv
ccucgucccacagguu

SEQ ID NO: 1352761 - RNA, 13 nt, Mycobacterium tuberculosis H37Rv
ccucggcgccgcc

SEQ ID NO: 1352762 - RNA, 16 nt, Mycobacterium tuberculosis H37Rv
ccucggcgaugucgcg

SEQ ID NO: 1352763 - RNA, 18 nt, Mycobacterium tuberculosis H37Rv
ccucggcgaugggccggu

SEQ ID NO: 1352764 - RNA, 16 nt, Mycobacterium tuberculosis H37Rv
ccucggcgccgcccag

SEQ ID NO: 1352765 - RNA, 21 nt, Mycobacterium tuberculosis H37Rv
ccucuagcuugacaacccugu

SEQ ID NO: 1352766 - RNA, 18 nt, Mycobacterium tuberculosis H37Rv
ccucugucuucagcugcg

SEQ ID NO: 1352767 - RNA, 12 nt, Mycobacterium tuberculosis H37Rv
ccucugcucagc

SEQ ID NO: 1352768 - RNA, 19 nt, Mycobacterium tuberculosis H37Rv
ccucugggcuguccuccug

SEQ ID NO: 1352769 - RNA, 23 nt, Mycobacterium tuberculosis H37Rv
ccucgaugcggguggcgccggug

SEQ ID NO: 1352770 - RNA, 17 nt, Mycobacterium tuberculosis H37Rv
ccucgauggaccgccag

SEQ ID NO: 1352771 - RNA, 16 nt, Mycobacterium tuberculosis H37Rv
ccucgauggcguccau

SEQ ID NO: 1352772 - RNA, 15 nt, Mycobacterium tuberculosis H37Rv
ccucgcaggugguga

SEQ ID NO: 1352773 - RNA, 16 nt, Mycobacterium tuberculosis H37Rv
ccucgauggucucccg

SEQ ID NO: 1352774 - RNA, 21 nt, Mycobacterium tuberculosis H37Rv
ccucgcccagcaaggcccgaa

SEQ ID NO: 1352775 - RNA, 14 nt, Mycobacterium tuberculosis H37Rv
ccucgccgcacgcc

SEQ ID NO: 1352776 - RNA, 21 nt, Mycobacterium tuberculosis H37Rv
ccucgcccucccgggcccgcu

SEQ ID NO: 1352777 - RNA, 13 nt, Mycobacterium tuberculosis H37Rv
ccucgcccagcaa

SEQ ID NO: 1352778 - RNA, 20 nt, Mycobacterium tuberculosis H37Rv
ccucgccaucgaccuugagc

SEQ ID NO: 1352779 - RNA, 15 nt, Mycobacterium tuberculosis H37Rv
ccucgccgcgcguga

SEQ ID NO: 1352780 - RNA, 15 nt, Mycobacterium tuberculosis H37Rv
ccucgccugcacgcc

SEQ ID NO: 1352781 - RNA, 19 nt, Mycobacterium tuberculosis H37Rv
ccucgccugcacgcccggc

SEQ ID NO: 1352782 - RNA, 23 nt, Mycobacterium tuberculosis H37Rv
ccucgccugcccgaaccaccacc

SEQ ID NO: 1352783 - RNA, 15 nt, Mycobacterium tuberculosis H37Rv
ccucgccggccgcca

SEQ ID NO: 1352784 - RNA, 16 nt, Mycobacterium tuberculosis H37Rv
ccucgccggccgccag

SEQ ID NO: 1352785 - RNA, 19 nt, Mycobacterium tuberculosis H37Rv
ccucggacugcagcgcggc

SEQ ID NO: 1352786 - RNA, 15 nt, Mycobacterium tuberculosis H37Rv
ccucggacugcagcg

SEQ ID NO: 1352787 - RNA, 22 nt, Mycobacterium tuberculosis H37Rv
ccucgcgaaauaacggagcggc

SEQ ID NO: 1352788 - RNA, 21 nt, Mycobacterium tuberculosis H37Rv
ccucagcgcgguccaucccga

SEQ ID NO: 1352789 - RNA, 18 nt, Mycobacterium tuberculosis H37Rv
ccucagcccgucagccga

SEQ ID NO: 1352790 - RNA, 19 nt, Mycobacterium tuberculosis H37Rv
ccucagccgccugucgggc

SEQ ID NO: 1352791 - RNA, 17 nt, Mycobacterium tuberculosis H37Rv
ccucagccggcggcugg

SEQ ID NO: 1352792 - RNA, 20 nt, Mycobacterium tuberculosis H37Rv
ccucagccaccgcggucagc

SEQ ID NO: 1352793 - RNA, 13 nt, Mycobacterium tuberculosis H37Rv
ccucgagcuugcc

SEQ ID NO: 1352794 - RNA, 18 nt, Mycobacterium tuberculosis H37Rv
ccucgagcugcuggcgcg

SEQ ID NO: 1352795 - RNA, 17 nt, Mycobacterium tuberculosis H37Rv
ccucgagcuugccgucg

SEQ ID NO: 1352796 - RNA, 13 nt, Mycobacterium tuberculosis H37Rv
ccucgagcggcag

SEQ ID NO: 1352797 - RNA, 14 nt, Mycobacterium tuberculosis H37Rv
ccucgagcggcaga

SEQ ID NO: 1352798 - RNA, 16 nt, Mycobacterium tuberculosis H37Rv
ccucgacuucggcggg

SEQ ID NO: 1352799 - RNA, 22 nt, Mycobacterium tuberculosis H37Rv
ccucgaguucgggcugcggcag

SEQ ID NO: 1352800 - RNA, 14 nt, Mycobacterium tuberculosis H37Rv
ccucgagugccgcc

SEQ ID NO: 1352801 - RNA, 15 nt, Mycobacterium tuberculosis H37Rv
ccucgagugccgccg

SEQ ID NO: 1352802 - RNA, 20 nt, Mycobacterium tuberculosis H37Rv
ccucgauaggugagcgcggg

SEQ ID NO: 1352803 - RNA, 16 nt, Mycobacterium tuberculosis H37Rv
ccucgaucacggcggc

SEQ ID NO: 1352804 - RNA, 20 nt, Mycobacterium tuberculosis H37Rv
ccucgaucgacucgaaccgu

SEQ ID NO: 1352805 - RNA, 17 nt, Mycobacterium tuberculosis H37Rv
ccucgaugccgcccgug

SEQ ID NO: 1352806 - RNA, 14 nt, Mycobacterium tuberculosis H37Rv
ccugggaaacuggg

SEQ ID NO: 1352807 - RNA, 15 nt, Mycobacterium tuberculosis H37Rv
ccugggcaaacuggg

SEQ ID NO: 1352808 - RNA, 19 nt, Mycobacterium tuberculosis H37Rv
ccugguccaggcccuggcc

SEQ ID NO: 1352809 - RNA, 23 nt, Mycobacterium tuberculosis H37Rv
ccugguccggaucacuuucgaag

SEQ ID NO: 1352810 - RNA, 17 nt, Mycobacterium tuberculosis H37Rv
ccuggcuacgcgcgccc

SEQ ID NO: 1352811 - RNA, 15 nt, Mycobacterium tuberculosis H37Rv
ccuggcuggucagga

SEQ ID NO: 1352812 - RNA, 16 nt, Mycobacterium tuberculosis H37Rv
ccuggucgagcacgcu

SEQ ID NO: 1352813 - RNA, 13 nt, Mycobacterium tuberculosis H37Rv
ccugguggcggga

SEQ ID NO: 1352814 - RNA, 14 nt, Mycobacterium tuberculosis H37Rv
ccuggugucgaucg

SEQ ID NO: 1352815 - RNA, 13 nt, Mycobacterium tuberculosis H37Rv
ccugguggcagac

SEQ ID NO: 1352816 - RNA, 23 nt, Mycobacterium tuberculosis H37Rv
ccuggcgacgcgacacacgccgc

SEQ ID NO: 1352817 - RNA, 16 nt, Mycobacterium tuberculosis H37Rv
ccuggccugcccagca

SEQ ID NO: 1352818 - RNA, 18 nt, Mycobacterium tuberculosis H37Rv
ccuggcgaacucgcgcag

SEQ ID NO: 1352819 - RNA, 19 nt, Mycobacterium tuberculosis H37Rv
ccuggccgcccuggccgcc

SEQ ID NO: 1352820 - RNA, 15 nt, Mycobacterium tuberculosis H37Rv
ccuggccgggaccgc

SEQ ID NO: 1352821 - RNA, 22 nt, Mycobacterium tuberculosis H37Rv
ccuggccagcagagcggcacgc

SEQ ID NO: 1352822 - RNA, 18 nt, Mycobacterium tuberculosis H37Rv
ccuggacaaccucgucga

SEQ ID NO: 1352823 - RNA, 23 nt, Mycobacterium tuberculosis H37Rv
ccuggaaguacacggcggcccgc

SEQ ID NO: 1352824 - RNA, 16 nt, Mycobacterium tuberculosis H37Rv
ccuggaauccaggagc

SEQ ID NO: 1352825 - RNA, 20 nt, Mycobacterium tuberculosis H37Rv
ccuggaaugccgccacaaag

SEQ ID NO: 1352826 - RNA, 20 nt, Mycobacterium tuberculosis H37Rv
ccuggcccgauaaaugccgc

SEQ ID NO: 1352827 - RNA, 19 nt, Mycobacterium tuberculosis H37Rv
ccuggccgccggcgccgcc

SEQ ID NO: 1352828 - RNA, 13 nt, Mycobacterium tuberculosis H37Rv
ccugcucauccac

SEQ ID NO: 1352829 - RNA, 13 nt, Mycobacterium tuberculosis H37Rv
ccugcccagcacc

SEQ ID NO: 1352830 - RNA, 19 nt, Mycobacterium tuberculosis H37Rv
ccugcucgcagcgggcgaa

SEQ ID NO: 1352831 - RNA, 14 nt, Mycobacterium tuberculosis H37Rv
ccugcccaccuucg

SEQ ID NO: 1352832 - RNA, 16 nt, Mycobacterium tuberculosis H37Rv
ccugccaguccgcagc

SEQ ID NO: 1352833 - RNA, 13 nt, Mycobacterium tuberculosis H37Rv
ccugccaguccug

SEQ ID NO: 1352834 - RNA, 22 nt, Mycobacterium tuberculosis H37Rv
ccugccauaggcccacggcagc

SEQ ID NO: 1352835 - RNA, 14 nt, Mycobacterium tuberculosis H37Rv
ccugccaguccgca

SEQ ID NO: 1352836 - RNA, 17 nt, Mycobacterium tuberculosis H37Rv
ccugcuggugucggcuc

SEQ ID NO: 1352837 - RNA, 14 nt, Mycobacterium tuberculosis H37Rv
ccugcugcugcagc

SEQ ID NO: 1352838 - RNA, 19 nt, Mycobacterium tuberculosis H37Rv
ccugcuggcccugcuccuc

SEQ ID NO: 1352839 - RNA, 14 nt, Mycobacterium tuberculosis H37Rv
ccugcuggcccugc

SEQ ID NO: 1352840 - RNA, 14 nt, Mycobacterium tuberculosis H37Rv
ccugcuggccgcgg

SEQ ID NO: 1352841 - RNA, 12 nt, Mycobacterium tuberculosis H37Rv
ccugcuggagca

SEQ ID NO: 1352842 - RNA, 15 nt, Mycobacterium tuberculosis H37Rv
ccugcuggaucucgg

SEQ ID NO: 1352843 - RNA, 19 nt, Mycobacterium tuberculosis H37Rv
ccuggaacugcaugguggc

SEQ ID NO: 1352844 - RNA, 16 nt, Mycobacterium tuberculosis H37Rv
ccuguucgccgucgcu

SEQ ID NO: 1352845 - RNA, 23 nt, Mycobacterium tuberculosis H37Rv
ccuguuguugucggugucgguga

SEQ ID NO: 1352846 - RNA, 21 nt, Mycobacterium tuberculosis H37Rv
ccuguuggcaugccgcccgcu

SEQ ID NO: 1352847 - RNA, 21 nt, Mycobacterium tuberculosis H37Rv
ccuguuugagcgcacucaccu

SEQ ID NO: 1352848 - RNA, 23 nt, Mycobacterium tuberculosis H37Rv
ccuucagcacggugaucagcagc

SEQ ID NO: 1352849 - RNA, 15 nt, Mycobacterium tuberculosis H37Rv
ccuucagccagucca

SEQ ID NO: 1352850 - RNA, 19 nt, Mycobacterium tuberculosis H37Rv
ccuucacgcuggccuccag

SEQ ID NO: 1352851 - RNA, 23 nt, Mycobacterium tuberculosis H37Rv
ccuuaucgcucucggucaguucc

SEQ ID NO: 1352852 - RNA, 11 nt, Mycobacterium tuberculosis H37Rv
ccuuauugccg

SEQ ID NO: 1352853 - RNA, 21 nt, Mycobacterium tuberculosis H37Rv
ccuuauugccgagcucggcua

SEQ ID NO: 1352854 - RNA, 22 nt, Mycobacterium tuberculosis H37Rv
caggcaguccaccgcgcggcgc

SEQ ID NO: 1352855 - RNA, 17 nt, Mycobacterium tuberculosis H37Rv
caggcagguuggccacc

SEQ ID NO: 1352856 - RNA, 15 nt, Mycobacterium tuberculosis H37Rv
caggcagggcagccc

SEQ ID NO: 1352857 - RNA, 13 nt, Mycobacterium tuberculosis H37Rv
caggccgaggcga

SEQ ID NO: 1352858 - RNA, 22 nt, Mycobacterium tuberculosis H37Rv
caggccgccaccgucaccgccg

SEQ ID NO: 1352859 - RNA, 18 nt, Mycobacterium tuberculosis H37Rv
caggccgagcccggugcu

SEQ ID NO: 1352860 - RNA, 17 nt, Mycobacterium tuberculosis H37Rv
caggccggcagcuugca

SEQ ID NO: 1352861 - RNA, 17 nt, Mycobacterium tuberculosis H37Rv
caggccggcacccacca

SEQ ID NO: 1352862 - RNA, 18 nt, Mycobacterium tuberculosis H37Rv
caggccggccaccaccgc

SEQ ID NO: 1352863 - RNA, 14 nt, Mycobacterium tuberculosis H37Rv
caggccggccacca

SEQ ID NO: 1352864 - RNA, 14 nt, Mycobacterium tuberculosis H37Rv
caggccgccugggg

SEQ ID NO: 1352865 - RNA, 21 nt, Mycobacterium tuberculosis H37Rv
caggccguagcccacgacgaa

SEQ ID NO: 1352866 - RNA, 16 nt, Mycobacterium tuberculosis H37Rv
caggccgggcgcaagc

SEQ ID NO: 1352867 - RNA, 23 nt, Mycobacterium tuberculosis H37Rv
caggccgguuugcacgcaccaca

SEQ ID NO: 1352868 - RNA, 14 nt, Mycobacterium tuberculosis H37Rv
caggccggugugcg

SEQ ID NO: 1352869 - RNA, 18 nt, Mycobacterium tuberculosis H37Rv
caggccggcggcggcgcu

SEQ ID NO: 1352870 - RNA, 15 nt, Mycobacterium tuberculosis H37Rv
caggccgggacagcg

SEQ ID NO: 1352871 - RNA, 15 nt, Mycobacterium tuberculosis H37Rv
caggccgccuggggg

SEQ ID NO: 1352872 - RNA, 17 nt, Mycobacterium tuberculosis H37Rv
caggccgcgcaugguca

SEQ ID NO: 1352873 - RNA, 23 nt, Mycobacterium tuberculosis H37Rv
caggccgcgcggacccagcaccc

SEQ ID NO: 1352874 - RNA, 15 nt, Mycobacterium tuberculosis H37Rv
caggccgcgcauggu

SEQ ID NO: 1352875 - RNA, 22 nt, Mycobacterium tuberculosis H37Rv
caggccgcgcgacaacccggcg

SEQ ID NO: 1352876 - RNA, 17 nt, Mycobacterium tuberculosis H37Rv
caggccguugccccguc

SEQ ID NO: 1352877 - RNA, 16 nt, Mycobacterium tuberculosis H37Rv
caggcgcccagcaccc

SEQ ID NO: 1352878 - RNA, 23 nt, Mycobacterium tuberculosis H37Rv
caggcgcauagggccaccgccgc

SEQ ID NO: 1352879 - RNA, 15 nt, Mycobacterium tuberculosis H37Rv
caggcgcgccgcacc

SEQ ID NO: 1352880 - RNA, 19 nt, Mycobacterium tuberculosis H37Rv
caggcgcucagcgcggcca

SEQ ID NO: 1352881 - RNA, 16 nt, Mycobacterium tuberculosis H37Rv
caggcgcucaucaccc

SEQ ID NO: 1352882 - RNA, 17 nt, Mycobacterium tuberculosis H37Rv
caggcgcgcaccaccgc

SEQ ID NO: 1352883 - RNA, 21 nt, Mycobacterium tuberculosis H37Rv
caggcgugcacaggucagcgc

SEQ ID NO: 1352884 - RNA, 23 nt, Mycobacterium tuberculosis H37Rv
caggcgugcaucgcgauuccggc

SEQ ID NO: 1352885 - RNA, 12 nt, Mycobacterium tuberculosis H37Rv
caggcgugcaca

SEQ ID NO: 1352886 - RNA, 22 nt, Mycobacterium tuberculosis H37Rv
caggcggcggccuggcacccgg

SEQ ID NO: 1352887 - RNA, 17 nt, Mycobacterium tuberculosis H37Rv
caggcggcuggcccgca

SEQ ID NO: 1352888 - RNA, 21 nt, Mycobacterium tuberculosis H37Rv
caggcggccgccgggaaauau

SEQ ID NO: 1352889 - RNA, 21 nt, Mycobacterium tuberculosis H37Rv
caggcguuuggcgugccgucg

SEQ ID NO: 1352890 - RNA, 17 nt, Mycobacterium tuberculosis H37Rv
caggcuaaucagccagg

SEQ ID NO: 1352891 - RNA, 23 nt, Mycobacterium tuberculosis H37Rv
caggggugugccguggucgaaga

SEQ ID NO: 1352892 - RNA, 18 nt, Mycobacterium tuberculosis H37Rv
cagggucgcgagcccgcc

SEQ ID NO: 1352893 - RNA, 13 nt, Mycobacterium tuberculosis H37Rv
cagggucugcuca

SEQ ID NO: 1352894 - RNA, 17 nt, Mycobacterium tuberculosis H37Rv
cagggucugcgccgccg

SEQ ID NO: 1352895 - RNA, 20 nt, Mycobacterium tuberculosis H37Rv
cagggugccggcgccgcccu

SEQ ID NO: 1352896 - RNA, 14 nt, Mycobacterium tuberculosis H37Rv
cagggugccgucgg

SEQ ID NO: 1352897 - RNA, 10 nt, Mycobacterium tuberculosis H37Rv
cagggugggc

SEQ ID NO: 1352898 - RNA, 12 nt, Mycobacterium tuberculosis H37Rv
cagggugggcuu

SEQ ID NO: 1352899 - RNA, 18 nt, Mycobacterium tuberculosis H37Rv
cagggugucgaagagcag

SEQ ID NO: 1352900 - RNA, 15 nt, Mycobacterium tuberculosis H37Rv
cagggugccggcgcc

SEQ ID NO: 1352901 - RNA, 23 nt, Mycobacterium tuberculosis H37Rv
cagggugcgcuugcggccgcgcg

SEQ ID NO: 1352902 - RNA, 21 nt, Mycobacterium tuberculosis H37Rv
cagggcgguggccacccggcc

SEQ ID NO: 1352903 - RNA, 20 nt, Mycobacterium tuberculosis H37Rv
cagggcgccgaucgugcccc

SEQ ID NO: 1352904 - RNA, 16 nt, Mycobacterium tuberculosis H37Rv
caggggacgggcggcc

SEQ ID NO: 1352905 - RNA, 14 nt, Mycobacterium tuberculosis H37Rv
caggggcuggugcu

SEQ ID NO: 1352906 - RNA, 11 nt, Mycobacterium tuberculosis H37Rv
cagggggcgag

SEQ ID NO: 1352907 - RNA, 17 nt, Mycobacterium tuberculosis H37Rv
cagggcacaucgggcgu

SEQ ID NO: 1352908 - RNA, 16 nt, Mycobacterium tuberculosis H37Rv
cagggcaacggccgcu

SEQ ID NO: 1352909 - RNA, 15 nt, Mycobacterium tuberculosis H37Rv
cagggagcggcugca

SEQ ID NO: 1352910 - RNA, 17 nt, Mycobacterium tuberculosis H37Rv
cagggagcgcagcgccg

SEQ ID NO: 1352911 - RNA, 13 nt, Mycobacterium tuberculosis H37Rv
cagggacccgaga

SEQ ID NO: 1352912 - RNA, 12 nt, Mycobacterium tuberculosis H37Rv
cagggacccgag

SEQ ID NO: 1352913 - RNA, 19 nt, Mycobacterium tuberculosis H37Rv
caggcucauccgccgggcc

SEQ ID NO: 1352914 - RNA, 21 nt, Mycobacterium tuberculosis H37Rv
cagggcccuagccggcgcgcc

SEQ ID NO: 1352915 - RNA, 22 nt, Mycobacterium tuberculosis H37Rv
cagggcccuagccggcgcgccc

SEQ ID NO: 1352916 - RNA, 12 nt, Mycobacterium tuberculosis H37Rv
cagggcccugcu

SEQ ID NO: 1352917 - RNA, 15 nt, Mycobacterium tuberculosis H37Rv
cagggcccuagccgg

SEQ ID NO: 1352918 - RNA, 20 nt, Mycobacterium tuberculosis H37Rv
cagggccgccgcgaacgggu

SEQ ID NO: 1352919 - RNA, 16 nt, Mycobacterium tuberculosis H37Rv
cagggccgccgaagcu

SEQ ID NO: 1352920 - RNA, 22 nt, Mycobacterium tuberculosis H37Rv
cagggccgcaguggcaagcugu

SEQ ID NO: 1352921 - RNA, 14 nt, Mycobacterium tuberculosis H37Rv
cagggccgcgcgca

SEQ ID NO: 1352922 - RNA, 17 nt, Mycobacterium tuberculosis H37Rv
cagggccagcggcagcc

SEQ ID NO: 1352923 - RNA, 22 nt, Mycobacterium tuberculosis H37Rv
cagggccgcucgccucgauggc

SEQ ID NO: 1352924 - RNA, 16 nt, Mycobacterium tuberculosis H37Rv
cagggccuccacccgc

SEQ ID NO: 1352925 - RNA, 20 nt, Mycobacterium tuberculosis H37Rv
cagggccuccacccgccacg

SEQ ID NO: 1352926 - RNA, 17 nt, Mycobacterium tuberculosis H37Rv
cagcuccacuggcgucu

SEQ ID NO: 1352927 - RNA, 12 nt, Mycobacterium tuberculosis H37Rv
cagcuccaccag

SEQ ID NO: 1352928 - RNA, 16 nt, Mycobacterium tuberculosis H37Rv
cagcuccccgaccgaa

SEQ ID NO: 1352929 - RNA, 15 nt, Mycobacterium tuberculosis H37Rv
cagcucccgcggcgc

SEQ ID NO: 1352930 - RNA, 17 nt, Mycobacterium tuberculosis H37Rv
cagcucccgcggcgcca

SEQ ID NO: 1352931 - RNA, 23 nt, Mycobacterium tuberculosis H37Rv
cagcucccgcggcgccacccgcg

SEQ ID NO: 1352932 - RNA, 14 nt, Mycobacterium tuberculosis H37Rv
cagcuccggcgcuc

SEQ ID NO: 1352933 - RNA, 19 nt, Mycobacterium tuberculosis H37Rv
cagcuccggcgcuccacug

SEQ ID NO: 1352934 - RNA, 14 nt, Mycobacterium tuberculosis H37Rv
cagcuccgccgccg

SEQ ID NO: 1352935 - RNA, 19 nt, Mycobacterium tuberculosis H37Rv
cagcuccucagccaccgcg

SEQ ID NO: 1352936 - RNA, 18 nt, Mycobacterium tuberculosis H37Rv
cagcuccgugacaccggg

SEQ ID NO: 1352937 - RNA, 14 nt, Mycobacterium tuberculosis H37Rv
cagcuccucagcca

SEQ ID NO: 1352938 - RNA, 23 nt, Mycobacterium tuberculosis H37Rv
cagcucgcgcacccagcccagcc

SEQ ID NO: 1352939 - RNA, 16 nt, Mycobacterium tuberculosis H37Rv
cagcucgccgugacca

SEQ ID NO: 1352940 - RNA, 12 nt, Mycobacterium tuberculosis H37Rv
cagcucgccggc

SEQ ID NO: 1352941 - RNA, 13 nt, Mycobacterium tuberculosis H37Rv
cagcucgccagcc

SEQ ID NO: 1352942 - RNA, 13 nt, Mycobacterium tuberculosis H37Rv
cagcucgccaggg

SEQ ID NO: 1352943 - RNA, 13 nt, Mycobacterium tuberculosis H37Rv
cagcuagcccggc

SEQ ID NO: 1352944 - RNA, 17 nt, Mycobacterium tuberculosis H37Rv
cagcuagcccggcagca

SEQ ID NO: 1352945 - RNA, 20 nt, Mycobacterium tuberculosis H37Rv
cagcuagcccggcagcacgu

SEQ ID NO: 1352946 - RNA, 12 nt, Mycobacterium tuberculosis H37Rv
cagcggcgcgcu

SEQ ID NO: 1352947 - RNA, 23 nt, Mycobacterium tuberculosis H37Rv
cagcggcggcaacccugcccggc

SEQ ID NO: 1352948 - RNA, 18 nt, Mycobacterium tuberculosis H37Rv
cagcggcggccacggcca

SEQ ID NO: 1352949 - RNA, 21 nt, Mycobacterium tuberculosis H37Rv
cagcggcggaaggacggcagc

SEQ ID NO: 1352950 - RNA, 15 nt, Mycobacterium tuberculosis H37Rv
cagcggcgcgcugca

SEQ ID NO: 1352951 - RNA, 17 nt, Mycobacterium tuberculosis H37Rv
cagcggcgccgccugga

SEQ ID NO: 1352952 - RNA, 20 nt, Mycobacterium tuberculosis H37Rv
cagcggcccuaucuggcggc

SEQ ID NO: 1352953 - RNA, 16 nt, Mycobacterium tuberculosis H37Rv
cagcggccgggcggcc

SEQ ID NO: 1352954 - RNA, 14 nt, Mycobacterium tuberculosis H37Rv
cagcggcgccacgu

SEQ ID NO: 1352955 - RNA, 16 nt, Mycobacterium tuberculosis H37Rv
cagcuggacuccgguc

SEQ ID NO: 1352956 - RNA, 15 nt, Mycobacterium tuberculosis H37Rv
cagcuggcgcagccu

SEQ ID NO: 1352957 - RNA, 12 nt, Mycobacterium tuberculosis H37Rv
cagcuggccacu

SEQ ID NO: 1352958 - RNA, 18 nt, Mycobacterium tuberculosis H37Rv
cagcuggcgaaugcgggc

SEQ ID NO: 1352959 - RNA, 19 nt, Mycobacterium tuberculosis H37Rv
cagcugcugccgauacagc

SEQ ID NO: 1352960 - RNA, 14 nt, Mycobacterium tuberculosis H37Rv
cagcugcugccgau

SEQ ID NO: 1352961 - RNA, 11 nt, Mycobacterium tuberculosis H37Rv
cagcugcugcc

SEQ ID NO: 1352962 - RNA, 16 nt, Mycobacterium tuberculosis H37Rv
cagcucgucgcugaac

SEQ ID NO: 1352963 - RNA, 20 nt, Mycobacterium tuberculosis H37Rv
cagcucgucggcgauggcca

SEQ ID NO: 1352964 - RNA, 15 nt, Mycobacterium tuberculosis H37Rv
cagcucgggcaugaa

SEQ ID NO: 1352965 - RNA, 22 nt, Mycobacterium tuberculosis H37Rv
cagcucgguggcaucggcggcc

SEQ ID NO: 1352966 - RNA, 20 nt, Mycobacterium tuberculosis H37Rv
cagcucggccgaggcggucu

SEQ ID NO: 1352967 - RNA, 16 nt, Mycobacterium tuberculosis H37Rv
cagcucggccgaggcg

SEQ ID NO: 1352968 - RNA, 21 nt, Mycobacterium tuberculosis H37Rv
cagcucggaucgguuccggcc

SEQ ID NO: 1352969 - RNA, 15 nt, Mycobacterium tuberculosis H37Rv
cagcugucgggcagc

SEQ ID NO: 1352970 - RNA, 18 nt, Mycobacterium tuberculosis H37Rv
cagcuguugucgcggaag

SEQ ID NO: 1352971 - RNA, 22 nt, Mycobacterium tuberculosis H37Rv
cagcuuagccgcagcuuggccu

SEQ ID NO: 1352972 - RNA, 21 nt, Mycobacterium tuberculosis H37Rv
caggacgcccacaugcucagg

SEQ ID NO: 1352973 - RNA, 13 nt, Mycobacterium tuberculosis H37Rv
caggacgacugga

SEQ ID NO: 1352974 - RNA, 22 nt, Mycobacterium tuberculosis H37Rv
caggacgacuggaaggcgggca

SEQ ID NO: 1352975 - RNA, 19 nt, Mycobacterium tuberculosis H37Rv
caggaccaacuguggugga

SEQ ID NO: 1352976 - RNA, 22 nt, Mycobacterium tuberculosis H37Rv
caggaccgggaucgucaggccc

SEQ ID NO: 1352977 - RNA, 18 nt, Mycobacterium tuberculosis H37Rv
caggaccgggauucccaa

SEQ ID NO: 1352978 - RNA, 20 nt, Mycobacterium tuberculosis H37Rv
caggaccggugggucugcuc

SEQ ID NO: 1352979 - RNA, 14 nt, Mycobacterium tuberculosis H37Rv
caggaccagcaccg

SEQ ID NO: 1352980 - RNA, 20 nt, Mycobacterium tuberculosis H37Rv
cagcuugcccgagcccagcc

SEQ ID NO: 1352981 - RNA, 21 nt, Mycobacterium tuberculosis H37Rv
cagcuugcagugccgccggcc

SEQ ID NO: 1352982 - RNA, 13 nt, Mycobacterium tuberculosis H37Rv
cagcuugacccac

SEQ ID NO: 1352983 - RNA, 20 nt, Mycobacterium tuberculosis H37Rv
cagcuugaugucuuuggcgu

SEQ ID NO: 1352984 - RNA, 12 nt, Mycobacterium tuberculosis H37Rv
caggaacgccgu

SEQ ID NO: 1352985 - RNA, 15 nt, Mycobacterium tuberculosis H37Rv
caggaacucggccca

SEQ ID NO: 1352986 - RNA, 19 nt, Mycobacterium tuberculosis H37Rv
caggaacucggcccacacg

SEQ ID NO: 1352987 - RNA, 15 nt, Mycobacterium tuberculosis H37Rv
caggaagaagccgaa

SEQ ID NO: 1352988 - RNA, 14 nt, Mycobacterium tuberculosis H37Rv
caggaagucccggg

SEQ ID NO: 1352989 - RNA, 21 nt, Mycobacterium tuberculosis H37Rv
caggagaauuaguuucguccc

SEQ ID NO: 1352990 - RNA, 22 nt, Mycobacterium tuberculosis H37Rv
caggagcaccucgaagugcagg

SEQ ID NO: 1352991 - RNA, 11 nt, Mycobacterium tuberculosis H37Rv
caggagcagca

SEQ ID NO: 1352992 - RNA, 18 nt, Mycobacterium tuberculosis H37Rv
caggacuggcaccgccag

SEQ ID NO: 1352993 - RNA, 22 nt, Mycobacterium tuberculosis H37Rv
caggacuggcaccgccagccac

SEQ ID NO: 1352994 - RNA, 16 nt, Mycobacterium tuberculosis H37Rv
caggacuccggccgca

SEQ ID NO: 1352995 - RNA, 19 nt, Mycobacterium tuberculosis H37Rv
caggacucgcguccucggg

SEQ ID NO: 1352996 - RNA, 16 nt, Mycobacterium tuberculosis H37Rv
caggacguggucggga

SEQ ID NO: 1352997 - RNA, 14 nt, Mycobacterium tuberculosis H37Rv
caggacgcgggcua

SEQ ID NO: 1352998 - RNA, 15 nt, Mycobacterium tuberculosis H37Rv
caggagccuccagcg

SEQ ID NO: 1352999 - RNA, 18 nt, Mycobacterium tuberculosis H37Rv
caggagccuccagcgcac

SEQ ID NO: 1353000 - RNA, 18 nt, Mycobacterium tuberculosis H37Rv
caggaguuugaccaccug

SEQ ID NO: 1353001 - RNA, 16 nt, Mycobacterium tuberculosis H37Rv
caggauguucaauccc

SEQ ID NO: 1353002 - RNA, 14 nt, Mycobacterium tuberculosis H37Rv
caggauucccaguc

SEQ ID NO: 1353003 - RNA, 16 nt, Mycobacterium tuberculosis H37Rv
caggauucccagucca

SEQ ID NO: 1353004 - RNA, 17 nt, Mycobacterium tuberculosis H37Rv
caggaucgcuacgucga

SEQ ID NO: 1353005 - RNA, 22 nt, Mycobacterium tuberculosis H37Rv
caggaucgccugagcgccgcgg

SEQ ID NO: 1353006 - RNA, 20 nt, Mycobacterium tuberculosis H37Rv
caggaucgccugagcgccgc

SEQ ID NO: 1353007 - RNA, 17 nt, Mycobacterium tuberculosis H37Rv
caggaucgaggcgucgg

SEQ ID NO: 1353008 - RNA, 22 nt, Mycobacterium tuberculosis H37Rv
caggauggugcggccgcggcga

SEQ ID NO: 1353009 - RNA, 21 nt, Mycobacterium tuberculosis H37Rv
caggauguguugccagaucag

SEQ ID NO: 1353010 - RNA, 14 nt, Mycobacterium tuberculosis H37Rv
cagucgggcagcgc

SEQ ID NO: 1353011 - RNA, 22 nt, Mycobacterium tuberculosis H37Rv
cagucgcgguaccaucaccgcg

SEQ ID NO: 1353012 - RNA, 12 nt, Mycobacterium tuberculosis H37Rv
cagucgcggcgc

SEQ ID NO: 1353013 - RNA, 17 nt, Mycobacterium tuberculosis H37Rv
cagucgccggccggccc

SEQ ID NO: 1353014 - RNA, 14 nt, Mycobacterium tuberculosis H37Rv
cagucgagcaccug

SEQ ID NO: 1353015 - RNA, 15 nt, Mycobacterium tuberculosis H37Rv
cagucgaugagugac

SEQ ID NO: 1353016 - RNA, 15 nt, Mycobacterium tuberculosis H37Rv
cagucgaagaagacc

SEQ ID NO: 1353017 - RNA, 15 nt, Mycobacterium tuberculosis H37Rv
cagucgacaauuccc

SEQ ID NO: 1353018 - RNA, 22 nt, Mycobacterium tuberculosis H37Rv
cagucgaccggacacuccugca

SEQ ID NO: 1353019 - RNA, 22 nt, Mycobacterium tuberculosis H37Rv
cagucgaacaagaccgcggcgu

SEQ ID NO: 1353020 - RNA, 13 nt, Mycobacterium tuberculosis H37Rv
cagucacgcccac

SEQ ID NO: 1353021 - RNA, 17 nt, Mycobacterium tuberculosis H37Rv
cagucacgcccaccacu

SEQ ID NO: 1353022 - RNA, 18 nt, Mycobacterium tuberculosis H37Rv
cagugcaggcggccgcca

SEQ ID NO: 1353023 - RNA, 20 nt, Mycobacterium tuberculosis H37Rv
cagugcaucgaucaccgcuu

SEQ ID NO: 1353024 - RNA, 12 nt, Mycobacterium tuberculosis H37Rv
cagugcugccuu

SEQ ID NO: 1353025 - RNA, 22 nt, Mycobacterium tuberculosis H37Rv
cagugccagaacccggacaggg

SEQ ID NO: 1353026 - RNA, 19 nt, Mycobacterium tuberculosis H37Rv
cagugccaauuccagcccc

SEQ ID NO: 1353027 - RNA, 15 nt, Mycobacterium tuberculosis H37Rv
cagugagcaugcgac

SEQ ID NO: 1353028 - RNA, 13 nt, Mycobacterium tuberculosis H37Rv
cagugagcccgcu

SEQ ID NO: 1353029 - RNA, 15 nt, Mycobacterium tuberculosis H37Rv
cagugagccgccauu

SEQ ID NO: 1353030 - RNA, 16 nt, Mycobacterium tuberculosis H37Rv
cagugaccgcuggugu

SEQ ID NO: 1353031 - RNA, 16 nt, Mycobacterium tuberculosis H37Rv
cagugaauugcccaag

SEQ ID NO: 1353032 - RNA, 14 nt, Mycobacterium tuberculosis H37Rv
cagugaacgcgcgu

SEQ ID NO: 1353033 - RNA, 19 nt, Mycobacterium tuberculosis H37Rv
cagugaacucgugacagcg

SEQ ID NO: 1353034 - RNA, 14 nt, Mycobacterium tuberculosis H37Rv
cagugaacauuggg

SEQ ID NO: 1353035 - RNA, 19 nt, Mycobacterium tuberculosis H37Rv
cagugaacauuggguaccu

SEQ ID NO: 1353036 - RNA, 20 nt, Mycobacterium tuberculosis H37Rv
cagugaaauugccgccgccg

SEQ ID NO: 1353037 - RNA, 23 nt, Mycobacterium tuberculosis H37Rv
caguacuaacaacaccaccagca

SEQ ID NO: 1353038 - RNA, 19 nt, Mycobacterium tuberculosis H37Rv
caguacuaacaacaccacc

SEQ ID NO: 1353039 - RNA, 14 nt, Mycobacterium tuberculosis H37Rv
caguacaccggcgu

SEQ ID NO: 1353040 - RNA, 18 nt, Mycobacterium tuberculosis H37Rv
cagucaacagggccagga

SEQ ID NO: 1353041 - RNA, 19 nt, Mycobacterium tuberculosis H37Rv
cagucaacucccgaacacu

SEQ ID NO: 1353042 - RNA, 22 nt, Mycobacterium tuberculosis H37Rv
cagguguccccgcccggccagc

SEQ ID NO: 1353043 - RNA, 17 nt, Mycobacterium tuberculosis H37Rv
caggugucgcugcugaa

SEQ ID NO: 1353044 - RNA, 20 nt, Mycobacterium tuberculosis H37Rv
cagguguuggacgccuugca

SEQ ID NO: 1353045 - RNA, 17 nt, Mycobacterium tuberculosis H37Rv
caggugugugccucagu

SEQ ID NO: 1353046 - RNA, 14 nt, Mycobacterium tuberculosis H37Rv
cagguugccgucgg

SEQ ID NO: 1353047 - RNA, 15 nt, Mycobacterium tuberculosis H37Rv
cagguuggccaccgc

SEQ ID NO: 1353048 - RNA, 15 nt, Mycobacterium tuberculosis H37Rv
cagguuggccccggc

SEQ ID NO: 1353049 - RNA, 19 nt, Mycobacterium tuberculosis H37Rv
cagguugcguugcaggaaa

SEQ ID NO: 1353050 - RNA, 17 nt, Mycobacterium tuberculosis H37Rv
caggugcgcgaccagga

SEQ ID NO: 1353051 - RNA, 15 nt, Mycobacterium tuberculosis H37Rv
caggugccuucuucg

SEQ ID NO: 1353052 - RNA, 14 nt, Mycobacterium tuberculosis H37Rv
caggugcucgucga

SEQ ID NO: 1353053 - RNA, 19 nt, Mycobacterium tuberculosis H37Rv
caggugcguccaggccagg

SEQ ID NO: 1353054 - RNA, 18 nt, Mycobacterium tuberculosis H37Rv
caggugggccgagagcag

SEQ ID NO: 1353055 - RNA, 16 nt, Mycobacterium tuberculosis H37Rv
cagguggccgucgccg

SEQ ID NO: 1353056 - RNA, 18 nt, Mycobacterium tuberculosis H37Rv
cagguggccgcaucgccu

SEQ ID NO: 1353057 - RNA, 14 nt, Mycobacterium tuberculosis H37Rv
cagguggccgucgc

SEQ ID NO: 1353058 - RNA, 15 nt, Mycobacterium tuberculosis H37Rv
cagguggccaggccg

SEQ ID NO: 1353059 - RNA, 20 nt, Mycobacterium tuberculosis H37Rv
cagggugucgaagagcaggc

SEQ ID NO: 1353060 - RNA, 21 nt, Mycobacterium tuberculosis H37Rv
caggguguucacguucagccc

SEQ ID NO: 1353061 - RNA, 18 nt, Mycobacterium tuberculosis H37Rv
cagggugugcgaacaagu

SEQ ID NO: 1353062 - RNA, 19 nt, Mycobacterium tuberculosis H37Rv
cagggugugcgucugcggc

SEQ ID NO: 1353063 - RNA, 12 nt, Mycobacterium tuberculosis H37Rv
cauaacagcugg

SEQ ID NO: 1353064 - RNA, 17 nt, Mycobacterium tuberculosis H37Rv
caguuggcaccagccgg

SEQ ID NO: 1353065 - RNA, 19 nt, Mycobacterium tuberculosis H37Rv
caguugguagccgcccucc

SEQ ID NO: 1353066 - RNA, 20 nt, Mycobacterium tuberculosis H37Rv
caguugcacaccggcacugc

SEQ ID NO: 1353067 - RNA, 18 nt, Mycobacterium tuberculosis H37Rv
caguugccgguugccacc

SEQ ID NO: 1353068 - RNA, 17 nt, Mycobacterium tuberculosis H37Rv
caguuggaacugaugaa

SEQ ID NO: 1353069 - RNA, 15 nt, Mycobacterium tuberculosis H37Rv
caguuggaacugccc

SEQ ID NO: 1353070 - RNA, 15 nt, Mycobacterium tuberculosis H37Rv
caguugcgcuccaac

SEQ ID NO: 1353071 - RNA, 16 nt, Mycobacterium tuberculosis H37Rv
caguugcgcuccaaca

SEQ ID NO: 1353072 - RNA, 23 nt, Mycobacterium tuberculosis H37Rv
cagugugcgguuggaucggcggc

SEQ ID NO: 1353073 - RNA, 16 nt, Mycobacterium tuberculosis H37Rv
cagugugggggucagg

SEQ ID NO: 1353074 - RNA, 21 nt, Mycobacterium tuberculosis H37Rv
caguguugcgcugcggccagc

SEQ ID NO: 1353075 - RNA, 14 nt, Mycobacterium tuberculosis H37Rv
caguuaaagguggu

SEQ ID NO: 1353076 - RNA, 18 nt, Mycobacterium tuberculosis H37Rv
caguguuguucgggcugc

SEQ ID NO: 1353077 - RNA, 16 nt, Mycobacterium tuberculosis H37Rv
caguugaacucgacca

SEQ ID NO: 1353078 - RNA, 16 nt, Mycobacterium tuberculosis H37Rv
caguugauccugcagu

SEQ ID NO: 1353079 - RNA, 21 nt, Mycobacterium tuberculosis H37Rv
cauacaggcccgccagcaggg

SEQ ID NO: 1353080 - RNA, 20 nt, Mycobacterium tuberculosis H37Rv
cauacaucgccuugcccagc

SEQ ID NO: 1353081 - RNA, 15 nt, Mycobacterium tuberculosis H37Rv
cauacagcgcccgga

SEQ ID NO: 1353082 - RNA, 16 nt, Mycobacterium tuberculosis H37Rv
cauaccccgaacauug

SEQ ID NO: 1353083 - RNA, 16 nt, Mycobacterium tuberculosis H37Rv
cauaaccggcgcgccc

SEQ ID NO: 1353084 - RNA, 21 nt, Mycobacterium tuberculosis H37Rv
cauaaccggcgcgccccgccg

SEQ ID NO: 1353085 - RNA, 13 nt, Mycobacterium tuberculosis H37Rv
cauaaccgguggg

SEQ ID NO: 1353086 - RNA, 15 nt, Mycobacterium tuberculosis H37Rv
cauaacugcggccca

SEQ ID NO: 1353087 - RNA, 17 nt, Mycobacterium tuberculosis H37Rv
cauaccguucacccagc

SEQ ID NO: 1353088 - RNA, 23 nt, Mycobacterium tuberculosis H37Rv
cauaccgaugguggugccaaccu

SEQ ID NO: 1353089 - RNA, 16 nt, Mycobacterium tuberculosis H37Rv
cauacgcgcugacccg

SEQ ID NO: 1353090 - RNA, 20 nt, Mycobacterium tuberculosis H37Rv
cauacgcgcugacccgccac

SEQ ID NO: 1353091 - RNA, 15 nt, Mycobacterium tuberculosis H37Rv
cauacgaaacaugcg

SEQ ID NO: 1353092 - RNA, 20 nt, Mycobacterium tuberculosis H37Rv
cauacgagcagugaccgcug

SEQ ID NO: 1353093 - RNA, 18 nt, Mycobacterium tuberculosis H37Rv
cauacgcccacuccagca

SEQ ID NO: 1353094 - RNA, 20 nt, Mycobacterium tuberculosis H37Rv
cauacgcccacuccagcagc

SEQ ID NO: 1353095 - RNA, 22 nt, Mycobacterium tuberculosis H37Rv
cauacgcccacuccagcagcuc

SEQ ID NO: 1353096 - RNA, 16 nt, Mycobacterium tuberculosis H37Rv
cauaugccgccggcag

SEQ ID NO: 1353097 - RNA, 22 nt, Mycobacterium tuberculosis H37Rv
cauaucgugaugugcccauuca

SEQ ID NO: 1353098 - RNA, 14 nt, Mycobacterium tuberculosis H37Rv
cauaucgcccacca

SEQ ID NO: 1353099 - RNA, 12 nt, Mycobacterium tuberculosis H37Rv
caucaacugcau

SEQ ID NO: 1353100 - RNA, 19 nt, Mycobacterium tuberculosis H37Rv
caucaacugcaucaccacu

SEQ ID NO: 1353101 - RNA, 16 nt, Mycobacterium tuberculosis H37Rv
caucaacgcgggcgcu

SEQ ID NO: 1353102 - RNA, 13 nt, Mycobacterium tuberculosis H37Rv
caucaccccggcc

SEQ ID NO: 1353103 - RNA, 15 nt, Mycobacterium tuberculosis H37Rv
caucaccgcagcacc

SEQ ID NO: 1353104 - RNA, 22 nt, Mycobacterium tuberculosis H37Rv
caucaccgcagcaccggagaac

SEQ ID NO: 1353105 - RNA, 21 nt, Mycobacterium tuberculosis H37Rv
caucaaaaacgaacccaggca

SEQ ID NO: 1353106 - RNA, 14 nt, Mycobacterium tuberculosis H37Rv
cauccacgucgccc

SEQ ID NO: 1353107 - RNA, 17 nt, Mycobacterium tuberculosis H37Rv
cauccaaaaucgccuga

SEQ ID NO: 1353108 - RNA, 13 nt, Mycobacterium tuberculosis H37Rv
cauccaccgaugg

SEQ ID NO: 1353109 - RNA, 23 nt, Mycobacterium tuberculosis H37Rv
cauccaccgcagauccccgccac

SEQ ID NO: 1353110 - RNA, 22 nt, Mycobacterium tuberculosis H37Rv
caucaucuggucgaccaucggu

SEQ ID NO: 1353111 - RNA, 14 nt, Mycobacterium tuberculosis H37Rv
caucaccgucgccc

SEQ ID NO: 1353112 - RNA, 16 nt, Mycobacterium tuberculosis H37Rv
caucaccgccagcccc

SEQ ID NO: 1353113 - RNA, 24 nt, Mycobacterium tuberculosis H37Rv
caucaccgcgccagccuccaccag

SEQ ID NO: 1353114 - RNA, 18 nt, Mycobacterium tuberculosis H37Rv
caucacgcacugauguca

SEQ ID NO: 1353115 - RNA, 11 nt, Mycobacterium tuberculosis H37Rv
caucacgcccu

SEQ ID NO: 1353116 - RNA, 22 nt, Mycobacterium tuberculosis H37Rv
caucacgccgccggaggugaca

SEQ ID NO: 1353117 - RNA, 14 nt, Mycobacterium tuberculosis H37Rv
caucacgcccacga

SEQ ID NO: 1353118 - RNA, 17 nt, Mycobacterium tuberculosis H37Rv
caucacgacucccccgg

SEQ ID NO: 1353119 - RNA, 14 nt, Mycobacterium tuberculosis H37Rv
caucaccuccgcga

SEQ ID NO: 1353120 - RNA, 18 nt, Mycobacterium tuberculosis H37Rv
caucagcgacaagugcac

SEQ ID NO: 1353121 - RNA, 15 nt, Mycobacterium tuberculosis H37Rv
caucagccgcaccag

SEQ ID NO: 1353122 - RNA, 20 nt, Mycobacterium tuberculosis H37Rv
caucagcccuucagcgaagc

SEQ ID NO: 1353123 - RNA, 23 nt, Mycobacterium tuberculosis H37Rv
caucacggcggggaucgcuggcc

SEQ ID NO: 1353124 - RNA, 12 nt, Mycobacterium tuberculosis H37Rv
caucacggucag

SEQ ID NO: 1353125 - RNA, 16 nt, Mycobacterium tuberculosis H37Rv
caucacggaccaggcc

SEQ ID NO: 1353126 - RNA, 17 nt, Mycobacterium tuberculosis H37Rv
caucaguuugacgccga

SEQ ID NO: 1353127 - RNA, 17 nt, Mycobacterium tuberculosis H37Rv
caucaggugcgccuggc

SEQ ID NO: 1353128 - RNA, 14 nt, Mycobacterium tuberculosis H37Rv
caucaggucggcga

SEQ ID NO: 1353129 - RNA, 16 nt, Mycobacterium tuberculosis H37Rv
caucggcggccugcuc

SEQ ID NO: 1353130 - RNA, 18 nt, Mycobacterium tuberculosis H37Rv
caucggcggggcccacac

SEQ ID NO: 1353131 - RNA, 11 nt, Mycobacterium tuberculosis H37Rv
caucggcgcca

SEQ ID NO: 1353132 - RNA, 17 nt, Mycobacterium tuberculosis H37Rv
caucggcgaccgccugc

SEQ ID NO: 1353133 - RNA, 19 nt, Mycobacterium tuberculosis H37Rv
caucgcgggcggcgcuggc

SEQ ID NO: 1353134 - RNA, 22 nt, Mycobacterium tuberculosis H37Rv
caucgcgacuagacgccgccgc

SEQ ID NO: 1353135 - RNA, 19 nt, Mycobacterium tuberculosis H37Rv
caucgcgagccagcugcuc

SEQ ID NO: 1353136 - RNA, 19 nt, Mycobacterium tuberculosis H37Rv
caucgcgauuccggcggcc

SEQ ID NO: 1353137 - RNA, 15 nt, Mycobacterium tuberculosis H37Rv
caucgccuugcccag

SEQ ID NO: 1353138 - RNA, 17 nt, Mycobacterium tuberculosis H37Rv
caucgccuugcccagcg

SEQ ID NO: 1353139 - RNA, 14 nt, Mycobacterium tuberculosis H37Rv
caucgcgcgcggcu

SEQ ID NO: 1353140 - RNA, 20 nt, Mycobacterium tuberculosis H37Rv
caucgcgcugcggcccacac

SEQ ID NO: 1353141 - RNA, 17 nt, Mycobacterium tuberculosis H37Rv
caucgcgcggaccagag

SEQ ID NO: 1353142 - RNA, 19 nt, Mycobacterium tuberculosis H37Rv
caucgcggccgcugggccc

SEQ ID NO: 1353143 - RNA, 19 nt, Mycobacterium tuberculosis H37Rv
caucgacgccugcggcggu

SEQ ID NO: 1353144 - RNA, 20 nt, Mycobacterium tuberculosis H37Rv
caucgacuugccgccgcaca

SEQ ID NO: 1353145 - RNA, 12 nt, Mycobacterium tuberculosis H37Rv
caucgaccaccu

SEQ ID NO: 1353146 - RNA, 21 nt, Mycobacterium tuberculosis H37Rv
caucgaccaccucgaugccgc

SEQ ID NO: 1353147 - RNA, 17 nt, Mycobacterium tuberculosis H37Rv
caucgaccgcggccggg

SEQ ID NO: 1353148 - RNA, 22 nt, Mycobacterium tuberculosis H37Rv
caucgagcccggacgagugcac

SEQ ID NO: 1353149 - RNA, 18 nt, Mycobacterium tuberculosis H37Rv
caucgagacgagccacgg

SEQ ID NO: 1353150 - RNA, 20 nt, Mycobacterium tuberculosis H37Rv
caucgaguccaccaccuggc

SEQ ID NO: 1353151 - RNA, 15 nt, Mycobacterium tuberculosis H37Rv
caucgaguccaccac

SEQ ID NO: 1353152 - RNA, 19 nt, Mycobacterium tuberculosis H37Rv
caucgaggcgaucaccgcg

SEQ ID NO: 1353153 - RNA, 20 nt, Mycobacterium tuberculosis H37Rv
caucgaggccagcagcugcu

SEQ ID NO: 1353154 - RNA, 14 nt, Mycobacterium tuberculosis H37Rv
caucgcccgaugcg

SEQ ID NO: 1353155 - RNA, 16 nt, Mycobacterium tuberculosis H37Rv
caucgcccaacaacgc

SEQ ID NO: 1353156 - RNA, 14 nt, Mycobacterium tuberculosis H37Rv
caucgccagcgccg

SEQ ID NO: 1353157 - RNA, 19 nt, Mycobacterium tuberculosis H37Rv
caucgccagcgccggccag

SEQ ID NO: 1353158 - RNA, 13 nt, Mycobacterium tuberculosis H37Rv
caucgccagcggc

SEQ ID NO: 1353159 - RNA, 14 nt, Mycobacterium tuberculosis H37Rv
caucgaucaccgcu

SEQ ID NO: 1353160 - RNA, 23 nt, Mycobacterium tuberculosis H37Rv
cauccggucagauagugcaugua

SEQ ID NO: 1353161 - RNA, 12 nt, Mycobacterium tuberculosis H37Rv
cauccgucaagu

SEQ ID NO: 1353162 - RNA, 15 nt, Mycobacterium tuberculosis H37Rv
cauccgggccgagcg

SEQ ID NO: 1353163 - RNA, 16 nt, Mycobacterium tuberculosis H37Rv
cauccacuccgccaac

SEQ ID NO: 1353164 - RNA, 17 nt, Mycobacterium tuberculosis H37Rv
cauccagaagccggcca

SEQ ID NO: 1353165 - RNA, 13 nt, Mycobacterium tuberculosis H37Rv
cauccgccccgcc

SEQ ID NO: 1353166 - RNA, 14 nt, Mycobacterium tuberculosis H37Rv
cauccgccccgccc

SEQ ID NO: 1353167 - RNA, 19 nt, Mycobacterium tuberculosis H37Rv
cauccgccgggccaggccg

SEQ ID NO: 1353168 - RNA, 16 nt, Mycobacterium tuberculosis H37Rv
cauccgcggcaugcaa

SEQ ID NO: 1353169 - RNA, 18 nt, Mycobacterium tuberculosis H37Rv
cauccgcgacggcgcccu

SEQ ID NO: 1353170 - RNA, 19 nt, Mycobacterium tuberculosis H37Rv
cauccgucguacacgccau

SEQ ID NO: 1353171 - RNA, 13 nt, Mycobacterium tuberculosis H37Rv
cauccucgagcug

SEQ ID NO: 1353172 - RNA, 17 nt, Mycobacterium tuberculosis H37Rv
cauccuugccaaucgcc

SEQ ID NO: 1353173 - RNA, 19 nt, Mycobacterium tuberculosis H37Rv
caucgggcgcgguaaccac

SEQ ID NO: 1353174 - RNA, 23 nt, Mycobacterium tuberculosis H37Rv
caucggcuggccgcgccucgguc

SEQ ID NO: 1353175 - RNA, 17 nt, Mycobacterium tuberculosis H37Rv
caucgguagaccccccu

SEQ ID NO: 1353176 - RNA, 14 nt, Mycobacterium tuberculosis H37Rv
caucggugucuucc

SEQ ID NO: 1353177 - RNA, 20 nt, Mycobacterium tuberculosis H37Rv
caucgguguggcccaacacc

SEQ ID NO: 1353178 - RNA, 22 nt, Mycobacterium tuberculosis H37Rv
caucggucagcgggcacgccgc

SEQ ID NO: 1353179 - RNA, 20 nt, Mycobacterium tuberculosis H37Rv
caucggucagcaugggguag

SEQ ID NO: 1353180 - RNA, 17 nt, Mycobacterium tuberculosis H37Rv
caucggucagcgcggca

SEQ ID NO: 1353181 - RNA, 16 nt, Mycobacterium tuberculosis H37Rv
caucugcccaccgcag

SEQ ID NO: 1353182 - RNA, 18 nt, Mycobacterium tuberculosis H37Rv
caucugcgaaaagccuug

SEQ ID NO: 1353183 - RNA, 15 nt, Mycobacterium tuberculosis H37Rv
caucugacagcuggg

SEQ ID NO: 1353184 - RNA, 19 nt, Mycobacterium tuberculosis H37Rv
caucugaucaggccacacu

SEQ ID NO: 1353185 - RNA, 21 nt, Mycobacterium tuberculosis H37Rv
caucucccgaccgccgagcgg

SEQ ID NO: 1353186 - RNA, 19 nt, Mycobacterium tuberculosis H37Rv
caucucccgaccgccgagc

SEQ ID NO: 1353187 - RNA, 19 nt, Mycobacterium tuberculosis H37Rv
caucuccgccgucgccacc

SEQ ID NO: 1353188 - RNA, 19 nt, Mycobacterium tuberculosis H37Rv
caucuggcgccguuagcgu

SEQ ID NO: 1353189 - RNA, 11 nt, Mycobacterium tuberculosis H37Rv
caucugcucgc

SEQ ID NO: 1353190 - RNA, 18 nt, Mycobacterium tuberculosis H37Rv
caucuggcgcugcuggca

SEQ ID NO: 1353191 - RNA, 17 nt, Mycobacterium tuberculosis H37Rv
caucuggcgcugcuggc

SEQ ID NO: 1353192 - RNA, 20 nt, Mycobacterium tuberculosis H37Rv
caucugguauggguccucga

SEQ ID NO: 1353193 - RNA, 12 nt, Mycobacterium tuberculosis H37Rv
caucuugaccaa

SEQ ID NO: 1353194 - RNA, 19 nt, Mycobacterium tuberculosis H37Rv
caugggcccugcacagcag

SEQ ID NO: 1353195 - RNA, 21 nt, Mycobacterium tuberculosis H37Rv
caugggccaggucagccgcgc

SEQ ID NO: 1353196 - RNA, 14 nt, Mycobacterium tuberculosis H37Rv
cauggguagccgcc

SEQ ID NO: 1353197 - RNA, 16 nt, Mycobacterium tuberculosis H37Rv
cauggguagccgccca

SEQ ID NO: 1353198 - RNA, 20 nt, Mycobacterium tuberculosis H37Rv
caugguagcgccccgaugcu

SEQ ID NO: 1353199 - RNA, 19 nt, Mycobacterium tuberculosis H37Rv
caugggggcguuggcgggc

SEQ ID NO: 1353200 - RNA, 12 nt, Mycobacterium tuberculosis H37Rv
caugggguagau

SEQ ID NO: 1353201 - RNA, 18 nt, Mycobacterium tuberculosis H37Rv
caugggccggcgccgcac

SEQ ID NO: 1353202 - RNA, 16 nt, Mycobacterium tuberculosis H37Rv
cauggauacgcagcac

SEQ ID NO: 1353203 - RNA, 20 nt, Mycobacterium tuberculosis H37Rv
caugcgguuagcagccgcug

SEQ ID NO: 1353204 - RNA, 16 nt, Mycobacterium tuberculosis H37Rv
caugcguaugcccacg

SEQ ID NO: 1353205 - RNA, 16 nt, Mycobacterium tuberculosis H37Rv
caugcgggcagcacuc

SEQ ID NO: 1353206 - RNA, 23 nt, Mycobacterium tuberculosis H37Rv
caugcccgcggugaccaccccgg

SEQ ID NO: 1353207 - RNA, 22 nt, Mycobacterium tuberculosis H37Rv
caugcccaugauggccgcggcu

SEQ ID NO: 1353208 - RNA, 18 nt, Mycobacterium tuberculosis H37Rv
caugcccaucuccaacag

SEQ ID NO: 1353209 - RNA, 19 nt, Mycobacterium tuberculosis H37Rv
caugcccgucagcggacag

SEQ ID NO: 1353210 - RNA, 14 nt, Mycobacterium tuberculosis H37Rv
caugcccucggcgc

SEQ ID NO: 1353211 - RNA, 18 nt, Mycobacterium tuberculosis H37Rv
caugcccuuguaggccau

SEQ ID NO: 1353212 - RNA, 13 nt, Mycobacterium tuberculosis H37Rv
caugccuccagaa

SEQ ID NO: 1353213 - RNA, 20 nt, Mycobacterium tuberculosis H37Rv
caugccuucggccaaccaug

SEQ ID NO: 1353214 - RNA, 22 nt, Mycobacterium tuberculosis H37Rv
caugccuucggccaaccaugcu

SEQ ID NO: 1353215 - RNA, 19 nt, Mycobacterium tuberculosis H37Rv
caugcgauacacggcggcg

SEQ ID NO: 1353216 - RNA, 18 nt, Mycobacterium tuberculosis H37Rv
cauggugacgugcucucg

SEQ ID NO: 1353217 - RNA, 17 nt, Mycobacterium tuberculosis H37Rv
caugguccaaccagcac

SEQ ID NO: 1353218 - RNA, 18 nt, Mycobacterium tuberculosis H37Rv
caugguccaaccagcacc

SEQ ID NO: 1353219 - RNA, 14 nt, Mycobacterium tuberculosis H37Rv
caugguccacagcc

SEQ ID NO: 1353220 - RNA, 13 nt, Mycobacterium tuberculosis H37Rv
caugguccgacca

SEQ ID NO: 1353221 - RNA, 17 nt, Mycobacterium tuberculosis H37Rv
cauggugggccuuccuc

SEQ ID NO: 1353222 - RNA, 16 nt, Mycobacterium tuberculosis H37Rv
caugucgguuuccucg

SEQ ID NO: 1353223 - RNA, 18 nt, Mycobacterium tuberculosis H37Rv
caugucuccgacauuggc

SEQ ID NO: 1353224 - RNA, 16 nt, Mycobacterium tuberculosis H37Rv
caugugcccaggucuc

SEQ ID NO: 1353225 - RNA, 21 nt, Mycobacterium tuberculosis H37Rv
caugugcccaggucuccauca

SEQ ID NO: 1353226 - RNA, 22 nt, Mycobacterium tuberculosis H37Rv
cauguucuuuugcgucugcugg

SEQ ID NO: 1353227 - RNA, 22 nt, Mycobacterium tuberculosis H37Rv
cauguugaagcgaagccagauc

SEQ ID NO: 1353228 - RNA, 19 nt, Mycobacterium tuberculosis H37Rv
cauuaaugcggccccgcgc

SEQ ID NO: 1353229 - RNA, 20 nt, Mycobacterium tuberculosis H37Rv
cauuaaugcggccccgcgca

SEQ ID NO: 1353230 - RNA, 14 nt, Mycobacterium tuberculosis H37Rv
cauucgugcccggg

SEQ ID NO: 1353231 - RNA, 11 nt, Mycobacterium tuberculosis H37Rv
cauucugcggc

SEQ ID NO: 1353232 - RNA, 14 nt, Mycobacterium tuberculosis H37Rv
cauugugcucgccg

SEQ ID NO: 1353233 - RNA, 22 nt, Mycobacterium tuberculosis H37Rv
cauuggccaggucggccaccgu

SEQ ID NO: 1353234 - RNA, 19 nt, Mycobacterium tuberculosis H37Rv
cauuggaugccauaggaca

SEQ ID NO: 1353235 - RNA, 15 nt, Mycobacterium tuberculosis H37Rv
cauugcgcaggaugu

SEQ ID NO: 1353236 - RNA, 21 nt, Mycobacterium tuberculosis H37Rv
cauugccguucucgucgagga

SEQ ID NO: 1353237 - RNA, 22 nt, Mycobacterium tuberculosis H37Rv
cauugcugcucgugagccccag

SEQ ID NO: 1353238 - RNA, 15 nt, Mycobacterium tuberculosis H37Rv
cauugcgccugaaua

SEQ ID NO: 1353239 - RNA, 15 nt, Mycobacterium tuberculosis H37Rv
cauugcagaaccgcc

SEQ ID NO: 1353240 - RNA, 13 nt, Mycobacterium tuberculosis H37Rv
cauugccgccggc

SEQ ID NO: 1353241 - RNA, 16 nt, Mycobacterium tuberculosis H37Rv
cagcgcuccagcaccc

SEQ ID NO: 1353242 - RNA, 13 nt, Mycobacterium tuberculosis H37Rv
cagcgcuccagcc

SEQ ID NO: 1353243 - RNA, 13 nt, Mycobacterium tuberculosis H37Rv
cagcgcuagccgg

SEQ ID NO: 1353244 - RNA, 14 nt, Mycobacterium tuberculosis H37Rv
cagcgcguggaacu

SEQ ID NO: 1353245 - RNA, 14 nt, Mycobacterium tuberculosis H37Rv
cagcgcugggccca

SEQ ID NO: 1353246 - RNA, 14 nt, Mycobacterium tuberculosis H37Rv
cagcggaccgcugc

SEQ ID NO: 1353247 - RNA, 21 nt, Mycobacterium tuberculosis H37Rv
cagcggcaauggccagcacca

SEQ ID NO: 1353248 - RNA, 23 nt, Mycobacterium tuberculosis H37Rv
cagcggcaauggccagcaccacg

SEQ ID NO: 1353249 - RNA, 20 nt, Mycobacterium tuberculosis H37Rv
cagcggcacacccaucaccg

SEQ ID NO: 1353250 - RNA, 16 nt, Mycobacterium tuberculosis H37Rv
cagcggcaccgcggcc

SEQ ID NO: 1353251 - RNA, 17 nt, Mycobacterium tuberculosis H37Rv
cagcggcacgaucggca

SEQ ID NO: 1353252 - RNA, 13 nt, Mycobacterium tuberculosis H37Rv
cagcggcauugcc

SEQ ID NO: 1353253 - RNA, 19 nt, Mycobacterium tuberculosis H37Rv
cagcggcaucgcgggcggc

SEQ ID NO: 1353254 - RNA, 15 nt, Mycobacterium tuberculosis H37Rv
cagcggcaucggcca

SEQ ID NO: 1353255 - RNA, 13 nt, Mycobacterium tuberculosis H37Rv
cagcggccaccga

SEQ ID NO: 1353256 - RNA, 12 nt, Mycobacterium tuberculosis H37Rv
cagcggccaccg

SEQ ID NO: 1353257 - RNA, 13 nt, Mycobacterium tuberculosis H37Rv
cagcggccaaccc

SEQ ID NO: 1353258 - RNA, 15 nt, Mycobacterium tuberculosis H37Rv
cagcggccagcccag

SEQ ID NO: 1353259 - RNA, 13 nt, Mycobacterium tuberculosis H37Rv
cagcggcaggaag

SEQ ID NO: 1353260 - RNA, 13 nt, Mycobacterium tuberculosis H37Rv
cagcggcagcacc

SEQ ID NO: 1353261 - RNA, 22 nt, Mycobacterium tuberculosis H37Rv
cagcggcaguuccugacgccau

SEQ ID NO: 1353262 - RNA, 23 nt, Mycobacterium tuberculosis H37Rv
cagcgcggccauuagcagcaccc

SEQ ID NO: 1353263 - RNA, 19 nt, Mycobacterium tuberculosis H37Rv
cagcgcggccaccaccgag

SEQ ID NO: 1353264 - RNA, 22 nt, Mycobacterium tuberculosis H37Rv
cagcgcggccaauugcgccgcc

SEQ ID NO: 1353265 - RNA, 15 nt, Mycobacterium tuberculosis H37Rv
cagcgcgcgccgcug

SEQ ID NO: 1353266 - RNA, 18 nt, Mycobacterium tuberculosis H37Rv
cagcgcgcgcucgggccc

SEQ ID NO: 1353267 - RNA, 12 nt, Mycobacterium tuberculosis H37Rv
cagcgcgccgcg

SEQ ID NO: 1353268 - RNA, 12 nt, Mycobacterium tuberculosis H37Rv
cagcgcgcggcu

SEQ ID NO: 1353269 - RNA, 18 nt, Mycobacterium tuberculosis H37Rv
cagcgcguaguccgcauc

SEQ ID NO: 1353270 - RNA, 15 nt, Mycobacterium tuberculosis H37Rv
cagcgcggcuggggc

SEQ ID NO: 1353271 - RNA, 20 nt, Mycobacterium tuberculosis H37Rv
cagcgcggcuggggccccgc

SEQ ID NO: 1353272 - RNA, 22 nt, Mycobacterium tuberculosis H37Rv
cagcgcgggacacgucgcgcca

SEQ ID NO: 1353273 - RNA, 14 nt, Mycobacterium tuberculosis H37Rv
cagcgcgggaucug

SEQ ID NO: 1353274 - RNA, 12 nt, Mycobacterium tuberculosis H37Rv
cagcgcggcgcg

SEQ ID NO: 1353275 - RNA, 19 nt, Mycobacterium tuberculosis H37Rv
cagcgcggccgggcgcccu

SEQ ID NO: 1353276 - RNA, 22 nt, Mycobacterium tuberculosis H37Rv
cagcgcggccuuggugggcaga

SEQ ID NO: 1353277 - RNA, 13 nt, Mycobacterium tuberculosis H37Rv
cagcgccuggccg

SEQ ID NO: 1353278 - RNA, 15 nt, Mycobacterium tuberculosis H37Rv
cagcgccugcgcgca

SEQ ID NO: 1353279 - RNA, 16 nt, Mycobacterium tuberculosis H37Rv
cagcgccugcggcagc

SEQ ID NO: 1353280 - RNA, 21 nt, Mycobacterium tuberculosis H37Rv
cagcgccuugaccagcagcug

SEQ ID NO: 1353281 - RNA, 20 nt, Mycobacterium tuberculosis H37Rv
cagcgccuugaccagcagcu

SEQ ID NO: 1353282 - RNA, 16 nt, Mycobacterium tuberculosis H37Rv
cagcgcgaccaaugcg

SEQ ID NO: 1353283 - RNA, 17 nt, Mycobacterium tuberculosis H37Rv
cagcgcgagaucagccg

SEQ ID NO: 1353284 - RNA, 16 nt, Mycobacterium tuberculosis H37Rv
cagcgcgaucaacgcg

SEQ ID NO: 1353285 - RNA, 22 nt, Mycobacterium tuberculosis H37Rv
cagcgcgagaucagccggcagc

SEQ ID NO: 1353286 - RNA, 22 nt, Mycobacterium tuberculosis H37Rv
cagcgcgacguccaccagccgg

SEQ ID NO: 1353287 - RNA, 19 nt, Mycobacterium tuberculosis H37Rv
cagcgcgcaaagacaccga

SEQ ID NO: 1353288 - RNA, 19 nt, Mycobacterium tuberculosis H37Rv
cagcgcgcccgacacccgu

SEQ ID NO: 1353289 - RNA, 14 nt, Mycobacterium tuberculosis H37Rv
cagcgcgccgcguu

SEQ ID NO: 1353290 - RNA, 15 nt, Mycobacterium tuberculosis H37Rv
cagcgcaucgccgcu

SEQ ID NO: 1353291 - RNA, 17 nt, Mycobacterium tuberculosis H37Rv
cagcgcaucggccagca

SEQ ID NO: 1353292 - RNA, 18 nt, Mycobacterium tuberculosis H37Rv
cagcgcaucggucaccaa

SEQ ID NO: 1353293 - RNA, 16 nt, Mycobacterium tuberculosis H37Rv
cagcgcaucgccgcug

SEQ ID NO: 1353294 - RNA, 13 nt, Mycobacterium tuberculosis H37Rv
cagcgcagugccu

SEQ ID NO: 1353295 - RNA, 22 nt, Mycobacterium tuberculosis H37Rv
cagcgcaggauucugcugacca

SEQ ID NO: 1353296 - RNA, 16 nt, Mycobacterium tuberculosis H37Rv
cagcgcauccacaauc

SEQ ID NO: 1353297 - RNA, 16 nt, Mycobacterium tuberculosis H37Rv
cagcgcagccugcagc

SEQ ID NO: 1353298 - RNA, 18 nt, Mycobacterium tuberculosis H37Rv
cagcgcagcagcggcauc

SEQ ID NO: 1353299 - RNA, 16 nt, Mycobacterium tuberculosis H37Rv
cagcgcacuggccgcu

SEQ ID NO: 1353300 - RNA, 13 nt, Mycobacterium tuberculosis H37Rv
cagcgccaauguc

SEQ ID NO: 1353301 - RNA, 18 nt, Mycobacterium tuberculosis H37Rv
cagcgccaacgcccccau

SEQ ID NO: 1353302 - RNA, 13 nt, Mycobacterium tuberculosis H37Rv
cagcgccacccgg

SEQ ID NO: 1353303 - RNA, 21 nt, Mycobacterium tuberculosis H37Rv
cagcgcaucuuugaacgccau

SEQ ID NO: 1353304 - RNA, 19 nt, Mycobacterium tuberculosis H37Rv
cagcgcauuuuccacaucc

SEQ ID NO: 1353305 - RNA, 18 nt, Mycobacterium tuberculosis H37Rv
cagcgcauuuuccacauc

SEQ ID NO: 1353306 - RNA, 21 nt, Mycobacterium tuberculosis H37Rv
cagcgauuuugaugcgauucu

SEQ ID NO: 1353307 - RNA, 21 nt, Mycobacterium tuberculosis H37Rv
cagcgcaacaucgaaaaccga

SEQ ID NO: 1353308 - RNA, 21 nt, Mycobacterium tuberculosis H37Rv
cagcgcaaccgaccgggccgc

SEQ ID NO: 1353309 - RNA, 16 nt, Mycobacterium tuberculosis H37Rv
cagcgcaaccuccgcg

SEQ ID NO: 1353310 - RNA, 17 nt, Mycobacterium tuberculosis H37Rv
cagcgcaaccuccgcga

SEQ ID NO: 1353311 - RNA, 19 nt, Mycobacterium tuberculosis H37Rv
cagcgcaaccuccgcgagc

SEQ ID NO: 1353312 - RNA, 21 nt, Mycobacterium tuberculosis H37Rv
cagcgcaaccuccgcgagcag

SEQ ID NO: 1353313 - RNA, 15 nt, Mycobacterium tuberculosis H37Rv
cagcgcacuacucga

SEQ ID NO: 1353314 - RNA, 22 nt, Mycobacterium tuberculosis H37Rv
cagcgcacuacucgaacaaccc

SEQ ID NO: 1353315 - RNA, 16 nt, Mycobacterium tuberculosis H37Rv
cagcgcacugcccggg

SEQ ID NO: 1353316 - RNA, 14 nt, Mycobacterium tuberculosis H37Rv
cagcgcacggacca

SEQ ID NO: 1353317 - RNA, 12 nt, Mycobacterium tuberculosis H37Rv
cagcgcacccgg

SEQ ID NO: 1353318 - RNA, 20 nt, Mycobacterium tuberculosis H37Rv
cagcgaucuugguggccuca

SEQ ID NO: 1353319 - RNA, 13 nt, Mycobacterium tuberculosis H37Rv
cagcgaucgccgc

SEQ ID NO: 1353320 - RNA, 20 nt, Mycobacterium tuberculosis H37Rv
cagcgaucccggcaacaacg

SEQ ID NO: 1353321 - RNA, 15 nt, Mycobacterium tuberculosis H37Rv
cagcgauccggggcu

SEQ ID NO: 1353322 - RNA, 21 nt, Mycobacterium tuberculosis H37Rv
cagcgauggguguugcuggcc

SEQ ID NO: 1353323 - RNA, 16 nt, Mycobacterium tuberculosis H37Rv
cagcgaugcucacuac

SEQ ID NO: 1353324 - RNA, 17 nt, Mycobacterium tuberculosis H37Rv
cagcgauauccacaauc

SEQ ID NO: 1353325 - RNA, 19 nt, Mycobacterium tuberculosis H37Rv
cagcgccgccggcgccggc

SEQ ID NO: 1353326 - RNA, 16 nt, Mycobacterium tuberculosis H37Rv
cagcgccgccggcacc

SEQ ID NO: 1353327 - RNA, 14 nt, Mycobacterium tuberculosis H37Rv
cagcgcccggccac

SEQ ID NO: 1353328 - RNA, 19 nt, Mycobacterium tuberculosis H37Rv
cagcgcccggccacuccag

SEQ ID NO: 1353329 - RNA, 13 nt, Mycobacterium tuberculosis H37Rv
cagcgcccggccc

SEQ ID NO: 1353330 - RNA, 14 nt, Mycobacterium tuberculosis H37Rv
cagcgccgacccgu

SEQ ID NO: 1353331 - RNA, 12 nt, Mycobacterium tuberculosis H37Rv
cagcgccuccuc

SEQ ID NO: 1353332 - RNA, 14 nt, Mycobacterium tuberculosis H37Rv
cagcgccuccucga

SEQ ID NO: 1353333 - RNA, 17 nt, Mycobacterium tuberculosis H37Rv
cagcgccuccagcacca

SEQ ID NO: 1353334 - RNA, 19 nt, Mycobacterium tuberculosis H37Rv
cagcgccuccagcaccacg

SEQ ID NO: 1353335 - RNA, 12 nt, Mycobacterium tuberculosis H37Rv
cagcgccuccag

SEQ ID NO: 1353336 - RNA, 14 nt, Mycobacterium tuberculosis H37Rv
cagcgccgcgcgcg

SEQ ID NO: 1353337 - RNA, 22 nt, Mycobacterium tuberculosis H37Rv
cagcgccgcugacuccugcggc

SEQ ID NO: 1353338 - RNA, 18 nt, Mycobacterium tuberculosis H37Rv
cagcgccggauccacacc

SEQ ID NO: 1353339 - RNA, 13 nt, Mycobacterium tuberculosis H37Rv
cagcgccaggccg

SEQ ID NO: 1353340 - RNA, 20 nt, Mycobacterium tuberculosis H37Rv
cagcgccacuggaagccaag

SEQ ID NO: 1353341 - RNA, 23 nt, Mycobacterium tuberculosis H37Rv
cagcgccacuggaagccaagcua

SEQ ID NO: 1353342 - RNA, 12 nt, Mycobacterium tuberculosis H37Rv
cagcgccacccg

SEQ ID NO: 1353343 - RNA, 17 nt, Mycobacterium tuberculosis H37Rv
cagcgcccccagcagcu

SEQ ID NO: 1353344 - RNA, 21 nt, Mycobacterium tuberculosis H37Rv
cagcgccccaugcaacacacc

SEQ ID NO: 1353345 - RNA, 12 nt, Mycobacterium tuberculosis H37Rv
cagcgcccccag

SEQ ID NO: 1353346 - RNA, 13 nt, Mycobacterium tuberculosis H37Rv
cagcgccaucauc

SEQ ID NO: 1353347 - RNA, 15 nt, Mycobacterium tuberculosis H37Rv
cagccgugccguggu

SEQ ID NO: 1353348 - RNA, 14 nt, Mycobacterium tuberculosis H37Rv
cagccgugcccagg

SEQ ID NO: 1353349 - RNA, 19 nt, Mycobacterium tuberculosis H37Rv
cagccgugcccaggccacc

SEQ ID NO: 1353350 - RNA, 22 nt, Mycobacterium tuberculosis H37Rv
cagccgucggcgcugcgcgcga

SEQ ID NO: 1353351 - RNA, 14 nt, Mycobacterium tuberculosis H37Rv
cagccgucggcgcu

SEQ ID NO: 1353352 - RNA, 14 nt, Mycobacterium tuberculosis H37Rv
cagccgucgccacc

SEQ ID NO: 1353353 - RNA, 17 nt, Mycobacterium tuberculosis H37Rv
cagccguggcgcgacgu

SEQ ID NO: 1353354 - RNA, 22 nt, Mycobacterium tuberculosis H37Rv
cagccguucccggugaccacuu

SEQ ID NO: 1353355 - RNA, 17 nt, Mycobacterium tuberculosis H37Rv
cagccgguccagcagcu

SEQ ID NO: 1353356 - RNA, 18 nt, Mycobacterium tuberculosis H37Rv
cagccgguccagacccag

SEQ ID NO: 1353357 - RNA, 21 nt, Mycobacterium tuberculosis H37Rv
cagccggucgaugccgaugcg

SEQ ID NO: 1353358 - RNA, 16 nt, Mycobacterium tuberculosis H37Rv
cagccggugccgccgu

SEQ ID NO: 1353359 - RNA, 17 nt, Mycobacterium tuberculosis H37Rv
cagccggugcgcugguu

SEQ ID NO: 1353360 - RNA, 17 nt, Mycobacterium tuberculosis H37Rv
cagccgucaccgcgacc

SEQ ID NO: 1353361 - RNA, 22 nt, Mycobacterium tuberculosis H37Rv
cagccgucaccgcgaccccugg

SEQ ID NO: 1353362 - RNA, 23 nt, Mycobacterium tuberculosis H37Rv
cagccguccgggcggccucccgg

SEQ ID NO: 1353363 - RNA, 23 nt, Mycobacterium tuberculosis H37Rv
cagccucgaguucgaccggcggg

SEQ ID NO: 1353364 - RNA, 13 nt, Mycobacterium tuberculosis H37Rv
cagccuccaccag

SEQ ID NO: 1353365 - RNA, 14 nt, Mycobacterium tuberculosis H37Rv
cagccuggccucgc

SEQ ID NO: 1353366 - RNA, 13 nt, Mycobacterium tuberculosis H37Rv
cagccuggccucg

SEQ ID NO: 1353367 - RNA, 12 nt, Mycobacterium tuberculosis H37Rv
cagccugcugca

SEQ ID NO: 1353368 - RNA, 15 nt, Mycobacterium tuberculosis H37Rv
cagccuggagauggc

SEQ ID NO: 1353369 - RNA, 16 nt, Mycobacterium tuberculosis H37Rv
cagccuuuccggccgc

SEQ ID NO: 1353370 - RNA, 21 nt, Mycobacterium tuberculosis H37Rv
cagccuuggacgugcgcgcca

SEQ ID NO: 1353371 - RNA, 21 nt, Mycobacterium tuberculosis H37Rv
cagccuugaucucgucccacu

SEQ ID NO: 1353372 - RNA, 18 nt, Mycobacterium tuberculosis H37Rv
cagccuuaugcagugaca

SEQ ID NO: 1353373 - RNA, 17 nt, Mycobacterium tuberculosis H37Rv
cagcgacgcugccgcca

SEQ ID NO: 1353374 - RNA, 20 nt, Mycobacterium tuberculosis H37Rv
cagcgacgcugccgccaggc

SEQ ID NO: 1353375 - RNA, 18 nt, Mycobacterium tuberculosis H37Rv
cagcgacgagaucagccu

SEQ ID NO: 1353376 - RNA, 20 nt, Mycobacterium tuberculosis H37Rv
cagcgaccucacugcggcgc

SEQ ID NO: 1353377 - RNA, 22 nt, Mycobacterium tuberculosis H37Rv
cagcgacgaagucgcagcugcc

SEQ ID NO: 1353378 - RNA, 23 nt, Mycobacterium tuberculosis H37Rv
cagcgacuuggcaucgcgagcca

SEQ ID NO: 1353379 - RNA, 14 nt, Mycobacterium tuberculosis H37Rv
cagcgacuugcugg

SEQ ID NO: 1353380 - RNA, 20 nt, Mycobacterium tuberculosis H37Rv
cagcgacgggaaagccaccu

SEQ ID NO: 1353381 - RNA, 18 nt, Mycobacterium tuberculosis H37Rv
cagcgacuccaccccacc

SEQ ID NO: 1353382 - RNA, 23 nt, Mycobacterium tuberculosis H37Rv
cagcgagcccagcugcgccgaac

SEQ ID NO: 1353383 - RNA, 16 nt, Mycobacterium tuberculosis H37Rv
cagcgagaccucucug

SEQ ID NO: 1353384 - RNA, 16 nt, Mycobacterium tuberculosis H37Rv
cagcgaacggccagga

SEQ ID NO: 1353385 - RNA, 13 nt, Mycobacterium tuberculosis H37Rv
cagcgaacggcca

SEQ ID NO: 1353386 - RNA, 13 nt, Mycobacterium tuberculosis H37Rv
cagcgaacgcugc

SEQ ID NO: 1353387 - RNA, 17 nt, Mycobacterium tuberculosis H37Rv
cagcgaaccgccggcac

SEQ ID NO: 1353388 - RNA, 19 nt, Mycobacterium tuberculosis H37Rv
cagcgaaccgccggcaccg

SEQ ID NO: 1353389 - RNA, 24 nt, Mycobacterium tuberculosis H37Rv
cagcgaaccggcugggcgccacca

SEQ ID NO: 1353390 - RNA, 19 nt, Mycobacterium tuberculosis H37Rv
cagcgaaacaccggccagc

SEQ ID NO: 1353391 - RNA, 17 nt, Mycobacterium tuberculosis H37Rv
cagcgaaacgagccggu

SEQ ID NO: 1353392 - RNA, 13 nt, Mycobacterium tuberculosis H37Rv
cagcgacaagugc

SEQ ID NO: 1353393 - RNA, 15 nt, Mycobacterium tuberculosis H37Rv
cagcgacaacaccac

SEQ ID NO: 1353394 - RNA, 14 nt, Mycobacterium tuberculosis H37Rv
cagccgcagccagg

SEQ ID NO: 1353395 - RNA, 14 nt, Mycobacterium tuberculosis H37Rv
cagccgcagcggcc

SEQ ID NO: 1353396 - RNA, 13 nt, Mycobacterium tuberculosis H37Rv
cagccgcccgccc

SEQ ID NO: 1353397 - RNA, 17 nt, Mycobacterium tuberculosis H37Rv
cagccgcccgcccaccu

SEQ ID NO: 1353398 - RNA, 20 nt, Mycobacterium tuberculosis H37Rv
cagccgcccgcccaccucga

SEQ ID NO: 1353399 - RNA, 22 nt, Mycobacterium tuberculosis H37Rv
cagccgcccugaauccucucga

SEQ ID NO: 1353400 - RNA, 13 nt, Mycobacterium tuberculosis H37Rv
cagccgcgcugcg

SEQ ID NO: 1353401 - RNA, 15 nt, Mycobacterium tuberculosis H37Rv
cagccgcggccacau

SEQ ID NO: 1353402 - RNA, 14 nt, Mycobacterium tuberculosis H37Rv
cagccgcggcccuc

SEQ ID NO: 1353403 - RNA, 20 nt, Mycobacterium tuberculosis H37Rv
cagccgcggcggcagcaccc

SEQ ID NO: 1353404 - RNA, 17 nt, Mycobacterium tuberculosis H37Rv
cagccgcgacgcggcgu

SEQ ID NO: 1353405 - RNA, 22 nt, Mycobacterium tuberculosis H37Rv
cagccgcgccgcggcccgcucc

SEQ ID NO: 1353406 - RNA, 16 nt, Mycobacterium tuberculosis H37Rv
cagccgcggggcccac

SEQ ID NO: 1353407 - RNA, 13 nt, Mycobacterium tuberculosis H37Rv
cagccgcuccacg

SEQ ID NO: 1353408 - RNA, 22 nt, Mycobacterium tuberculosis H37Rv
cagccgcuccacguacgcggcu

SEQ ID NO: 1353409 - RNA, 15 nt, Mycobacterium tuberculosis H37Rv
cagccgcucacccgg

SEQ ID NO: 1353410 - RNA, 15 nt, Mycobacterium tuberculosis H37Rv
cagccggcagcagcg

SEQ ID NO: 1353411 - RNA, 20 nt, Mycobacterium tuberculosis H37Rv
cagccggccauacgcgcgcg

SEQ ID NO: 1353412 - RNA, 14 nt, Mycobacterium tuberculosis H37Rv
cagccggaccgugu

SEQ ID NO: 1353413 - RNA, 20 nt, Mycobacterium tuberculosis H37Rv
cagccgggcgucgcuggugg

SEQ ID NO: 1353414 - RNA, 16 nt, Mycobacterium tuberculosis H37Rv
cagccgguccagaccc

SEQ ID NO: 1353415 - RNA, 18 nt, Mycobacterium tuberculosis H37Rv
cagccgggcaccacccuu

SEQ ID NO: 1353416 - RNA, 14 nt, Mycobacterium tuberculosis H37Rv
cagccggcuugggc

SEQ ID NO: 1353417 - RNA, 13 nt, Mycobacterium tuberculosis H37Rv
cagccggcccugc

SEQ ID NO: 1353418 - RNA, 13 nt, Mycobacterium tuberculosis H37Rv
cagcccgcgcagc

SEQ ID NO: 1353419 - RNA, 16 nt, Mycobacterium tuberculosis H37Rv
cagcccgcgcagcggu

SEQ ID NO: 1353420 - RNA, 19 nt, Mycobacterium tuberculosis H37Rv
cagcccgccggacccgccc

SEQ ID NO: 1353421 - RNA, 14 nt, Mycobacterium tuberculosis H37Rv
cagcccgccggcgu

SEQ ID NO: 1353422 - RNA, 13 nt, Mycobacterium tuberculosis H37Rv
cagcccgccgcug

SEQ ID NO: 1353423 - RNA, 15 nt, Mycobacterium tuberculosis H37Rv
cagcccgccggaccc

SEQ ID NO: 1353424 - RNA, 21 nt, Mycobacterium tuberculosis H37Rv
cagcccgaugaucccgccacc

SEQ ID NO: 1353425 - RNA, 16 nt, Mycobacterium tuberculosis H37Rv
cagcccgcccaaugcg

SEQ ID NO: 1353426 - RNA, 17 nt, Mycobacterium tuberculosis H37Rv
cagcccgcccggugugu

SEQ ID NO: 1353427 - RNA, 21 nt, Mycobacterium tuberculosis H37Rv
cagcccggccuugccgccggc

SEQ ID NO: 1353428 - RNA, 18 nt, Mycobacterium tuberculosis H37Rv
cagcccggccgccgagga

SEQ ID NO: 1353429 - RNA, 14 nt, Mycobacterium tuberculosis H37Rv
cagcccggccgccg

SEQ ID NO: 1353430 - RNA, 18 nt, Mycobacterium tuberculosis H37Rv
cagcccggccggucgaga

SEQ ID NO: 1353431 - RNA, 20 nt, Mycobacterium tuberculosis H37Rv
cagcccgggcagccccuccg

SEQ ID NO: 1353432 - RNA, 21 nt, Mycobacterium tuberculosis H37Rv
cagcccgggcagccccuccgc

SEQ ID NO: 1353433 - RNA, 18 nt, Mycobacterium tuberculosis H37Rv
cagcccggucauggucag

SEQ ID NO: 1353434 - RNA, 18 nt, Mycobacterium tuberculosis H37Rv
cagcccgggcagcaccag

SEQ ID NO: 1353435 - RNA, 17 nt, Mycobacterium tuberculosis H37Rv
cagcccggcgugcagaa

SEQ ID NO: 1353436 - RNA, 21 nt, Mycobacterium tuberculosis H37Rv
cagcccggcuaacuggacugg

SEQ ID NO: 1353437 - RNA, 13 nt, Mycobacterium tuberculosis H37Rv
cagcccgggcagc

SEQ ID NO: 1353438 - RNA, 17 nt, Mycobacterium tuberculosis H37Rv
cagcccgggcagcacca

SEQ ID NO: 1353439 - RNA, 16 nt, Mycobacterium tuberculosis H37Rv
cagccgagcguggcgu

SEQ ID NO: 1353440 - RNA, 17 nt, Mycobacterium tuberculosis H37Rv
cagccgauacaggccac

SEQ ID NO: 1353441 - RNA, 19 nt, Mycobacterium tuberculosis H37Rv
cagccgagcggcggcacug

SEQ ID NO: 1353442 - RNA, 16 nt, Mycobacterium tuberculosis H37Rv
cagccgagacaccacg

SEQ ID NO: 1353443 - RNA, 16 nt, Mycobacterium tuberculosis H37Rv
cagccgaugcugcggg

SEQ ID NO: 1353444 - RNA, 12 nt, Mycobacterium tuberculosis H37Rv
cagccgaugcug

SEQ ID NO: 1353445 - RNA, 23 nt, Mycobacterium tuberculosis H37Rv
cagccgaugauaauuccagcacc

SEQ ID NO: 1353446 - RNA, 16 nt, Mycobacterium tuberculosis H37Rv
cagccgacagaugguc

SEQ ID NO: 1353447 - RNA, 22 nt, Mycobacterium tuberculosis H37Rv
cagccgacgcacgugaugcccu

SEQ ID NO: 1353448 - RNA, 20 nt, Mycobacterium tuberculosis H37Rv
cagccgaccgaaucagcacg

SEQ ID NO: 1353449 - RNA, 18 nt, Mycobacterium tuberculosis H37Rv
cagccgacaacuguccug

SEQ ID NO: 1353450 - RNA, 16 nt, Mycobacterium tuberculosis H37Rv
cagcccguucgugccg

SEQ ID NO: 1353451 - RNA, 15 nt, Mycobacterium tuberculosis H37Rv
cagcccguugcagga

SEQ ID NO: 1353452 - RNA, 17 nt, Mycobacterium tuberculosis H37Rv
cagcccguagcacaccg

SEQ ID NO: 1353453 - RNA, 17 nt, Mycobacterium tuberculosis H37Rv
cagcccggugugcugca

SEQ ID NO: 1353454 - RNA, 16 nt, Mycobacterium tuberculosis H37Rv
cagcccguccggcccc

SEQ ID NO: 1353455 - RNA, 22 nt, Mycobacterium tuberculosis H37Rv
cagcccguccaggcgcugcagc

SEQ ID NO: 1353456 - RNA, 18 nt, Mycobacterium tuberculosis H37Rv
cagcccuuggcgcgcagg

SEQ ID NO: 1353457 - RNA, 16 nt, Mycobacterium tuberculosis H37Rv
cagcccuucagcgucc

SEQ ID NO: 1353458 - RNA, 16 nt, Mycobacterium tuberculosis H37Rv
cagcccuaucagccga

SEQ ID NO: 1353459 - RNA, 14 nt, Mycobacterium tuberculosis H37Rv
cagcccugcgcagc

SEQ ID NO: 1353460 - RNA, 18 nt, Mycobacterium tuberculosis H37Rv
cagcacgauccagcugua

SEQ ID NO: 1353461 - RNA, 22 nt, Mycobacterium tuberculosis H37Rv
cagcaccucagaaaguccccgc

SEQ ID NO: 1353462 - RNA, 14 nt, Mycobacterium tuberculosis H37Rv
cagcaccuccaccg

SEQ ID NO: 1353463 - RNA, 16 nt, Mycobacterium tuberculosis H37Rv
cagcaccuccaccgcg

SEQ ID NO: 1353464 - RNA, 22 nt, Mycobacterium tuberculosis H37Rv
cagcaccgggaugugcggcugc

SEQ ID NO: 1353465 - RNA, 21 nt, Mycobacterium tuberculosis H37Rv
cagcaccuccaccgcgccggc

SEQ ID NO: 1353466 - RNA, 13 nt, Mycobacterium tuberculosis H37Rv
cagcaccuccgua

SEQ ID NO: 1353467 - RNA, 16 nt, Mycobacterium tuberculosis H37Rv
cagcaccgguggcgcu

SEQ ID NO: 1353468 - RNA, 15 nt, Mycobacterium tuberculosis H37Rv
cagcaccgugacagc

SEQ ID NO: 1353469 - RNA, 14 nt, Mycobacterium tuberculosis H37Rv
cagcaccggcccga

SEQ ID NO: 1353470 - RNA, 14 nt, Mycobacterium tuberculosis H37Rv
cagcacccacauca

SEQ ID NO: 1353471 - RNA, 12 nt, Mycobacterium tuberculosis H37Rv
cagcaccagcac

SEQ ID NO: 1353472 - RNA, 13 nt, Mycobacterium tuberculosis H37Rv
cagcacccgcgcc

SEQ ID NO: 1353473 - RNA, 14 nt, Mycobacterium tuberculosis H37Rv
cagcacccgcgcca

SEQ ID NO: 1353474 - RNA, 16 nt, Mycobacterium tuberculosis H37Rv
cagcacccgcuccagc

SEQ ID NO: 1353475 - RNA, 17 nt, Mycobacterium tuberculosis H37Rv
cagcacccgcuccagcu

SEQ ID NO: 1353476 - RNA, 19 nt, Mycobacterium tuberculosis H37Rv
cagcacccgcuccagcucg

SEQ ID NO: 1353477 - RNA, 22 nt, Mycobacterium tuberculosis H37Rv
cagcacccgagcgaugcgaccg

SEQ ID NO: 1353478 - RNA, 17 nt, Mycobacterium tuberculosis H37Rv
cagcacccgagcgaugc

SEQ ID NO: 1353479 - RNA, 13 nt, Mycobacterium tuberculosis H37Rv
cagcacccgagcg

SEQ ID NO: 1353480 - RNA, 19 nt, Mycobacterium tuberculosis H37Rv
cagcacccccucggcuucg

SEQ ID NO: 1353481 - RNA, 18 nt, Mycobacterium tuberculosis H37Rv
cagcaccgccgcgccggc

SEQ ID NO: 1353482 - RNA, 16 nt, Mycobacterium tuberculosis H37Rv
cagcaccgccgcugcc

SEQ ID NO: 1353483 - RNA, 18 nt, Mycobacterium tuberculosis H37Rv
cagcaccggaucgaccaa

SEQ ID NO: 1353484 - RNA, 20 nt, Mycobacterium tuberculosis H37Rv
cagcacccugcgggccgaga

SEQ ID NO: 1353485 - RNA, 20 nt, Mycobacterium tuberculosis H37Rv
cagcaccgaacccgccaccg

SEQ ID NO: 1353486 - RNA, 14 nt, Mycobacterium tuberculosis H37Rv
cagcacgugugcgg

SEQ ID NO: 1353487 - RNA, 17 nt, Mycobacterium tuberculosis H37Rv
cagcacguccgcggagc

SEQ ID NO: 1353488 - RNA, 17 nt, Mycobacterium tuberculosis H37Rv
cagcacguaacgccgcu

SEQ ID NO: 1353489 - RNA, 15 nt, Mycobacterium tuberculosis H37Rv
cagcacguaacccag

SEQ ID NO: 1353490 - RNA, 12 nt, Mycobacterium tuberculosis H37Rv
cagcacggucaa

SEQ ID NO: 1353491 - RNA, 23 nt, Mycobacterium tuberculosis H37Rv
cagcacgguguugcgcacccgcg

SEQ ID NO: 1353492 - RNA, 17 nt, Mycobacterium tuberculosis H37Rv
cagcacggcggccacgu

SEQ ID NO: 1353493 - RNA, 18 nt, Mycobacterium tuberculosis H37Rv
cagcacgggugagcacca

SEQ ID NO: 1353494 - RNA, 14 nt, Mycobacterium tuberculosis H37Rv
cagcacggcggcca

SEQ ID NO: 1353495 - RNA, 17 nt, Mycobacterium tuberculosis H37Rv
cagcacgcuggcguugu

SEQ ID NO: 1353496 - RNA, 14 nt, Mycobacterium tuberculosis H37Rv
cagcacgcgcgcga

SEQ ID NO: 1353497 - RNA, 16 nt, Mycobacterium tuberculosis H37Rv
cagcacgcgcgcgacc

SEQ ID NO: 1353498 - RNA, 21 nt, Mycobacterium tuberculosis H37Rv
cagcacgcucgugacgaucag

SEQ ID NO: 1353499 - RNA, 21 nt, Mycobacterium tuberculosis H37Rv
cagcacgcugaccacaaccgu

SEQ ID NO: 1353500 - RNA, 14 nt, Mycobacterium tuberculosis H37Rv
cagcacgcccucga

SEQ ID NO: 1353501 - RNA, 20 nt, Mycobacterium tuberculosis H37Rv
cagcacgccgccggccgcca

SEQ ID NO: 1353502 - RNA, 17 nt, Mycobacterium tuberculosis H37Rv
cagcagauugaugucag

SEQ ID NO: 1353503 - RNA, 18 nt, Mycobacterium tuberculosis H37Rv
cagcagauccuggccggu

SEQ ID NO: 1353504 - RNA, 13 nt, Mycobacterium tuberculosis H37Rv
cagcagaucaggu

SEQ ID NO: 1353505 - RNA, 11 nt, Mycobacterium tuberculosis H37Rv
cagcagcaacg

SEQ ID NO: 1353506 - RNA, 13 nt, Mycobacterium tuberculosis H37Rv
cagcagagccaac

SEQ ID NO: 1353507 - RNA, 21 nt, Mycobacterium tuberculosis H37Rv
cagcagagccaacgcgcgacc

SEQ ID NO: 1353508 - RNA, 19 nt, Mycobacterium tuberculosis H37Rv
cagcagaaacaucgacagc

SEQ ID NO: 1353509 - RNA, 16 nt, Mycobacterium tuberculosis H37Rv
cagcacuccaccgcug

SEQ ID NO: 1353510 - RNA, 14 nt, Mycobacterium tuberculosis H37Rv
cagcagccaggagc

SEQ ID NO: 1353511 - RNA, 21 nt, Mycobacterium tuberculosis H37Rv
cagcagcaugucgacggucag

SEQ ID NO: 1353512 - RNA, 14 nt, Mycobacterium tuberculosis H37Rv
cagcagcagcgccg

SEQ ID NO: 1353513 - RNA, 16 nt, Mycobacterium tuberculosis H37Rv
cagcagcagauccugg

SEQ ID NO: 1353514 - RNA, 18 nt, Mycobacterium tuberculosis H37Rv
cagcagccgcgacgcggc

SEQ ID NO: 1353515 - RNA, 17 nt, Mycobacterium tuberculosis H37Rv
cagcagccgccgaugau

SEQ ID NO: 1353516 - RNA, 16 nt, Mycobacterium tuberculosis H37Rv
cagcagcccgggcagc

SEQ ID NO: 1353517 - RNA, 18 nt, Mycobacterium tuberculosis H37Rv
cagcagcgcaacggccag

SEQ ID NO: 1353518 - RNA, 14 nt, Mycobacterium tuberculosis H37Rv
cagcagcgccaccc

SEQ ID NO: 1353519 - RNA, 22 nt, Mycobacterium tuberculosis H37Rv
cagcagcgagucgaaugucccg

SEQ ID NO: 1353520 - RNA, 20 nt, Mycobacterium tuberculosis H37Rv
cagcagcuugacaucgguca

SEQ ID NO: 1353521 - RNA, 20 nt, Mycobacterium tuberculosis H37Rv
cagcaggaucggcagcagag

SEQ ID NO: 1353522 - RNA, 23 nt, Mycobacterium tuberculosis H37Rv
cagcaggaucggcagcagaguuc

SEQ ID NO: 1353523 - RNA, 18 nt, Mycobacterium tuberculosis H37Rv
cagcaggaaguagccgag

SEQ ID NO: 1353524 - RNA, 18 nt, Mycobacterium tuberculosis H37Rv
cagcaggaagccgaagau

SEQ ID NO: 1353525 - RNA, 13 nt, Mycobacterium tuberculosis H37Rv
cagcaggacaccu

SEQ ID NO: 1353526 - RNA, 16 nt, Mycobacterium tuberculosis H37Rv
cagcagcggcgagcca

SEQ ID NO: 1353527 - RNA, 22 nt, Mycobacterium tuberculosis H37Rv
cagcagcggcggaaggacggca

SEQ ID NO: 1353528 - RNA, 15 nt, Mycobacterium tuberculosis H37Rv
cagcagcgucggugc

SEQ ID NO: 1353529 - RNA, 20 nt, Mycobacterium tuberculosis H37Rv
cagcagcguugacggcuucg

SEQ ID NO: 1353530 - RNA, 13 nt, Mycobacterium tuberculosis H37Rv
cagcagcgcgaca

SEQ ID NO: 1353531 - RNA, 15 nt, Mycobacterium tuberculosis H37Rv
cagcagugccgugcu

SEQ ID NO: 1353532 - RNA, 16 nt, Mycobacterium tuberculosis H37Rv
cagcaguacaccgccc

SEQ ID NO: 1353533 - RNA, 23 nt, Mycobacterium tuberculosis H37Rv
cagcaguucggcgaugcgcgggu

SEQ ID NO: 1353534 - RNA, 15 nt, Mycobacterium tuberculosis H37Rv
cagcagguuguaguc

SEQ ID NO: 1353535 - RNA, 16 nt, Mycobacterium tuberculosis H37Rv
cagcagguuggcgagc

SEQ ID NO: 1353536 - RNA, 20 nt, Mycobacterium tuberculosis H37Rv
cagcaggugagccaguuggc

SEQ ID NO: 1353537 - RNA, 22 nt, Mycobacterium tuberculosis H37Rv
cagcagggccaccaccacggcc

SEQ ID NO: 1353538 - RNA, 14 nt, Mycobacterium tuberculosis H37Rv
cagcagggccacca

SEQ ID NO: 1353539 - RNA, 20 nt, Mycobacterium tuberculosis H37Rv
cagcaggcucgaaccgacgc

SEQ ID NO: 1353540 - RNA, 22 nt, Mycobacterium tuberculosis H37Rv
cagcaggggaucguccggccgg

SEQ ID NO: 1353541 - RNA, 20 nt, Mycobacterium tuberculosis H37Rv
cagcaggggacgggcggcca

SEQ ID NO: 1353542 - RNA, 22 nt, Mycobacterium tuberculosis H37Rv
cagcaggcggcugaacggcagc

SEQ ID NO: 1353543 - RNA, 21 nt, Mycobacterium tuberculosis H37Rv
cagcaggccgggcgcaagcag

SEQ ID NO: 1353544 - RNA, 22 nt, Mycobacterium tuberculosis H37Rv
cagcaggccgggcgcaagcagc

SEQ ID NO: 1353545 - RNA, 16 nt, Mycobacterium tuberculosis H37Rv
cagcaggccgggcgca

SEQ ID NO: 1353546 - RNA, 17 nt, Mycobacterium tuberculosis H37Rv
cagcaggccgggcgcaa

SEQ ID NO: 1353547 - RNA, 19 nt, Mycobacterium tuberculosis H37Rv
cagcaggcccacccgggcg

SEQ ID NO: 1353548 - RNA, 15 nt, Mycobacterium tuberculosis H37Rv
cagcaggcccagcgg

SEQ ID NO: 1353549 - RNA, 14 nt, Mycobacterium tuberculosis H37Rv
cagcaggcccuggc

SEQ ID NO: 1353550 - RNA, 17 nt, Mycobacterium tuberculosis H37Rv
cagcaggccacugcguu

SEQ ID NO: 1353551 - RNA, 14 nt, Mycobacterium tuberculosis H37Rv
cagcaggcccaccc

SEQ ID NO: 1353552 - RNA, 14 nt, Mycobacterium tuberculosis H37Rv
cagccacgucuccu

SEQ ID NO: 1353553 - RNA, 16 nt, Mycobacterium tuberculosis H37Rv
cagccacgcugucccg

SEQ ID NO: 1353554 - RNA, 15 nt, Mycobacterium tuberculosis H37Rv
cagccacgcaaauac

SEQ ID NO: 1353555 - RNA, 14 nt, Mycobacterium tuberculosis H37Rv
cagccaccgggcgu

SEQ ID NO: 1353556 - RNA, 12 nt, Mycobacterium tuberculosis H37Rv
cagccagcaagu

SEQ ID NO: 1353557 - RNA, 16 nt, Mycobacterium tuberculosis H37Rv
cagccagcccagccgc

SEQ ID NO: 1353558 - RNA, 18 nt, Mycobacterium tuberculosis H37Rv
cagccagcccagccgcca

SEQ ID NO: 1353559 - RNA, 14 nt, Mycobacterium tuberculosis H37Rv
cagccagccaccga

SEQ ID NO: 1353560 - RNA, 13 nt, Mycobacterium tuberculosis H37Rv
cagccagccaccg

SEQ ID NO: 1353561 - RNA, 14 nt, Mycobacterium tuberculosis H37Rv
cagccagcccagcc

SEQ ID NO: 1353562 - RNA, 15 nt, Mycobacterium tuberculosis H37Rv
cagccagaccaacau

SEQ ID NO: 1353563 - RNA, 16 nt, Mycobacterium tuberculosis H37Rv
cagccagaugccggua

SEQ ID NO: 1353564 - RNA, 12 nt, Mycobacterium tuberculosis H37Rv
cagccagcaaca

SEQ ID NO: 1353565 - RNA, 11 nt, Mycobacterium tuberculosis H37Rv
cagccagcaag

SEQ ID NO: 1353566 - RNA, 18 nt, Mycobacterium tuberculosis H37Rv
cagccagaucuccccgac

SEQ ID NO: 1353567 - RNA, 23 nt, Mycobacterium tuberculosis H37Rv
cagccagggucccgccgccugga

SEQ ID NO: 1353568 - RNA, 23 nt, Mycobacterium tuberculosis H37Rv
cagccaguaaaaaggcaggacug

SEQ ID NO: 1353569 - RNA, 20 nt, Mycobacterium tuberculosis H37Rv
cagccagggucccgccgccu

SEQ ID NO: 1353570 - RNA, 19 nt, Mycobacterium tuberculosis H37Rv
cagccaguguugcaguggc

SEQ ID NO: 1353571 - RNA, 19 nt, Mycobacterium tuberculosis H37Rv
cagccaguugaucaggccg

SEQ ID NO: 1353572 - RNA, 20 nt, Mycobacterium tuberculosis H37Rv
cagccaguguugcaguggcg

SEQ ID NO: 1353573 - RNA, 19 nt, Mycobacterium tuberculosis H37Rv
cagccaguccagcgcgcca

SEQ ID NO: 1353574 - RNA, 17 nt, Mycobacterium tuberculosis H37Rv
cagccaguccagcgcgc

SEQ ID NO: 1353575 - RNA, 14 nt, Mycobacterium tuberculosis H37Rv
cagccagccgcccu

SEQ ID NO: 1353576 - RNA, 22 nt, Mycobacterium tuberculosis H37Rv
cagccagccugcuggccgcggc

SEQ ID NO: 1353577 - RNA, 17 nt, Mycobacterium tuberculosis H37Rv
cagccaggccagugcca

SEQ ID NO: 1353578 - RNA, 18 nt, Mycobacterium tuberculosis H37Rv
cagccagcuggacuccgg

SEQ ID NO: 1353579 - RNA, 14 nt, Mycobacterium tuberculosis H37Rv
cagccagcuggacu

SEQ ID NO: 1353580 - RNA, 12 nt, Mycobacterium tuberculosis H37Rv
cagccaggagcc

SEQ ID NO: 1353581 - RNA, 23 nt, Mycobacterium tuberculosis H37Rv
cagccaggagccgaucacgcugc

SEQ ID NO: 1353582 - RNA, 13 nt, Mycobacterium tuberculosis H37Rv
cagccccuccgcg

SEQ ID NO: 1353583 - RNA, 21 nt, Mycobacterium tuberculosis H37Rv
cagccccguuucgccagaugg

SEQ ID NO: 1353584 - RNA, 22 nt, Mycobacterium tuberculosis H37Rv
cagccccguuucgccagauggc

SEQ ID NO: 1353585 - RNA, 17 nt, Mycobacterium tuberculosis H37Rv
cagccccgacugcgccc

SEQ ID NO: 1353586 - RNA, 18 nt, Mycobacterium tuberculosis H37Rv
cagccccgccggggccgc

SEQ ID NO: 1353587 - RNA, 22 nt, Mycobacterium tuberculosis H37Rv
cagccccgccggggccgccguc

SEQ ID NO: 1353588 - RNA, 15 nt, Mycobacterium tuberculosis H37Rv
cagccccgcgcccac

SEQ ID NO: 1353589 - RNA, 20 nt, Mycobacterium tuberculosis H37Rv
cagccccccggcgacggcgu

SEQ ID NO: 1353590 - RNA, 14 nt, Mycobacterium tuberculosis H37Rv
cagccccagggugc

SEQ ID NO: 1353591 - RNA, 17 nt, Mycobacterium tuberculosis H37Rv
cagcccaugcgccacgc

SEQ ID NO: 1353592 - RNA, 15 nt, Mycobacterium tuberculosis H37Rv
cagcccaugcccggc

SEQ ID NO: 1353593 - RNA, 16 nt, Mycobacterium tuberculosis H37Rv
cagccauggugggccu

SEQ ID NO: 1353594 - RNA, 20 nt, Mycobacterium tuberculosis H37Rv
cagccaugcucgucuugggc

SEQ ID NO: 1353595 - RNA, 19 nt, Mycobacterium tuberculosis H37Rv
cagccauggcagcgccgca

SEQ ID NO: 1353596 - RNA, 19 nt, Mycobacterium tuberculosis H37Rv
cagcccaccggugccgccc

SEQ ID NO: 1353597 - RNA, 21 nt, Mycobacterium tuberculosis H37Rv
cagcccaccggugccgcccgc

SEQ ID NO: 1353598 - RNA, 10 nt, Mycobacterium tuberculosis H37Rv
cagcccacuc

SEQ ID NO: 1353599 - RNA, 16 nt, Mycobacterium tuberculosis H37Rv
cagcccagccgccagc

SEQ ID NO: 1353600 - RNA, 13 nt, Mycobacterium tuberculosis H37Rv
cagcccaggccuu

SEQ ID NO: 1353601 - RNA, 23 nt, Mycobacterium tuberculosis H37Rv
cagcccacaggcggcgcugcagc

SEQ ID NO: 1353602 - RNA, 17 nt, Mycobacterium tuberculosis H37Rv
cagcaucagcgccagcg

SEQ ID NO: 1353603 - RNA, 20 nt, Mycobacterium tuberculosis H37Rv
cagcaucacguccgcggugu

SEQ ID NO: 1353604 - RNA, 15 nt, Mycobacterium tuberculosis H37Rv
cagcauccccgcagc

SEQ ID NO: 1353605 - RNA, 17 nt, Mycobacterium tuberculosis H37Rv
cagcaugacaccggcca

SEQ ID NO: 1353606 - RNA, 14 nt, Mycobacterium tuberculosis H37Rv
cagcaugccuucgg

SEQ ID NO: 1353607 - RNA, 22 nt, Mycobacterium tuberculosis H37Rv
cagcaugacaccggccaccagc

SEQ ID NO: 1353608 - RNA, 23 nt, Mycobacterium tuberculosis H37Rv
cagcaugacaccggccaccagcc

SEQ ID NO: 1353609 - RNA, 17 nt, Mycobacterium tuberculosis H37Rv
cagcaucgccagcagga

SEQ ID NO: 1353610 - RNA, 23 nt, Mycobacterium tuberculosis H37Rv
cagcauccggccgucaucuggaa

SEQ ID NO: 1353611 - RNA, 13 nt, Mycobacterium tuberculosis H37Rv
cagcauccggccg

SEQ ID NO: 1353612 - RNA, 21 nt, Mycobacterium tuberculosis H37Rv
cagcaucuccgucggccaggc

SEQ ID NO: 1353613 - RNA, 17 nt, Mycobacterium tuberculosis H37Rv
cagcaucggcagcagcg

SEQ ID NO: 1353614 - RNA, 13 nt, Mycobacterium tuberculosis H37Rv
cagcauggcccug

SEQ ID NO: 1353615 - RNA, 17 nt, Mycobacterium tuberculosis H37Rv
cagcauggcccuggcga

SEQ ID NO: 1353616 - RNA, 20 nt, Mycobacterium tuberculosis H37Rv
cagcauggcuuuugcgccga

SEQ ID NO: 1353617 - RNA, 13 nt, Mycobacterium tuberculosis H37Rv
cagcaugguggac

SEQ ID NO: 1353618 - RNA, 15 nt, Mycobacterium tuberculosis H37Rv
cagcaugguggacga

SEQ ID NO: 1353619 - RNA, 22 nt, Mycobacterium tuberculosis H37Rv
cagcauggcccuggcgaccagc

SEQ ID NO: 1353620 - RNA, 22 nt, Mycobacterium tuberculosis H37Rv
cagcaugguccacagccggcgg

SEQ ID NO: 1353621 - RNA, 17 nt, Mycobacterium tuberculosis H37Rv
cagcaugguccacagcc

SEQ ID NO: 1353622 - RNA, 21 nt, Mycobacterium tuberculosis H37Rv
cagcaugucucgggcgcgggu

SEQ ID NO: 1353623 - RNA, 16 nt, Mycobacterium tuberculosis H37Rv
cagcauugaagaagcc

SEQ ID NO: 1353624 - RNA, 15 nt, Mycobacterium tuberculosis H37Rv
cagccaacgcguccc

SEQ ID NO: 1353625 - RNA, 17 nt, Mycobacterium tuberculosis H37Rv
cagccaacgggaacaac

SEQ ID NO: 1353626 - RNA, 21 nt, Mycobacterium tuberculosis H37Rv
cagccaacucaggccgguacc

SEQ ID NO: 1353627 - RNA, 22 nt, Mycobacterium tuberculosis H37Rv
cagccaaccggcgcaguagccg

SEQ ID NO: 1353628 - RNA, 21 nt, Mycobacterium tuberculosis H37Rv
cagccaaaacgagcagauggu

SEQ ID NO: 1353629 - RNA, 15 nt, Mycobacterium tuberculosis H37Rv
cagccaaaucagcca

SEQ ID NO: 1353630 - RNA, 18 nt, Mycobacterium tuberculosis H37Rv
cagccaccgcauguggga

SEQ ID NO: 1353631 - RNA, 14 nt, Mycobacterium tuberculosis H37Rv
cagccaccgcgcgu

SEQ ID NO: 1353632 - RNA, 17 nt, Mycobacterium tuberculosis H37Rv
cagccaccgcggucagc

SEQ ID NO: 1353633 - RNA, 14 nt, Mycobacterium tuberculosis H37Rv
cagccaccaucugg

SEQ ID NO: 1353634 - RNA, 16 nt, Mycobacterium tuberculosis H37Rv
cagccaaguccgcccg

SEQ ID NO: 1353635 - RNA, 17 nt, Mycobacterium tuberculosis H37Rv
cagccacagccgaccuc

SEQ ID NO: 1353636 - RNA, 12 nt, Mycobacterium tuberculosis H37Rv
cacugccaccgc

SEQ ID NO: 1353637 - RNA, 13 nt, Mycobacterium tuberculosis H37Rv
cacugccagccgu

SEQ ID NO: 1353638 - RNA, 19 nt, Mycobacterium tuberculosis H37Rv
cacugccaguagucgccgg

SEQ ID NO: 1353639 - RNA, 15 nt, Mycobacterium tuberculosis H37Rv
cacugcccggggucc

SEQ ID NO: 1353640 - RNA, 15 nt, Mycobacterium tuberculosis H37Rv
cacugcgcccgccac

SEQ ID NO: 1353641 - RNA, 16 nt, Mycobacterium tuberculosis H37Rv
cacugcgcccgccacg

SEQ ID NO: 1353642 - RNA, 15 nt, Mycobacterium tuberculosis H37Rv
cacugcgccggccgc

SEQ ID NO: 1353643 - RNA, 17 nt, Mycobacterium tuberculosis H37Rv
cacugcgccggccgcag

SEQ ID NO: 1353644 - RNA, 13 nt, Mycobacterium tuberculosis H37Rv
cacugcgcccgcc

SEQ ID NO: 1353645 - RNA, 22 nt, Mycobacterium tuberculosis H37Rv
cacugcgaucgcgacccgaucg

SEQ ID NO: 1353646 - RNA, 15 nt, Mycobacterium tuberculosis H37Rv
cacugcgccgugacc

SEQ ID NO: 1353647 - RNA, 17 nt, Mycobacterium tuberculosis H37Rv
cacugcggcagguucgg

SEQ ID NO: 1353648 - RNA, 15 nt, Mycobacterium tuberculosis H37Rv
cacugcggccgcgcc

SEQ ID NO: 1353649 - RNA, 12 nt, Mycobacterium tuberculosis H37Rv
cacugcgagcgc

SEQ ID NO: 1353650 - RNA, 19 nt, Mycobacterium tuberculosis H37Rv
cacugcgaccgucccggcc

SEQ ID NO: 1353651 - RNA, 22 nt, Mycobacterium tuberculosis H37Rv
cacugcgaaaauggcgccuugg

SEQ ID NO: 1353652 - RNA, 23 nt, Mycobacterium tuberculosis H37Rv
cacugccgcgcucgcgcaccguc

SEQ ID NO: 1353653 - RNA, 18 nt, Mycobacterium tuberculosis H37Rv
cacugccggcagcgcccc

SEQ ID NO: 1353654 - RNA, 22 nt, Mycobacterium tuberculosis H37Rv
cacugccgccgguuccgccggc

SEQ ID NO: 1353655 - RNA, 23 nt, Mycobacterium tuberculosis H37Rv
cacugccggugggcguucccccg

SEQ ID NO: 1353656 - RNA, 18 nt, Mycobacterium tuberculosis H37Rv
cacugaugucacccgccc

SEQ ID NO: 1353657 - RNA, 12 nt, Mycobacterium tuberculosis H37Rv
caauguccaggc

SEQ ID NO: 1353658 - RNA, 23 nt, Mycobacterium tuberculosis H37Rv
cacuguuggugccgccaccaccg

SEQ ID NO: 1353659 - RNA, 15 nt, Mycobacterium tuberculosis H37Rv
cacuguugaagaagc

SEQ ID NO: 1353660 - RNA, 19 nt, Mycobacterium tuberculosis H37Rv
cacuguugaagaagcccga

SEQ ID NO: 1353661 - RNA, 18 nt, Mycobacterium tuberculosis H37Rv
cacugugccgcugcaucc

SEQ ID NO: 1353662 - RNA, 18 nt, Mycobacterium tuberculosis H37Rv
cacugucggguaacccca

SEQ ID NO: 1353663 - RNA, 16 nt, Mycobacterium tuberculosis H37Rv
cacuggugacccugau

SEQ ID NO: 1353664 - RNA, 21 nt, Mycobacterium tuberculosis H37Rv
cacugguugggcgagaccgcg

SEQ ID NO: 1353665 - RNA, 18 nt, Mycobacterium tuberculosis H37Rv
cacuggcgccggugccgc

SEQ ID NO: 1353666 - RNA, 19 nt, Mycobacterium tuberculosis H37Rv
cacuggcgauaucggcccc

SEQ ID NO: 1353667 - RNA, 22 nt, Mycobacterium tuberculosis H37Rv
cacuggcgauaucggcccccaa

SEQ ID NO: 1353668 - RNA, 16 nt, Mycobacterium tuberculosis H37Rv
cacugcugcggcagcg

SEQ ID NO: 1353669 - RNA, 17 nt, Mycobacterium tuberculosis H37Rv
cacuggaauggaucucg

SEQ ID NO: 1353670 - RNA, 15 nt, Mycobacterium tuberculosis H37Rv
cacuggaccaccgcc

SEQ ID NO: 1353671 - RNA, 21 nt, Mycobacterium tuberculosis H37Rv
cacuugaaguucuucuccguc

SEQ ID NO: 1353672 - RNA, 17 nt, Mycobacterium tuberculosis H37Rv
cacuucggcgccgcgcc

SEQ ID NO: 1353673 - RNA, 23 nt, Mycobacterium tuberculosis H37Rv
cacuucgguguuggacacucccg

SEQ ID NO: 1353674 - RNA, 16 nt, Mycobacterium tuberculosis H37Rv
cacuucccccgggucc

SEQ ID NO: 1353675 - RNA, 13 nt, Mycobacterium tuberculosis H37Rv
cacuuggacccgg

SEQ ID NO: 1353676 - RNA, 19 nt, Mycobacterium tuberculosis H37Rv
cacuuggacccggccggcc

SEQ ID NO: 1353677 - RNA, 13 nt, Mycobacterium tuberculosis H37Rv
cacuugccgggca

SEQ ID NO: 1353678 - RNA, 18 nt, Mycobacterium tuberculosis H37Rv
cacuugcgccaccguggc

SEQ ID NO: 1353679 - RNA, 12 nt, Mycobacterium tuberculosis H37Rv
cacuugaugcuc

SEQ ID NO: 1353680 - RNA, 13 nt, Mycobacterium tuberculosis H37Rv
cacuuuccggccg

SEQ ID NO: 1353681 - RNA, 19 nt, Mycobacterium tuberculosis H37Rv
cacuuuuccgccggccagg

SEQ ID NO: 1353682 - RNA, 12 nt, Mycobacterium tuberculosis H37Rv
cacuuucuuccu

SEQ ID NO: 1353683 - RNA, 15 nt, Mycobacterium tuberculosis H37Rv
cagaaacaacgucgc

SEQ ID NO: 1353684 - RNA, 13 nt, Mycobacterium tuberculosis H37Rv
cagaacaccaccg

SEQ ID NO: 1353685 - RNA, 17 nt, Mycobacterium tuberculosis H37Rv
cagaacaccaccgccag

SEQ ID NO: 1353686 - RNA, 21 nt, Mycobacterium tuberculosis H37Rv
cagaaccacuuuccgaggagg

SEQ ID NO: 1353687 - RNA, 14 nt, Mycobacterium tuberculosis H37Rv
cagaaccagcgacc

SEQ ID NO: 1353688 - RNA, 14 nt, Mycobacterium tuberculosis H37Rv
cagaacggcggcag

SEQ ID NO: 1353689 - RNA, 15 nt, Mycobacterium tuberculosis H37Rv
cagaacgcggccucg

SEQ ID NO: 1353690 - RNA, 19 nt, Mycobacterium tuberculosis H37Rv
cagaaccuggagccgugcg

SEQ ID NO: 1353691 - RNA, 14 nt, Mycobacterium tuberculosis H37Rv
cagaacucaccgac

SEQ ID NO: 1353692 - RNA, 17 nt, Mycobacterium tuberculosis H37Rv
cagaacgugacggucca

SEQ ID NO: 1353693 - RNA, 16 nt, Mycobacterium tuberculosis H37Rv
cagacccgugccguca

SEQ ID NO: 1353694 - RNA, 23 nt, Mycobacterium tuberculosis H37Rv
cagaccgugacguagggcagcgc

SEQ ID NO: 1353695 - RNA, 15 nt, Mycobacterium tuberculosis H37Rv
cagacccaccaccgc

SEQ ID NO: 1353696 - RNA, 13 nt, Mycobacterium tuberculosis H37Rv
cagacccaccacc

SEQ ID NO: 1353697 - RNA, 22 nt, Mycobacterium tuberculosis H37Rv
cagacccaguccgguagcagcg

SEQ ID NO: 1353698 - RNA, 13 nt, Mycobacterium tuberculosis H37Rv
cagaccaccgccu

SEQ ID NO: 1353699 - RNA, 14 nt, Mycobacterium tuberculosis H37Rv
cagaccaccgccug

SEQ ID NO: 1353700 - RNA, 13 nt, Mycobacterium tuberculosis H37Rv
cagaccacaacgc

SEQ ID NO: 1353701 - RNA, 14 nt, Mycobacterium tuberculosis H37Rv
cagacacagcaccg

SEQ ID NO: 1353702 - RNA, 13 nt, Mycobacterium tuberculosis H37Rv
cagacacagaauc

SEQ ID NO: 1353703 - RNA, 14 nt, Mycobacterium tuberculosis H37Rv
cagacacgcgcgcu

SEQ ID NO: 1353704 - RNA, 13 nt, Mycobacterium tuberculosis H37Rv
cagacacgcugca

SEQ ID NO: 1353705 - RNA, 18 nt, Mycobacterium tuberculosis H37Rv
cagacacuaaagcccucg

SEQ ID NO: 1353706 - RNA, 15 nt, Mycobacterium tuberculosis H37Rv
cagacagacccccag

SEQ ID NO: 1353707 - RNA, 13 nt, Mycobacterium tuberculosis H37Rv
cagaccaacauga

SEQ ID NO: 1353708 - RNA, 23 nt, Mycobacterium tuberculosis H37Rv
cagaccaagcccgucgucgugca

SEQ ID NO: 1353709 - RNA, 23 nt, Mycobacterium tuberculosis H37Rv
cagacaggcggcggccuggcacc

SEQ ID NO: 1353710 - RNA, 21 nt, Mycobacterium tuberculosis H37Rv
cagaauucggcgcgacagccg

SEQ ID NO: 1353711 - RNA, 18 nt, Mycobacterium tuberculosis H37Rv
cagaaugccuggcccguc

SEQ ID NO: 1353712 - RNA, 20 nt, Mycobacterium tuberculosis H37Rv
cagaauccugcgcugcacca

SEQ ID NO: 1353713 - RNA, 17 nt, Mycobacterium tuberculosis H37Rv
cagaaucgaccgccgcu

SEQ ID NO: 1353714 - RNA, 21 nt, Mycobacterium tuberculosis H37Rv
cagaaucucgccgggcugcaa

SEQ ID NO: 1353715 - RNA, 18 nt, Mycobacterium tuberculosis H37Rv
cagaaucgcacgcgaaau

SEQ ID NO: 1353716 - RNA, 15 nt, Mycobacterium tuberculosis H37Rv
cagaaucugccucuc

SEQ ID NO: 1353717 - RNA, 18 nt, Mycobacterium tuberculosis H37Rv
cagaaucugccucucagc

SEQ ID NO: 1353718 - RNA, 15 nt, Mycobacterium tuberculosis H37Rv
cagaaucucgccggg

SEQ ID NO: 1353719 - RNA, 13 nt, Mycobacterium tuberculosis H37Rv
cagaaucugccuc

SEQ ID NO: 1353720 - RNA, 14 nt, Mycobacterium tuberculosis H37Rv
cagacgacgaucag

SEQ ID NO: 1353721 - RNA, 15 nt, Mycobacterium tuberculosis H37Rv
cagacgcggaaucgc

SEQ ID NO: 1353722 - RNA, 18 nt, Mycobacterium tuberculosis H37Rv
cagacgcagaaucgccca

SEQ ID NO: 1353723 - RNA, 17 nt, Mycobacterium tuberculosis H37Rv
cagacgcagaagccccc

SEQ ID NO: 1353724 - RNA, 16 nt, Mycobacterium tuberculosis H37Rv
cagacgauggccaggu

SEQ ID NO: 1353725 - RNA, 14 nt, Mycobacterium tuberculosis H37Rv
cagacgcaaaaucc

SEQ ID NO: 1353726 - RNA, 17 nt, Mycobacterium tuberculosis H37Rv
cagacgcauaagccccc

SEQ ID NO: 1353727 - RNA, 16 nt, Mycobacterium tuberculosis H37Rv
cagacgccccuucccu

SEQ ID NO: 1353728 - RNA, 20 nt, Mycobacterium tuberculosis H37Rv
cagacgccacugccagccgu

SEQ ID NO: 1353729 - RNA, 17 nt, Mycobacterium tuberculosis H37Rv
cagacggugcagcuccc

SEQ ID NO: 1353730 - RNA, 21 nt, Mycobacterium tuberculosis H37Rv
cagacggugcagcuccccgcc

SEQ ID NO: 1353731 - RNA, 22 nt, Mycobacterium tuberculosis H37Rv
cagacggugaagccgagcgccc

SEQ ID NO: 1353732 - RNA, 18 nt, Mycobacterium tuberculosis H37Rv
cagagaacuccgccacca

SEQ ID NO: 1353733 - RNA, 20 nt, Mycobacterium tuberculosis H37Rv
cagagccgcccuugccuccg

SEQ ID NO: 1353734 - RNA, 15 nt, Mycobacterium tuberculosis H37Rv
cagagccgggcuggc

SEQ ID NO: 1353735 - RNA, 17 nt, Mycobacterium tuberculosis H37Rv
cagagccgcugcggcac

SEQ ID NO: 1353736 - RNA, 18 nt, Mycobacterium tuberculosis H37Rv
cagagccccggcaagcgc

SEQ ID NO: 1353737 - RNA, 16 nt, Mycobacterium tuberculosis H37Rv
cagagcacgcgcggcg

SEQ ID NO: 1353738 - RNA, 19 nt, Mycobacterium tuberculosis H37Rv
cagagcaccgcgaacagca

SEQ ID NO: 1353739 - RNA, 14 nt, Mycobacterium tuberculosis H37Rv
cagagcggcacgca

SEQ ID NO: 1353740 - RNA, 22 nt, Mycobacterium tuberculosis H37Rv
cagagcgaacccccgccgcgca

SEQ ID NO: 1353741 - RNA, 22 nt, Mycobacterium tuberculosis H37Rv
cagagcucgaaguuggcuuucg

SEQ ID NO: 1353742 - RNA, 21 nt, Mycobacterium tuberculosis H37Rv
cagaggcgcaagaaugccgcc

SEQ ID NO: 1353743 - RNA, 19 nt, Mycobacterium tuberculosis H37Rv
cagaggaucaucgacgccu

SEQ ID NO: 1353744 - RNA, 19 nt, Mycobacterium tuberculosis H37Rv
cagaggucggucagccacc

SEQ ID NO: 1353745 - RNA, 19 nt, Mycobacterium tuberculosis H37Rv
cagaggucacgcagcaccc

SEQ ID NO: 1353746 - RNA, 18 nt, Mycobacterium tuberculosis H37Rv
cagaguucccgaaacccg

SEQ ID NO: 1353747 - RNA, 19 nt, Mycobacterium tuberculosis H37Rv
cagaguuugcgaugcccac

SEQ ID NO: 1353748 - RNA, 15 nt, Mycobacterium tuberculosis H37Rv
cagauaccaccgccg

SEQ ID NO: 1353749 - RNA, 18 nt, Mycobacterium tuberculosis H37Rv
cagauacaggaacaacgc

SEQ ID NO: 1353750 - RNA, 23 nt, Mycobacterium tuberculosis H37Rv
cagauacaucgggaucugggcuc

SEQ ID NO: 1353751 - RNA, 14 nt, Mycobacterium tuberculosis H37Rv
cagauacgagcugu

SEQ ID NO: 1353752 - RNA, 12 nt, Mycobacterium tuberculosis H37Rv
cagauagacuag

SEQ ID NO: 1353753 - RNA, 17 nt, Mycobacterium tuberculosis H37Rv
cagaucaacaucaucac

SEQ ID NO: 1353754 - RNA, 20 nt, Mycobacterium tuberculosis H37Rv
cagaucaacgcgaaccgucu

SEQ ID NO: 1353755 - RNA, 22 nt, Mycobacterium tuberculosis H37Rv
cagaucacgcacucgcgucccg

SEQ ID NO: 1353756 - RNA, 16 nt, Mycobacterium tuberculosis H37Rv
cagaucaccgccagcu

SEQ ID NO: 1353757 - RNA, 17 nt, Mycobacterium tuberculosis H37Rv
cagauaucguacuggcu

SEQ ID NO: 1353758 - RNA, 17 nt, Mycobacterium tuberculosis H37Rv
cagauagugcauguauu

SEQ ID NO: 1353759 - RNA, 19 nt, Mycobacterium tuberculosis H37Rv
cagauaggacccagccagc

SEQ ID NO: 1353760 - RNA, 21 nt, Mycobacterium tuberculosis H37Rv
cagauagguuccaccgggcgu

SEQ ID NO: 1353761 - RNA, 15 nt, Mycobacterium tuberculosis H37Rv
cagaugccgggcuga

SEQ ID NO: 1353762 - RNA, 21 nt, Mycobacterium tuberculosis H37Rv
cagauggcauugcgcccaccg

SEQ ID NO: 1353763 - RNA, 15 nt, Mycobacterium tuberculosis H37Rv
cagauggccacccgc

SEQ ID NO: 1353764 - RNA, 17 nt, Mycobacterium tuberculosis H37Rv
cagaucgucacucccga

SEQ ID NO: 1353765 - RNA, 13 nt, Mycobacterium tuberculosis H37Rv
cagaugagucaaa

SEQ ID NO: 1353766 - RNA, 14 nt, Mycobacterium tuberculosis H37Rv
cagaugagucaaaa

SEQ ID NO: 1353767 - RNA, 21 nt, Mycobacterium tuberculosis H37Rv
cagaugaugccguucggaccc

SEQ ID NO: 1353768 - RNA, 17 nt, Mycobacterium tuberculosis H37Rv
cagaugagucaaaaucc

SEQ ID NO: 1353769 - RNA, 16 nt, Mycobacterium tuberculosis H37Rv
cagaugcagcggucca

SEQ ID NO: 1353770 - RNA, 15 nt, Mycobacterium tuberculosis H37Rv
cagaugcagcggucc

SEQ ID NO: 1353771 - RNA, 17 nt, Mycobacterium tuberculosis H37Rv
cagaucggcgacgccgu

SEQ ID NO: 1353772 - RNA, 17 nt, Mycobacterium tuberculosis H37Rv
cagaucgagggggacgc

SEQ ID NO: 1353773 - RNA, 17 nt, Mycobacterium tuberculosis H37Rv
cagaucgcacaccaaca

SEQ ID NO: 1353774 - RNA, 18 nt, Mycobacterium tuberculosis H37Rv
cagauccgguccaccgcc

SEQ ID NO: 1353775 - RNA, 13 nt, Mycobacterium tuberculosis H37Rv
cagaucuugcagu

SEQ ID NO: 1353776 - RNA, 21 nt, Mycobacterium tuberculosis H37Rv
cagaucuggguucccgaugug

SEQ ID NO: 1353777 - RNA, 20 nt, Mycobacterium tuberculosis H37Rv
cagaucuccaagcucgacaa

SEQ ID NO: 1353778 - RNA, 15 nt, Mycobacterium tuberculosis H37Rv
cagaucguccaccgc

SEQ ID NO: 1353779 - RNA, 19 nt, Mycobacterium tuberculosis H37Rv
cagaucguagugcgcgcca

SEQ ID NO: 1353780 - RNA, 15 nt, Mycobacterium tuberculosis H37Rv
cagaugggccuccac

SEQ ID NO: 1353781 - RNA, 21 nt, Mycobacterium tuberculosis H37Rv
cagaugguuggaucgccaccg

SEQ ID NO: 1353782 - RNA, 19 nt, Mycobacterium tuberculosis H37Rv
cagauguaccucaucgcag

SEQ ID NO: 1353783 - RNA, 12 nt, Mycobacterium tuberculosis H37Rv
cagauggggcuc

SEQ ID NO: 1353784 - RNA, 17 nt, Mycobacterium tuberculosis H37Rv
cagauugucgacgguca

SEQ ID NO: 1353785 - RNA, 18 nt, Mycobacterium tuberculosis H37Rv
cagauugcucggugguga

SEQ ID NO: 1353786 - RNA, 16 nt, Mycobacterium tuberculosis H37Rv
cagauuugcuccagcg

SEQ ID NO: 1353787 - RNA, 15 nt, Mycobacterium tuberculosis H37Rv
cagcacaaacccagu

SEQ ID NO: 1353788 - RNA, 16 nt, Mycobacterium tuberculosis H37Rv
cagcacaaacccaguu

SEQ ID NO: 1353789 - RNA, 16 nt, Mycobacterium tuberculosis H37Rv
cagcacacccagaugc

SEQ ID NO: 1353790 - RNA, 22 nt, Mycobacterium tuberculosis H37Rv
cagcaauccaaggcucagcagc

SEQ ID NO: 1353791 - RNA, 19 nt, Mycobacterium tuberculosis H37Rv
cagcaaucagccgccuucu

SEQ ID NO: 1353792 - RNA, 17 nt, Mycobacterium tuberculosis H37Rv
cagcaaucagccgccuu

SEQ ID NO: 1353793 - RNA, 14 nt, Mycobacterium tuberculosis H37Rv
cagcaauccgcaaa

SEQ ID NO: 1353794 - RNA, 16 nt, Mycobacterium tuberculosis H37Rv
cagcaaucagccgccu

SEQ ID NO: 1353795 - RNA, 18 nt, Mycobacterium tuberculosis H37Rv
cagcaauccaaggcucag

SEQ ID NO: 1353796 - RNA, 18 nt, Mycobacterium tuberculosis H37Rv
cagcaccacggcgcgcgc

SEQ ID NO: 1353797 - RNA, 13 nt, Mycobacterium tuberculosis H37Rv
cagcaccacggcc

SEQ ID NO: 1353798 - RNA, 17 nt, Mycobacterium tuberculosis H37Rv
cagcacagcgcagccug

SEQ ID NO: 1353799 - RNA, 16 nt, Mycobacterium tuberculosis H37Rv
cagcacauccugcagc

SEQ ID NO: 1353800 - RNA, 15 nt, Mycobacterium tuberculosis H37Rv
cagcacauccagccc

SEQ ID NO: 1353801 - RNA, 12 nt, Mycobacterium tuberculosis H37Rv
cagcaccaccac

SEQ ID NO: 1353802 - RNA, 13 nt, Mycobacterium tuberculosis H37Rv
cagcaccacaacg

SEQ ID NO: 1353803 - RNA, 17 nt, Mycobacterium tuberculosis H37Rv
cagcaccacaacgucgg

SEQ ID NO: 1353804 - RNA, 17 nt, Mycobacterium tuberculosis H37Rv
cagcaaccaccccaggg

SEQ ID NO: 1353805 - RNA, 18 nt, Mycobacterium tuberculosis H37Rv
cagcaacgcggugccggg

SEQ ID NO: 1353806 - RNA, 21 nt, Mycobacterium tuberculosis H37Rv
cagcaacgacccgaagccgac

SEQ ID NO: 1353807 - RNA, 22 nt, Mycobacterium tuberculosis H37Rv
cagcaaaggggugugugcugcc

SEQ ID NO: 1353808 - RNA, 16 nt, Mycobacterium tuberculosis H37Rv
cagcaaaugcggcgcg

SEQ ID NO: 1353809 - RNA, 18 nt, Mycobacterium tuberculosis H37Rv
cagcaaaggggugugugc

SEQ ID NO: 1353810 - RNA, 17 nt, Mycobacterium tuberculosis H37Rv
cagcaacagcgcggugu

SEQ ID NO: 1353811 - RNA, 13 nt, Mycobacterium tuberculosis H37Rv
cagcaacaggccc

SEQ ID NO: 1353812 - RNA, 16 nt, Mycobacterium tuberculosis H37Rv
cagcaagaucggcagc

SEQ ID NO: 1353813 - RNA, 21 nt, Mycobacterium tuberculosis H37Rv
cagcaagugugagcagaccca

SEQ ID NO: 1353814 - RNA, 15 nt, Mycobacterium tuberculosis H37Rv
cagcaagugcgggcu

SEQ ID NO: 1353815 - RNA, 20 nt, Mycobacterium tuberculosis H37Rv
cagcaagugugagcagaccc

SEQ ID NO: 1353816 - RNA, 20 nt, Mycobacterium tuberculosis H37Rv
cagcaacugccgcacccggu

SEQ ID NO: 1353817 - RNA, 18 nt, Mycobacterium tuberculosis H37Rv
cagcaacggcagcgaggc

SEQ ID NO: 1353818 - RNA, 19 nt, Mycobacterium tuberculosis H37Rv
cagcaacgugugcaccauc

SEQ ID NO: 1353819 - RNA, 16 nt, Mycobacterium tuberculosis H37Rv
caaaguagacgugcca

SEQ ID NO: 1353820 - RNA, 20 nt, Mycobacterium tuberculosis H37Rv
caaagccgggauugccgcca

SEQ ID NO: 1353821 - RNA, 22 nt, Mycobacterium tuberculosis H37Rv
caaagccgucagcucaccaccc

SEQ ID NO: 1353822 - RNA, 17 nt, Mycobacterium tuberculosis H37Rv
caaaucgaugaccgucg

SEQ ID NO: 1353823 - RNA, 13 nt, Mycobacterium tuberculosis H37Rv
caaaucaagcaca

SEQ ID NO: 1353824 - RNA, 17 nt, Mycobacterium tuberculosis H37Rv
caaaucaagcacagccc

SEQ ID NO: 1353825 - RNA, 17 nt, Mycobacterium tuberculosis H37Rv
caacacgucgagcagcc

SEQ ID NO: 1353826 - RNA, 21 nt, Mycobacterium tuberculosis H37Rv
caacacuuccgggcggugaag

SEQ ID NO: 1353827 - RNA, 22 nt, Mycobacterium tuberculosis H37Rv
caacaggccaacuuggcggcca

SEQ ID NO: 1353828 - RNA, 13 nt, Mycobacterium tuberculosis H37Rv
caacaggccaacu

SEQ ID NO: 1353829 - RNA, 17 nt, Mycobacterium tuberculosis H37Rv
caacaccagaugcaccu

SEQ ID NO: 1353830 - RNA, 13 nt, Mycobacterium tuberculosis H37Rv
caacaccaccgcc

SEQ ID NO: 1353831 - RNA, 17 nt, Mycobacterium tuberculosis H37Rv
caacaccaacgaacugg

SEQ ID NO: 1353832 - RNA, 23 nt, Mycobacterium tuberculosis H37Rv
caacacauuucuuugggcggccc

SEQ ID NO: 1353833 - RNA, 19 nt, Mycobacterium tuberculosis H37Rv
caaccgaugacgcguucaa

SEQ ID NO: 1353834 - RNA, 15 nt, Mycobacterium tuberculosis H37Rv
caacccugcggugca

SEQ ID NO: 1353835 - RNA, 22 nt, Mycobacterium tuberculosis H37Rv
caaccgccaucgucgaagaccu

SEQ ID NO: 1353836 - RNA, 21 nt, Mycobacterium tuberculosis H37Rv
caaccggcgcaguagccgacc

SEQ ID NO: 1353837 - RNA, 19 nt, Mycobacterium tuberculosis H37Rv
caaccgcgucgaagccggg

SEQ ID NO: 1353838 - RNA, 15 nt, Mycobacterium tuberculosis H37Rv
caaccgcgcccuagc

SEQ ID NO: 1353839 - RNA, 19 nt, Mycobacterium tuberculosis H37Rv
caaccgcgggaacccccca

SEQ ID NO: 1353840 - RNA, 14 nt, Mycobacterium tuberculosis H37Rv
caaccgcugcugcu

SEQ ID NO: 1353841 - RNA, 23 nt, Mycobacterium tuberculosis H37Rv
caaccgcuuugaauugcgcgccc

SEQ ID NO: 1353842 - RNA, 15 nt, Mycobacterium tuberculosis H37Rv
caaccggacgcccuc

SEQ ID NO: 1353843 - RNA, 14 nt, Mycobacterium tuberculosis H37Rv
caaccggugcgcau

SEQ ID NO: 1353844 - RNA, 15 nt, Mycobacterium tuberculosis H37Rv
caaccggucagccug

SEQ ID NO: 1353845 - RNA, 20 nt, Mycobacterium tuberculosis H37Rv
caaccggucaaacgcgcgcg

SEQ ID NO: 1353846 - RNA, 17 nt, Mycobacterium tuberculosis H37Rv
caaccgguaucgccgcu

SEQ ID NO: 1353847 - RNA, 18 nt, Mycobacterium tuberculosis H37Rv
caaccgggacaaccccuu

SEQ ID NO: 1353848 - RNA, 18 nt, Mycobacterium tuberculosis H37Rv
caaccgggaggccaccgc

SEQ ID NO: 1353849 - RNA, 13 nt, Mycobacterium tuberculosis H37Rv
caaccccgagcgg

SEQ ID NO: 1353850 - RNA, 17 nt, Mycobacterium tuberculosis H37Rv
caacccuaaaccagcca

SEQ ID NO: 1353851 - RNA, 11 nt, Mycobacterium tuberculosis H37Rv
caacccuaggg

SEQ ID NO: 1353852 - RNA, 17 nt, Mycobacterium tuberculosis H37Rv
caacccucgccggucag

SEQ ID NO: 1353853 - RNA, 23 nt, Mycobacterium tuberculosis H37Rv
caacccggcgggcccgccggccc

SEQ ID NO: 1353854 - RNA, 14 nt, Mycobacterium tuberculosis H37Rv
caacccgcaccccg

SEQ ID NO: 1353855 - RNA, 14 nt, Mycobacterium tuberculosis H37Rv
caacccgcuuggca

SEQ ID NO: 1353856 - RNA, 23 nt, Mycobacterium tuberculosis H37Rv
caaccaugcgguuagcagccgcu

SEQ ID NO: 1353857 - RNA, 19 nt, Mycobacterium tuberculosis H37Rv
caaccauguuaacgcgcgu

SEQ ID NO: 1353858 - RNA, 19 nt, Mycobacterium tuberculosis H37Rv
caaccauuagcgccaagcc

SEQ ID NO: 1353859 - RNA, 16 nt, Mycobacterium tuberculosis H37Rv
caaccccaacaucccg

SEQ ID NO: 1353860 - RNA, 18 nt, Mycobacterium tuberculosis H37Rv
caacauguugucgucgcc

SEQ ID NO: 1353861 - RNA, 21 nt, Mycobacterium tuberculosis H37Rv
caacauguugucgucgccgcc

SEQ ID NO: 1353862 - RNA, 18 nt, Mycobacterium tuberculosis H37Rv
caacaugucaccugcauc

SEQ ID NO: 1353863 - RNA, 15 nt, Mycobacterium tuberculosis H37Rv
caacaugcuggagaa

SEQ ID NO: 1353864 - RNA, 12 nt, Mycobacterium tuberculosis H37Rv
caaccagcagca

SEQ ID NO: 1353865 - RNA, 18 nt, Mycobacterium tuberculosis H37Rv
caaccagcccggccgccg

SEQ ID NO: 1353866 - RNA, 18 nt, Mycobacterium tuberculosis H37Rv
caaccagcgagcccagcu

SEQ ID NO: 1353867 - RNA, 16 nt, Mycobacterium tuberculosis H37Rv
caaccagcgagcccag

SEQ ID NO: 1353868 - RNA, 19 nt, Mycobacterium tuberculosis H37Rv
caaccaggaugguugcgac

SEQ ID NO: 1353869 - RNA, 11 nt, Mycobacterium tuberculosis H37Rv
caaccagcaga

SEQ ID NO: 1353870 - RNA, 11 nt, Mycobacterium tuberculosis H37Rv
caaccagcagc

SEQ ID NO: 1353871 - RNA, 14 nt, Mycobacterium tuberculosis H37Rv
caaccacaucaccg

SEQ ID NO: 1353872 - RNA, 15 nt, Mycobacterium tuberculosis H37Rv
caaccaccggccgcg

SEQ ID NO: 1353873 - RNA, 21 nt, Mycobacterium tuberculosis H37Rv
caacugggccgagcgcgccgu

SEQ ID NO: 1353874 - RNA, 15 nt, Mycobacterium tuberculosis H37Rv
caacugcggcagguc

SEQ ID NO: 1353875 - RNA, 17 nt, Mycobacterium tuberculosis H37Rv
caacugccgagcagacg

SEQ ID NO: 1353876 - RNA, 18 nt, Mycobacterium tuberculosis H37Rv
caacugccgcacccgguc

SEQ ID NO: 1353877 - RNA, 23 nt, Mycobacterium tuberculosis H37Rv
caacugcgccguucgcucccccg

SEQ ID NO: 1353878 - RNA, 20 nt, Mycobacterium tuberculosis H37Rv
caacuaccuguugacacaac

SEQ ID NO: 1353879 - RNA, 16 nt, Mycobacterium tuberculosis H37Rv
caacucuucagcaagc

SEQ ID NO: 1353880 - RNA, 20 nt, Mycobacterium tuberculosis H37Rv
caacugcagauaggacccag

SEQ ID NO: 1353881 - RNA, 13 nt, Mycobacterium tuberculosis H37Rv
caacggcgcggca

SEQ ID NO: 1353882 - RNA, 16 nt, Mycobacterium tuberculosis H37Rv
caacgucgugaucgca

SEQ ID NO: 1353883 - RNA, 17 nt, Mycobacterium tuberculosis H37Rv
caacgucacgucgacgg

SEQ ID NO: 1353884 - RNA, 20 nt, Mycobacterium tuberculosis H37Rv
caacgcggucugcuccaggc

SEQ ID NO: 1353885 - RNA, 17 nt, Mycobacterium tuberculosis H37Rv
caacggacgggaucgcc

SEQ ID NO: 1353886 - RNA, 17 nt, Mycobacterium tuberculosis H37Rv
caacggccacaugccac

SEQ ID NO: 1353887 - RNA, 18 nt, Mycobacterium tuberculosis H37Rv
caacgcgggugccgggca

SEQ ID NO: 1353888 - RNA, 14 nt, Mycobacterium tuberculosis H37Rv
caacgcggucugcu

SEQ ID NO: 1353889 - RNA, 15 nt, Mycobacterium tuberculosis H37Rv
caacgcggucugcuc

SEQ ID NO: 1353890 - RNA, 19 nt, Mycobacterium tuberculosis H37Rv
caacgcggugggcacagcc

SEQ ID NO: 1353891 - RNA, 15 nt, Mycobacterium tuberculosis H37Rv
caacgcccaccacgc

SEQ ID NO: 1353892 - RNA, 20 nt, Mycobacterium tuberculosis H37Rv
caacgccgauggcuuggugc

SEQ ID NO: 1353893 - RNA, 23 nt, Mycobacterium tuberculosis H37Rv
caacgccacugcgccgugaccca

SEQ ID NO: 1353894 - RNA, 15 nt, Mycobacterium tuberculosis H37Rv
caaccucccucuagc

SEQ ID NO: 1353895 - RNA, 20 nt, Mycobacterium tuberculosis H37Rv
caaucguccacccgagcucu

SEQ ID NO: 1353896 - RNA, 21 nt, Mycobacterium tuberculosis H37Rv
caaucguccacccgagcucuu

SEQ ID NO: 1353897 - RNA, 14 nt, Mycobacterium tuberculosis H37Rv
caaucugcgggccg

SEQ ID NO: 1353898 - RNA, 13 nt, Mycobacterium tuberculosis H37Rv
caaucuccuccgc

SEQ ID NO: 1353899 - RNA, 16 nt, Mycobacterium tuberculosis H37Rv
caaucgggaucgcugc

SEQ ID NO: 1353900 - RNA, 15 nt, Mycobacterium tuberculosis H37Rv
caauccugguguucg

SEQ ID NO: 1353901 - RNA, 21 nt, Mycobacterium tuberculosis H37Rv
caaucgcaaugaccugcagcg

SEQ ID NO: 1353902 - RNA, 18 nt, Mycobacterium tuberculosis H37Rv
caaucgaggaaggugugc

SEQ ID NO: 1353903 - RNA, 17 nt, Mycobacterium tuberculosis H37Rv
caaucccggccaggggc

SEQ ID NO: 1353904 - RNA, 19 nt, Mycobacterium tuberculosis H37Rv
caaucccgccaucugccug

SEQ ID NO: 1353905 - RNA, 18 nt, Mycobacterium tuberculosis H37Rv
caauccgcccuaaugaag

SEQ ID NO: 1353906 - RNA, 22 nt, Mycobacterium tuberculosis H37Rv
caauccgcacagcgacgagauc

SEQ ID NO: 1353907 - RNA, 18 nt, Mycobacterium tuberculosis H37Rv
caauccggcgccagcagu

SEQ ID NO: 1353908 - RNA, 15 nt, Mycobacterium tuberculosis H37Rv
caauccaccgauucg

SEQ ID NO: 1353909 - RNA, 17 nt, Mycobacterium tuberculosis H37Rv
caaucaugucagcgcug

SEQ ID NO: 1353910 - RNA, 16 nt, Mycobacterium tuberculosis H37Rv
caaugcaaauagccuu

SEQ ID NO: 1353911 - RNA, 16 nt, Mycobacterium tuberculosis H37Rv
caaugaccugcagcgc

SEQ ID NO: 1353912 - RNA, 17 nt, Mycobacterium tuberculosis H37Rv
caaugaccgccagcagc

SEQ ID NO: 1353913 - RNA, 14 nt, Mycobacterium tuberculosis H37Rv
caaugcgagcaccc

SEQ ID NO: 1353914 - RNA, 14 nt, Mycobacterium tuberculosis H37Rv
caaugcgcgacggu

SEQ ID NO: 1353915 - RNA, 14 nt, Mycobacterium tuberculosis H37Rv
caaugccggccgcg

SEQ ID NO: 1353916 - RNA, 20 nt, Mycobacterium tuberculosis H37Rv
caauggacaccaacccaccc

SEQ ID NO: 1353917 - RNA, 17 nt, Mycobacterium tuberculosis H37Rv
caaugcgcgacggucaa

SEQ ID NO: 1353918 - RNA, 17 nt, Mycobacterium tuberculosis H37Rv
caauggccugcagcgcg

SEQ ID NO: 1353919 - RNA, 18 nt, Mycobacterium tuberculosis H37Rv
caauggcggaccgggcca

SEQ ID NO: 1353920 - RNA, 15 nt, Mycobacterium tuberculosis H37Rv
caauaggcuccagcg

SEQ ID NO: 1353921 - RNA, 22 nt, Mycobacterium tuberculosis H37Rv
caauaggcuccagcgcgcgccg

SEQ ID NO: 1353922 - RNA, 19 nt, Mycobacterium tuberculosis H37Rv
caauacgugcgaaucgaga

SEQ ID NO: 1353923 - RNA, 20 nt, Mycobacterium tuberculosis H37Rv
caagucaccauagcucaggg

SEQ ID NO: 1353924 - RNA, 22 nt, Mycobacterium tuberculosis H37Rv
caagucauccaggucgccuucc

SEQ ID NO: 1353925 - RNA, 14 nt, Mycobacterium tuberculosis H37Rv
caagccggggaacu

SEQ ID NO: 1353926 - RNA, 19 nt, Mycobacterium tuberculosis H37Rv
caagccgggugggagcagc

SEQ ID NO: 1353927 - RNA, 22 nt, Mycobacterium tuberculosis H37Rv
caagccgcugauguacccggcg

SEQ ID NO: 1353928 - RNA, 20 nt, Mycobacterium tuberculosis H37Rv
caagccgcggcuaggccagc

SEQ ID NO: 1353929 - RNA, 16 nt, Mycobacterium tuberculosis H37Rv
caagccgccggcgcca

SEQ ID NO: 1353930 - RNA, 21 nt, Mycobacterium tuberculosis H37Rv
caagcccucgggacggccgcc

SEQ ID NO: 1353931 - RNA, 14 nt, Mycobacterium tuberculosis H37Rv
caagccagcguugg

SEQ ID NO: 1353932 - RNA, 17 nt, Mycobacterium tuberculosis H37Rv
caagccagcacugccau

SEQ ID NO: 1353933 - RNA, 19 nt, Mycobacterium tuberculosis H37Rv
caagccagcaucggcagca

SEQ ID NO: 1353934 - RNA, 11 nt, Mycobacterium tuberculosis H37Rv
caagccaagcg

SEQ ID NO: 1353935 - RNA, 14 nt, Mycobacterium tuberculosis H37Rv
caagcagcccgggu

SEQ ID NO: 1353936 - RNA, 18 nt, Mycobacterium tuberculosis H37Rv
caagcacagcgaacagac

SEQ ID NO: 1353937 - RNA, 16 nt, Mycobacterium tuberculosis H37Rv
caagcacagcccggcu

SEQ ID NO: 1353938 - RNA, 18 nt, Mycobacterium tuberculosis H37Rv
caagcacaccgccagcgg

SEQ ID NO: 1353939 - RNA, 17 nt, Mycobacterium tuberculosis H37Rv
caagcacaccgccagcg

SEQ ID NO: 1353940 - RNA, 15 nt, Mycobacterium tuberculosis H37Rv
caagcacaccgccag

SEQ ID NO: 1353941 - RNA, 17 nt, Mycobacterium tuberculosis H37Rv
caaggacucggacgcgc

SEQ ID NO: 1353942 - RNA, 17 nt, Mycobacterium tuberculosis H37Rv
caagccguucugucccg

SEQ ID NO: 1353943 - RNA, 18 nt, Mycobacterium tuberculosis H37Rv
caagccguagaccaggcc

SEQ ID NO: 1353944 - RNA, 19 nt, Mycobacterium tuberculosis H37Rv
caagccguagaccaggccc

SEQ ID NO: 1353945 - RNA, 21 nt, Mycobacterium tuberculosis H37Rv
caagccguaguaguggccgcc

SEQ ID NO: 1353946 - RNA, 13 nt, Mycobacterium tuberculosis H37Rv
caagcgugacccg

SEQ ID NO: 1353947 - RNA, 15 nt, Mycobacterium tuberculosis H37Rv
caagcgucgcaaaca

SEQ ID NO: 1353948 - RNA, 18 nt, Mycobacterium tuberculosis H37Rv
caagccggcgcccgccgc

SEQ ID NO: 1353949 - RNA, 17 nt, Mycobacterium tuberculosis H37Rv
caagguguccagcaccu

SEQ ID NO: 1353950 - RNA, 16 nt, Mycobacterium tuberculosis H37Rv
caagguggcaugcgac

SEQ ID NO: 1353951 - RNA, 15 nt, Mycobacterium tuberculosis H37Rv
caaggugcgccgcca

SEQ ID NO: 1353952 - RNA, 22 nt, Mycobacterium tuberculosis H37Rv
caaggucaucacuaaccuggcg

SEQ ID NO: 1353953 - RNA, 19 nt, Mycobacterium tuberculosis H37Rv
caagguauagccggagcgc

SEQ ID NO: 1353954 - RNA, 20 nt, Mycobacterium tuberculosis H37Rv
caagguauagccggagcgca

SEQ ID NO: 1353955 - RNA, 16 nt, Mycobacterium tuberculosis H37Rv
caagguauccaacgcg

SEQ ID NO: 1353956 - RNA, 14 nt, Mycobacterium tuberculosis H37Rv
caaggccgucgacc

SEQ ID NO: 1353957 - RNA, 23 nt, Mycobacterium tuberculosis H37Rv
caaggcgcuaaaacgccagucga

SEQ ID NO: 1353958 - RNA, 14 nt, Mycobacterium tuberculosis H37Rv
caaggcggcggcca

SEQ ID NO: 1353959 - RNA, 16 nt, Mycobacterium tuberculosis H37Rv
caaaacccgagccugg

SEQ ID NO: 1353960 - RNA, 14 nt, Mycobacterium tuberculosis H37Rv
caaaaccugggaug

SEQ ID NO: 1353961 - RNA, 19 nt, Mycobacterium tuberculosis H37Rv
caaaaagcucggcccuguu

SEQ ID NO: 1353962 - RNA, 21 nt, Mycobacterium tuberculosis H37Rv
caaaaacccggugaccagcaa

SEQ ID NO: 1353963 - RNA, 22 nt, Mycobacterium tuberculosis H37Rv
auuuuuguuguuauuuuuggcc

SEQ ID NO: 1353964 - RNA, 15 nt, Mycobacterium tuberculosis H37Rv
auuucucccagccca

SEQ ID NO: 1353965 - RNA, 13 nt, Mycobacterium tuberculosis H37Rv
auuucucccagcc

SEQ ID NO: 1353966 - RNA, 16 nt, Mycobacterium tuberculosis H37Rv
auuucguugagaacau

SEQ ID NO: 1353967 - RNA, 14 nt, Mycobacterium tuberculosis H37Rv
auuugucggcgccu

SEQ ID NO: 1353968 - RNA, 21 nt, Mycobacterium tuberculosis H37Rv
auuuggugaagccguagacgu

SEQ ID NO: 1353969 - RNA, 19 nt, Mycobacterium tuberculosis H37Rv
auuuucucggggugguggu

SEQ ID NO: 1353970 - RNA, 19 nt, Mycobacterium tuberculosis H37Rv
auuuucacugugccgcugc

SEQ ID NO: 1353971 - RNA, 13 nt, Mycobacterium tuberculosis H37Rv
auucucggccggc

SEQ ID NO: 1353972 - RNA, 20 nt, Mycobacterium tuberculosis H37Rv
auucugcgucugcucgccgu

SEQ ID NO: 1353973 - RNA, 19 nt, Mycobacterium tuberculosis H37Rv
auucuguugugccgcaagc

SEQ ID NO: 1353974 - RNA, 11 nt, Mycobacterium tuberculosis H37Rv
auucuggaugc

SEQ ID NO: 1353975 - RNA, 15 nt, Mycobacterium tuberculosis H37Rv
auugagcacgcgcaa

SEQ ID NO: 1353976 - RNA, 11 nt, Mycobacterium tuberculosis H37Rv
auugccgccgu

SEQ ID NO: 1353977 - RNA, 20 nt, Mycobacterium tuberculosis H37Rv
auugccgccguugccgccau

SEQ ID NO: 1353978 - RNA, 11 nt, Mycobacterium tuberculosis H37Rv
auugccgccgc

SEQ ID NO: 1353979 - RNA, 15 nt, Mycobacterium tuberculosis H37Rv
auugccgaccgccug

SEQ ID NO: 1353980 - RNA, 17 nt, Mycobacterium tuberculosis H37Rv
auugcaccgcggccagc

SEQ ID NO: 1353981 - RNA, 23 nt, Mycobacterium tuberculosis H37Rv
auugagucaucuggcgcgccacc

SEQ ID NO: 1353982 - RNA, 22 nt, Mycobacterium tuberculosis H37Rv
auuggcuccgaacauggccagc

SEQ ID NO: 1353983 - RNA, 17 nt, Mycobacterium tuberculosis H37Rv
auugcguucgccgcccg

SEQ ID NO: 1353984 - RNA, 18 nt, Mycobacterium tuberculosis H37Rv
auugucggcgaaaugaag

SEQ ID NO: 1353985 - RNA, 14 nt, Mycobacterium tuberculosis H37Rv
auugucgaucuggu

SEQ ID NO: 1353986 - RNA, 22 nt, Mycobacterium tuberculosis H37Rv
auuucagccuuguugccgccgg

SEQ ID NO: 1353987 - RNA, 17 nt, Mycobacterium tuberculosis H37Rv
auucacgacgccgagca

SEQ ID NO: 1353988 - RNA, 23 nt, Mycobacterium tuberculosis H37Rv
auucacgggugcgccacaaccgu

SEQ ID NO: 1353989 - RNA, 16 nt, Mycobacterium tuberculosis H37Rv
auucaacagcaccgcg

SEQ ID NO: 1353990 - RNA, 21 nt, Mycobacterium tuberculosis H37Rv
auuaguuucguccccagaccg

SEQ ID NO: 1353991 - RNA, 16 nt, Mycobacterium tuberculosis H37Rv
auguuggccggcgcca

SEQ ID NO: 1353992 - RNA, 18 nt, Mycobacterium tuberculosis H37Rv
auguuggccggcgccacc

SEQ ID NO: 1353993 - RNA, 14 nt, Mycobacterium tuberculosis H37Rv
auguuguucagcag

SEQ ID NO: 1353994 - RNA, 17 nt, Mycobacterium tuberculosis H37Rv
auguugcgacggccggc

SEQ ID NO: 1353995 - RNA, 19 nt, Mycobacterium tuberculosis H37Rv
auguugccggaguugaagu

SEQ ID NO: 1353996 - RNA, 17 nt, Mycobacterium tuberculosis H37Rv
auguucaucgcagucau

SEQ ID NO: 1353997 - RNA, 16 nt, Mycobacterium tuberculosis H37Rv
auuaaaaagcccagcg

SEQ ID NO: 1353998 - RNA, 16 nt, Mycobacterium tuberculosis H37Rv
auuaaggugaccacgg

SEQ ID NO: 1353999 - RNA, 23 nt, Mycobacterium tuberculosis H37Rv
auuaagggucaucgccagcggca

SEQ ID NO: 1354000 - RNA, 16 nt, Mycobacterium tuberculosis H37Rv
auggugguggcccggc

SEQ ID NO: 1354001 - RNA, 20 nt, Mycobacterium tuberculosis H37Rv
augguggugccgaccugucc

SEQ ID NO: 1354002 - RNA, 15 nt, Mycobacterium tuberculosis H37Rv
auggugugcagcagc

SEQ ID NO: 1354003 - RNA, 16 nt, Mycobacterium tuberculosis H37Rv
augguguacugcugcu

SEQ ID NO: 1354004 - RNA, 16 nt, Mycobacterium tuberculosis H37Rv
auggucguaggguggg

SEQ ID NO: 1354005 - RNA, 22 nt, Mycobacterium tuberculosis H37Rv
augguaccgccacuggcgcuga

SEQ ID NO: 1354006 - RNA, 21 nt, Mycobacterium tuberculosis H37Rv
augguacccgcgccgcgcauc

SEQ ID NO: 1354007 - RNA, 20 nt, Mycobacterium tuberculosis H37Rv
augggcgguuccacgcugcc

SEQ ID NO: 1354008 - RNA, 17 nt, Mycobacterium tuberculosis H37Rv
augggcgguuccacgcu

SEQ ID NO: 1354009 - RNA, 18 nt, Mycobacterium tuberculosis H37Rv
augggcggacaaaagaac

SEQ ID NO: 1354010 - RNA, 21 nt, Mycobacterium tuberculosis H37Rv
augggcggguggugcggccgu

SEQ ID NO: 1354011 - RNA, 18 nt, Mycobacterium tuberculosis H37Rv
augggcgcguagcucagc

SEQ ID NO: 1354012 - RNA, 18 nt, Mycobacterium tuberculosis H37Rv
augggcccugcacagcag

SEQ ID NO: 1354013 - RNA, 18 nt, Mycobacterium tuberculosis H37Rv
augggccgguuccucagc

SEQ ID NO: 1354014 - RNA, 21 nt, Mycobacterium tuberculosis H37Rv
auggcugagcccgccgcgacc

SEQ ID NO: 1354015 - RNA, 22 nt, Mycobacterium tuberculosis H37Rv
augggaccuugaucgagcaggg

SEQ ID NO: 1354016 - RNA, 19 nt, Mycobacterium tuberculosis H37Rv
augggcagaucgauaccgu

SEQ ID NO: 1354017 - RNA, 15 nt, Mycobacterium tuberculosis H37Rv
augggcagccgcccg

SEQ ID NO: 1354018 - RNA, 22 nt, Mycobacterium tuberculosis H37Rv
augggcagccgcccgcccaccu

SEQ ID NO: 1354019 - RNA, 24 nt, Mycobacterium tuberculosis H37Rv
auggcggccaccgucagcgcgacc

SEQ ID NO: 1354020 - RNA, 14 nt, Mycobacterium tuberculosis H37Rv
auggcuccgcccag

SEQ ID NO: 1354021 - RNA, 23 nt, Mycobacterium tuberculosis H37Rv
auggcgcugauggugcugcggcg

SEQ ID NO: 1354022 - RNA, 16 nt, Mycobacterium tuberculosis H37Rv
auggcgcugauggugc

SEQ ID NO: 1354023 - RNA, 22 nt, Mycobacterium tuberculosis H37Rv
auggcgcgcaacguagccagca

SEQ ID NO: 1354024 - RNA, 21 nt, Mycobacterium tuberculosis H37Rv
auggcgcgagcagacgcagaa

SEQ ID NO: 1354025 - RNA, 23 nt, Mycobacterium tuberculosis H37Rv
auggccagguuguagacggcacc

SEQ ID NO: 1354026 - RNA, 19 nt, Mycobacterium tuberculosis H37Rv
auggccaucagcucgccag

SEQ ID NO: 1354027 - RNA, 22 nt, Mycobacterium tuberculosis H37Rv
auggccaccgaacgcggccacc

SEQ ID NO: 1354028 - RNA, 15 nt, Mycobacterium tuberculosis H37Rv
auggccagcaucagc

SEQ ID NO: 1354029 - RNA, 12 nt, Mycobacterium tuberculosis H37Rv
auggccagcauc

SEQ ID NO: 1354030 - RNA, 17 nt, Mycobacterium tuberculosis H37Rv
augcgcaccagcggcug

SEQ ID NO: 1354031 - RNA, 17 nt, Mycobacterium tuberculosis H37Rv
augcgcaccaguccagc

SEQ ID NO: 1354032 - RNA, 15 nt, Mycobacterium tuberculosis H37Rv
auguagggcugcucc

SEQ ID NO: 1354033 - RNA, 14 nt, Mycobacterium tuberculosis H37Rv
auguccagguggcg

SEQ ID NO: 1354034 - RNA, 23 nt, Mycobacterium tuberculosis H37Rv
auguccgacgccaccgccaccac

SEQ ID NO: 1354035 - RNA, 20 nt, Mycobacterium tuberculosis H37Rv
augugacaucgggccgccga

SEQ ID NO: 1354036 - RNA, 15 nt, Mycobacterium tuberculosis H37Rv
auguccucgauccgg

SEQ ID NO: 1354037 - RNA, 19 nt, Mycobacterium tuberculosis H37Rv
auguccuuggagaugucgg

SEQ ID NO: 1354038 - RNA, 17 nt, Mycobacterium tuberculosis H37Rv
auguccugggccgccgc

SEQ ID NO: 1354039 - RNA, 21 nt, Mycobacterium tuberculosis H37Rv
augucuugcaguaacuucacc

SEQ ID NO: 1354040 - RNA, 20 nt, Mycobacterium tuberculosis H37Rv
augucuugcgaugugcauuc

SEQ ID NO: 1354041 - RNA, 15 nt, Mycobacterium tuberculosis H37Rv
augucuuguggugga

SEQ ID NO: 1354042 - RNA, 15 nt, Mycobacterium tuberculosis H37Rv
auguggcgucggagu

SEQ ID NO: 1354043 - RNA, 15 nt, Mycobacterium tuberculosis H37Rv
auguggauagcuuuu

SEQ ID NO: 1354044 - RNA, 18 nt, Mycobacterium tuberculosis H37Rv
aucuggcuggugauggcc

SEQ ID NO: 1354045 - RNA, 22 nt, Mycobacterium tuberculosis H37Rv
aucuggcguagugcucgccggc

SEQ ID NO: 1354046 - RNA, 15 nt, Mycobacterium tuberculosis H37Rv
aucuucugccuuggc

SEQ ID NO: 1354047 - RNA, 15 nt, Mycobacterium tuberculosis H37Rv
aucuggucaagaccc

SEQ ID NO: 1354048 - RNA, 19 nt, Mycobacterium tuberculosis H37Rv
aucuucucgagccgccgga

SEQ ID NO: 1354049 - RNA, 16 nt, Mycobacterium tuberculosis H37Rv
aucuucuucagguagc

SEQ ID NO: 1354050 - RNA, 20 nt, Mycobacterium tuberculosis H37Rv
aucuuuccggcguauagccc

SEQ ID NO: 1354051 - RNA, 13 nt, Mycobacterium tuberculosis H37Rv
augaagaacuggc

SEQ ID NO: 1354052 - RNA, 13 nt, Mycobacterium tuberculosis H37Rv
augaagauccaga

SEQ ID NO: 1354053 - RNA, 19 nt, Mycobacterium tuberculosis H37Rv
augacugggcaaacccgga

SEQ ID NO: 1354054 - RNA, 17 nt, Mycobacterium tuberculosis H37Rv
augaccagggucugcuc

SEQ ID NO: 1354055 - RNA, 20 nt, Mycobacterium tuberculosis H37Rv
augaccagggucugcucauc

SEQ ID NO: 1354056 - RNA, 22 nt, Mycobacterium tuberculosis H37Rv
augaccuguagaucagcagcgg

SEQ ID NO: 1354057 - RNA, 22 nt, Mycobacterium tuberculosis H37Rv
augacgauggccgccgcgagga

SEQ ID NO: 1354058 - RNA, 14 nt, Mycobacterium tuberculosis H37Rv
augacgaacggacc

SEQ ID NO: 1354059 - RNA, 17 nt, Mycobacterium tuberculosis H37Rv
augacgcccagggcguc

SEQ ID NO: 1354060 - RNA, 13 nt, Mycobacterium tuberculosis H37Rv
augagaucgggac

SEQ ID NO: 1354061 - RNA, 17 nt, Mycobacterium tuberculosis H37Rv
augaccacauuggugau

SEQ ID NO: 1354062 - RNA, 19 nt, Mycobacterium tuberculosis H37Rv
augaccaccgaaauaccca

SEQ ID NO: 1354063 - RNA, 21 nt, Mycobacterium tuberculosis H37Rv
augauggccgucagccaggug

SEQ ID NO: 1354064 - RNA, 18 nt, Mycobacterium tuberculosis H37Rv
augauggacaccagccag

SEQ ID NO: 1354065 - RNA, 20 nt, Mycobacterium tuberculosis H37Rv
augcaaggaaaagccuggcc

SEQ ID NO: 1354066 - RNA, 20 nt, Mycobacterium tuberculosis H37Rv
augcaacgcggcgaagugca

SEQ ID NO: 1354067 - RNA, 15 nt, Mycobacterium tuberculosis H37Rv
augcaguuccuugcc

SEQ ID NO: 1354068 - RNA, 22 nt, Mycobacterium tuberculosis H37Rv
augccaggacuggcaccgccag

SEQ ID NO: 1354069 - RNA, 20 nt, Mycobacterium tuberculosis H37Rv
augccaggacuggcaccgcc

SEQ ID NO: 1354070 - RNA, 20 nt, Mycobacterium tuberculosis H37Rv
augccaagcuccaaccaugc

SEQ ID NO: 1354071 - RNA, 23 nt, Mycobacterium tuberculosis H37Rv
augcagcgguccagacaucagug

SEQ ID NO: 1354072 - RNA, 21 nt, Mycobacterium tuberculosis H37Rv
augcagcgguccagacaucag

SEQ ID NO: 1354073 - RNA, 13 nt, Mycobacterium tuberculosis H37Rv
augccguagaguc

SEQ ID NO: 1354074 - RNA, 21 nt, Mycobacterium tuberculosis H37Rv
augccgcgggacaucaccgca

SEQ ID NO: 1354075 - RNA, 18 nt, Mycobacterium tuberculosis H37Rv
augccggucauccgggcg

SEQ ID NO: 1354076 - RNA, 21 nt, Mycobacterium tuberculosis H37Rv
augccggugccgggcaccacc

SEQ ID NO: 1354077 - RNA, 21 nt, Mycobacterium tuberculosis H37Rv
augccgcgaucgugcagguug

SEQ ID NO: 1354078 - RNA, 10 nt, Mycobacterium tuberculosis H37Rv
augccgccgg

SEQ ID NO: 1354079 - RNA, 21 nt, Mycobacterium tuberculosis H37Rv
augccggacgccaugcccgca

SEQ ID NO: 1354080 - RNA, 21 nt, Mycobacterium tuberculosis H37Rv
augccggaaagcaucaugccc

SEQ ID NO: 1354081 - RNA, 21 nt, Mycobacterium tuberculosis H37Rv
augccggcccccacacaggca

SEQ ID NO: 1354082 - RNA, 20 nt, Mycobacterium tuberculosis H37Rv
augccuugaaacggugucuc

SEQ ID NO: 1354083 - RNA, 16 nt, Mycobacterium tuberculosis H37Rv
augccugcgcgaugcg

SEQ ID NO: 1354084 - RNA, 19 nt, Mycobacterium tuberculosis H37Rv
augccugcgcgaugcgauu

SEQ ID NO: 1354085 - RNA, 22 nt, Mycobacterium tuberculosis H37Rv
augccugcgaaacgcuggccac

SEQ ID NO: 1354086 - RNA, 23 nt, Mycobacterium tuberculosis H37Rv
augccuggaaucgcggagccagg

SEQ ID NO: 1354087 - RNA, 18 nt, Mycobacterium tuberculosis H37Rv
augccugcccaccuucga

SEQ ID NO: 1354088 - RNA, 17 nt, Mycobacterium tuberculosis H37Rv
augccguugaucgcaaa

SEQ ID NO: 1354089 - RNA, 18 nt, Mycobacterium tuberculosis H37Rv
augccguucaugccaugg

SEQ ID NO: 1354090 - RNA, 14 nt, Mycobacterium tuberculosis H37Rv
augccuaccgggcc

SEQ ID NO: 1354091 - RNA, 19 nt, Mycobacterium tuberculosis H37Rv
augccgcccccauaacugc

SEQ ID NO: 1354092 - RNA, 18 nt, Mycobacterium tuberculosis H37Rv
augccgccccgcagcugc

SEQ ID NO: 1354093 - RNA, 12 nt, Mycobacterium tuberculosis H37Rv
augccgcccgca

SEQ ID NO: 1354094 - RNA, 14 nt, Mycobacterium tuberculosis H37Rv
augccgccaaccgc

SEQ ID NO: 1354095 - RNA, 21 nt, Mycobacterium tuberculosis H37Rv
augcccugcgcucgggcugcc

SEQ ID NO: 1354096 - RNA, 21 nt, Mycobacterium tuberculosis H37Rv
augcccugcccgaagguggga

SEQ ID NO: 1354097 - RNA, 18 nt, Mycobacterium tuberculosis H37Rv
augcccuggggguggcag

SEQ ID NO: 1354098 - RNA, 14 nt, Mycobacterium tuberculosis H37Rv
augcccuuggccag

SEQ ID NO: 1354099 - RNA, 17 nt, Mycobacterium tuberculosis H37Rv
augcccuuggccagcag

SEQ ID NO: 1354100 - RNA, 15 nt, Mycobacterium tuberculosis H37Rv
augcccuuguaggcc

SEQ ID NO: 1354101 - RNA, 19 nt, Mycobacterium tuberculosis H37Rv
augccgagaagacuacugc

SEQ ID NO: 1354102 - RNA, 21 nt, Mycobacterium tuberculosis H37Rv
augcccgcugaucagauccuc

SEQ ID NO: 1354103 - RNA, 16 nt, Mycobacterium tuberculosis H37Rv
augcccgccguagacc

SEQ ID NO: 1354104 - RNA, 19 nt, Mycobacterium tuberculosis H37Rv
augcccgccguagaccagc

SEQ ID NO: 1354105 - RNA, 23 nt, Mycobacterium tuberculosis H37Rv
augccccggagccagaaugcaag

SEQ ID NO: 1354106 - RNA, 14 nt, Mycobacterium tuberculosis H37Rv
aucucgaucaucau

SEQ ID NO: 1354107 - RNA, 14 nt, Mycobacterium tuberculosis H37Rv
aucucgcccaccuc

SEQ ID NO: 1354108 - RNA, 20 nt, Mycobacterium tuberculosis H37Rv
aucucgcccaccuccugguu

SEQ ID NO: 1354109 - RNA, 18 nt, Mycobacterium tuberculosis H37Rv
aucucgaccggcuugccc

SEQ ID NO: 1354110 - RNA, 20 nt, Mycobacterium tuberculosis H37Rv
aucucgaccucgucggccga

SEQ ID NO: 1354111 - RNA, 18 nt, Mycobacterium tuberculosis H37Rv
aucucgacggccucgucg

SEQ ID NO: 1354112 - RNA, 23 nt, Mycobacterium tuberculosis H37Rv
aucucgacggccucgucgauguu

SEQ ID NO: 1354113 - RNA, 18 nt, Mycobacterium tuberculosis H37Rv
aucuccucgccugcccga

SEQ ID NO: 1354114 - RNA, 11 nt, Mycobacterium tuberculosis H37Rv
aucuccuccug

SEQ ID NO: 1354115 - RNA, 22 nt, Mycobacterium tuberculosis H37Rv
aucuccuuggccguucggcgcc

SEQ ID NO: 1354116 - RNA, 23 nt, Mycobacterium tuberculosis H37Rv
aucucccgaaucgugcggcgacc

SEQ ID NO: 1354117 - RNA, 12 nt, Mycobacterium tuberculosis H37Rv
aucuccaccuuc

SEQ ID NO: 1354118 - RNA, 15 nt, Mycobacterium tuberculosis H37Rv
aucuccaccuucugg

SEQ ID NO: 1354119 - RNA, 23 nt, Mycobacterium tuberculosis H37Rv
aucuaguacacaaauccgcacca

SEQ ID NO: 1354120 - RNA, 18 nt, Mycobacterium tuberculosis H37Rv
aucuagaggcggcccccg

SEQ ID NO: 1354121 - RNA, 19 nt, Mycobacterium tuberculosis H37Rv
aucucggcguugccgccgu

SEQ ID NO: 1354122 - RNA, 16 nt, Mycobacterium tuberculosis H37Rv
aucucggcgcagccgg

SEQ ID NO: 1354123 - RNA, 22 nt, Mycobacterium tuberculosis H37Rv
aucucgcgggcccgcgcggcgg

SEQ ID NO: 1354124 - RNA, 18 nt, Mycobacterium tuberculosis H37Rv
aucucgccggcgaagacc

SEQ ID NO: 1354125 - RNA, 15 nt, Mycobacterium tuberculosis H37Rv
aucucggucagaugc

SEQ ID NO: 1354126 - RNA, 23 nt, Mycobacterium tuberculosis H37Rv
aucucguagccgccgucgccggu

SEQ ID NO: 1354127 - RNA, 16 nt, Mycobacterium tuberculosis H37Rv
aucucguagccgccgu

SEQ ID NO: 1354128 - RNA, 22 nt, Mycobacterium tuberculosis H37Rv
aucucgguggacggcaggcggc

SEQ ID NO: 1354129 - RNA, 12 nt, Mycobacterium tuberculosis H37Rv
aucucuccugga

SEQ ID NO: 1354130 - RNA, 21 nt, Mycobacterium tuberculosis H37Rv
aucucguggaucugccucucg

SEQ ID NO: 1354131 - RNA, 15 nt, Mycobacterium tuberculosis H37Rv
aucucuugcaaccug

SEQ ID NO: 1354132 - RNA, 14 nt, Mycobacterium tuberculosis H37Rv
aucugacggcgccg

SEQ ID NO: 1354133 - RNA, 21 nt, Mycobacterium tuberculosis H37Rv
aucugccgccgcggccacaac

SEQ ID NO: 1354134 - RNA, 19 nt, Mycobacterium tuberculosis H37Rv
aucugcgcgaggggccggc

SEQ ID NO: 1354135 - RNA, 19 nt, Mycobacterium tuberculosis H37Rv
aucugcgcgucaggccagc

SEQ ID NO: 1354136 - RNA, 14 nt, Mycobacterium tuberculosis H37Rv
aucugcgccaucac

SEQ ID NO: 1354137 - RNA, 14 nt, Mycobacterium tuberculosis H37Rv
aucugcccuguucg

SEQ ID NO: 1354138 - RNA, 16 nt, Mycobacterium tuberculosis H37Rv
aucugcccggugaucc

SEQ ID NO: 1354139 - RNA, 23 nt, Mycobacterium tuberculosis H37Rv
aucugcacgagugcggcgaccag

SEQ ID NO: 1354140 - RNA, 14 nt, Mycobacterium tuberculosis H37Rv
aucugcaggcccag

SEQ ID NO: 1354141 - RNA, 22 nt, Mycobacterium tuberculosis H37Rv
aucggccuguccaccgaugcca

SEQ ID NO: 1354142 - RNA, 16 nt, Mycobacterium tuberculosis H37Rv
aucgggaucugggcuc

SEQ ID NO: 1354143 - RNA, 21 nt, Mycobacterium tuberculosis H37Rv
aucgggcccaccgcugcggca

SEQ ID NO: 1354144 - RNA, 16 nt, Mycobacterium tuberculosis H37Rv
aucggcgacaggagac

SEQ ID NO: 1354145 - RNA, 18 nt, Mycobacterium tuberculosis H37Rv
aucggcuucuucuucuug

SEQ ID NO: 1354146 - RNA, 21 nt, Mycobacterium tuberculosis H37Rv
aucgggaauuucgucggccau

SEQ ID NO: 1354147 - RNA, 15 nt, Mycobacterium tuberculosis H37Rv
aucgguccaaagcac

SEQ ID NO: 1354148 - RNA, 20 nt, Mycobacterium tuberculosis H37Rv
aucggugaccguggcgggga

SEQ ID NO: 1354149 - RNA, 23 nt, Mycobacterium tuberculosis H37Rv
aucgggcguggugagcaguguga

SEQ ID NO: 1354150 - RNA, 15 nt, Mycobacterium tuberculosis H37Rv
aucggggccacugag

SEQ ID NO: 1354151 - RNA, 13 nt, Mycobacterium tuberculosis H37Rv
aucgcgugcugga

SEQ ID NO: 1354152 - RNA, 13 nt, Mycobacterium tuberculosis H37Rv
aucggagucuuca

SEQ ID NO: 1354153 - RNA, 18 nt, Mycobacterium tuberculosis H37Rv
aucgcgggcgugccgacc

SEQ ID NO: 1354154 - RNA, 23 nt, Mycobacterium tuberculosis H37Rv
aucgcggucaaauccagcagcca

SEQ ID NO: 1354155 - RNA, 14 nt, Mycobacterium tuberculosis H37Rv
aucgcggugugccg

SEQ ID NO: 1354156 - RNA, 15 nt, Mycobacterium tuberculosis H37Rv
aucgcguccuccucg

SEQ ID NO: 1354157 - RNA, 13 nt, Mycobacterium tuberculosis H37Rv
aucgcggucuuga

SEQ ID NO: 1354158 - RNA, 20 nt, Mycobacterium tuberculosis H37Rv
aucggauacccagccggccu

SEQ ID NO: 1354159 - RNA, 15 nt, Mycobacterium tuberculosis H37Rv
aucggauggcggcca

SEQ ID NO: 1354160 - RNA, 10 nt, Mycobacterium tuberculosis H37Rv
aucggccacc

SEQ ID NO: 1354161 - RNA, 18 nt, Mycobacterium tuberculosis H37Rv
aucggccaccuguuggca

SEQ ID NO: 1354162 - RNA, 19 nt, Mycobacterium tuberculosis H37Rv
aucggccaacuugcucagc

SEQ ID NO: 1354163 - RNA, 23 nt, Mycobacterium tuberculosis H37Rv
aucgguggucgauggacaacagc

SEQ ID NO: 1354164 - RNA, 22 nt, Mycobacterium tuberculosis H37Rv
aucggugcacaacgcccaccac

SEQ ID NO: 1354165 - RNA, 14 nt, Mycobacterium tuberculosis H37Rv
aucgucgagcaccu

SEQ ID NO: 1354166 - RNA, 19 nt, Mycobacterium tuberculosis H37Rv
aucgucgaacagcaccgcc

SEQ ID NO: 1354167 - RNA, 21 nt, Mycobacterium tuberculosis H37Rv
aucgucgccgaccgucacuga

SEQ ID NO: 1354168 - RNA, 16 nt, Mycobacterium tuberculosis H37Rv
aucguguugucaggac

SEQ ID NO: 1354169 - RNA, 18 nt, Mycobacterium tuberculosis H37Rv
aucgugggugccggcuca

SEQ ID NO: 1354170 - RNA, 20 nt, Mycobacterium tuberculosis H37Rv
aucguugccggugccgccgc

SEQ ID NO: 1354171 - RNA, 19 nt, Mycobacterium tuberculosis H37Rv
aucguugccucgucgccgc

SEQ ID NO: 1354172 - RNA, 21 nt, Mycobacterium tuberculosis H37Rv
aucguugccgaccgucacuga

SEQ ID NO: 1354173 - RNA, 18 nt, Mycobacterium tuberculosis H37Rv
aucguucgggguggugga

SEQ ID NO: 1354174 - RNA, 16 nt, Mycobacterium tuberculosis H37Rv
aucgagaguugaaucc

SEQ ID NO: 1354175 - RNA, 13 nt, Mycobacterium tuberculosis H37Rv
aucgagcaccgca

SEQ ID NO: 1354176 - RNA, 19 nt, Mycobacterium tuberculosis H37Rv
aucagcugcgcaucgccac

SEQ ID NO: 1354177 - RNA, 14 nt, Mycobacterium tuberculosis H37Rv
aucgaguccaccac

SEQ ID NO: 1354178 - RNA, 19 nt, Mycobacterium tuberculosis H37Rv
aucgaguagcugaccgagc

SEQ ID NO: 1354179 - RNA, 22 nt, Mycobacterium tuberculosis H37Rv
aucgaggugauguuggccgcca

SEQ ID NO: 1354180 - RNA, 12 nt, Mycobacterium tuberculosis H37Rv
aucgagguugac

SEQ ID NO: 1354181 - RNA, 22 nt, Mycobacterium tuberculosis H37Rv
aucgagggggacgcugaucgaa

SEQ ID NO: 1354182 - RNA, 20 nt, Mycobacterium tuberculosis H37Rv
aucgagcagggugaccagga

SEQ ID NO: 1354183 - RNA, 14 nt, Mycobacterium tuberculosis H37Rv
aucgagcgccagcc

SEQ ID NO: 1354184 - RNA, 22 nt, Mycobacterium tuberculosis H37Rv
aucgaucagcaacucggccacg

SEQ ID NO: 1354185 - RNA, 23 nt, Mycobacterium tuberculosis H37Rv
aucgaucagcaacucggccacgg

SEQ ID NO: 1354186 - RNA, 13 nt, Mycobacterium tuberculosis H37Rv
aucgcacccacca

SEQ ID NO: 1354187 - RNA, 18 nt, Mycobacterium tuberculosis H37Rv
aucgcaaugaccugcagc

SEQ ID NO: 1354188 - RNA, 18 nt, Mycobacterium tuberculosis H37Rv
aucgcccagugugcgccg

SEQ ID NO: 1354189 - RNA, 21 nt, Mycobacterium tuberculosis H37Rv
aucgcccgaguugaagaagcc

SEQ ID NO: 1354190 - RNA, 16 nt, Mycobacterium tuberculosis H37Rv
aucgcccggccccgca

SEQ ID NO: 1354191 - RNA, 23 nt, Mycobacterium tuberculosis H37Rv
aucgcccgggcgggauccaccca

SEQ ID NO: 1354192 - RNA, 23 nt, Mycobacterium tuberculosis H37Rv
aucgcccucgucgcgggccaccg

SEQ ID NO: 1354193 - RNA, 20 nt, Mycobacterium tuberculosis H37Rv
aucgccgggaacaucccagc

SEQ ID NO: 1354194 - RNA, 18 nt, Mycobacterium tuberculosis H37Rv
aucgccggcggccaccag

SEQ ID NO: 1354195 - RNA, 13 nt, Mycobacterium tuberculosis H37Rv
aucgcccugggcg

SEQ ID NO: 1354196 - RNA, 21 nt, Mycobacterium tuberculosis H37Rv
aucgcagggaucaccccggcc

SEQ ID NO: 1354197 - RNA, 18 nt, Mycobacterium tuberculosis H37Rv
aucgcagacggcugccac

SEQ ID NO: 1354198 - RNA, 23 nt, Mycobacterium tuberculosis H37Rv
aucgccuccagccggcgaaugcg

SEQ ID NO: 1354199 - RNA, 18 nt, Mycobacterium tuberculosis H37Rv
aucgccgucagcaccgcu

SEQ ID NO: 1354200 - RNA, 17 nt, Mycobacterium tuberculosis H37Rv
aucgccguccagcaaua

SEQ ID NO: 1354201 - RNA, 16 nt, Mycobacterium tuberculosis H37Rv
aucgcgccgucggcga

SEQ ID NO: 1354202 - RNA, 17 nt, Mycobacterium tuberculosis H37Rv
aucgcgcggcugugccc

SEQ ID NO: 1354203 - RNA, 17 nt, Mycobacterium tuberculosis H37Rv
aucgcgcggaccagagu

SEQ ID NO: 1354204 - RNA, 19 nt, Mycobacterium tuberculosis H37Rv
auaaggcgucaauguggau

SEQ ID NO: 1354205 - RNA, 11 nt, Mycobacterium tuberculosis H37Rv
auaagguauuc

SEQ ID NO: 1354206 - RNA, 17 nt, Mycobacterium tuberculosis H37Rv
auaaaccgcacaucgcu

SEQ ID NO: 1354207 - RNA, 16 nt, Mycobacterium tuberculosis H37Rv
auaacccaaccgcgcc

SEQ ID NO: 1354208 - RNA, 13 nt, Mycobacterium tuberculosis H37Rv
auaacccuggccg

SEQ ID NO: 1354209 - RNA, 15 nt, Mycobacterium tuberculosis H37Rv
auaaccggccauguc

SEQ ID NO: 1354210 - RNA, 19 nt, Mycobacterium tuberculosis H37Rv
auaaccguugaccucuucg

SEQ ID NO: 1354211 - RNA, 14 nt, Mycobacterium tuberculosis H37Rv
agugaccacgcugc

SEQ ID NO: 1354212 - RNA, 18 nt, Mycobacterium tuberculosis H37Rv
agugaccgcagucccagc

SEQ ID NO: 1354213 - RNA, 21 nt, Mycobacterium tuberculosis H37Rv
agugaccgcagucccagcaca

SEQ ID NO: 1354214 - RNA, 21 nt, Mycobacterium tuberculosis H37Rv
agugacgccucgacacccagc

SEQ ID NO: 1354215 - RNA, 13 nt, Mycobacterium tuberculosis H37Rv
agugaccugggcg

SEQ ID NO: 1354216 - RNA, 13 nt, Mycobacterium tuberculosis H37Rv
agugacagcagga

SEQ ID NO: 1354217 - RNA, 17 nt, Mycobacterium tuberculosis H37Rv
agucuucgucgucggaa

SEQ ID NO: 1354218 - RNA, 17 nt, Mycobacterium tuberculosis H37Rv
agucuuucgcuucgccc

SEQ ID NO: 1354219 - RNA, 17 nt, Mycobacterium tuberculosis H37Rv
agucugauggccucgcg

SEQ ID NO: 1354220 - RNA, 20 nt, Mycobacterium tuberculosis H37Rv
agucgcgcgccaagacgaac

SEQ ID NO: 1354221 - RNA, 18 nt, Mycobacterium tuberculosis H37Rv
agucgacgacguggcugc

SEQ ID NO: 1354222 - RNA, 19 nt, Mycobacterium tuberculosis H37Rv
agucgacgaacgccucacc

SEQ ID NO: 1354223 - RNA, 16 nt, Mycobacterium tuberculosis H37Rv
agucgacgccgcagcg

SEQ ID NO: 1354224 - RNA, 16 nt, Mycobacterium tuberculosis H37Rv
agucgccgaucgagac

SEQ ID NO: 1354225 - RNA, 14 nt, Mycobacterium tuberculosis H37Rv
agucgccggccggc

SEQ ID NO: 1354226 - RNA, 22 nt, Mycobacterium tuberculosis H37Rv
aguccgcgccgacggccagcag

SEQ ID NO: 1354227 - RNA, 20 nt, Mycobacterium tuberculosis H37Rv
aguccgcgccggcgggcgcg

SEQ ID NO: 1354228 - RNA, 21 nt, Mycobacterium tuberculosis H37Rv
aguaccgucaucgcggugugc

SEQ ID NO: 1354229 - RNA, 19 nt, Mycobacterium tuberculosis H37Rv
aguccgguagcuguggugg

SEQ ID NO: 1354230 - RNA, 19 nt, Mycobacterium tuberculosis H37Rv
aguccguacuugccaccca

SEQ ID NO: 1354231 - RNA, 21 nt, Mycobacterium tuberculosis H37Rv
aguccgucgacaccgcggacc

SEQ ID NO: 1354232 - RNA, 14 nt, Mycobacterium tuberculosis H37Rv
agucgaagaagacc

SEQ ID NO: 1354233 - RNA, 22 nt, Mycobacterium tuberculosis H37Rv
agugcagaagacaagugguggu

SEQ ID NO: 1354234 - RNA, 21 nt, Mycobacterium tuberculosis H37Rv
agugcagacaggcggcggccu

SEQ ID NO: 1354235 - RNA, 19 nt, Mycobacterium tuberculosis H37Rv
agugcagcgaucccggcaa

SEQ ID NO: 1354236 - RNA, 16 nt, Mycobacterium tuberculosis H37Rv
agugagcgaucgggug

SEQ ID NO: 1354237 - RNA, 19 nt, Mycobacterium tuberculosis H37Rv
agugacugguauuucccuu

SEQ ID NO: 1354238 - RNA, 22 nt, Mycobacterium tuberculosis H37Rv
agugacgguccguucgaugcca

SEQ ID NO: 1354239 - RNA, 23 nt, Mycobacterium tuberculosis H37Rv
agugcaggugcccggccaaaaug

SEQ ID NO: 1354240 - RNA, 15 nt, Mycobacterium tuberculosis H37Rv
agugcagcucgauac

SEQ ID NO: 1354241 - RNA, 16 nt, Mycobacterium tuberculosis H37Rv
agugcaggcggccgcc

SEQ ID NO: 1354242 - RNA, 16 nt, Mycobacterium tuberculosis H37Rv
agugcaggugcccggc

SEQ ID NO: 1354243 - RNA, 12 nt, Mycobacterium tuberculosis H37Rv
agugcugcaccg

SEQ ID NO: 1354244 - RNA, 19 nt, Mycobacterium tuberculosis H37Rv
aguggagccccgacugcug

SEQ ID NO: 1354245 - RNA, 17 nt, Mycobacterium tuberculosis H37Rv
aguggaagccgaccacc

SEQ ID NO: 1354246 - RNA, 14 nt, Mycobacterium tuberculosis H37Rv
agugcgauaccuag

SEQ ID NO: 1354247 - RNA, 19 nt, Mycobacterium tuberculosis H37Rv
agugcgcauaauauuuucc

SEQ ID NO: 1354248 - RNA, 13 nt, Mycobacterium tuberculosis H37Rv
agugucagcagau

SEQ ID NO: 1354249 - RNA, 13 nt, Mycobacterium tuberculosis H37Rv
agugucugcucgc

SEQ ID NO: 1354250 - RNA, 16 nt, Mycobacterium tuberculosis H37Rv
agugugacggcggcca

SEQ ID NO: 1354251 - RNA, 22 nt, Mycobacterium tuberculosis H37Rv
agugucuccggcaacagcacca

SEQ ID NO: 1354252 - RNA, 20 nt, Mycobacterium tuberculosis H37Rv
agugucuccggcaacagcac

SEQ ID NO: 1354253 - RNA, 19 nt, Mycobacterium tuberculosis H37Rv
agugucuccggcaacagca

SEQ ID NO: 1354254 - RNA, 20 nt, Mycobacterium tuberculosis H37Rv
agugggaugaccuuggccgu

SEQ ID NO: 1354255 - RNA, 13 nt, Mycobacterium tuberculosis H37Rv
agugggacuggcg

SEQ ID NO: 1354256 - RNA, 16 nt, Mycobacterium tuberculosis H37Rv
aguggcucgcucugcg

SEQ ID NO: 1354257 - RNA, 13 nt, Mycobacterium tuberculosis H37Rv
aguggggugcggg

SEQ ID NO: 1354258 - RNA, 20 nt, Mycobacterium tuberculosis H37Rv
agugggcgguaccucgucga

SEQ ID NO: 1354259 - RNA, 23 nt, Mycobacterium tuberculosis H37Rv
aguggggauucguugucgagcac

SEQ ID NO: 1354260 - RNA, 21 nt, Mycobacterium tuberculosis H37Rv
agugguacggcucggcgcuga

SEQ ID NO: 1354261 - RNA, 19 nt, Mycobacterium tuberculosis H37Rv
aguggugauccagccgucg

SEQ ID NO: 1354262 - RNA, 20 nt, Mycobacterium tuberculosis H37Rv
aguggugaccgacgcggaca

SEQ ID NO: 1354263 - RNA, 18 nt, Mycobacterium tuberculosis H37Rv
aguggugggcguggcugg

SEQ ID NO: 1354264 - RNA, 14 nt, Mycobacterium tuberculosis H37Rv
agugguccagccag

SEQ ID NO: 1354265 - RNA, 23 nt, Mycobacterium tuberculosis H37Rv
aguggucccguucgcccgcccgu

SEQ ID NO: 1354266 - RNA, 16 nt, Mycobacterium tuberculosis H37Rv
agugguuagucggccu

SEQ ID NO: 1354267 - RNA, 15 nt, Mycobacterium tuberculosis H37Rv
aguuccaauccggaa

SEQ ID NO: 1354268 - RNA, 19 nt, Mycobacterium tuberculosis H37Rv
aguuccaaaucgguggcaa

SEQ ID NO: 1354269 - RNA, 21 nt, Mycobacterium tuberculosis H37Rv
aguuccacggguggugccagg

SEQ ID NO: 1354270 - RNA, 20 nt, Mycobacterium tuberculosis H37Rv
aguucugcacagugcggccc

SEQ ID NO: 1354271 - RNA, 22 nt, Mycobacterium tuberculosis H37Rv
aguucgucaccguuggccgcgc

SEQ ID NO: 1354272 - RNA, 22 nt, Mycobacterium tuberculosis H37Rv
aguucgucggcggugcgcugau

SEQ ID NO: 1354273 - RNA, 16 nt, Mycobacterium tuberculosis H37Rv
aguucggcgagcacau

SEQ ID NO: 1354274 - RNA, 15 nt, Mycobacterium tuberculosis H37Rv
aguucgagcugccag

SEQ ID NO: 1354275 - RNA, 18 nt, Mycobacterium tuberculosis H37Rv
aguuaggccgccagccgg

SEQ ID NO: 1354276 - RNA, 15 nt, Mycobacterium tuberculosis H37Rv
aguguguuugguggu

SEQ ID NO: 1354277 - RNA, 14 nt, Mycobacterium tuberculosis H37Rv
aguguguuuggugg

SEQ ID NO: 1354278 - RNA, 20 nt, Mycobacterium tuberculosis H37Rv
agugugagcagacccagucc

SEQ ID NO: 1354279 - RNA, 16 nt, Mycobacterium tuberculosis H37Rv
agugugauuccggguc

SEQ ID NO: 1354280 - RNA, 18 nt, Mycobacterium tuberculosis H37Rv
aguguggccgaaagccag

SEQ ID NO: 1354281 - RNA, 18 nt, Mycobacterium tuberculosis H37Rv
aguguggcgaugaccacg

SEQ ID NO: 1354282 - RNA, 17 nt, Mycobacterium tuberculosis H37Rv
agugugggggucagggg

SEQ ID NO: 1354283 - RNA, 15 nt, Mycobacterium tuberculosis H37Rv
aguuguuggccagac

SEQ ID NO: 1354284 - RNA, 13 nt, Mycobacterium tuberculosis H37Rv
aguuggaacugcc

SEQ ID NO: 1354285 - RNA, 13 nt, Mycobacterium tuberculosis H37Rv
aguuggcaccagc

SEQ ID NO: 1354286 - RNA, 22 nt, Mycobacterium tuberculosis H37Rv
aguugcucggcuucccuaggcu

SEQ ID NO: 1354287 - RNA, 13 nt, Mycobacterium tuberculosis H37Rv
aguugaagaagcc

SEQ ID NO: 1354288 - RNA, 11 nt, Mycobacterium tuberculosis H37Rv
aguugaagaag

SEQ ID NO: 1354289 - RNA, 18 nt, Mycobacterium tuberculosis H37Rv
aguugaaggugccggcgu

SEQ ID NO: 1354290 - RNA, 16 nt, Mycobacterium tuberculosis H37Rv
aguuuugcggccaggg

SEQ ID NO: 1354291 - RNA, 16 nt, Mycobacterium tuberculosis H37Rv
aguuuccccuaccaga

SEQ ID NO: 1354292 - RNA, 13 nt, Mycobacterium tuberculosis H37Rv
aguuuaccgugcc

SEQ ID NO: 1354293 - RNA, 15 nt, Mycobacterium tuberculosis H37Rv
aguuugaccaccugg

SEQ ID NO: 1354294 - RNA, 22 nt, Mycobacterium tuberculosis H37Rv
auacgauguucagguugcugau

SEQ ID NO: 1354295 - RNA, 17 nt, Mycobacterium tuberculosis H37Rv
auacgagcagugaccgc

SEQ ID NO: 1354296 - RNA, 14 nt, Mycobacterium tuberculosis H37Rv
auacggccggccgu

SEQ ID NO: 1354297 - RNA, 19 nt, Mycobacterium tuberculosis H37Rv
auacgcccacuccagcagc

SEQ ID NO: 1354298 - RNA, 16 nt, Mycobacterium tuberculosis H37Rv
auacggguguggccgu

SEQ ID NO: 1354299 - RNA, 23 nt, Mycobacterium tuberculosis H37Rv
auaccgguugcggucaucggcgc

SEQ ID NO: 1354300 - RNA, 15 nt, Mycobacterium tuberculosis H37Rv
auaccggcuggccag

SEQ ID NO: 1354301 - RNA, 17 nt, Mycobacterium tuberculosis H37Rv
auaccggcuggccaggu

SEQ ID NO: 1354302 - RNA, 17 nt, Mycobacterium tuberculosis H37Rv
auaccggcgugcaguac

SEQ ID NO: 1354303 - RNA, 19 nt, Mycobacterium tuberculosis H37Rv
auaccggccgccaucaucg

SEQ ID NO: 1354304 - RNA, 17 nt, Mycobacterium tuberculosis H37Rv
auagcgggcgguagcca

SEQ ID NO: 1354305 - RNA, 16 nt, Mycobacterium tuberculosis H37Rv
auagcgcggcaccagc

SEQ ID NO: 1354306 - RNA, 18 nt, Mycobacterium tuberculosis H37Rv
auagccaucacgacuccc

SEQ ID NO: 1354307 - RNA, 19 nt, Mycobacterium tuberculosis H37Rv
auagcugcgcgaagccacc

SEQ ID NO: 1354308 - RNA, 14 nt, Mycobacterium tuberculosis H37Rv
auaggaagguugaa

SEQ ID NO: 1354309 - RNA, 20 nt, Mycobacterium tuberculosis H37Rv
auagcugcgcgaagccacca

SEQ ID NO: 1354310 - RNA, 23 nt, Mycobacterium tuberculosis H37Rv
auaucgccgagaaccagcgaaau

SEQ ID NO: 1354311 - RNA, 14 nt, Mycobacterium tuberculosis H37Rv
auaucuugcgcaug

SEQ ID NO: 1354312 - RNA, 18 nt, Mycobacterium tuberculosis H37Rv
auaguguguuuggugguu

SEQ ID NO: 1354313 - RNA, 14 nt, Mycobacterium tuberculosis H37Rv
auaggugaacgcug

SEQ ID NO: 1354314 - RNA, 21 nt, Mycobacterium tuberculosis H37Rv
auagguguguggcgccgggga

SEQ ID NO: 1354315 - RNA, 17 nt, Mycobacterium tuberculosis H37Rv
auaggaccacgggaugc

SEQ ID NO: 1354316 - RNA, 16 nt, Mycobacterium tuberculosis H37Rv
auaggcaaggucaacc

SEQ ID NO: 1354317 - RNA, 15 nt, Mycobacterium tuberculosis H37Rv
auauugcgcccggcc

SEQ ID NO: 1354318 - RNA, 11 nt, Mycobacterium tuberculosis H37Rv
auauugccauc

SEQ ID NO: 1354319 - RNA, 15 nt, Mycobacterium tuberculosis H37Rv
aucaaccccagcgca

SEQ ID NO: 1354320 - RNA, 23 nt, Mycobacterium tuberculosis H37Rv
aucaacgaacggauaccugggac

SEQ ID NO: 1354321 - RNA, 16 nt, Mycobacterium tuberculosis H37Rv
aucaacgacaccagau

SEQ ID NO: 1354322 - RNA, 17 nt, Mycobacterium tuberculosis H37Rv
aucaacgcguugcacag

SEQ ID NO: 1354323 - RNA, 18 nt, Mycobacterium tuberculosis H37Rv
aucaacgcgucgcccgca

SEQ ID NO: 1354324 - RNA, 14 nt, Mycobacterium tuberculosis H37Rv
aucaaggccaccuc

SEQ ID NO: 1354325 - RNA, 22 nt, Mycobacterium tuberculosis H37Rv
aucaaggagauccagggccuuc

SEQ ID NO: 1354326 - RNA, 20 nt, Mycobacterium tuberculosis H37Rv
aucaaugcugcguccuggau

SEQ ID NO: 1354327 - RNA, 19 nt, Mycobacterium tuberculosis H37Rv
aucaccacuggacccgccc

SEQ ID NO: 1354328 - RNA, 13 nt, Mycobacterium tuberculosis H37Rv
aucacaucaaagu

SEQ ID NO: 1354329 - RNA, 23 nt, Mycobacterium tuberculosis H37Rv
aucacaucggccucugaccagcc

SEQ ID NO: 1354330 - RNA, 13 nt, Mycobacterium tuberculosis H37Rv
aucaccggcugcu

SEQ ID NO: 1354331 - RNA, 18 nt, Mycobacterium tuberculosis H37Rv
aucaccucaccagucagg

SEQ ID NO: 1354332 - RNA, 20 nt, Mycobacterium tuberculosis H37Rv
aucaccgagucgacggccag

SEQ ID NO: 1354333 - RNA, 17 nt, Mycobacterium tuberculosis H37Rv
aucaccggaacccccag

SEQ ID NO: 1354334 - RNA, 22 nt, Mycobacterium tuberculosis H37Rv
aucaccgcgccagccuccacca

SEQ ID NO: 1354335 - RNA, 11 nt, Mycobacterium tuberculosis H37Rv
aucaccgcgcu

SEQ ID NO: 1354336 - RNA, 18 nt, Mycobacterium tuberculosis H37Rv
aucaccaugaucagcgcc

SEQ ID NO: 1354337 - RNA, 14 nt, Mycobacterium tuberculosis H37Rv
aucacccccuggac

SEQ ID NO: 1354338 - RNA, 13 nt, Mycobacterium tuberculosis H37Rv
aucacccagcgcc

SEQ ID NO: 1354339 - RNA, 23 nt, Mycobacterium tuberculosis H37Rv
aucacgggcuaccggcagcugcu

SEQ ID NO: 1354340 - RNA, 18 nt, Mycobacterium tuberculosis H37Rv
aucacgggcuaccggcag

SEQ ID NO: 1354341 - RNA, 17 nt, Mycobacterium tuberculosis H37Rv
aucacgccgucgcagag

SEQ ID NO: 1354342 - RNA, 18 nt, Mycobacterium tuberculosis H37Rv
aucacggcaccgaagugc

SEQ ID NO: 1354343 - RNA, 22 nt, Mycobacterium tuberculosis H37Rv
aucacugaggcugcggguggga

SEQ ID NO: 1354344 - RNA, 22 nt, Mycobacterium tuberculosis H37Rv
aucacucacccgggcagccugc

SEQ ID NO: 1354345 - RNA, 16 nt, Mycobacterium tuberculosis H37Rv
aucacguggaccacgg

SEQ ID NO: 1354346 - RNA, 17 nt, Mycobacterium tuberculosis H37Rv
aucacguggaccacggc

SEQ ID NO: 1354347 - RNA, 17 nt, Mycobacterium tuberculosis H37Rv
aucacgucgucagccac

SEQ ID NO: 1354348 - RNA, 17 nt, Mycobacterium tuberculosis H37Rv
aucacguugcgcuggau

SEQ ID NO: 1354349 - RNA, 18 nt, Mycobacterium tuberculosis H37Rv
aucagcaugguccacagc

SEQ ID NO: 1354350 - RNA, 17 nt, Mycobacterium tuberculosis H37Rv
aucagcaccgacagccc

SEQ ID NO: 1354351 - RNA, 19 nt, Mycobacterium tuberculosis H37Rv
aucagcaagagccgcagcc

SEQ ID NO: 1354352 - RNA, 14 nt, Mycobacterium tuberculosis H37Rv
aucagcagcccccc

SEQ ID NO: 1354353 - RNA, 12 nt, Mycobacterium tuberculosis H37Rv
aucagccgugcg

SEQ ID NO: 1354354 - RNA, 22 nt, Mycobacterium tuberculosis H37Rv
aucagcccgacaccguccagca

SEQ ID NO: 1354355 - RNA, 16 nt, Mycobacterium tuberculosis H37Rv
aucagcccgcgcagca

SEQ ID NO: 1354356 - RNA, 17 nt, Mycobacterium tuberculosis H37Rv
aucagcggauccagaaa

SEQ ID NO: 1354357 - RNA, 16 nt, Mycobacterium tuberculosis H37Rv
aucagcgccagcgagc

SEQ ID NO: 1354358 - RNA, 14 nt, Mycobacterium tuberculosis H37Rv
aucagaaucaggcu

SEQ ID NO: 1354359 - RNA, 19 nt, Mycobacterium tuberculosis H37Rv
aucagacggcgaguaggcg

SEQ ID NO: 1354360 - RNA, 22 nt, Mycobacterium tuberculosis H37Rv
aucagagcguucuucagccagg

SEQ ID NO: 1354361 - RNA, 16 nt, Mycobacterium tuberculosis H37Rv
aucagauucgcgcugg

SEQ ID NO: 1354362 - RNA, 15 nt, Mycobacterium tuberculosis H37Rv
aggugggauugaagc

SEQ ID NO: 1354363 - RNA, 22 nt, Mycobacterium tuberculosis H37Rv
agguggcuggcugugccgagcu

SEQ ID NO: 1354364 - RNA, 23 nt, Mycobacterium tuberculosis H37Rv
agguggccgcgcaggggcggcgu

SEQ ID NO: 1354365 - RNA, 12 nt, Mycobacterium tuberculosis H37Rv
agguggcccgcg

SEQ ID NO: 1354366 - RNA, 21 nt, Mycobacterium tuberculosis H37Rv
agguggccgcgcaggggcggc

SEQ ID NO: 1354367 - RNA, 13 nt, Mycobacterium tuberculosis H37Rv
aggugggcagcag

SEQ ID NO: 1354368 - RNA, 21 nt, Mycobacterium tuberculosis H37Rv
aggugggauugaagcuggcca

SEQ ID NO: 1354369 - RNA, 11 nt, Mycobacterium tuberculosis H37Rv
aggugggcucg

SEQ ID NO: 1354370 - RNA, 15 nt, Mycobacterium tuberculosis H37Rv
agguggcgcacaucg

SEQ ID NO: 1354371 - RNA, 16 nt, Mycobacterium tuberculosis H37Rv
aggugcgcgaccagga

SEQ ID NO: 1354372 - RNA, 13 nt, Mycobacterium tuberculosis H37Rv
aggugccuucuuc

SEQ ID NO: 1354373 - RNA, 16 nt, Mycobacterium tuberculosis H37Rv
aggugcccaagcaguc

SEQ ID NO: 1354374 - RNA, 18 nt, Mycobacterium tuberculosis H37Rv
aggugcccaaggccagga

SEQ ID NO: 1354375 - RNA, 11 nt, Mycobacterium tuberculosis H37Rv
aggugccgggg

SEQ ID NO: 1354376 - RNA, 17 nt, Mycobacterium tuberculosis H37Rv
aggugacaaaucggcca

SEQ ID NO: 1354377 - RNA, 18 nt, Mycobacterium tuberculosis H37Rv
aggugaaccccgccggca

SEQ ID NO: 1354378 - RNA, 18 nt, Mycobacterium tuberculosis H37Rv
aggugaacgacaugggca

SEQ ID NO: 1354379 - RNA, 21 nt, Mycobacterium tuberculosis H37Rv
aggugaacgacaugggcaggc

SEQ ID NO: 1354380 - RNA, 20 nt, Mycobacterium tuberculosis H37Rv
aggugacgcccgcuccgcgg

SEQ ID NO: 1354381 - RNA, 15 nt, Mycobacterium tuberculosis H37Rv
aggugacgccgccag

SEQ ID NO: 1354382 - RNA, 18 nt, Mycobacterium tuberculosis H37Rv
aggugacguucgaugccc

SEQ ID NO: 1354383 - RNA, 17 nt, Mycobacterium tuberculosis H37Rv
aggugaaucgacugauc

SEQ ID NO: 1354384 - RNA, 17 nt, Mycobacterium tuberculosis H37Rv
aggugaugagugcggac

SEQ ID NO: 1354385 - RNA, 13 nt, Mycobacterium tuberculosis H37Rv
aggugaucagcag

SEQ ID NO: 1354386 - RNA, 16 nt, Mycobacterium tuberculosis H37Rv
aggugcacugccgggu

SEQ ID NO: 1354387 - RNA, 13 nt, Mycobacterium tuberculosis H37Rv
aggugccaccugu

SEQ ID NO: 1354388 - RNA, 19 nt, Mycobacterium tuberculosis H37Rv
aggugcagguugcccucac

SEQ ID NO: 1354389 - RNA, 22 nt, Mycobacterium tuberculosis H37Rv
aggucgacaccgcggugccccg

SEQ ID NO: 1354390 - RNA, 22 nt, Mycobacterium tuberculosis H37Rv
agguccgccccguugugucacc

SEQ ID NO: 1354391 - RNA, 20 nt, Mycobacterium tuberculosis H37Rv
agguccucagcgaugcucac

SEQ ID NO: 1354392 - RNA, 20 nt, Mycobacterium tuberculosis H37Rv
agguccucgagguccucguc

SEQ ID NO: 1354393 - RNA, 16 nt, Mycobacterium tuberculosis H37Rv
aggucgccggcacacc

SEQ ID NO: 1354394 - RNA, 19 nt, Mycobacterium tuberculosis H37Rv
aggucgccgccgccacggc

SEQ ID NO: 1354395 - RNA, 17 nt, Mycobacterium tuberculosis H37Rv
aggucgagcgaccccac

SEQ ID NO: 1354396 - RNA, 20 nt, Mycobacterium tuberculosis H37Rv
aggucgcauucugcugccag

SEQ ID NO: 1354397 - RNA, 18 nt, Mycobacterium tuberculosis H37Rv
aggucgacgccgaccacc

SEQ ID NO: 1354398 - RNA, 23 nt, Mycobacterium tuberculosis H37Rv
aggucgauaccggcgugcaguac

SEQ ID NO: 1354399 - RNA, 12 nt, Mycobacterium tuberculosis H37Rv
aggucgaugccg

SEQ ID NO: 1354400 - RNA, 19 nt, Mycobacterium tuberculosis H37Rv
agguccgcggccgcgguga

SEQ ID NO: 1354401 - RNA, 19 nt, Mycobacterium tuberculosis H37Rv
agguccgaucgugugaggc

SEQ ID NO: 1354402 - RNA, 23 nt, Mycobacterium tuberculosis H37Rv
agguccgcacgaucugcaggccc

SEQ ID NO: 1354403 - RNA, 21 nt, Mycobacterium tuberculosis H37Rv
aggucucugucauugcugccc

SEQ ID NO: 1354404 - RNA, 20 nt, Mycobacterium tuberculosis H37Rv
aggucuccaucaaccgcgcu

SEQ ID NO: 1354405 - RNA, 23 nt, Mycobacterium tuberculosis H37Rv
aggucuccggcaagccgauugcu

SEQ ID NO: 1354406 - RNA, 18 nt, Mycobacterium tuberculosis H37Rv
aggucuggccugccccag

SEQ ID NO: 1354407 - RNA, 14 nt, Mycobacterium tuberculosis H37Rv
aggugaacugguug

SEQ ID NO: 1354408 - RNA, 23 nt, Mycobacterium tuberculosis H37Rv
aggucguggacuuuauggcuagu

SEQ ID NO: 1354409 - RNA, 21 nt, Mycobacterium tuberculosis H37Rv
aggucggugugcaucgccggc

SEQ ID NO: 1354410 - RNA, 17 nt, Mycobacterium tuberculosis H37Rv
aggucggucaggucgag

SEQ ID NO: 1354411 - RNA, 23 nt, Mycobacterium tuberculosis H37Rv
aggucggccagcagcagugccac

SEQ ID NO: 1354412 - RNA, 13 nt, Mycobacterium tuberculosis H37Rv
aggucggccaccg

SEQ ID NO: 1354413 - RNA, 21 nt, Mycobacterium tuberculosis H37Rv
aggucggcgggcgcggguggc

SEQ ID NO: 1354414 - RNA, 18 nt, Mycobacterium tuberculosis H37Rv
aggucgcggucuuugagc

SEQ ID NO: 1354415 - RNA, 21 nt, Mycobacterium tuberculosis H37Rv
agguacucaguguuccgccac

SEQ ID NO: 1354416 - RNA, 22 nt, Mycobacterium tuberculosis H37Rv
agguagucgucgacuugcaggc

SEQ ID NO: 1354417 - RNA, 15 nt, Mycobacterium tuberculosis H37Rv
agguaggucaccagg

SEQ ID NO: 1354418 - RNA, 23 nt, Mycobacterium tuberculosis H37Rv
agguaagcgaacggguagucggg

SEQ ID NO: 1354419 - RNA, 14 nt, Mycobacterium tuberculosis H37Rv
agguacgccaggug

SEQ ID NO: 1354420 - RNA, 15 nt, Mycobacterium tuberculosis H37Rv
agguacaucaccacg

SEQ ID NO: 1354421 - RNA, 19 nt, Mycobacterium tuberculosis H37Rv
aggucaaggucgucgugga

SEQ ID NO: 1354422 - RNA, 22 nt, Mycobacterium tuberculosis H37Rv
agguaguucgacugaaucaugg

SEQ ID NO: 1354423 - RNA, 13 nt, Mycobacterium tuberculosis H37Rv
agguaugcccgga

SEQ ID NO: 1354424 - RNA, 19 nt, Mycobacterium tuberculosis H37Rv
agggugcccgcguugccaa

SEQ ID NO: 1354425 - RNA, 17 nt, Mycobacterium tuberculosis H37Rv
agggugcucgucaccaa

SEQ ID NO: 1354426 - RNA, 14 nt, Mycobacterium tuberculosis H37Rv
aggguggccagcag

SEQ ID NO: 1354427 - RNA, 15 nt, Mycobacterium tuberculosis H37Rv
aggguggccagcagg

SEQ ID NO: 1354428 - RNA, 19 nt, Mycobacterium tuberculosis H37Rv
agggugccggucacgucga

SEQ ID NO: 1354429 - RNA, 16 nt, Mycobacterium tuberculosis H37Rv
aggguggcgcgguacc

SEQ ID NO: 1354430 - RNA, 13 nt, Mycobacterium tuberculosis H37Rv
aggguggccagca

SEQ ID NO: 1354431 - RNA, 20 nt, Mycobacterium tuberculosis H37Rv
aggguguugcggcugaccuc

SEQ ID NO: 1354432 - RNA, 23 nt, Mycobacterium tuberculosis H37Rv
agggugucgaagagcaggcccau

SEQ ID NO: 1354433 - RNA, 19 nt, Mycobacterium tuberculosis H37Rv
aggguauccacgccgggca

SEQ ID NO: 1354434 - RNA, 16 nt, Mycobacterium tuberculosis H37Rv
agggucgacguaggac

SEQ ID NO: 1354435 - RNA, 21 nt, Mycobacterium tuberculosis H37Rv
agggucagcucggugaugucg

SEQ ID NO: 1354436 - RNA, 13 nt, Mycobacterium tuberculosis H37Rv
agguaagcagcca

SEQ ID NO: 1354437 - RNA, 20 nt, Mycobacterium tuberculosis H37Rv
aggguucggacggcugguag

SEQ ID NO: 1354438 - RNA, 18 nt, Mycobacterium tuberculosis H37Rv
agguuucccgggucccau

SEQ ID NO: 1354439 - RNA, 23 nt, Mycobacterium tuberculosis H37Rv
agguuugcgccgcgcagcgagga

SEQ ID NO: 1354440 - RNA, 15 nt, Mycobacterium tuberculosis H37Rv
aggugucgggcucgc

SEQ ID NO: 1354441 - RNA, 21 nt, Mycobacterium tuberculosis H37Rv
agguguccccgcccggccagc

SEQ ID NO: 1354442 - RNA, 19 nt, Mycobacterium tuberculosis H37Rv
aggugugcgacgacggcgc

SEQ ID NO: 1354443 - RNA, 19 nt, Mycobacterium tuberculosis H37Rv
agguguagcccuccgagca

SEQ ID NO: 1354444 - RNA, 18 nt, Mycobacterium tuberculosis H37Rv
aggugugcgucuccagcu

SEQ ID NO: 1354445 - RNA, 19 nt, Mycobacterium tuberculosis H37Rv
aggugugcgucuccagcug

SEQ ID NO: 1354446 - RNA, 14 nt, Mycobacterium tuberculosis H37Rv
agguguggugacag

SEQ ID NO: 1354447 - RNA, 22 nt, Mycobacterium tuberculosis H37Rv
agguguguggcgccggggacca

SEQ ID NO: 1354448 - RNA, 15 nt, Mycobacterium tuberculosis H37Rv
agguguguggcggcg

SEQ ID NO: 1354449 - RNA, 19 nt, Mycobacterium tuberculosis H37Rv
agguugggaacagccuauu

SEQ ID NO: 1354450 - RNA, 14 nt, Mycobacterium tuberculosis H37Rv
agguugaccaccag

SEQ ID NO: 1354451 - RNA, 16 nt, Mycobacterium tuberculosis H37Rv
agguugacccccgggu

SEQ ID NO: 1354452 - RNA, 19 nt, Mycobacterium tuberculosis H37Rv
agguugacgucaggcugaa

SEQ ID NO: 1354453 - RNA, 19 nt, Mycobacterium tuberculosis H37Rv
agguugccgcaccagucgc

SEQ ID NO: 1354454 - RNA, 17 nt, Mycobacterium tuberculosis H37Rv
aguacacaaauccgcac

SEQ ID NO: 1354455 - RNA, 18 nt, Mycobacterium tuberculosis H37Rv
aguaccccucgcacaaug

SEQ ID NO: 1354456 - RNA, 12 nt, Mycobacterium tuberculosis H37Rv
aguaaguccucg

SEQ ID NO: 1354457 - RNA, 18 nt, Mycobacterium tuberculosis H37Rv
aggcucacacucggccgg

SEQ ID NO: 1354458 - RNA, 16 nt, Mycobacterium tuberculosis H37Rv
aggcucccccaccagg

SEQ ID NO: 1354459 - RNA, 22 nt, Mycobacterium tuberculosis H37Rv
aggcuccaagcaauuccaccgc

SEQ ID NO: 1354460 - RNA, 21 nt, Mycobacterium tuberculosis H37Rv
aggcucgagguguagcccucc

SEQ ID NO: 1354461 - RNA, 12 nt, Mycobacterium tuberculosis H37Rv
aggcucgcagga

SEQ ID NO: 1354462 - RNA, 19 nt, Mycobacterium tuberculosis H37Rv
aggcucgcguggccgccgg

SEQ ID NO: 1354463 - RNA, 21 nt, Mycobacterium tuberculosis H37Rv
aggcugcagugccgcacccag

SEQ ID NO: 1354464 - RNA, 14 nt, Mycobacterium tuberculosis H37Rv
aggcugcagugccg

SEQ ID NO: 1354465 - RNA, 18 nt, Mycobacterium tuberculosis H37Rv
aggcgugucgucgcggcc

SEQ ID NO: 1354466 - RNA, 14 nt, Mycobacterium tuberculosis H37Rv
aggcguuuccgcug

SEQ ID NO: 1354467 - RNA, 18 nt, Mycobacterium tuberculosis H37Rv
aggcguuggaucccagcc

SEQ ID NO: 1354468 - RNA, 15 nt, Mycobacterium tuberculosis H37Rv
aggcggccgccggga

SEQ ID NO: 1354469 - RNA, 12 nt, Mycobacterium tuberculosis H37Rv
aggcggccaggu

SEQ ID NO: 1354470 - RNA, 15 nt, Mycobacterium tuberculosis H37Rv
aggcggccagcgcgc

SEQ ID NO: 1354471 - RNA, 14 nt, Mycobacterium tuberculosis H37Rv
aggcgguguccaga

SEQ ID NO: 1354472 - RNA, 21 nt, Mycobacterium tuberculosis H37Rv
aggcggucgaucauggcggca

SEQ ID NO: 1354473 - RNA, 18 nt, Mycobacterium tuberculosis H37Rv
aggcggucuuguccagga

SEQ ID NO: 1354474 - RNA, 14 nt, Mycobacterium tuberculosis H37Rv
aggcggugacgugg

SEQ ID NO: 1354475 - RNA, 22 nt, Mycobacterium tuberculosis H37Rv
aggcggugacguggugggcuug

SEQ ID NO: 1354476 - RNA, 16 nt, Mycobacterium tuberculosis H37Rv
aggcgggggagcccag

SEQ ID NO: 1354477 - RNA, 13 nt, Mycobacterium tuberculosis H37Rv
aggcgcgcaccac

SEQ ID NO: 1354478 - RNA, 15 nt, Mycobacterium tuberculosis H37Rv
aggcgcgcaccaccg

SEQ ID NO: 1354479 - RNA, 22 nt, Mycobacterium tuberculosis H37Rv
aggcgcuccuucagggcgucga

SEQ ID NO: 1354480 - RNA, 16 nt, Mycobacterium tuberculosis H37Rv
aggcgcucaucaccca

SEQ ID NO: 1354481 - RNA, 17 nt, Mycobacterium tuberculosis H37Rv
aggcgcucaucacccag

SEQ ID NO: 1354482 - RNA, 15 nt, Mycobacterium tuberculosis H37Rv
aggcgcuaggaacgc

SEQ ID NO: 1354483 - RNA, 23 nt, Mycobacterium tuberculosis H37Rv
aggcgcugaagaucaacaggcgu

SEQ ID NO: 1354484 - RNA, 22 nt, Mycobacterium tuberculosis H37Rv
aggcgcugaacgcgagcaacac

SEQ ID NO: 1354485 - RNA, 15 nt, Mycobacterium tuberculosis H37Rv
aggcgcuucgccaca

SEQ ID NO: 1354486 - RNA, 16 nt, Mycobacterium tuberculosis H37Rv
aggcgcuucgccacac

SEQ ID NO: 1354487 - RNA, 14 nt, Mycobacterium tuberculosis H37Rv
aggccgcacgggcg

SEQ ID NO: 1354488 - RNA, 16 nt, Mycobacterium tuberculosis H37Rv
aggccgaugacgaugc

SEQ ID NO: 1354489 - RNA, 22 nt, Mycobacterium tuberculosis H37Rv
aggccgccgccgucggcgagca

SEQ ID NO: 1354490 - RNA, 16 nt, Mycobacterium tuberculosis H37Rv
aggccgccguggugau

SEQ ID NO: 1354491 - RNA, 17 nt, Mycobacterium tuberculosis H37Rv
aggccgcgcggacccag

SEQ ID NO: 1354492 - RNA, 13 nt, Mycobacterium tuberculosis H37Rv
aggccgcgcccga

SEQ ID NO: 1354493 - RNA, 15 nt, Mycobacterium tuberculosis H37Rv
aggccggcccgcaac

SEQ ID NO: 1354494 - RNA, 17 nt, Mycobacterium tuberculosis H37Rv
aggccggcccgcaacgc

SEQ ID NO: 1354495 - RNA, 13 nt, Mycobacterium tuberculosis H37Rv
aggccggcggcgg

SEQ ID NO: 1354496 - RNA, 20 nt, Mycobacterium tuberculosis H37Rv
aggccggcggcggcgcucgg

SEQ ID NO: 1354497 - RNA, 13 nt, Mycobacterium tuberculosis H37Rv
aggccggccacca

SEQ ID NO: 1354498 - RNA, 20 nt, Mycobacterium tuberculosis H37Rv
aggccggccaccaccgcgcc

SEQ ID NO: 1354499 - RNA, 20 nt, Mycobacterium tuberculosis H37Rv
aggccggcagcuugcagugc

SEQ ID NO: 1354500 - RNA, 17 nt, Mycobacterium tuberculosis H37Rv
aggccgcuugccccgcc

SEQ ID NO: 1354501 - RNA, 22 nt, Mycobacterium tuberculosis H37Rv
aggccgcuugccccgccuuggc

SEQ ID NO: 1354502 - RNA, 15 nt, Mycobacterium tuberculosis H37Rv
aggccgcugccaggg

SEQ ID NO: 1354503 - RNA, 23 nt, Mycobacterium tuberculosis H37Rv
aggccgcggugaugggccaggcg

SEQ ID NO: 1354504 - RNA, 19 nt, Mycobacterium tuberculosis H37Rv
aggccgcgcggacccagca

SEQ ID NO: 1354505 - RNA, 22 nt, Mycobacterium tuberculosis H37Rv
aggccgcggcacccggcuugag

SEQ ID NO: 1354506 - RNA, 14 nt, Mycobacterium tuberculosis H37Rv
aggccgcugccagc

SEQ ID NO: 1354507 - RNA, 14 nt, Mycobacterium tuberculosis H37Rv
aggccuaccaggcg

SEQ ID NO: 1354508 - RNA, 17 nt, Mycobacterium tuberculosis H37Rv
aggccuaguccggcacu

SEQ ID NO: 1354509 - RNA, 19 nt, Mycobacterium tuberculosis H37Rv
aggccugacugaauuuggu

SEQ ID NO: 1354510 - RNA, 13 nt, Mycobacterium tuberculosis H37Rv
aggccuccaaaau

SEQ ID NO: 1354511 - RNA, 15 nt, Mycobacterium tuberculosis H37Rv
aggccgguucccuug

SEQ ID NO: 1354512 - RNA, 23 nt, Mycobacterium tuberculosis H37Rv
aggccgguucccuuguucccgaa

SEQ ID NO: 1354513 - RNA, 16 nt, Mycobacterium tuberculosis H37Rv
aggccgucggcgucga

SEQ ID NO: 1354514 - RNA, 22 nt, Mycobacterium tuberculosis H37Rv
aggccgucguugccggcgacca

SEQ ID NO: 1354515 - RNA, 18 nt, Mycobacterium tuberculosis H37Rv
aggccgggcgcaagcagc

SEQ ID NO: 1354516 - RNA, 17 nt, Mycobacterium tuberculosis H37Rv
aggccggcuaccgcgcu

SEQ ID NO: 1354517 - RNA, 21 nt, Mycobacterium tuberculosis H37Rv
aggccggguggccacgcccag

SEQ ID NO: 1354518 - RNA, 20 nt, Mycobacterium tuberculosis H37Rv
aggccgggcgcaagcagccc

SEQ ID NO: 1354519 - RNA, 16 nt, Mycobacterium tuberculosis H37Rv
aggcgauccagacggu

SEQ ID NO: 1354520 - RNA, 18 nt, Mycobacterium tuberculosis H37Rv
aggcgaugcgccaggcug

SEQ ID NO: 1354521 - RNA, 20 nt, Mycobacterium tuberculosis H37Rv
aggcgaugcgccaggcugaa

SEQ ID NO: 1354522 - RNA, 14 nt, Mycobacterium tuberculosis H37Rv
aggcgcaccaggcg

SEQ ID NO: 1354523 - RNA, 14 nt, Mycobacterium tuberculosis H37Rv
aggcgcagcugggu

SEQ ID NO: 1354524 - RNA, 22 nt, Mycobacterium tuberculosis H37Rv
aggcgcagauuccucuucaggc

SEQ ID NO: 1354525 - RNA, 19 nt, Mycobacterium tuberculosis H37Rv
aggcgcauagggccaccgc

SEQ ID NO: 1354526 - RNA, 14 nt, Mycobacterium tuberculosis H37Rv
aggcgccgcagggc

SEQ ID NO: 1354527 - RNA, 15 nt, Mycobacterium tuberculosis H37Rv
aggcgaacagggcug

SEQ ID NO: 1354528 - RNA, 14 nt, Mycobacterium tuberculosis H37Rv
aggcgaaagauggc

SEQ ID NO: 1354529 - RNA, 18 nt, Mycobacterium tuberculosis H37Rv
aggcgaaagauggccuca

SEQ ID NO: 1354530 - RNA, 20 nt, Mycobacterium tuberculosis H37Rv
aggcgaaaauugcuccacca

SEQ ID NO: 1354531 - RNA, 14 nt, Mycobacterium tuberculosis H37Rv
aggcgaagcgguga

SEQ ID NO: 1354532 - RNA, 15 nt, Mycobacterium tuberculosis H37Rv
aggcgagccgccacc

SEQ ID NO: 1354533 - RNA, 15 nt, Mycobacterium tuberculosis H37Rv
aggcgacgguuccca

SEQ ID NO: 1354534 - RNA, 13 nt, Mycobacterium tuberculosis H37Rv
agggcacaucggg

SEQ ID NO: 1354535 - RNA, 12 nt, Mycobacterium tuberculosis H37Rv
agggcaacagug

SEQ ID NO: 1354536 - RNA, 19 nt, Mycobacterium tuberculosis H37Rv
agggcagccgcccacccgg

SEQ ID NO: 1354537 - RNA, 20 nt, Mycobacterium tuberculosis H37Rv
agggcagcgccaggccguug

SEQ ID NO: 1354538 - RNA, 16 nt, Mycobacterium tuberculosis H37Rv
agggcagcagcccggg

SEQ ID NO: 1354539 - RNA, 16 nt, Mycobacterium tuberculosis H37Rv
agggcauacagcaugu

SEQ ID NO: 1354540 - RNA, 13 nt, Mycobacterium tuberculosis H37Rv
agggcaucgagac

SEQ ID NO: 1354541 - RNA, 21 nt, Mycobacterium tuberculosis H37Rv
agggccauaaaugcgcguucg

SEQ ID NO: 1354542 - RNA, 16 nt, Mycobacterium tuberculosis H37Rv
agggccaggacaacca

SEQ ID NO: 1354543 - RNA, 16 nt, Mycobacterium tuberculosis H37Rv
agggcccuggcggccc

SEQ ID NO: 1354544 - RNA, 18 nt, Mycobacterium tuberculosis H37Rv
agggccgccgaagcucau

SEQ ID NO: 1354545 - RNA, 14 nt, Mycobacterium tuberculosis H37Rv
agggccacggcugc

SEQ ID NO: 1354546 - RNA, 22 nt, Mycobacterium tuberculosis H37Rv
agggccagcggcagccuggccu

SEQ ID NO: 1354547 - RNA, 20 nt, Mycobacterium tuberculosis H37Rv
agggccagcgccucggcauc

SEQ ID NO: 1354548 - RNA, 17 nt, Mycobacterium tuberculosis H37Rv
agggccggugacucaga

SEQ ID NO: 1354549 - RNA, 11 nt, Mycobacterium tuberculosis H37Rv
agggccguucc

SEQ ID NO: 1354550 - RNA, 19 nt, Mycobacterium tuberculosis H37Rv
agggccgccgcugccgccu

SEQ ID NO: 1354551 - RNA, 11 nt, Mycobacterium tuberculosis H37Rv
agggccgccgc

SEQ ID NO: 1354552 - RNA, 15 nt, Mycobacterium tuberculosis H37Rv
agggccgccgcuggu

SEQ ID NO: 1354553 - RNA, 20 nt, Mycobacterium tuberculosis H37Rv
agggccgcgaucgacggugu

SEQ ID NO: 1354554 - RNA, 17 nt, Mycobacterium tuberculosis H37Rv
agggccggcgguggggg

SEQ ID NO: 1354555 - RNA, 15 nt, Mycobacterium tuberculosis H37Rv
agggccuuggcggga

SEQ ID NO: 1354556 - RNA, 21 nt, Mycobacterium tuberculosis H37Rv
agggcgauuuccaucgcgacc

SEQ ID NO: 1354557 - RNA, 16 nt, Mycobacterium tuberculosis H37Rv
agggcgcccgccccgc

SEQ ID NO: 1354558 - RNA, 13 nt, Mycobacterium tuberculosis H37Rv
agggcgccgaucg

SEQ ID NO: 1354559 - RNA, 15 nt, Mycobacterium tuberculosis H37Rv
agggcggcagcgagg

SEQ ID NO: 1354560 - RNA, 20 nt, Mycobacterium tuberculosis H37Rv
agggcggcagcgaggcucgc

SEQ ID NO: 1354561 - RNA, 13 nt, Mycobacterium tuberculosis H37Rv
agggcggcgaggu

SEQ ID NO: 1354562 - RNA, 19 nt, Mycobacterium tuberculosis H37Rv
aggggguggugucgcggcc

SEQ ID NO: 1354563 - RNA, 19 nt, Mycobacterium tuberculosis H37Rv
aggggcuuuugcgucugcu

SEQ ID NO: 1354564 - RNA, 21 nt, Mycobacterium tuberculosis H37Rv
aggggcuuuugcgucugcucg

SEQ ID NO: 1354565 - RNA, 19 nt, Mycobacterium tuberculosis H37Rv
aggggcgccuuugccccgu

SEQ ID NO: 1354566 - RNA, 15 nt, Mycobacterium tuberculosis H37Rv
agggcgguggccacc

SEQ ID NO: 1354567 - RNA, 17 nt, Mycobacterium tuberculosis H37Rv
agggcucggcggcccgg

SEQ ID NO: 1354568 - RNA, 19 nt, Mycobacterium tuberculosis H37Rv
agggcucggcggcccggcc

SEQ ID NO: 1354569 - RNA, 16 nt, Mycobacterium tuberculosis H37Rv
agggcuccucgugcac

SEQ ID NO: 1354570 - RNA, 20 nt, Mycobacterium tuberculosis H37Rv
agggcuaccggcgccgcgcg

SEQ ID NO: 1354571 - RNA, 20 nt, Mycobacterium tuberculosis H37Rv
aggggaucaccggcugcuga

SEQ ID NO: 1354572 - RNA, 20 nt, Mycobacterium tuberculosis H37Rv
aggggacccagcggcggucu

SEQ ID NO: 1354573 - RNA, 14 nt, Mycobacterium tuberculosis H37Rv
aggggacgggcggc

SEQ ID NO: 1354574 - RNA, 18 nt, Mycobacterium tuberculosis H37Rv
aggggaucugaguggacg

SEQ ID NO: 1354575 - RNA, 17 nt, Mycobacterium tuberculosis H37Rv
aggggcagcgcggccac

SEQ ID NO: 1354576 - RNA, 19 nt, Mycobacterium tuberculosis H37Rv
aggggcaauugccugcgcu

SEQ ID NO: 1354577 - RNA, 17 nt, Mycobacterium tuberculosis H37Rv
agggcuugucgccggca

SEQ ID NO: 1354578 - RNA, 13 nt, Mycobacterium tuberculosis H37Rv
agggcugcuccug

SEQ ID NO: 1354579 - RNA, 14 nt, Mycobacterium tuberculosis H37Rv
aggcugguccgggu

SEQ ID NO: 1354580 - RNA, 16 nt, Mycobacterium tuberculosis H37Rv
aggcuggucugcaggc

SEQ ID NO: 1354581 - RNA, 17 nt, Mycobacterium tuberculosis H37Rv
aggcugguuucggccgc

SEQ ID NO: 1354582 - RNA, 16 nt, Mycobacterium tuberculosis H37Rv
aggcuggcgagggcug

SEQ ID NO: 1354583 - RNA, 21 nt, Mycobacterium tuberculosis H37Rv
aggcuguggccagcaucauca

SEQ ID NO: 1354584 - RNA, 19 nt, Mycobacterium tuberculosis H37Rv
aggcugucgcgggccacca

SEQ ID NO: 1354585 - RNA, 14 nt, Mycobacterium tuberculosis H37Rv
aggcuguaacaccc

SEQ ID NO: 1354586 - RNA, 16 nt, Mycobacterium tuberculosis H37Rv
aggcugucgagucggu

SEQ ID NO: 1354587 - RNA, 19 nt, Mycobacterium tuberculosis H37Rv
aggcuguccagcagcgaaa

SEQ ID NO: 1354588 - RNA, 11 nt, Mycobacterium tuberculosis H37Rv
aggcuguccag

SEQ ID NO: 1354589 - RNA, 22 nt, Mycobacterium tuberculosis H37Rv
aggcugcagugccgcacccaga

SEQ ID NO: 1354590 - RNA, 14 nt, Mycobacterium tuberculosis H37Rv
aggcugugccggcc

SEQ ID NO: 1354591 - RNA, 23 nt, Mycobacterium tuberculosis H37Rv
aggcuuccagccacagcccggcg

SEQ ID NO: 1354592 - RNA, 21 nt, Mycobacterium tuberculosis H37Rv
aggcuuccagccacagcccgg

SEQ ID NO: 1354593 - RNA, 17 nt, Mycobacterium tuberculosis H37Rv
aggcuuccagccacagc

SEQ ID NO: 1354594 - RNA, 17 nt, Mycobacterium tuberculosis H37Rv
aggcuuccggcgcgacc

SEQ ID NO: 1354595 - RNA, 22 nt, Mycobacterium tuberculosis H37Rv
aggcuucggugacccgggcggc

SEQ ID NO: 1354596 - RNA, 22 nt, Mycobacterium tuberculosis H37Rv
aggcuuucgauauagccgccgg

SEQ ID NO: 1354597 - RNA, 11 nt, Mycobacterium tuberculosis H37Rv
aggcuucccug

SEQ ID NO: 1354598 - RNA, 18 nt, Mycobacterium tuberculosis H37Rv
aggcuugacugcacacca

SEQ ID NO: 1354599 - RNA, 14 nt, Mycobacterium tuberculosis H37Rv
aggcuugcggcacc

SEQ ID NO: 1354600 - RNA, 20 nt, Mycobacterium tuberculosis H37Rv
agggaucacgccaccauccc

SEQ ID NO: 1354601 - RNA, 16 nt, Mycobacterium tuberculosis H37Rv
agggagugccgcacga

SEQ ID NO: 1354602 - RNA, 15 nt, Mycobacterium tuberculosis H37Rv
agggagcgcagcgcc

SEQ ID NO: 1354603 - RNA, 22 nt, Mycobacterium tuberculosis H37Rv
agggaggccccccggggccgca

SEQ ID NO: 1354604 - RNA, 14 nt, Mycobacterium tuberculosis H37Rv
agggaggggccguc

SEQ ID NO: 1354605 - RNA, 20 nt, Mycobacterium tuberculosis H37Rv
agggaucuagaggcggcccc

SEQ ID NO: 1354606 - RNA, 15 nt, Mycobacterium tuberculosis H37Rv
agggaugaucaccgg

SEQ ID NO: 1354607 - RNA, 16 nt, Mycobacterium tuberculosis H37Rv
agggaagccugcgggc

SEQ ID NO: 1354608 - RNA, 22 nt, Mycobacterium tuberculosis H37Rv
agcguggugauccggucuccgc

SEQ ID NO: 1354609 - RNA, 13 nt, Mycobacterium tuberculosis H37Rv
agcguucccacac

SEQ ID NO: 1354610 - RNA, 15 nt, Mycobacterium tuberculosis H37Rv
agcucaauuccaugc

SEQ ID NO: 1354611 - RNA, 14 nt, Mycobacterium tuberculosis H37Rv
agcucaccacccgc

SEQ ID NO: 1354612 - RNA, 13 nt, Mycobacterium tuberculosis H37Rv
agcucaccgcaca

SEQ ID NO: 1354613 - RNA, 11 nt, Mycobacterium tuberculosis H37Rv
agcucacccug

SEQ ID NO: 1354614 - RNA, 15 nt, Mycobacterium tuberculosis H37Rv
agcucaaccaccucg

SEQ ID NO: 1354615 - RNA, 21 nt, Mycobacterium tuberculosis H37Rv
agcuaugucaccugggccagc

SEQ ID NO: 1354616 - RNA, 15 nt, Mycobacterium tuberculosis H37Rv
agcgucgcggccacg

SEQ ID NO: 1354617 - RNA, 14 nt, Mycobacterium tuberculosis H37Rv
agcgucgggcacau

SEQ ID NO: 1354618 - RNA, 23 nt, Mycobacterium tuberculosis H37Rv
agcgucgggcacaucgcacgguc

SEQ ID NO: 1354619 - RNA, 19 nt, Mycobacterium tuberculosis H37Rv
agcgucucgccgggaaaca

SEQ ID NO: 1354620 - RNA, 15 nt, Mycobacterium tuberculosis H37Rv
agcgucguugcucgg

SEQ ID NO: 1354621 - RNA, 21 nt, Mycobacterium tuberculosis H37Rv
agcguggguucgaaucccauc

SEQ ID NO: 1354622 - RNA, 17 nt, Mycobacterium tuberculosis H37Rv
agcguggggccgccacc

SEQ ID NO: 1354623 - RNA, 15 nt, Mycobacterium tuberculosis H37Rv
agcgugggcauuccc

SEQ ID NO: 1354624 - RNA, 16 nt, Mycobacterium tuberculosis H37Rv
agcgugcggggcgccu

SEQ ID NO: 1354625 - RNA, 14 nt, Mycobacterium tuberculosis H37Rv
agcgugccgcccgg

SEQ ID NO: 1354626 - RNA, 22 nt, Mycobacterium tuberculosis H37Rv
agcgugccgguggcgccgccgc

SEQ ID NO: 1354627 - RNA, 15 nt, Mycobacterium tuberculosis H37Rv
agcgugcggggcgcc

SEQ ID NO: 1354628 - RNA, 15 nt, Mycobacterium tuberculosis H37Rv
agcggugugggauga

SEQ ID NO: 1354629 - RNA, 14 nt, Mycobacterium tuberculosis H37Rv
agcgguccagccac

SEQ ID NO: 1354630 - RNA, 13 nt, Mycobacterium tuberculosis H37Rv
agcggucggcggu

SEQ ID NO: 1354631 - RNA, 13 nt, Mycobacterium tuberculosis H37Rv
agcggugacccac

SEQ ID NO: 1354632 - RNA, 17 nt, Mycobacterium tuberculosis H37Rv
agcggugaggugaccaa

SEQ ID NO: 1354633 - RNA, 18 nt, Mycobacterium tuberculosis H37Rv
agcggugcagcccgccgg

SEQ ID NO: 1354634 - RNA, 23 nt, Mycobacterium tuberculosis H37Rv
agcgguaucccccagccgcggcg

SEQ ID NO: 1354635 - RNA, 14 nt, Mycobacterium tuberculosis H37Rv
agcgguaaugccag

SEQ ID NO: 1354636 - RNA, 22 nt, Mycobacterium tuberculosis H37Rv
agcggggauguccgcggccacc

SEQ ID NO: 1354637 - RNA, 17 nt, Mycobacterium tuberculosis H37Rv
agcgggccagcacccgc

SEQ ID NO: 1354638 - RNA, 21 nt, Mycobacterium tuberculosis H37Rv
agcggcgccgcccuaaggggc

SEQ ID NO: 1354639 - RNA, 14 nt, Mycobacterium tuberculosis H37Rv
agcggcgccgcccu

SEQ ID NO: 1354640 - RNA, 15 nt, Mycobacterium tuberculosis H37Rv
agcggcgccgccugg

SEQ ID NO: 1354641 - RNA, 13 nt, Mycobacterium tuberculosis H37Rv
agcggcggccacg

SEQ ID NO: 1354642 - RNA, 23 nt, Mycobacterium tuberculosis H37Rv
agcggcgggggcgucgccgccgg

SEQ ID NO: 1354643 - RNA, 15 nt, Mycobacterium tuberculosis H37Rv
agcggcgggcgauga

SEQ ID NO: 1354644 - RNA, 22 nt, Mycobacterium tuberculosis H37Rv
agcggcuccacuuggggcgcca

SEQ ID NO: 1354645 - RNA, 19 nt, Mycobacterium tuberculosis H37Rv
agcggcuccgaaggccgcc

SEQ ID NO: 1354646 - RNA, 21 nt, Mycobacterium tuberculosis H37Rv
agcggcucgcgcgggaagucc

SEQ ID NO: 1354647 - RNA, 22 nt, Mycobacterium tuberculosis H37Rv
agcggcucggcgggggaccccg

SEQ ID NO: 1354648 - RNA, 19 nt, Mycobacterium tuberculosis H37Rv
agcggcuugcgguggcgga

SEQ ID NO: 1354649 - RNA, 21 nt, Mycobacterium tuberculosis H37Rv
agcggcugcggcaacgagguc

SEQ ID NO: 1354650 - RNA, 18 nt, Mycobacterium tuberculosis H37Rv
agcgggaaggcucaccac

SEQ ID NO: 1354651 - RNA, 22 nt, Mycobacterium tuberculosis H37Rv
agcggccauccggcggcggcca

SEQ ID NO: 1354652 - RNA, 13 nt, Mycobacterium tuberculosis H37Rv
agcggccagcagu

SEQ ID NO: 1354653 - RNA, 13 nt, Mycobacterium tuberculosis H37Rv
agcggccaccgcc

SEQ ID NO: 1354654 - RNA, 21 nt, Mycobacterium tuberculosis H37Rv
agcggcccuaucuggcggccg

SEQ ID NO: 1354655 - RNA, 20 nt, Mycobacterium tuberculosis H37Rv
agcggccgggcggccaggcg

SEQ ID NO: 1354656 - RNA, 20 nt, Mycobacterium tuberculosis H37Rv
agcggcgcagcgugagugca

SEQ ID NO: 1354657 - RNA, 23 nt, Mycobacterium tuberculosis H37Rv
agcggcgccacguggucgagcag

SEQ ID NO: 1354658 - RNA, 15 nt, Mycobacterium tuberculosis H37Rv
agcggccuccagcac

SEQ ID NO: 1354659 - RNA, 23 nt, Mycobacterium tuberculosis H37Rv
agcggccuaacgaguaggcggcu

SEQ ID NO: 1354660 - RNA, 14 nt, Mycobacterium tuberculosis H37Rv
agcggccucgggac

SEQ ID NO: 1354661 - RNA, 24 nt, Mycobacterium tuberculosis H37Rv
agcggccugcucgggggccgacca

SEQ ID NO: 1354662 - RNA, 19 nt, Mycobacterium tuberculosis H37Rv
agcggcccgcugcgcggcc

SEQ ID NO: 1354663 - RNA, 20 nt, Mycobacterium tuberculosis H37Rv
agcggagacgaucgccaggc

SEQ ID NO: 1354664 - RNA, 21 nt, Mycobacterium tuberculosis H37Rv
agcggacucgagucugcgcag

SEQ ID NO: 1354665 - RNA, 12 nt, Mycobacterium tuberculosis H37Rv
agcggaccgcug

SEQ ID NO: 1354666 - RNA, 17 nt, Mycobacterium tuberculosis H37Rv
agcggcauugccagccg

SEQ ID NO: 1354667 - RNA, 21 nt, Mycobacterium tuberculosis H37Rv
agcggagccacucggcccggc

SEQ ID NO: 1354668 - RNA, 21 nt, Mycobacterium tuberculosis H37Rv
agcggcaucgcgggcggcgcu

SEQ ID NO: 1354669 - RNA, 16 nt, Mycobacterium tuberculosis H37Rv
agcggcaucggccagc

SEQ ID NO: 1354670 - RNA, 15 nt, Mycobacterium tuberculosis H37Rv
agcggaagcgguuga

SEQ ID NO: 1354671 - RNA, 22 nt, Mycobacterium tuberculosis H37Rv
agcggaaaacccagaucggcga

SEQ ID NO: 1354672 - RNA, 20 nt, Mycobacterium tuberculosis H37Rv
agcgcgcaacguacgcacgc

SEQ ID NO: 1354673 - RNA, 16 nt, Mycobacterium tuberculosis H37Rv
agcgcgaugcagugcg

SEQ ID NO: 1354674 - RNA, 14 nt, Mycobacterium tuberculosis H37Rv
agcgcgaugaccuc

SEQ ID NO: 1354675 - RNA, 19 nt, Mycobacterium tuberculosis H37Rv
agcgcgaucgauuccgcuc

SEQ ID NO: 1354676 - RNA, 12 nt, Mycobacterium tuberculosis H37Rv
agcgcgaucacc

SEQ ID NO: 1354677 - RNA, 16 nt, Mycobacterium tuberculosis H37Rv
agcgcgagcccgaacc

SEQ ID NO: 1354678 - RNA, 12 nt, Mycobacterium tuberculosis H37Rv
agcgcgccacga

SEQ ID NO: 1354679 - RNA, 18 nt, Mycobacterium tuberculosis H37Rv
agcgcgcauagggcuggu

SEQ ID NO: 1354680 - RNA, 22 nt, Mycobacterium tuberculosis H37Rv
agcgcgcccgacacccguaagc

SEQ ID NO: 1354681 - RNA, 17 nt, Mycobacterium tuberculosis H37Rv
agcgcgcgcgugaagaa

SEQ ID NO: 1354682 - RNA, 20 nt, Mycobacterium tuberculosis H37Rv
agcgcgcgcgggugcaaccg

SEQ ID NO: 1354683 - RNA, 16 nt, Mycobacterium tuberculosis H37Rv
agcgcgcggagucaag

SEQ ID NO: 1354684 - RNA, 17 nt, Mycobacterium tuberculosis H37Rv
agcgcgcguagcggggg

SEQ ID NO: 1354685 - RNA, 18 nt, Mycobacterium tuberculosis H37Rv
agcgcgcguagcggggga

SEQ ID NO: 1354686 - RNA, 16 nt, Mycobacterium tuberculosis H37Rv
agcgcgcuacgcggcc

SEQ ID NO: 1354687 - RNA, 14 nt, Mycobacterium tuberculosis H37Rv
agcgcgcucagguc

SEQ ID NO: 1354688 - RNA, 18 nt, Mycobacterium tuberculosis H37Rv
agcgcgcuggccagcccg

SEQ ID NO: 1354689 - RNA, 20 nt, Mycobacterium tuberculosis H37Rv
agcgcgccucgcccagcaag

SEQ ID NO: 1354690 - RNA, 14 nt, Mycobacterium tuberculosis H37Rv
agcgcgccggccau

SEQ ID NO: 1354691 - RNA, 19 nt, Mycobacterium tuberculosis H37Rv
agcgcgccgaaggcggcca

SEQ ID NO: 1354692 - RNA, 16 nt, Mycobacterium tuberculosis H37Rv
agcgcucgugaccgaa

SEQ ID NO: 1354693 - RNA, 16 nt, Mycobacterium tuberculosis H37Rv
agcgcuggcuacgccu

SEQ ID NO: 1354694 - RNA, 15 nt, Mycobacterium tuberculosis H37Rv
agcgcugggcccagg

SEQ ID NO: 1354695 - RNA, 13 nt, Mycobacterium tuberculosis H37Rv
agcgcugcucccg

SEQ ID NO: 1354696 - RNA, 18 nt, Mycobacterium tuberculosis H37Rv
agcgcuggcaggccgggc

SEQ ID NO: 1354697 - RNA, 22 nt, Mycobacterium tuberculosis H37Rv
agcgcggccacgccgaucaaca

SEQ ID NO: 1354698 - RNA, 22 nt, Mycobacterium tuberculosis H37Rv
agcgcgcuggcuacccaccggc

SEQ ID NO: 1354699 - RNA, 14 nt, Mycobacterium tuberculosis H37Rv
agcgcggcaaccgu

SEQ ID NO: 1354700 - RNA, 16 nt, Mycobacterium tuberculosis H37Rv
agcgcggccagcagca

SEQ ID NO: 1354701 - RNA, 19 nt, Mycobacterium tuberculosis H37Rv
agcgcggccagcagcagau

SEQ ID NO: 1354702 - RNA, 15 nt, Mycobacterium tuberculosis H37Rv
agcgcggccagcagc

SEQ ID NO: 1354703 - RNA, 12 nt, Mycobacterium tuberculosis H37Rv
agcgcggccacc

SEQ ID NO: 1354704 - RNA, 14 nt, Mycobacterium tuberculosis H37Rv
agcgcggccacccg

SEQ ID NO: 1354705 - RNA, 19 nt, Mycobacterium tuberculosis H37Rv
agcucagugaugcgccccg

SEQ ID NO: 1354706 - RNA, 17 nt, Mycobacterium tuberculosis H37Rv
agcucacgcugaagccg

SEQ ID NO: 1354707 - RNA, 16 nt, Mycobacterium tuberculosis H37Rv
agcucacgugcugccg

SEQ ID NO: 1354708 - RNA, 14 nt, Mycobacterium tuberculosis H37Rv
agcucucgcggcgu

SEQ ID NO: 1354709 - RNA, 22 nt, Mycobacterium tuberculosis H37Rv
agcucucgcggcguucgccggu

SEQ ID NO: 1354710 - RNA, 21 nt, Mycobacterium tuberculosis H37Rv
agcucguugcuggcggccagc

SEQ ID NO: 1354711 - RNA, 13 nt, Mycobacterium tuberculosis H37Rv
agcucaucgccgc

SEQ ID NO: 1354712 - RNA, 14 nt, Mycobacterium tuberculosis H37Rv
agcucaucgccgcu

SEQ ID NO: 1354713 - RNA, 16 nt, Mycobacterium tuberculosis H37Rv
agcugcccgacguugu

SEQ ID NO: 1354714 - RNA, 22 nt, Mycobacterium tuberculosis H37Rv
agcugcccgccagcgccgccgc

SEQ ID NO: 1354715 - RNA, 20 nt, Mycobacterium tuberculosis H37Rv
agcugccccgccaccucgcc

SEQ ID NO: 1354716 - RNA, 23 nt, Mycobacterium tuberculosis H37Rv
agcugccgaucaauggcaacgaa

SEQ ID NO: 1354717 - RNA, 23 nt, Mycobacterium tuberculosis H37Rv
agcugaacacgaauccggccacu

SEQ ID NO: 1354718 - RNA, 20 nt, Mycobacterium tuberculosis H37Rv
agcucugcgucgugcccgua

SEQ ID NO: 1354719 - RNA, 14 nt, Mycobacterium tuberculosis H37Rv
agcuggggcccggc

SEQ ID NO: 1354720 - RNA, 12 nt, Mycobacterium tuberculosis H37Rv
agcugggucccg

SEQ ID NO: 1354721 - RNA, 17 nt, Mycobacterium tuberculosis H37Rv
agcugguagcgcaccac

SEQ ID NO: 1354722 - RNA, 13 nt, Mycobacterium tuberculosis H37Rv
agcugggcagcca

SEQ ID NO: 1354723 - RNA, 17 nt, Mycobacterium tuberculosis H37Rv
agcuggcguucccgcuc

SEQ ID NO: 1354724 - RNA, 14 nt, Mycobacterium tuberculosis H37Rv
agcuggacggccuc

SEQ ID NO: 1354725 - RNA, 15 nt, Mycobacterium tuberculosis H37Rv
agcuggacggccucc

SEQ ID NO: 1354726 - RNA, 16 nt, Mycobacterium tuberculosis H37Rv
agcuggaacggcagca

SEQ ID NO: 1354727 - RNA, 16 nt, Mycobacterium tuberculosis H37Rv
agcugcuuggcggucu

SEQ ID NO: 1354728 - RNA, 23 nt, Mycobacterium tuberculosis H37Rv
agcugcgcagcgcaaacaucuug

SEQ ID NO: 1354729 - RNA, 16 nt, Mycobacterium tuberculosis H37Rv
agcugccugaccggcg

SEQ ID NO: 1354730 - RNA, 17 nt, Mycobacterium tuberculosis H37Rv
agcugccggcccaccag

SEQ ID NO: 1354731 - RNA, 22 nt, Mycobacterium tuberculosis H37Rv
agcugcgcaucgccaccaucac

SEQ ID NO: 1354732 - RNA, 14 nt, Mycobacterium tuberculosis H37Rv
agcugcgcgggcga

SEQ ID NO: 1354733 - RNA, 16 nt, Mycobacterium tuberculosis H37Rv
agcugcuggcgcgccu

SEQ ID NO: 1354734 - RNA, 19 nt, Mycobacterium tuberculosis H37Rv
agcugguccuccaaggcgg

SEQ ID NO: 1354735 - RNA, 15 nt, Mycobacterium tuberculosis H37Rv
agcugguugugcugg

SEQ ID NO: 1354736 - RNA, 22 nt, Mycobacterium tuberculosis H37Rv
agcuguaggcgaccagauagaa

SEQ ID NO: 1354737 - RNA, 12 nt, Mycobacterium tuberculosis H37Rv
agcugugguggu

SEQ ID NO: 1354738 - RNA, 17 nt, Mycobacterium tuberculosis H37Rv
agcugucgccuuugagg

SEQ ID NO: 1354739 - RNA, 21 nt, Mycobacterium tuberculosis H37Rv
agcuugagcgugagcgccgcg

SEQ ID NO: 1354740 - RNA, 15 nt, Mycobacterium tuberculosis H37Rv
agcuugacaacccug

SEQ ID NO: 1354741 - RNA, 17 nt, Mycobacterium tuberculosis H37Rv
agcuugaccgaccacgc

SEQ ID NO: 1354742 - RNA, 23 nt, Mycobacterium tuberculosis H37Rv
agcuuccgcgacgcucgcugcag

SEQ ID NO: 1354743 - RNA, 15 nt, Mycobacterium tuberculosis H37Rv
agcuucgcgcagccg

SEQ ID NO: 1354744 - RNA, 17 nt, Mycobacterium tuberculosis H37Rv
agcuuggucgccgggca

SEQ ID NO: 1354745 - RNA, 23 nt, Mycobacterium tuberculosis H37Rv
agcuuggcggccagcguguccca

SEQ ID NO: 1354746 - RNA, 18 nt, Mycobacterium tuberculosis H37Rv
agcuuggccucagccacc

SEQ ID NO: 1354747 - RNA, 20 nt, Mycobacterium tuberculosis H37Rv
agcuuggagaucgccgccgg

SEQ ID NO: 1354748 - RNA, 22 nt, Mycobacterium tuberculosis H37Rv
agcuuggagaggcggugcagcu

SEQ ID NO: 1354749 - RNA, 14 nt, Mycobacterium tuberculosis H37Rv
agcuuggccgccgc

SEQ ID NO: 1354750 - RNA, 19 nt, Mycobacterium tuberculosis H37Rv
agcuugcggccgaauuccu

SEQ ID NO: 1354751 - RNA, 18 nt, Mycobacterium tuberculosis H37Rv
agcuugaucccauccaga

SEQ ID NO: 1354752 - RNA, 16 nt, Mycobacterium tuberculosis H37Rv
agcuugaucgccgagg

SEQ ID NO: 1354753 - RNA, 16 nt, Mycobacterium tuberculosis H37Rv
agcuuuaucugcaugc

SEQ ID NO: 1354754 - RNA, 13 nt, Mycobacterium tuberculosis H37Rv
agcuuguuuucca

SEQ ID NO: 1354755 - RNA, 18 nt, Mycobacterium tuberculosis H37Rv
aggaucgcgccuauccaa

SEQ ID NO: 1354756 - RNA, 15 nt, Mycobacterium tuberculosis H37Rv
aggaucgcugguugg

SEQ ID NO: 1354757 - RNA, 13 nt, Mycobacterium tuberculosis H37Rv
aggaucggggcgc

SEQ ID NO: 1354758 - RNA, 22 nt, Mycobacterium tuberculosis H37Rv
aggaugcugagcgccaggccgc

SEQ ID NO: 1354759 - RNA, 13 nt, Mycobacterium tuberculosis H37Rv
aggaugcggcccc

SEQ ID NO: 1354760 - RNA, 20 nt, Mycobacterium tuberculosis H37Rv
aggaugugguuggugcuggc

SEQ ID NO: 1354761 - RNA, 22 nt, Mycobacterium tuberculosis H37Rv
aggauuuucucggggugguggu

SEQ ID NO: 1354762 - RNA, 23 nt, Mycobacterium tuberculosis H37Rv
aggauucccucgacagugcugcc

SEQ ID NO: 1354763 - RNA, 16 nt, Mycobacterium tuberculosis H37Rv
aggauucggcggucgc

SEQ ID NO: 1354764 - RNA, 19 nt, Mycobacterium tuberculosis H37Rv
aggcaccgaaaaacaccag

SEQ ID NO: 1354765 - RNA, 21 nt, Mycobacterium tuberculosis H37Rv
aggcaccgaaaaacaccagcg

SEQ ID NO: 1354766 - RNA, 13 nt, Mycobacterium tuberculosis H37Rv
aggcaccgacauc

SEQ ID NO: 1354767 - RNA, 21 nt, Mycobacterium tuberculosis H37Rv
aggcaccggaugauguggugu

SEQ ID NO: 1354768 - RNA, 20 nt, Mycobacterium tuberculosis H37Rv
aggcacaacaucgccgcagu

SEQ ID NO: 1354769 - RNA, 19 nt, Mycobacterium tuberculosis H37Rv
aggcaaggucaacccgcac

SEQ ID NO: 1354770 - RNA, 15 nt, Mycobacterium tuberculosis H37Rv
aggcaagcaaccggu

SEQ ID NO: 1354771 - RNA, 15 nt, Mycobacterium tuberculosis H37Rv
aggcaagccagcacu

SEQ ID NO: 1354772 - RNA, 23 nt, Mycobacterium tuberculosis H37Rv
aggcaacccagaaguagguuuuc

SEQ ID NO: 1354773 - RNA, 18 nt, Mycobacterium tuberculosis H37Rv
aggcaaagcgagcaccgc

SEQ ID NO: 1354774 - RNA, 21 nt, Mycobacterium tuberculosis H37Rv
aggccaugcucgccaaaccca

SEQ ID NO: 1354775 - RNA, 12 nt, Mycobacterium tuberculosis H37Rv
aggcccacggca

SEQ ID NO: 1354776 - RNA, 19 nt, Mycobacterium tuberculosis H37Rv
aggcccacggcgaccagga

SEQ ID NO: 1354777 - RNA, 17 nt, Mycobacterium tuberculosis H37Rv
aggccaccgcagacgcc

SEQ ID NO: 1354778 - RNA, 20 nt, Mycobacterium tuberculosis H37Rv
aggccacccgcgaagccgcc

SEQ ID NO: 1354779 - RNA, 18 nt, Mycobacterium tuberculosis H37Rv
aggccagagucgcccgca

SEQ ID NO: 1354780 - RNA, 18 nt, Mycobacterium tuberculosis H37Rv
aggccacguagcagcgcc

SEQ ID NO: 1354781 - RNA, 13 nt, Mycobacterium tuberculosis H37Rv
aggccagcgcuca

SEQ ID NO: 1354782 - RNA, 13 nt, Mycobacterium tuberculosis H37Rv
aggccagcccggc

SEQ ID NO: 1354783 - RNA, 14 nt, Mycobacterium tuberculosis H37Rv
aggccacggggcuu

SEQ ID NO: 1354784 - RNA, 13 nt, Mycobacterium tuberculosis H37Rv
aggcccgccagca

SEQ ID NO: 1354785 - RNA, 15 nt, Mycobacterium tuberculosis H37Rv
aggcccuggccaccc

SEQ ID NO: 1354786 - RNA, 16 nt, Mycobacterium tuberculosis H37Rv
aggcccugcggccacg

SEQ ID NO: 1354787 - RNA, 15 nt, Mycobacterium tuberculosis H37Rv
aggccgaaauccaga

SEQ ID NO: 1354788 - RNA, 20 nt, Mycobacterium tuberculosis H37Rv
aggccgaacagccgagccag

SEQ ID NO: 1354789 - RNA, 18 nt, Mycobacterium tuberculosis H37Rv
aggcccgguucgaggauc

SEQ ID NO: 1354790 - RNA, 22 nt, Mycobacterium tuberculosis H37Rv
aggcccgggcggccagcugcag

SEQ ID NO: 1354791 - RNA, 19 nt, Mycobacterium tuberculosis H37Rv
aggcccucgcgcgcgucga

SEQ ID NO: 1354792 - RNA, 18 nt, Mycobacterium tuberculosis H37Rv
aggcccucgggacugcgc

SEQ ID NO: 1354793 - RNA, 13 nt, Mycobacterium tuberculosis H37Rv
aggccgaccagca

SEQ ID NO: 1354794 - RNA, 13 nt, Mycobacterium tuberculosis H37Rv
aggccgaccugua

SEQ ID NO: 1354795 - RNA, 19 nt, Mycobacterium tuberculosis H37Rv
aggccgagcagauacuugu

SEQ ID NO: 1354796 - RNA, 18 nt, Mycobacterium tuberculosis H37Rv
aggccgacgucgaccacu

SEQ ID NO: 1354797 - RNA, 13 nt, Mycobacterium tuberculosis H37Rv
aggccgaggaagg

SEQ ID NO: 1354798 - RNA, 17 nt, Mycobacterium tuberculosis H37Rv
aggcauuagcacgcugu

SEQ ID NO: 1354799 - RNA, 22 nt, Mycobacterium tuberculosis H37Rv
aggcauuggugaguagauugcu

SEQ ID NO: 1354800 - RNA, 22 nt, Mycobacterium tuberculosis H37Rv
aggccaagccgcggcuaggcca

SEQ ID NO: 1354801 - RNA, 14 nt, Mycobacterium tuberculosis H37Rv
aggccaagccgcgg

SEQ ID NO: 1354802 - RNA, 15 nt, Mycobacterium tuberculosis H37Rv
aggccacagcccggc

SEQ ID NO: 1354803 - RNA, 13 nt, Mycobacterium tuberculosis H37Rv
aggccaacggcgc

SEQ ID NO: 1354804 - RNA, 15 nt, Mycobacterium tuberculosis H37Rv
aggccaacggcgcug

SEQ ID NO: 1354805 - RNA, 22 nt, Mycobacterium tuberculosis H37Rv
aggaccuucugucccugcaguc

SEQ ID NO: 1354806 - RNA, 15 nt, Mycobacterium tuberculosis H37Rv
aggacgaguccuagc

SEQ ID NO: 1354807 - RNA, 15 nt, Mycobacterium tuberculosis H37Rv
aggacggcagccacc

SEQ ID NO: 1354808 - RNA, 14 nt, Mycobacterium tuberculosis H37Rv
aggacggcggccag

SEQ ID NO: 1354809 - RNA, 16 nt, Mycobacterium tuberculosis H37Rv
aggacggcggccagga

SEQ ID NO: 1354810 - RNA, 20 nt, Mycobacterium tuberculosis H37Rv
aggacgcccacaugcucagg

SEQ ID NO: 1354811 - RNA, 21 nt, Mycobacterium tuberculosis H37Rv
aggacgcgggcuaucgguuca

SEQ ID NO: 1354812 - RNA, 12 nt, Mycobacterium tuberculosis H37Rv
aggacgguucau

SEQ ID NO: 1354813 - RNA, 13 nt, Mycobacterium tuberculosis H37Rv
aggacggcugccg

SEQ ID NO: 1354814 - RNA, 16 nt, Mycobacterium tuberculosis H37Rv
aggacguggcgcugga

SEQ ID NO: 1354815 - RNA, 17 nt, Mycobacterium tuberculosis H37Rv
aggaccgcucugcggcc

SEQ ID NO: 1354816 - RNA, 16 nt, Mycobacterium tuberculosis H37Rv
aggaccgcucugcggc

SEQ ID NO: 1354817 - RNA, 21 nt, Mycobacterium tuberculosis H37Rv
aggaccgcgccgaucaccacc

SEQ ID NO: 1354818 - RNA, 14 nt, Mycobacterium tuberculosis H37Rv
aggaccagaggcgc

SEQ ID NO: 1354819 - RNA, 19 nt, Mycobacterium tuberculosis H37Rv
aggacguuucagccgggug

SEQ ID NO: 1354820 - RNA, 18 nt, Mycobacterium tuberculosis H37Rv
aggacuucggugagcagg

SEQ ID NO: 1354821 - RNA, 21 nt, Mycobacterium tuberculosis H37Rv
aggacuucggugagcagggcg

SEQ ID NO: 1354822 - RNA, 20 nt, Mycobacterium tuberculosis H37Rv
aggacuugcacgucggcugc

SEQ ID NO: 1354823 - RNA, 21 nt, Mycobacterium tuberculosis H37Rv
aggagaucaacauccugggca

SEQ ID NO: 1354824 - RNA, 15 nt, Mycobacterium tuberculosis H37Rv
aggagaccacggcgu

SEQ ID NO: 1354825 - RNA, 18 nt, Mycobacterium tuberculosis H37Rv
aggaucagcgcacuggcc

SEQ ID NO: 1354826 - RNA, 15 nt, Mycobacterium tuberculosis H37Rv
aggauccguggccaa

SEQ ID NO: 1354827 - RNA, 19 nt, Mycobacterium tuberculosis H37Rv
aggagcccguccaggcccg

SEQ ID NO: 1354828 - RNA, 12 nt, Mycobacterium tuberculosis H37Rv
aggagccgggcc

SEQ ID NO: 1354829 - RNA, 15 nt, Mycobacterium tuberculosis H37Rv
aggagcuuccgaccg

SEQ ID NO: 1354830 - RNA, 17 nt, Mycobacterium tuberculosis H37Rv
aggagguuguagucaga

SEQ ID NO: 1354831 - RNA, 19 nt, Mycobacterium tuberculosis H37Rv
aggaaagucaccguccacg

SEQ ID NO: 1354832 - RNA, 20 nt, Mycobacterium tuberculosis H37Rv
aggaaacgagcgaaggugaa

SEQ ID NO: 1354833 - RNA, 17 nt, Mycobacterium tuberculosis H37Rv
aggaacucggcccacac

SEQ ID NO: 1354834 - RNA, 20 nt, Mycobacterium tuberculosis H37Rv
aggaacucggcccacacggu

SEQ ID NO: 1354835 - RNA, 21 nt, Mycobacterium tuberculosis H37Rv
aggaacugaaacgcuuggccc

SEQ ID NO: 1354836 - RNA, 20 nt, Mycobacterium tuberculosis H37Rv
aggaacuacccgccagcaaa

SEQ ID NO: 1354837 - RNA, 23 nt, Mycobacterium tuberculosis H37Rv
aggaaccgggcaaaucaagcaca

SEQ ID NO: 1354838 - RNA, 18 nt, Mycobacterium tuberculosis H37Rv
aggaaccgggcaaaucaa

SEQ ID NO: 1354839 - RNA, 22 nt, Mycobacterium tuberculosis H37Rv
aggaaccacccaccggccacca

SEQ ID NO: 1354840 - RNA, 16 nt, Mycobacterium tuberculosis H37Rv
aggaacaggcaaagua

SEQ ID NO: 1354841 - RNA, 21 nt, Mycobacterium tuberculosis H37Rv
aggaauucgccauagcgggcg

SEQ ID NO: 1354842 - RNA, 22 nt, Mycobacterium tuberculosis H37Rv
aggaaucguucgggguggugga

SEQ ID NO: 1354843 - RNA, 22 nt, Mycobacterium tuberculosis H37Rv
aggaaggugugcgucuccagcu

SEQ ID NO: 1354844 - RNA, 14 nt, Mycobacterium tuberculosis H37Rv
aggaagcggccggu

SEQ ID NO: 1354845 - RNA, 21 nt, Mycobacterium tuberculosis H37Rv
aggaagccgaagaugcacagg

SEQ ID NO: 1354846 - RNA, 16 nt, Mycobacterium tuberculosis H37Rv
acggcccgccguccgg

SEQ ID NO: 1354847 - RNA, 13 nt, Mycobacterium tuberculosis H37Rv
acggccaucgugc

SEQ ID NO: 1354848 - RNA, 22 nt, Mycobacterium tuberculosis H37Rv
acggccaucgccagccugugcu

SEQ ID NO: 1354849 - RNA, 19 nt, Mycobacterium tuberculosis H37Rv
acggccaugaucacaccgc

SEQ ID NO: 1354850 - RNA, 19 nt, Mycobacterium tuberculosis H37Rv
acggccagugcgcagaaca

SEQ ID NO: 1354851 - RNA, 14 nt, Mycobacterium tuberculosis H37Rv
acggccgggacggc

SEQ ID NO: 1354852 - RNA, 23 nt, Mycobacterium tuberculosis H37Rv
acggccgacaacccggccgggcc

SEQ ID NO: 1354853 - RNA, 17 nt, Mycobacterium tuberculosis H37Rv
acggcgaugcagccaca

SEQ ID NO: 1354854 - RNA, 14 nt, Mycobacterium tuberculosis H37Rv
acggcgcugacgaa

SEQ ID NO: 1354855 - RNA, 17 nt, Mycobacterium tuberculosis H37Rv
acggcgcugccgggauc

SEQ ID NO: 1354856 - RNA, 22 nt, Mycobacterium tuberculosis H37Rv
acggcgagaaaaugacccacac

SEQ ID NO: 1354857 - RNA, 16 nt, Mycobacterium tuberculosis H37Rv
acggcgacucgaggac

SEQ ID NO: 1354858 - RNA, 20 nt, Mycobacterium tuberculosis H37Rv
acggcgagaaaaugacccac

SEQ ID NO: 1354859 - RNA, 16 nt, Mycobacterium tuberculosis H37Rv
acggcgacggcgccca

SEQ ID NO: 1354860 - RNA, 19 nt, Mycobacterium tuberculosis H37Rv
acggcgaccacgccgccgg

SEQ ID NO: 1354861 - RNA, 17 nt, Mycobacterium tuberculosis H37Rv
acggcgaccaggagccu

SEQ ID NO: 1354862 - RNA, 15 nt, Mycobacterium tuberculosis H37Rv
acggcgaccacgccg

SEQ ID NO: 1354863 - RNA, 20 nt, Mycobacterium tuberculosis H37Rv
acggcgaaaaucccgcuccc

SEQ ID NO: 1354864 - RNA, 16 nt, Mycobacterium tuberculosis H37Rv
acggcgaacuuggccg

SEQ ID NO: 1354865 - RNA, 14 nt, Mycobacterium tuberculosis H37Rv
acggaugaugccgg

SEQ ID NO: 1354866 - RNA, 17 nt, Mycobacterium tuberculosis H37Rv
acggaucaggcccgggc

SEQ ID NO: 1354867 - RNA, 20 nt, Mycobacterium tuberculosis H37Rv
acggcaagaaacagguaagc

SEQ ID NO: 1354868 - RNA, 16 nt, Mycobacterium tuberculosis H37Rv
acggcaagccauucac

SEQ ID NO: 1354869 - RNA, 22 nt, Mycobacterium tuberculosis H37Rv
acggcaagccaaccagcccggc

SEQ ID NO: 1354870 - RNA, 21 nt, Mycobacterium tuberculosis H37Rv
acggcaagccaaccagcccgg

SEQ ID NO: 1354871 - RNA, 20 nt, Mycobacterium tuberculosis H37Rv
acggccaagaucggcgcccc

SEQ ID NO: 1354872 - RNA, 12 nt, Mycobacterium tuberculosis H37Rv
acggccagcagg

SEQ ID NO: 1354873 - RNA, 16 nt, Mycobacterium tuberculosis H37Rv
acggccagcaggauga

SEQ ID NO: 1354874 - RNA, 15 nt, Mycobacterium tuberculosis H37Rv
acgcaacggcaccca

SEQ ID NO: 1354875 - RNA, 18 nt, Mycobacterium tuberculosis H37Rv
acgcacaauacggucagc

SEQ ID NO: 1354876 - RNA, 15 nt, Mycobacterium tuberculosis H37Rv
acgcacaagccucga

SEQ ID NO: 1354877 - RNA, 17 nt, Mycobacterium tuberculosis H37Rv
acgcugcucuggacggu

SEQ ID NO: 1354878 - RNA, 16 nt, Mycobacterium tuberculosis H37Rv
acgcuguccaggucug

SEQ ID NO: 1354879 - RNA, 17 nt, Mycobacterium tuberculosis H37Rv
acgcuguaagcaugccg

SEQ ID NO: 1354880 - RNA, 15 nt, Mycobacterium tuberculosis H37Rv
acgcuggucggcggc

SEQ ID NO: 1354881 - RNA, 21 nt, Mycobacterium tuberculosis H37Rv
acgcugggcgguagcuuccgc

SEQ ID NO: 1354882 - RNA, 14 nt, Mycobacterium tuberculosis H37Rv
acggaagaccgcgg

SEQ ID NO: 1354883 - RNA, 15 nt, Mycobacterium tuberculosis H37Rv
acggacccggcgcga

SEQ ID NO: 1354884 - RNA, 14 nt, Mycobacterium tuberculosis H37Rv
acggaccuccucgc

SEQ ID NO: 1354885 - RNA, 15 nt, Mycobacterium tuberculosis H37Rv
acggacgaagcaccu

SEQ ID NO: 1354886 - RNA, 20 nt, Mycobacterium tuberculosis H37Rv
acgggcucgcugcaccagcu

SEQ ID NO: 1354887 - RNA, 21 nt, Mycobacterium tuberculosis H37Rv
acgggcucgcugcaccagcug

SEQ ID NO: 1354888 - RNA, 22 nt, Mycobacterium tuberculosis H37Rv
acgggcugccccuccgggcgca

SEQ ID NO: 1354889 - RNA, 17 nt, Mycobacterium tuberculosis H37Rv
acgggcuuccgacauga

SEQ ID NO: 1354890 - RNA, 15 nt, Mycobacterium tuberculosis H37Rv
acgggguggcacgca

SEQ ID NO: 1354891 - RNA, 19 nt, Mycobacterium tuberculosis H37Rv
acggggcggucggccggcu

SEQ ID NO: 1354892 - RNA, 16 nt, Mycobacterium tuberculosis H37Rv
acggggccgccagcug

SEQ ID NO: 1354893 - RNA, 23 nt, Mycobacterium tuberculosis H37Rv
acggggaggucaaaaucagggug

SEQ ID NO: 1354894 - RNA, 20 nt, Mycobacterium tuberculosis H37Rv
acggggucgcccggggcgca

SEQ ID NO: 1354895 - RNA, 20 nt, Mycobacterium tuberculosis H37Rv
acgggccgcgguacccaccu

SEQ ID NO: 1354896 - RNA, 22 nt, Mycobacterium tuberculosis H37Rv
acgggccgcgguacccaccucc

SEQ ID NO: 1354897 - RNA, 13 nt, Mycobacterium tuberculosis H37Rv
acggcggccagga

SEQ ID NO: 1354898 - RNA, 17 nt, Mycobacterium tuberculosis H37Rv
acggcggccaggaccaa

SEQ ID NO: 1354899 - RNA, 22 nt, Mycobacterium tuberculosis H37Rv
acggcggcccacgcgcacucga

SEQ ID NO: 1354900 - RNA, 23 nt, Mycobacterium tuberculosis H37Rv
acgguacgccgccgcgacgcacu

SEQ ID NO: 1354901 - RNA, 14 nt, Mycobacterium tuberculosis H37Rv
acgguagcacgguc

SEQ ID NO: 1354902 - RNA, 14 nt, Mycobacterium tuberculosis H37Rv
acgggugucgggcg

SEQ ID NO: 1354903 - RNA, 15 nt, Mycobacterium tuberculosis H37Rv
acggguccgggccaa

SEQ ID NO: 1354904 - RNA, 13 nt, Mycobacterium tuberculosis H37Rv
acgggucgccgga

SEQ ID NO: 1354905 - RNA, 23 nt, Mycobacterium tuberculosis H37Rv
acgggguccgaugcgugccgacc

SEQ ID NO: 1354906 - RNA, 23 nt, Mycobacterium tuberculosis H37Rv
acgggucgggcaaccugccgggc

SEQ ID NO: 1354907 - RNA, 12 nt, Mycobacterium tuberculosis H37Rv
acgggucggguc

SEQ ID NO: 1354908 - RNA, 17 nt, Mycobacterium tuberculosis H37Rv
acggguggcccgaccgg

SEQ ID NO: 1354909 - RNA, 12 nt, Mycobacterium tuberculosis H37Rv
acggguggugcc

SEQ ID NO: 1354910 - RNA, 18 nt, Mycobacterium tuberculosis H37Rv
acgguggugucagccacc

SEQ ID NO: 1354911 - RNA, 20 nt, Mycobacterium tuberculosis H37Rv
acgguguauugggguggcag

SEQ ID NO: 1354912 - RNA, 18 nt, Mycobacterium tuberculosis H37Rv
acggugucgucgaccacc

SEQ ID NO: 1354913 - RNA, 17 nt, Mycobacterium tuberculosis H37Rv
acgguugccccggcgac

SEQ ID NO: 1354914 - RNA, 12 nt, Mycobacterium tuberculosis H37Rv
acguaacccagu

SEQ ID NO: 1354915 - RNA, 17 nt, Mycobacterium tuberculosis H37Rv
acggucgcucggcauga

SEQ ID NO: 1354916 - RNA, 18 nt, Mycobacterium tuberculosis H37Rv
acggucgaccaggacggu

SEQ ID NO: 1354917 - RNA, 23 nt, Mycobacterium tuberculosis H37Rv
acggucuggcccgcgacaucggg

SEQ ID NO: 1354918 - RNA, 16 nt, Mycobacterium tuberculosis H37Rv
acggucugggucuugg

SEQ ID NO: 1354919 - RNA, 21 nt, Mycobacterium tuberculosis H37Rv
acggucagcacgcugaccaca

SEQ ID NO: 1354920 - RNA, 17 nt, Mycobacterium tuberculosis H37Rv
acgguccgccacggcgg

SEQ ID NO: 1354921 - RNA, 21 nt, Mycobacterium tuberculosis H37Rv
acggugcacagcagugaacgu

SEQ ID NO: 1354922 - RNA, 16 nt, Mycobacterium tuberculosis H37Rv
acggugaucagcagca

SEQ ID NO: 1354923 - RNA, 14 nt, Mycobacterium tuberculosis H37Rv
acggugaauucacg

SEQ ID NO: 1354924 - RNA, 16 nt, Mycobacterium tuberculosis H37Rv
acggucugauggugga

SEQ ID NO: 1354925 - RNA, 19 nt, Mycobacterium tuberculosis H37Rv
acggugggugggcgccgca

SEQ ID NO: 1354926 - RNA, 15 nt, Mycobacterium tuberculosis H37Rv
acgguguaacugcgu

SEQ ID NO: 1354927 - RNA, 22 nt, Mycobacterium tuberculosis H37Rv
acgguggugggcuaggucgcgc

SEQ ID NO: 1354928 - RNA, 21 nt, Mycobacterium tuberculosis H37Rv
acggugcucuucgaugacuag

SEQ ID NO: 1354929 - RNA, 15 nt, Mycobacterium tuberculosis H37Rv
acggugcugccguug

SEQ ID NO: 1354930 - RNA, 14 nt, Mycobacterium tuberculosis H37Rv
acgucgagguugau

SEQ ID NO: 1354931 - RNA, 13 nt, Mycobacterium tuberculosis H37Rv
acgucgccgggcg

SEQ ID NO: 1354932 - RNA, 18 nt, Mycobacterium tuberculosis H37Rv
acgucgagauccucgucg

SEQ ID NO: 1354933 - RNA, 14 nt, Mycobacterium tuberculosis H37Rv
acgucgagcagccg

SEQ ID NO: 1354934 - RNA, 15 nt, Mycobacterium tuberculosis H37Rv
acgucgacuucgccc

SEQ ID NO: 1354935 - RNA, 20 nt, Mycobacterium tuberculosis H37Rv
acgucgacaccgaggaccuc

SEQ ID NO: 1354936 - RNA, 18 nt, Mycobacterium tuberculosis H37Rv
acgucgaacuucagcggc

SEQ ID NO: 1354937 - RNA, 22 nt, Mycobacterium tuberculosis H37Rv
acguccgcgggggaccgcccga

SEQ ID NO: 1354938 - RNA, 17 nt, Mycobacterium tuberculosis H37Rv
acguccgcaaccucgcc

SEQ ID NO: 1354939 - RNA, 18 nt, Mycobacterium tuberculosis H37Rv
acguccaguggcagccag

SEQ ID NO: 1354940 - RNA, 24 nt, Mycobacterium tuberculosis H37Rv
acguccaguccaugugcccagguc

SEQ ID NO: 1354941 - RNA, 20 nt, Mycobacterium tuberculosis H37Rv
acgugccaaugauucggcac

SEQ ID NO: 1354942 - RNA, 16 nt, Mycobacterium tuberculosis H37Rv
acgugcgagcccaccu

SEQ ID NO: 1354943 - RNA, 20 nt, Mycobacterium tuberculosis H37Rv
acgugcucucgcucgugcac

SEQ ID NO: 1354944 - RNA, 20 nt, Mycobacterium tuberculosis H37Rv
acgugcucguagacuugcug

SEQ ID NO: 1354945 - RNA, 21 nt, Mycobacterium tuberculosis H37Rv
acgucgguaaacguugggaaa

SEQ ID NO: 1354946 - RNA, 16 nt, Mycobacterium tuberculosis H37Rv
acgucgcauugugcaa

SEQ ID NO: 1354947 - RNA, 17 nt, Mycobacterium tuberculosis H37Rv
acgucggugaccucggc

SEQ ID NO: 1354948 - RNA, 17 nt, Mycobacterium tuberculosis H37Rv
acgucgcgcaucgccuc

SEQ ID NO: 1354949 - RNA, 21 nt, Mycobacterium tuberculosis H37Rv
acgucgcgcaucgccuccucg

SEQ ID NO: 1354950 - RNA, 17 nt, Mycobacterium tuberculosis H37Rv
acgucguagaccuccag

SEQ ID NO: 1354951 - RNA, 18 nt, Mycobacterium tuberculosis H37Rv
acgucgucagccaccgca

SEQ ID NO: 1354952 - RNA, 17 nt, Mycobacterium tuberculosis H37Rv
acguuugccggcccacc

SEQ ID NO: 1354953 - RNA, 14 nt, Mycobacterium tuberculosis H37Rv
acguuggcagcccu

SEQ ID NO: 1354954 - RNA, 15 nt, Mycobacterium tuberculosis H37Rv
acguuggcagcccuc

SEQ ID NO: 1354955 - RNA, 14 nt, Mycobacterium tuberculosis H37Rv
acguuggccaggcc

SEQ ID NO: 1354956 - RNA, 22 nt, Mycobacterium tuberculosis H37Rv
acguugcuggcuggguggcccc

SEQ ID NO: 1354957 - RNA, 17 nt, Mycobacterium tuberculosis H37Rv
acguugugccuuagcug

SEQ ID NO: 1354958 - RNA, 18 nt, Mycobacterium tuberculosis H37Rv
acguuggcgugcaccgca

SEQ ID NO: 1354959 - RNA, 17 nt, Mycobacterium tuberculosis H37Rv
acguuguccaccgccac

SEQ ID NO: 1354960 - RNA, 20 nt, Mycobacterium tuberculosis H37Rv
acuacggccucgcugggcuc

SEQ ID NO: 1354961 - RNA, 14 nt, Mycobacterium tuberculosis H37Rv
acucaaagacccga

SEQ ID NO: 1354962 - RNA, 23 nt, Mycobacterium tuberculosis H37Rv
acucgacguaagugugcccugcu

SEQ ID NO: 1354963 - RNA, 22 nt, Mycobacterium tuberculosis H37Rv
acucgacauccucgauggaccg

SEQ ID NO: 1354964 - RNA, 22 nt, Mycobacterium tuberculosis H37Rv
acuccugcagcccgggcagcac

SEQ ID NO: 1354965 - RNA, 13 nt, Mycobacterium tuberculosis H37Rv
acuccugcagccc

SEQ ID NO: 1354966 - RNA, 17 nt, Mycobacterium tuberculosis H37Rv
acuccgugcuuccauuc

SEQ ID NO: 1354967 - RNA, 18 nt, Mycobacterium tuberculosis H37Rv
acuccggucaacacccgc

SEQ ID NO: 1354968 - RNA, 20 nt, Mycobacterium tuberculosis H37Rv
acuccgggcucggcgucgcc

SEQ ID NO: 1354969 - RNA, 16 nt, Mycobacterium tuberculosis H37Rv
acuccggguggcggcg

SEQ ID NO: 1354970 - RNA, 17 nt, Mycobacterium tuberculosis H37Rv
acuccggucaacacccg

SEQ ID NO: 1354971 - RNA, 22 nt, Mycobacterium tuberculosis H37Rv
acuccggacccuuacccggcgc

SEQ ID NO: 1354972 - RNA, 15 nt, Mycobacterium tuberculosis H37Rv
acuccggcaagcaca

SEQ ID NO: 1354973 - RNA, 13 nt, Mycobacterium tuberculosis H37Rv
acuccggccgcac

SEQ ID NO: 1354974 - RNA, 17 nt, Mycobacterium tuberculosis H37Rv
acuccgcgagcccggcc

SEQ ID NO: 1354975 - RNA, 12 nt, Mycobacterium tuberculosis H37Rv
acuccgcggcgc

SEQ ID NO: 1354976 - RNA, 19 nt, Mycobacterium tuberculosis H37Rv
acuccgcggaacccagcac

SEQ ID NO: 1354977 - RNA, 17 nt, Mycobacterium tuberculosis H37Rv
acuccgcgcgcugggcc

SEQ ID NO: 1354978 - RNA, 14 nt, Mycobacterium tuberculosis H37Rv
acuccgcggcgcgc

SEQ ID NO: 1354979 - RNA, 15 nt, Mycobacterium tuberculosis H37Rv
acucaacaccagcaa

SEQ ID NO: 1354980 - RNA, 19 nt, Mycobacterium tuberculosis H37Rv
acucaagauuuccaucgca

SEQ ID NO: 1354981 - RNA, 16 nt, Mycobacterium tuberculosis H37Rv
acucugcguccaccac

SEQ ID NO: 1354982 - RNA, 22 nt, Mycobacterium tuberculosis H37Rv
acucugcguccaccacgcaaaa

SEQ ID NO: 1354983 - RNA, 14 nt, Mycobacterium tuberculosis H37Rv
acucggccacagcg

SEQ ID NO: 1354984 - RNA, 18 nt, Mycobacterium tuberculosis H37Rv
acucggcgauauggccuu

SEQ ID NO: 1354985 - RNA, 21 nt, Mycobacterium tuberculosis H37Rv
acucggcccggcaggacuugg

SEQ ID NO: 1354986 - RNA, 18 nt, Mycobacterium tuberculosis H37Rv
acucggcgaccugccgga

SEQ ID NO: 1354987 - RNA, 22 nt, Mycobacterium tuberculosis H37Rv
acucgaguggcgaacgggugag

SEQ ID NO: 1354988 - RNA, 14 nt, Mycobacterium tuberculosis H37Rv
acucgaucgccuga

SEQ ID NO: 1354989 - RNA, 19 nt, Mycobacterium tuberculosis H37Rv
acucgauauaacccggcuc

SEQ ID NO: 1354990 - RNA, 22 nt, Mycobacterium tuberculosis H37Rv
acucgauauaacccggcuccag

SEQ ID NO: 1354991 - RNA, 21 nt, Mycobacterium tuberculosis H37Rv
acucggauagccccguguugu

SEQ ID NO: 1354992 - RNA, 21 nt, Mycobacterium tuberculosis H37Rv
acucggccacggcgucggcca

SEQ ID NO: 1354993 - RNA, 13 nt, Mycobacterium tuberculosis H37Rv
acucggcaccgcg

SEQ ID NO: 1354994 - RNA, 17 nt, Mycobacterium tuberculosis H37Rv
acucggcccacacgguc

SEQ ID NO: 1354995 - RNA, 13 nt, Mycobacterium tuberculosis H37Rv
acucggccagcuc

SEQ ID NO: 1354996 - RNA, 20 nt, Mycobacterium tuberculosis H37Rv
acugaggaaagucaccgucc

SEQ ID NO: 1354997 - RNA, 15 nt, Mycobacterium tuberculosis H37Rv
acugauagacccugg

SEQ ID NO: 1354998 - RNA, 24 nt, Mycobacterium tuberculosis H37Rv
acugcgaaggaccagagcucgaag

SEQ ID NO: 1354999 - RNA, 21 nt, Mycobacterium tuberculosis H37Rv
acugcgaagaguccuuaaacg

SEQ ID NO: 1355000 - RNA, 16 nt, Mycobacterium tuberculosis H37Rv
acugccucaaaccgga

SEQ ID NO: 1355001 - RNA, 16 nt, Mycobacterium tuberculosis H37Rv
acugccguugccgccg

SEQ ID NO: 1355002 - RNA, 22 nt, Mycobacterium tuberculosis H37Rv
acugccggcagcgcccccggac

SEQ ID NO: 1355003 - RNA, 23 nt, Mycobacterium tuberculosis H37Rv
acugccggccaacuucugcacga

SEQ ID NO: 1355004 - RNA, 14 nt, Mycobacterium tuberculosis H37Rv
acugccgcgcucgc

SEQ ID NO: 1355005 - RNA, 23 nt, Mycobacterium tuberculosis H37Rv
acugccgcgcucgcgcaccguca

SEQ ID NO: 1355006 - RNA, 23 nt, Mycobacterium tuberculosis H37Rv
acugcgcccauagcugccggccc

SEQ ID NO: 1355007 - RNA, 20 nt, Mycobacterium tuberculosis H37Rv
acugcgccguucgcuccccc

SEQ ID NO: 1355008 - RNA, 13 nt, Mycobacterium tuberculosis H37Rv
acugcagcccugc

SEQ ID NO: 1355009 - RNA, 18 nt, Mycobacterium tuberculosis H37Rv
acugcccgcguuugcgaa

SEQ ID NO: 1355010 - RNA, 13 nt, Mycobacterium tuberculosis H37Rv
acugccccagcac

SEQ ID NO: 1355011 - RNA, 13 nt, Mycobacterium tuberculosis H37Rv
acuggugggccau

SEQ ID NO: 1355012 - RNA, 16 nt, Mycobacterium tuberculosis H37Rv
acuggggaggccaacc

SEQ ID NO: 1355013 - RNA, 16 nt, Mycobacterium tuberculosis H37Rv
acuggcuuugacggga

SEQ ID NO: 1355014 - RNA, 14 nt, Mycobacterium tuberculosis H37Rv
acuggcaccgccag

SEQ ID NO: 1355015 - RNA, 18 nt, Mycobacterium tuberculosis H37Rv
acuggccccgguggugcu

SEQ ID NO: 1355016 - RNA, 21 nt, Mycobacterium tuberculosis H37Rv
acuggccccgguggugcugcc

SEQ ID NO: 1355017 - RNA, 20 nt, Mycobacterium tuberculosis H37Rv
acuggccccgccagcggcag

SEQ ID NO: 1355018 - RNA, 21 nt, Mycobacterium tuberculosis H37Rv
acuggcgguguaacccggaac

SEQ ID NO: 1355019 - RNA, 19 nt, Mycobacterium tuberculosis H37Rv
acuggccguuucggcgccg

SEQ ID NO: 1355020 - RNA, 21 nt, Mycobacterium tuberculosis H37Rv
acuggcccggacaugcgggca

SEQ ID NO: 1355021 - RNA, 17 nt, Mycobacterium tuberculosis H37Rv
acuggcccggacaugcg

SEQ ID NO: 1355022 - RNA, 21 nt, Mycobacterium tuberculosis H37Rv
acugcugcggcagcgcggcca

SEQ ID NO: 1355023 - RNA, 18 nt, Mycobacterium tuberculosis H37Rv
acugcugaaucacaccau

SEQ ID NO: 1355024 - RNA, 20 nt, Mycobacterium tuberculosis H37Rv
acugcuccuugggucgguca

SEQ ID NO: 1355025 - RNA, 20 nt, Mycobacterium tuberculosis H37Rv
acuggaauggaucucggcgu

SEQ ID NO: 1355026 - RNA, 17 nt, Mycobacterium tuberculosis H37Rv
acuggacaagcuccucg

SEQ ID NO: 1355027 - RNA, 22 nt, Mycobacterium tuberculosis H37Rv
acuggaccacucggcggccacc

SEQ ID NO: 1355028 - RNA, 13 nt, Mycobacterium tuberculosis H37Rv
acuggaagccaag

SEQ ID NO: 1355029 - RNA, 12 nt, Mycobacterium tuberculosis H37Rv
acuggaaggcgg

SEQ ID NO: 1355030 - RNA, 18 nt, Mycobacterium tuberculosis H37Rv
acugcugcuugagcucgc

SEQ ID NO: 1355031 - RNA, 13 nt, Mycobacterium tuberculosis H37Rv
acugcugcuugag

SEQ ID NO: 1355032 - RNA, 14 nt, Mycobacterium tuberculosis H37Rv
acugcuggucaggu

SEQ ID NO: 1355033 - RNA, 21 nt, Mycobacterium tuberculosis H37Rv
acugcugggggucaaucgggu

SEQ ID NO: 1355034 - RNA, 16 nt, Mycobacterium tuberculosis H37Rv
acugucuggucggcua

SEQ ID NO: 1355035 - RNA, 13 nt, Mycobacterium tuberculosis H37Rv
acuguucccacag

SEQ ID NO: 1355036 - RNA, 20 nt, Mycobacterium tuberculosis H37Rv
acuguuaggcgauugcgccg

SEQ ID NO: 1355037 - RNA, 17 nt, Mycobacterium tuberculosis H37Rv
acuuagcccgauggugc

SEQ ID NO: 1355038 - RNA, 14 nt, Mycobacterium tuberculosis H37Rv
acuguugaagaagc

SEQ ID NO: 1355039 - RNA, 16 nt, Mycobacterium tuberculosis H37Rv
acuucagcauggugga

SEQ ID NO: 1355040 - RNA, 19 nt, Mycobacterium tuberculosis H37Rv
acuuccgcagcgccacccg

SEQ ID NO: 1355041 - RNA, 12 nt, Mycobacterium tuberculosis H37Rv
acuucccccggg

SEQ ID NO: 1355042 - RNA, 11 nt, Mycobacterium tuberculosis H37Rv
acuucaccacc

SEQ ID NO: 1355043 - RNA, 13 nt, Mycobacterium tuberculosis H37Rv
acuucaccggcuc

SEQ ID NO: 1355044 - RNA, 19 nt, Mycobacterium tuberculosis H37Rv
agacuagccgauccagcag

SEQ ID NO: 1355045 - RNA, 22 nt, Mycobacterium tuberculosis H37Rv
agacuagcugcuagcccggcgg

SEQ ID NO: 1355046 - RNA, 14 nt, Mycobacterium tuberculosis H37Rv
agagucaacaucag

SEQ ID NO: 1355047 - RNA, 15 nt, Mycobacterium tuberculosis H37Rv
agagucaacaucagc

SEQ ID NO: 1355048 - RNA, 16 nt, Mycobacterium tuberculosis H37Rv
agagucaacaucagca

SEQ ID NO: 1355049 - RNA, 21 nt, Mycobacterium tuberculosis H37Rv
agagguccuugaugcgcccca

SEQ ID NO: 1355050 - RNA, 22 nt, Mycobacterium tuberculosis H37Rv
agagguccuugaugcgccccau

SEQ ID NO: 1355051 - RNA, 13 nt, Mycobacterium tuberculosis H37Rv
agagccugcucgc

SEQ ID NO: 1355052 - RNA, 20 nt, Mycobacterium tuberculosis H37Rv
agagcugguccuccaaggcg

SEQ ID NO: 1355053 - RNA, 13 nt, Mycobacterium tuberculosis H37Rv
agauacggccacc

SEQ ID NO: 1355054 - RNA, 13 nt, Mycobacterium tuberculosis H37Rv
agauagcgcucga

SEQ ID NO: 1355055 - RNA, 14 nt, Mycobacterium tuberculosis H37Rv
agauaccaccgccg

SEQ ID NO: 1355056 - RNA, 17 nt, Mycobacterium tuberculosis H37Rv
agauacccgcggcagca

SEQ ID NO: 1355057 - RNA, 13 nt, Mycobacterium tuberculosis H37Rv
agaucaccgccag

SEQ ID NO: 1355058 - RNA, 14 nt, Mycobacterium tuberculosis H37Rv
agaucaccgccagc

SEQ ID NO: 1355059 - RNA, 15 nt, Mycobacterium tuberculosis H37Rv
agaucaccgccacca

SEQ ID NO: 1355060 - RNA, 14 nt, Mycobacterium tuberculosis H37Rv
agaucacgcgucgu

SEQ ID NO: 1355061 - RNA, 18 nt, Mycobacterium tuberculosis H37Rv
agaucaccucccgcggca

SEQ ID NO: 1355062 - RNA, 19 nt, Mycobacterium tuberculosis H37Rv
agaucaacgcgucgcccgc

SEQ ID NO: 1355063 - RNA, 23 nt, Mycobacterium tuberculosis H37Rv
agaucagcaccgugacagcggca

SEQ ID NO: 1355064 - RNA, 20 nt, Mycobacterium tuberculosis H37Rv
agaucagcaugguccacagc

SEQ ID NO: 1355065 - RNA, 19 nt, Mycobacterium tuberculosis H37Rv
agaucagcgccugguccuc

SEQ ID NO: 1355066 - RNA, 23 nt, Mycobacterium tuberculosis H37Rv
agaugacgguggugacgucgagg

SEQ ID NO: 1355067 - RNA, 18 nt, Mycobacterium tuberculosis H37Rv
agaugccugcuagcagca

SEQ ID NO: 1355068 - RNA, 23 nt, Mycobacterium tuberculosis H37Rv
agaugccguaguaaggagccggg

SEQ ID NO: 1355069 - RNA, 19 nt, Mycobacterium tuberculosis H37Rv
agaugcacgucgagcaggc

SEQ ID NO: 1355070 - RNA, 18 nt, Mycobacterium tuberculosis H37Rv
agaucuuuucaccaccuc

SEQ ID NO: 1355071 - RNA, 20 nt, Mycobacterium tuberculosis H37Rv
agaugaagcaguugccgcgg

SEQ ID NO: 1355072 - RNA, 14 nt, Mycobacterium tuberculosis H37Rv
agaugaaggugacg

SEQ ID NO: 1355073 - RNA, 23 nt, Mycobacterium tuberculosis H37Rv
agaucuucaccggccggugccag

SEQ ID NO: 1355074 - RNA, 19 nt, Mycobacterium tuberculosis H37Rv
agaucucgcgggcccgcgc

SEQ ID NO: 1355075 - RNA, 14 nt, Mycobacterium tuberculosis H37Rv
agaucuggguuccc

SEQ ID NO: 1355076 - RNA, 16 nt, Mycobacterium tuberculosis H37Rv
agaucugggcuggcag

SEQ ID NO: 1355077 - RNA, 18 nt, Mycobacterium tuberculosis H37Rv
agaucgcuaggaccgcgg

SEQ ID NO: 1355078 - RNA, 19 nt, Mycobacterium tuberculosis H37Rv
agaucgccucgacgcggca

SEQ ID NO: 1355079 - RNA, 15 nt, Mycobacterium tuberculosis H37Rv
agaucgccugggggu

SEQ ID NO: 1355080 - RNA, 20 nt, Mycobacterium tuberculosis H37Rv
agaucgcccgaguugaagaa

SEQ ID NO: 1355081 - RNA, 24 nt, Mycobacterium tuberculosis H37Rv
agaucgacuucauagcgccggagu

SEQ ID NO: 1355082 - RNA, 16 nt, Mycobacterium tuberculosis H37Rv
agaucgagggggacgc

SEQ ID NO: 1355083 - RNA, 19 nt, Mycobacterium tuberculosis H37Rv
agauccuuaucgcucucgg

SEQ ID NO: 1355084 - RNA, 20 nt, Mycobacterium tuberculosis H37Rv
agaucucacgugcccgcgcg

SEQ ID NO: 1355085 - RNA, 21 nt, Mycobacterium tuberculosis H37Rv
agaucgucgacccaccaugug

SEQ ID NO: 1355086 - RNA, 14 nt, Mycobacterium tuberculosis H37Rv
agaucggcgccccu

SEQ ID NO: 1355087 - RNA, 14 nt, Mycobacterium tuberculosis H37Rv
agaucgucgccaug

SEQ ID NO: 1355088 - RNA, 14 nt, Mycobacterium tuberculosis H37Rv
agaucggugccagc

SEQ ID NO: 1355089 - RNA, 21 nt, Mycobacterium tuberculosis H37Rv
agaucggccggauacgggcug

SEQ ID NO: 1355090 - RNA, 23 nt, Mycobacterium tuberculosis H37Rv
agauccguccgcugguggucagc

SEQ ID NO: 1355091 - RNA, 17 nt, Mycobacterium tuberculosis H37Rv
agauccgguccaccgcc

SEQ ID NO: 1355092 - RNA, 20 nt, Mycobacterium tuberculosis H37Rv
agauccucgucgagguccuc

SEQ ID NO: 1355093 - RNA, 18 nt, Mycobacterium tuberculosis H37Rv
agauccguccgcuggugg

SEQ ID NO: 1355094 - RNA, 14 nt, Mycobacterium tuberculosis H37Rv
agauccuggaggug

SEQ ID NO: 1355095 - RNA, 22 nt, Mycobacterium tuberculosis H37Rv
agauccggccaacggcacccug

SEQ ID NO: 1355096 - RNA, 13 nt, Mycobacterium tuberculosis H37Rv
agauccgccgggu

SEQ ID NO: 1355097 - RNA, 19 nt, Mycobacterium tuberculosis H37Rv
agauccgcagcgucuugau

SEQ ID NO: 1355098 - RNA, 20 nt, Mycobacterium tuberculosis H37Rv
agauccgccacgcucaaccc

SEQ ID NO: 1355099 - RNA, 15 nt, Mycobacterium tuberculosis H37Rv
agaucccggucccaa

SEQ ID NO: 1355100 - RNA, 23 nt, Mycobacterium tuberculosis H37Rv
agauccauuggaugccauaggac

SEQ ID NO: 1355101 - RNA, 17 nt, Mycobacterium tuberculosis H37Rv
agaucccaguccgaugg

SEQ ID NO: 1355102 - RNA, 19 nt, Mycobacterium tuberculosis H37Rv
agauuccucuucaggcccu

SEQ ID NO: 1355103 - RNA, 19 nt, Mycobacterium tuberculosis H37Rv
agauucggugccagcaggc

SEQ ID NO: 1355104 - RNA, 13 nt, Mycobacterium tuberculosis H37Rv
agauugcugacga

SEQ ID NO: 1355105 - RNA, 23 nt, Mycobacterium tuberculosis H37Rv
agauuggaagacgccggcgaugc

SEQ ID NO: 1355106 - RNA, 18 nt, Mycobacterium tuberculosis H37Rv
agauugccgguuuugccg

SEQ ID NO: 1355107 - RNA, 12 nt, Mycobacterium tuberculosis H37Rv
agauggaauggc

SEQ ID NO: 1355108 - RNA, 20 nt, Mycobacterium tuberculosis H37Rv
agaugcgcccggcgugguga

SEQ ID NO: 1355109 - RNA, 14 nt, Mycobacterium tuberculosis H37Rv
agauggcccgucgu

SEQ ID NO: 1355110 - RNA, 14 nt, Mycobacterium tuberculosis H37Rv
agaugggccacccg

SEQ ID NO: 1355111 - RNA, 22 nt, Mycobacterium tuberculosis H37Rv
agauggcucucggugguccagc

SEQ ID NO: 1355112 - RNA, 20 nt, Mycobacterium tuberculosis H37Rv
agauggguacccgaucacuc

SEQ ID NO: 1355113 - RNA, 15 nt, Mycobacterium tuberculosis H37Rv
agaagaacucggcgu

SEQ ID NO: 1355114 - RNA, 14 nt, Mycobacterium tuberculosis H37Rv
agaagaagcccagg

SEQ ID NO: 1355115 - RNA, 15 nt, Mycobacterium tuberculosis H37Rv
agaauucgccaaggc

SEQ ID NO: 1355116 - RNA, 20 nt, Mycobacterium tuberculosis H37Rv
agaauggacugaacaccaaa

SEQ ID NO: 1355117 - RNA, 13 nt, Mycobacterium tuberculosis H37Rv
agaaucugccucu

SEQ ID NO: 1355118 - RNA, 19 nt, Mycobacterium tuberculosis H37Rv
agaaucgaagcggcugcug

SEQ ID NO: 1355119 - RNA, 20 nt, Mycobacterium tuberculosis H37Rv
agaaucgcacgaaaucagcc

SEQ ID NO: 1355120 - RNA, 22 nt, Mycobacterium tuberculosis H37Rv
agaaucccgggcucugcugcca

SEQ ID NO: 1355121 - RNA, 15 nt, Mycobacterium tuberculosis H37Rv
agaauccggcccacc

SEQ ID NO: 1355122 - RNA, 13 nt, Mycobacterium tuberculosis H37Rv
agaccucagccgg

SEQ ID NO: 1355123 - RNA, 20 nt, Mycobacterium tuberculosis H37Rv
agaccucagccggcggcugg

SEQ ID NO: 1355124 - RNA, 17 nt, Mycobacterium tuberculosis H37Rv
agaccuagcaccgcgcc

SEQ ID NO: 1355125 - RNA, 16 nt, Mycobacterium tuberculosis H37Rv
agacgaccgugcuggg

SEQ ID NO: 1355126 - RNA, 15 nt, Mycobacterium tuberculosis H37Rv
agacgacgaucagcc

SEQ ID NO: 1355127 - RNA, 21 nt, Mycobacterium tuberculosis H37Rv
agaccucggcgugucugcccg

SEQ ID NO: 1355128 - RNA, 20 nt, Mycobacterium tuberculosis H37Rv
agacccagcgcggcaacucc

SEQ ID NO: 1355129 - RNA, 17 nt, Mycobacterium tuberculosis H37Rv
agaccauggucauguuc

SEQ ID NO: 1355130 - RNA, 17 nt, Mycobacterium tuberculosis H37Rv
agaccagggcagcggcc

SEQ ID NO: 1355131 - RNA, 16 nt, Mycobacterium tuberculosis H37Rv
agaccaggcccagguc

SEQ ID NO: 1355132 - RNA, 16 nt, Mycobacterium tuberculosis H37Rv
agacgaucgccaggcc

SEQ ID NO: 1355133 - RNA, 16 nt, Mycobacterium tuberculosis H37Rv
agacgauucggcggcc

SEQ ID NO: 1355134 - RNA, 15 nt, Mycobacterium tuberculosis H37Rv
agacgauggccaggu

SEQ ID NO: 1355135 - RNA, 23 nt, Mycobacterium tuberculosis H37Rv
agacguuccaucacggaccaggc

SEQ ID NO: 1355136 - RNA, 15 nt, Mycobacterium tuberculosis H37Rv
agacgucgcaacgug

SEQ ID NO: 1355137 - RNA, 12 nt, Mycobacterium tuberculosis H37Rv
agacaucagugc

SEQ ID NO: 1355138 - RNA, 16 nt, Mycobacterium tuberculosis H37Rv
agaccagcaggcccug

SEQ ID NO: 1355139 - RNA, 20 nt, Mycobacterium tuberculosis H37Rv
agacagacaggauugccgag

SEQ ID NO: 1355140 - RNA, 11 nt, Mycobacterium tuberculosis H37Rv
agaauuggccc

SEQ ID NO: 1355141 - RNA, 15 nt, Mycobacterium tuberculosis H37Rv
agaacccacgcaugc

SEQ ID NO: 1355142 - RNA, 16 nt, Mycobacterium tuberculosis H37Rv
agaacaccggccaggc

SEQ ID NO: 1355143 - RNA, 20 nt, Mycobacterium tuberculosis H37Rv
agaacaacgggauccgcgcg

SEQ ID NO: 1355144 - RNA, 14 nt, Mycobacterium tuberculosis H37Rv
agaacaacaucgcc

SEQ ID NO: 1355145 - RNA, 18 nt, Mycobacterium tuberculosis H37Rv
agaaauucuugaaauagu

SEQ ID NO: 1355146 - RNA, 20 nt, Mycobacterium tuberculosis H37Rv
agaacgcggccucgucgagu

SEQ ID NO: 1355147 - RNA, 22 nt, Mycobacterium tuberculosis H37Rv
agaaccgccaccagaccaggaa

SEQ ID NO: 1355148 - RNA, 18 nt, Mycobacterium tuberculosis H37Rv
agaaccggguaaugcgac

SEQ ID NO: 1355149 - RNA, 13 nt, Mycobacterium tuberculosis H37Rv
agaacuggcugcu

SEQ ID NO: 1355150 - RNA, 15 nt, Mycobacterium tuberculosis H37Rv
agaacuccgccacca

SEQ ID NO: 1355151 - RNA, 16 nt, Mycobacterium tuberculosis H37Rv
agaacuccgccaccau

SEQ ID NO: 1355152 - RNA, 20 nt, Mycobacterium tuberculosis H37Rv
agaacguuuucgucacccca

SEQ ID NO: 1355153 - RNA, 20 nt, Mycobacterium tuberculosis H37Rv
agaacgucgagacuucggug

SEQ ID NO: 1355154 - RNA, 13 nt, Mycobacterium tuberculosis H37Rv
agaacgugcuggu

SEQ ID NO: 1355155 - RNA, 18 nt, Mycobacterium tuberculosis H37Rv
agaacguggccguuaauu

SEQ ID NO: 1355156 - RNA, 18 nt, Mycobacterium tuberculosis H37Rv
acuucgaaucaggcucca

SEQ ID NO: 1355157 - RNA, 22 nt, Mycobacterium tuberculosis H37Rv
acuuuucgguggcggcagcagc

SEQ ID NO: 1355158 - RNA, 15 nt, Mycobacterium tuberculosis H37Rv
agaaacccugcugcg

SEQ ID NO: 1355159 - RNA, 16 nt, Mycobacterium tuberculosis H37Rv
agaaacccggcgacca

SEQ ID NO: 1355160 - RNA, 16 nt, Mycobacterium tuberculosis H37Rv
agaaacggcgacucga

SEQ ID NO: 1355161 - RNA, 20 nt, Mycobacterium tuberculosis H37Rv
accgccguggccgcacugcu

SEQ ID NO: 1355162 - RNA, 15 nt, Mycobacterium tuberculosis H37Rv
accgccgugugccac

SEQ ID NO: 1355163 - RNA, 19 nt, Mycobacterium tuberculosis H37Rv
accgccgggaugccggccc

SEQ ID NO: 1355164 - RNA, 16 nt, Mycobacterium tuberculosis H37Rv
accgccguuugcgccg

SEQ ID NO: 1355165 - RNA, 14 nt, Mycobacterium tuberculosis H37Rv
accgccgucgccac

SEQ ID NO: 1355166 - RNA, 20 nt, Mycobacterium tuberculosis H37Rv
accgccguugccaagcagcu

SEQ ID NO: 1355167 - RNA, 21 nt, Mycobacterium tuberculosis H37Rv
accgccaucgucgaagaccuc

SEQ ID NO: 1355168 - RNA, 14 nt, Mycobacterium tuberculosis H37Rv
accgcccagugcca

SEQ ID NO: 1355169 - RNA, 21 nt, Mycobacterium tuberculosis H37Rv
accgccggcggcggccgcagc

SEQ ID NO: 1355170 - RNA, 18 nt, Mycobacterium tuberculosis H37Rv
accgccugcgccgcccgc

SEQ ID NO: 1355171 - RNA, 13 nt, Mycobacterium tuberculosis H37Rv
accgccugcgccg

SEQ ID NO: 1355172 - RNA, 17 nt, Mycobacterium tuberculosis H37Rv
accgccugugccgccgg

SEQ ID NO: 1355173 - RNA, 14 nt, Mycobacterium tuberculosis H37Rv
accgcgaccccugg

SEQ ID NO: 1355174 - RNA, 17 nt, Mycobacterium tuberculosis H37Rv
accgccuuugccgccgg

SEQ ID NO: 1355175 - RNA, 11 nt, Mycobacterium tuberculosis H37Rv
accgccuuggu

SEQ ID NO: 1355176 - RNA, 16 nt, Mycobacterium tuberculosis H37Rv
accgcgaaagcaccga

SEQ ID NO: 1355177 - RNA, 21 nt, Mycobacterium tuberculosis H37Rv
accgcgaaagcaccgagcauc

SEQ ID NO: 1355178 - RNA, 14 nt, Mycobacterium tuberculosis H37Rv
accgcugucagccg

SEQ ID NO: 1355179 - RNA, 16 nt, Mycobacterium tuberculosis H37Rv
accgcugucagccgac

SEQ ID NO: 1355180 - RNA, 16 nt, Mycobacterium tuberculosis H37Rv
accgcugggacaacgu

SEQ ID NO: 1355181 - RNA, 17 nt, Mycobacterium tuberculosis H37Rv
accgcugcuccucgcgg

SEQ ID NO: 1355182 - RNA, 13 nt, Mycobacterium tuberculosis H37Rv
accgcuggaucgc

SEQ ID NO: 1355183 - RNA, 16 nt, Mycobacterium tuberculosis H37Rv
accgcugcugcugccc

SEQ ID NO: 1355184 - RNA, 17 nt, Mycobacterium tuberculosis H37Rv
accgcugcugcugcccc

SEQ ID NO: 1355185 - RNA, 18 nt, Mycobacterium tuberculosis H37Rv
accgcugccgcugccgaa

SEQ ID NO: 1355186 - RNA, 14 nt, Mycobacterium tuberculosis H37Rv
accgcugccggcac

SEQ ID NO: 1355187 - RNA, 18 nt, Mycobacterium tuberculosis H37Rv
accgcugaccccggcagc

SEQ ID NO: 1355188 - RNA, 15 nt, Mycobacterium tuberculosis H37Rv
accgcucugcggcca

SEQ ID NO: 1355189 - RNA, 17 nt, Mycobacterium tuberculosis H37Rv
accgcggccaugacacg

SEQ ID NO: 1355190 - RNA, 10 nt, Mycobacterium tuberculosis H37Rv
accgcggaca

SEQ ID NO: 1355191 - RNA, 16 nt, Mycobacterium tuberculosis H37Rv
accgcggccagcggga

SEQ ID NO: 1355192 - RNA, 20 nt, Mycobacterium tuberculosis H37Rv
accgcgccgucgucgagcac

SEQ ID NO: 1355193 - RNA, 16 nt, Mycobacterium tuberculosis H37Rv
accccgauggucgaga

SEQ ID NO: 1355194 - RNA, 22 nt, Mycobacterium tuberculosis H37Rv
accccgccgagcgguugccuuc

SEQ ID NO: 1355195 - RNA, 23 nt, Mycobacterium tuberculosis H37Rv
accccgccgagcgguugccuucu

SEQ ID NO: 1355196 - RNA, 13 nt, Mycobacterium tuberculosis H37Rv
accccgccgccug

SEQ ID NO: 1355197 - RNA, 22 nt, Mycobacterium tuberculosis H37Rv
accccucacccagcuggguccc

SEQ ID NO: 1355198 - RNA, 16 nt, Mycobacterium tuberculosis H37Rv
accgaucgaacagugc

SEQ ID NO: 1355199 - RNA, 22 nt, Mycobacterium tuberculosis H37Rv
accccuggccgccggcgccgcc

SEQ ID NO: 1355200 - RNA, 16 nt, Mycobacterium tuberculosis H37Rv
accgaucugcuucagu

SEQ ID NO: 1355201 - RNA, 12 nt, Mycobacterium tuberculosis H37Rv
accgaucggcag

SEQ ID NO: 1355202 - RNA, 23 nt, Mycobacterium tuberculosis H37Rv
accgaucggcaaaccgucggagg

SEQ ID NO: 1355203 - RNA, 23 nt, Mycobacterium tuberculosis H37Rv
accgaugcgccggaccagcuccu

SEQ ID NO: 1355204 - RNA, 23 nt, Mycobacterium tuberculosis H37Rv
accgaugguggugccaaccuggg

SEQ ID NO: 1355205 - RNA, 22 nt, Mycobacterium tuberculosis H37Rv
accgaugguggugccaaccugg

SEQ ID NO: 1355206 - RNA, 16 nt, Mycobacterium tuberculosis H37Rv
accgauggcgcaccgg

SEQ ID NO: 1355207 - RNA, 18 nt, Mycobacterium tuberculosis H37Rv
accgccaacauuggugag

SEQ ID NO: 1355208 - RNA, 23 nt, Mycobacterium tuberculosis H37Rv
accgccaacauuggugagguggu

SEQ ID NO: 1355209 - RNA, 13 nt, Mycobacterium tuberculosis H37Rv
accgcauguggga

SEQ ID NO: 1355210 - RNA, 17 nt, Mycobacterium tuberculosis H37Rv
accgccaucgccaacac

SEQ ID NO: 1355211 - RNA, 17 nt, Mycobacterium tuberculosis H37Rv
accgccaccacccaggc

SEQ ID NO: 1355212 - RNA, 19 nt, Mycobacterium tuberculosis H37Rv
accgcaucgggcuugcgca

SEQ ID NO: 1355213 - RNA, 21 nt, Mycobacterium tuberculosis H37Rv
accgcaccgacuccugggcca

SEQ ID NO: 1355214 - RNA, 18 nt, Mycobacterium tuberculosis H37Rv
accgcaccggaauacagc

SEQ ID NO: 1355215 - RNA, 13 nt, Mycobacterium tuberculosis H37Rv
accgcaccguccc

SEQ ID NO: 1355216 - RNA, 13 nt, Mycobacterium tuberculosis H37Rv
accgcacccgcuc

SEQ ID NO: 1355217 - RNA, 16 nt, Mycobacterium tuberculosis H37Rv
accggccaccagcccg

SEQ ID NO: 1355218 - RNA, 21 nt, Mycobacterium tuberculosis H37Rv
accggccaacagucgcagcac

SEQ ID NO: 1355219 - RNA, 13 nt, Mycobacterium tuberculosis H37Rv
accggccaguggg

SEQ ID NO: 1355220 - RNA, 18 nt, Mycobacterium tuberculosis H37Rv
accggccagcggcccguc

SEQ ID NO: 1355221 - RNA, 23 nt, Mycobacterium tuberculosis H37Rv
accggccaucgaccguccggguc

SEQ ID NO: 1355222 - RNA, 17 nt, Mycobacterium tuberculosis H37Rv
accggccaccagcccga

SEQ ID NO: 1355223 - RNA, 17 nt, Mycobacterium tuberculosis H37Rv
accggccaccagggcca

SEQ ID NO: 1355224 - RNA, 18 nt, Mycobacterium tuberculosis H37Rv
accggccaccagggccac

SEQ ID NO: 1355225 - RNA, 11 nt, Mycobacterium tuberculosis H37Rv
accggccagcc

SEQ ID NO: 1355226 - RNA, 15 nt, Mycobacterium tuberculosis H37Rv
accggcaugccgcca

SEQ ID NO: 1355227 - RNA, 14 nt, Mycobacterium tuberculosis H37Rv
accggcaucgauca

SEQ ID NO: 1355228 - RNA, 21 nt, Mycobacterium tuberculosis H37Rv
accgcuuccagguugaagaau

SEQ ID NO: 1355229 - RNA, 14 nt, Mycobacterium tuberculosis H37Rv
accgcuucccccgg

SEQ ID NO: 1355230 - RNA, 21 nt, Mycobacterium tuberculosis H37Rv
accgcuucaggcgccacugcu

SEQ ID NO: 1355231 - RNA, 14 nt, Mycobacterium tuberculosis H37Rv
accgcuucaggcgc

SEQ ID NO: 1355232 - RNA, 18 nt, Mycobacterium tuberculosis H37Rv
accggcaagccacgccgg

SEQ ID NO: 1355233 - RNA, 22 nt, Mycobacterium tuberculosis H37Rv
accggcaaucggcggcacccgg

SEQ ID NO: 1355234 - RNA, 13 nt, Mycobacterium tuberculosis H37Rv
accggcacccccg

SEQ ID NO: 1355235 - RNA, 15 nt, Mycobacterium tuberculosis H37Rv
accggcaccggccgg

SEQ ID NO: 1355236 - RNA, 11 nt, Mycobacterium tuberculosis H37Rv
accggcacccg

SEQ ID NO: 1355237 - RNA, 16 nt, Mycobacterium tuberculosis H37Rv
accggcacccgcacgg

SEQ ID NO: 1355238 - RNA, 18 nt, Mycobacterium tuberculosis H37Rv
accggcccgcagcagcau

SEQ ID NO: 1355239 - RNA, 16 nt, Mycobacterium tuberculosis H37Rv
accggcccagugggac

SEQ ID NO: 1355240 - RNA, 21 nt, Mycobacterium tuberculosis H37Rv
accggccgcuauggcccgggc

SEQ ID NO: 1355241 - RNA, 17 nt, Mycobacterium tuberculosis H37Rv
accggccgugccgccga

SEQ ID NO: 1355242 - RNA, 17 nt, Mycobacterium tuberculosis H37Rv
accggccgggugaacca

SEQ ID NO: 1355243 - RNA, 23 nt, Mycobacterium tuberculosis H37Rv
accggccgucgacgcauggguca

SEQ ID NO: 1355244 - RNA, 17 nt, Mycobacterium tuberculosis H37Rv
accggcgacgccggccu

SEQ ID NO: 1355245 - RNA, 15 nt, Mycobacterium tuberculosis H37Rv
accggcgagcccgca

SEQ ID NO: 1355246 - RNA, 22 nt, Mycobacterium tuberculosis H37Rv
accggccuuuccagcaccccga

SEQ ID NO: 1355247 - RNA, 12 nt, Mycobacterium tuberculosis H37Rv
accggccuucaa

SEQ ID NO: 1355248 - RNA, 15 nt, Mycobacterium tuberculosis H37Rv
accggcgccuccggc

SEQ ID NO: 1355249 - RNA, 17 nt, Mycobacterium tuberculosis H37Rv
accggcgccuccggcac

SEQ ID NO: 1355250 - RNA, 13 nt, Mycobacterium tuberculosis H37Rv
accggcgccuccg

SEQ ID NO: 1355251 - RNA, 12 nt, Mycobacterium tuberculosis H37Rv
accggcgcgccc

SEQ ID NO: 1355252 - RNA, 15 nt, Mycobacterium tuberculosis H37Rv
accggcgcgccccgc

SEQ ID NO: 1355253 - RNA, 21 nt, Mycobacterium tuberculosis H37Rv
accggcgccggaguugaagaa

SEQ ID NO: 1355254 - RNA, 18 nt, Mycobacterium tuberculosis H37Rv
accggcgccgccgucgcc

SEQ ID NO: 1355255 - RNA, 17 nt, Mycobacterium tuberculosis H37Rv
accggcgccgccggcac

SEQ ID NO: 1355256 - RNA, 14 nt, Mycobacterium tuberculosis H37Rv
accggcgccgccgu

SEQ ID NO: 1355257 - RNA, 23 nt, Mycobacterium tuberculosis H37Rv
accggcgccuccggcaccuccag

SEQ ID NO: 1355258 - RNA, 15 nt, Mycobacterium tuberculosis H37Rv
accggcgucgcugcc

SEQ ID NO: 1355259 - RNA, 17 nt, Mycobacterium tuberculosis H37Rv
accggcgucugcccgcc

SEQ ID NO: 1355260 - RNA, 20 nt, Mycobacterium tuberculosis H37Rv
accggcucacguaaccagug

SEQ ID NO: 1355261 - RNA, 16 nt, Mycobacterium tuberculosis H37Rv
accggcgugcugugcu

SEQ ID NO: 1355262 - RNA, 20 nt, Mycobacterium tuberculosis H37Rv
accggcgucugcccgcccag

SEQ ID NO: 1355263 - RNA, 18 nt, Mycobacterium tuberculosis H37Rv
accggcugcaaccagcgg

SEQ ID NO: 1355264 - RNA, 22 nt, Mycobacterium tuberculosis H37Rv
accggcugauucgagccacaug

SEQ ID NO: 1355265 - RNA, 16 nt, Mycobacterium tuberculosis H37Rv
accggcugcaaccagc

SEQ ID NO: 1355266 - RNA, 18 nt, Mycobacterium tuberculosis H37Rv
accggcugauucgagcca

SEQ ID NO: 1355267 - RNA, 22 nt, Mycobacterium tuberculosis H37Rv
accggcugaccggggcgcccgg

SEQ ID NO: 1355268 - RNA, 18 nt, Mycobacterium tuberculosis H37Rv
accggcugaccgacccgg

SEQ ID NO: 1355269 - RNA, 15 nt, Mycobacterium tuberculosis H37Rv
accggcucgucgggc

SEQ ID NO: 1355270 - RNA, 17 nt, Mycobacterium tuberculosis H37Rv
accggggcuuggguuga

SEQ ID NO: 1355271 - RNA, 16 nt, Mycobacterium tuberculosis H37Rv
accggggcgcccggcc

SEQ ID NO: 1355272 - RNA, 17 nt, Mycobacterium tuberculosis H37Rv
accgggcguuucccugc

SEQ ID NO: 1355273 - RNA, 15 nt, Mycobacterium tuberculosis H37Rv
accgggcggacagga

SEQ ID NO: 1355274 - RNA, 16 nt, Mycobacterium tuberculosis H37Rv
accgggucagcccagc

SEQ ID NO: 1355275 - RNA, 16 nt, Mycobacterium tuberculosis H37Rv
accggguagcucccug

SEQ ID NO: 1355276 - RNA, 12 nt, Mycobacterium tuberculosis H37Rv
accgggugcagg

SEQ ID NO: 1355277 - RNA, 23 nt, Mycobacterium tuberculosis H37Rv
accgggccucaugcuaggccacc

SEQ ID NO: 1355278 - RNA, 14 nt, Mycobacterium tuberculosis H37Rv
accgggcaccagaa

SEQ ID NO: 1355279 - RNA, 22 nt, Mycobacterium tuberculosis H37Rv
accggcuuggugaaccgcgcgg

SEQ ID NO: 1355280 - RNA, 17 nt, Mycobacterium tuberculosis H37Rv
accggcuuugcuugccg

SEQ ID NO: 1355281 - RNA, 17 nt, Mycobacterium tuberculosis H37Rv
accggcugauucgagcc

SEQ ID NO: 1355282 - RNA, 17 nt, Mycobacterium tuberculosis H37Rv
accggcuggccaggugg

SEQ ID NO: 1355283 - RNA, 12 nt, Mycobacterium tuberculosis H37Rv
accggcuggcca

SEQ ID NO: 1355284 - RNA, 22 nt, Mycobacterium tuberculosis H37Rv
accggcuggugccuuaccaccg

SEQ ID NO: 1355285 - RNA, 21 nt, Mycobacterium tuberculosis H37Rv
accggcuggugccaacugcgc

SEQ ID NO: 1355286 - RNA, 18 nt, Mycobacterium tuberculosis H37Rv
accggcuggugccaacug

SEQ ID NO: 1355287 - RNA, 15 nt, Mycobacterium tuberculosis H37Rv
accggucgcagugca

SEQ ID NO: 1355288 - RNA, 18 nt, Mycobacterium tuberculosis H37Rv
accggucgcagugcaccc

SEQ ID NO: 1355289 - RNA, 21 nt, Mycobacterium tuberculosis H37Rv
accggugauggugaccagcag

SEQ ID NO: 1355290 - RNA, 19 nt, Mycobacterium tuberculosis H37Rv
accggugaucguggguacc

SEQ ID NO: 1355291 - RNA, 17 nt, Mycobacterium tuberculosis H37Rv
accggugauggugacca

SEQ ID NO: 1355292 - RNA, 22 nt, Mycobacterium tuberculosis H37Rv
accggucggccauugcccgggc

SEQ ID NO: 1355293 - RNA, 16 nt, Mycobacterium tuberculosis H37Rv
accgguauagccaagu

SEQ ID NO: 1355294 - RNA, 14 nt, Mycobacterium tuberculosis H37Rv
accggucagcaccu

SEQ ID NO: 1355295 - RNA, 17 nt, Mycobacterium tuberculosis H37Rv
accgguggcagccugcu

SEQ ID NO: 1355296 - RNA, 19 nt, Mycobacterium tuberculosis H37Rv
accgguguuccgcccagcg

SEQ ID NO: 1355297 - RNA, 14 nt, Mycobacterium tuberculosis H37Rv
accggugccagcag

SEQ ID NO: 1355298 - RNA, 16 nt, Mycobacterium tuberculosis H37Rv
accggugccagcagug

SEQ ID NO: 1355299 - RNA, 17 nt, Mycobacterium tuberculosis H37Rv
accggugcccaccaccg

SEQ ID NO: 1355300 - RNA, 23 nt, Mycobacterium tuberculosis H37Rv
accggugccgcccgcgccgccgc

SEQ ID NO: 1355301 - RNA, 14 nt, Mycobacterium tuberculosis H37Rv
accggugccgccgu

SEQ ID NO: 1355302 - RNA, 15 nt, Mycobacterium tuberculosis H37Rv
accguaauuucuuca

SEQ ID NO: 1355303 - RNA, 16 nt, Mycobacterium tuberculosis H37Rv
accgguuuucgccggc

SEQ ID NO: 1355304 - RNA, 23 nt, Mycobacterium tuberculosis H37Rv
accgucuggccguugcccgacuc

SEQ ID NO: 1355305 - RNA, 22 nt, Mycobacterium tuberculosis H37Rv
accgucuuacucgucacggggu

SEQ ID NO: 1355306 - RNA, 21 nt, Mycobacterium tuberculosis H37Rv
accgugacagcggcauugcca

SEQ ID NO: 1355307 - RNA, 22 nt, Mycobacterium tuberculosis H37Rv
accgugacguagggcagcgcca

SEQ ID NO: 1355308 - RNA, 16 nt, Mycobacterium tuberculosis H37Rv
accgucucgcaccgcg

SEQ ID NO: 1355309 - RNA, 15 nt, Mycobacterium tuberculosis H37Rv
accgucuggccguug

SEQ ID NO: 1355310 - RNA, 22 nt, Mycobacterium tuberculosis H37Rv
accgucuccggcgccaccgccg

SEQ ID NO: 1355311 - RNA, 20 nt, Mycobacterium tuberculosis H37Rv
accgucguacucggcggcca

SEQ ID NO: 1355312 - RNA, 17 nt, Mycobacterium tuberculosis H37Rv
accgucgggcccagccg

SEQ ID NO: 1355313 - RNA, 16 nt, Mycobacterium tuberculosis H37Rv
accgucggcagcagcg

SEQ ID NO: 1355314 - RNA, 18 nt, Mycobacterium tuberculosis H37Rv
accgucgccggugacgac

SEQ ID NO: 1355315 - RNA, 14 nt, Mycobacterium tuberculosis H37Rv
accgugccgcccgg

SEQ ID NO: 1355316 - RNA, 18 nt, Mycobacterium tuberculosis H37Rv
accgugcccugggugaug

SEQ ID NO: 1355317 - RNA, 13 nt, Mycobacterium tuberculosis H37Rv
accgugccgggcg

SEQ ID NO: 1355318 - RNA, 12 nt, Mycobacterium tuberculosis H37Rv
accgugucaccg

SEQ ID NO: 1355319 - RNA, 15 nt, Mycobacterium tuberculosis H37Rv
accguggcggccucc

SEQ ID NO: 1355320 - RNA, 17 nt, Mycobacterium tuberculosis H37Rv
accguggcggccuccuc

SEQ ID NO: 1355321 - RNA, 15 nt, Mycobacterium tuberculosis H37Rv
accguggcgccgguc

SEQ ID NO: 1355322 - RNA, 13 nt, Mycobacterium tuberculosis H37Rv
accguggcagcug

SEQ ID NO: 1355323 - RNA, 18 nt, Mycobacterium tuberculosis H37Rv
accguggcagcugcucuc

SEQ ID NO: 1355324 - RNA, 16 nt, Mycobacterium tuberculosis H37Rv
accgucaugggcggcu

SEQ ID NO: 1355325 - RNA, 13 nt, Mycobacterium tuberculosis H37Rv
accguccagcaac

SEQ ID NO: 1355326 - RNA, 13 nt, Mycobacterium tuberculosis H37Rv
accguccagcagc

SEQ ID NO: 1355327 - RNA, 14 nt, Mycobacterium tuberculosis H37Rv
accguccagcagcu

SEQ ID NO: 1355328 - RNA, 17 nt, Mycobacterium tuberculosis H37Rv
accgucccagcgccgca

SEQ ID NO: 1355329 - RNA, 13 nt, Mycobacterium tuberculosis H37Rv
accgucaccgccg

SEQ ID NO: 1355330 - RNA, 16 nt, Mycobacterium tuberculosis H37Rv
accgucagcgccgcug

SEQ ID NO: 1355331 - RNA, 15 nt, Mycobacterium tuberculosis H37Rv
accgucagcgcgccg

SEQ ID NO: 1355332 - RNA, 19 nt, Mycobacterium tuberculosis H37Rv
accgucaguagccacgccc

SEQ ID NO: 1355333 - RNA, 23 nt, Mycobacterium tuberculosis H37Rv
accgucaguucggugugcggcgc

SEQ ID NO: 1355334 - RNA, 21 nt, Mycobacterium tuberculosis H37Rv
accguagagcaugccgcccgc

SEQ ID NO: 1355335 - RNA, 15 nt, Mycobacterium tuberculosis H37Rv
accguagcccugcuc

SEQ ID NO: 1355336 - RNA, 14 nt, Mycobacterium tuberculosis H37Rv
accguauugaccag

SEQ ID NO: 1355337 - RNA, 17 nt, Mycobacterium tuberculosis H37Rv
accgucaaccugcugca

SEQ ID NO: 1355338 - RNA, 14 nt, Mycobacterium tuberculosis H37Rv
accguugccgccgu

SEQ ID NO: 1355339 - RNA, 22 nt, Mycobacterium tuberculosis H37Rv
accguugccgccgucaccgccg

SEQ ID NO: 1355340 - RNA, 20 nt, Mycobacterium tuberculosis H37Rv
accguugcgaagaagaaggc

SEQ ID NO: 1355341 - RNA, 15 nt, Mycobacterium tuberculosis H37Rv
accguugaccucuuc

SEQ ID NO: 1355342 - RNA, 18 nt, Mycobacterium tuberculosis H37Rv
accguuugcgcaccgguc

SEQ ID NO: 1355343 - RNA, 20 nt, Mycobacterium tuberculosis H37Rv
accguuucgaucucgagcag

SEQ ID NO: 1355344 - RNA, 21 nt, Mycobacterium tuberculosis H37Rv
accuaccgagaucaccgccac

SEQ ID NO: 1355345 - RNA, 23 nt, Mycobacterium tuberculosis H37Rv
accuaccgagaucaccgccacca

SEQ ID NO: 1355346 - RNA, 14 nt, Mycobacterium tuberculosis H37Rv
accucacugcggcg

SEQ ID NO: 1355347 - RNA, 12 nt, Mycobacterium tuberculosis H37Rv
accucagcugcg

SEQ ID NO: 1355348 - RNA, 21 nt, Mycobacterium tuberculosis H37Rv
accucaucgcggucgccaccg

SEQ ID NO: 1355349 - RNA, 16 nt, Mycobacterium tuberculosis H37Rv
accucaugaucucacc

SEQ ID NO: 1355350 - RNA, 15 nt, Mycobacterium tuberculosis H37Rv
accucaccgaaagau

SEQ ID NO: 1355351 - RNA, 15 nt, Mycobacterium tuberculosis H37Rv
accuccagugcggcc

SEQ ID NO: 1355352 - RNA, 15 nt, Mycobacterium tuberculosis H37Rv
accuccggguccagg

SEQ ID NO: 1355353 - RNA, 18 nt, Mycobacterium tuberculosis H37Rv
accucccgcagccgggca

SEQ ID NO: 1355354 - RNA, 13 nt, Mycobacterium tuberculosis H37Rv
accucccgcagcc

SEQ ID NO: 1355355 - RNA, 15 nt, Mycobacterium tuberculosis H37Rv
accucccuggccccc

SEQ ID NO: 1355356 - RNA, 19 nt, Mycobacterium tuberculosis H37Rv
accucgaagugcaggugcg

SEQ ID NO: 1355357 - RNA, 19 nt, Mycobacterium tuberculosis H37Rv
accucgacgccccaggaca

SEQ ID NO: 1355358 - RNA, 18 nt, Mycobacterium tuberculosis H37Rv
accucgaaaccguggcca

SEQ ID NO: 1355359 - RNA, 20 nt, Mycobacterium tuberculosis H37Rv
accuccugcgagugcggcac

SEQ ID NO: 1355360 - RNA, 23 nt, Mycobacterium tuberculosis H37Rv
accucgaugccgccccgcagcug

SEQ ID NO: 1355361 - RNA, 13 nt, Mycobacterium tuberculosis H37Rv
accucgcccauga

SEQ ID NO: 1355362 - RNA, 21 nt, Mycobacterium tuberculosis H37Rv
accucgccaucgaccuugagc

SEQ ID NO: 1355363 - RNA, 12 nt, Mycobacterium tuberculosis H37Rv
accucgcccucc

SEQ ID NO: 1355364 - RNA, 20 nt, Mycobacterium tuberculosis H37Rv
accucgccggccgucagcac

SEQ ID NO: 1355365 - RNA, 21 nt, Mycobacterium tuberculosis H37Rv
accucgccggccgucagcaca

SEQ ID NO: 1355366 - RNA, 22 nt, Mycobacterium tuberculosis H37Rv
accucgccgcccuguccgggua

SEQ ID NO: 1355367 - RNA, 11 nt, Mycobacterium tuberculosis H37Rv
accucgccggc

SEQ ID NO: 1355368 - RNA, 15 nt, Mycobacterium tuberculosis H37Rv
accugaagccagcgc

SEQ ID NO: 1355369 - RNA, 17 nt, Mycobacterium tuberculosis H37Rv
accugacacgcccgcga

SEQ ID NO: 1355370 - RNA, 21 nt, Mycobacterium tuberculosis H37Rv
accugacacgcccgcgagcug

SEQ ID NO: 1355371 - RNA, 13 nt, Mycobacterium tuberculosis H37Rv
accugaggcaccu

SEQ ID NO: 1355372 - RNA, 18 nt, Mycobacterium tuberculosis H37Rv
accugagcaccaagaccg

SEQ ID NO: 1355373 - RNA, 15 nt, Mycobacterium tuberculosis H37Rv
accugaguugguucg

SEQ ID NO: 1355374 - RNA, 16 nt, Mycobacterium tuberculosis H37Rv
accucugcugagcugc

SEQ ID NO: 1355375 - RNA, 18 nt, Mycobacterium tuberculosis H37Rv
accucucugcgccaggcg

SEQ ID NO: 1355376 - RNA, 22 nt, Mycobacterium tuberculosis H37Rv
accucucgcuugccgaaauccu

SEQ ID NO: 1355377 - RNA, 11 nt, Mycobacterium tuberculosis H37Rv
accucuugccc

SEQ ID NO: 1355378 - RNA, 13 nt, Mycobacterium tuberculosis H37Rv
accucuggcggcg

SEQ ID NO: 1355379 - RNA, 19 nt, Mycobacterium tuberculosis H37Rv
accucgucaaucaccaccg

SEQ ID NO: 1355380 - RNA, 14 nt, Mycobacterium tuberculosis H37Rv
accucgucccacag

SEQ ID NO: 1355381 - RNA, 20 nt, Mycobacterium tuberculosis H37Rv
accucgucggcgacggccag

SEQ ID NO: 1355382 - RNA, 16 nt, Mycobacterium tuberculosis H37Rv
accucgucgcgucgcc

SEQ ID NO: 1355383 - RNA, 23 nt, Mycobacterium tuberculosis H37Rv
accucgucggccgacaccgccac

SEQ ID NO: 1355384 - RNA, 16 nt, Mycobacterium tuberculosis H37Rv
accucguguccgggga

SEQ ID NO: 1355385 - RNA, 15 nt, Mycobacterium tuberculosis H37Rv
accucguugcugccg

SEQ ID NO: 1355386 - RNA, 21 nt, Mycobacterium tuberculosis H37Rv
accucggaucgccaggccguc

SEQ ID NO: 1355387 - RNA, 18 nt, Mycobacterium tuberculosis H37Rv
accucggcaaccaccucg

SEQ ID NO: 1355388 - RNA, 14 nt, Mycobacterium tuberculosis H37Rv
accugggccaucac

SEQ ID NO: 1355389 - RNA, 18 nt, Mycobacterium tuberculosis H37Rv
accugguuuacccgcaug

SEQ ID NO: 1355390 - RNA, 16 nt, Mycobacterium tuberculosis H37Rv
accugguuccagaggc

SEQ ID NO: 1355391 - RNA, 19 nt, Mycobacterium tuberculosis H37Rv
accugguuccagaggcccg

SEQ ID NO: 1355392 - RNA, 13 nt, Mycobacterium tuberculosis H37Rv
accuggucgcguc

SEQ ID NO: 1355393 - RNA, 17 nt, Mycobacterium tuberculosis H37Rv
accuguugcccuugcgc

SEQ ID NO: 1355394 - RNA, 23 nt, Mycobacterium tuberculosis H37Rv
accuguuuggggcugugcaggcg

SEQ ID NO: 1355395 - RNA, 16 nt, Mycobacterium tuberculosis H37Rv
accuguguugagcggc

SEQ ID NO: 1355396 - RNA, 23 nt, Mycobacterium tuberculosis H37Rv
accugcugggagggaccacccgg

SEQ ID NO: 1355397 - RNA, 19 nt, Mycobacterium tuberculosis H37Rv
accugcuccgcugucaccc

SEQ ID NO: 1355398 - RNA, 17 nt, Mycobacterium tuberculosis H37Rv
accugcuggaagccguc

SEQ ID NO: 1355399 - RNA, 16 nt, Mycobacterium tuberculosis H37Rv
accugcugcaccguca

SEQ ID NO: 1355400 - RNA, 20 nt, Mycobacterium tuberculosis H37Rv
accugggccagcagccguuc

SEQ ID NO: 1355401 - RNA, 12 nt, Mycobacterium tuberculosis H37Rv
accuggccacgg

SEQ ID NO: 1355402 - RNA, 21 nt, Mycobacterium tuberculosis H37Rv
accuggccugcggcaggugcg

SEQ ID NO: 1355403 - RNA, 16 nt, Mycobacterium tuberculosis H37Rv
accugccgggccacgg

SEQ ID NO: 1355404 - RNA, 23 nt, Mycobacterium tuberculosis H37Rv
accugcgggaucgccgagaccgc

SEQ ID NO: 1355405 - RNA, 18 nt, Mycobacterium tuberculosis H37Rv
accugcgucggcccgcgg

SEQ ID NO: 1355406 - RNA, 18 nt, Mycobacterium tuberculosis H37Rv
accugcgaccaggcgcgg

SEQ ID NO: 1355407 - RNA, 14 nt, Mycobacterium tuberculosis H37Rv
accugcaugcccag

SEQ ID NO: 1355408 - RNA, 15 nt, Mycobacterium tuberculosis H37Rv
accugcaugcccaga

SEQ ID NO: 1355409 - RNA, 13 nt, Mycobacterium tuberculosis H37Rv
accugcaucacaa

SEQ ID NO: 1355410 - RNA, 18 nt, Mycobacterium tuberculosis H37Rv
accuuggugcccagcagg

SEQ ID NO: 1355411 - RNA, 18 nt, Mycobacterium tuberculosis H37Rv
accuugguguggggcggc

SEQ ID NO: 1355412 - RNA, 14 nt, Mycobacterium tuberculosis H37Rv
accuuggucgccaa

SEQ ID NO: 1355413 - RNA, 22 nt, Mycobacterium tuberculosis H37Rv
accuugcgguucggacacacag

SEQ ID NO: 1355414 - RNA, 16 nt, Mycobacterium tuberculosis H37Rv
accuugaccgggcagg

SEQ ID NO: 1355415 - RNA, 20 nt, Mycobacterium tuberculosis H37Rv
accuugaccgggcagguagc

SEQ ID NO: 1355416 - RNA, 15 nt, Mycobacterium tuberculosis H37Rv
accuugaugccauac

SEQ ID NO: 1355417 - RNA, 16 nt, Mycobacterium tuberculosis H37Rv
accuugaucgagcagg

SEQ ID NO: 1355418 - RNA, 16 nt, Mycobacterium tuberculosis H37Rv
acgaaaucgucgggua

SEQ ID NO: 1355419 - RNA, 19 nt, Mycobacterium tuberculosis H37Rv
acgaaaugcacgccgggca

SEQ ID NO: 1355420 - RNA, 17 nt, Mycobacterium tuberculosis H37Rv
acgacgacaagugcccg

SEQ ID NO: 1355421 - RNA, 17 nt, Mycobacterium tuberculosis H37Rv
acgacgacaccgcgcag

SEQ ID NO: 1355422 - RNA, 13 nt, Mycobacterium tuberculosis H37Rv
acgaccccggcgg

SEQ ID NO: 1355423 - RNA, 14 nt, Mycobacterium tuberculosis H37Rv
acgacccagcaugg

SEQ ID NO: 1355424 - RNA, 23 nt, Mycobacterium tuberculosis H37Rv
acgaccccacccuaaucguuccg

SEQ ID NO: 1355425 - RNA, 23 nt, Mycobacterium tuberculosis H37Rv
acgacccgggaaggaaccgggca

SEQ ID NO: 1355426 - RNA, 17 nt, Mycobacterium tuberculosis H37Rv
acgaccgcgcaacaccu

SEQ ID NO: 1355427 - RNA, 11 nt, Mycobacterium tuberculosis H37Rv
acgacauuggu

SEQ ID NO: 1355428 - RNA, 19 nt, Mycobacterium tuberculosis H37Rv
acgacauuggugcugacau

SEQ ID NO: 1355429 - RNA, 16 nt, Mycobacterium tuberculosis H37Rv
acgacaugggcaggcc

SEQ ID NO: 1355430 - RNA, 20 nt, Mycobacterium tuberculosis H37Rv
acgacaugaccgacaggugc

SEQ ID NO: 1355431 - RNA, 12 nt, Mycobacterium tuberculosis H37Rv
acgaccagcaga

SEQ ID NO: 1355432 - RNA, 14 nt, Mycobacterium tuberculosis H37Rv
acgaccacaccacg

SEQ ID NO: 1355433 - RNA, 18 nt, Mycobacterium tuberculosis H37Rv
acgacugugcgccgcagc

SEQ ID NO: 1355434 - RNA, 18 nt, Mycobacterium tuberculosis H37Rv
acgagcacacaacaccca

SEQ ID NO: 1355435 - RNA, 19 nt, Mycobacterium tuberculosis H37Rv
acgagauacggccaccagg

SEQ ID NO: 1355436 - RNA, 19 nt, Mycobacterium tuberculosis H37Rv
acgacugaucaagugccag

SEQ ID NO: 1355437 - RNA, 12 nt, Mycobacterium tuberculosis H37Rv
acgacgccaccu

SEQ ID NO: 1355438 - RNA, 13 nt, Mycobacterium tuberculosis H37Rv
acgacgucggccg

SEQ ID NO: 1355439 - RNA, 22 nt, Mycobacterium tuberculosis H37Rv
acgacgucggcguuaccgaccu

SEQ ID NO: 1355440 - RNA, 21 nt, Mycobacterium tuberculosis H37Rv
acgacuccggcaagcacaccg

SEQ ID NO: 1355441 - RNA, 12 nt, Mycobacterium tuberculosis H37Rv
acgaaugcagca

SEQ ID NO: 1355442 - RNA, 13 nt, Mycobacterium tuberculosis H37Rv
acgaauggggcca

SEQ ID NO: 1355443 - RNA, 15 nt, Mycobacterium tuberculosis H37Rv
acgacaacacccacg

SEQ ID NO: 1355444 - RNA, 16 nt, Mycobacterium tuberculosis H37Rv
acgacaagugcccggc

SEQ ID NO: 1355445 - RNA, 20 nt, Mycobacterium tuberculosis H37Rv
acgacaagguguggugacag

SEQ ID NO: 1355446 - RNA, 14 nt, Mycobacterium tuberculosis H37Rv
acgacaccagagcg

SEQ ID NO: 1355447 - RNA, 22 nt, Mycobacterium tuberculosis H37Rv
acgaagucgaacggcuuggcgu

SEQ ID NO: 1355448 - RNA, 19 nt, Mycobacterium tuberculosis H37Rv
acgaagggaaggacgcgca

SEQ ID NO: 1355449 - RNA, 19 nt, Mycobacterium tuberculosis H37Rv
acgaagacuugcaucaaaa

SEQ ID NO: 1355450 - RNA, 22 nt, Mycobacterium tuberculosis H37Rv
acgaagaucgcgugccacagca

SEQ ID NO: 1355451 - RNA, 17 nt, Mycobacterium tuberculosis H37Rv
acgaagcagacgaagua

SEQ ID NO: 1355452 - RNA, 19 nt, Mycobacterium tuberculosis H37Rv
acgaacugcagccauucuu

SEQ ID NO: 1355453 - RNA, 12 nt, Mycobacterium tuberculosis H37Rv
acgaacuggucu

SEQ ID NO: 1355454 - RNA, 22 nt, Mycobacterium tuberculosis H37Rv
acgaacugugcuauggccgcac

SEQ ID NO: 1355455 - RNA, 15 nt, Mycobacterium tuberculosis H37Rv
acgaaccgcucagcg

SEQ ID NO: 1355456 - RNA, 20 nt, Mycobacterium tuberculosis H37Rv
acgaaccgggacaaccgcgc

SEQ ID NO: 1355457 - RNA, 12 nt, Mycobacterium tuberculosis H37Rv
acgaacaccccg

SEQ ID NO: 1355458 - RNA, 18 nt, Mycobacterium tuberculosis H37Rv
acgaacaguugcggcugg

SEQ ID NO: 1355459 - RNA, 18 nt, Mycobacterium tuberculosis H37Rv
acgaacaccccgggcgcc

SEQ ID NO: 1355460 - RNA, 20 nt, Mycobacterium tuberculosis H37Rv
acgauugcugcggcuuucag

SEQ ID NO: 1355461 - RNA, 13 nt, Mycobacterium tuberculosis H37Rv
acgcaacaucgga

SEQ ID NO: 1355462 - RNA, 15 nt, Mycobacterium tuberculosis H37Rv
acgaugaucccaagc

SEQ ID NO: 1355463 - RNA, 21 nt, Mycobacterium tuberculosis H37Rv
acgaugacguugacgucgguc

SEQ ID NO: 1355464 - RNA, 17 nt, Mycobacterium tuberculosis H37Rv
acgaugacggugggguc

SEQ ID NO: 1355465 - RNA, 18 nt, Mycobacterium tuberculosis H37Rv
acgaugaccaugaugacc

SEQ ID NO: 1355466 - RNA, 15 nt, Mycobacterium tuberculosis H37Rv
acgaucgugccggga

SEQ ID NO: 1355467 - RNA, 17 nt, Mycobacterium tuberculosis H37Rv
acgaucggcggcgcgcc

SEQ ID NO: 1355468 - RNA, 14 nt, Mycobacterium tuberculosis H37Rv
acgaucugcagcac

SEQ ID NO: 1355469 - RNA, 12 nt, Mycobacterium tuberculosis H37Rv
acgaugucaccc

SEQ ID NO: 1355470 - RNA, 13 nt, Mycobacterium tuberculosis H37Rv
acgaugugccagg

SEQ ID NO: 1355471 - RNA, 16 nt, Mycobacterium tuberculosis H37Rv
acgaugugccaggugc

SEQ ID NO: 1355472 - RNA, 15 nt, Mycobacterium tuberculosis H37Rv
acgauggcggccacc

SEQ ID NO: 1355473 - RNA, 14 nt, Mycobacterium tuberculosis H37Rv
acgauggccggguc

SEQ ID NO: 1355474 - RNA, 22 nt, Mycobacterium tuberculosis H37Rv
acgaugcccuucugacuaucuc

SEQ ID NO: 1355475 - RNA, 13 nt, Mycobacterium tuberculosis H37Rv
acgaugcccuucu

SEQ ID NO: 1355476 - RNA, 22 nt, Mycobacterium tuberculosis H37Rv
acgaugccggcaagccugcgcu

SEQ ID NO: 1355477 - RNA, 14 nt, Mycobacterium tuberculosis H37Rv
acgagguagcgcgc

SEQ ID NO: 1355478 - RNA, 15 nt, Mycobacterium tuberculosis H37Rv
acgagguagcgcgca

SEQ ID NO: 1355479 - RNA, 16 nt, Mycobacterium tuberculosis H37Rv
acgagggccagcagcc

SEQ ID NO: 1355480 - RNA, 23 nt, Mycobacterium tuberculosis H37Rv
acgagcgucagauccggccguug

SEQ ID NO: 1355481 - RNA, 21 nt, Mycobacterium tuberculosis H37Rv
acgagcagauggugaacgugc

SEQ ID NO: 1355482 - RNA, 16 nt, Mycobacterium tuberculosis H37Rv
acgagccagaggugga

SEQ ID NO: 1355483 - RNA, 15 nt, Mycobacterium tuberculosis H37Rv
acgagcggcuucagc

SEQ ID NO: 1355484 - RNA, 17 nt, Mycobacterium tuberculosis H37Rv
acgagcuuccacgccgg

SEQ ID NO: 1355485 - RNA, 21 nt, Mycobacterium tuberculosis H37Rv
acgagucgccgcgggcagcga

SEQ ID NO: 1355486 - RNA, 19 nt, Mycobacterium tuberculosis H37Rv
acgaguccguggagcgggg

SEQ ID NO: 1355487 - RNA, 18 nt, Mycobacterium tuberculosis H37Rv
acgaucaagagguccuug

SEQ ID NO: 1355488 - RNA, 17 nt, Mycobacterium tuberculosis H37Rv
acgaucagcgaguagcc

SEQ ID NO: 1355489 - RNA, 23 nt, Mycobacterium tuberculosis H37Rv
acgaucagggugucgaagagcag

SEQ ID NO: 1355490 - RNA, 12 nt, Mycobacterium tuberculosis H37Rv
acgaucauuccu

SEQ ID NO: 1355491 - RNA, 20 nt, Mycobacterium tuberculosis H37Rv
acaugguccgaccagcggcc

SEQ ID NO: 1355492 - RNA, 15 nt, Mycobacterium tuberculosis H37Rv
acauggcccggaggc

SEQ ID NO: 1355493 - RNA, 21 nt, Mycobacterium tuberculosis H37Rv
acauggcggugcgcagcuugg

SEQ ID NO: 1355494 - RNA, 15 nt, Mycobacterium tuberculosis H37Rv
acaugggugaugcaa

SEQ ID NO: 1355495 - RNA, 16 nt, Mycobacterium tuberculosis H37Rv
acaugugggugaacac

SEQ ID NO: 1355496 - RNA, 22 nt, Mycobacterium tuberculosis H37Rv
acauuuuuguuguuauuuuugg

SEQ ID NO: 1355497 - RNA, 17 nt, Mycobacterium tuberculosis H37Rv
accaacauacagcaauc

SEQ ID NO: 1355498 - RNA, 13 nt, Mycobacterium tuberculosis H37Rv
accaacgcgggaa

SEQ ID NO: 1355499 - RNA, 18 nt, Mycobacterium tuberculosis H37Rv
accaacgucgacuucagc

SEQ ID NO: 1355500 - RNA, 19 nt, Mycobacterium tuberculosis H37Rv
accaagcucggccagcacg

SEQ ID NO: 1355501 - RNA, 17 nt, Mycobacterium tuberculosis H37Rv
accaagcucggccagca

SEQ ID NO: 1355502 - RNA, 15 nt, Mycobacterium tuberculosis H37Rv
accaacuguggugga

SEQ ID NO: 1355503 - RNA, 21 nt, Mycobacterium tuberculosis H37Rv
accaagucaugcccacgcugc

SEQ ID NO: 1355504 - RNA, 18 nt, Mycobacterium tuberculosis H37Rv
accaagguguccagcacc

SEQ ID NO: 1355505 - RNA, 21 nt, Mycobacterium tuberculosis H37Rv
accaaguugaccuucaccugg

SEQ ID NO: 1355506 - RNA, 22 nt, Mycobacterium tuberculosis H37Rv
accacauuggcgaucagcagcc

SEQ ID NO: 1355507 - RNA, 13 nt, Mycobacterium tuberculosis H37Rv
accagaacgccag

SEQ ID NO: 1355508 - RNA, 13 nt, Mycobacterium tuberculosis H37Rv
accagaagcagug

SEQ ID NO: 1355509 - RNA, 15 nt, Mycobacterium tuberculosis H37Rv
accacugcgcccgcc

SEQ ID NO: 1355510 - RNA, 14 nt, Mycobacterium tuberculosis H37Rv
accagcaggcggcu

SEQ ID NO: 1355511 - RNA, 19 nt, Mycobacterium tuberculosis H37Rv
accagcaucguggccgcac

SEQ ID NO: 1355512 - RNA, 12 nt, Mycobacterium tuberculosis H37Rv
accagccagccu

SEQ ID NO: 1355513 - RNA, 15 nt, Mycobacterium tuberculosis H37Rv
accagccagcgagga

SEQ ID NO: 1355514 - RNA, 19 nt, Mycobacterium tuberculosis H37Rv
accagcauggcuuuugcgc

SEQ ID NO: 1355515 - RNA, 14 nt, Mycobacterium tuberculosis H37Rv
accagccaccacca

SEQ ID NO: 1355516 - RNA, 23 nt, Mycobacterium tuberculosis H37Rv
accagccuuuccggccgccugcc

SEQ ID NO: 1355517 - RNA, 20 nt, Mycobacterium tuberculosis H37Rv
accagaucaacaucaucacu

SEQ ID NO: 1355518 - RNA, 22 nt, Mycobacterium tuberculosis H37Rv
accagaucaacaucaucacugu

SEQ ID NO: 1355519 - RNA, 24 nt, Mycobacterium tuberculosis H37Rv
accagaggcgugucgacuccgauc

SEQ ID NO: 1355520 - RNA, 19 nt, Mycobacterium tuberculosis H37Rv
accagagucaacaucagca

SEQ ID NO: 1355521 - RNA, 13 nt, Mycobacterium tuberculosis H37Rv
accaccaccgccg

SEQ ID NO: 1355522 - RNA, 22 nt, Mycobacterium tuberculosis H37Rv
accaccacguggcccuccucgg

SEQ ID NO: 1355523 - RNA, 14 nt, Mycobacterium tuberculosis H37Rv
accaccacggccag

SEQ ID NO: 1355524 - RNA, 15 nt, Mycobacterium tuberculosis H37Rv
accacccccggcagg

SEQ ID NO: 1355525 - RNA, 20 nt, Mycobacterium tuberculosis H37Rv
accacccggcgcgaauuccu

SEQ ID NO: 1355526 - RNA, 19 nt, Mycobacterium tuberculosis H37Rv
accacccgguccugcucgc

SEQ ID NO: 1355527 - RNA, 15 nt, Mycobacterium tuberculosis H37Rv
accacccgccgcagc

SEQ ID NO: 1355528 - RNA, 22 nt, Mycobacterium tuberculosis H37Rv
accacccgcacuccaagucaca

SEQ ID NO: 1355529 - RNA, 14 nt, Mycobacterium tuberculosis H37Rv
accaccgcccacag

SEQ ID NO: 1355530 - RNA, 18 nt, Mycobacterium tuberculosis H37Rv
accaccgcauaacgccag

SEQ ID NO: 1355531 - RNA, 19 nt, Mycobacterium tuberculosis H37Rv
accaccgcauaacgccagu

SEQ ID NO: 1355532 - RNA, 17 nt, Mycobacterium tuberculosis H37Rv
accaccggaaccaccag

SEQ ID NO: 1355533 - RNA, 22 nt, Mycobacterium tuberculosis H37Rv
accaccgcugcgaagagcccgu

SEQ ID NO: 1355534 - RNA, 13 nt, Mycobacterium tuberculosis H37Rv
accaccgcucgcc

SEQ ID NO: 1355535 - RNA, 19 nt, Mycobacterium tuberculosis H37Rv
accaccgcucgucguccgg

SEQ ID NO: 1355536 - RNA, 22 nt, Mycobacterium tuberculosis H37Rv
accaccgcugagccggugcacu

SEQ ID NO: 1355537 - RNA, 15 nt, Mycobacterium tuberculosis H37Rv
accaccggcaccgcu

SEQ ID NO: 1355538 - RNA, 14 nt, Mycobacterium tuberculosis H37Rv
accaccgccgaagc

SEQ ID NO: 1355539 - RNA, 15 nt, Mycobacterium tuberculosis H37Rv
accaccgccggcccg

SEQ ID NO: 1355540 - RNA, 24 nt, Mycobacterium tuberculosis H37Rv
accaccgccggugccgccaucgcc

SEQ ID NO: 1355541 - RNA, 22 nt, Mycobacterium tuberculosis H37Rv
accaccgccgccggcaccgccg

SEQ ID NO: 1355542 - RNA, 11 nt, Mycobacterium tuberculosis H37Rv
accaccgccug

SEQ ID NO: 1355543 - RNA, 18 nt, Mycobacterium tuberculosis H37Rv
accaccgcggcggcggcc

SEQ ID NO: 1355544 - RNA, 16 nt, Mycobacterium tuberculosis H37Rv
accacggcguggcgcc

SEQ ID NO: 1355545 - RNA, 19 nt, Mycobacterium tuberculosis H37Rv
accacggcguggcgccgga

SEQ ID NO: 1355546 - RNA, 20 nt, Mycobacterium tuberculosis H37Rv
accacggcggcaucaccugg

SEQ ID NO: 1355547 - RNA, 13 nt, Mycobacterium tuberculosis H37Rv
accacgagcagcc

SEQ ID NO: 1355548 - RNA, 16 nt, Mycobacterium tuberculosis H37Rv
accacgacgucgguga

SEQ ID NO: 1355549 - RNA, 13 nt, Mycobacterium tuberculosis H37Rv
accacgacgugga

SEQ ID NO: 1355550 - RNA, 21 nt, Mycobacterium tuberculosis H37Rv
accacgacguucgacgacagc

SEQ ID NO: 1355551 - RNA, 23 nt, Mycobacterium tuberculosis H37Rv
accacgagcguagcgaccucgcc

SEQ ID NO: 1355552 - RNA, 14 nt, Mycobacterium tuberculosis H37Rv
accacgauggcggc

SEQ ID NO: 1355553 - RNA, 18 nt, Mycobacterium tuberculosis H37Rv
accacgaucgcagugggc

SEQ ID NO: 1355554 - RNA, 17 nt, Mycobacterium tuberculosis H37Rv
accacgaucgcgagccc

SEQ ID NO: 1355555 - RNA, 14 nt, Mycobacterium tuberculosis H37Rv
accagggcagcggc

SEQ ID NO: 1355556 - RNA, 16 nt, Mycobacterium tuberculosis H37Rv
accaggcggccgcguc

SEQ ID NO: 1355557 - RNA, 23 nt, Mycobacterium tuberculosis H37Rv
accagggccgccgcugccgccug

SEQ ID NO: 1355558 - RNA, 16 nt, Mycobacterium tuberculosis H37Rv
accaggguggcaucga

SEQ ID NO: 1355559 - RNA, 18 nt, Mycobacterium tuberculosis H37Rv
accaggguguauggccac

SEQ ID NO: 1355560 - RNA, 23 nt, Mycobacterium tuberculosis H37Rv
accagggugacggaguuggcccg

SEQ ID NO: 1355561 - RNA, 20 nt, Mycobacterium tuberculosis H37Rv
accaggggucgcugugcagc

SEQ ID NO: 1355562 - RNA, 18 nt, Mycobacterium tuberculosis H37Rv
accaggucgauaagggcu

SEQ ID NO: 1355563 - RNA, 20 nt, Mycobacterium tuberculosis H37Rv
accagguccaguaccuuggc

SEQ ID NO: 1355564 - RNA, 18 nt, Mycobacterium tuberculosis H37Rv
accagguaaucaccuggc

SEQ ID NO: 1355565 - RNA, 18 nt, Mycobacterium tuberculosis H37Rv
accagguggccaggccgu

SEQ ID NO: 1355566 - RNA, 16 nt, Mycobacterium tuberculosis H37Rv
accaggugccaggaug

SEQ ID NO: 1355567 - RNA, 21 nt, Mycobacterium tuberculosis H37Rv
accagguguccccgcccggcc

SEQ ID NO: 1355568 - RNA, 19 nt, Mycobacterium tuberculosis H37Rv
accaggucgugcccgggac

SEQ ID NO: 1355569 - RNA, 21 nt, Mycobacterium tuberculosis H37Rv
accagguugccguggcugaaa

SEQ ID NO: 1355570 - RNA, 16 nt, Mycobacterium tuberculosis H37Rv
accagcgaguugagca

SEQ ID NO: 1355571 - RNA, 22 nt, Mycobacterium tuberculosis H37Rv
accagcgaaaugcccaucacca

SEQ ID NO: 1355572 - RNA, 20 nt, Mycobacterium tuberculosis H37Rv
accagccuuaugcagugaca

SEQ ID NO: 1355573 - RNA, 17 nt, Mycobacterium tuberculosis H37Rv
accagcgaauccagccg

SEQ ID NO: 1355574 - RNA, 18 nt, Mycobacterium tuberculosis H37Rv
accagcgcccggcccgcc

SEQ ID NO: 1355575 - RNA, 16 nt, Mycobacterium tuberculosis H37Rv
accagcgccccggcgc

SEQ ID NO: 1355576 - RNA, 21 nt, Mycobacterium tuberculosis H37Rv
accagcgccgauaccagccaa

SEQ ID NO: 1355577 - RNA, 14 nt, Mycobacterium tuberculosis H37Rv
accagcgcgagccc

SEQ ID NO: 1355578 - RNA, 20 nt, Mycobacterium tuberculosis H37Rv
accagcgcaucggccagcag

SEQ ID NO: 1355579 - RNA, 17 nt, Mycobacterium tuberculosis H37Rv
accagcgcuccagcacc

SEQ ID NO: 1355580 - RNA, 20 nt, Mycobacterium tuberculosis H37Rv
accaggccaacggcgcugcc

SEQ ID NO: 1355581 - RNA, 20 nt, Mycobacterium tuberculosis H37Rv
accaggccgagccgcccgcc

SEQ ID NO: 1355582 - RNA, 15 nt, Mycobacterium tuberculosis H37Rv
accaggccgcgcgca

SEQ ID NO: 1355583 - RNA, 16 nt, Mycobacterium tuberculosis H37Rv
accaggccguccucgg

SEQ ID NO: 1355584 - RNA, 20 nt, Mycobacterium tuberculosis H37Rv
accaggccguccucggucag

SEQ ID NO: 1355585 - RNA, 16 nt, Mycobacterium tuberculosis H37Rv
accaggcgagccgcca

SEQ ID NO: 1355586 - RNA, 21 nt, Mycobacterium tuberculosis H37Rv
accaguguggcgaugaccacg

SEQ ID NO: 1355587 - RNA, 20 nt, Mycobacterium tuberculosis H37Rv
accaguaauacugccguucg

SEQ ID NO: 1355588 - RNA, 13 nt, Mycobacterium tuberculosis H37Rv
accagucgaagaa

SEQ ID NO: 1355589 - RNA, 18 nt, Mycobacterium tuberculosis H37Rv
accauacccgcgcgcacc

SEQ ID NO: 1355590 - RNA, 14 nt, Mycobacterium tuberculosis H37Rv
acccagaccggcuc

SEQ ID NO: 1355591 - RNA, 17 nt, Mycobacterium tuberculosis H37Rv
acccagacaccggcuau

SEQ ID NO: 1355592 - RNA, 15 nt, Mycobacterium tuberculosis H37Rv
acccagcgcagcagc

SEQ ID NO: 1355593 - RNA, 16 nt, Mycobacterium tuberculosis H37Rv
acccagcgcagcagcg

SEQ ID NO: 1355594 - RNA, 14 nt, Mycobacterium tuberculosis H37Rv
acccagccgcagcc

SEQ ID NO: 1355595 - RNA, 15 nt, Mycobacterium tuberculosis H37Rv
acccagcagcggcac

SEQ ID NO: 1355596 - RNA, 17 nt, Mycobacterium tuberculosis H37Rv
accccaccacagacgac

SEQ ID NO: 1355597 - RNA, 16 nt, Mycobacterium tuberculosis H37Rv
accccaaguccagcag

SEQ ID NO: 1355598 - RNA, 22 nt, Mycobacterium tuberculosis H37Rv
acccagcgccgacccaacccga

SEQ ID NO: 1355599 - RNA, 14 nt, Mycobacterium tuberculosis H37Rv
acccagcgcagcag

SEQ ID NO: 1355600 - RNA, 19 nt, Mycobacterium tuberculosis H37Rv
acccagcgguaucccccag

SEQ ID NO: 1355601 - RNA, 21 nt, Mycobacterium tuberculosis H37Rv
acccagcgguaucccccagcc

SEQ ID NO: 1355602 - RNA, 23 nt, Mycobacterium tuberculosis H37Rv
acccagcgguaucccccagccgc

SEQ ID NO: 1355603 - RNA, 16 nt, Mycobacterium tuberculosis H37Rv
acccagcgugcccgcc

SEQ ID NO: 1355604 - RNA, 19 nt, Mycobacterium tuberculosis H37Rv
acccagcgugcccgccacc

SEQ ID NO: 1355605 - RNA, 16 nt, Mycobacterium tuberculosis H37Rv
accccagcggccaccg

SEQ ID NO: 1355606 - RNA, 15 nt, Mycobacterium tuberculosis H37Rv
accccagcggccacc

SEQ ID NO: 1355607 - RNA, 15 nt, Mycobacterium tuberculosis H37Rv
accccagccggcagc

SEQ ID NO: 1355608 - RNA, 18 nt, Mycobacterium tuberculosis H37Rv
accccagccggcagcagc

SEQ ID NO: 1355609 - RNA, 13 nt, Mycobacterium tuberculosis H37Rv
accccacggccag

SEQ ID NO: 1355610 - RNA, 15 nt, Mycobacterium tuberculosis H37Rv
accccauggccaccg

SEQ ID NO: 1355611 - RNA, 17 nt, Mycobacterium tuberculosis H37Rv
accccauggccagcgcu

SEQ ID NO: 1355612 - RNA, 21 nt, Mycobacterium tuberculosis H37Rv
accccaucagaaugccuggcc

SEQ ID NO: 1355613 - RNA, 19 nt, Mycobacterium tuberculosis H37Rv
accccagucggccaagcug

SEQ ID NO: 1355614 - RNA, 23 nt, Mycobacterium tuberculosis H37Rv
acccccgauggcgucgccggccc

SEQ ID NO: 1355615 - RNA, 16 nt, Mycobacterium tuberculosis H37Rv
accccccgggcccgcc

SEQ ID NO: 1355616 - RNA, 20 nt, Mycobacterium tuberculosis H37Rv
accccccauagcaagaaccg

SEQ ID NO: 1355617 - RNA, 17 nt, Mycobacterium tuberculosis H37Rv
acccccagcaaaggggu

SEQ ID NO: 1355618 - RNA, 17 nt, Mycobacterium tuberculosis H37Rv
accccccccacccacca

SEQ ID NO: 1355619 - RNA, 16 nt, Mycobacterium tuberculosis H37Rv
accccgagccuugagc

SEQ ID NO: 1355620 - RNA, 19 nt, Mycobacterium tuberculosis H37Rv
acccccuuuacacccccaa

SEQ ID NO: 1355621 - RNA, 21 nt, Mycobacterium tuberculosis H37Rv
acccaauccggcgccagcagu

SEQ ID NO: 1355622 - RNA, 15 nt, Mycobacterium tuberculosis H37Rv
acccaaccgcgccac

SEQ ID NO: 1355623 - RNA, 14 nt, Mycobacterium tuberculosis H37Rv
acccaacacccaga

SEQ ID NO: 1355624 - RNA, 20 nt, Mycobacterium tuberculosis H37Rv
acccacaucagccgcaccag

SEQ ID NO: 1355625 - RNA, 16 nt, Mycobacterium tuberculosis H37Rv
acccacacccagcgug

SEQ ID NO: 1355626 - RNA, 20 nt, Mycobacterium tuberculosis H37Rv
acccaccagugcaucgauca

SEQ ID NO: 1355627 - RNA, 13 nt, Mycobacterium tuberculosis H37Rv
accaucaucucgg

SEQ ID NO: 1355628 - RNA, 15 nt, Mycobacterium tuberculosis H37Rv
acagccgguaggaca

SEQ ID NO: 1355629 - RNA, 15 nt, Mycobacterium tuberculosis H37Rv
acagccgcgcugcga

SEQ ID NO: 1355630 - RNA, 18 nt, Mycobacterium tuberculosis H37Rv
acagccccaucaccaccg

SEQ ID NO: 1355631 - RNA, 18 nt, Mycobacterium tuberculosis H37Rv
acagccccgcggccagca

SEQ ID NO: 1355632 - RNA, 15 nt, Mycobacterium tuberculosis H37Rv
acagccccagggugc

SEQ ID NO: 1355633 - RNA, 12 nt, Mycobacterium tuberculosis H37Rv
acagcgaacaga

SEQ ID NO: 1355634 - RNA, 13 nt, Mycobacterium tuberculosis H37Rv
acagcgagcacac

SEQ ID NO: 1355635 - RNA, 14 nt, Mycobacterium tuberculosis H37Rv
acagcgagcgguug

SEQ ID NO: 1355636 - RNA, 14 nt, Mycobacterium tuberculosis H37Rv
acagcgaaccgccg

SEQ ID NO: 1355637 - RNA, 18 nt, Mycobacterium tuberculosis H37Rv
acagcgcagccugcagcg

SEQ ID NO: 1355638 - RNA, 23 nt, Mycobacterium tuberculosis H37Rv
acagcgccuggccggaauacccg

SEQ ID NO: 1355639 - RNA, 16 nt, Mycobacterium tuberculosis H37Rv
acagcgcggcggucga

SEQ ID NO: 1355640 - RNA, 20 nt, Mycobacterium tuberculosis H37Rv
acagcgcgguguucgcggca

SEQ ID NO: 1355641 - RNA, 15 nt, Mycobacterium tuberculosis H37Rv
acagcgcgcgcucgg

SEQ ID NO: 1355642 - RNA, 20 nt, Mycobacterium tuberculosis H37Rv
acagcggguucaacgcgcgc

SEQ ID NO: 1355643 - RNA, 22 nt, Mycobacterium tuberculosis H37Rv
acagcggcggcgucgacggcuc

SEQ ID NO: 1355644 - RNA, 21 nt, Mycobacterium tuberculosis H37Rv
acagcgucucggaggcgacca

SEQ ID NO: 1355645 - RNA, 22 nt, Mycobacterium tuberculosis H37Rv
acagcuuggagaucgccgccgg

SEQ ID NO: 1355646 - RNA, 18 nt, Mycobacterium tuberculosis H37Rv
acagcuugcugcgcacca

SEQ ID NO: 1355647 - RNA, 16 nt, Mycobacterium tuberculosis H37Rv
acagcugggucggagu

SEQ ID NO: 1355648 - RNA, 15 nt, Mycobacterium tuberculosis H37Rv
acagcuguugauuga

SEQ ID NO: 1355649 - RNA, 15 nt, Mycobacterium tuberculosis H37Rv
acagcucgccuaguu

SEQ ID NO: 1355650 - RNA, 22 nt, Mycobacterium tuberculosis H37Rv
acagcucgccgugaccaggugc

SEQ ID NO: 1355651 - RNA, 19 nt, Mycobacterium tuberculosis H37Rv
acaggacaauggacaccaa

SEQ ID NO: 1355652 - RNA, 23 nt, Mycobacterium tuberculosis H37Rv
acaggccgaagcucacacuggcu

SEQ ID NO: 1355653 - RNA, 19 nt, Mycobacterium tuberculosis H37Rv
acaggcccgccagcagggc

SEQ ID NO: 1355654 - RNA, 20 nt, Mycobacterium tuberculosis H37Rv
acaggcauuuucacugugcc

SEQ ID NO: 1355655 - RNA, 18 nt, Mycobacterium tuberculosis H37Rv
acaggcaucggaggaacc

SEQ ID NO: 1355656 - RNA, 14 nt, Mycobacterium tuberculosis H37Rv
acagaugcauccag

SEQ ID NO: 1355657 - RNA, 14 nt, Mycobacterium tuberculosis H37Rv
acagaugccaccca

SEQ ID NO: 1355658 - RNA, 18 nt, Mycobacterium tuberculosis H37Rv
acagaucuugugccaggc

SEQ ID NO: 1355659 - RNA, 18 nt, Mycobacterium tuberculosis H37Rv
acagcacauccagcccug

SEQ ID NO: 1355660 - RNA, 20 nt, Mycobacterium tuberculosis H37Rv
acagcaauuugccguagaaa

SEQ ID NO: 1355661 - RNA, 19 nt, Mycobacterium tuberculosis H37Rv
acagaugugguaccagccc

SEQ ID NO: 1355662 - RNA, 13 nt, Mycobacterium tuberculosis H37Rv
acagccacgcaca

SEQ ID NO: 1355663 - RNA, 15 nt, Mycobacterium tuberculosis H37Rv
acagcaccguccucg

SEQ ID NO: 1355664 - RNA, 13 nt, Mycobacterium tuberculosis H37Rv
acagcacauccag

SEQ ID NO: 1355665 - RNA, 15 nt, Mycobacterium tuberculosis H37Rv
acagcacccacgccg

SEQ ID NO: 1355666 - RNA, 13 nt, Mycobacterium tuberculosis H37Rv
acacuugcaacuc

SEQ ID NO: 1355667 - RNA, 16 nt, Mycobacterium tuberculosis H37Rv
acacuguucccacagg

SEQ ID NO: 1355668 - RNA, 18 nt, Mycobacterium tuberculosis H37Rv
acacugguggugcccgga

SEQ ID NO: 1355669 - RNA, 19 nt, Mycobacterium tuberculosis H37Rv
acacugaguucggugcugu

SEQ ID NO: 1355670 - RNA, 15 nt, Mycobacterium tuberculosis H37Rv
acaucagcaggacca

SEQ ID NO: 1355671 - RNA, 23 nt, Mycobacterium tuberculosis H37Rv
acaucgaugucagugaucaccaa

SEQ ID NO: 1355672 - RNA, 14 nt, Mycobacterium tuberculosis H37Rv
acaucgaccaccuc

SEQ ID NO: 1355673 - RNA, 21 nt, Mycobacterium tuberculosis H37Rv
acauccaacgaccuccacgcc

SEQ ID NO: 1355674 - RNA, 16 nt, Mycobacterium tuberculosis H37Rv
acaugcuggagaaacc

SEQ ID NO: 1355675 - RNA, 15 nt, Mycobacterium tuberculosis H37Rv
acaugcucagucgcu

SEQ ID NO: 1355676 - RNA, 23 nt, Mycobacterium tuberculosis H37Rv
acaugcaucugaucaggccacac

SEQ ID NO: 1355677 - RNA, 13 nt, Mycobacterium tuberculosis H37Rv
acaugaccgacag

SEQ ID NO: 1355678 - RNA, 18 nt, Mycobacterium tuberculosis H37Rv
acaugaccgacaggugcu

SEQ ID NO: 1355679 - RNA, 19 nt, Mycobacterium tuberculosis H37Rv
acaucgcgggcgugccgac

SEQ ID NO: 1355680 - RNA, 12 nt, Mycobacterium tuberculosis H37Rv
acaucuggucac

SEQ ID NO: 1355681 - RNA, 13 nt, Mycobacterium tuberculosis H37Rv
acaguucgccgga

SEQ ID NO: 1355682 - RNA, 14 nt, Mycobacterium tuberculosis H37Rv
acaguguuguucgg

SEQ ID NO: 1355683 - RNA, 14 nt, Mycobacterium tuberculosis H37Rv
acagugucugccau

SEQ ID NO: 1355684 - RNA, 13 nt, Mycobacterium tuberculosis H37Rv
acagugccucgcg

SEQ ID NO: 1355685 - RNA, 13 nt, Mycobacterium tuberculosis H37Rv
acagugccaccug

SEQ ID NO: 1355686 - RNA, 19 nt, Mycobacterium tuberculosis H37Rv
acagugcgcaucauuugca

SEQ ID NO: 1355687 - RNA, 17 nt, Mycobacterium tuberculosis H37Rv
acagugacgccacgacc

SEQ ID NO: 1355688 - RNA, 20 nt, Mycobacterium tuberculosis H37Rv
acagucgaccggacacuccu

SEQ ID NO: 1355689 - RNA, 16 nt, Mycobacterium tuberculosis H37Rv
acagucgacaauuccc

SEQ ID NO: 1355690 - RNA, 19 nt, Mycobacterium tuberculosis H37Rv
acaguaggccuccgcugcc

SEQ ID NO: 1355691 - RNA, 21 nt, Mycobacterium tuberculosis H37Rv
acaggugccagaccagggcag

SEQ ID NO: 1355692 - RNA, 22 nt, Mycobacterium tuberculosis H37Rv
acaggugcaggucgugcuccca

SEQ ID NO: 1355693 - RNA, 16 nt, Mycobacterium tuberculosis H37Rv
acaggggccagcgcgc

SEQ ID NO: 1355694 - RNA, 23 nt, Mycobacterium tuberculosis H37Rv
acagguccugcgccgcacgccga

SEQ ID NO: 1355695 - RNA, 14 nt, Mycobacterium tuberculosis H37Rv
acagguccugcgcc

SEQ ID NO: 1355696 - RNA, 16 nt, Mycobacterium tuberculosis H37Rv
acaggucagcgcugcc

SEQ ID NO: 1355697 - RNA, 21 nt, Mycobacterium tuberculosis H37Rv
acagguaagcagccagcaaca

SEQ ID NO: 1355698 - RNA, 23 nt, Mycobacterium tuberculosis H37Rv
acaggcuugacugcacaccaccg

SEQ ID NO: 1355699 - RNA, 20 nt, Mycobacterium tuberculosis H37Rv
acaggcuugacugcacacca

SEQ ID NO: 1355700 - RNA, 20 nt, Mycobacterium tuberculosis H37Rv
acaggcuggcgauggccguc

SEQ ID NO: 1355701 - RNA, 16 nt, Mycobacterium tuberculosis H37Rv
acaggcugaagacgaa

SEQ ID NO: 1355702 - RNA, 13 nt, Mycobacterium tuberculosis H37Rv
aacaacuccagca

SEQ ID NO: 1355703 - RNA, 14 nt, Mycobacterium tuberculosis H37Rv
aacaacuccagcag

SEQ ID NO: 1355704 - RNA, 16 nt, Mycobacterium tuberculosis H37Rv
aacaacgucugcagcc

SEQ ID NO: 1355705 - RNA, 19 nt, Mycobacterium tuberculosis H37Rv
aacaacguucggcacaacc

SEQ ID NO: 1355706 - RNA, 20 nt, Mycobacterium tuberculosis H37Rv
aacaacgcuaacugcuuuuc

SEQ ID NO: 1355707 - RNA, 18 nt, Mycobacterium tuberculosis H37Rv
aacaacagccgcagccag

SEQ ID NO: 1355708 - RNA, 14 nt, Mycobacterium tuberculosis H37Rv
aacaacagcggcaa

SEQ ID NO: 1355709 - RNA, 23 nt, Mycobacterium tuberculosis H37Rv
aacaaccccgguugacucgcucc

SEQ ID NO: 1355710 - RNA, 21 nt, Mycobacterium tuberculosis H37Rv
aacaagguauagccggagcgc

SEQ ID NO: 1355711 - RNA, 21 nt, Mycobacterium tuberculosis H37Rv
aacaauucacgcaccacaaac

SEQ ID NO: 1355712 - RNA, 13 nt, Mycobacterium tuberculosis H37Rv
aacaccagcgcgu

SEQ ID NO: 1355713 - RNA, 19 nt, Mycobacterium tuberculosis H37Rv
aacaccagauggcucucgg

SEQ ID NO: 1355714 - RNA, 19 nt, Mycobacterium tuberculosis H37Rv
aacaccagaugcaccucgc

SEQ ID NO: 1355715 - RNA, 22 nt, Mycobacterium tuberculosis H37Rv
aacaccaaccagugcagcucga

SEQ ID NO: 1355716 - RNA, 18 nt, Mycobacterium tuberculosis H37Rv
aacaccaacgacagcgac

SEQ ID NO: 1355717 - RNA, 14 nt, Mycobacterium tuberculosis H37Rv
aacacaugcaucug

SEQ ID NO: 1355718 - RNA, 14 nt, Mycobacterium tuberculosis H37Rv
aacacgacagccag

SEQ ID NO: 1355719 - RNA, 14 nt, Mycobacterium tuberculosis H37Rv
aacacgaccucuug

SEQ ID NO: 1355720 - RNA, 19 nt, Mycobacterium tuberculosis H37Rv
aacaccgucggcagcagcg

SEQ ID NO: 1355721 - RNA, 20 nt, Mycobacterium tuberculosis H37Rv
aacaccgugcaccagcucac

SEQ ID NO: 1355722 - RNA, 22 nt, Mycobacterium tuberculosis H37Rv
aacaccgcccggcccggcucgg

SEQ ID NO: 1355723 - RNA, 14 nt, Mycobacterium tuberculosis H37Rv
aacaccccacacag

SEQ ID NO: 1355724 - RNA, 17 nt, Mycobacterium tuberculosis H37Rv
aacaccccgggcgccga

SEQ ID NO: 1355725 - RNA, 13 nt, Mycobacterium tuberculosis H37Rv
aacacccgcccgg

SEQ ID NO: 1355726 - RNA, 20 nt, Mycobacterium tuberculosis H37Rv
aacacccacgugcugccuuu

SEQ ID NO: 1355727 - RNA, 23 nt, Mycobacterium tuberculosis H37Rv
aacacguggauguguaggugggg

SEQ ID NO: 1355728 - RNA, 22 nt, Mycobacterium tuberculosis H37Rv
aacagcaugauccgcugggccg

SEQ ID NO: 1355729 - RNA, 15 nt, Mycobacterium tuberculosis H37Rv
aacagcaggccucca

SEQ ID NO: 1355730 - RNA, 13 nt, Mycobacterium tuberculosis H37Rv
aacagcaccagug

SEQ ID NO: 1355731 - RNA, 18 nt, Mycobacterium tuberculosis H37Rv
aacagcaacggcagcgug

SEQ ID NO: 1355732 - RNA, 14 nt, Mycobacterium tuberculosis H37Rv
aacagcaccgccgg

SEQ ID NO: 1355733 - RNA, 18 nt, Mycobacterium tuberculosis H37Rv
aacagcgacgccaugguc

SEQ ID NO: 1355734 - RNA, 16 nt, Mycobacterium tuberculosis H37Rv
aacagcgcgccggcgu

SEQ ID NO: 1355735 - RNA, 16 nt, Mycobacterium tuberculosis H37Rv
aacagcgaucgccgca

SEQ ID NO: 1355736 - RNA, 19 nt, Mycobacterium tuberculosis H37Rv
aacagcugcccgccagcgc

SEQ ID NO: 1355737 - RNA, 14 nt, Mycobacterium tuberculosis H37Rv
aacaggaucagcga

SEQ ID NO: 1355738 - RNA, 16 nt, Mycobacterium tuberculosis H37Rv
aacagucgcagccagg

SEQ ID NO: 1355739 - RNA, 17 nt, Mycobacterium tuberculosis H37Rv
aacaucaccucgaugcc

SEQ ID NO: 1355740 - RNA, 19 nt, Mycobacterium tuberculosis H37Rv
aacauccccgagcugucgg

SEQ ID NO: 1355741 - RNA, 20 nt, Mycobacterium tuberculosis H37Rv
aacaucuccucggcgaugcc

SEQ ID NO: 1355742 - RNA, 16 nt, Mycobacterium tuberculosis H37Rv
aacauccugggcaagu

SEQ ID NO: 1355743 - RNA, 14 nt, Mycobacterium tuberculosis H37Rv
aacaucgccagcgc

SEQ ID NO: 1355744 - RNA, 13 nt, Mycobacterium tuberculosis H37Rv
aacauccuaagaa

SEQ ID NO: 1355745 - RNA, 20 nt, Mycobacterium tuberculosis H37Rv
aacaugaguggcaaucccgc

SEQ ID NO: 1355746 - RNA, 15 nt, Mycobacterium tuberculosis H37Rv
aacauggccagcauc

SEQ ID NO: 1355747 - RNA, 19 nt, Mycobacterium tuberculosis H37Rv
aacauguccgcacgcucgg

SEQ ID NO: 1355748 - RNA, 20 nt, Mycobacterium tuberculosis H37Rv
aacauuccggcaccuccgcc

SEQ ID NO: 1355749 - RNA, 22 nt, Mycobacterium tuberculosis H37Rv
aaccagcggucggcgaccacca

SEQ ID NO: 1355750 - RNA, 19 nt, Mycobacterium tuberculosis H37Rv
aaccagcgcgucucguuga

SEQ ID NO: 1355751 - RNA, 22 nt, Mycobacterium tuberculosis H37Rv
aaccagcgaaaugcccaucacc

SEQ ID NO: 1355752 - RNA, 18 nt, Mycobacterium tuberculosis H37Rv
aaccagcgaccuagcagc

SEQ ID NO: 1355753 - RNA, 18 nt, Mycobacterium tuberculosis H37Rv
aaccaggcgagccgccac

SEQ ID NO: 1355754 - RNA, 13 nt, Mycobacterium tuberculosis H37Rv
aaccagcagcagg

SEQ ID NO: 1355755 - RNA, 20 nt, Mycobacterium tuberculosis H37Rv
aaccagccaccaccaggucg

SEQ ID NO: 1355756 - RNA, 21 nt, Mycobacterium tuberculosis H37Rv
aaccagccaccaccaggucgg

SEQ ID NO: 1355757 - RNA, 13 nt, Mycobacterium tuberculosis H37Rv
aaccaccagcacg

SEQ ID NO: 1355758 - RNA, 16 nt, Mycobacterium tuberculosis H37Rv
aaccacccgcaacaca

SEQ ID NO: 1355759 - RNA, 19 nt, Mycobacterium tuberculosis H37Rv
aaccacucgcucaggaaca

SEQ ID NO: 1355760 - RNA, 23 nt, Mycobacterium tuberculosis H37Rv
aaccacucgcucaggaacaauga

SEQ ID NO: 1355761 - RNA, 23 nt, Mycobacterium tuberculosis H37Rv
aacccaggucuuucgaauccccg

SEQ ID NO: 1355762 - RNA, 15 nt, Mycobacterium tuberculosis H37Rv
aacccagcaccacaa

SEQ ID NO: 1355763 - RNA, 20 nt, Mycobacterium tuberculosis H37Rv
aacccaaccgcgccaccucc

SEQ ID NO: 1355764 - RNA, 11 nt, Mycobacterium tuberculosis H37Rv
aaccaguccuc

SEQ ID NO: 1355765 - RNA, 14 nt, Mycobacterium tuberculosis H37Rv
aaccagucgaccca

SEQ ID NO: 1355766 - RNA, 22 nt, Mycobacterium tuberculosis H37Rv
aaccaguugacgaagaacaccu

SEQ ID NO: 1355767 - RNA, 22 nt, Mycobacterium tuberculosis H37Rv
aacccguauugccaaagcccga

SEQ ID NO: 1355768 - RNA, 15 nt, Mycobacterium tuberculosis H37Rv
aacccgucgagccgu

SEQ ID NO: 1355769 - RNA, 21 nt, Mycobacterium tuberculosis H37Rv
aacccgucgagccgugccucg

SEQ ID NO: 1355770 - RNA, 21 nt, Mycobacterium tuberculosis H37Rv
aacccguaggguggccgacga

SEQ ID NO: 1355771 - RNA, 13 nt, Mycobacterium tuberculosis H37Rv
aacccggugacca

SEQ ID NO: 1355772 - RNA, 19 nt, Mycobacterium tuberculosis H37Rv
aacccggugaccagcaacc

SEQ ID NO: 1355773 - RNA, 12 nt, Mycobacterium tuberculosis H37Rv
aacccggcggca

SEQ ID NO: 1355774 - RNA, 13 nt, Mycobacterium tuberculosis H37Rv
aacccggucggca

SEQ ID NO: 1355775 - RNA, 18 nt, Mycobacterium tuberculosis H37Rv
aacccggauacaacacag

SEQ ID NO: 1355776 - RNA, 18 nt, Mycobacterium tuberculosis H37Rv
aacccgaucucugcggcg

SEQ ID NO: 1355777 - RNA, 19 nt, Mycobacterium tuberculosis H37Rv
aaccccgaagaccuggccu

SEQ ID NO: 1355778 - RNA, 18 nt, Mycobacterium tuberculosis H37Rv
aaccccaaguccagcagc

SEQ ID NO: 1355779 - RNA, 22 nt, Mycobacterium tuberculosis H37Rv
aaccccacgcagaaguugaugg

SEQ ID NO: 1355780 - RNA, 17 nt, Mycobacterium tuberculosis H37Rv
aaccccaggcgcugccg

SEQ ID NO: 1355781 - RNA, 13 nt, Mycobacterium tuberculosis H37Rv
aacccccggggcg

SEQ ID NO: 1355782 - RNA, 23 nt, Mycobacterium tuberculosis H37Rv
aaccgaagccucggcaugcagcc

SEQ ID NO: 1355783 - RNA, 23 nt, Mycobacterium tuberculosis H37Rv
aacccuagggcggugccgccgga

SEQ ID NO: 1355784 - RNA, 19 nt, Mycobacterium tuberculosis H37Rv
aacccguuuugggugaucg

SEQ ID NO: 1355785 - RNA, 18 nt, Mycobacterium tuberculosis H37Rv
aacccucagccgcgccgg

SEQ ID NO: 1355786 - RNA, 12 nt, Mycobacterium tuberculosis H37Rv
aacccugcaccc

SEQ ID NO: 1355787 - RNA, 22 nt, Mycobacterium tuberculosis H37Rv
aacccugccacgcgugacucgg

SEQ ID NO: 1355788 - RNA, 12 nt, Mycobacterium tuberculosis H37Rv
aacccucgccac

SEQ ID NO: 1355789 - RNA, 16 nt, Mycobacterium tuberculosis H37Rv
aaccgcccgccaggcc

SEQ ID NO: 1355790 - RNA, 19 nt, Mycobacterium tuberculosis H37Rv
aaccgcguuaugccaggcg

SEQ ID NO: 1355791 - RNA, 17 nt, Mycobacterium tuberculosis H37Rv
aaccgcaccgucccagu

SEQ ID NO: 1355792 - RNA, 14 nt, Mycobacterium tuberculosis H37Rv
aaccgguagucgcc

SEQ ID NO: 1355793 - RNA, 22 nt, Mycobacterium tuberculosis H37Rv
aaccggcggcagcgaucggggc

SEQ ID NO: 1355794 - RNA, 20 nt, Mycobacterium tuberculosis H37Rv
aaccgggcagcaaaaaccag

SEQ ID NO: 1355795 - RNA, 19 nt, Mycobacterium tuberculosis H37Rv
aaccgggcaaaucaagcac

SEQ ID NO: 1355796 - RNA, 13 nt, Mycobacterium tuberculosis H37Rv
aaccgggccggcu

SEQ ID NO: 1355797 - RNA, 19 nt, Mycobacterium tuberculosis H37Rv
aaccggaccuggguggcgu

SEQ ID NO: 1355798 - RNA, 22 nt, Mycobacterium tuberculosis H37Rv
aaccggcauaacgaucccguga

SEQ ID NO: 1355799 - RNA, 19 nt, Mycobacterium tuberculosis H37Rv
aaccggcgcaguagccgac

SEQ ID NO: 1355800 - RNA, 23 nt, Mycobacterium tuberculosis H37Rv
aaccggcgguuuuggggugcuuu

SEQ ID NO: 1355801 - RNA, 17 nt, Mycobacterium tuberculosis H37Rv
aaccggcgugucgaggg

SEQ ID NO: 1355802 - RNA, 16 nt, Mycobacterium tuberculosis H37Rv
aacgacacgccgcucc

SEQ ID NO: 1355803 - RNA, 19 nt, Mycobacterium tuberculosis H37Rv
aaccucgacgcccgcccug

SEQ ID NO: 1355804 - RNA, 12 nt, Mycobacterium tuberculosis H37Rv
aaccucgccggu

SEQ ID NO: 1355805 - RNA, 20 nt, Mycobacterium tuberculosis H37Rv
aaccucaucgcggucgccac

SEQ ID NO: 1355806 - RNA, 15 nt, Mycobacterium tuberculosis H37Rv
aaccuggcggucccg

SEQ ID NO: 1355807 - RNA, 16 nt, Mycobacterium tuberculosis H37Rv
aaccugcgaccaggcg

SEQ ID NO: 1355808 - RNA, 19 nt, Mycobacterium tuberculosis H37Rv
aaccgucucggcgaccgac

SEQ ID NO: 1355809 - RNA, 15 nt, Mycobacterium tuberculosis H37Rv
aaccgugcugggcau

SEQ ID NO: 1355810 - RNA, 21 nt, Mycobacterium tuberculosis H37Rv
aaccgugagcaccagcagcac

SEQ ID NO: 1355811 - RNA, 15 nt, Mycobacterium tuberculosis H37Rv
aaccgguguagcagc

SEQ ID NO: 1355812 - RNA, 19 nt, Mycobacterium tuberculosis H37Rv
aaccguuugacgcgcucgc

SEQ ID NO: 1355813 - RNA, 22 nt, Mycobacterium tuberculosis H37Rv
aaccguugcugcgcagcggcau

SEQ ID NO: 1355814 - RNA, 15 nt, Mycobacterium tuberculosis H37Rv
aaccguguaggccau

SEQ ID NO: 1355815 - RNA, 14 nt, Mycobacterium tuberculosis H37Rv
aacgcagccagcgc

SEQ ID NO: 1355816 - RNA, 18 nt, Mycobacterium tuberculosis H37Rv
aacgcaggcagugagggu

SEQ ID NO: 1355817 - RNA, 19 nt, Mycobacterium tuberculosis H37Rv
aacgaugaugaugaccaca

SEQ ID NO: 1355818 - RNA, 13 nt, Mycobacterium tuberculosis H37Rv
aacgcaaagacag

SEQ ID NO: 1355819 - RNA, 15 nt, Mycobacterium tuberculosis H37Rv
aacgacuccuggcga

SEQ ID NO: 1355820 - RNA, 20 nt, Mycobacterium tuberculosis H37Rv
aacgacuguggcgccgccgg

SEQ ID NO: 1355821 - RNA, 21 nt, Mycobacterium tuberculosis H37Rv
aacgacuggguggugcucacc

SEQ ID NO: 1355822 - RNA, 18 nt, Mycobacterium tuberculosis H37Rv
aacgaucagucgucuuga

SEQ ID NO: 1355823 - RNA, 16 nt, Mycobacterium tuberculosis H37Rv
aacgaggucugcggcc

SEQ ID NO: 1355824 - RNA, 16 nt, Mycobacterium tuberculosis H37Rv
aacgaguaggcggcuc

SEQ ID NO: 1355825 - RNA, 18 nt, Mycobacterium tuberculosis H37Rv
aacgagucagugccaucu

SEQ ID NO: 1355826 - RNA, 21 nt, Mycobacterium tuberculosis H37Rv
aacgcgaccgcaucucgggcg

SEQ ID NO: 1355827 - RNA, 19 nt, Mycobacterium tuberculosis H37Rv
aacgccucgccggccgcca

SEQ ID NO: 1355828 - RNA, 22 nt, Mycobacterium tuberculosis H37Rv
aacgccugcucgucggccaccg

SEQ ID NO: 1355829 - RNA, 23 nt, Mycobacterium tuberculosis H37Rv
aacgccgucgucguagaacugca

SEQ ID NO: 1355830 - RNA, 18 nt, Mycobacterium tuberculosis H37Rv
aacgccggguucgccgga

SEQ ID NO: 1355831 - RNA, 22 nt, Mycobacterium tuberculosis H37Rv
aacgccgcccgcugggcucgcu

SEQ ID NO: 1355832 - RNA, 19 nt, Mycobacterium tuberculosis H37Rv
aacgccaccgucgcugccc

SEQ ID NO: 1355833 - RNA, 12 nt, Mycobacterium tuberculosis H37Rv
aacgccaaaaug

SEQ ID NO: 1355834 - RNA, 18 nt, Mycobacterium tuberculosis H37Rv
aacgcauacagcgcccgg

SEQ ID NO: 1355835 - RNA, 17 nt, Mycobacterium tuberculosis H37Rv
aacgccccggcgcggcc

SEQ ID NO: 1355836 - RNA, 13 nt, Mycobacterium tuberculosis H37Rv
aacgcccgcuuca

SEQ ID NO: 1355837 - RNA, 11 nt, Mycobacterium tuberculosis H37Rv
aacgcccggca

SEQ ID NO: 1355838 - RNA, 11 nt, Mycobacterium tuberculosis H37Rv
aacgcccggcu

SEQ ID NO: 1355839 - RNA, 17 nt, Mycobacterium tuberculosis H37Rv
aacgcccugacgguggu

SEQ ID NO: 1355840 - RNA, 12 nt, Mycobacterium tuberculosis H37Rv
aacgccagcagc

SEQ ID NO: 1355841 - RNA, 13 nt, Mycobacterium tuberculosis H37Rv
aacgccagcagcg

SEQ ID NO: 1355842 - RNA, 21 nt, Mycobacterium tuberculosis H37Rv
aacgcgcgcagccgggcaccg

SEQ ID NO: 1355843 - RNA, 15 nt, Mycobacterium tuberculosis H37Rv
aacgcggcaccacgu

SEQ ID NO: 1355844 - RNA, 22 nt, Mycobacterium tuberculosis H37Rv
aacgcggugggcacagccagua

SEQ ID NO: 1355845 - RNA, 21 nt, Mycobacterium tuberculosis H37Rv
aacgcgguaaagccccgcucc

SEQ ID NO: 1355846 - RNA, 16 nt, Mycobacterium tuberculosis H37Rv
aacgcggugggcacag

SEQ ID NO: 1355847 - RNA, 17 nt, Mycobacterium tuberculosis H37Rv
aacgcggugggcacagc

SEQ ID NO: 1355848 - RNA, 21 nt, Mycobacterium tuberculosis H37Rv
aacgcgugcugagucgguuca

SEQ ID NO: 1355849 - RNA, 17 nt, Mycobacterium tuberculosis H37Rv
aacggcacccugcggca

SEQ ID NO: 1355850 - RNA, 14 nt, Mycobacterium tuberculosis H37Rv
aacggcagcguggg

SEQ ID NO: 1355851 - RNA, 13 nt, Mycobacterium tuberculosis H37Rv
aacgcuuccagcg

SEQ ID NO: 1355852 - RNA, 18 nt, Mycobacterium tuberculosis H37Rv
aacgcugucccagcccgg

SEQ ID NO: 1355853 - RNA, 20 nt, Mycobacterium tuberculosis H37Rv
aacgcuggccacucacauug

SEQ ID NO: 1355854 - RNA, 23 nt, Mycobacterium tuberculosis H37Rv
aacggcuuggcugccuccaucaa

SEQ ID NO: 1355855 - RNA, 17 nt, Mycobacterium tuberculosis H37Rv
aacgggcaaaccauugc

SEQ ID NO: 1355856 - RNA, 22 nt, Mycobacterium tuberculosis H37Rv
aacgggccuucagcucaccacc

SEQ ID NO: 1355857 - RNA, 17 nt, Mycobacterium tuberculosis H37Rv
aacggcgguaagggcgg

SEQ ID NO: 1355858 - RNA, 18 nt, Mycobacterium tuberculosis H37Rv
aacggcgcgccgaccacc

SEQ ID NO: 1355859 - RNA, 18 nt, Mycobacterium tuberculosis H37Rv
aacgguacgccgccgcga

SEQ ID NO: 1355860 - RNA, 23 nt, Mycobacterium tuberculosis H37Rv
aacgggcuuccgacaugaaccgg

SEQ ID NO: 1355861 - RNA, 18 nt, Mycobacterium tuberculosis H37Rv
aacgggucggcgaccacc

SEQ ID NO: 1355862 - RNA, 15 nt, Mycobacterium tuberculosis H37Rv
aacuacccgccagca

SEQ ID NO: 1355863 - RNA, 13 nt, Mycobacterium tuberculosis H37Rv
aacuaacggcagc

SEQ ID NO: 1355864 - RNA, 18 nt, Mycobacterium tuberculosis H37Rv
aacuaacggcagccaccg

SEQ ID NO: 1355865 - RNA, 12 nt, Mycobacterium tuberculosis H37Rv
aacgucagugcc

SEQ ID NO: 1355866 - RNA, 19 nt, Mycobacterium tuberculosis H37Rv
aacgucagugccccgcagc

SEQ ID NO: 1355867 - RNA, 22 nt, Mycobacterium tuberculosis H37Rv
aacgucacguggucggccaccc

SEQ ID NO: 1355868 - RNA, 21 nt, Mycobacterium tuberculosis H37Rv
aacucacgcaggaaaaccccg

SEQ ID NO: 1355869 - RNA, 22 nt, Mycobacterium tuberculosis H37Rv
aacucaugcccgacgagucgcc

SEQ ID NO: 1355870 - RNA, 19 nt, Mycobacterium tuberculosis H37Rv
aacuccgcguugggcaccu

SEQ ID NO: 1355871 - RNA, 16 nt, Mycobacterium tuberculosis H37Rv
aacuccugcagcccgg

SEQ ID NO: 1355872 - RNA, 17 nt, Mycobacterium tuberculosis H37Rv
aacucguccagcagugc

SEQ ID NO: 1355873 - RNA, 15 nt, Mycobacterium tuberculosis H37Rv
aacucgucgauucgg

SEQ ID NO: 1355874 - RNA, 22 nt, Mycobacterium tuberculosis H37Rv
aacucgccgcuggcaaucccgc

SEQ ID NO: 1355875 - RNA, 15 nt, Mycobacterium tuberculosis H37Rv
aacucuucagcaagc

SEQ ID NO: 1355876 - RNA, 18 nt, Mycobacterium tuberculosis H37Rv
aacuguggaaggugauca

SEQ ID NO: 1355877 - RNA, 15 nt, Mycobacterium tuberculosis H37Rv
aacuguccggguggg

SEQ ID NO: 1355878 - RNA, 12 nt, Mycobacterium tuberculosis H37Rv
aacuggacuggg

SEQ ID NO: 1355879 - RNA, 21 nt, Mycobacterium tuberculosis H37Rv
aacuggaccggugccagcagu

SEQ ID NO: 1355880 - RNA, 20 nt, Mycobacterium tuberculosis H37Rv
aacugggcaccggcggucug

SEQ ID NO: 1355881 - RNA, 14 nt, Mycobacterium tuberculosis H37Rv
aacugggcggccug

SEQ ID NO: 1355882 - RNA, 17 nt, Mycobacterium tuberculosis H37Rv
aacuggcuugugcccaa

SEQ ID NO: 1355883 - RNA, 19 nt, Mycobacterium tuberculosis H37Rv
aacugaucgaccgccuccu

SEQ ID NO: 1355884 - RNA, 21 nt, Mycobacterium tuberculosis H37Rv
aacugaugaaccacggcaggc

SEQ ID NO: 1355885 - RNA, 23 nt, Mycobacterium tuberculosis H37Rv
aacugaauggcaccgaggccaag

SEQ ID NO: 1355886 - RNA, 15 nt, Mycobacterium tuberculosis H37Rv
aacugcgccagcaac

SEQ ID NO: 1355887 - RNA, 23 nt, Mycobacterium tuberculosis H37Rv
aacugcagguucuugaccagcag

SEQ ID NO: 1355888 - RNA, 15 nt, Mycobacterium tuberculosis H37Rv
aacugcagcauggcc

SEQ ID NO: 1355889 - RNA, 15 nt, Mycobacterium tuberculosis H37Rv
aacuugcugacgaau

SEQ ID NO: 1355890 - RNA, 20 nt, Mycobacterium tuberculosis H37Rv
aacuugacgaacucgccguc

SEQ ID NO: 1355891 - RNA, 18 nt, Mycobacterium tuberculosis H37Rv
aacuugagcuccucacgg

SEQ ID NO: 1355892 - RNA, 16 nt, Mycobacterium tuberculosis H37Rv
aacuucgacaacgcau

SEQ ID NO: 1355893 - RNA, 22 nt, Mycobacterium tuberculosis H37Rv
aacuucgacaacgcauccgaca

SEQ ID NO: 1355894 - RNA, 19 nt, Mycobacterium tuberculosis H37Rv
aagaaccugagcaccaaga

SEQ ID NO: 1355895 - RNA, 14 nt, Mycobacterium tuberculosis H37Rv
aagaacaugcucac

SEQ ID NO: 1355896 - RNA, 16 nt, Mycobacterium tuberculosis H37Rv
aagaagccgguguuga

SEQ ID NO: 1355897 - RNA, 18 nt, Mycobacterium tuberculosis H37Rv
aagaaacagguaagcagc

SEQ ID NO: 1355898 - RNA, 12 nt, Mycobacterium tuberculosis H37Rv
aauccagcgccg

SEQ ID NO: 1355899 - RNA, 19 nt, Mycobacterium tuberculosis H37Rv
aaucagggucugcgccgcc

SEQ ID NO: 1355900 - RNA, 12 nt, Mycobacterium tuberculosis H37Rv
aaucaucucccg

SEQ ID NO: 1355901 - RNA, 22 nt, Mycobacterium tuberculosis H37Rv
aauccgcgucgucgagucgaca

SEQ ID NO: 1355902 - RNA, 19 nt, Mycobacterium tuberculosis H37Rv
aauccggcauacaucgccu

SEQ ID NO: 1355903 - RNA, 15 nt, Mycobacterium tuberculosis H37Rv
aauccggucgaugac

SEQ ID NO: 1355904 - RNA, 17 nt, Mycobacterium tuberculosis H37Rv
aauccugcgcugcacca

SEQ ID NO: 1355905 - RNA, 16 nt, Mycobacterium tuberculosis H37Rv
aauccugcgcugcacc

SEQ ID NO: 1355906 - RNA, 22 nt, Mycobacterium tuberculosis H37Rv
aaucgcugaccgcguagaccag

SEQ ID NO: 1355907 - RNA, 15 nt, Mycobacterium tuberculosis H37Rv
aaucgccugccacag

SEQ ID NO: 1355908 - RNA, 18 nt, Mycobacterium tuberculosis H37Rv
aaucgcgucgagagaacg

SEQ ID NO: 1355909 - RNA, 16 nt, Mycobacterium tuberculosis H37Rv
aaucgcggagccagga

SEQ ID NO: 1355910 - RNA, 18 nt, Mycobacterium tuberculosis H37Rv
aaucgcggagccaggacg

SEQ ID NO: 1355911 - RNA, 17 nt, Mycobacterium tuberculosis H37Rv
aaucuuugguagucugc

SEQ ID NO: 1355912 - RNA, 14 nt, Mycobacterium tuberculosis H37Rv
aaugaccugcagcg

SEQ ID NO: 1355913 - RNA, 17 nt, Mycobacterium tuberculosis H37Rv
aaugacgauccagccca

SEQ ID NO: 1355914 - RNA, 18 nt, Mycobacterium tuberculosis H37Rv
aaugcaucgcggcggcgc

SEQ ID NO: 1355915 - RNA, 19 nt, Mycobacterium tuberculosis H37Rv
aaugcccuuggccagcagg

SEQ ID NO: 1355916 - RNA, 21 nt, Mycobacterium tuberculosis H37Rv
aaugccggugccgggcaccac

SEQ ID NO: 1355917 - RNA, 12 nt, Mycobacterium tuberculosis H37Rv
aaugccuggccc

SEQ ID NO: 1355918 - RNA, 19 nt, Mycobacterium tuberculosis H37Rv
aaugcgcuggcgccgccgg

SEQ ID NO: 1355919 - RNA, 13 nt, Mycobacterium tuberculosis H37Rv
aaugcgcgcuggg

SEQ ID NO: 1355920 - RNA, 15 nt, Mycobacterium tuberculosis H37Rv
aauggacaccaaccc

SEQ ID NO: 1355921 - RNA, 14 nt, Mycobacterium tuberculosis H37Rv
aauggaccagcgcc

SEQ ID NO: 1355922 - RNA, 13 nt, Mycobacterium tuberculosis H37Rv
aauggaaugaucg

SEQ ID NO: 1355923 - RNA, 13 nt, Mycobacterium tuberculosis H37Rv
aauggccagcacc

SEQ ID NO: 1355924 - RNA, 18 nt, Mycobacterium tuberculosis H37Rv
aauugugugcagcagcau

SEQ ID NO: 1355925 - RNA, 15 nt, Mycobacterium tuberculosis H37Rv
aauugcggccgcgcg

SEQ ID NO: 1355926 - RNA, 23 nt, Mycobacterium tuberculosis H37Rv
aauugcccaagcgcguuguuguc

SEQ ID NO: 1355927 - RNA, 21 nt, Mycobacterium tuberculosis H37Rv
aauugagccggcccugcucgc

SEQ ID NO: 1355928 - RNA, 18 nt, Mycobacterium tuberculosis H37Rv
aauucaacagcaccgcga

SEQ ID NO: 1355929 - RNA, 17 nt, Mycobacterium tuberculosis H37Rv
aauuccggugaucgcgg

SEQ ID NO: 1355930 - RNA, 16 nt, Mycobacterium tuberculosis H37Rv
aauuccguuaggcucc

SEQ ID NO: 1355931 - RNA, 14 nt, Mycobacterium tuberculosis H37Rv
aauuccggcucacc

SEQ ID NO: 1355932 - RNA, 22 nt, Mycobacterium tuberculosis H37Rv
aauuccucggauaacgucacac

SEQ ID NO: 1355933 - RNA, 21 nt, Mycobacterium tuberculosis H37Rv
aauucguacagugucugccau

SEQ ID NO: 1355934 - RNA, 15 nt, Mycobacterium tuberculosis H37Rv
aauucguagggaugc

SEQ ID NO: 1355935 - RNA, 13 nt, Mycobacterium tuberculosis H37Rv
aauuccagccagc

SEQ ID NO: 1355936 - RNA, 23 nt, Mycobacterium tuberculosis H37Rv
aauucaugccgguguugccgaag

SEQ ID NO: 1355937 - RNA, 15 nt, Mycobacterium tuberculosis H37Rv
aauucacgcaccaca

SEQ ID NO: 1355938 - RNA, 15 nt, Mycobacterium tuberculosis H37Rv
aauaacgcgggaucc

SEQ ID NO: 1355939 - RNA, 20 nt, Mycobacterium tuberculosis H37Rv
aauacgcugcuggucuugcc

SEQ ID NO: 1355940 - RNA, 15 nt, Mycobacterium tuberculosis H37Rv
aauacccgcuggccc

SEQ ID NO: 1355941 - RNA, 22 nt, Mycobacterium tuberculosis H37Rv
aauaggucgguccgcacugugc

SEQ ID NO: 1355942 - RNA, 21 nt, Mycobacterium tuberculosis H37Rv
aauagucuucuuucgccuccg

SEQ ID NO: 1355943 - RNA, 14 nt, Mycobacterium tuberculosis H37Rv
aauaugccgaugac

SEQ ID NO: 1355944 - RNA, 14 nt, Mycobacterium tuberculosis H37Rv
aauaucucgccgua

SEQ ID NO: 1355945 - RNA, 21 nt, Mycobacterium tuberculosis H37Rv
aagugcggugagauggcggug

SEQ ID NO: 1355946 - RNA, 20 nt, Mycobacterium tuberculosis H37Rv
aaguggugcccuugaagaaa

SEQ ID NO: 1355947 - RNA, 17 nt, Mycobacterium tuberculosis H37Rv
aagugccuuccucggca

SEQ ID NO: 1355948 - RNA, 21 nt, Mycobacterium tuberculosis H37Rv
aagucuggagugaggcugugc

SEQ ID NO: 1355949 - RNA, 24 nt, Mycobacterium tuberculosis H37Rv
aagucauucguagcuucccuccag

SEQ ID NO: 1355950 - RNA, 17 nt, Mycobacterium tuberculosis H37Rv
aagucaacaccgcggcc

SEQ ID NO: 1355951 - RNA, 23 nt, Mycobacterium tuberculosis H37Rv
aagucaaacgccgucacggcagu

SEQ ID NO: 1355952 - RNA, 22 nt, Mycobacterium tuberculosis H37Rv
aaguagccgaccggcagcgaug

SEQ ID NO: 1355953 - RNA, 19 nt, Mycobacterium tuberculosis H37Rv
aaguagccgacuaucggcc

SEQ ID NO: 1355954 - RNA, 14 nt, Mycobacterium tuberculosis H37Rv
aagggcuuccaggg

SEQ ID NO: 1355955 - RNA, 21 nt, Mycobacterium tuberculosis H37Rv
aagggauccgaagagccagca

SEQ ID NO: 1355956 - RNA, 21 nt, Mycobacterium tuberculosis H37Rv
aaggaugcugucagacggcgu

SEQ ID NO: 1355957 - RNA, 17 nt, Mycobacterium tuberculosis H37Rv
aaggauugcggaaaccc

SEQ ID NO: 1355958 - RNA, 22 nt, Mycobacterium tuberculosis H37Rv
aaggaugucggggcgaagcuug

SEQ ID NO: 1355959 - RNA, 15 nt, Mycobacterium tuberculosis H37Rv
aaggcucaccaggcg

SEQ ID NO: 1355960 - RNA, 14 nt, Mycobacterium tuberculosis H37Rv
aaggcggccaggug

SEQ ID NO: 1355961 - RNA, 17 nt, Mycobacterium tuberculosis H37Rv
aagccgugccgcacagc

SEQ ID NO: 1355962 - RNA, 23 nt, Mycobacterium tuberculosis H37Rv
aagccguuguccaagcccucggg

SEQ ID NO: 1355963 - RNA, 22 nt, Mycobacterium tuberculosis H37Rv
aagccuaguacgccgagcagac

SEQ ID NO: 1355964 - RNA, 18 nt, Mycobacterium tuberculosis H37Rv
aagccucggcaugcagcc

SEQ ID NO: 1355965 - RNA, 21 nt, Mycobacterium tuberculosis H37Rv
aagccgggauugccgccaccu

SEQ ID NO: 1355966 - RNA, 23 nt, Mycobacterium tuberculosis H37Rv
aagccggcguuuaucagcaagag

SEQ ID NO: 1355967 - RNA, 16 nt, Mycobacterium tuberculosis H37Rv
aagccgggucuguugg

SEQ ID NO: 1355968 - RNA, 19 nt, Mycobacterium tuberculosis H37Rv
aagccgggugggagcagcc

SEQ ID NO: 1355969 - RNA, 13 nt, Mycobacterium tuberculosis H37Rv
aagccggccacua

SEQ ID NO: 1355970 - RNA, 14 nt, Mycobacterium tuberculosis H37Rv
aagccggccacgca

SEQ ID NO: 1355971 - RNA, 17 nt, Mycobacterium tuberculosis H37Rv
aagccgcgagcgcgcga

SEQ ID NO: 1355972 - RNA, 22 nt, Mycobacterium tuberculosis H37Rv
aagccgcggcuaggccagcacg

SEQ ID NO: 1355973 - RNA, 20 nt, Mycobacterium tuberculosis H37Rv
aagccgcggcuaggccagca

SEQ ID NO: 1355974 - RNA, 17 nt, Mycobacterium tuberculosis H37Rv
aagcgacgagcagcaau

SEQ ID NO: 1355975 - RNA, 13 nt, Mycobacterium tuberculosis H37Rv
aagcgaagccaga

SEQ ID NO: 1355976 - RNA, 20 nt, Mycobacterium tuberculosis H37Rv
aagccuuaccccgcagcuca

SEQ ID NO: 1355977 - RNA, 16 nt, Mycobacterium tuberculosis H37Rv
aagccagcgcagccag

SEQ ID NO: 1355978 - RNA, 18 nt, Mycobacterium tuberculosis H37Rv
aagccacucgcgcacaua

SEQ ID NO: 1355979 - RNA, 20 nt, Mycobacterium tuberculosis H37Rv
aagcccacguuuagggugcc

SEQ ID NO: 1355980 - RNA, 17 nt, Mycobacterium tuberculosis H37Rv
aagcccgaagacggggu

SEQ ID NO: 1355981 - RNA, 21 nt, Mycobacterium tuberculosis H37Rv
aagcccgucgucgugcacgac

SEQ ID NO: 1355982 - RNA, 19 nt, Mycobacterium tuberculosis H37Rv
aagcccgucgcggccggcg

SEQ ID NO: 1355983 - RNA, 14 nt, Mycobacterium tuberculosis H37Rv
aagccgaccuucuc

SEQ ID NO: 1355984 - RNA, 20 nt, Mycobacterium tuberculosis H37Rv
aagccgaacaccgucagcgu

SEQ ID NO: 1355985 - RNA, 15 nt, Mycobacterium tuberculosis H37Rv
aagccgagcaucaga

SEQ ID NO: 1355986 - RNA, 14 nt, Mycobacterium tuberculosis H37Rv
aagccgacgaccag

SEQ ID NO: 1355987 - RNA, 16 nt, Mycobacterium tuberculosis H37Rv
aagccgacgaccagca

SEQ ID NO: 1355988 - RNA, 19 nt, Mycobacterium tuberculosis H37Rv
aagccgacgaccagcagau

SEQ ID NO: 1355989 - RNA, 15 nt, Mycobacterium tuberculosis H37Rv
aagccgcaccgcugu

SEQ ID NO: 1355990 - RNA, 17 nt, Mycobacterium tuberculosis H37Rv
aaggacggcagccacca

SEQ ID NO: 1355991 - RNA, 22 nt, Mycobacterium tuberculosis H37Rv
aaggacggcagccaccagcgac

SEQ ID NO: 1355992 - RNA, 20 nt, Mycobacterium tuberculosis H37Rv
aaggaccggcaccuggucca

SEQ ID NO: 1355993 - RNA, 14 nt, Mycobacterium tuberculosis H37Rv
aaggaaccgggcaa

SEQ ID NO: 1355994 - RNA, 18 nt, Mycobacterium tuberculosis H37Rv
aaggaaccgggcaaauca

SEQ ID NO: 1355995 - RNA, 20 nt, Mycobacterium tuberculosis H37Rv
aaggaaccgggcaaaucaag

SEQ ID NO: 1355996 - RNA, 18 nt, Mycobacterium tuberculosis H37Rv
aagcgccgaaacagcacc

SEQ ID NO: 1355997 - RNA, 15 nt, Mycobacterium tuberculosis H37Rv
aagcgcgguugcgcu

SEQ ID NO: 1355998 - RNA, 15 nt, Mycobacterium tuberculosis H37Rv
aagcucaagggacac

SEQ ID NO: 1355999 - RNA, 13 nt, Mycobacterium tuberculosis H37Rv
aagcucagcuucu

SEQ ID NO: 1356000 - RNA, 17 nt, Mycobacterium tuberculosis H37Rv
aagcucacacuggcuuu

SEQ ID NO: 1356001 - RNA, 21 nt, Mycobacterium tuberculosis H37Rv
aagcguugcacugcugguuga

SEQ ID NO: 1356002 - RNA, 17 nt, Mycobacterium tuberculosis H37Rv
aagcgguugacccacag

SEQ ID NO: 1356003 - RNA, 18 nt, Mycobacterium tuberculosis H37Rv
aagcgguugacccacagc

SEQ ID NO: 1356004 - RNA, 16 nt, Mycobacterium tuberculosis H37Rv
uucuuguagccgccga

SEQ ID NO: 1356005 - RNA, 16 nt, Mycobacterium tuberculosis H37Rv
uucuuggcgucuugga

SEQ ID NO: 1356006 - RNA, 23 nt, Mycobacterium tuberculosis H37Rv
uugagcagcuugguggcguggcc

SEQ ID NO: 1356007 - RNA, 21 nt, Mycobacterium tuberculosis H37Rv
uucuuggcaggugccuucuuc

SEQ ID NO: 1356008 - RNA, 21 nt, Mycobacterium tuberculosis H37Rv
uugaggauccgcaccacgccc

SEQ ID NO: 1356009 - RNA, 21 nt, Mycobacterium tuberculosis H37Rv
uugauguugccggaguugaag

SEQ ID NO: 1356010 - RNA, 16 nt, Mycobacterium tuberculosis H37Rv
uugaucgccggccugc

SEQ ID NO: 1356011 - RNA, 14 nt, Mycobacterium tuberculosis H37Rv
uugauccuggcuca

SEQ ID NO: 1356012 - RNA, 16 nt, Mycobacterium tuberculosis H37Rv
uugaugcgugguuggc

SEQ ID NO: 1356013 - RNA, 15 nt, Mycobacterium tuberculosis H37Rv
uugaucugcccuguu

SEQ ID NO: 1356014 - RNA, 16 nt, Mycobacterium tuberculosis H37Rv
uugaucuccaccuucu

SEQ ID NO: 1356015 - RNA, 15 nt, Mycobacterium tuberculosis H37Rv
uugcacugcucguug

SEQ ID NO: 1356016 - RNA, 15 nt, Mycobacterium tuberculosis H37Rv
uugcacugcugguug

SEQ ID NO: 1356017 - RNA, 21 nt, Mycobacterium tuberculosis H37Rv
uugcagcgggccacugagcca

SEQ ID NO: 1356018 - RNA, 15 nt, Mycobacterium tuberculosis H37Rv
uugccacgccgccgg

SEQ ID NO: 1356019 - RNA, 19 nt, Mycobacterium tuberculosis H37Rv
uugccacggcccgguuggg

SEQ ID NO: 1356020 - RNA, 15 nt, Mycobacterium tuberculosis H37Rv
uugcgcggucucgag

SEQ ID NO: 1356021 - RNA, 12 nt, Mycobacterium tuberculosis H37Rv
uugcgcuuguug

SEQ ID NO: 1356022 - RNA, 23 nt, Mycobacterium tuberculosis H37Rv
uugcgggggaguaguggugggcg

SEQ ID NO: 1356023 - RNA, 13 nt, Mycobacterium tuberculosis H37Rv
uugcgggcgugga

SEQ ID NO: 1356024 - RNA, 18 nt, Mycobacterium tuberculosis H37Rv
uugcggccgaauuccuca

SEQ ID NO: 1356025 - RNA, 11 nt, Mycobacterium tuberculosis H37Rv
uugcggcccgg

SEQ ID NO: 1356026 - RNA, 12 nt, Mycobacterium tuberculosis H37Rv
uugcgaagccca

SEQ ID NO: 1356027 - RNA, 19 nt, Mycobacterium tuberculosis H37Rv
uugcgaaacgaauccgcca

SEQ ID NO: 1356028 - RNA, 19 nt, Mycobacterium tuberculosis H37Rv
uugccggcguugccgccgu

SEQ ID NO: 1356029 - RNA, 15 nt, Mycobacterium tuberculosis H37Rv
uugccggcuuggccu

SEQ ID NO: 1356030 - RNA, 14 nt, Mycobacterium tuberculosis H37Rv
uugccagaucagca

SEQ ID NO: 1356031 - RNA, 18 nt, Mycobacterium tuberculosis H37Rv
uuggaccgagacuugcug

SEQ ID NO: 1356032 - RNA, 20 nt, Mycobacterium tuberculosis H37Rv
uuggagccgccaccgaggcc

SEQ ID NO: 1356033 - RNA, 12 nt, Mycobacterium tuberculosis H37Rv
uuggcaccagcc

SEQ ID NO: 1356034 - RNA, 16 nt, Mycobacterium tuberculosis H37Rv
uuggcaacacagcuga

SEQ ID NO: 1356035 - RNA, 14 nt, Mycobacterium tuberculosis H37Rv
uuggcaagcacgcg

SEQ ID NO: 1356036 - RNA, 12 nt, Mycobacterium tuberculosis H37Rv
uuggcagcacag

SEQ ID NO: 1356037 - RNA, 20 nt, Mycobacterium tuberculosis H37Rv
uugcugguugcgcucauccg

SEQ ID NO: 1356038 - RNA, 18 nt, Mycobacterium tuberculosis H37Rv
uugcgguaagccggcgug

SEQ ID NO: 1356039 - RNA, 14 nt, Mycobacterium tuberculosis H37Rv
uugggaaaagcccg

SEQ ID NO: 1356040 - RNA, 14 nt, Mycobacterium tuberculosis H37Rv
uugggagccaccgg

SEQ ID NO: 1356041 - RNA, 14 nt, Mycobacterium tuberculosis H37Rv
uugggccagcuccu

SEQ ID NO: 1356042 - RNA, 16 nt, Mycobacterium tuberculosis H37Rv
uugggccagcuccuga

SEQ ID NO: 1356043 - RNA, 12 nt, Mycobacterium tuberculosis H37Rv
uugggccagcgc

SEQ ID NO: 1356044 - RNA, 15 nt, Mycobacterium tuberculosis H37Rv
uuggcgucagcagca

SEQ ID NO: 1356045 - RNA, 16 nt, Mycobacterium tuberculosis H37Rv
uuggcgucagcagcaa

SEQ ID NO: 1356046 - RNA, 14 nt, Mycobacterium tuberculosis H37Rv
uuggcggccagcgu

SEQ ID NO: 1356047 - RNA, 15 nt, Mycobacterium tuberculosis H37Rv
uuggcucggcgcagc

SEQ ID NO: 1356048 - RNA, 17 nt, Mycobacterium tuberculosis H37Rv
uuggccguaccggugau

SEQ ID NO: 1356049 - RNA, 19 nt, Mycobacterium tuberculosis H37Rv
uuggccgcgcaggcuucca

SEQ ID NO: 1356050 - RNA, 14 nt, Mycobacterium tuberculosis H37Rv
uuggccgcaaggcg

SEQ ID NO: 1356051 - RNA, 22 nt, Mycobacterium tuberculosis H37Rv
uuggccaugcuggucagcggcg

SEQ ID NO: 1356052 - RNA, 20 nt, Mycobacterium tuberculosis H37Rv
uuggccaccaucgccgccgu

SEQ ID NO: 1356053 - RNA, 13 nt, Mycobacterium tuberculosis H37Rv
uuggccaccgccc

SEQ ID NO: 1356054 - RNA, 18 nt, Mycobacterium tuberculosis H37Rv
uuggccacuugcucggcg

SEQ ID NO: 1356055 - RNA, 23 nt, Mycobacterium tuberculosis H37Rv
uuggccaaccccauggccagcgc

SEQ ID NO: 1356056 - RNA, 21 nt, Mycobacterium tuberculosis H37Rv
uuggccaauagaagcacgucg

SEQ ID NO: 1356057 - RNA, 13 nt, Mycobacterium tuberculosis H37Rv
uuggcgaagcccg

SEQ ID NO: 1356058 - RNA, 15 nt, Mycobacterium tuberculosis H37Rv
uuggcgacgaggcga

SEQ ID NO: 1356059 - RNA, 14 nt, Mycobacterium tuberculosis H37Rv
uuggcgacugucug

SEQ ID NO: 1356060 - RNA, 20 nt, Mycobacterium tuberculosis H37Rv
uuggcgaugacaaucaccug

SEQ ID NO: 1356061 - RNA, 21 nt, Mycobacterium tuberculosis H37Rv
uuggcgccaccagucacgccc

SEQ ID NO: 1356062 - RNA, 17 nt, Mycobacterium tuberculosis H37Rv
uuggcgccaaaaaggau

SEQ ID NO: 1356063 - RNA, 18 nt, Mycobacterium tuberculosis H37Rv
uuggugcagaccaccgcc

SEQ ID NO: 1356064 - RNA, 22 nt, Mycobacterium tuberculosis H37Rv
uugguggauucgaucaggccuu

SEQ ID NO: 1356065 - RNA, 17 nt, Mycobacterium tuberculosis H37Rv
uuggugggccagcagca

SEQ ID NO: 1356066 - RNA, 19 nt, Mycobacterium tuberculosis H37Rv
uugguggucgccacccgac

SEQ ID NO: 1356067 - RNA, 17 nt, Mycobacterium tuberculosis H37Rv
uuggucagugugaacug

SEQ ID NO: 1356068 - RNA, 15 nt, Mycobacterium tuberculosis H37Rv
uuggugaggugguca

SEQ ID NO: 1356069 - RNA, 18 nt, Mycobacterium tuberculosis H37Rv
uuggugaguagauugcug

SEQ ID NO: 1356070 - RNA, 14 nt, Mycobacterium tuberculosis H37Rv
uuggucuugaaccc

SEQ ID NO: 1356071 - RNA, 22 nt, Mycobacterium tuberculosis H37Rv
uuggggcgcgugggcgugcagg

SEQ ID NO: 1356072 - RNA, 19 nt, Mycobacterium tuberculosis H37Rv
uuggguagcaaaccccgga

SEQ ID NO: 1356073 - RNA, 17 nt, Mycobacterium tuberculosis H37Rv
uugggugccguugcguc

SEQ ID NO: 1356074 - RNA, 17 nt, Mycobacterium tuberculosis H37Rv
uugggugggugcagcac

SEQ ID NO: 1356075 - RNA, 22 nt, Mycobacterium tuberculosis H37Rv
uugguagccggccgcuuggccg

SEQ ID NO: 1356076 - RNA, 15 nt, Mycobacterium tuberculosis H37Rv
uugguagccagggcg

SEQ ID NO: 1356077 - RNA, 14 nt, Mycobacterium tuberculosis H37Rv
uugguaguccugcu

SEQ ID NO: 1356078 - RNA, 15 nt, Mycobacterium tuberculosis H37Rv
uugugccuuagcugc

SEQ ID NO: 1356079 - RNA, 22 nt, Mycobacterium tuberculosis H37Rv
uugucggcgaaaugaagugcac

SEQ ID NO: 1356080 - RNA, 22 nt, Mycobacterium tuberculosis H37Rv
uugugaacggugucaacggcac

SEQ ID NO: 1356081 - RNA, 22 nt, Mycobacterium tuberculosis H37Rv
uuguggccgccuucgccgccgc

SEQ ID NO: 1356082 - RNA, 19 nt, Mycobacterium tuberculosis H37Rv
uuguggucagcugcugcca

SEQ ID NO: 1356083 - RNA, 17 nt, Mycobacterium tuberculosis H37Rv
uuguggucgaguugaag

SEQ ID NO: 1356084 - RNA, 17 nt, Mycobacterium tuberculosis H37Rv
uuguuccguccccgacg

SEQ ID NO: 1356085 - RNA, 18 nt, Mycobacterium tuberculosis H37Rv
uuguaggacaagugccgg

SEQ ID NO: 1356086 - RNA, 17 nt, Mycobacterium tuberculosis H37Rv
uuguagcgggcaagaug

SEQ ID NO: 1356087 - RNA, 18 nt, Mycobacterium tuberculosis H37Rv
uugguugcgccaggaacc

SEQ ID NO: 1356088 - RNA, 12 nt, Mycobacterium tuberculosis H37Rv
uuguccggugag

SEQ ID NO: 1356089 - RNA, 17 nt, Mycobacterium tuberculosis H37Rv
uuguccggugguggcga

SEQ ID NO: 1356090 - RNA, 18 nt, Mycobacterium tuberculosis H37Rv
uuguccuaauucggggcc

SEQ ID NO: 1356091 - RNA, 17 nt, Mycobacterium tuberculosis H37Rv
uuguccuucagccaguc

SEQ ID NO: 1356092 - RNA, 16 nt, Mycobacterium tuberculosis H37Rv
uuguccagggugguca

SEQ ID NO: 1356093 - RNA, 23 nt, Mycobacterium tuberculosis H37Rv
uugucagcgaacggccaggacaa

SEQ ID NO: 1356094 - RNA, 15 nt, Mycobacterium tuberculosis H37Rv
uuccguuaggcucca

SEQ ID NO: 1356095 - RNA, 21 nt, Mycobacterium tuberculosis H37Rv
uuccucugggcuguccuccug

SEQ ID NO: 1356096 - RNA, 22 nt, Mycobacterium tuberculosis H37Rv
uuccucugggcuguccuccuga

SEQ ID NO: 1356097 - RNA, 19 nt, Mycobacterium tuberculosis H37Rv
uuccgucugacccaccgcc

SEQ ID NO: 1356098 - RNA, 14 nt, Mycobacterium tuberculosis H37Rv
uuccgugccgacca

SEQ ID NO: 1356099 - RNA, 18 nt, Mycobacterium tuberculosis H37Rv
uuccugacgccauucauc

SEQ ID NO: 1356100 - RNA, 15 nt, Mycobacterium tuberculosis H37Rv
uuccucuucaggccc

SEQ ID NO: 1356101 - RNA, 16 nt, Mycobacterium tuberculosis H37Rv
uuccugaggguuucca

SEQ ID NO: 1356102 - RNA, 16 nt, Mycobacterium tuberculosis H37Rv
uucgacgacagcaccg

SEQ ID NO: 1356103 - RNA, 24 nt, Mycobacterium tuberculosis H37Rv
uucgacaggccaccgcagacgccg

SEQ ID NO: 1356104 - RNA, 13 nt, Mycobacterium tuberculosis H37Rv
uucgacaggccac

SEQ ID NO: 1356105 - RNA, 17 nt, Mycobacterium tuberculosis H37Rv
uucccuuguucccgaaa

SEQ ID NO: 1356106 - RNA, 17 nt, Mycobacterium tuberculosis H37Rv
uuccgcgaaggucucga

SEQ ID NO: 1356107 - RNA, 20 nt, Mycobacterium tuberculosis H37Rv
uuccgcgaaucaacaggacc

SEQ ID NO: 1356108 - RNA, 19 nt, Mycobacterium tuberculosis H37Rv
uuccgccggccccaccggu

SEQ ID NO: 1356109 - RNA, 13 nt, Mycobacterium tuberculosis H37Rv
uuccggcgcggcc

SEQ ID NO: 1356110 - RNA, 15 nt, Mycobacterium tuberculosis H37Rv
uucccgcuugagcag

SEQ ID NO: 1356111 - RNA, 15 nt, Mycobacterium tuberculosis H37Rv
uuccccuguugcccc

SEQ ID NO: 1356112 - RNA, 17 nt, Mycobacterium tuberculosis H37Rv
uucccccggcaccgccg

SEQ ID NO: 1356113 - RNA, 14 nt, Mycobacterium tuberculosis H37Rv
uucgcccuugccgc

SEQ ID NO: 1356114 - RNA, 22 nt, Mycobacterium tuberculosis H37Rv
uucgccccugcacagcaggcuc

SEQ ID NO: 1356115 - RNA, 22 nt, Mycobacterium tuberculosis H37Rv
uucgcccggcugcgccgggcuc

SEQ ID NO: 1356116 - RNA, 18 nt, Mycobacterium tuberculosis H37Rv
uucgauugcgcugcaccg

SEQ ID NO: 1356117 - RNA, 13 nt, Mycobacterium tuberculosis H37Rv
uucgccagcgccg

SEQ ID NO: 1356118 - RNA, 11 nt, Mycobacterium tuberculosis H37Rv
uucgccagcgc

SEQ ID NO: 1356119 - RNA, 23 nt, Mycobacterium tuberculosis H37Rv
uucgacucggccucuagcuugac

SEQ ID NO: 1356120 - RNA, 14 nt, Mycobacterium tuberculosis H37Rv
uucgagguggcugc

SEQ ID NO: 1356121 - RNA, 20 nt, Mycobacterium tuberculosis H37Rv
uucgagcaccgacaccggcc

SEQ ID NO: 1356122 - RNA, 13 nt, Mycobacterium tuberculosis H37Rv
uucgaucaggccu

SEQ ID NO: 1356123 - RNA, 21 nt, Mycobacterium tuberculosis H37Rv
uucgaucaacugcagauagga

SEQ ID NO: 1356124 - RNA, 14 nt, Mycobacterium tuberculosis H37Rv
uucgggugcagcca

SEQ ID NO: 1356125 - RNA, 15 nt, Mycobacterium tuberculosis H37Rv
uucgucgaaccuguc

SEQ ID NO: 1356126 - RNA, 18 nt, Mycobacterium tuberculosis H37Rv
uucgggacgcgagugcgu

SEQ ID NO: 1356127 - RNA, 14 nt, Mycobacterium tuberculosis H37Rv
uucggguccagcgg

SEQ ID NO: 1356128 - RNA, 15 nt, Mycobacterium tuberculosis H37Rv
uucgugagcggccag

SEQ ID NO: 1356129 - RNA, 16 nt, Mycobacterium tuberculosis H37Rv
uucgucggagaacgcc

SEQ ID NO: 1356130 - RNA, 20 nt, Mycobacterium tuberculosis H37Rv
uucgucgucgcugagcagcg

SEQ ID NO: 1356131 - RNA, 13 nt, Mycobacterium tuberculosis H37Rv
uucggccaccaac

SEQ ID NO: 1356132 - RNA, 18 nt, Mycobacterium tuberculosis H37Rv
uucggcauaacccuggcc

SEQ ID NO: 1356133 - RNA, 17 nt, Mycobacterium tuberculosis H37Rv
uucggccgaccgggcuc

SEQ ID NO: 1356134 - RNA, 21 nt, Mycobacterium tuberculosis H37Rv
uucggccauguagccguugcc

SEQ ID NO: 1356135 - RNA, 14 nt, Mycobacterium tuberculosis H37Rv
uucggcgaucgucu

SEQ ID NO: 1356136 - RNA, 20 nt, Mycobacterium tuberculosis H37Rv
uucggcugcgaaagccacuc

SEQ ID NO: 1356137 - RNA, 13 nt, Mycobacterium tuberculosis H37Rv
uucggcugccacc

SEQ ID NO: 1356138 - RNA, 15 nt, Mycobacterium tuberculosis H37Rv
uucggcggucagcgg

SEQ ID NO: 1356139 - RNA, 13 nt, Mycobacterium tuberculosis H37Rv
uucggcgucgucg

SEQ ID NO: 1356140 - RNA, 19 nt, Mycobacterium tuberculosis H37Rv
uucggcaggaaugccgcgg

SEQ ID NO: 1356141 - RNA, 18 nt, Mycobacterium tuberculosis H37Rv
uucggaugucccuugacg

SEQ ID NO: 1356142 - RNA, 20 nt, Mycobacterium tuberculosis H37Rv
uucgcgggauccaggcccag

SEQ ID NO: 1356143 - RNA, 17 nt, Mycobacterium tuberculosis H37Rv
uucgcgugccagcgccc

SEQ ID NO: 1356144 - RNA, 23 nt, Mycobacterium tuberculosis H37Rv
uucuccaacacaaacgccgccgg

SEQ ID NO: 1356145 - RNA, 13 nt, Mycobacterium tuberculosis H37Rv
uucuccaggcuga

SEQ ID NO: 1356146 - RNA, 13 nt, Mycobacterium tuberculosis H37Rv
uucugaagcccga

SEQ ID NO: 1356147 - RNA, 13 nt, Mycobacterium tuberculosis H37Rv
uucuggaaccccg

SEQ ID NO: 1356148 - RNA, 14 nt, Mycobacterium tuberculosis H37Rv
uucugguccagcac

SEQ ID NO: 1356149 - RNA, 13 nt, Mycobacterium tuberculosis H37Rv
uucuggcccgcag

SEQ ID NO: 1356150 - RNA, 23 nt, Mycobacterium tuberculosis H37Rv
uucuucggugaagaacaugcuca

SEQ ID NO: 1356151 - RNA, 15 nt, Mycobacterium tuberculosis H37Rv
uucuucgcgaagaac

SEQ ID NO: 1356152 - RNA, 15 nt, Mycobacterium tuberculosis H37Rv
uucuucggccagcuc

SEQ ID NO: 1356153 - RNA, 17 nt, Mycobacterium tuberculosis H37Rv
uucuucggccagcuccc

SEQ ID NO: 1356154 - RNA, 16 nt, Mycobacterium tuberculosis H37Rv
uucauguggcgcgggu

SEQ ID NO: 1356155 - RNA, 14 nt, Mycobacterium tuberculosis H37Rv
uucaugaugacaau

SEQ ID NO: 1356156 - RNA, 21 nt, Mycobacterium tuberculosis H37Rv
uuccaaagggaguguuugggu

SEQ ID NO: 1356157 - RNA, 20 nt, Mycobacterium tuberculosis H37Rv
uuccaaaaucaucugcacau

SEQ ID NO: 1356158 - RNA, 13 nt, Mycobacterium tuberculosis H37Rv
uuccaacaccaac

SEQ ID NO: 1356159 - RNA, 14 nt, Mycobacterium tuberculosis H37Rv
uuccaacuccugca

SEQ ID NO: 1356160 - RNA, 15 nt, Mycobacterium tuberculosis H37Rv
uuccaagccgaccug

SEQ ID NO: 1356161 - RNA, 16 nt, Mycobacterium tuberculosis H37Rv
uucaucacgccgccgg

SEQ ID NO: 1356162 - RNA, 22 nt, Mycobacterium tuberculosis H37Rv
uucaucaucugcgaaaagccuu

SEQ ID NO: 1356163 - RNA, 17 nt, Mycobacterium tuberculosis H37Rv
uucagguccaccgcugc

SEQ ID NO: 1356164 - RNA, 23 nt, Mycobacterium tuberculosis H37Rv
uucagguccaccgcugccggcag

SEQ ID NO: 1356165 - RNA, 22 nt, Mycobacterium tuberculosis H37Rv
uucaguucggccgucauggccc

SEQ ID NO: 1356166 - RNA, 15 nt, Mycobacterium tuberculosis H37Rv
uuagggcgcccgccc

SEQ ID NO: 1356167 - RNA, 14 nt, Mycobacterium tuberculosis H37Rv
uucacuggucuccc

SEQ ID NO: 1356168 - RNA, 22 nt, Mycobacterium tuberculosis H37Rv
uucaccacucggucguugccgc

SEQ ID NO: 1356169 - RNA, 17 nt, Mycobacterium tuberculosis H37Rv
uucaccacccuguuguu

SEQ ID NO: 1356170 - RNA, 22 nt, Mycobacterium tuberculosis H37Rv
uucaccacccuguuguugcccc

SEQ ID NO: 1356171 - RNA, 19 nt, Mycobacterium tuberculosis H37Rv
ugggcagauauugccugcc

SEQ ID NO: 1356172 - RNA, 19 nt, Mycobacterium tuberculosis H37Rv
ugggcgccgacaccggcug

SEQ ID NO: 1356173 - RNA, 14 nt, Mycobacterium tuberculosis H37Rv
ugggcgccacagcc

SEQ ID NO: 1356174 - RNA, 11 nt, Mycobacterium tuberculosis H37Rv
ugggcgccggu

SEQ ID NO: 1356175 - RNA, 20 nt, Mycobacterium tuberculosis H37Rv
ugggcgcguagcucagcggu

SEQ ID NO: 1356176 - RNA, 19 nt, Mycobacterium tuberculosis H37Rv
ugggcggccgggcucccca

SEQ ID NO: 1356177 - RNA, 13 nt, Mycobacterium tuberculosis H37Rv
ugggcggcacugg

SEQ ID NO: 1356178 - RNA, 22 nt, Mycobacterium tuberculosis H37Rv
ugggcggccuggucggccaggu

SEQ ID NO: 1356179 - RNA, 17 nt, Mycobacterium tuberculosis H37Rv
ugggcggcccaccggcc

SEQ ID NO: 1356180 - RNA, 18 nt, Mycobacterium tuberculosis H37Rv
ugggcgugacgggcagga

SEQ ID NO: 1356181 - RNA, 21 nt, Mycobacterium tuberculosis H37Rv
ugggcguacucggcgcgcagc

SEQ ID NO: 1356182 - RNA, 15 nt, Mycobacterium tuberculosis H37Rv
ugggcggugucgucg

SEQ ID NO: 1356183 - RNA, 14 nt, Mycobacterium tuberculosis H37Rv
uggggacuggcagg

SEQ ID NO: 1356184 - RNA, 13 nt, Mycobacterium tuberculosis H37Rv
ugggcgucaagca

SEQ ID NO: 1356185 - RNA, 22 nt, Mycobacterium tuberculosis H37Rv
ugggcguucccccggcaccgcc

SEQ ID NO: 1356186 - RNA, 12 nt, Mycobacterium tuberculosis H37Rv
ugggugugcccg

SEQ ID NO: 1356187 - RNA, 18 nt, Mycobacterium tuberculosis H37Rv
ugggugcgucgacccagc

SEQ ID NO: 1356188 - RNA, 23 nt, Mycobacterium tuberculosis H37Rv
ugggugcgacacauagugcggca

SEQ ID NO: 1356189 - RNA, 14 nt, Mycobacterium tuberculosis H37Rv
ugggugcgcggccg

SEQ ID NO: 1356190 - RNA, 17 nt, Mycobacterium tuberculosis H37Rv
ugggugcgucgacccag

SEQ ID NO: 1356191 - RNA, 21 nt, Mycobacterium tuberculosis H37Rv
ugggucuuugcccgccacgcu

SEQ ID NO: 1356192 - RNA, 13 nt, Mycobacterium tuberculosis H37Rv
ugggugaggccaa

SEQ ID NO: 1356193 - RNA, 19 nt, Mycobacterium tuberculosis H37Rv
ugggucugcucagcgcggc

SEQ ID NO: 1356194 - RNA, 16 nt, Mycobacterium tuberculosis H37Rv
ugggggccggcagcgg

SEQ ID NO: 1356195 - RNA, 19 nt, Mycobacterium tuberculosis H37Rv
uggggcugugcaggcggga

SEQ ID NO: 1356196 - RNA, 22 nt, Mycobacterium tuberculosis H37Rv
uggggaucgaccauggucgauu

SEQ ID NO: 1356197 - RNA, 22 nt, Mycobacterium tuberculosis H37Rv
uggggaucgcaccgugggcccu

SEQ ID NO: 1356198 - RNA, 22 nt, Mycobacterium tuberculosis H37Rv
uggggcacuuccagcccggcaa

SEQ ID NO: 1356199 - RNA, 15 nt, Mycobacterium tuberculosis H37Rv
uggggauuccgcacc

SEQ ID NO: 1356200 - RNA, 23 nt, Mycobacterium tuberculosis H37Rv
uggggcagucccggugggcggcu

SEQ ID NO: 1356201 - RNA, 21 nt, Mycobacterium tuberculosis H37Rv
uggggccgggcuccucugguu

SEQ ID NO: 1356202 - RNA, 12 nt, Mycobacterium tuberculosis H37Rv
uggggcgccggg

SEQ ID NO: 1356203 - RNA, 14 nt, Mycobacterium tuberculosis H37Rv
uggggcgcgccggc

SEQ ID NO: 1356204 - RNA, 21 nt, Mycobacterium tuberculosis H37Rv
uggggcgcgugggcgugcagg

SEQ ID NO: 1356205 - RNA, 14 nt, Mycobacterium tuberculosis H37Rv
uggcgucggccagg

SEQ ID NO: 1356206 - RNA, 15 nt, Mycobacterium tuberculosis H37Rv
uggcgucggccagga

SEQ ID NO: 1356207 - RNA, 11 nt, Mycobacterium tuberculosis H37Rv
uggcgugcagc

SEQ ID NO: 1356208 - RNA, 12 nt, Mycobacterium tuberculosis H37Rv
uggcgugcagca

SEQ ID NO: 1356209 - RNA, 16 nt, Mycobacterium tuberculosis H37Rv
uggcguggcccucggc

SEQ ID NO: 1356210 - RNA, 13 nt, Mycobacterium tuberculosis H37Rv
uggcguguggcuu

SEQ ID NO: 1356211 - RNA, 16 nt, Mycobacterium tuberculosis H37Rv
uggcguugccaccgga

SEQ ID NO: 1356212 - RNA, 15 nt, Mycobacterium tuberculosis H37Rv
uggcuuggugcccaa

SEQ ID NO: 1356213 - RNA, 14 nt, Mycobacterium tuberculosis H37Rv
uggcuugcucugcg

SEQ ID NO: 1356214 - RNA, 14 nt, Mycobacterium tuberculosis H37Rv
uggcuugugcccaa

SEQ ID NO: 1356215 - RNA, 20 nt, Mycobacterium tuberculosis H37Rv
ugggaugaccuuggccgugc

SEQ ID NO: 1356216 - RNA, 19 nt, Mycobacterium tuberculosis H37Rv
ugggaucccagcgcagcgg

SEQ ID NO: 1356217 - RNA, 17 nt, Mycobacterium tuberculosis H37Rv
ugggaucccagcgcagc

SEQ ID NO: 1356218 - RNA, 20 nt, Mycobacterium tuberculosis H37Rv
ugggagcuacccgggccagg

SEQ ID NO: 1356219 - RNA, 18 nt, Mycobacterium tuberculosis H37Rv
ugggagcuacccgggcca

SEQ ID NO: 1356220 - RNA, 19 nt, Mycobacterium tuberculosis H37Rv
ugggaggcggcgccagugc

SEQ ID NO: 1356221 - RNA, 21 nt, Mycobacterium tuberculosis H37Rv
ugggagguggcgcggggccgc

SEQ ID NO: 1356222 - RNA, 14 nt, Mycobacterium tuberculosis H37Rv
uggucauccagcca

SEQ ID NO: 1356223 - RNA, 18 nt, Mycobacterium tuberculosis H37Rv
uggucagucaccaaccac

SEQ ID NO: 1356224 - RNA, 16 nt, Mycobacterium tuberculosis H37Rv
uggucagcugcugcca

SEQ ID NO: 1356225 - RNA, 16 nt, Mycobacterium tuberculosis H37Rv
uggucaggcuggaggu

SEQ ID NO: 1356226 - RNA, 13 nt, Mycobacterium tuberculosis H37Rv
uggucagccgcgg

SEQ ID NO: 1356227 - RNA, 15 nt, Mycobacterium tuberculosis H37Rv
uggucagcagcucca

SEQ ID NO: 1356228 - RNA, 13 nt, Mycobacterium tuberculosis H37Rv
uggucagcuggcc

SEQ ID NO: 1356229 - RNA, 24 nt, Mycobacterium tuberculosis H37Rv
uggucaggaacacucgcgaauaac

SEQ ID NO: 1356230 - RNA, 24 nt, Mycobacterium tuberculosis H37Rv
uggucagccgcggcggcagcaccc

SEQ ID NO: 1356231 - RNA, 12 nt, Mycobacterium tuberculosis H37Rv
uggucaccagcc

SEQ ID NO: 1356232 - RNA, 14 nt, Mycobacterium tuberculosis H37Rv
uggucaccagccac

SEQ ID NO: 1356233 - RNA, 21 nt, Mycobacterium tuberculosis H37Rv
uggucacgguucgcccgucgc

SEQ ID NO: 1356234 - RNA, 15 nt, Mycobacterium tuberculosis H37Rv
uggucaacagcggca

SEQ ID NO: 1356235 - RNA, 17 nt, Mycobacterium tuberculosis H37Rv
uggucaacggccgacuu

SEQ ID NO: 1356236 - RNA, 14 nt, Mycobacterium tuberculosis H37Rv
uggucgccaugucg

SEQ ID NO: 1356237 - RNA, 14 nt, Mycobacterium tuberculosis H37Rv
uggucgcugcugcc

SEQ ID NO: 1356238 - RNA, 13 nt, Mycobacterium tuberculosis H37Rv
uggucggccaccc

SEQ ID NO: 1356239 - RNA, 19 nt, Mycobacterium tuberculosis H37Rv
uggucggccaggucgagca

SEQ ID NO: 1356240 - RNA, 20 nt, Mycobacterium tuberculosis H37Rv
uggucgcggucccacggccg

SEQ ID NO: 1356241 - RNA, 14 nt, Mycobacterium tuberculosis H37Rv
uggucgcgccaccc

SEQ ID NO: 1356242 - RNA, 18 nt, Mycobacterium tuberculosis H37Rv
uggucgauggcguacagc

SEQ ID NO: 1356243 - RNA, 14 nt, Mycobacterium tuberculosis H37Rv
uggucgagugcgau

SEQ ID NO: 1356244 - RNA, 20 nt, Mycobacterium tuberculosis H37Rv
uggucgacgucgguguaacc

SEQ ID NO: 1356245 - RNA, 21 nt, Mycobacterium tuberculosis H37Rv
uggucgcaggauucccagucc

SEQ ID NO: 1356246 - RNA, 18 nt, Mycobacterium tuberculosis H37Rv
uggucgcaggauucccag

SEQ ID NO: 1356247 - RNA, 20 nt, Mycobacterium tuberculosis H37Rv
uggucgcaggauucccaguc

SEQ ID NO: 1356248 - RNA, 18 nt, Mycobacterium tuberculosis H37Rv
uggucgccgcuuucuugg

SEQ ID NO: 1356249 - RNA, 20 nt, Mycobacterium tuberculosis H37Rv
ugguccuuguugugguggag

SEQ ID NO: 1356250 - RNA, 23 nt, Mycobacterium tuberculosis H37Rv
uggucgaaacgguacgccgccgc

SEQ ID NO: 1356251 - RNA, 23 nt, Mycobacterium tuberculosis H37Rv
uggucgaauaguugaccaggccg

SEQ ID NO: 1356252 - RNA, 17 nt, Mycobacterium tuberculosis H37Rv
ugguccaaccagcacca

SEQ ID NO: 1356253 - RNA, 16 nt, Mycobacterium tuberculosis H37Rv
ugguccaaccgggccg

SEQ ID NO: 1356254 - RNA, 19 nt, Mycobacterium tuberculosis H37Rv
uggucauguucggggcgca

SEQ ID NO: 1356255 - RNA, 19 nt, Mycobacterium tuberculosis H37Rv
uggguugugccgcccugga

SEQ ID NO: 1356256 - RNA, 14 nt, Mycobacterium tuberculosis H37Rv
uggguuggauaaag

SEQ ID NO: 1356257 - RNA, 17 nt, Mycobacterium tuberculosis H37Rv
uggguuccguggaugga

SEQ ID NO: 1356258 - RNA, 20 nt, Mycobacterium tuberculosis H37Rv
uggguguugcuggccgcgau

SEQ ID NO: 1356259 - RNA, 22 nt, Mycobacterium tuberculosis H37Rv
uggguguugucgucgagcgcgc

SEQ ID NO: 1356260 - RNA, 16 nt, Mycobacterium tuberculosis H37Rv
ugguaaccagggcagc

SEQ ID NO: 1356261 - RNA, 13 nt, Mycobacterium tuberculosis H37Rv
ugguaaccagggc

SEQ ID NO: 1356262 - RNA, 23 nt, Mycobacterium tuberculosis H37Rv
ugguaugcccgccguagaccagc

SEQ ID NO: 1356263 - RNA, 16 nt, Mycobacterium tuberculosis H37Rv
ugguaccggcgccgca

SEQ ID NO: 1356264 - RNA, 13 nt, Mycobacterium tuberculosis H37Rv
ugguaccccagca

SEQ ID NO: 1356265 - RNA, 15 nt, Mycobacterium tuberculosis H37Rv
ugguacccaccaggg

SEQ ID NO: 1356266 - RNA, 18 nt, Mycobacterium tuberculosis H37Rv
ugguacccagcgcggcca

SEQ ID NO: 1356267 - RNA, 13 nt, Mycobacterium tuberculosis H37Rv
ugguagccagggc

SEQ ID NO: 1356268 - RNA, 21 nt, Mycobacterium tuberculosis H37Rv
uggcgaguggcugacacugcc

SEQ ID NO: 1356269 - RNA, 19 nt, Mycobacterium tuberculosis H37Rv
uggcgagccacggcacugg

SEQ ID NO: 1356270 - RNA, 16 nt, Mycobacterium tuberculosis H37Rv
uggcgauagcggcgcu

SEQ ID NO: 1356271 - RNA, 22 nt, Mycobacterium tuberculosis H37Rv
uggcgaaucuuugguagucugc

SEQ ID NO: 1356272 - RNA, 17 nt, Mycobacterium tuberculosis H37Rv
uggcgaaugacggccag

SEQ ID NO: 1356273 - RNA, 14 nt, Mycobacterium tuberculosis H37Rv
uggcgaggcagcac

SEQ ID NO: 1356274 - RNA, 16 nt, Mycobacterium tuberculosis H37Rv
uggcgaggcagcaccc

SEQ ID NO: 1356275 - RNA, 16 nt, Mycobacterium tuberculosis H37Rv
uggcgaucucuaccag

SEQ ID NO: 1356276 - RNA, 13 nt, Mycobacterium tuberculosis H37Rv
uggcgcccgucuc

SEQ ID NO: 1356277 - RNA, 17 nt, Mycobacterium tuberculosis H37Rv
uggcgcccugcgccaca

SEQ ID NO: 1356278 - RNA, 23 nt, Mycobacterium tuberculosis H37Rv
uggcgccgaaaaggucggggaac

SEQ ID NO: 1356279 - RNA, 15 nt, Mycobacterium tuberculosis H37Rv
uggcgccgucggccg

SEQ ID NO: 1356280 - RNA, 19 nt, Mycobacterium tuberculosis H37Rv
uggcgccguugccggcguu

SEQ ID NO: 1356281 - RNA, 15 nt, Mycobacterium tuberculosis H37Rv
uggcgcugaagccga

SEQ ID NO: 1356282 - RNA, 13 nt, Mycobacterium tuberculosis H37Rv
uggcgccggggcg

SEQ ID NO: 1356283 - RNA, 19 nt, Mycobacterium tuberculosis H37Rv
uggcgccggggcgcagguu

SEQ ID NO: 1356284 - RNA, 14 nt, Mycobacterium tuberculosis H37Rv
uggcgccggugccg

SEQ ID NO: 1356285 - RNA, 14 nt, Mycobacterium tuberculosis H37Rv
uggcgccggggccg

SEQ ID NO: 1356286 - RNA, 21 nt, Mycobacterium tuberculosis H37Rv
uggcgccggccaguucggccu

SEQ ID NO: 1356287 - RNA, 13 nt, Mycobacterium tuberculosis H37Rv
uggcgccgcgccg

SEQ ID NO: 1356288 - RNA, 20 nt, Mycobacterium tuberculosis H37Rv
uggcgccgccggcaccgccg

SEQ ID NO: 1356289 - RNA, 14 nt, Mycobacterium tuberculosis H37Rv
uggcgccgcggcug

SEQ ID NO: 1356290 - RNA, 23 nt, Mycobacterium tuberculosis H37Rv
uggcgguguaacccggaaccagc

SEQ ID NO: 1356291 - RNA, 14 nt, Mycobacterium tuberculosis H37Rv
uggcggugcgcagc

SEQ ID NO: 1356292 - RNA, 14 nt, Mycobacterium tuberculosis H37Rv
uggcggugagccgc

SEQ ID NO: 1356293 - RNA, 20 nt, Mycobacterium tuberculosis H37Rv
uggcgguccggaaauuccgg

SEQ ID NO: 1356294 - RNA, 22 nt, Mycobacterium tuberculosis H37Rv
uggcggucggcagaccgaccuc

SEQ ID NO: 1356295 - RNA, 20 nt, Mycobacterium tuberculosis H37Rv
uggcgggguugaucaccgac

SEQ ID NO: 1356296 - RNA, 18 nt, Mycobacterium tuberculosis H37Rv
uggcggggaucagcgagu

SEQ ID NO: 1356297 - RNA, 21 nt, Mycobacterium tuberculosis H37Rv
uggcggcuucgccccgaggau

SEQ ID NO: 1356298 - RNA, 14 nt, Mycobacterium tuberculosis H37Rv
uggcggcugcagcc

SEQ ID NO: 1356299 - RNA, 16 nt, Mycobacterium tuberculosis H37Rv
uggcgggagccuuggu

SEQ ID NO: 1356300 - RNA, 22 nt, Mycobacterium tuberculosis H37Rv
uggcgggaucgagagccgaccg

SEQ ID NO: 1356301 - RNA, 15 nt, Mycobacterium tuberculosis H37Rv
uggcggccagcgcac

SEQ ID NO: 1356302 - RNA, 17 nt, Mycobacterium tuberculosis H37Rv
uggcggccaccgucagc

SEQ ID NO: 1356303 - RNA, 13 nt, Mycobacterium tuberculosis H37Rv
uggcggcacuggc

SEQ ID NO: 1356304 - RNA, 15 nt, Mycobacterium tuberculosis H37Rv
uggcggaccgggcca

SEQ ID NO: 1356305 - RNA, 21 nt, Mycobacterium tuberculosis H37Rv
uggcggcagguguuggugcgg

SEQ ID NO: 1356306 - RNA, 19 nt, Mycobacterium tuberculosis H37Rv
uggcggcagguguuggugc

SEQ ID NO: 1356307 - RNA, 23 nt, Mycobacterium tuberculosis H37Rv
uggcggaucuggcuccggccagg

SEQ ID NO: 1356308 - RNA, 23 nt, Mycobacterium tuberculosis H37Rv
uggcggauggccgccuuggcuuc

SEQ ID NO: 1356309 - RNA, 22 nt, Mycobacterium tuberculosis H37Rv
uggcggaacagcuucgcgcagc

SEQ ID NO: 1356310 - RNA, 15 nt, Mycobacterium tuberculosis H37Rv
uggcgcugcucugag

SEQ ID NO: 1356311 - RNA, 15 nt, Mycobacterium tuberculosis H37Rv
uggcgcugcuggcag

SEQ ID NO: 1356312 - RNA, 18 nt, Mycobacterium tuberculosis H37Rv
uggccgccggcgccgcca

SEQ ID NO: 1356313 - RNA, 15 nt, Mycobacterium tuberculosis H37Rv
uggccgccccggccg

SEQ ID NO: 1356314 - RNA, 17 nt, Mycobacterium tuberculosis H37Rv
uggccgccgccaccugu

SEQ ID NO: 1356315 - RNA, 20 nt, Mycobacterium tuberculosis H37Rv
uggccgcgcucaucgcggcg

SEQ ID NO: 1356316 - RNA, 15 nt, Mycobacterium tuberculosis H37Rv
uggccgcgcaggcuu

SEQ ID NO: 1356317 - RNA, 18 nt, Mycobacterium tuberculosis H37Rv
uggccgccuucgccgccg

SEQ ID NO: 1356318 - RNA, 14 nt, Mycobacterium tuberculosis H37Rv
uggccgcugccuuc

SEQ ID NO: 1356319 - RNA, 16 nt, Mycobacterium tuberculosis H37Rv
uggccgcugccuucuu

SEQ ID NO: 1356320 - RNA, 18 nt, Mycobacterium tuberculosis H37Rv
uggccgcucuccaccccg

SEQ ID NO: 1356321 - RNA, 17 nt, Mycobacterium tuberculosis H37Rv
uggccggcgagggugag

SEQ ID NO: 1356322 - RNA, 18 nt, Mycobacterium tuberculosis H37Rv
uggccgguucaggggugg

SEQ ID NO: 1356323 - RNA, 19 nt, Mycobacterium tuberculosis H37Rv
uggccgggucgucuuccag

SEQ ID NO: 1356324 - RNA, 20 nt, Mycobacterium tuberculosis H37Rv
uggccguucggcgcccgcuc

SEQ ID NO: 1356325 - RNA, 17 nt, Mycobacterium tuberculosis H37Rv
uggccguuuguuuuguc

SEQ ID NO: 1356326 - RNA, 19 nt, Mycobacterium tuberculosis H37Rv
uggccucagccaccgggcg

SEQ ID NO: 1356327 - RNA, 18 nt, Mycobacterium tuberculosis H37Rv
uggccucccacggcgcgu

SEQ ID NO: 1356328 - RNA, 21 nt, Mycobacterium tuberculosis H37Rv
uggccucaacgccagcugcuu

SEQ ID NO: 1356329 - RNA, 19 nt, Mycobacterium tuberculosis H37Rv
uggccuagcaugaggcccg

SEQ ID NO: 1356330 - RNA, 18 nt, Mycobacterium tuberculosis H37Rv
uggcgaaggacaacagcc

SEQ ID NO: 1356331 - RNA, 13 nt, Mycobacterium tuberculosis H37Rv
uggcgaacagcac

SEQ ID NO: 1356332 - RNA, 19 nt, Mycobacterium tuberculosis H37Rv
uggccuuugagcgcggcca

SEQ ID NO: 1356333 - RNA, 19 nt, Mycobacterium tuberculosis H37Rv
uggccgcaaggcguguagc

SEQ ID NO: 1356334 - RNA, 23 nt, Mycobacterium tuberculosis H37Rv
uggccgauguaguccggccaguc

SEQ ID NO: 1356335 - RNA, 14 nt, Mycobacterium tuberculosis H37Rv
uggccgcagggccu

SEQ ID NO: 1356336 - RNA, 16 nt, Mycobacterium tuberculosis H37Rv
uggccgccacaccgcc

SEQ ID NO: 1356337 - RNA, 14 nt, Mycobacterium tuberculosis H37Rv
uggccaugcucuug

SEQ ID NO: 1356338 - RNA, 17 nt, Mycobacterium tuberculosis H37Rv
uggccgagcagggccgg

SEQ ID NO: 1356339 - RNA, 21 nt, Mycobacterium tuberculosis H37Rv
uggccagcgcggcgucgccuu

SEQ ID NO: 1356340 - RNA, 13 nt, Mycobacterium tuberculosis H37Rv
uggccagcgcggc

SEQ ID NO: 1356341 - RNA, 23 nt, Mycobacterium tuberculosis H37Rv
uggccaggcccaagccguggccg

SEQ ID NO: 1356342 - RNA, 15 nt, Mycobacterium tuberculosis H37Rv
uggccaggaaguccc

SEQ ID NO: 1356343 - RNA, 22 nt, Mycobacterium tuberculosis H37Rv
uggccaccaaacgcugcuggca

SEQ ID NO: 1356344 - RNA, 19 nt, Mycobacterium tuberculosis H37Rv
uggccagccacagccgacc

SEQ ID NO: 1356345 - RNA, 16 nt, Mycobacterium tuberculosis H37Rv
uggccagcaccacggc

SEQ ID NO: 1356346 - RNA, 15 nt, Mycobacterium tuberculosis H37Rv
uggccagcagcagcg

SEQ ID NO: 1356347 - RNA, 17 nt, Mycobacterium tuberculosis H37Rv
uggccagcagcagcgcu

SEQ ID NO: 1356348 - RNA, 18 nt, Mycobacterium tuberculosis H37Rv
uggccaaccccauggcca

SEQ ID NO: 1356349 - RNA, 15 nt, Mycobacterium tuberculosis H37Rv
uggccaaccgggucg

SEQ ID NO: 1356350 - RNA, 20 nt, Mycobacterium tuberculosis H37Rv
uggccaacucgacauccucg

SEQ ID NO: 1356351 - RNA, 22 nt, Mycobacterium tuberculosis H37Rv
uggccaacucuucagcaagcca

SEQ ID NO: 1356352 - RNA, 19 nt, Mycobacterium tuberculosis H37Rv
uggccaaacuuucgggaca

SEQ ID NO: 1356353 - RNA, 24 nt, Mycobacterium tuberculosis H37Rv
uggccaccaaacgcugcuggcaug

SEQ ID NO: 1356354 - RNA, 15 nt, Mycobacterium tuberculosis H37Rv
uggcagccagcggcg

SEQ ID NO: 1356355 - RNA, 22 nt, Mycobacterium tuberculosis H37Rv
uggcagcccguucgaaguucuc

SEQ ID NO: 1356356 - RNA, 14 nt, Mycobacterium tuberculosis H37Rv
uggcagccugcugc

SEQ ID NO: 1356357 - RNA, 18 nt, Mycobacterium tuberculosis H37Rv
uggcagcgcggccgggcg

SEQ ID NO: 1356358 - RNA, 13 nt, Mycobacterium tuberculosis H37Rv
uggcagcgcaccc

SEQ ID NO: 1356359 - RNA, 14 nt, Mycobacterium tuberculosis H37Rv
uggcaccucgcccu

SEQ ID NO: 1356360 - RNA, 14 nt, Mycobacterium tuberculosis H37Rv
uggcaccgccagcc

SEQ ID NO: 1356361 - RNA, 22 nt, Mycobacterium tuberculosis H37Rv
uggcaccagccggugagcgagc

SEQ ID NO: 1356362 - RNA, 22 nt, Mycobacterium tuberculosis H37Rv
uggcacaagcuggggaacagca

SEQ ID NO: 1356363 - RNA, 22 nt, Mycobacterium tuberculosis H37Rv
uggcaaucccgccaucugccug

SEQ ID NO: 1356364 - RNA, 19 nt, Mycobacterium tuberculosis H37Rv
uggauuggcgucagcagca

SEQ ID NO: 1356365 - RNA, 21 nt, Mycobacterium tuberculosis H37Rv
uggauuggcgucagcagcaac

SEQ ID NO: 1356366 - RNA, 19 nt, Mycobacterium tuberculosis H37Rv
uggcaaagacgcuggccac

SEQ ID NO: 1356367 - RNA, 16 nt, Mycobacterium tuberculosis H37Rv
ugcguucaucauccac

SEQ ID NO: 1356368 - RNA, 17 nt, Mycobacterium tuberculosis H37Rv
uggauucuucagcgcgg

SEQ ID NO: 1356369 - RNA, 17 nt, Mycobacterium tuberculosis H37Rv
ugcguucggccgggccg

SEQ ID NO: 1356370 - RNA, 17 nt, Mycobacterium tuberculosis H37Rv
uguacgcaucgccguca

SEQ ID NO: 1356371 - RNA, 20 nt, Mycobacterium tuberculosis H37Rv
uguacaccgcgcccgccgau

SEQ ID NO: 1356372 - RNA, 15 nt, Mycobacterium tuberculosis H37Rv
uguaccccagcaucu

SEQ ID NO: 1356373 - RNA, 21 nt, Mycobacterium tuberculosis H37Rv
uguaacccguuaccgauuggc

SEQ ID NO: 1356374 - RNA, 16 nt, Mycobacterium tuberculosis H37Rv
ugguuucgacucgguu

SEQ ID NO: 1356375 - RNA, 21 nt, Mycobacterium tuberculosis H37Rv
ugguuucggccgcauccccgg

SEQ ID NO: 1356376 - RNA, 21 nt, Mycobacterium tuberculosis H37Rv
uggugacguugucgccaaccc

SEQ ID NO: 1356377 - RNA, 19 nt, Mycobacterium tuberculosis H37Rv
uggucggcggccucggucu

SEQ ID NO: 1356378 - RNA, 20 nt, Mycobacterium tuberculosis H37Rv
uggucggcggccucggucug

SEQ ID NO: 1356379 - RNA, 18 nt, Mycobacterium tuberculosis H37Rv
uggucggagguggggugg

SEQ ID NO: 1356380 - RNA, 23 nt, Mycobacterium tuberculosis H37Rv
uguaguccucgguggccuucugg

SEQ ID NO: 1356381 - RNA, 15 nt, Mycobacterium tuberculosis H37Rv
uguagggcuuccagg

SEQ ID NO: 1356382 - RNA, 14 nt, Mycobacterium tuberculosis H37Rv
uguagggcugcucc

SEQ ID NO: 1356383 - RNA, 15 nt, Mycobacterium tuberculosis H37Rv
uguaguacagcgcaa

SEQ ID NO: 1356384 - RNA, 17 nt, Mycobacterium tuberculosis H37Rv
uguaggccucggcagca

SEQ ID NO: 1356385 - RNA, 15 nt, Mycobacterium tuberculosis H37Rv
uguaggccgggccgg

SEQ ID NO: 1356386 - RNA, 14 nt, Mycobacterium tuberculosis H37Rv
ugucacugggccgg

SEQ ID NO: 1356387 - RNA, 16 nt, Mycobacterium tuberculosis H37Rv
ugucacguaacgccgc

SEQ ID NO: 1356388 - RNA, 18 nt, Mycobacterium tuberculosis H37Rv
ugucagugaucaccaacc

SEQ ID NO: 1356389 - RNA, 20 nt, Mycobacterium tuberculosis H37Rv
ugucagugaucaccaacccg

SEQ ID NO: 1356390 - RNA, 20 nt, Mycobacterium tuberculosis H37Rv
uguaugcguuacgccgcgag

SEQ ID NO: 1356391 - RNA, 16 nt, Mycobacterium tuberculosis H37Rv
ugucuagcugguggug

SEQ ID NO: 1356392 - RNA, 13 nt, Mycobacterium tuberculosis H37Rv
ugucgguucgucg

SEQ ID NO: 1356393 - RNA, 21 nt, Mycobacterium tuberculosis H37Rv
ugucgguuuccucgagccagc

SEQ ID NO: 1356394 - RNA, 14 nt, Mycobacterium tuberculosis H37Rv
ugucggugccgucg

SEQ ID NO: 1356395 - RNA, 14 nt, Mycobacterium tuberculosis H37Rv
ugucgggccaggcg

SEQ ID NO: 1356396 - RNA, 16 nt, Mycobacterium tuberculosis H37Rv
ugucggggccgucguc

SEQ ID NO: 1356397 - RNA, 12 nt, Mycobacterium tuberculosis H37Rv
ugucgguacuga

SEQ ID NO: 1356398 - RNA, 13 nt, Mycobacterium tuberculosis H37Rv
ugucgggauuggc

SEQ ID NO: 1356399 - RNA, 23 nt, Mycobacterium tuberculosis H37Rv
ugucgcuaugccccggagccaga

SEQ ID NO: 1356400 - RNA, 13 nt, Mycobacterium tuberculosis H37Rv
ugucgcggugcgg

SEQ ID NO: 1356401 - RNA, 20 nt, Mycobacterium tuberculosis H37Rv
ugucgcgaucgcggcaucga

SEQ ID NO: 1356402 - RNA, 16 nt, Mycobacterium tuberculosis H37Rv
uguccagguggcgcgg

SEQ ID NO: 1356403 - RNA, 19 nt, Mycobacterium tuberculosis H37Rv
uguccaggcgcgcaccacc

SEQ ID NO: 1356404 - RNA, 20 nt, Mycobacterium tuberculosis H37Rv
uguccaggcgcgcaccaccg

SEQ ID NO: 1356405 - RNA, 16 nt, Mycobacterium tuberculosis H37Rv
uguccagcguccuggc

SEQ ID NO: 1356406 - RNA, 19 nt, Mycobacterium tuberculosis H37Rv
ugucgccagggagcgcagc

SEQ ID NO: 1356407 - RNA, 20 nt, Mycobacterium tuberculosis H37Rv
ugucgccgaacgccaccacc

SEQ ID NO: 1356408 - RNA, 18 nt, Mycobacterium tuberculosis H37Rv
ugucgccgccgcgacuga

SEQ ID NO: 1356409 - RNA, 21 nt, Mycobacterium tuberculosis H37Rv
ugucgccgccgcgacugacga

SEQ ID NO: 1356410 - RNA, 16 nt, Mycobacterium tuberculosis H37Rv
ugucgccgccguugcc

SEQ ID NO: 1356411 - RNA, 18 nt, Mycobacterium tuberculosis H37Rv
ugucgccgucgcggcacg

SEQ ID NO: 1356412 - RNA, 23 nt, Mycobacterium tuberculosis H37Rv
uguccagaacggcgaucaccgag

SEQ ID NO: 1356413 - RNA, 13 nt, Mycobacterium tuberculosis H37Rv
uguccagaacggu

SEQ ID NO: 1356414 - RNA, 18 nt, Mycobacterium tuberculosis H37Rv
uguccagaauccaggugg

SEQ ID NO: 1356415 - RNA, 18 nt, Mycobacterium tuberculosis H37Rv
uguccaccagcguguagc

SEQ ID NO: 1356416 - RNA, 14 nt, Mycobacterium tuberculosis H37Rv
uguccaccgcggcg

SEQ ID NO: 1356417 - RNA, 21 nt, Mycobacterium tuberculosis H37Rv
ugucauugcugcccaauggcg

SEQ ID NO: 1356418 - RNA, 16 nt, Mycobacterium tuberculosis H37Rv
ugugcggcguuguggc

SEQ ID NO: 1356419 - RNA, 15 nt, Mycobacterium tuberculosis H37Rv
ugugcgauccagggc

SEQ ID NO: 1356420 - RNA, 23 nt, Mycobacterium tuberculosis H37Rv
ugugcgaccacaucaugccagcc

SEQ ID NO: 1356421 - RNA, 16 nt, Mycobacterium tuberculosis H37Rv
ugugcgagcugcgggu

SEQ ID NO: 1356422 - RNA, 17 nt, Mycobacterium tuberculosis H37Rv
ugugccuacuugcucga

SEQ ID NO: 1356423 - RNA, 17 nt, Mycobacterium tuberculosis H37Rv
ugugccguccccggccg

SEQ ID NO: 1356424 - RNA, 13 nt, Mycobacterium tuberculosis H37Rv
ugugccacggggc

SEQ ID NO: 1356425 - RNA, 21 nt, Mycobacterium tuberculosis H37Rv
ugugccacuucuucacuggcg

SEQ ID NO: 1356426 - RNA, 19 nt, Mycobacterium tuberculosis H37Rv
ugugacgggcacaaccaga

SEQ ID NO: 1356427 - RNA, 21 nt, Mycobacterium tuberculosis H37Rv
ugugacuuauccggccaguga

SEQ ID NO: 1356428 - RNA, 11 nt, Mycobacterium tuberculosis H37Rv
ugugagcagac

SEQ ID NO: 1356429 - RNA, 23 nt, Mycobacterium tuberculosis H37Rv
ugugagccacgcgcaaacucaga

SEQ ID NO: 1356430 - RNA, 12 nt, Mycobacterium tuberculosis H37Rv
ugugacaucggg

SEQ ID NO: 1356431 - RNA, 15 nt, Mycobacterium tuberculosis H37Rv
ugugacgccgggcug

SEQ ID NO: 1356432 - RNA, 17 nt, Mycobacterium tuberculosis H37Rv
ugugacgggcacaacca

SEQ ID NO: 1356433 - RNA, 16 nt, Mycobacterium tuberculosis H37Rv
uguguaucaacagauu

SEQ ID NO: 1356434 - RNA, 18 nt, Mycobacterium tuberculosis H37Rv
uguggucuucaucgccgu

SEQ ID NO: 1356435 - RNA, 19 nt, Mycobacterium tuberculosis H37Rv
uguggucggugccagcacc

SEQ ID NO: 1356436 - RNA, 15 nt, Mycobacterium tuberculosis H37Rv
uguggucacccgcag

SEQ ID NO: 1356437 - RNA, 21 nt, Mycobacterium tuberculosis H37Rv
ugugggugguugugucggccu

SEQ ID NO: 1356438 - RNA, 20 nt, Mycobacterium tuberculosis H37Rv
uguggccguggguuugagcc

SEQ ID NO: 1356439 - RNA, 17 nt, Mycobacterium tuberculosis H37Rv
uguggcccaacaccgcc

SEQ ID NO: 1356440 - RNA, 24 nt, Mycobacterium tuberculosis H37Rv
uguggcccacauguccagcguccu

SEQ ID NO: 1356441 - RNA, 13 nt, Mycobacterium tuberculosis H37Rv
uguggcacccggc

SEQ ID NO: 1356442 - RNA, 21 nt, Mycobacterium tuberculosis H37Rv
ugugggaacuggaccacagcc

SEQ ID NO: 1356443 - RNA, 15 nt, Mycobacterium tuberculosis H37Rv
uguggcuuugacugc

SEQ ID NO: 1356444 - RNA, 16 nt, Mycobacterium tuberculosis H37Rv
uguggcugagcagguc

SEQ ID NO: 1356445 - RNA, 16 nt, Mycobacterium tuberculosis H37Rv
ugugcugccaccggcc

SEQ ID NO: 1356446 - RNA, 15 nt, Mycobacterium tuberculosis H37Rv
ugugcgucuccagcu

SEQ ID NO: 1356447 - RNA, 20 nt, Mycobacterium tuberculosis H37Rv
ugugcgucguucggagcccu

SEQ ID NO: 1356448 - RNA, 13 nt, Mycobacterium tuberculosis H37Rv
uguuaaagaagcc

SEQ ID NO: 1356449 - RNA, 19 nt, Mycobacterium tuberculosis H37Rv
uguguccgaaggcuugucg

SEQ ID NO: 1356450 - RNA, 12 nt, Mycobacterium tuberculosis H37Rv
uguguggcagcc

SEQ ID NO: 1356451 - RNA, 22 nt, Mycobacterium tuberculosis H37Rv
uguguuccaacuccugcagccc

SEQ ID NO: 1356452 - RNA, 11 nt, Mycobacterium tuberculosis H37Rv
uuaccggugac

SEQ ID NO: 1356453 - RNA, 15 nt, Mycobacterium tuberculosis H37Rv
uuacgcaccgaggcc

SEQ ID NO: 1356454 - RNA, 23 nt, Mycobacterium tuberculosis H37Rv
uuagcggcugagggcccuuggcc

SEQ ID NO: 1356455 - RNA, 20 nt, Mycobacterium tuberculosis H37Rv
uuaacacccugggcaaacug

SEQ ID NO: 1356456 - RNA, 13 nt, Mycobacterium tuberculosis H37Rv
uguuuggugguuu

SEQ ID NO: 1356457 - RNA, 14 nt, Mycobacterium tuberculosis H37Rv
uguuuggguuuugu

SEQ ID NO: 1356458 - RNA, 22 nt, Mycobacterium tuberculosis H37Rv
uguuuugucaggauauuucuaa

SEQ ID NO: 1356459 - RNA, 20 nt, Mycobacterium tuberculosis H37Rv
uguucacccacuccgccgau

SEQ ID NO: 1356460 - RNA, 13 nt, Mycobacterium tuberculosis H37Rv
uguucagcccgcc

SEQ ID NO: 1356461 - RNA, 17 nt, Mycobacterium tuberculosis H37Rv
uguuauuuuuggccaug

SEQ ID NO: 1356462 - RNA, 21 nt, Mycobacterium tuberculosis H37Rv
uguuauuuuuggccaugcucu

SEQ ID NO: 1356463 - RNA, 17 nt, Mycobacterium tuberculosis H37Rv
uguucaaucccuccgcc

SEQ ID NO: 1356464 - RNA, 19 nt, Mycobacterium tuberculosis H37Rv
uguuagugaggcccgaguu

SEQ ID NO: 1356465 - RNA, 15 nt, Mycobacterium tuberculosis H37Rv
uguuauugaugcccg

SEQ ID NO: 1356466 - RNA, 15 nt, Mycobacterium tuberculosis H37Rv
uguuccacaccaggc

SEQ ID NO: 1356467 - RNA, 21 nt, Mycobacterium tuberculosis H37Rv
uguuccacaccaggccgagcc

SEQ ID NO: 1356468 - RNA, 18 nt, Mycobacterium tuberculosis H37Rv
uguuccaacuccugcagc

SEQ ID NO: 1356469 - RNA, 15 nt, Mycobacterium tuberculosis H37Rv
uguuccgccacccgc

SEQ ID NO: 1356470 - RNA, 20 nt, Mycobacterium tuberculosis H37Rv
uguuccagaaggccgcaccg

SEQ ID NO: 1356471 - RNA, 22 nt, Mycobacterium tuberculosis H37Rv
uguuccagcggguggccaucac

SEQ ID NO: 1356472 - RNA, 23 nt, Mycobacterium tuberculosis H37Rv
uguucgugccggcguugccgaaa

SEQ ID NO: 1356473 - RNA, 15 nt, Mycobacterium tuberculosis H37Rv
uguucgacacccucg

SEQ ID NO: 1356474 - RNA, 19 nt, Mycobacterium tuberculosis H37Rv
uguuccuugugaccccggc

SEQ ID NO: 1356475 - RNA, 21 nt, Mycobacterium tuberculosis H37Rv
uguucggcccuauggguuccu

SEQ ID NO: 1356476 - RNA, 18 nt, Mycobacterium tuberculosis H37Rv
uguucggugguccuggcg

SEQ ID NO: 1356477 - RNA, 12 nt, Mycobacterium tuberculosis H37Rv
uguucugcacgu

SEQ ID NO: 1356478 - RNA, 16 nt, Mycobacterium tuberculosis H37Rv
uguugaccgggucguc

SEQ ID NO: 1356479 - RNA, 15 nt, Mycobacterium tuberculosis H37Rv
uguugaagaagcccg

SEQ ID NO: 1356480 - RNA, 16 nt, Mycobacterium tuberculosis H37Rv
uguugacgcccgaguu

SEQ ID NO: 1356481 - RNA, 16 nt, Mycobacterium tuberculosis H37Rv
uguugcgcacccgcgg

SEQ ID NO: 1356482 - RNA, 22 nt, Mycobacterium tuberculosis H37Rv
uguugcccugcaacccggucgg

SEQ ID NO: 1356483 - RNA, 18 nt, Mycobacterium tuberculosis H37Rv
uguugcggcugaccuccc

SEQ ID NO: 1356484 - RNA, 22 nt, Mycobacterium tuberculosis H37Rv
uguugcccaauucgacugcaac

SEQ ID NO: 1356485 - RNA, 10 nt, Mycobacterium tuberculosis H37Rv
uguuguugaa

SEQ ID NO: 1356486 - RNA, 15 nt, Mycobacterium tuberculosis H37Rv
uguuguugaagcccg

SEQ ID NO: 1356487 - RNA, 12 nt, Mycobacterium tuberculosis H37Rv
uguuguuugaga

SEQ ID NO: 1356488 - RNA, 13 nt, Mycobacterium tuberculosis H37Rv
uguuguacuggcu

SEQ ID NO: 1356489 - RNA, 15 nt, Mycobacterium tuberculosis H37Rv
uguugucugaccccc

SEQ ID NO: 1356490 - RNA, 19 nt, Mycobacterium tuberculosis H37Rv
uguugugagauuggcagac

SEQ ID NO: 1356491 - RNA, 16 nt, Mycobacterium tuberculosis H37Rv
uguuggcaugccgccc

SEQ ID NO: 1356492 - RNA, 20 nt, Mycobacterium tuberculosis H37Rv
uguugggcgcgaaacgccgc

SEQ ID NO: 1356493 - RNA, 14 nt, Mycobacterium tuberculosis H37Rv
uguugggagccacc

SEQ ID NO: 1356494 - RNA, 18 nt, Mycobacterium tuberculosis H37Rv
ugcaccgaagauggccag

SEQ ID NO: 1356495 - RNA, 19 nt, Mycobacterium tuberculosis H37Rv
ugcaccgaagauggccagc

SEQ ID NO: 1356496 - RNA, 13 nt, Mycobacterium tuberculosis H37Rv
ugcaccccaugac

SEQ ID NO: 1356497 - RNA, 17 nt, Mycobacterium tuberculosis H37Rv
ugcaccgagccgucguc

SEQ ID NO: 1356498 - RNA, 22 nt, Mycobacterium tuberculosis H37Rv
ugcaccgcggccagcaccagcu

SEQ ID NO: 1356499 - RNA, 16 nt, Mycobacterium tuberculosis H37Rv
ugcaccgccgccgccc

SEQ ID NO: 1356500 - RNA, 20 nt, Mycobacterium tuberculosis H37Rv
ugcacccaccccgaagaugc

SEQ ID NO: 1356501 - RNA, 17 nt, Mycobacterium tuberculosis H37Rv
ugcacgcucggcgccgu

SEQ ID NO: 1356502 - RNA, 20 nt, Mycobacterium tuberculosis H37Rv
ugcacgcucugcgccacagc

SEQ ID NO: 1356503 - RNA, 22 nt, Mycobacterium tuberculosis H37Rv
ugcacgcgggcguuggccagca

SEQ ID NO: 1356504 - RNA, 20 nt, Mycobacterium tuberculosis H37Rv
ugcacgcgggugccgacguc

SEQ ID NO: 1356505 - RNA, 18 nt, Mycobacterium tuberculosis H37Rv
ugcacgcgauggccauca

SEQ ID NO: 1356506 - RNA, 12 nt, Mycobacterium tuberculosis H37Rv
ugcacggccggg

SEQ ID NO: 1356507 - RNA, 24 nt, Mycobacterium tuberculosis H37Rv
ugcacggacaguuccccgggcucg

SEQ ID NO: 1356508 - RNA, 19 nt, Mycobacterium tuberculosis H37Rv
ugcacgccucaaaaaucgu

SEQ ID NO: 1356509 - RNA, 22 nt, Mycobacterium tuberculosis H37Rv
ugcacgccgauaccgugcaccu

SEQ ID NO: 1356510 - RNA, 18 nt, Mycobacterium tuberculosis H37Rv
ugcacgcaccacaaucca

SEQ ID NO: 1356511 - RNA, 14 nt, Mycobacterium tuberculosis H37Rv
ugcagaaacagccg

SEQ ID NO: 1356512 - RNA, 20 nt, Mycobacterium tuberculosis H37Rv
ugcagaaacagccgcagcgg

SEQ ID NO: 1356513 - RNA, 21 nt, Mycobacterium tuberculosis H37Rv
ugcacgguaucggugcugguc

SEQ ID NO: 1356514 - RNA, 18 nt, Mycobacterium tuberculosis H37Rv
ugcacggucaugccgccg

SEQ ID NO: 1356515 - RNA, 14 nt, Mycobacterium tuberculosis H37Rv
ugcacggugcccag

SEQ ID NO: 1356516 - RNA, 15 nt, Mycobacterium tuberculosis H37Rv
ugcaggaccagcacc

SEQ ID NO: 1356517 - RNA, 16 nt, Mycobacterium tuberculosis H37Rv
ugcaggaccagcaccg

SEQ ID NO: 1356518 - RNA, 23 nt, Mycobacterium tuberculosis H37Rv
ugcaggacgcccacaugcucagg

SEQ ID NO: 1356519 - RNA, 19 nt, Mycobacterium tuberculosis H37Rv
ugcaggaucggcuugggaa

SEQ ID NO: 1356520 - RNA, 13 nt, Mycobacterium tuberculosis H37Rv
ugcaggccagagu

SEQ ID NO: 1356521 - RNA, 16 nt, Mycobacterium tuberculosis H37Rv
ugcaggauucggcggu

SEQ ID NO: 1356522 - RNA, 16 nt, Mycobacterium tuberculosis H37Rv
ugcaggcccaggcugu

SEQ ID NO: 1356523 - RNA, 23 nt, Mycobacterium tuberculosis H37Rv
ugcagcuguaauuccucggauaa

SEQ ID NO: 1356524 - RNA, 20 nt, Mycobacterium tuberculosis H37Rv
ugcagcgcaggauucugcug

SEQ ID NO: 1356525 - RNA, 19 nt, Mycobacterium tuberculosis H37Rv
ugcagcgcacgcagccgau

SEQ ID NO: 1356526 - RNA, 17 nt, Mycobacterium tuberculosis H37Rv
ugcagcgaucccggcaa

SEQ ID NO: 1356527 - RNA, 21 nt, Mycobacterium tuberculosis H37Rv
ugcagcgcgguggucagcacc

SEQ ID NO: 1356528 - RNA, 17 nt, Mycobacterium tuberculosis H37Rv
ugcagcgcguucggcac

SEQ ID NO: 1356529 - RNA, 18 nt, Mycobacterium tuberculosis H37Rv
ugcagcgcgauggccugg

SEQ ID NO: 1356530 - RNA, 18 nt, Mycobacterium tuberculosis H37Rv
ugcagcagcauccggccg

SEQ ID NO: 1356531 - RNA, 13 nt, Mycobacterium tuberculosis H37Rv
ugcagaccgggug

SEQ ID NO: 1356532 - RNA, 18 nt, Mycobacterium tuberculosis H37Rv
ugcagacggguggcccga

SEQ ID NO: 1356533 - RNA, 13 nt, Mycobacterium tuberculosis H37Rv
ugcagcagcgcgc

SEQ ID NO: 1356534 - RNA, 14 nt, Mycobacterium tuberculosis H37Rv
ugcagcagggcuuc

SEQ ID NO: 1356535 - RNA, 20 nt, Mycobacterium tuberculosis H37Rv
ugcagcgacgacgcccacca

SEQ ID NO: 1356536 - RNA, 15 nt, Mycobacterium tuberculosis H37Rv
ugcaucgaucaccgc

SEQ ID NO: 1356537 - RNA, 18 nt, Mycobacterium tuberculosis H37Rv
ugcauccggcccacucac

SEQ ID NO: 1356538 - RNA, 19 nt, Mycobacterium tuberculosis H37Rv
ugcaucgcgauuccggcgg

SEQ ID NO: 1356539 - RNA, 19 nt, Mycobacterium tuberculosis H37Rv
ugcaugagcguucagcacg

SEQ ID NO: 1356540 - RNA, 18 nt, Mycobacterium tuberculosis H37Rv
ugcauccauccugccuua

SEQ ID NO: 1356541 - RNA, 21 nt, Mycobacterium tuberculosis H37Rv
ugcauccacugcggcgcuggg

SEQ ID NO: 1356542 - RNA, 18 nt, Mycobacterium tuberculosis H37Rv
ugcagggccacuggccgg

SEQ ID NO: 1356543 - RNA, 21 nt, Mycobacterium tuberculosis H37Rv
ugcaggcugguuucggccgca

SEQ ID NO: 1356544 - RNA, 22 nt, Mycobacterium tuberculosis H37Rv
ugcaggcggccuugccgggccg

SEQ ID NO: 1356545 - RNA, 23 nt, Mycobacterium tuberculosis H37Rv
ugcaggcggccuugccgggccgc

SEQ ID NO: 1356546 - RNA, 14 nt, Mycobacterium tuberculosis H37Rv
ugcaggcgcagcug

SEQ ID NO: 1356547 - RNA, 23 nt, Mycobacterium tuberculosis H37Rv
ugccaacgcccguguugaagaag

SEQ ID NO: 1356548 - RNA, 21 nt, Mycobacterium tuberculosis H37Rv
ugccaacgacaggcgcccaca

SEQ ID NO: 1356549 - RNA, 21 nt, Mycobacterium tuberculosis H37Rv
ugccaaaggacgacaccgcga

SEQ ID NO: 1356550 - RNA, 18 nt, Mycobacterium tuberculosis H37Rv
ugccacugccguugccgc

SEQ ID NO: 1356551 - RNA, 14 nt, Mycobacterium tuberculosis H37Rv
ugccagaucagcac

SEQ ID NO: 1356552 - RNA, 11 nt, Mycobacterium tuberculosis H37Rv
ugccagcacca

SEQ ID NO: 1356553 - RNA, 12 nt, Mycobacterium tuberculosis H37Rv
ugccacaggcgu

SEQ ID NO: 1356554 - RNA, 14 nt, Mycobacterium tuberculosis H37Rv
ugccacacaggcgu

SEQ ID NO: 1356555 - RNA, 16 nt, Mycobacterium tuberculosis H37Rv
ugccacagaccgaaca

SEQ ID NO: 1356556 - RNA, 22 nt, Mycobacterium tuberculosis H37Rv
ugccacagaccgaacagcaccg

SEQ ID NO: 1356557 - RNA, 23 nt, Mycobacterium tuberculosis H37Rv
ugccacagcucgccgugaccagg

SEQ ID NO: 1356558 - RNA, 22 nt, Mycobacterium tuberculosis H37Rv
ugccacguucgcgggcgucccg

SEQ ID NO: 1356559 - RNA, 22 nt, Mycobacterium tuberculosis H37Rv
ugccacgcucggugcugcgccg

SEQ ID NO: 1356560 - RNA, 13 nt, Mycobacterium tuberculosis H37Rv
ugccacgccgccg

SEQ ID NO: 1356561 - RNA, 23 nt, Mycobacterium tuberculosis H37Rv
ugccacgcguuccuccagcagcg

SEQ ID NO: 1356562 - RNA, 15 nt, Mycobacterium tuberculosis H37Rv
ugcccaaggccagga

SEQ ID NO: 1356563 - RNA, 15 nt, Mycobacterium tuberculosis H37Rv
ugcccaagcagucca

SEQ ID NO: 1356564 - RNA, 16 nt, Mycobacterium tuberculosis H37Rv
ugccauaggacaggaa

SEQ ID NO: 1356565 - RNA, 17 nt, Mycobacterium tuberculosis H37Rv
ugccaucaaggccaccu

SEQ ID NO: 1356566 - RNA, 16 nt, Mycobacterium tuberculosis H37Rv
ugccagugccgcccac

SEQ ID NO: 1356567 - RNA, 14 nt, Mycobacterium tuberculosis H37Rv
ugccagugauggcg

SEQ ID NO: 1356568 - RNA, 17 nt, Mycobacterium tuberculosis H37Rv
ugccagugauggcgcgg

SEQ ID NO: 1356569 - RNA, 13 nt, Mycobacterium tuberculosis H37Rv
ugccagggcgggc

SEQ ID NO: 1356570 - RNA, 19 nt, Mycobacterium tuberculosis H37Rv
ugccaggugcggugaucga

SEQ ID NO: 1356571 - RNA, 19 nt, Mycobacterium tuberculosis H37Rv
ugccaguagucgccgggcg

SEQ ID NO: 1356572 - RNA, 20 nt, Mycobacterium tuberculosis H37Rv
ugccaggacuggcaccgcca

SEQ ID NO: 1356573 - RNA, 16 nt, Mycobacterium tuberculosis H37Rv
ugccaggaccgcgccg

SEQ ID NO: 1356574 - RNA, 16 nt, Mycobacterium tuberculosis H37Rv
ugccaggcgcagcugg

SEQ ID NO: 1356575 - RNA, 19 nt, Mycobacterium tuberculosis H37Rv
ugccagcaggccgaagaaa

SEQ ID NO: 1356576 - RNA, 14 nt, Mycobacterium tuberculosis H37Rv
ugccagcgccgccg

SEQ ID NO: 1356577 - RNA, 15 nt, Mycobacterium tuberculosis H37Rv
ugccagccgugcagg

SEQ ID NO: 1356578 - RNA, 21 nt, Mycobacterium tuberculosis H37Rv
ugccagccgucaccgcgaccc

SEQ ID NO: 1356579 - RNA, 23 nt, Mycobacterium tuberculosis H37Rv
ugccagcggccgggcggccaggc

SEQ ID NO: 1356580 - RNA, 18 nt, Mycobacterium tuberculosis H37Rv
ugcccggcaaccuggacu

SEQ ID NO: 1356581 - RNA, 23 nt, Mycobacterium tuberculosis H37Rv
ugcccggcaaccuggacuggguc

SEQ ID NO: 1356582 - RNA, 13 nt, Mycobacterium tuberculosis H37Rv
ugcccggccgcca

SEQ ID NO: 1356583 - RNA, 21 nt, Mycobacterium tuberculosis H37Rv
ugcccggccgccagcgcgccg

SEQ ID NO: 1356584 - RNA, 21 nt, Mycobacterium tuberculosis H37Rv
ugcccgccguagaccagccgu

SEQ ID NO: 1356585 - RNA, 14 nt, Mycobacterium tuberculosis H37Rv
ugcccgcgcggcca

SEQ ID NO: 1356586 - RNA, 15 nt, Mycobacterium tuberculosis H37Rv
ugcccgguuucuucu

SEQ ID NO: 1356587 - RNA, 22 nt, Mycobacterium tuberculosis H37Rv
ugcccggcucucagcgacagcu

SEQ ID NO: 1356588 - RNA, 14 nt, Mycobacterium tuberculosis H37Rv
ugcccggcgcgaag

SEQ ID NO: 1356589 - RNA, 19 nt, Mycobacterium tuberculosis H37Rv
ugcccgggcggucgaagac

SEQ ID NO: 1356590 - RNA, 20 nt, Mycobacterium tuberculosis H37Rv
ugcccgggacaaguucggua

SEQ ID NO: 1356591 - RNA, 17 nt, Mycobacterium tuberculosis H37Rv
ugcccgggaccauagcc

SEQ ID NO: 1356592 - RNA, 17 nt, Mycobacterium tuberculosis H37Rv
ugcccgggcccgucguc

SEQ ID NO: 1356593 - RNA, 20 nt, Mycobacterium tuberculosis H37Rv
ugccccuucaaagcggccuc

SEQ ID NO: 1356594 - RNA, 23 nt, Mycobacterium tuberculosis H37Rv
ugcccgaaccaccaccggcaaca

SEQ ID NO: 1356595 - RNA, 19 nt, Mycobacterium tuberculosis H37Rv
ugcccgaagagcacgucaa

SEQ ID NO: 1356596 - RNA, 23 nt, Mycobacterium tuberculosis H37Rv
ugcccgacccgccgacgccgccg

SEQ ID NO: 1356597 - RNA, 13 nt, Mycobacterium tuberculosis H37Rv
ugcccgacgaugc

SEQ ID NO: 1356598 - RNA, 18 nt, Mycobacterium tuberculosis H37Rv
ugcccgagcccagccggg

SEQ ID NO: 1356599 - RNA, 22 nt, Mycobacterium tuberculosis H37Rv
ugcccgauacccggugauggug

SEQ ID NO: 1356600 - RNA, 15 nt, Mycobacterium tuberculosis H37Rv
ugcccgcaacgccaa

SEQ ID NO: 1356601 - RNA, 18 nt, Mycobacterium tuberculosis H37Rv
ugcccgcauugccaacgc

SEQ ID NO: 1356602 - RNA, 19 nt, Mycobacterium tuberculosis H37Rv
ugcccgcauugccaacgcc

SEQ ID NO: 1356603 - RNA, 18 nt, Mycobacterium tuberculosis H37Rv
ugcccgccagcgccgccg

SEQ ID NO: 1356604 - RNA, 21 nt, Mycobacterium tuberculosis H37Rv
ugcccgccaccggcgcgaccg

SEQ ID NO: 1356605 - RNA, 14 nt, Mycobacterium tuberculosis H37Rv
ugcccgcccagccc

SEQ ID NO: 1356606 - RNA, 13 nt, Mycobacterium tuberculosis H37Rv
ugcccgccgcguc

SEQ ID NO: 1356607 - RNA, 19 nt, Mycobacterium tuberculosis H37Rv
ugcccagcgcacggaccau

SEQ ID NO: 1356608 - RNA, 15 nt, Mycobacterium tuberculosis H37Rv
ugcccagcgccgaau

SEQ ID NO: 1356609 - RNA, 20 nt, Mycobacterium tuberculosis H37Rv
ugcccagcgaauccaggccg

SEQ ID NO: 1356610 - RNA, 18 nt, Mycobacterium tuberculosis H37Rv
ugcccaggucuccaucaa

SEQ ID NO: 1356611 - RNA, 18 nt, Mycobacterium tuberculosis H37Rv
ugcccaggugcguccagg

SEQ ID NO: 1356612 - RNA, 23 nt, Mycobacterium tuberculosis H37Rv
ugcccaggugcguccaggccagg

SEQ ID NO: 1356613 - RNA, 19 nt, Mycobacterium tuberculosis H37Rv
ugcccacggcgaccacgcc

SEQ ID NO: 1356614 - RNA, 23 nt, Mycobacterium tuberculosis H37Rv
ugcccacggcgaccacgccgccg

SEQ ID NO: 1356615 - RNA, 13 nt, Mycobacterium tuberculosis H37Rv
ugcccacgggccg

SEQ ID NO: 1356616 - RNA, 16 nt, Mycobacterium tuberculosis H37Rv
ugcccacgggccggcc

SEQ ID NO: 1356617 - RNA, 19 nt, Mycobacterium tuberculosis H37Rv
ugcccagaaaaccgccgca

SEQ ID NO: 1356618 - RNA, 23 nt, Mycobacterium tuberculosis H37Rv
ugcccagcacccccugcaccguc

SEQ ID NO: 1356619 - RNA, 15 nt, Mycobacterium tuberculosis H37Rv
ugcccagcagcgcga

SEQ ID NO: 1356620 - RNA, 21 nt, Mycobacterium tuberculosis H37Rv
ugccccgccguaccgaagcgg

SEQ ID NO: 1356621 - RNA, 14 nt, Mycobacterium tuberculosis H37Rv
ugccccgccgagcg

SEQ ID NO: 1356622 - RNA, 21 nt, Mycobacterium tuberculosis H37Rv
ugccccgccuuggccaccauc

SEQ ID NO: 1356623 - RNA, 14 nt, Mycobacterium tuberculosis H37Rv
ugccccgccuuggc

SEQ ID NO: 1356624 - RNA, 16 nt, Mycobacterium tuberculosis H37Rv
ugccccgaaccgcgcu

SEQ ID NO: 1356625 - RNA, 19 nt, Mycobacterium tuberculosis H37Rv
ugcccccguucuggaaccc

SEQ ID NO: 1356626 - RNA, 20 nt, Mycobacterium tuberculosis H37Rv
ugccccgcaucgcccaagcc

SEQ ID NO: 1356627 - RNA, 20 nt, Mycobacterium tuberculosis H37Rv
ugccccgaccgccguggccg

SEQ ID NO: 1356628 - RNA, 14 nt, Mycobacterium tuberculosis H37Rv
ugccccgcagcacu

SEQ ID NO: 1356629 - RNA, 16 nt, Mycobacterium tuberculosis H37Rv
ugccccgcagcacucg

SEQ ID NO: 1356630 - RNA, 15 nt, Mycobacterium tuberculosis H37Rv
ugccccgcagcaucg

SEQ ID NO: 1356631 - RNA, 14 nt, Mycobacterium tuberculosis H37Rv
ugcccccgccggcc

SEQ ID NO: 1356632 - RNA, 19 nt, Mycobacterium tuberculosis H37Rv
ugcccccauugccgccguc

SEQ ID NO: 1356633 - RNA, 23 nt, Mycobacterium tuberculosis H37Rv
ugccccaguccgaagcugcugcu

SEQ ID NO: 1356634 - RNA, 15 nt, Mycobacterium tuberculosis H37Rv
ugcccauagccaggu

SEQ ID NO: 1356635 - RNA, 13 nt, Mycobacterium tuberculosis H37Rv
ugcccaucuccaa

SEQ ID NO: 1356636 - RNA, 14 nt, Mycobacterium tuberculosis H37Rv
ugcccaucuccaac

SEQ ID NO: 1356637 - RNA, 13 nt, Mycobacterium tuberculosis H37Rv
ugcccaucggcau

SEQ ID NO: 1356638 - RNA, 18 nt, Mycobacterium tuberculosis H37Rv
ugcccaugcggcaggugc

SEQ ID NO: 1356639 - RNA, 20 nt, Mycobacterium tuberculosis H37Rv
ugcccaugauggccgcggcu

SEQ ID NO: 1356640 - RNA, 12 nt, Mycobacterium tuberculosis H37Rv
ugccccaagcca

SEQ ID NO: 1356641 - RNA, 15 nt, Mycobacterium tuberculosis H37Rv
ugccgccgcacaucu

SEQ ID NO: 1356642 - RNA, 23 nt, Mycobacterium tuberculosis H37Rv
ugccgccggcgccacccgcgccg

SEQ ID NO: 1356643 - RNA, 22 nt, Mycobacterium tuberculosis H37Rv
ugccgccggccccgccgucacc

SEQ ID NO: 1356644 - RNA, 19 nt, Mycobacterium tuberculosis H37Rv
ugccgccggccccgccguu

SEQ ID NO: 1356645 - RNA, 13 nt, Mycobacterium tuberculosis H37Rv
ugccgccgcggcg

SEQ ID NO: 1356646 - RNA, 16 nt, Mycobacterium tuberculosis H37Rv
ugccgccgcggccacc

SEQ ID NO: 1356647 - RNA, 14 nt, Mycobacterium tuberculosis H37Rv
ugccgccgcggcag

SEQ ID NO: 1356648 - RNA, 14 nt, Mycobacterium tuberculosis H37Rv
ugccgccgcggcca

SEQ ID NO: 1356649 - RNA, 21 nt, Mycobacterium tuberculosis H37Rv
ugccgccgucgccacgcccag

SEQ ID NO: 1356650 - RNA, 17 nt, Mycobacterium tuberculosis H37Rv
ugccgccgucgccgcca

SEQ ID NO: 1356651 - RNA, 17 nt, Mycobacterium tuberculosis H37Rv
ugccgccgucgccgccg

SEQ ID NO: 1356652 - RNA, 20 nt, Mycobacterium tuberculosis H37Rv
ugccgccgucaccgccgacc

SEQ ID NO: 1356653 - RNA, 21 nt, Mycobacterium tuberculosis H37Rv
ugccgccgucaccgccgacca

SEQ ID NO: 1356654 - RNA, 19 nt, Mycobacterium tuberculosis H37Rv
ugccgccgucaccgccguu

SEQ ID NO: 1356655 - RNA, 22 nt, Mycobacterium tuberculosis H37Rv
ugccgccggugccgaucagcag

SEQ ID NO: 1356656 - RNA, 17 nt, Mycobacterium tuberculosis H37Rv
ugccgccggugccaccc

SEQ ID NO: 1356657 - RNA, 16 nt, Mycobacterium tuberculosis H37Rv
ugccgccggugccacc

SEQ ID NO: 1356658 - RNA, 22 nt, Mycobacterium tuberculosis H37Rv
ugccgccgucguugcccgaccc

SEQ ID NO: 1356659 - RNA, 17 nt, Mycobacterium tuberculosis H37Rv
ugccgccggugccgcca

SEQ ID NO: 1356660 - RNA, 23 nt, Mycobacterium tuberculosis H37Rv
ugccgccgguguugccguuaccg

SEQ ID NO: 1356661 - RNA, 16 nt, Mycobacterium tuberculosis H37Rv
ugccgccguugccacc

SEQ ID NO: 1356662 - RNA, 21 nt, Mycobacterium tuberculosis H37Rv
ugccgccguugccgccauggc

SEQ ID NO: 1356663 - RNA, 15 nt, Mycobacterium tuberculosis H37Rv
ugccgccgugguugc

SEQ ID NO: 1356664 - RNA, 18 nt, Mycobacterium tuberculosis H37Rv
ugccgccguugccggcuu

SEQ ID NO: 1356665 - RNA, 20 nt, Mycobacterium tuberculosis H37Rv
ugccgcgaucgggcccagca

SEQ ID NO: 1356666 - RNA, 15 nt, Mycobacterium tuberculosis H37Rv
ugccgcgcagcugcc

SEQ ID NO: 1356667 - RNA, 21 nt, Mycobacterium tuberculosis H37Rv
ugccgcgcagcugccgcaccc

SEQ ID NO: 1356668 - RNA, 14 nt, Mycobacterium tuberculosis H37Rv
ugccgcgccgacgc

SEQ ID NO: 1356669 - RNA, 12 nt, Mycobacterium tuberculosis H37Rv
ugccgcgcggcg

SEQ ID NO: 1356670 - RNA, 14 nt, Mycobacterium tuberculosis H37Rv
ugccgcgccacugu

SEQ ID NO: 1356671 - RNA, 13 nt, Mycobacterium tuberculosis H37Rv
ugccgcgcgcccg

SEQ ID NO: 1356672 - RNA, 21 nt, Mycobacterium tuberculosis H37Rv
ugccgcuuagcaaucggcagg

SEQ ID NO: 1356673 - RNA, 21 nt, Mycobacterium tuberculosis H37Rv
ugccggaggaucgcugguugg

SEQ ID NO: 1356674 - RNA, 18 nt, Mycobacterium tuberculosis H37Rv
ugccggacagcucgcgcu

SEQ ID NO: 1356675 - RNA, 18 nt, Mycobacterium tuberculosis H37Rv
ugccggaccaccgggccg

SEQ ID NO: 1356676 - RNA, 18 nt, Mycobacterium tuberculosis H37Rv
ugccgcugagcccugcgc

SEQ ID NO: 1356677 - RNA, 22 nt, Mycobacterium tuberculosis H37Rv
ugccgcugcgccgucgcagcca

SEQ ID NO: 1356678 - RNA, 20 nt, Mycobacterium tuberculosis H37Rv
ugccgcggaggcggccagcc

SEQ ID NO: 1356679 - RNA, 20 nt, Mycobacterium tuberculosis H37Rv
ugccgcgguugugcugggug

SEQ ID NO: 1356680 - RNA, 20 nt, Mycobacterium tuberculosis H37Rv
ugccgcguagaacccaggcc

SEQ ID NO: 1356681 - RNA, 14 nt, Mycobacterium tuberculosis H37Rv
ugccgcgucggccg

SEQ ID NO: 1356682 - RNA, 15 nt, Mycobacterium tuberculosis H37Rv
ugccgcgucggccgc

SEQ ID NO: 1356683 - RNA, 18 nt, Mycobacterium tuberculosis H37Rv
ugccgcgucggccgcgcu

SEQ ID NO: 1356684 - RNA, 14 nt, Mycobacterium tuberculosis H37Rv
ugccguggccgcca

SEQ ID NO: 1356685 - RNA, 18 nt, Mycobacterium tuberculosis H37Rv
ugccgugcggaucacucc

SEQ ID NO: 1356686 - RNA, 22 nt, Mycobacterium tuberculosis H37Rv
ugccgugccgguguguccagcg

SEQ ID NO: 1356687 - RNA, 15 nt, Mycobacterium tuberculosis H37Rv
ugccgugcugggccg

SEQ ID NO: 1356688 - RNA, 18 nt, Mycobacterium tuberculosis H37Rv
ugccgugguggacgaugc

SEQ ID NO: 1356689 - RNA, 17 nt, Mycobacterium tuberculosis H37Rv
ugccguguucagcaccc

SEQ ID NO: 1356690 - RNA, 16 nt, Mycobacterium tuberculosis H37Rv
ugccguugcccucggc

SEQ ID NO: 1356691 - RNA, 14 nt, Mycobacterium tuberculosis H37Rv
ugccuaccgggccc

SEQ ID NO: 1356692 - RNA, 23 nt, Mycobacterium tuberculosis H37Rv
ugccuacaccggcaagccacgcc

SEQ ID NO: 1356693 - RNA, 18 nt, Mycobacterium tuberculosis H37Rv
ugccuagccgcagccccg

SEQ ID NO: 1356694 - RNA, 16 nt, Mycobacterium tuberculosis H37Rv
ugccucaccgccgcua

SEQ ID NO: 1356695 - RNA, 18 nt, Mycobacterium tuberculosis H37Rv
ugccggcguuagcguagc

SEQ ID NO: 1356696 - RNA, 21 nt, Mycobacterium tuberculosis H37Rv
ugccgggaucgccguccagca

SEQ ID NO: 1356697 - RNA, 16 nt, Mycobacterium tuberculosis H37Rv
ugccgggaugccgccg

SEQ ID NO: 1356698 - RNA, 20 nt, Mycobacterium tuberculosis H37Rv
ugccgggcccagcaggucgu

SEQ ID NO: 1356699 - RNA, 22 nt, Mycobacterium tuberculosis H37Rv
ugccgggcccagcaggucgucg

SEQ ID NO: 1356700 - RNA, 23 nt, Mycobacterium tuberculosis H37Rv
ugccgggccgcgcgggccgccgc

SEQ ID NO: 1356701 - RNA, 18 nt, Mycobacterium tuberculosis H37Rv
ugccgggccgccgagcgg

SEQ ID NO: 1356702 - RNA, 14 nt, Mycobacterium tuberculosis H37Rv
ugccgggcgcgcgu

SEQ ID NO: 1356703 - RNA, 16 nt, Mycobacterium tuberculosis H37Rv
ugccguccggcgcugg

SEQ ID NO: 1356704 - RNA, 15 nt, Mycobacterium tuberculosis H37Rv
ugccgugccgggcca

SEQ ID NO: 1356705 - RNA, 19 nt, Mycobacterium tuberculosis H37Rv
ugccgugccggugugucca

SEQ ID NO: 1356706 - RNA, 23 nt, Mycobacterium tuberculosis H37Rv
ugccguaguaaggagccgggccg

SEQ ID NO: 1356707 - RNA, 23 nt, Mycobacterium tuberculosis H37Rv
ugccgccgacaccaccggcgccg

SEQ ID NO: 1356708 - RNA, 17 nt, Mycobacterium tuberculosis H37Rv
ugccgccgacgggaacc

SEQ ID NO: 1356709 - RNA, 14 nt, Mycobacterium tuberculosis H37Rv
ugccgccgagcugg

SEQ ID NO: 1356710 - RNA, 21 nt, Mycobacterium tuberculosis H37Rv
ugccgccgauaccgccggccc

SEQ ID NO: 1356711 - RNA, 15 nt, Mycobacterium tuberculosis H37Rv
ugccgccgaacagcu

SEQ ID NO: 1356712 - RNA, 11 nt, Mycobacterium tuberculosis H37Rv
ugccgccgaag

SEQ ID NO: 1356713 - RNA, 17 nt, Mycobacterium tuberculosis H37Rv
ugccgccgacgccgccg

SEQ ID NO: 1356714 - RNA, 22 nt, Mycobacterium tuberculosis H37Rv
ugccgccgccuccgccgaggcc

SEQ ID NO: 1356715 - RNA, 14 nt, Mycobacterium tuberculosis H37Rv
ugccgccgccuccg

SEQ ID NO: 1356716 - RNA, 17 nt, Mycobacterium tuberculosis H37Rv
ugccgccgccggcgccg

SEQ ID NO: 1356717 - RNA, 16 nt, Mycobacterium tuberculosis H37Rv
ugccgcccaugccggg

SEQ ID NO: 1356718 - RNA, 19 nt, Mycobacterium tuberculosis H37Rv
ugccgcccgcgccgccgcu

SEQ ID NO: 1356719 - RNA, 17 nt, Mycobacterium tuberculosis H37Rv
ugccgcccgcgccgccg

SEQ ID NO: 1356720 - RNA, 14 nt, Mycobacterium tuberculosis H37Rv
ugccgcccgcgccg

SEQ ID NO: 1356721 - RNA, 22 nt, Mycobacterium tuberculosis H37Rv
ugccgcccgcgccgccggaccc

SEQ ID NO: 1356722 - RNA, 16 nt, Mycobacterium tuberculosis H37Rv
ugccgccaccggcguc

SEQ ID NO: 1356723 - RNA, 17 nt, Mycobacterium tuberculosis H37Rv
ugccgccacgggcggcc

SEQ ID NO: 1356724 - RNA, 23 nt, Mycobacterium tuberculosis H37Rv
ugccgccaccgcugucgauggac

SEQ ID NO: 1356725 - RNA, 13 nt, Mycobacterium tuberculosis H37Rv
ugccgccaccggc

SEQ ID NO: 1356726 - RNA, 16 nt, Mycobacterium tuberculosis H37Rv
ugccgccaccaccggc

SEQ ID NO: 1356727 - RNA, 19 nt, Mycobacterium tuberculosis H37Rv
ugccgccauggccgccguu

SEQ ID NO: 1356728 - RNA, 19 nt, Mycobacterium tuberculosis H37Rv
ugccgaucaguccggcguu

SEQ ID NO: 1356729 - RNA, 12 nt, Mycobacterium tuberculosis H37Rv
ugccgaucggcc

SEQ ID NO: 1356730 - RNA, 19 nt, Mycobacterium tuberculosis H37Rv
ugccgaucggccaacaggu

SEQ ID NO: 1356731 - RNA, 23 nt, Mycobacterium tuberculosis H37Rv
ugccgaucccgugguggcgccau

SEQ ID NO: 1356732 - RNA, 16 nt, Mycobacterium tuberculosis H37Rv
ugccgauccccaggcc

SEQ ID NO: 1356733 - RNA, 20 nt, Mycobacterium tuberculosis H37Rv
ugccgaugcgacgcagaccg

SEQ ID NO: 1356734 - RNA, 19 nt, Mycobacterium tuberculosis H37Rv
ugccgauggaugggcugcg

SEQ ID NO: 1356735 - RNA, 22 nt, Mycobacterium tuberculosis H37Rv
ugccgauggaugggcugcgcgu

SEQ ID NO: 1356736 - RNA, 15 nt, Mycobacterium tuberculosis H37Rv
ugccgcaccggugcu

SEQ ID NO: 1356737 - RNA, 18 nt, Mycobacterium tuberculosis H37Rv
ugccgcaccggugcucgu

SEQ ID NO: 1356738 - RNA, 14 nt, Mycobacterium tuberculosis H37Rv
ugccgcacccccuc

SEQ ID NO: 1356739 - RNA, 15 nt, Mycobacterium tuberculosis H37Rv
ugccgcacccccucc

SEQ ID NO: 1356740 - RNA, 16 nt, Mycobacterium tuberculosis H37Rv
ugcccugcgugcagau

SEQ ID NO: 1356741 - RNA, 18 nt, Mycobacterium tuberculosis H37Rv
ugcccguucugcccaggc

SEQ ID NO: 1356742 - RNA, 19 nt, Mycobacterium tuberculosis H37Rv
ugcccucaacgucccagcc

SEQ ID NO: 1356743 - RNA, 20 nt, Mycobacterium tuberculosis H37Rv
ugcccucaacgaucgcgccg

SEQ ID NO: 1356744 - RNA, 16 nt, Mycobacterium tuberculosis H37Rv
ugcccugggugauggc

SEQ ID NO: 1356745 - RNA, 17 nt, Mycobacterium tuberculosis H37Rv
ugcccuggaccagcggg

SEQ ID NO: 1356746 - RNA, 14 nt, Mycobacterium tuberculosis H37Rv
ugcccuugaagaaa

SEQ ID NO: 1356747 - RNA, 14 nt, Mycobacterium tuberculosis H37Rv
ugcccuuggccagc

SEQ ID NO: 1356748 - RNA, 16 nt, Mycobacterium tuberculosis H37Rv
ugcccuugcggaagaa

SEQ ID NO: 1356749 - RNA, 23 nt, Mycobacterium tuberculosis H37Rv
ugccgaacagcgaaccgccggca

SEQ ID NO: 1356750 - RNA, 22 nt, Mycobacterium tuberculosis H37Rv
ugccgaaacgccgaccgcgccg

SEQ ID NO: 1356751 - RNA, 17 nt, Mycobacterium tuberculosis H37Rv
ugccgaacgccagaccg

SEQ ID NO: 1356752 - RNA, 15 nt, Mycobacterium tuberculosis H37Rv
ugccgaaccgcgcgu

SEQ ID NO: 1356753 - RNA, 15 nt, Mycobacterium tuberculosis H37Rv
ugccgaauugggcga

SEQ ID NO: 1356754 - RNA, 23 nt, Mycobacterium tuberculosis H37Rv
ugccgaccgguuggguagcaccg

SEQ ID NO: 1356755 - RNA, 16 nt, Mycobacterium tuberculosis H37Rv
ugccgaccgucacuga

SEQ ID NO: 1356756 - RNA, 21 nt, Mycobacterium tuberculosis H37Rv
ugccgacccgcuucgcccggc

SEQ ID NO: 1356757 - RNA, 15 nt, Mycobacterium tuberculosis H37Rv
ugccgaccagcgcgc

SEQ ID NO: 1356758 - RNA, 21 nt, Mycobacterium tuberculosis H37Rv
ugccgacaguuuaccgugccg

SEQ ID NO: 1356759 - RNA, 16 nt, Mycobacterium tuberculosis H37Rv
ugccgaccaccagcau

SEQ ID NO: 1356760 - RNA, 15 nt, Mycobacterium tuberculosis H37Rv
ugccgagaacaccgg

SEQ ID NO: 1356761 - RNA, 16 nt, Mycobacterium tuberculosis H37Rv
ugccgacgcgcggcca

SEQ ID NO: 1356762 - RNA, 18 nt, Mycobacterium tuberculosis H37Rv
ugccgacggcgccgaacc

SEQ ID NO: 1356763 - RNA, 23 nt, Mycobacterium tuberculosis H37Rv
ugccgaccggucagcgcgcggcu

SEQ ID NO: 1356764 - RNA, 18 nt, Mycobacterium tuberculosis H37Rv
ugccgacgccccgaucgg

SEQ ID NO: 1356765 - RNA, 16 nt, Mycobacterium tuberculosis H37Rv
ugccgagaucccagcg

SEQ ID NO: 1356766 - RNA, 21 nt, Mycobacterium tuberculosis H37Rv
ugccgagcgugcgcugguggc

SEQ ID NO: 1356767 - RNA, 18 nt, Mycobacterium tuberculosis H37Rv
ugccgagcuucagcgcgc

SEQ ID NO: 1356768 - RNA, 19 nt, Mycobacterium tuberculosis H37Rv
ugccgagcuucagcgcgcu

SEQ ID NO: 1356769 - RNA, 16 nt, Mycobacterium tuberculosis H37Rv
ugccgauacagcacau

SEQ ID NO: 1356770 - RNA, 20 nt, Mycobacterium tuberculosis H37Rv
ugcgacucugcgucugcuca

SEQ ID NO: 1356771 - RNA, 19 nt, Mycobacterium tuberculosis H37Rv
ugcgacguucuugggaccg

SEQ ID NO: 1356772 - RNA, 16 nt, Mycobacterium tuberculosis H37Rv
ugcgacgcccgccuuc

SEQ ID NO: 1356773 - RNA, 18 nt, Mycobacterium tuberculosis H37Rv
ugcgacgacgccaaugcc

SEQ ID NO: 1356774 - RNA, 20 nt, Mycobacterium tuberculosis H37Rv
ugcgacccgcagaccgccac

SEQ ID NO: 1356775 - RNA, 17 nt, Mycobacterium tuberculosis H37Rv
ugcgacgaaccggauca

SEQ ID NO: 1356776 - RNA, 18 nt, Mycobacterium tuberculosis H37Rv
ugcgaccaagucaugccc

SEQ ID NO: 1356777 - RNA, 13 nt, Mycobacterium tuberculosis H37Rv
ugcgacccgggcg

SEQ ID NO: 1356778 - RNA, 22 nt, Mycobacterium tuberculosis H37Rv
ugcgacccgcagaccgccaccg

SEQ ID NO: 1356779 - RNA, 11 nt, Mycobacterium tuberculosis H37Rv
ugccuggcccg

SEQ ID NO: 1356780 - RNA, 21 nt, Mycobacterium tuberculosis H37Rv
ugccugcgcgagugccagucc

SEQ ID NO: 1356781 - RNA, 22 nt, Mycobacterium tuberculosis H37Rv
ugccugcuggucggugaugguc

SEQ ID NO: 1356782 - RNA, 14 nt, Mycobacterium tuberculosis H37Rv
ugccucccgcgccg

SEQ ID NO: 1356783 - RNA, 11 nt, Mycobacterium tuberculosis H37Rv
ugccuccagaa

SEQ ID NO: 1356784 - RNA, 16 nt, Mycobacterium tuberculosis H37Rv
ugccugcgcacgaccc

SEQ ID NO: 1356785 - RNA, 16 nt, Mycobacterium tuberculosis H37Rv
ugcgcagccgcagccg

SEQ ID NO: 1356786 - RNA, 21 nt, Mycobacterium tuberculosis H37Rv
ugcgcagcagcgugcacaccc

SEQ ID NO: 1356787 - RNA, 23 nt, Mycobacterium tuberculosis H37Rv
ugcgcagcgugaaaugcacgauc

SEQ ID NO: 1356788 - RNA, 18 nt, Mycobacterium tuberculosis H37Rv
ugcgcagcgugaaaugca

SEQ ID NO: 1356789 - RNA, 17 nt, Mycobacterium tuberculosis H37Rv
ugcgcagaacaccaccg

SEQ ID NO: 1356790 - RNA, 16 nt, Mycobacterium tuberculosis H37Rv
ugcgcagaacaccacc

SEQ ID NO: 1356791 - RNA, 18 nt, Mycobacterium tuberculosis H37Rv
ugcgcacggcgccgaccc

SEQ ID NO: 1356792 - RNA, 22 nt, Mycobacterium tuberculosis H37Rv
ugcgcacugaggcucaggugcu

SEQ ID NO: 1356793 - RNA, 20 nt, Mycobacterium tuberculosis H37Rv
ugcgcagaaacgccgagcgc

SEQ ID NO: 1356794 - RNA, 17 nt, Mycobacterium tuberculosis H37Rv
ugcgcagauuugcucca

SEQ ID NO: 1356795 - RNA, 20 nt, Mycobacterium tuberculosis H37Rv
ugcgcaacuucuucagcagc

SEQ ID NO: 1356796 - RNA, 22 nt, Mycobacterium tuberculosis H37Rv
ugcgauucacacucgggcggcu

SEQ ID NO: 1356797 - RNA, 19 nt, Mycobacterium tuberculosis H37Rv
ugcgacugcgaaugcuggg

SEQ ID NO: 1356798 - RNA, 20 nt, Mycobacterium tuberculosis H37Rv
ugcgcaacccagccgcgcca

SEQ ID NO: 1356799 - RNA, 12 nt, Mycobacterium tuberculosis H37Rv
ugcgccccauga

SEQ ID NO: 1356800 - RNA, 15 nt, Mycobacterium tuberculosis H37Rv
ugcgcccagcgaccc

SEQ ID NO: 1356801 - RNA, 11 nt, Mycobacterium tuberculosis H37Rv
ugcgcccagca

SEQ ID NO: 1356802 - RNA, 21 nt, Mycobacterium tuberculosis H37Rv
ugcgcaucgguccaaagcacg

SEQ ID NO: 1356803 - RNA, 21 nt, Mycobacterium tuberculosis H37Rv
ugcgcgaugcgauucugcguc

SEQ ID NO: 1356804 - RNA, 15 nt, Mycobacterium tuberculosis H37Rv
ugcgcgaggggccgg

SEQ ID NO: 1356805 - RNA, 19 nt, Mycobacterium tuberculosis H37Rv
ugcgcgaccacccgccgca

SEQ ID NO: 1356806 - RNA, 21 nt, Mycobacterium tuberculosis H37Rv
aaaugguucgcacaccuccuc

SEQ ID NO: 1356807 - RNA, 18 nt, Mycobacterium tuberculosis H37Rv
ugcgccgucgcagccagc

SEQ ID NO: 1356808 - RNA, 18 nt, Mycobacterium tuberculosis H37Rv
ugcgccucggcggccagc

SEQ ID NO: 1356809 - RNA, 21 nt, Mycobacterium tuberculosis H37Rv
ugcgccguggcaucgccucca

SEQ ID NO: 1356810 - RNA, 18 nt, Mycobacterium tuberculosis H37Rv
ugcgguacugagccgcga

SEQ ID NO: 1356811 - RNA, 17 nt, Mycobacterium tuberculosis H37Rv
ugcggguggauuggugc

SEQ ID NO: 1356812 - RNA, 12 nt, Mycobacterium tuberculosis H37Rv
ugcggguggagu

SEQ ID NO: 1356813 - RNA, 14 nt, Mycobacterium tuberculosis H37Rv
ugcgggucagcgcc

SEQ ID NO: 1356814 - RNA, 19 nt, Mycobacterium tuberculosis H37Rv
ugcgggugucgggcagcaa

SEQ ID NO: 1356815 - RNA, 21 nt, Mycobacterium tuberculosis H37Rv
ugcggguucacuuccgggcag

SEQ ID NO: 1356816 - RNA, 16 nt, Mycobacterium tuberculosis H37Rv
ugcgggugggcacacc

SEQ ID NO: 1356817 - RNA, 14 nt, Mycobacterium tuberculosis H37Rv
ugcggucagauucg

SEQ ID NO: 1356818 - RNA, 23 nt, Mycobacterium tuberculosis H37Rv
ugcggucagacgccggccgccga

SEQ ID NO: 1356819 - RNA, 13 nt, Mycobacterium tuberculosis H37Rv
ugcguaugcccac

SEQ ID NO: 1356820 - RNA, 20 nt, Mycobacterium tuberculosis H37Rv
ugcguagccgugggccacga

SEQ ID NO: 1356821 - RNA, 19 nt, Mycobacterium tuberculosis H37Rv
ugcguagccgugggccacg

SEQ ID NO: 1356822 - RNA, 16 nt, Mycobacterium tuberculosis H37Rv
ugcgggccgugacccu

SEQ ID NO: 1356823 - RNA, 14 nt, Mycobacterium tuberculosis H37Rv
ugcgggccaucaag

SEQ ID NO: 1356824 - RNA, 22 nt, Mycobacterium tuberculosis H37Rv
ugcgggcccucuaugcgggcag

SEQ ID NO: 1356825 - RNA, 23 nt, Mycobacterium tuberculosis H37Rv
ugcgggcccucuaugcgggcagc

SEQ ID NO: 1356826 - RNA, 19 nt, Mycobacterium tuberculosis H37Rv
ugcgggcggugcacaccgu

SEQ ID NO: 1356827 - RNA, 18 nt, Mycobacterium tuberculosis H37Rv
ugcgggcuuugccaacaa

SEQ ID NO: 1356828 - RNA, 16 nt, Mycobacterium tuberculosis H37Rv
ugcgggcucucggcgu

SEQ ID NO: 1356829 - RNA, 18 nt, Mycobacterium tuberculosis H37Rv
ugcgggcuguccgggcug

SEQ ID NO: 1356830 - RNA, 20 nt, Mycobacterium tuberculosis H37Rv
ugcgggggaguagugguggg

SEQ ID NO: 1356831 - RNA, 14 nt, Mycobacterium tuberculosis H37Rv
ugcggggccgggcg

SEQ ID NO: 1356832 - RNA, 13 nt, Mycobacterium tuberculosis H37Rv
ugcggggccgggc

SEQ ID NO: 1356833 - RNA, 22 nt, Mycobacterium tuberculosis H37Rv
ugcgggguugaccguggucgga

SEQ ID NO: 1356834 - RNA, 21 nt, Mycobacterium tuberculosis H37Rv
ugcggggggccuuaucccacc

SEQ ID NO: 1356835 - RNA, 24 nt, Mycobacterium tuberculosis H37Rv
ugcggggguacgucaccggguccg

SEQ ID NO: 1356836 - RNA, 23 nt, Mycobacterium tuberculosis H37Rv
ugcggccaggcgguacgggucgc

SEQ ID NO: 1356837 - RNA, 12 nt, Mycobacterium tuberculosis H37Rv
ugcggccaggga

SEQ ID NO: 1356838 - RNA, 19 nt, Mycobacterium tuberculosis H37Rv
ugcggccagggagcggcuu

SEQ ID NO: 1356839 - RNA, 18 nt, Mycobacterium tuberculosis H37Rv
ugcggccacucgcccgau

SEQ ID NO: 1356840 - RNA, 23 nt, Mycobacterium tuberculosis H37Rv
ugcggcccucgagcagugccgug

SEQ ID NO: 1356841 - RNA, 15 nt, Mycobacterium tuberculosis H37Rv
ugcggcccacaccag

SEQ ID NO: 1356842 - RNA, 18 nt, Mycobacterium tuberculosis H37Rv
ugcggccgcugaucaaca

SEQ ID NO: 1356843 - RNA, 13 nt, Mycobacterium tuberculosis H37Rv
ugcggccgcgccg

SEQ ID NO: 1356844 - RNA, 11 nt, Mycobacterium tuberculosis H37Rv
ugcggccgcgc

SEQ ID NO: 1356845 - RNA, 14 nt, Mycobacterium tuberculosis H37Rv
ugcggccuagggcg

SEQ ID NO: 1356846 - RNA, 18 nt, Mycobacterium tuberculosis H37Rv
ugcggaucggcggaccgc

SEQ ID NO: 1356847 - RNA, 22 nt, Mycobacterium tuberculosis H37Rv
ugcggaucacucccccacacac

SEQ ID NO: 1356848 - RNA, 16 nt, Mycobacterium tuberculosis H37Rv
ugcggacucagcggcg

SEQ ID NO: 1356849 - RNA, 17 nt, Mycobacterium tuberculosis H37Rv
ugcggacuucgccgccc

SEQ ID NO: 1356850 - RNA, 18 nt, Mycobacterium tuberculosis H37Rv
ugcggacaguucccggcc

SEQ ID NO: 1356851 - RNA, 15 nt, Mycobacterium tuberculosis H37Rv
ugcgcucacuggcga

SEQ ID NO: 1356852 - RNA, 15 nt, Mycobacterium tuberculosis H37Rv
ugcgcggugaugguu

SEQ ID NO: 1356853 - RNA, 16 nt, Mycobacterium tuberculosis H37Rv
ugcgcggugccggccg

SEQ ID NO: 1356854 - RNA, 16 nt, Mycobacterium tuberculosis H37Rv
ugcgcgucaggccagc

SEQ ID NO: 1356855 - RNA, 18 nt, Mycobacterium tuberculosis H37Rv
ugcgcgucagccgcaccc

SEQ ID NO: 1356856 - RNA, 15 nt, Mycobacterium tuberculosis H37Rv
ugcgcgucgcgcgcg

SEQ ID NO: 1356857 - RNA, 19 nt, Mycobacterium tuberculosis H37Rv
ugcgcgucgagcagcacca

SEQ ID NO: 1356858 - RNA, 15 nt, Mycobacterium tuberculosis H37Rv
ugcgcgugcugcgga

SEQ ID NO: 1356859 - RNA, 15 nt, Mycobacterium tuberculosis H37Rv
ugcgcgcgcagcuga

SEQ ID NO: 1356860 - RNA, 20 nt, Mycobacterium tuberculosis H37Rv
ugcgcgcucggccagcauca

SEQ ID NO: 1356861 - RNA, 13 nt, Mycobacterium tuberculosis H37Rv
ugcgcggccgccc

SEQ ID NO: 1356862 - RNA, 13 nt, Mycobacterium tuberculosis H37Rv
ugcgcggcauccc

SEQ ID NO: 1356863 - RNA, 17 nt, Mycobacterium tuberculosis H37Rv
ugcgcgcccaccgggcg

SEQ ID NO: 1356864 - RNA, 15 nt, Mycobacterium tuberculosis H37Rv
ugcgcgcccgggcgg

SEQ ID NO: 1356865 - RNA, 21 nt, Mycobacterium tuberculosis H37Rv
ugcgcgccauuggcgccgccg

SEQ ID NO: 1356866 - RNA, 13 nt, Mycobacterium tuberculosis H37Rv
ugcgcgccagaca

SEQ ID NO: 1356867 - RNA, 21 nt, Mycobacterium tuberculosis H37Rv
ugcgcgccgauaugcgugagc

SEQ ID NO: 1356868 - RNA, 15 nt, Mycobacterium tuberculosis H37Rv
ugacugcacaccacc

SEQ ID NO: 1356869 - RNA, 14 nt, Mycobacterium tuberculosis H37Rv
ugacgaacccaccg

SEQ ID NO: 1356870 - RNA, 22 nt, Mycobacterium tuberculosis H37Rv
ugaccuugcccugcgugcagau

SEQ ID NO: 1356871 - RNA, 15 nt, Mycobacterium tuberculosis H37Rv
ugagacaaaggugcc

SEQ ID NO: 1356872 - RNA, 20 nt, Mycobacterium tuberculosis H37Rv
ugagacaaaggugccgaccg

SEQ ID NO: 1356873 - RNA, 17 nt, Mycobacterium tuberculosis H37Rv
ugagcagacccgugccg

SEQ ID NO: 1356874 - RNA, 16 nt, Mycobacterium tuberculosis H37Rv
ugagcagacccagucc

SEQ ID NO: 1356875 - RNA, 21 nt, Mycobacterium tuberculosis H37Rv
ugagcagcuuagucagggccg

SEQ ID NO: 1356876 - RNA, 23 nt, Mycobacterium tuberculosis H37Rv
ugagcacccgauaguucuggccc

SEQ ID NO: 1356877 - RNA, 21 nt, Mycobacterium tuberculosis H37Rv
ugagcaccugggcgcgcuggc

SEQ ID NO: 1356878 - RNA, 14 nt, Mycobacterium tuberculosis H37Rv
ugagcaccugggcg

SEQ ID NO: 1356879 - RNA, 22 nt, Mycobacterium tuberculosis H37Rv
ugagcacgauauugggauacuc

SEQ ID NO: 1356880 - RNA, 23 nt, Mycobacterium tuberculosis H37Rv
ugagaucgcccgaguugaagaag

SEQ ID NO: 1356881 - RNA, 19 nt, Mycobacterium tuberculosis H37Rv
ugagauggcggugagcacu

SEQ ID NO: 1356882 - RNA, 16 nt, Mycobacterium tuberculosis H37Rv
ugagccgugccgccag

SEQ ID NO: 1356883 - RNA, 14 nt, Mycobacterium tuberculosis H37Rv
ugagccgagccagc

SEQ ID NO: 1356884 - RNA, 18 nt, Mycobacterium tuberculosis H37Rv
ugagccccccgagcccgc

SEQ ID NO: 1356885 - RNA, 19 nt, Mycobacterium tuberculosis H37Rv
ugagccgcagcaccucguc

SEQ ID NO: 1356886 - RNA, 23 nt, Mycobacterium tuberculosis H37Rv
ugagccgcgaaaucaccgcugag

SEQ ID NO: 1356887 - RNA, 16 nt, Mycobacterium tuberculosis H37Rv
ugagcccggggagacg

SEQ ID NO: 1356888 - RNA, 20 nt, Mycobacterium tuberculosis H37Rv
ugagcccguugaccugcgca

SEQ ID NO: 1356889 - RNA, 20 nt, Mycobacterium tuberculosis H37Rv
ugagccauacgcgcugaccc

SEQ ID NO: 1356890 - RNA, 21 nt, Mycobacterium tuberculosis H37Rv
ugagccauacgcgcugacccg

SEQ ID NO: 1356891 - RNA, 17 nt, Mycobacterium tuberculosis H37Rv
ugagcagggcggcgaac

SEQ ID NO: 1356892 - RNA, 22 nt, Mycobacterium tuberculosis H37Rv
ugagcaguucguuccagaugag

SEQ ID NO: 1356893 - RNA, 20 nt, Mycobacterium tuberculosis H37Rv
ugagccaccaacaccgcguc

SEQ ID NO: 1356894 - RNA, 16 nt, Mycobacterium tuberculosis H37Rv
ugagccaccaacaccg

SEQ ID NO: 1356895 - RNA, 19 nt, Mycobacterium tuberculosis H37Rv
ugagccaccaacaccgcgu

SEQ ID NO: 1356896 - RNA, 23 nt, Mycobacterium tuberculosis H37Rv
ugagcaugcccagcgcacggacc

SEQ ID NO: 1356897 - RNA, 21 nt, Mycobacterium tuberculosis H37Rv
ugagcgaccgcgagggccagc

SEQ ID NO: 1356898 - RNA, 15 nt, Mycobacterium tuberculosis H37Rv
ugagcgagcgcgcgu

SEQ ID NO: 1356899 - RNA, 17 nt, Mycobacterium tuberculosis H37Rv
ugagcgagcucccgggc

SEQ ID NO: 1356900 - RNA, 18 nt, Mycobacterium tuberculosis H37Rv
ugagcgccacgccgaggc

SEQ ID NO: 1356901 - RNA, 13 nt, Mycobacterium tuberculosis H37Rv
ugagcgccgaugu

SEQ ID NO: 1356902 - RNA, 19 nt, Mycobacterium tuberculosis H37Rv
ugagcgccgauguggccgg

SEQ ID NO: 1356903 - RNA, 14 nt, Mycobacterium tuberculosis H37Rv
ugagcgccgcggcg

SEQ ID NO: 1356904 - RNA, 13 nt, Mycobacterium tuberculosis H37Rv
ugagcgcgcucag

SEQ ID NO: 1356905 - RNA, 20 nt, Mycobacterium tuberculosis H37Rv
ugagcgccggcaucgcgcaa

SEQ ID NO: 1356906 - RNA, 23 nt, Mycobacterium tuberculosis H37Rv
ugagcgccgcuaauggauccagc

SEQ ID NO: 1356907 - RNA, 13 nt, Mycobacterium tuberculosis H37Rv
ugagcgcgcuggc

SEQ ID NO: 1356908 - RNA, 16 nt, Mycobacterium tuberculosis H37Rv
ugagcgcgcuggccag

SEQ ID NO: 1356909 - RNA, 23 nt, Mycobacterium tuberculosis H37Rv
ugagcgcggcuacggucgcagua

SEQ ID NO: 1356910 - RNA, 15 nt, Mycobacterium tuberculosis H37Rv
ugaggaucauggcgu

SEQ ID NO: 1356911 - RNA, 14 nt, Mycobacterium tuberculosis H37Rv
ugaggaucaugucc

SEQ ID NO: 1356912 - RNA, 17 nt, Mycobacterium tuberculosis H37Rv
ugagcuuggucgccggg

SEQ ID NO: 1356913 - RNA, 18 nt, Mycobacterium tuberculosis H37Rv
ugaguaccaauccaggcc

SEQ ID NO: 1356914 - RNA, 17 nt, Mycobacterium tuberculosis H37Rv
ugagguuggagcgccag

SEQ ID NO: 1356915 - RNA, 17 nt, Mycobacterium tuberculosis H37Rv
ugauacagcgccagggg

SEQ ID NO: 1356916 - RNA, 22 nt, Mycobacterium tuberculosis H37Rv
ugagucguaguaggcgccgcga

SEQ ID NO: 1356917 - RNA, 20 nt, Mycobacterium tuberculosis H37Rv
ugaguccccaggugggcagc

SEQ ID NO: 1356918 - RNA, 16 nt, Mycobacterium tuberculosis H37Rv
ugaguccgcugagcgg

SEQ ID NO: 1356919 - RNA, 13 nt, Mycobacterium tuberculosis H37Rv
ugaucccauccag

SEQ ID NO: 1356920 - RNA, 19 nt, Mycobacterium tuberculosis H37Rv
ugauccccguugacccaga

SEQ ID NO: 1356921 - RNA, 18 nt, Mycobacterium tuberculosis H37Rv
ugaucccgccaccgaaca

SEQ ID NO: 1356922 - RNA, 15 nt, Mycobacterium tuberculosis H37Rv
ugaucgucucggcua

SEQ ID NO: 1356923 - RNA, 23 nt, Mycobacterium tuberculosis H37Rv
ugaucaccgcguaguccaggccg

SEQ ID NO: 1356924 - RNA, 16 nt, Mycobacterium tuberculosis H37Rv
ugaucacucacccggg

SEQ ID NO: 1356925 - RNA, 17 nt, Mycobacterium tuberculosis H37Rv
ugaucacucacccgggc

SEQ ID NO: 1356926 - RNA, 16 nt, Mycobacterium tuberculosis H37Rv
ugaucacaccgagcgc

SEQ ID NO: 1356927 - RNA, 15 nt, Mycobacterium tuberculosis H37Rv
ugaucacauucagca

SEQ ID NO: 1356928 - RNA, 14 nt, Mycobacterium tuberculosis H37Rv
ugauggaguggcug

SEQ ID NO: 1356929 - RNA, 20 nt, Mycobacterium tuberculosis H37Rv
ugauggcgcgaucggugccg

SEQ ID NO: 1356930 - RNA, 19 nt, Mycobacterium tuberculosis H37Rv
ugaugggcauggugguggc

SEQ ID NO: 1356931 - RNA, 13 nt, Mycobacterium tuberculosis H37Rv
ugaugggccaggc

SEQ ID NO: 1356932 - RNA, 20 nt, Mycobacterium tuberculosis H37Rv
ugaugggccgguuccucagc

SEQ ID NO: 1356933 - RNA, 21 nt, Mycobacterium tuberculosis H37Rv
ugaugcucgacaaccacggca

SEQ ID NO: 1356934 - RNA, 14 nt, Mycobacterium tuberculosis H37Rv
ugaugcuggccagg

SEQ ID NO: 1356935 - RNA, 22 nt, Mycobacterium tuberculosis H37Rv
ugaucuugccacuccaggagcc

SEQ ID NO: 1356936 - RNA, 18 nt, Mycobacterium tuberculosis H37Rv
ugaucuugccgcccuuga

SEQ ID NO: 1356937 - RNA, 21 nt, Mycobacterium tuberculosis H37Rv
ugaugcagugauugagcagca

SEQ ID NO: 1356938 - RNA, 23 nt, Mycobacterium tuberculosis H37Rv
ugaugccggcgccggcccgcagc

SEQ ID NO: 1356939 - RNA, 22 nt, Mycobacterium tuberculosis H37Rv
ugauugcggaacaccaccaggc

SEQ ID NO: 1356940 - RNA, 13 nt, Mycobacterium tuberculosis H37Rv
ugauugugcccag

SEQ ID NO: 1356941 - RNA, 21 nt, Mycobacterium tuberculosis H37Rv
ugauugucggcgaaaugaagu

SEQ ID NO: 1356942 - RNA, 22 nt, Mycobacterium tuberculosis H37Rv
ugauguuuuccccgcccuugcc

SEQ ID NO: 1356943 - RNA, 22 nt, Mycobacterium tuberculosis H37Rv
ugaugguggacagcaauuugcc

SEQ ID NO: 1356944 - RNA, 18 nt, Mycobacterium tuberculosis H37Rv
ugauggucaccgucugca

SEQ ID NO: 1356945 - RNA, 20 nt, Mycobacterium tuberculosis H37Rv
ugauggucaaugccggccgc

SEQ ID NO: 1356946 - RNA, 22 nt, Mycobacterium tuberculosis H37Rv
ugauggucaaugccggccgcgg

SEQ ID NO: 1356947 - RNA, 14 nt, Mycobacterium tuberculosis H37Rv
ugaugggucaccuc

SEQ ID NO: 1356948 - RNA, 15 nt, Mycobacterium tuberculosis H37Rv
ugaugggcagccgcc

SEQ ID NO: 1356949 - RNA, 16 nt, Mycobacterium tuberculosis H37Rv
ugauguaaccguagcc

SEQ ID NO: 1356950 - RNA, 21 nt, Mycobacterium tuberculosis H37Rv
ugauguagcggcguuccgggc

SEQ ID NO: 1356951 - RNA, 18 nt, Mycobacterium tuberculosis H37Rv
ugauguagggcugcuccu

SEQ ID NO: 1356952 - RNA, 21 nt, Mycobacterium tuberculosis H37Rv
ugaugucaacgugucccaagc

SEQ ID NO: 1356953 - RNA, 19 nt, Mycobacterium tuberculosis H37Rv
ugauguagggcugcuccug

SEQ ID NO: 1356954 - RNA, 21 nt, Mycobacterium tuberculosis H37Rv
ugauguccucccaucccaugu

SEQ ID NO: 1356955 - RNA, 21 nt, Mycobacterium tuberculosis H37Rv
ugaauccggcauacaucgccu

SEQ ID NO: 1356956 - RNA, 18 nt, Mycobacterium tuberculosis H37Rv
ugaaucucacgacgccuu

SEQ ID NO: 1356957 - RNA, 17 nt, Mycobacterium tuberculosis H37Rv
ugaaucgcggaugccag

SEQ ID NO: 1356958 - RNA, 18 nt, Mycobacterium tuberculosis H37Rv
ugaaucggaccgaccggc

SEQ ID NO: 1356959 - RNA, 13 nt, Mycobacterium tuberculosis H37Rv
ugaauggcagcac

SEQ ID NO: 1356960 - RNA, 14 nt, Mycobacterium tuberculosis H37Rv
ugaauggcagcacg

SEQ ID NO: 1356961 - RNA, 21 nt, Mycobacterium tuberculosis H37Rv
ugaauuuggugaagccguaga

SEQ ID NO: 1356962 - RNA, 16 nt, Mycobacterium tuberculosis H37Rv
ugaauucgcuugcagc

SEQ ID NO: 1356963 - RNA, 17 nt, Mycobacterium tuberculosis H37Rv
ugacagacacagcaccg

SEQ ID NO: 1356964 - RNA, 14 nt, Mycobacterium tuberculosis H37Rv
ugacacaccgcguc

SEQ ID NO: 1356965 - RNA, 17 nt, Mycobacterium tuberculosis H37Rv
ugacaccgaccgggucg

SEQ ID NO: 1356966 - RNA, 21 nt, Mycobacterium tuberculosis H37Rv
ugacaccgccggggugcaccg

SEQ ID NO: 1356967 - RNA, 23 nt, Mycobacterium tuberculosis H37Rv
ugacacccaucgaccgcccgcca

SEQ ID NO: 1356968 - RNA, 20 nt, Mycobacterium tuberculosis H37Rv
ugacaccggccaccagcccg

SEQ ID NO: 1356969 - RNA, 15 nt, Mycobacterium tuberculosis H37Rv
ugacaccggccacca

SEQ ID NO: 1356970 - RNA, 14 nt, Mycobacterium tuberculosis H37Rv
ugacaaggaugguc

SEQ ID NO: 1356971 - RNA, 18 nt, Mycobacterium tuberculosis H37Rv
ugaccgcaccggccgcua

SEQ ID NO: 1356972 - RNA, 22 nt, Mycobacterium tuberculosis H37Rv
ugaccgcagcacucccugguuc

SEQ ID NO: 1356973 - RNA, 15 nt, Mycobacterium tuberculosis H37Rv
ugaccgcagucccag

SEQ ID NO: 1356974 - RNA, 14 nt, Mycobacterium tuberculosis H37Rv
ugaccgccgcgccg

SEQ ID NO: 1356975 - RNA, 17 nt, Mycobacterium tuberculosis H37Rv
ugaccgcguagaccagu

SEQ ID NO: 1356976 - RNA, 15 nt, Mycobacterium tuberculosis H37Rv
ugaccgcugcccagu

SEQ ID NO: 1356977 - RNA, 18 nt, Mycobacterium tuberculosis H37Rv
ugaccucggcgaccagaa

SEQ ID NO: 1356978 - RNA, 15 nt, Mycobacterium tuberculosis H37Rv
ugaccucgcgcaccg

SEQ ID NO: 1356979 - RNA, 16 nt, Mycobacterium tuberculosis H37Rv
ugaccugauccggccg

SEQ ID NO: 1356980 - RNA, 15 nt, Mycobacterium tuberculosis H37Rv
ugaccagcagcucgu

SEQ ID NO: 1356981 - RNA, 14 nt, Mycobacterium tuberculosis H37Rv
ugaccagcagcuga

SEQ ID NO: 1356982 - RNA, 13 nt, Mycobacterium tuberculosis H37Rv
ugacagugaccug

SEQ ID NO: 1356983 - RNA, 10 nt, Mycobacterium tuberculosis H37Rv
ugaccaggug

SEQ ID NO: 1356984 - RNA, 16 nt, Mycobacterium tuberculosis H37Rv
ugaccagucgcggcgu

SEQ ID NO: 1356985 - RNA, 21 nt, Mycobacterium tuberculosis H37Rv
ugaccaucguguacuggucug

SEQ ID NO: 1356986 - RNA, 22 nt, Mycobacterium tuberculosis H37Rv
ugaccaucguguacuggucugg

SEQ ID NO: 1356987 - RNA, 23 nt, Mycobacterium tuberculosis H37Rv
ugaccaucguguacuggucugga

SEQ ID NO: 1356988 - RNA, 18 nt, Mycobacterium tuberculosis H37Rv
ugaccagccuuaugcagu

SEQ ID NO: 1356989 - RNA, 22 nt, Mycobacterium tuberculosis H37Rv
ugaccaggaagcagaaguccuc

SEQ ID NO: 1356990 - RNA, 11 nt, Mycobacterium tuberculosis H37Rv
ugaccaggcgg

SEQ ID NO: 1356991 - RNA, 19 nt, Mycobacterium tuberculosis H37Rv
ugaccaggaaugucuccag

SEQ ID NO: 1356992 - RNA, 17 nt, Mycobacterium tuberculosis H37Rv
ugaccagggucugcuca

SEQ ID NO: 1356993 - RNA, 21 nt, Mycobacterium tuberculosis H37Rv
ucuucgggcucguccagcaac

SEQ ID NO: 1356994 - RNA, 14 nt, Mycobacterium tuberculosis H37Rv
ugaacaccccuccu

SEQ ID NO: 1356995 - RNA, 23 nt, Mycobacterium tuberculosis H37Rv
ugaacaagauucgcucaccaccg

SEQ ID NO: 1356996 - RNA, 15 nt, Mycobacterium tuberculosis H37Rv
ugaagccgggcgcuu

SEQ ID NO: 1356997 - RNA, 21 nt, Mycobacterium tuberculosis H37Rv
ugaagccgggcgcuugcacca

SEQ ID NO: 1356998 - RNA, 13 nt, Mycobacterium tuberculosis H37Rv
ugaaggcgccggu

SEQ ID NO: 1356999 - RNA, 18 nt, Mycobacterium tuberculosis H37Rv
ugaacgaucggaccacca

SEQ ID NO: 1357000 - RNA, 17 nt, Mycobacterium tuberculosis H37Rv
ugaacgacauccggccg

SEQ ID NO: 1357001 - RNA, 22 nt, Mycobacterium tuberculosis H37Rv
ugaacgacgggucguucuccgc

SEQ ID NO: 1357002 - RNA, 19 nt, Mycobacterium tuberculosis H37Rv
ugaaccagucgacccagcg

SEQ ID NO: 1357003 - RNA, 23 nt, Mycobacterium tuberculosis H37Rv
ugaacgcaccaacguugugccgc

SEQ ID NO: 1357004 - RNA, 12 nt, Mycobacterium tuberculosis H37Rv
ugaacgccgcca

SEQ ID NO: 1357005 - RNA, 15 nt, Mycobacterium tuberculosis H37Rv
ugaacgccagcagcg

SEQ ID NO: 1357006 - RNA, 22 nt, Mycobacterium tuberculosis H37Rv
ugaagaacaugcucacgaucac

SEQ ID NO: 1357007 - RNA, 20 nt, Mycobacterium tuberculosis H37Rv
ugaagaacaugcucacgauc

SEQ ID NO: 1357008 - RNA, 17 nt, Mycobacterium tuberculosis H37Rv
ugaacgcccgcuucagc

SEQ ID NO: 1357009 - RNA, 14 nt, Mycobacterium tuberculosis H37Rv
ugaagagaagucuc

SEQ ID NO: 1357010 - RNA, 19 nt, Mycobacterium tuberculosis H37Rv
ucgcgagcagacgcggaau

SEQ ID NO: 1357011 - RNA, 14 nt, Mycobacterium tuberculosis H37Rv
ucgcgagccagcug

SEQ ID NO: 1357012 - RNA, 21 nt, Mycobacterium tuberculosis H37Rv
ucgcgagcccgccacagcccc

SEQ ID NO: 1357013 - RNA, 23 nt, Mycobacterium tuberculosis H37Rv
ucgcgagcccgccacagccccag

SEQ ID NO: 1357014 - RNA, 15 nt, Mycobacterium tuberculosis H37Rv
ucgccugcgggaacg

SEQ ID NO: 1357015 - RNA, 14 nt, Mycobacterium tuberculosis H37Rv
ucgccuucccagcc

SEQ ID NO: 1357016 - RNA, 15 nt, Mycobacterium tuberculosis H37Rv
ucgccuucccagccg

SEQ ID NO: 1357017 - RNA, 17 nt, Mycobacterium tuberculosis H37Rv
ucgcgcauugcgcuucc

SEQ ID NO: 1357018 - RNA, 23 nt, Mycobacterium tuberculosis H37Rv
ucgcgcauugccgacgcgcggcc

SEQ ID NO: 1357019 - RNA, 18 nt, Mycobacterium tuberculosis H37Rv
ucgcgcaucgccuccucg

SEQ ID NO: 1357020 - RNA, 17 nt, Mycobacterium tuberculosis H37Rv
ucgcgcaggaagcccac

SEQ ID NO: 1357021 - RNA, 15 nt, Mycobacterium tuberculosis H37Rv
ucgcgcagcuccacc

SEQ ID NO: 1357022 - RNA, 22 nt, Mycobacterium tuberculosis H37Rv
ucgcgccaggccacguagcagc

SEQ ID NO: 1357023 - RNA, 14 nt, Mycobacterium tuberculosis H37Rv
ucgcgccaggccac

SEQ ID NO: 1357024 - RNA, 19 nt, Mycobacterium tuberculosis H37Rv
ucgcgccaucgucgcgccg

SEQ ID NO: 1357025 - RNA, 19 nt, Mycobacterium tuberculosis H37Rv
ucgcgcccgcugagccagc

SEQ ID NO: 1357026 - RNA, 23 nt, Mycobacterium tuberculosis H37Rv
ucgcgcccgccaucagcccggcg

SEQ ID NO: 1357027 - RNA, 13 nt, Mycobacterium tuberculosis H37Rv
ucgcgcagcgcga

SEQ ID NO: 1357028 - RNA, 22 nt, Mycobacterium tuberculosis H37Rv
ucgcgcaaggcgccgcagggcc

SEQ ID NO: 1357029 - RNA, 14 nt, Mycobacterium tuberculosis H37Rv
ucgccgccgucgug

SEQ ID NO: 1357030 - RNA, 15 nt, Mycobacterium tuberculosis H37Rv
ucgccgccggugccg

SEQ ID NO: 1357031 - RNA, 14 nt, Mycobacterium tuberculosis H37Rv
ucgccgcgccguag

SEQ ID NO: 1357032 - RNA, 14 nt, Mycobacterium tuberculosis H37Rv
ucgccgcuggccag

SEQ ID NO: 1357033 - RNA, 18 nt, Mycobacterium tuberculosis H37Rv
ucgccgggcaacgcgaac

SEQ ID NO: 1357034 - RNA, 21 nt, Mycobacterium tuberculosis H37Rv
ucgccggcuucgcccagagcc

SEQ ID NO: 1357035 - RNA, 14 nt, Mycobacterium tuberculosis H37Rv
ucgccggcgccaag

SEQ ID NO: 1357036 - RNA, 14 nt, Mycobacterium tuberculosis H37Rv
ucgccggcaccgga

SEQ ID NO: 1357037 - RNA, 22 nt, Mycobacterium tuberculosis H37Rv
ucgccggaugcugucagcagcc

SEQ ID NO: 1357038 - RNA, 13 nt, Mycobacterium tuberculosis H37Rv
ucgccggccaccc

SEQ ID NO: 1357039 - RNA, 21 nt, Mycobacterium tuberculosis H37Rv
ucgccggacgacaacaggccg

SEQ ID NO: 1357040 - RNA, 21 nt, Mycobacterium tuberculosis H37Rv
ucgccggaucguucgcgugcc

SEQ ID NO: 1357041 - RNA, 19 nt, Mycobacterium tuberculosis H37Rv
ucgccuccaggcgccaccc

SEQ ID NO: 1357042 - RNA, 15 nt, Mycobacterium tuberculosis H37Rv
ucgccuccaggcgcc

SEQ ID NO: 1357043 - RNA, 19 nt, Mycobacterium tuberculosis H37Rv
ucgccucgacgcggcaggc

SEQ ID NO: 1357044 - RNA, 21 nt, Mycobacterium tuberculosis H37Rv
ucgccuccggauccucggccg

SEQ ID NO: 1357045 - RNA, 17 nt, Mycobacterium tuberculosis H37Rv
ucgccugcacgcccggc

SEQ ID NO: 1357046 - RNA, 16 nt, Mycobacterium tuberculosis H37Rv
ucgccucggcgcugcg

SEQ ID NO: 1357047 - RNA, 21 nt, Mycobacterium tuberculosis H37Rv
ucgccucggacacggcagccu

SEQ ID NO: 1357048 - RNA, 16 nt, Mycobacterium tuberculosis H37Rv
ucgccgggucagcccg

SEQ ID NO: 1357049 - RNA, 23 nt, Mycobacterium tuberculosis H37Rv
ucgccgguaggcggccagcgcgc

SEQ ID NO: 1357050 - RNA, 19 nt, Mycobacterium tuberculosis H37Rv
ucgccguacaucagcgcga

SEQ ID NO: 1357051 - RNA, 21 nt, Mycobacterium tuberculosis H37Rv
ucgccguacaucagcgcgaac

SEQ ID NO: 1357052 - RNA, 22 nt, Mycobacterium tuberculosis H37Rv
ucgccgugcuguuccagcgucu

SEQ ID NO: 1357053 - RNA, 15 nt, Mycobacterium tuberculosis H37Rv
ucgccguugucgucg

SEQ ID NO: 1357054 - RNA, 14 nt, Mycobacterium tuberculosis H37Rv
ucgccuaccggccu

SEQ ID NO: 1357055 - RNA, 23 nt, Mycobacterium tuberculosis H37Rv
ucgcccgggcgggauccacccag

SEQ ID NO: 1357056 - RNA, 16 nt, Mycobacterium tuberculosis H37Rv
ucgcccucccgggccc

SEQ ID NO: 1357057 - RNA, 13 nt, Mycobacterium tuberculosis H37Rv
ucgcccggcugcg

SEQ ID NO: 1357058 - RNA, 15 nt, Mycobacterium tuberculosis H37Rv
ucgcccgcugagcac

SEQ ID NO: 1357059 - RNA, 13 nt, Mycobacterium tuberculosis H37Rv
ucgcccagggugg

SEQ ID NO: 1357060 - RNA, 18 nt, Mycobacterium tuberculosis H37Rv
ucgcccaggccaaggugg

SEQ ID NO: 1357061 - RNA, 16 nt, Mycobacterium tuberculosis H37Rv
ucgcccagcgugaacu

SEQ ID NO: 1357062 - RNA, 17 nt, Mycobacterium tuberculosis H37Rv
ucgcccagcgugaacug

SEQ ID NO: 1357063 - RNA, 12 nt, Mycobacterium tuberculosis H37Rv
ucgcccagcaag

SEQ ID NO: 1357064 - RNA, 15 nt, Mycobacterium tuberculosis H37Rv
ucgcccagcaaggcc

SEQ ID NO: 1357065 - RNA, 18 nt, Mycobacterium tuberculosis H37Rv
ucgcccaacaccgcgccg

SEQ ID NO: 1357066 - RNA, 14 nt, Mycobacterium tuberculosis H37Rv
ucgccaugcugccc

SEQ ID NO: 1357067 - RNA, 18 nt, Mycobacterium tuberculosis H37Rv
ucgccgaccgucacugau

SEQ ID NO: 1357068 - RNA, 21 nt, Mycobacterium tuberculosis H37Rv
ucgccgagcgugcaaucacug

SEQ ID NO: 1357069 - RNA, 12 nt, Mycobacterium tuberculosis H37Rv
ucgccgaagugg

SEQ ID NO: 1357070 - RNA, 17 nt, Mycobacterium tuberculosis H37Rv
ucgccgaacgccaccac

SEQ ID NO: 1357071 - RNA, 17 nt, Mycobacterium tuberculosis H37Rv
ucgcccuuagggucgcc

SEQ ID NO: 1357072 - RNA, 22 nt, Mycobacterium tuberculosis H37Rv
ucgccgcaguccgcacgcggca

SEQ ID NO: 1357073 - RNA, 21 nt, Mycobacterium tuberculosis H37Rv
ucgccgaggacgccggcgccg

SEQ ID NO: 1357074 - RNA, 23 nt, Mycobacterium tuberculosis H37Rv
ucgccgaugauguuuuccccgcc

SEQ ID NO: 1357075 - RNA, 18 nt, Mycobacterium tuberculosis H37Rv
ucgccgauaucugccacg

SEQ ID NO: 1357076 - RNA, 24 nt, Mycobacterium tuberculosis H37Rv
ucgccgccauugccgccggugccg

SEQ ID NO: 1357077 - RNA, 14 nt, Mycobacterium tuberculosis H37Rv
ucgccgccgcgcgu

SEQ ID NO: 1357078 - RNA, 24 nt, Mycobacterium tuberculosis H37Rv
ucgccaccaucguugccggugccg

SEQ ID NO: 1357079 - RNA, 15 nt, Mycobacterium tuberculosis H37Rv
ucgccaccaucaccg

SEQ ID NO: 1357080 - RNA, 16 nt, Mycobacterium tuberculosis H37Rv
ucgccacaccggggcg

SEQ ID NO: 1357081 - RNA, 16 nt, Mycobacterium tuberculosis H37Rv
ucgccaccagagucaa

SEQ ID NO: 1357082 - RNA, 21 nt, Mycobacterium tuberculosis H37Rv
ucgccacuguugaagaagccc

SEQ ID NO: 1357083 - RNA, 20 nt, Mycobacterium tuberculosis H37Rv
ucgccacuguugaagaagcc

SEQ ID NO: 1357084 - RNA, 14 nt, Mycobacterium tuberculosis H37Rv
ucgccacgcccagc

SEQ ID NO: 1357085 - RNA, 21 nt, Mycobacterium tuberculosis H37Rv
ucgccacgcucggcggccagc

SEQ ID NO: 1357086 - RNA, 21 nt, Mycobacterium tuberculosis H37Rv
ucgccagguggccgcucucca

SEQ ID NO: 1357087 - RNA, 21 nt, Mycobacterium tuberculosis H37Rv
ucgccagggagcgcagcgccg

SEQ ID NO: 1357088 - RNA, 18 nt, Mycobacterium tuberculosis H37Rv
ucgccagcugacacccgc

SEQ ID NO: 1357089 - RNA, 12 nt, Mycobacterium tuberculosis H37Rv
ucgccagcggcg

SEQ ID NO: 1357090 - RNA, 14 nt, Mycobacterium tuberculosis H37Rv
ucgccagcggcgcg

SEQ ID NO: 1357091 - RNA, 12 nt, Mycobacterium tuberculosis H37Rv
ucgccagcggca

SEQ ID NO: 1357092 - RNA, 20 nt, Mycobacterium tuberculosis H37Rv
ucgccagcaggaagccgaag

SEQ ID NO: 1357093 - RNA, 22 nt, Mycobacterium tuberculosis H37Rv
ucgcugccuucaucggggcuuc

SEQ ID NO: 1357094 - RNA, 23 nt, Mycobacterium tuberculosis H37Rv
ucgcugcccaugcggcaggugcc

SEQ ID NO: 1357095 - RNA, 21 nt, Mycobacterium tuberculosis H37Rv
ucgcuggcgacccaaaaugcc

SEQ ID NO: 1357096 - RNA, 22 nt, Mycobacterium tuberculosis H37Rv
ucgcuggcgaugccgagaagac

SEQ ID NO: 1357097 - RNA, 14 nt, Mycobacterium tuberculosis H37Rv
ucgcuggccgcgag

SEQ ID NO: 1357098 - RNA, 15 nt, Mycobacterium tuberculosis H37Rv
ucgcugauccgggcg

SEQ ID NO: 1357099 - RNA, 20 nt, Mycobacterium tuberculosis H37Rv
ucgcugacccgggccgggcc

SEQ ID NO: 1357100 - RNA, 22 nt, Mycobacterium tuberculosis H37Rv
ucgcugaccgcguagaccagug

SEQ ID NO: 1357101 - RNA, 22 nt, Mycobacterium tuberculosis H37Rv
ucgcuacgcaacgggucggguc

SEQ ID NO: 1357102 - RNA, 13 nt, Mycobacterium tuberculosis H37Rv
ucgcucagggugu

SEQ ID NO: 1357103 - RNA, 20 nt, Mycobacterium tuberculosis H37Rv
ucgcucaguuuggcgggugc

SEQ ID NO: 1357104 - RNA, 16 nt, Mycobacterium tuberculosis H37Rv
ucgcucgcgccagguc

SEQ ID NO: 1357105 - RNA, 19 nt, Mycobacterium tuberculosis H37Rv
ucgcucccgguuggggugg

SEQ ID NO: 1357106 - RNA, 18 nt, Mycobacterium tuberculosis H37Rv
ucgcuccgcggcgcagca

SEQ ID NO: 1357107 - RNA, 20 nt, Mycobacterium tuberculosis H37Rv
ucgcuccgcggcgcagcacg

SEQ ID NO: 1357108 - RNA, 18 nt, Mycobacterium tuberculosis H37Rv
ucgcgggguaggcccagc

SEQ ID NO: 1357109 - RNA, 14 nt, Mycobacterium tuberculosis H37Rv
ucgcgggcggcgcu

SEQ ID NO: 1357110 - RNA, 15 nt, Mycobacterium tuberculosis H37Rv
ucgcgguagccgcgg

SEQ ID NO: 1357111 - RNA, 20 nt, Mycobacterium tuberculosis H37Rv
ucgcgggccgcgucgaacug

SEQ ID NO: 1357112 - RNA, 13 nt, Mycobacterium tuberculosis H37Rv
ucgcggcggcgcu

SEQ ID NO: 1357113 - RNA, 23 nt, Mycobacterium tuberculosis H37Rv
ucgcgggcccgcgcggcgguguc

SEQ ID NO: 1357114 - RNA, 20 nt, Mycobacterium tuberculosis H37Rv
ucgcggccguggaugucgcg

SEQ ID NO: 1357115 - RNA, 21 nt, Mycobacterium tuberculosis H37Rv
ucgcggccgcggccucccgca

SEQ ID NO: 1357116 - RNA, 16 nt, Mycobacterium tuberculosis H37Rv
ucgcgucacaccagcg

SEQ ID NO: 1357117 - RNA, 13 nt, Mycobacterium tuberculosis H37Rv
ucgcguccuccuc

SEQ ID NO: 1357118 - RNA, 14 nt, Mycobacterium tuberculosis H37Rv
ucgcguccuccucg

SEQ ID NO: 1357119 - RNA, 20 nt, Mycobacterium tuberculosis H37Rv
ucgcgguggcggugucggcg

SEQ ID NO: 1357120 - RNA, 19 nt, Mycobacterium tuberculosis H37Rv
ucgcguaccaacaggaugg

SEQ ID NO: 1357121 - RNA, 17 nt, Mycobacterium tuberculosis H37Rv
ucgcguacguacugcuu

SEQ ID NO: 1357122 - RNA, 16 nt, Mycobacterium tuberculosis H37Rv
ucgcgcggcugugccc

SEQ ID NO: 1357123 - RNA, 13 nt, Mycobacterium tuberculosis H37Rv
ucgcgcgcgaaac

SEQ ID NO: 1357124 - RNA, 20 nt, Mycobacterium tuberculosis H37Rv
ucgcgcgcgaacacccgaag

SEQ ID NO: 1357125 - RNA, 21 nt, Mycobacterium tuberculosis H37Rv
ucgcgcgaccuggucgaacug

SEQ ID NO: 1357126 - RNA, 15 nt, Mycobacterium tuberculosis H37Rv
ucgcggaucagcccg

SEQ ID NO: 1357127 - RNA, 13 nt, Mycobacterium tuberculosis H37Rv
ucgcggacccgcg

SEQ ID NO: 1357128 - RNA, 17 nt, Mycobacterium tuberculosis H37Rv
ucgcggaagugucgucg

SEQ ID NO: 1357129 - RNA, 16 nt, Mycobacterium tuberculosis H37Rv
ucgcggaugcguuggc

SEQ ID NO: 1357130 - RNA, 12 nt, Mycobacterium tuberculosis H37Rv
ucgcgcugauca

SEQ ID NO: 1357131 - RNA, 23 nt, Mycobacterium tuberculosis H37Rv
ucgcgcugcggcccacaccagcg

SEQ ID NO: 1357132 - RNA, 15 nt, Mycobacterium tuberculosis H37Rv
ucggaauacaacagc

SEQ ID NO: 1357133 - RNA, 14 nt, Mycobacterium tuberculosis H37Rv
ucggacagggugcg

SEQ ID NO: 1357134 - RNA, 14 nt, Mycobacterium tuberculosis H37Rv
ucggaccacccggc

SEQ ID NO: 1357135 - RNA, 19 nt, Mycobacterium tuberculosis H37Rv
ucggaaaaccgcaccgucc

SEQ ID NO: 1357136 - RNA, 22 nt, Mycobacterium tuberculosis H37Rv
ucggagggggaccucuucggug

SEQ ID NO: 1357137 - RNA, 23 nt, Mycobacterium tuberculosis H37Rv
ucggaggaaccccgcgcggugcc

SEQ ID NO: 1357138 - RNA, 18 nt, Mycobacterium tuberculosis H37Rv
ucggagccggccaccucg

SEQ ID NO: 1357139 - RNA, 18 nt, Mycobacterium tuberculosis H37Rv
ucggagauuucgucgcug

SEQ ID NO: 1357140 - RNA, 20 nt, Mycobacterium tuberculosis H37Rv
ucggagauuucgucgcugag

SEQ ID NO: 1357141 - RNA, 12 nt, Mycobacterium tuberculosis H37Rv
ucggacugaaga

SEQ ID NO: 1357142 - RNA, 11 nt, Mycobacterium tuberculosis H37Rv
ucggacugggg

SEQ ID NO: 1357143 - RNA, 23 nt, Mycobacterium tuberculosis H37Rv
ucggagaacauguaggucgccgc

SEQ ID NO: 1357144 - RNA, 13 nt, Mycobacterium tuberculosis H37Rv
ucggacccacccu

SEQ ID NO: 1357145 - RNA, 18 nt, Mycobacterium tuberculosis H37Rv
ucggaccagcugccggcg

SEQ ID NO: 1357146 - RNA, 19 nt, Mycobacterium tuberculosis H37Rv
ucggcauugcgcaggaugu

SEQ ID NO: 1357147 - RNA, 13 nt, Mycobacterium tuberculosis H37Rv
ucggccaccgccu

SEQ ID NO: 1357148 - RNA, 16 nt, Mycobacterium tuberculosis H37Rv
ucggccaccgccugag

SEQ ID NO: 1357149 - RNA, 13 nt, Mycobacterium tuberculosis H37Rv
ucggccaccaacu

SEQ ID NO: 1357150 - RNA, 22 nt, Mycobacterium tuberculosis H37Rv
ucggcauguuccuugcggccgc

SEQ ID NO: 1357151 - RNA, 15 nt, Mycobacterium tuberculosis H37Rv
ucggcauccaggcug

SEQ ID NO: 1357152 - RNA, 22 nt, Mycobacterium tuberculosis H37Rv
ucggcacgucguugggcauguc

SEQ ID NO: 1357153 - RNA, 21 nt, Mycobacterium tuberculosis H37Rv
ucggcaccgucucgcaccgcg

SEQ ID NO: 1357154 - RNA, 21 nt, Mycobacterium tuberculosis H37Rv
ucggcacgccgggcaucggcg

SEQ ID NO: 1357155 - RNA, 17 nt, Mycobacterium tuberculosis H37Rv
ucggcacuuagcccgau

SEQ ID NO: 1357156 - RNA, 13 nt, Mycobacterium tuberculosis H37Rv
ucggcacuuagcc

SEQ ID NO: 1357157 - RNA, 17 nt, Mycobacterium tuberculosis H37Rv
ucggcagauggucucga

SEQ ID NO: 1357158 - RNA, 16 nt, Mycobacterium tuberculosis H37Rv
ucggcagcaggacacc

SEQ ID NO: 1357159 - RNA, 17 nt, Mycobacterium tuberculosis H37Rv
ucggcagcaggacaccu

SEQ ID NO: 1357160 - RNA, 18 nt, Mycobacterium tuberculosis H37Rv
ucggaugucucggcacca

SEQ ID NO: 1357161 - RNA, 19 nt, Mycobacterium tuberculosis H37Rv
ucggaugucucggcaccac

SEQ ID NO: 1357162 - RNA, 16 nt, Mycobacterium tuberculosis H37Rv
ucggaucguacggguc

SEQ ID NO: 1357163 - RNA, 15 nt, Mycobacterium tuberculosis H37Rv
ucggaucgccaggcc

SEQ ID NO: 1357164 - RNA, 16 nt, Mycobacterium tuberculosis H37Rv
ucggcaacggcggcgu

SEQ ID NO: 1357165 - RNA, 20 nt, Mycobacterium tuberculosis H37Rv
ucggcaaccaccucgugggc

SEQ ID NO: 1357166 - RNA, 24 nt, Mycobacterium tuberculosis H37Rv
ucggcaaccaccucgugggccacu

SEQ ID NO: 1357167 - RNA, 22 nt, Mycobacterium tuberculosis H37Rv
ucggcaaccacggagcccgacu

SEQ ID NO: 1357168 - RNA, 19 nt, Mycobacterium tuberculosis H37Rv
ucggcaauacuccgcugac

SEQ ID NO: 1357169 - RNA, 14 nt, Mycobacterium tuberculosis H37Rv
ucgggaucgcugcc

SEQ ID NO: 1357170 - RNA, 16 nt, Mycobacterium tuberculosis H37Rv
ucgggaucggccggcg

SEQ ID NO: 1357171 - RNA, 19 nt, Mycobacterium tuberculosis H37Rv
ucgggauggacaccaccuc

SEQ ID NO: 1357172 - RNA, 21 nt, Mycobacterium tuberculosis H37Rv
ucgggauggacggcagccagc

SEQ ID NO: 1357173 - RNA, 20 nt, Mycobacterium tuberculosis H37Rv
ucgggcacaucgcacggucg

SEQ ID NO: 1357174 - RNA, 20 nt, Mycobacterium tuberculosis H37Rv
ucgggcaaccugccgggcca

SEQ ID NO: 1357175 - RNA, 15 nt, Mycobacterium tuberculosis H37Rv
ucgggcaacucggug

SEQ ID NO: 1357176 - RNA, 22 nt, Mycobacterium tuberculosis H37Rv
ucgggcaugacgaauugguugc

SEQ ID NO: 1357177 - RNA, 16 nt, Mycobacterium tuberculosis H37Rv
ucgggcaugcucuggc

SEQ ID NO: 1357178 - RNA, 15 nt, Mycobacterium tuberculosis H37Rv
ucgggcccagcgcgc

SEQ ID NO: 1357179 - RNA, 12 nt, Mycobacterium tuberculosis H37Rv
ucgggcagcacc

SEQ ID NO: 1357180 - RNA, 22 nt, Mycobacterium tuberculosis H37Rv
ucgggcagauaugacggcagac

SEQ ID NO: 1357181 - RNA, 16 nt, Mycobacterium tuberculosis H37Rv
ucgggcagcgcggcca

SEQ ID NO: 1357182 - RNA, 21 nt, Mycobacterium tuberculosis H37Rv
ucgggccggccgccgcgggac

SEQ ID NO: 1357183 - RNA, 21 nt, Mycobacterium tuberculosis H37Rv
ucgggcgcgaaaccgcauguc

SEQ ID NO: 1357184 - RNA, 17 nt, Mycobacterium tuberculosis H37Rv
ucgggcgcccaugcuga

SEQ ID NO: 1357185 - RNA, 22 nt, Mycobacterium tuberculosis H37Rv
ucgggcgcgcggcgagccucgc

SEQ ID NO: 1357186 - RNA, 19 nt, Mycobacterium tuberculosis H37Rv
ucgggcggcgucgcggauc

SEQ ID NO: 1357187 - RNA, 17 nt, Mycobacterium tuberculosis H37Rv
ucgggcgugucgggaac

SEQ ID NO: 1357188 - RNA, 18 nt, Mycobacterium tuberculosis H37Rv
ucgggcgugaucccgccc

SEQ ID NO: 1357189 - RNA, 14 nt, Mycobacterium tuberculosis H37Rv
ucgggcgucagcag

SEQ ID NO: 1357190 - RNA, 18 nt, Mycobacterium tuberculosis H37Rv
ucggggaugcugaccuuc

SEQ ID NO: 1357191 - RNA, 11 nt, Mycobacterium tuberculosis H37Rv
ucggggaacac

SEQ ID NO: 1357192 - RNA, 17 nt, Mycobacterium tuberculosis H37Rv
ucggggccgcaggccag

SEQ ID NO: 1357193 - RNA, 21 nt, Mycobacterium tuberculosis H37Rv
ucgggcugccgcaugcgcucc

SEQ ID NO: 1357194 - RNA, 19 nt, Mycobacterium tuberculosis H37Rv
ucgggcucguccagcaacc

SEQ ID NO: 1357195 - RNA, 16 nt, Mycobacterium tuberculosis H37Rv
ucgggcucggagauga

SEQ ID NO: 1357196 - RNA, 11 nt, Mycobacterium tuberculosis H37Rv
ucgggugcagc

SEQ ID NO: 1357197 - RNA, 23 nt, Mycobacterium tuberculosis H37Rv
ucgggguuuaguuuaucggccgu

SEQ ID NO: 1357198 - RNA, 14 nt, Mycobacterium tuberculosis H37Rv
ucgggggcagcgcc

SEQ ID NO: 1357199 - RNA, 12 nt, Mycobacterium tuberculosis H37Rv
ucgggucagcac

SEQ ID NO: 1357200 - RNA, 13 nt, Mycobacterium tuberculosis H37Rv
ucggguaccagca

SEQ ID NO: 1357201 - RNA, 22 nt, Mycobacterium tuberculosis H37Rv
ucggguaccggcggcaaagcgu

SEQ ID NO: 1357202 - RNA, 13 nt, Mycobacterium tuberculosis H37Rv
ucgggguugacug

SEQ ID NO: 1357203 - RNA, 18 nt, Mycobacterium tuberculosis H37Rv
ucgggucgaucaccgaca

SEQ ID NO: 1357204 - RNA, 17 nt, Mycobacterium tuberculosis H37Rv
ucggguccgacagcccc

SEQ ID NO: 1357205 - RNA, 21 nt, Mycobacterium tuberculosis H37Rv
ucgguucgccccugcacagca

SEQ ID NO: 1357206 - RNA, 13 nt, Mycobacterium tuberculosis H37Rv
ucgguuuccucga

SEQ ID NO: 1357207 - RNA, 16 nt, Mycobacterium tuberculosis H37Rv
ucggugggcgugacgu

SEQ ID NO: 1357208 - RNA, 17 nt, Mycobacterium tuberculosis H37Rv
ucggugggugccagccg

SEQ ID NO: 1357209 - RNA, 16 nt, Mycobacterium tuberculosis H37Rv
ucgguuagcgcggcca

SEQ ID NO: 1357210 - RNA, 14 nt, Mycobacterium tuberculosis H37Rv
ucgguuagcgcggc

SEQ ID NO: 1357211 - RNA, 19 nt, Mycobacterium tuberculosis H37Rv
ucggugucuuccuccucga

SEQ ID NO: 1357212 - RNA, 22 nt, Mycobacterium tuberculosis H37Rv
ucgguguggcccaacaccgcca

SEQ ID NO: 1357213 - RNA, 13 nt, Mycobacterium tuberculosis H37Rv
ucgguguggccgu

SEQ ID NO: 1357214 - RNA, 12 nt, Mycobacterium tuberculosis H37Rv
ucgguguggacu

SEQ ID NO: 1357215 - RNA, 13 nt, Mycobacterium tuberculosis H37Rv
ucggugcacggcg

SEQ ID NO: 1357216 - RNA, 19 nt, Mycobacterium tuberculosis H37Rv
ucggugaucuuguccgggc

SEQ ID NO: 1357217 - RNA, 19 nt, Mycobacterium tuberculosis H37Rv
ucggugagcagggcggcga

SEQ ID NO: 1357218 - RNA, 17 nt, Mycobacterium tuberculosis H37Rv
ucggugaccuguuuggg

SEQ ID NO: 1357219 - RNA, 22 nt, Mycobacterium tuberculosis H37Rv
ucggugagcccguugaccugcg

SEQ ID NO: 1357220 - RNA, 16 nt, Mycobacterium tuberculosis H37Rv
ucggugagcgggcaag

SEQ ID NO: 1357221 - RNA, 12 nt, Mycobacterium tuberculosis H37Rv
ucggugaagacg

SEQ ID NO: 1357222 - RNA, 23 nt, Mycobacterium tuberculosis H37Rv
ucggugcggaacaccgcccggcc

SEQ ID NO: 1357223 - RNA, 15 nt, Mycobacterium tuberculosis H37Rv
ucggugcggugcaca

SEQ ID NO: 1357224 - RNA, 21 nt, Mycobacterium tuberculosis H37Rv
ucggugcagcccgccgcugaa

SEQ ID NO: 1357225 - RNA, 14 nt, Mycobacterium tuberculosis H37Rv
ucggugcagcccgc

SEQ ID NO: 1357226 - RNA, 21 nt, Mycobacterium tuberculosis H37Rv
ucggugccgcugaugcuggcc

SEQ ID NO: 1357227 - RNA, 17 nt, Mycobacterium tuberculosis H37Rv
ucggugccggggcugcc

SEQ ID NO: 1357228 - RNA, 21 nt, Mycobacterium tuberculosis H37Rv
ucggucgccauguugaagcga

SEQ ID NO: 1357229 - RNA, 13 nt, Mycobacterium tuberculosis H37Rv
ucgguccugccaa

SEQ ID NO: 1357230 - RNA, 20 nt, Mycobacterium tuberculosis H37Rv
ucggucucauagugcagguc

SEQ ID NO: 1357231 - RNA, 16 nt, Mycobacterium tuberculosis H37Rv
ucggugaacgccgccc

SEQ ID NO: 1357232 - RNA, 23 nt, Mycobacterium tuberculosis H37Rv
ucggugaaaaaggcgacucggug

SEQ ID NO: 1357233 - RNA, 13 nt, Mycobacterium tuberculosis H37Rv
ucggucugcaugc

SEQ ID NO: 1357234 - RNA, 20 nt, Mycobacterium tuberculosis H37Rv
ucggucugcaugcgcuggaa

SEQ ID NO: 1357235 - RNA, 22 nt, Mycobacterium tuberculosis H37Rv
ucggucaauucggugcgcuggc

SEQ ID NO: 1357236 - RNA, 19 nt, Mycobacterium tuberculosis H37Rv
ucggucagcgggcacgccg

SEQ ID NO: 1357237 - RNA, 14 nt, Mycobacterium tuberculosis H37Rv
ucggucaguuccuc

SEQ ID NO: 1357238 - RNA, 16 nt, Mycobacterium tuberculosis H37Rv
ucggccaucguccagc

SEQ ID NO: 1357239 - RNA, 17 nt, Mycobacterium tuberculosis H37Rv
ucggccaucguccagca

SEQ ID NO: 1357240 - RNA, 21 nt, Mycobacterium tuberculosis H37Rv
ucggccagguaauugccgacc

SEQ ID NO: 1357241 - RNA, 19 nt, Mycobacterium tuberculosis H37Rv
ucggccagcuccgccugcc

SEQ ID NO: 1357242 - RNA, 19 nt, Mycobacterium tuberculosis H37Rv
ucggccagcucgugaucuu

SEQ ID NO: 1357243 - RNA, 13 nt, Mycobacterium tuberculosis H37Rv
ucggccagcagcg

SEQ ID NO: 1357244 - RNA, 15 nt, Mycobacterium tuberculosis H37Rv
ucggccagcacgccg

SEQ ID NO: 1357245 - RNA, 21 nt, Mycobacterium tuberculosis H37Rv
ucggccagcagaucagguccu

SEQ ID NO: 1357246 - RNA, 21 nt, Mycobacterium tuberculosis H37Rv
ucggccauugcccgggcggga

SEQ ID NO: 1357247 - RNA, 21 nt, Mycobacterium tuberculosis H37Rv
ucggcccgaggugccggggcc

SEQ ID NO: 1357248 - RNA, 18 nt, Mycobacterium tuberculosis H37Rv
ucggcccacggugucccg

SEQ ID NO: 1357249 - RNA, 18 nt, Mycobacterium tuberculosis H37Rv
ucggcccauaacagcugg

SEQ ID NO: 1357250 - RNA, 18 nt, Mycobacterium tuberculosis H37Rv
ucggccgaccgggcucug

SEQ ID NO: 1357251 - RNA, 18 nt, Mycobacterium tuberculosis H37Rv
ucggccgaugcgcagugc

SEQ ID NO: 1357252 - RNA, 16 nt, Mycobacterium tuberculosis H37Rv
ucggcccgugccacag

SEQ ID NO: 1357253 - RNA, 16 nt, Mycobacterium tuberculosis H37Rv
ucggcgaacgcgucca

SEQ ID NO: 1357254 - RNA, 17 nt, Mycobacterium tuberculosis H37Rv
ucggcgaagcacaccgu

SEQ ID NO: 1357255 - RNA, 24 nt, Mycobacterium tuberculosis H37Rv
ucggcgaucgucaagccgggcacg

SEQ ID NO: 1357256 - RNA, 22 nt, Mycobacterium tuberculosis H37Rv
ucggcgaugauguugagcugga

SEQ ID NO: 1357257 - RNA, 16 nt, Mycobacterium tuberculosis H37Rv
ucggcgagcaccaccc

SEQ ID NO: 1357258 - RNA, 19 nt, Mycobacterium tuberculosis H37Rv
ucggcgcccgcucggccgc

SEQ ID NO: 1357259 - RNA, 19 nt, Mycobacterium tuberculosis H37Rv
ucggcgaugggccgguccg

SEQ ID NO: 1357260 - RNA, 13 nt, Mycobacterium tuberculosis H37Rv
ucggcgcacagcg

SEQ ID NO: 1357261 - RNA, 16 nt, Mycobacterium tuberculosis H37Rv
ucggccggcaccccac

SEQ ID NO: 1357262 - RNA, 20 nt, Mycobacterium tuberculosis H37Rv
ucggccggcaccccacggcc

SEQ ID NO: 1357263 - RNA, 21 nt, Mycobacterium tuberculosis H37Rv
ucggccggcggcgcccaucgc

SEQ ID NO: 1357264 - RNA, 15 nt, Mycobacterium tuberculosis H37Rv
ucggccggcgucagc

SEQ ID NO: 1357265 - RNA, 19 nt, Mycobacterium tuberculosis H37Rv
ucggccgucauggcccgau

SEQ ID NO: 1357266 - RNA, 15 nt, Mycobacterium tuberculosis H37Rv
ucggccgggcucuau

SEQ ID NO: 1357267 - RNA, 17 nt, Mycobacterium tuberculosis H37Rv
ucggccucgucgugcac

SEQ ID NO: 1357268 - RNA, 20 nt, Mycobacterium tuberculosis H37Rv
ucggcgaaccacggcagcca

SEQ ID NO: 1357269 - RNA, 20 nt, Mycobacterium tuberculosis H37Rv
ucggccugccggcagcggcg

SEQ ID NO: 1357270 - RNA, 14 nt, Mycobacterium tuberculosis H37Rv
ucggcgcggcuguc

SEQ ID NO: 1357271 - RNA, 21 nt, Mycobacterium tuberculosis H37Rv
ucggcgccgccguccagcgcc

SEQ ID NO: 1357272 - RNA, 12 nt, Mycobacterium tuberculosis H37Rv
ucggcgccggcg

SEQ ID NO: 1357273 - RNA, 23 nt, Mycobacterium tuberculosis H37Rv
ucggcgccggcggccgcggugcc

SEQ ID NO: 1357274 - RNA, 15 nt, Mycobacterium tuberculosis H37Rv
ucggcggccaccaug

SEQ ID NO: 1357275 - RNA, 22 nt, Mycobacterium tuberculosis H37Rv
ucggcgcugaucgcgcgcaccg

SEQ ID NO: 1357276 - RNA, 22 nt, Mycobacterium tuberculosis H37Rv
ucggcggugaaaucgcacagcg

SEQ ID NO: 1357277 - RNA, 15 nt, Mycobacterium tuberculosis H37Rv
ucggcggugccacca

SEQ ID NO: 1357278 - RNA, 22 nt, Mycobacterium tuberculosis H37Rv
ucggcgguguccuacuuuucca

SEQ ID NO: 1357279 - RNA, 19 nt, Mycobacterium tuberculosis H37Rv
ucggcgucaccguguugca

SEQ ID NO: 1357280 - RNA, 15 nt, Mycobacterium tuberculosis H37Rv
ucggcgugcaggguc

SEQ ID NO: 1357281 - RNA, 16 nt, Mycobacterium tuberculosis H37Rv
ucggcgucccagggca

SEQ ID NO: 1357282 - RNA, 15 nt, Mycobacterium tuberculosis H37Rv
ucggcggcuuggccg

SEQ ID NO: 1357283 - RNA, 14 nt, Mycobacterium tuberculosis H37Rv
ucggcgggagcugc

SEQ ID NO: 1357284 - RNA, 13 nt, Mycobacterium tuberculosis H37Rv
ucggcgggucagg

SEQ ID NO: 1357285 - RNA, 21 nt, Mycobacterium tuberculosis H37Rv
ucggcggguagaaccagcccg

SEQ ID NO: 1357286 - RNA, 22 nt, Mycobacterium tuberculosis H37Rv
ucggcggcuucguggcggcgcg

SEQ ID NO: 1357287 - RNA, 18 nt, Mycobacterium tuberculosis H37Rv
ucggcggcgaacagcccc

SEQ ID NO: 1357288 - RNA, 22 nt, Mycobacterium tuberculosis H37Rv
ucggcggccucgcugcucagca

SEQ ID NO: 1357289 - RNA, 22 nt, Mycobacterium tuberculosis H37Rv
ucggcucgagucgcagcacggg

SEQ ID NO: 1357290 - RNA, 17 nt, Mycobacterium tuberculosis H37Rv
ucggcuagugcauuguc

SEQ ID NO: 1357291 - RNA, 20 nt, Mycobacterium tuberculosis H37Rv
ucggcuaccuuguccggccc

SEQ ID NO: 1357292 - RNA, 15 nt, Mycobacterium tuberculosis H37Rv
ucggcguuggggcuc

SEQ ID NO: 1357293 - RNA, 16 nt, Mycobacterium tuberculosis H37Rv
ucggcugauagggcug

SEQ ID NO: 1357294 - RNA, 16 nt, Mycobacterium tuberculosis H37Rv
ucggcugccgcggcug

SEQ ID NO: 1357295 - RNA, 22 nt, Mycobacterium tuberculosis H37Rv
ucggcuggugggggagcggccg

SEQ ID NO: 1357296 - RNA, 23 nt, Mycobacterium tuberculosis H37Rv
ucggcugguuacucaccaaccgc

SEQ ID NO: 1357297 - RNA, 15 nt, Mycobacterium tuberculosis H37Rv
ucggcuuggccggcg

SEQ ID NO: 1357298 - RNA, 15 nt, Mycobacterium tuberculosis H37Rv
ucggcuugggaaacc

SEQ ID NO: 1357299 - RNA, 16 nt, Mycobacterium tuberculosis H37Rv
ucggcuugggaaaccc

SEQ ID NO: 1357300 - RNA, 20 nt, Mycobacterium tuberculosis H37Rv
ucggcuugggaaacccggcc

SEQ ID NO: 1357301 - RNA, 17 nt, Mycobacterium tuberculosis H37Rv
ucggcuuugccgcugug

SEQ ID NO: 1357302 - RNA, 20 nt, Mycobacterium tuberculosis H37Rv
ucgggaacgcucgucgacag

SEQ ID NO: 1357303 - RNA, 19 nt, Mycobacterium tuberculosis H37Rv
ucgggaccggcuugccgcc

SEQ ID NO: 1357304 - RNA, 13 nt, Mycobacterium tuberculosis H37Rv
ucgggagcggcug

SEQ ID NO: 1357305 - RNA, 18 nt, Mycobacterium tuberculosis H37Rv
ucgggagcggcugcggca

SEQ ID NO: 1357306 - RNA, 17 nt, Mycobacterium tuberculosis H37Rv
ucgucggccggcacccc

SEQ ID NO: 1357307 - RNA, 18 nt, Mycobacterium tuberculosis H37Rv
ucgucggcgacggccagc

SEQ ID NO: 1357308 - RNA, 14 nt, Mycobacterium tuberculosis H37Rv
ucgucggcaggcag

SEQ ID NO: 1357309 - RNA, 18 nt, Mycobacterium tuberculosis H37Rv
ucgucggcaugggccggc

SEQ ID NO: 1357310 - RNA, 22 nt, Mycobacterium tuberculosis H37Rv
ucgucggcaugggccggcgccg

SEQ ID NO: 1357311 - RNA, 20 nt, Mycobacterium tuberculosis H37Rv
ucgucgguaaugccgggccc

SEQ ID NO: 1357312 - RNA, 17 nt, Mycobacterium tuberculosis H37Rv
ucgucgggcaugcucug

SEQ ID NO: 1357313 - RNA, 16 nt, Mycobacterium tuberculosis H37Rv
ucgucggcgccggcgg

SEQ ID NO: 1357314 - RNA, 20 nt, Mycobacterium tuberculosis H37Rv
ucgucgcgauccacuccggc

SEQ ID NO: 1357315 - RNA, 21 nt, Mycobacterium tuberculosis H37Rv
ucgucgcugcccaucacaccc

SEQ ID NO: 1357316 - RNA, 15 nt, Mycobacterium tuberculosis H37Rv
ucgucggacucgucc

SEQ ID NO: 1357317 - RNA, 14 nt, Mycobacterium tuberculosis H37Rv
ucgucgcccaggcg

SEQ ID NO: 1357318 - RNA, 15 nt, Mycobacterium tuberculosis H37Rv
ucgucgccagggccg

SEQ ID NO: 1357319 - RNA, 13 nt, Mycobacterium tuberculosis H37Rv
ucgucgccagggc

SEQ ID NO: 1357320 - RNA, 14 nt, Mycobacterium tuberculosis H37Rv
ucgucgccagggcc

SEQ ID NO: 1357321 - RNA, 22 nt, Mycobacterium tuberculosis H37Rv
ucgucgccgucggugccgccgc

SEQ ID NO: 1357322 - RNA, 22 nt, Mycobacterium tuberculosis H37Rv
ucgucgccugcgacuaagggca

SEQ ID NO: 1357323 - RNA, 14 nt, Mycobacterium tuberculosis H37Rv
ucgucgccgagcgg

SEQ ID NO: 1357324 - RNA, 22 nt, Mycobacterium tuberculosis H37Rv
ucgucgaucgacucacacaccg

SEQ ID NO: 1357325 - RNA, 18 nt, Mycobacterium tuberculosis H37Rv
ucgucgaucgccgcgccg

SEQ ID NO: 1357326 - RNA, 15 nt, Mycobacterium tuberculosis H37Rv
ucgucgaugucgacg

SEQ ID NO: 1357327 - RNA, 19 nt, Mycobacterium tuberculosis H37Rv
ucgucgccaagcccaggcg

SEQ ID NO: 1357328 - RNA, 16 nt, Mycobacterium tuberculosis H37Rv
ucgucgacggccuggg

SEQ ID NO: 1357329 - RNA, 22 nt, Mycobacterium tuberculosis H37Rv
ucgucgacgcgucguggucggc

SEQ ID NO: 1357330 - RNA, 22 nt, Mycobacterium tuberculosis H37Rv
ucgucgagcaccacccgggccu

SEQ ID NO: 1357331 - RNA, 16 nt, Mycobacterium tuberculosis H37Rv
ucgucgagcaccaccc

SEQ ID NO: 1357332 - RNA, 16 nt, Mycobacterium tuberculosis H37Rv
ucgucgaggaagauca

SEQ ID NO: 1357333 - RNA, 18 nt, Mycobacterium tuberculosis H37Rv
ucgucgaacuuugucgcg

SEQ ID NO: 1357334 - RNA, 17 nt, Mycobacterium tuberculosis H37Rv
ucgucgacccaccaugu

SEQ ID NO: 1357335 - RNA, 14 nt, Mycobacterium tuberculosis H37Rv
ucgucgaaagccug

SEQ ID NO: 1357336 - RNA, 15 nt, Mycobacterium tuberculosis H37Rv
ucguccgacgggccg

SEQ ID NO: 1357337 - RNA, 13 nt, Mycobacterium tuberculosis H37Rv
ucguccggccacg

SEQ ID NO: 1357338 - RNA, 22 nt, Mycobacterium tuberculosis H37Rv
ucguccggccacgguccggccc

SEQ ID NO: 1357339 - RNA, 21 nt, Mycobacterium tuberculosis H37Rv
ucguccgcggucucagugcuc

SEQ ID NO: 1357340 - RNA, 14 nt, Mycobacterium tuberculosis H37Rv
ucguccccagaccg

SEQ ID NO: 1357341 - RNA, 13 nt, Mycobacterium tuberculosis H37Rv
ucguccagcacca

SEQ ID NO: 1357342 - RNA, 23 nt, Mycobacterium tuberculosis H37Rv
ucgucauugcgaaaaucgaagcc

SEQ ID NO: 1357343 - RNA, 11 nt, Mycobacterium tuberculosis H37Rv
ucgucaggccc

SEQ ID NO: 1357344 - RNA, 15 nt, Mycobacterium tuberculosis H37Rv
ucguacucccaggcc

SEQ ID NO: 1357345 - RNA, 22 nt, Mycobacterium tuberculosis H37Rv
ucguagacagucugcgacugga

SEQ ID NO: 1357346 - RNA, 14 nt, Mycobacterium tuberculosis H37Rv
ucgucaccccacca

SEQ ID NO: 1357347 - RNA, 21 nt, Mycobacterium tuberculosis H37Rv
ucguauccgguucugggccug

SEQ ID NO: 1357348 - RNA, 17 nt, Mycobacterium tuberculosis H37Rv
ucguaugauucacgcuc

SEQ ID NO: 1357349 - RNA, 20 nt, Mycobacterium tuberculosis H37Rv
ucgucguccuguccgggcug

SEQ ID NO: 1357350 - RNA, 21 nt, Mycobacterium tuberculosis H37Rv
ucgucgugagucacccggccg

SEQ ID NO: 1357351 - RNA, 20 nt, Mycobacterium tuberculosis H37Rv
ucgucguugugugccagcgu

SEQ ID NO: 1357352 - RNA, 20 nt, Mycobacterium tuberculosis H37Rv
ucgucguaccguucgggccg

SEQ ID NO: 1357353 - RNA, 13 nt, Mycobacterium tuberculosis H37Rv
ucgucggucugca

SEQ ID NO: 1357354 - RNA, 12 nt, Mycobacterium tuberculosis H37Rv
ucgugagccagc

SEQ ID NO: 1357355 - RNA, 22 nt, Mycobacterium tuberculosis H37Rv
ucgugaugucaacgugucccaa

SEQ ID NO: 1357356 - RNA, 13 nt, Mycobacterium tuberculosis H37Rv
ucgugaaaccaca

SEQ ID NO: 1357357 - RNA, 15 nt, Mycobacterium tuberculosis H37Rv
ucguggaucugccuc

SEQ ID NO: 1357358 - RNA, 22 nt, Mycobacterium tuberculosis H37Rv
ucguggcgccgccccauacuug

SEQ ID NO: 1357359 - RNA, 21 nt, Mycobacterium tuberculosis H37Rv
ucguggcgcgccgcaucggcg

SEQ ID NO: 1357360 - RNA, 22 nt, Mycobacterium tuberculosis H37Rv
ucguggagcucacgugcugccg

SEQ ID NO: 1357361 - RNA, 13 nt, Mycobacterium tuberculosis H37Rv
ucgugguaaccau

SEQ ID NO: 1357362 - RNA, 14 nt, Mycobacterium tuberculosis H37Rv
ucgugggcugugcg

SEQ ID NO: 1357363 - RNA, 23 nt, Mycobacterium tuberculosis H37Rv
ucgugcaaugcuuccagcaucag

SEQ ID NO: 1357364 - RNA, 13 nt, Mycobacterium tuberculosis H37Rv
ucgugcacgcuga

SEQ ID NO: 1357365 - RNA, 11 nt, Mycobacterium tuberculosis H37Rv
ucgugccaccg

SEQ ID NO: 1357366 - RNA, 13 nt, Mycobacterium tuberculosis H37Rv
ucgugccggcguu

SEQ ID NO: 1357367 - RNA, 23 nt, Mycobacterium tuberculosis H37Rv
ucgugcgacaacacgaccucuug

SEQ ID NO: 1357368 - RNA, 18 nt, Mycobacterium tuberculosis H37Rv
ucguucaccgcagcgggu

SEQ ID NO: 1357369 - RNA, 22 nt, Mycobacterium tuberculosis H37Rv
ucguucauguagcagcgcggcu

SEQ ID NO: 1357370 - RNA, 16 nt, Mycobacterium tuberculosis H37Rv
ucguguuggccggguc

SEQ ID NO: 1357371 - RNA, 17 nt, Mycobacterium tuberculosis H37Rv
ucguugcccgacccgcc

SEQ ID NO: 1357372 - RNA, 14 nt, Mycobacterium tuberculosis H37Rv
ucguugccagggcg

SEQ ID NO: 1357373 - RNA, 15 nt, Mycobacterium tuberculosis H37Rv
ucguucuccauccgc

SEQ ID NO: 1357374 - RNA, 21 nt, Mycobacterium tuberculosis H37Rv
ucguuggcaaagacgcuggcc

SEQ ID NO: 1357375 - RNA, 13 nt, Mycobacterium tuberculosis H37Rv
ucuccaccuucug

SEQ ID NO: 1357376 - RNA, 14 nt, Mycobacterium tuberculosis H37Rv
ucuccaccgcgaug

SEQ ID NO: 1357377 - RNA, 22 nt, Mycobacterium tuberculosis H37Rv
ucuccaagcucgacaacugccc

SEQ ID NO: 1357378 - RNA, 23 nt, Mycobacterium tuberculosis H37Rv
ucuccaacacaaacgccgccggg

SEQ ID NO: 1357379 - RNA, 16 nt, Mycobacterium tuberculosis H37Rv
ucucccgaccgccgag

SEQ ID NO: 1357380 - RNA, 20 nt, Mycobacterium tuberculosis H37Rv
ucuccccguccugccagucc

SEQ ID NO: 1357381 - RNA, 12 nt, Mycobacterium tuberculosis H37Rv
ucuccgccgccc

SEQ ID NO: 1357382 - RNA, 23 nt, Mycobacterium tuberculosis H37Rv
ucuccgccaacaacuucucgucg

SEQ ID NO: 1357383 - RNA, 20 nt, Mycobacterium tuberculosis H37Rv
ucuccgccgucgccaccggu

SEQ ID NO: 1357384 - RNA, 14 nt, Mycobacterium tuberculosis H37Rv
ucuccgacauuggc

SEQ ID NO: 1357385 - RNA, 20 nt, Mycobacterium tuberculosis H37Rv
ucucgccgggaaacaccggc

SEQ ID NO: 1357386 - RNA, 16 nt, Mycobacterium tuberculosis H37Rv
ucucgccgggaaacac

SEQ ID NO: 1357387 - RNA, 14 nt, Mycobacterium tuberculosis H37Rv
ucucgcaccgcguu

SEQ ID NO: 1357388 - RNA, 21 nt, Mycobacterium tuberculosis H37Rv
ucucgaucuggucaagacccg

SEQ ID NO: 1357389 - RNA, 13 nt, Mycobacterium tuberculosis H37Rv
ucucgaucaccuc

SEQ ID NO: 1357390 - RNA, 22 nt, Mycobacterium tuberculosis H37Rv
ucucgaccguauugaccagcgg

SEQ ID NO: 1357391 - RNA, 19 nt, Mycobacterium tuberculosis H37Rv
ucuccggcaacagcaccag

SEQ ID NO: 1357392 - RNA, 14 nt, Mycobacterium tuberculosis H37Rv
ucuccuccagagac

SEQ ID NO: 1357393 - RNA, 17 nt, Mycobacterium tuberculosis H37Rv
ucuccuccaccagugcc

SEQ ID NO: 1357394 - RNA, 15 nt, Mycobacterium tuberculosis H37Rv
ucuccuggaaaggac

SEQ ID NO: 1357395 - RNA, 16 nt, Mycobacterium tuberculosis H37Rv
ucuccuugagcuucuc

SEQ ID NO: 1357396 - RNA, 19 nt, Mycobacterium tuberculosis H37Rv
ucuccuccggaaagcucuc

SEQ ID NO: 1357397 - RNA, 21 nt, Mycobacterium tuberculosis H37Rv
ucuccuccgcguagagcagca

SEQ ID NO: 1357398 - RNA, 20 nt, Mycobacterium tuberculosis H37Rv
ucuccucuugcaccagggcc

SEQ ID NO: 1357399 - RNA, 21 nt, Mycobacterium tuberculosis H37Rv
ucuccugcugugggauucggg

SEQ ID NO: 1357400 - RNA, 21 nt, Mycobacterium tuberculosis H37Rv
ucucggcgggucaggccaggg

SEQ ID NO: 1357401 - RNA, 19 nt, Mycobacterium tuberculosis H37Rv
ucucggcgcagccggugag

SEQ ID NO: 1357402 - RNA, 13 nt, Mycobacterium tuberculosis H37Rv
ucucggccggcgg

SEQ ID NO: 1357403 - RNA, 12 nt, Mycobacterium tuberculosis H37Rv
ucucggccaggg

SEQ ID NO: 1357404 - RNA, 14 nt, Mycobacterium tuberculosis H37Rv
ucucggcaccacag

SEQ ID NO: 1357405 - RNA, 13 nt, Mycobacterium tuberculosis H37Rv
ucucggcaccaca

SEQ ID NO: 1357406 - RNA, 22 nt, Mycobacterium tuberculosis H37Rv
aaaugcuucgccaacugcggca

SEQ ID NO: 1357407 - RNA, 16 nt, Mycobacterium tuberculosis H37Rv
ucucugcgccaggcgg

SEQ ID NO: 1357408 - RNA, 20 nt, Mycobacterium tuberculosis H37Rv
ucucugagcgggcgggccug

SEQ ID NO: 1357409 - RNA, 23 nt, Mycobacterium tuberculosis H37Rv
ucugcagacgguccgcuacggcg

SEQ ID NO: 1357410 - RNA, 15 nt, Mycobacterium tuberculosis H37Rv
ucugcacgucggccc

SEQ ID NO: 1357411 - RNA, 19 nt, Mycobacterium tuberculosis H37Rv
ucugcagcgucuccuugag

SEQ ID NO: 1357412 - RNA, 18 nt, Mycobacterium tuberculosis H37Rv
ucugaaaauugacccccu

SEQ ID NO: 1357413 - RNA, 22 nt, Mycobacterium tuberculosis H37Rv
ucugacaucggccaagguuguc

SEQ ID NO: 1357414 - RNA, 15 nt, Mycobacterium tuberculosis H37Rv
ucugacccccgaccc

SEQ ID NO: 1357415 - RNA, 20 nt, Mycobacterium tuberculosis H37Rv
ucugacgcuacgacaguguu

SEQ ID NO: 1357416 - RNA, 18 nt, Mycobacterium tuberculosis H37Rv
ucuucaccggccggugcc

SEQ ID NO: 1357417 - RNA, 16 nt, Mycobacterium tuberculosis H37Rv
ucuucgcuaccuucuu

SEQ ID NO: 1357418 - RNA, 16 nt, Mycobacterium tuberculosis H37Rv
ucuuccucggccaccc

SEQ ID NO: 1357419 - RNA, 14 nt, Mycobacterium tuberculosis H37Rv
ucuuccucggccac

SEQ ID NO: 1357420 - RNA, 19 nt, Mycobacterium tuberculosis H37Rv
ucuuccggugcgccgaucc

SEQ ID NO: 1357421 - RNA, 19 nt, Mycobacterium tuberculosis H37Rv
ucugguugggccagcuccu

SEQ ID NO: 1357422 - RNA, 22 nt, Mycobacterium tuberculosis H37Rv
ucuggucgaccaucgguuugca

SEQ ID NO: 1357423 - RNA, 16 nt, Mycobacterium tuberculosis H37Rv
ucuggucggcggccuc

SEQ ID NO: 1357424 - RNA, 18 nt, Mycobacterium tuberculosis H37Rv
ucugggcggugaaggccc

SEQ ID NO: 1357425 - RNA, 22 nt, Mycobacterium tuberculosis H37Rv
ucuggaugucccaugcacggcc

SEQ ID NO: 1357426 - RNA, 18 nt, Mycobacterium tuberculosis H37Rv
ucuggcuacgggccgcgg

SEQ ID NO: 1357427 - RNA, 17 nt, Mycobacterium tuberculosis H37Rv
ucuggcuccggccaggg

SEQ ID NO: 1357428 - RNA, 22 nt, Mycobacterium tuberculosis H37Rv
ucuggcaggugaacugguugac

SEQ ID NO: 1357429 - RNA, 13 nt, Mycobacterium tuberculosis H37Rv
ucuggcaggccag

SEQ ID NO: 1357430 - RNA, 15 nt, Mycobacterium tuberculosis H37Rv
ucuggcaggccagca

SEQ ID NO: 1357431 - RNA, 13 nt, Mycobacterium tuberculosis H37Rv
ucugcaugcgcug

SEQ ID NO: 1357432 - RNA, 18 nt, Mycobacterium tuberculosis H37Rv
ucuagcuugacaacccug

SEQ ID NO: 1357433 - RNA, 16 nt, Mycobacterium tuberculosis H37Rv
ucuaggccucagaacc

SEQ ID NO: 1357434 - RNA, 15 nt, Mycobacterium tuberculosis H37Rv
ucuagcggccuagga

SEQ ID NO: 1357435 - RNA, 22 nt, Mycobacterium tuberculosis H37Rv
ucuagcggccuaggacgccgcc

SEQ ID NO: 1357436 - RNA, 16 nt, Mycobacterium tuberculosis H37Rv
ucuagcaaagccagcg

SEQ ID NO: 1357437 - RNA, 14 nt, Mycobacterium tuberculosis H37Rv
ucuagcaaagccag

SEQ ID NO: 1357438 - RNA, 19 nt, Mycobacterium tuberculosis H37Rv
ucuauccggcgcagguucu

SEQ ID NO: 1357439 - RNA, 22 nt, Mycobacterium tuberculosis H37Rv
aaaugcgggcuuugccaacaaa

SEQ ID NO: 1357440 - RNA, 23 nt, Mycobacterium tuberculosis H37Rv
aaaugccugcccaccuucgaguu

SEQ ID NO: 1357441 - RNA, 20 nt, Mycobacterium tuberculosis H37Rv
ucuaaauaccuuuggcuccc

SEQ ID NO: 1357442 - RNA, 15 nt, Mycobacterium tuberculosis H37Rv
aaaugaagugcaccg

SEQ ID NO: 1357443 - RNA, 23 nt, Mycobacterium tuberculosis H37Rv
ucuaccuuagcgccguugccgcc

SEQ ID NO: 1357444 - RNA, 15 nt, Mycobacterium tuberculosis H37Rv
ucuaccuuuuuggca

SEQ ID NO: 1357445 - RNA, 19 nt, Mycobacterium tuberculosis H37Rv
ucuaauuggcuugugccca

SEQ ID NO: 1357446 - RNA, 19 nt, Mycobacterium tuberculosis H37Rv
ucaaagacccgacgccacg

SEQ ID NO: 1357447 - RNA, 21 nt, Mycobacterium tuberculosis H37Rv
ucaaacccgaaaacccaacac

SEQ ID NO: 1357448 - RNA, 18 nt, Mycobacterium tuberculosis H37Rv
ucaaaccggaaacagcau

SEQ ID NO: 1357449 - RNA, 20 nt, Mycobacterium tuberculosis H37Rv
ucaaaaagcucggcccuguu

SEQ ID NO: 1357450 - RNA, 19 nt, Mycobacterium tuberculosis H37Rv
ucaaaaaccacgcgucgcu

SEQ ID NO: 1357451 - RNA, 16 nt, Mycobacterium tuberculosis H37Rv
uauuucucccagccca

SEQ ID NO: 1357452 - RNA, 19 nt, Mycobacterium tuberculosis H37Rv
uauucgccagcgccggaug

SEQ ID NO: 1357453 - RNA, 13 nt, Mycobacterium tuberculosis H37Rv
uauuaccgcuugc

SEQ ID NO: 1357454 - RNA, 20 nt, Mycobacterium tuberculosis H37Rv
ucaaauccuuugcugcccag

SEQ ID NO: 1357455 - RNA, 17 nt, Mycobacterium tuberculosis H37Rv
ucaacgugucccaagcc

SEQ ID NO: 1357456 - RNA, 13 nt, Mycobacterium tuberculosis H37Rv
ucaacgugaacug

SEQ ID NO: 1357457 - RNA, 18 nt, Mycobacterium tuberculosis H37Rv
ucaagggggucgagcgcu

SEQ ID NO: 1357458 - RNA, 14 nt, Mycobacterium tuberculosis H37Rv
ucaaggugaucagc

SEQ ID NO: 1357459 - RNA, 18 nt, Mycobacterium tuberculosis H37Rv
ucaagaucggugccagca

SEQ ID NO: 1357460 - RNA, 20 nt, Mycobacterium tuberculosis H37Rv
ucaagaucggugccagcacu

SEQ ID NO: 1357461 - RNA, 23 nt, Mycobacterium tuberculosis H37Rv
ucaaucccuccgccaaggaggcc

SEQ ID NO: 1357462 - RNA, 14 nt, Mycobacterium tuberculosis H37Rv
ucaaugcuggcagc

SEQ ID NO: 1357463 - RNA, 14 nt, Mycobacterium tuberculosis H37Rv
ucaauggcagcuga

SEQ ID NO: 1357464 - RNA, 21 nt, Mycobacterium tuberculosis H37Rv
ucaaucgucaagaacgccacg

SEQ ID NO: 1357465 - RNA, 16 nt, Mycobacterium tuberculosis H37Rv
ucaaucgcgucaucaa

SEQ ID NO: 1357466 - RNA, 15 nt, Mycobacterium tuberculosis H37Rv
ucacacccacaccca

SEQ ID NO: 1357467 - RNA, 23 nt, Mycobacterium tuberculosis H37Rv
ucacaccacgguuggccaccagc

SEQ ID NO: 1357468 - RNA, 16 nt, Mycobacterium tuberculosis H37Rv
ucacaccccaggcacc

SEQ ID NO: 1357469 - RNA, 23 nt, Mycobacterium tuberculosis H37Rv
ucacaacugcccgacgaccauuc

SEQ ID NO: 1357470 - RNA, 13 nt, Mycobacterium tuberculosis H37Rv
ucacaagccugcc

SEQ ID NO: 1357471 - RNA, 14 nt, Mycobacterium tuberculosis H37Rv
ucacauucagcacg

SEQ ID NO: 1357472 - RNA, 12 nt, Mycobacterium tuberculosis H37Rv
ucacacuggcuu

SEQ ID NO: 1357473 - RNA, 16 nt, Mycobacterium tuberculosis H37Rv
ucaccacaugggagcc

SEQ ID NO: 1357474 - RNA, 12 nt, Mycobacterium tuberculosis H37Rv
ucaccagcaccc

SEQ ID NO: 1357475 - RNA, 12 nt, Mycobacterium tuberculosis H37Rv
ucaccaugugcu

SEQ ID NO: 1357476 - RNA, 19 nt, Mycobacterium tuberculosis H37Rv
ucaccagccgucagcgcgg

SEQ ID NO: 1357477 - RNA, 19 nt, Mycobacterium tuberculosis H37Rv
ucacccacuccgccgauag

SEQ ID NO: 1357478 - RNA, 16 nt, Mycobacterium tuberculosis H37Rv
ucacccacccgcaccg

SEQ ID NO: 1357479 - RNA, 20 nt, Mycobacterium tuberculosis H37Rv
ucacccacauggugauccac

SEQ ID NO: 1357480 - RNA, 20 nt, Mycobacterium tuberculosis H37Rv
ucaccgcguaguccaggccg

SEQ ID NO: 1357481 - RNA, 23 nt, Mycobacterium tuberculosis H37Rv
ucaccgccauugccaccaagucc

SEQ ID NO: 1357482 - RNA, 17 nt, Mycobacterium tuberculosis H37Rv
ucaccgccuuugccgcc

SEQ ID NO: 1357483 - RNA, 22 nt, Mycobacterium tuberculosis H37Rv
ucaccgcgccagccuccaccag

SEQ ID NO: 1357484 - RNA, 20 nt, Mycobacterium tuberculosis H37Rv
ucaccgccguuaccgccguu

SEQ ID NO: 1357485 - RNA, 15 nt, Mycobacterium tuberculosis H37Rv
ucaccgccgcgaccg

SEQ ID NO: 1357486 - RNA, 23 nt, Mycobacterium tuberculosis H37Rv
ucaccguguugcacgcgggugcc

SEQ ID NO: 1357487 - RNA, 19 nt, Mycobacterium tuberculosis H37Rv
ucaccggcgcccagcgccu

SEQ ID NO: 1357488 - RNA, 23 nt, Mycobacterium tuberculosis H37Rv
ucaccggguuggaagccgcaccg

SEQ ID NO: 1357489 - RNA, 14 nt, Mycobacterium tuberculosis H37Rv
ucaccggcugcuga

SEQ ID NO: 1357490 - RNA, 17 nt, Mycobacterium tuberculosis H37Rv
ucaccgacaccgugccg

SEQ ID NO: 1357491 - RNA, 16 nt, Mycobacterium tuberculosis H37Rv
ucaccgacgucgccaa

SEQ ID NO: 1357492 - RNA, 19 nt, Mycobacterium tuberculosis H37Rv
ucaccgacaugacgcggcc

SEQ ID NO: 1357493 - RNA, 22 nt, Mycobacterium tuberculosis H37Rv
ucaccgaucucgaccagcgccg

SEQ ID NO: 1357494 - RNA, 21 nt, Mycobacterium tuberculosis H37Rv
ucaccgcacaccugcgcggcg

SEQ ID NO: 1357495 - RNA, 19 nt, Mycobacterium tuberculosis H37Rv
ucaccgccaccaccagggc

SEQ ID NO: 1357496 - RNA, 13 nt, Mycobacterium tuberculosis H37Rv
ucaccgccaccac

SEQ ID NO: 1357497 - RNA, 14 nt, Mycobacterium tuberculosis H37Rv
ucaccccuucgcca

SEQ ID NO: 1357498 - RNA, 17 nt, Mycobacterium tuberculosis H37Rv
ucacccagcgccgaccc

SEQ ID NO: 1357499 - RNA, 16 nt, Mycobacterium tuberculosis H37Rv
ucaccucggugccggc

SEQ ID NO: 1357500 - RNA, 22 nt, Mycobacterium tuberculosis H37Rv
ucaccucggugccggccgcaca

SEQ ID NO: 1357501 - RNA, 15 nt, Mycobacterium tuberculosis H37Rv
ucaccucgccggcgg

SEQ ID NO: 1357502 - RNA, 19 nt, Mycobacterium tuberculosis H37Rv
ucaccucgucgacaaacca

SEQ ID NO: 1357503 - RNA, 18 nt, Mycobacterium tuberculosis H37Rv
ucaccuucgucgcggccg

SEQ ID NO: 1357504 - RNA, 21 nt, Mycobacterium tuberculosis H37Rv
ucaccuucggccgaccgggcu

SEQ ID NO: 1357505 - RNA, 20 nt, Mycobacterium tuberculosis H37Rv
ucaccuucaccgggugaccc

SEQ ID NO: 1357506 - RNA, 21 nt, Mycobacterium tuberculosis H37Rv
ucaccugacacgcccgcgagc

SEQ ID NO: 1357507 - RNA, 21 nt, Mycobacterium tuberculosis H37Rv
ucaccugcaucgucgccaagc

SEQ ID NO: 1357508 - RNA, 15 nt, Mycobacterium tuberculosis H37Rv
ucacgagcaaaccag

SEQ ID NO: 1357509 - RNA, 22 nt, Mycobacterium tuberculosis H37Rv
ucacgaccugcucauccaccuc

SEQ ID NO: 1357510 - RNA, 20 nt, Mycobacterium tuberculosis H37Rv
ucaccuugccuagccgcagc

SEQ ID NO: 1357511 - RNA, 18 nt, Mycobacterium tuberculosis H37Rv
ucacgguagcguucgucg

SEQ ID NO: 1357512 - RNA, 21 nt, Mycobacterium tuberculosis H37Rv
ucacgcuggccuccagcuugg

SEQ ID NO: 1357513 - RNA, 22 nt, Mycobacterium tuberculosis H37Rv
ucacggggcgugacagggcggc

SEQ ID NO: 1357514 - RNA, 18 nt, Mycobacterium tuberculosis H37Rv
ucacgggcuccaacaggu

SEQ ID NO: 1357515 - RNA, 17 nt, Mycobacterium tuberculosis H37Rv
ucacgcucacccggcgu

SEQ ID NO: 1357516 - RNA, 19 nt, Mycobacterium tuberculosis H37Rv
ucacgcguuccauggcccg

SEQ ID NO: 1357517 - RNA, 13 nt, Mycobacterium tuberculosis H37Rv
ucacgcgcggauc

SEQ ID NO: 1357518 - RNA, 19 nt, Mycobacterium tuberculosis H37Rv
ucacgcugaagccgcugga

SEQ ID NO: 1357519 - RNA, 18 nt, Mycobacterium tuberculosis H37Rv
ucacgcgaaugacgaucc

SEQ ID NO: 1357520 - RNA, 22 nt, Mycobacterium tuberculosis H37Rv
ucacgcagcacccugcgggccg

SEQ ID NO: 1357521 - RNA, 21 nt, Mycobacterium tuberculosis H37Rv
ucacgcagcacccugcgggcc

SEQ ID NO: 1357522 - RNA, 13 nt, Mycobacterium tuberculosis H37Rv
ucacgcacccggc

SEQ ID NO: 1357523 - RNA, 17 nt, Mycobacterium tuberculosis H37Rv
ucacucccccacacacc

SEQ ID NO: 1357524 - RNA, 19 nt, Mycobacterium tuberculosis H37Rv
ucacucggauagccccgug

SEQ ID NO: 1357525 - RNA, 13 nt, Mycobacterium tuberculosis H37Rv
ucacuccaugauc

SEQ ID NO: 1357526 - RNA, 16 nt, Mycobacterium tuberculosis H37Rv
ucacguaacgccgcgg

SEQ ID NO: 1357527 - RNA, 15 nt, Mycobacterium tuberculosis H37Rv
ucacguaauccucgc

SEQ ID NO: 1357528 - RNA, 16 nt, Mycobacterium tuberculosis H37Rv
ucacguaauuccccag

SEQ ID NO: 1357529 - RNA, 21 nt, Mycobacterium tuberculosis H37Rv
uccagcaacagcgagcgguug

SEQ ID NO: 1357530 - RNA, 22 nt, Mycobacterium tuberculosis H37Rv
uccagcaaggccagcacggcuu

SEQ ID NO: 1357531 - RNA, 18 nt, Mycobacterium tuberculosis H37Rv
uccagcaaggccagcacg

SEQ ID NO: 1357532 - RNA, 23 nt, Mycobacterium tuberculosis H37Rv
uccagcaccgggaagucgggguc

SEQ ID NO: 1357533 - RNA, 18 nt, Mycobacterium tuberculosis H37Rv
uccagcacgccguccagg

SEQ ID NO: 1357534 - RNA, 24 nt, Mycobacterium tuberculosis H37Rv
uccagcaccacggcgcgcgcgccg

SEQ ID NO: 1357535 - RNA, 18 nt, Mycobacterium tuberculosis H37Rv
uccagcaccagcacggca

SEQ ID NO: 1357536 - RNA, 13 nt, Mycobacterium tuberculosis H37Rv
uccagcagcgagu

SEQ ID NO: 1357537 - RNA, 18 nt, Mycobacterium tuberculosis H37Rv
uccagcagcgacgcugcc

SEQ ID NO: 1357538 - RNA, 19 nt, Mycobacterium tuberculosis H37Rv
uccagcagcgacgcugccg

SEQ ID NO: 1357539 - RNA, 17 nt, Mycobacterium tuberculosis H37Rv
uccagcagccaggagcc

SEQ ID NO: 1357540 - RNA, 12 nt, Mycobacterium tuberculosis H37Rv
uccagcacggcc

SEQ ID NO: 1357541 - RNA, 23 nt, Mycobacterium tuberculosis H37Rv
uccagcaggccgggacagcgccg

SEQ ID NO: 1357542 - RNA, 14 nt, Mycobacterium tuberculosis H37Rv
uccagcagcgccuc

SEQ ID NO: 1357543 - RNA, 19 nt, Mycobacterium tuberculosis H37Rv
uccagcaggacggugaagc

SEQ ID NO: 1357544 - RNA, 14 nt, Mycobacterium tuberculosis H37Rv
uccagcgugccugg

SEQ ID NO: 1357545 - RNA, 19 nt, Mycobacterium tuberculosis H37Rv
uccagcgauccggggcugg

SEQ ID NO: 1357546 - RNA, 21 nt, Mycobacterium tuberculosis H37Rv
uccagcgagcgcagcacguaa

SEQ ID NO: 1357547 - RNA, 23 nt, Mycobacterium tuberculosis H37Rv
uccagcccaugcgccacgccacu

SEQ ID NO: 1357548 - RNA, 12 nt, Mycobacterium tuberculosis H37Rv
uccagccaggcg

SEQ ID NO: 1357549 - RNA, 19 nt, Mycobacterium tuberculosis H37Rv
uccagccgggugccggcau

SEQ ID NO: 1357550 - RNA, 16 nt, Mycobacterium tuberculosis H37Rv
uccagccgguccagac

SEQ ID NO: 1357551 - RNA, 20 nt, Mycobacterium tuberculosis H37Rv
uccagccggcgcgccggaug

SEQ ID NO: 1357552 - RNA, 18 nt, Mycobacterium tuberculosis H37Rv
uccagccgcgcguccggg

SEQ ID NO: 1357553 - RNA, 18 nt, Mycobacterium tuberculosis H37Rv
uccagcucgcugcgcgcc

SEQ ID NO: 1357554 - RNA, 16 nt, Mycobacterium tuberculosis H37Rv
uccaggguggucgucg

SEQ ID NO: 1357555 - RNA, 22 nt, Mycobacterium tuberculosis H37Rv
uccagggagcggcugcacgccu

SEQ ID NO: 1357556 - RNA, 14 nt, Mycobacterium tuberculosis H37Rv
uccaggcugucgcg

SEQ ID NO: 1357557 - RNA, 20 nt, Mycobacterium tuberculosis H37Rv
uccagagacaugucgcugcc

SEQ ID NO: 1357558 - RNA, 22 nt, Mycobacterium tuberculosis H37Rv
uccagaaugucgcggguggcuu

SEQ ID NO: 1357559 - RNA, 22 nt, Mycobacterium tuberculosis H37Rv
uccagauaccaccgccgcugcc

SEQ ID NO: 1357560 - RNA, 17 nt, Mycobacterium tuberculosis H37Rv
uccagauaccaccgccg

SEQ ID NO: 1357561 - RNA, 16 nt, Mycobacterium tuberculosis H37Rv
uccagauaccaccgcc

SEQ ID NO: 1357562 - RNA, 17 nt, Mycobacterium tuberculosis H37Rv
uccaccgcgccgucguc

SEQ ID NO: 1357563 - RNA, 17 nt, Mycobacterium tuberculosis H37Rv
uccaccggaccgaccac

SEQ ID NO: 1357564 - RNA, 17 nt, Mycobacterium tuberculosis H37Rv
uccaccgguccagggcc

SEQ ID NO: 1357565 - RNA, 20 nt, Mycobacterium tuberculosis H37Rv
uccaccucggcguuggaaaa

SEQ ID NO: 1357566 - RNA, 20 nt, Mycobacterium tuberculosis H37Rv
uccacugggccugccagucc

SEQ ID NO: 1357567 - RNA, 19 nt, Mycobacterium tuberculosis H37Rv
uccacugacgucucaucaa

SEQ ID NO: 1357568 - RNA, 18 nt, Mycobacterium tuberculosis H37Rv
uccaaagggaguguuugg

SEQ ID NO: 1357569 - RNA, 14 nt, Mycobacterium tuberculosis H37Rv
uccaaaucgguggc

SEQ ID NO: 1357570 - RNA, 13 nt, Mycobacterium tuberculosis H37Rv
uccaccgccgaca

SEQ ID NO: 1357571 - RNA, 21 nt, Mycobacterium tuberculosis H37Rv
uccaccgcggcgucgccgugc

SEQ ID NO: 1357572 - RNA, 21 nt, Mycobacterium tuberculosis H37Rv
uccaccgcagauccccgccac

SEQ ID NO: 1357573 - RNA, 19 nt, Mycobacterium tuberculosis H37Rv
uccaccgacguggccagcc

SEQ ID NO: 1357574 - RNA, 22 nt, Mycobacterium tuberculosis H37Rv
uccaccgacguggccagcccgc

SEQ ID NO: 1357575 - RNA, 16 nt, Mycobacterium tuberculosis H37Rv
uccaccgaccuaccgu

SEQ ID NO: 1357576 - RNA, 20 nt, Mycobacterium tuberculosis H37Rv
uccaccacgcuggccucguc

SEQ ID NO: 1357577 - RNA, 15 nt, Mycobacterium tuberculosis H37Rv
uccaccaccuggccg

SEQ ID NO: 1357578 - RNA, 19 nt, Mycobacterium tuberculosis H37Rv
uccaccacgucgggaugcc

SEQ ID NO: 1357579 - RNA, 16 nt, Mycobacterium tuberculosis H37Rv
uccaccacgcaaaagu

SEQ ID NO: 1357580 - RNA, 14 nt, Mycobacterium tuberculosis H37Rv
uccacccgccggcc

SEQ ID NO: 1357581 - RNA, 16 nt, Mycobacterium tuberculosis H37Rv
uccacaucggcucuga

SEQ ID NO: 1357582 - RNA, 14 nt, Mycobacterium tuberculosis H37Rv
ucaugggaucaggc

SEQ ID NO: 1357583 - RNA, 18 nt, Mycobacterium tuberculosis H37Rv
ucaugguggggaccgcga

SEQ ID NO: 1357584 - RNA, 17 nt, Mycobacterium tuberculosis H37Rv
ucauguccugggccgcc

SEQ ID NO: 1357585 - RNA, 23 nt, Mycobacterium tuberculosis H37Rv
ucauucgugggaaccaccagcac

SEQ ID NO: 1357586 - RNA, 22 nt, Mycobacterium tuberculosis H37Rv
ucauggccggucugcugggcac

SEQ ID NO: 1357587 - RNA, 16 nt, Mycobacterium tuberculosis H37Rv
ucaugcgauucugcgu

SEQ ID NO: 1357588 - RNA, 18 nt, Mycobacterium tuberculosis H37Rv
ucaugcccuuguaggcca

SEQ ID NO: 1357589 - RNA, 21 nt, Mycobacterium tuberculosis H37Rv
ucaugccauagaugcccgcga

SEQ ID NO: 1357590 - RNA, 22 nt, Mycobacterium tuberculosis H37Rv
ucaugcagggaauagcggcgcc

SEQ ID NO: 1357591 - RNA, 17 nt, Mycobacterium tuberculosis H37Rv
ucaugcaaaagccgcga

SEQ ID NO: 1357592 - RNA, 13 nt, Mycobacterium tuberculosis H37Rv
ucaucguggggau

SEQ ID NO: 1357593 - RNA, 21 nt, Mycobacterium tuberculosis H37Rv
ucaucucggugguggccauga

SEQ ID NO: 1357594 - RNA, 16 nt, Mycobacterium tuberculosis H37Rv
ucaucucgguggacgg

SEQ ID NO: 1357595 - RNA, 22 nt, Mycobacterium tuberculosis H37Rv
ucaucucgguggacggcaggcg

SEQ ID NO: 1357596 - RNA, 20 nt, Mycobacterium tuberculosis H37Rv
ucaucucggugguggccaug

SEQ ID NO: 1357597 - RNA, 22 nt, Mycobacterium tuberculosis H37Rv
ucauagaaauacaggcccggca

SEQ ID NO: 1357598 - RNA, 17 nt, Mycobacterium tuberculosis H37Rv
ucauagacagggccgcu

SEQ ID NO: 1357599 - RNA, 14 nt, Mycobacterium tuberculosis H37Rv
ucaucaacgacacc

SEQ ID NO: 1357600 - RNA, 21 nt, Mycobacterium tuberculosis H37Rv
ucaucaccucuccguccucgu

SEQ ID NO: 1357601 - RNA, 16 nt, Mycobacterium tuberculosis H37Rv
ucaucaccucucgcuu

SEQ ID NO: 1357602 - RNA, 13 nt, Mycobacterium tuberculosis H37Rv
ucaucacccagcg

SEQ ID NO: 1357603 - RNA, 19 nt, Mycobacterium tuberculosis H37Rv
ucauauccgccccagcugc

SEQ ID NO: 1357604 - RNA, 20 nt, Mycobacterium tuberculosis H37Rv
ucauaucucgagcccucguu

SEQ ID NO: 1357605 - RNA, 20 nt, Mycobacterium tuberculosis H37Rv
ucaucgacgccugcggcggu

SEQ ID NO: 1357606 - RNA, 17 nt, Mycobacterium tuberculosis H37Rv
ucaucgacguuccagca

SEQ ID NO: 1357607 - RNA, 20 nt, Mycobacterium tuberculosis H37Rv
ucaucgagucgaagaaccug

SEQ ID NO: 1357608 - RNA, 15 nt, Mycobacterium tuberculosis H37Rv
ucaucgcagucaugu

SEQ ID NO: 1357609 - RNA, 13 nt, Mycobacterium tuberculosis H37Rv
ucaucgccagcgg

SEQ ID NO: 1357610 - RNA, 19 nt, Mycobacterium tuberculosis H37Rv
ucaucgcggucgccaccgu

SEQ ID NO: 1357611 - RNA, 15 nt, Mycobacterium tuberculosis H37Rv
ucaucgcgcacgccc

SEQ ID NO: 1357612 - RNA, 20 nt, Mycobacterium tuberculosis H37Rv
ucaucccgauguaccccagc

SEQ ID NO: 1357613 - RNA, 18 nt, Mycobacterium tuberculosis H37Rv
ucaucccgagaucaccuu

SEQ ID NO: 1357614 - RNA, 18 nt, Mycobacterium tuberculosis H37Rv
ucauccgggcgaccacca

SEQ ID NO: 1357615 - RNA, 13 nt, Mycobacterium tuberculosis H37Rv
ucaucgaagcuuc

SEQ ID NO: 1357616 - RNA, 15 nt, Mycobacterium tuberculosis H37Rv
ucaucauccacaccg

SEQ ID NO: 1357617 - RNA, 19 nt, Mycobacterium tuberculosis H37Rv
ucaucacuaaccuggcgua

SEQ ID NO: 1357618 - RNA, 15 nt, Mycobacterium tuberculosis H37Rv
ucaucauggccggau

SEQ ID NO: 1357619 - RNA, 20 nt, Mycobacterium tuberculosis H37Rv
ucauccacuccgccaacauc

SEQ ID NO: 1357620 - RNA, 20 nt, Mycobacterium tuberculosis H37Rv
ucaguucccgaaccccgacc

SEQ ID NO: 1357621 - RNA, 22 nt, Mycobacterium tuberculosis H37Rv
ucaguucccgcuugaucugggc

SEQ ID NO: 1357622 - RNA, 22 nt, Mycobacterium tuberculosis H37Rv
ucaguucggccgucauggcccg

SEQ ID NO: 1357623 - RNA, 20 nt, Mycobacterium tuberculosis H37Rv
ucauaaaugggugugcugcc

SEQ ID NO: 1357624 - RNA, 20 nt, Mycobacterium tuberculosis H37Rv
ucaggaucccgguggcagca

SEQ ID NO: 1357625 - RNA, 21 nt, Mycobacterium tuberculosis H37Rv
ucaggaucccgguggcagcac

SEQ ID NO: 1357626 - RNA, 21 nt, Mycobacterium tuberculosis H37Rv
ucaggcaacgaagagggcgcc

SEQ ID NO: 1357627 - RNA, 21 nt, Mycobacterium tuberculosis H37Rv
ucagggcgcaaaccacccgca

SEQ ID NO: 1357628 - RNA, 22 nt, Mycobacterium tuberculosis H37Rv
ucagggguggcgcgggccggcg

SEQ ID NO: 1357629 - RNA, 15 nt, Mycobacterium tuberculosis H37Rv
ucaggugcgcgacca

SEQ ID NO: 1357630 - RNA, 22 nt, Mycobacterium tuberculosis H37Rv
ucagcgaaccaccggcgccgcc

SEQ ID NO: 1357631 - RNA, 22 nt, Mycobacterium tuberculosis H37Rv
ucagcgaagccgggucucggug

SEQ ID NO: 1357632 - RNA, 13 nt, Mycobacterium tuberculosis H37Rv
ucagcgauccucg

SEQ ID NO: 1357633 - RNA, 14 nt, Mycobacterium tuberculosis H37Rv
ucagcgauccucgc

SEQ ID NO: 1357634 - RNA, 14 nt, Mycobacterium tuberculosis H37Rv
ucagccgcgccggg

SEQ ID NO: 1357635 - RNA, 16 nt, Mycobacterium tuberculosis H37Rv
ucagccgugcgggccg

SEQ ID NO: 1357636 - RNA, 12 nt, Mycobacterium tuberculosis H37Rv
ucagccguggca

SEQ ID NO: 1357637 - RNA, 13 nt, Mycobacterium tuberculosis H37Rv
ucagccaggccag

SEQ ID NO: 1357638 - RNA, 13 nt, Mycobacterium tuberculosis H37Rv
ucagccgcgcgcc

SEQ ID NO: 1357639 - RNA, 19 nt, Mycobacterium tuberculosis H37Rv
ucagccgcgcgggucacga

SEQ ID NO: 1357640 - RNA, 23 nt, Mycobacterium tuberculosis H37Rv
ucagccgcgcgggucacgaccug

SEQ ID NO: 1357641 - RNA, 19 nt, Mycobacterium tuberculosis H37Rv
ucagccguccgggcggccu

SEQ ID NO: 1357642 - RNA, 18 nt, Mycobacterium tuberculosis H37Rv
ucagccgugccgugguga

SEQ ID NO: 1357643 - RNA, 22 nt, Mycobacterium tuberculosis H37Rv
ucagccggcggcuggucucugg

SEQ ID NO: 1357644 - RNA, 21 nt, Mycobacterium tuberculosis H37Rv
ucacuguugcccuugggacug

SEQ ID NO: 1357645 - RNA, 15 nt, Mycobacterium tuberculosis H37Rv
ucacuguuccgggug

SEQ ID NO: 1357646 - RNA, 12 nt, Mycobacterium tuberculosis H37Rv
ucagccaggugu

SEQ ID NO: 1357647 - RNA, 18 nt, Mycobacterium tuberculosis H37Rv
ucacucguugaccggccg

SEQ ID NO: 1357648 - RNA, 18 nt, Mycobacterium tuberculosis H37Rv
ucagcucaccacccagau

SEQ ID NO: 1357649 - RNA, 13 nt, Mycobacterium tuberculosis H37Rv
ucagcuggccgcg

SEQ ID NO: 1357650 - RNA, 15 nt, Mycobacterium tuberculosis H37Rv
ucagcugcucgucuu

SEQ ID NO: 1357651 - RNA, 12 nt, Mycobacterium tuberculosis H37Rv
ucagcugcugcc

SEQ ID NO: 1357652 - RNA, 13 nt, Mycobacterium tuberculosis H37Rv
ucagcgugucgcc

SEQ ID NO: 1357653 - RNA, 19 nt, Mycobacterium tuberculosis H37Rv
ucagcgcguagccaaugcc

SEQ ID NO: 1357654 - RNA, 12 nt, Mycobacterium tuberculosis H37Rv
ucagcgcgcugc

SEQ ID NO: 1357655 - RNA, 15 nt, Mycobacterium tuberculosis H37Rv
ucagcgcggcgucua

SEQ ID NO: 1357656 - RNA, 22 nt, Mycobacterium tuberculosis H37Rv
ucagcgcggcgucuagcccgcc

SEQ ID NO: 1357657 - RNA, 19 nt, Mycobacterium tuberculosis H37Rv
ucagcgcggcgcccuggcc

SEQ ID NO: 1357658 - RNA, 21 nt, Mycobacterium tuberculosis H37Rv
ucagcgcgcgccgcuggguga

SEQ ID NO: 1357659 - RNA, 17 nt, Mycobacterium tuberculosis H37Rv
ucagcgccgcgcgcgcc

SEQ ID NO: 1357660 - RNA, 21 nt, Mycobacterium tuberculosis H37Rv
ucagcgccgcgccccagacgc

SEQ ID NO: 1357661 - RNA, 22 nt, Mycobacterium tuberculosis H37Rv
ucagcuuggacccugcgccgcc

SEQ ID NO: 1357662 - RNA, 17 nt, Mycobacterium tuberculosis H37Rv
uaggcgaaauagcccaa

SEQ ID NO: 1357663 - RNA, 15 nt, Mycobacterium tuberculosis H37Rv
uaggcccggucuugg

SEQ ID NO: 1357664 - RNA, 14 nt, Mycobacterium tuberculosis H37Rv
uaggccgcgcggcg

SEQ ID NO: 1357665 - RNA, 22 nt, Mycobacterium tuberculosis H37Rv
uaggccgcgcggcggcgccggc

SEQ ID NO: 1357666 - RNA, 16 nt, Mycobacterium tuberculosis H37Rv
uaggcaugccacacac

SEQ ID NO: 1357667 - RNA, 12 nt, Mycobacterium tuberculosis H37Rv
uaggccagcccg

SEQ ID NO: 1357668 - RNA, 20 nt, Mycobacterium tuberculosis H37Rv
uaggccccgccagcgccggu

SEQ ID NO: 1357669 - RNA, 22 nt, Mycobacterium tuberculosis H37Rv
uagggcugaccgaagaagcccg

SEQ ID NO: 1357670 - RNA, 11 nt, Mycobacterium tuberculosis H37Rv
uagggccgcgu

SEQ ID NO: 1357671 - RNA, 17 nt, Mycobacterium tuberculosis H37Rv
uaggcuugcaaggucgc

SEQ ID NO: 1357672 - RNA, 14 nt, Mycobacterium tuberculosis H37Rv
uaggcucccacucc

SEQ ID NO: 1357673 - RNA, 23 nt, Mycobacterium tuberculosis H37Rv
uaggcggccaugucagcggccug

SEQ ID NO: 1357674 - RNA, 20 nt, Mycobacterium tuberculosis H37Rv
uagggcuguccgaccucgcc

SEQ ID NO: 1357675 - RNA, 13 nt, Mycobacterium tuberculosis H37Rv
uagggggcaaggc

SEQ ID NO: 1357676 - RNA, 19 nt, Mycobacterium tuberculosis H37Rv
uagggugaguuccaugugc

SEQ ID NO: 1357677 - RNA, 13 nt, Mycobacterium tuberculosis H37Rv
uaguguguuuggu

SEQ ID NO: 1357678 - RNA, 21 nt, Mycobacterium tuberculosis H37Rv
uaguucaccaacgcgggaacg

SEQ ID NO: 1357679 - RNA, 23 nt, Mycobacterium tuberculosis H37Rv
uaguucagccaggccgcaaugcg

SEQ ID NO: 1357680 - RNA, 14 nt, Mycobacterium tuberculosis H37Rv
uaguuaacccaggg

SEQ ID NO: 1357681 - RNA, 16 nt, Mycobacterium tuberculosis H37Rv
uaguccgcauccgcga

SEQ ID NO: 1357682 - RNA, 22 nt, Mycobacterium tuberculosis H37Rv
uaguccggcacugcggccaguc

SEQ ID NO: 1357683 - RNA, 13 nt, Mycobacterium tuberculosis H37Rv
uagugcaggugcc

SEQ ID NO: 1357684 - RNA, 20 nt, Mycobacterium tuberculosis H37Rv
uagugcaaugguucgugcac

SEQ ID NO: 1357685 - RNA, 18 nt, Mycobacterium tuberculosis H37Rv
uagugcaucggcagcccc

SEQ ID NO: 1357686 - RNA, 20 nt, Mycobacterium tuberculosis H37Rv
uauccacggucgaccaggac

SEQ ID NO: 1357687 - RNA, 23 nt, Mycobacterium tuberculosis H37Rv
uauagccgguugucgcagcgcac

SEQ ID NO: 1357688 - RNA, 14 nt, Mycobacterium tuberculosis H37Rv
uagcgacagcagcg

SEQ ID NO: 1357689 - RNA, 19 nt, Mycobacterium tuberculosis H37Rv
uagcgaaugaucuugccac

SEQ ID NO: 1357690 - RNA, 15 nt, Mycobacterium tuberculosis H37Rv
uagccugguguacca

SEQ ID NO: 1357691 - RNA, 22 nt, Mycobacterium tuberculosis H37Rv
uagcgccaagccgugccgcaca

SEQ ID NO: 1357692 - RNA, 15 nt, Mycobacterium tuberculosis H37Rv
uagcgcaccaccguc

SEQ ID NO: 1357693 - RNA, 13 nt, Mycobacterium tuberculosis H37Rv
uagcgcacugccg

SEQ ID NO: 1357694 - RNA, 14 nt, Mycobacterium tuberculosis H37Rv
uagcggcucaccgc

SEQ ID NO: 1357695 - RNA, 19 nt, Mycobacterium tuberculosis H37Rv
uagcggaucgcggucagcg

SEQ ID NO: 1357696 - RNA, 19 nt, Mycobacterium tuberculosis H37Rv
uagcgguuuagccgcuugg

SEQ ID NO: 1357697 - RNA, 17 nt, Mycobacterium tuberculosis H37Rv
uagcggugugggaugag

SEQ ID NO: 1357698 - RNA, 13 nt, Mycobacterium tuberculosis H37Rv
uagcgcggccagc

SEQ ID NO: 1357699 - RNA, 19 nt, Mycobacterium tuberculosis H37Rv
uagcgcgaaagcgccgaaa

SEQ ID NO: 1357700 - RNA, 12 nt, Mycobacterium tuberculosis H37Rv
uagcccugcuca

SEQ ID NO: 1357701 - RNA, 19 nt, Mycobacterium tuberculosis H37Rv
uagccgccgaagggugagc

SEQ ID NO: 1357702 - RNA, 17 nt, Mycobacterium tuberculosis H37Rv
uagccgcugccuggccg

SEQ ID NO: 1357703 - RNA, 15 nt, Mycobacterium tuberculosis H37Rv
uagccggguugccug

SEQ ID NO: 1357704 - RNA, 21 nt, Mycobacterium tuberculosis H37Rv
uagccgcuugggccugggccg

SEQ ID NO: 1357705 - RNA, 22 nt, Mycobacterium tuberculosis H37Rv
uagccguugccgccgaacagcu

SEQ ID NO: 1357706 - RNA, 18 nt, Mycobacterium tuberculosis H37Rv
uagccguugccgccgaac

SEQ ID NO: 1357707 - RNA, 19 nt, Mycobacterium tuberculosis H37Rv
uagccgugacaaggugcgc

SEQ ID NO: 1357708 - RNA, 16 nt, Mycobacterium tuberculosis H37Rv
uagccaccaagcacaa

SEQ ID NO: 1357709 - RNA, 14 nt, Mycobacterium tuberculosis H37Rv
uagccacgcccaca

SEQ ID NO: 1357710 - RNA, 22 nt, Mycobacterium tuberculosis H37Rv
uagccaugggauucggccagac

SEQ ID NO: 1357711 - RNA, 16 nt, Mycobacterium tuberculosis H37Rv
uagcccuccgagcaca

SEQ ID NO: 1357712 - RNA, 20 nt, Mycobacterium tuberculosis H37Rv
uagcccgauggugccgaccc

SEQ ID NO: 1357713 - RNA, 23 nt, Mycobacterium tuberculosis H37Rv
uagccauucgguguggccguggg

SEQ ID NO: 1357714 - RNA, 20 nt, Mycobacterium tuberculosis H37Rv
uagccauucgguguggccgu

SEQ ID NO: 1357715 - RNA, 13 nt, Mycobacterium tuberculosis H37Rv
uagcccacccggg

SEQ ID NO: 1357716 - RNA, 22 nt, Mycobacterium tuberculosis H37Rv
uagcugcggucgaacaucaucg

SEQ ID NO: 1357717 - RNA, 13 nt, Mycobacterium tuberculosis H37Rv
uagcuguggcccg

SEQ ID NO: 1357718 - RNA, 14 nt, Mycobacterium tuberculosis H37Rv
uagcuguuggccag

SEQ ID NO: 1357719 - RNA, 13 nt, Mycobacterium tuberculosis H37Rv
uagcuuagcugcc

SEQ ID NO: 1357720 - RNA, 22 nt, Mycobacterium tuberculosis H37Rv
uagcugcgcagcgcaaacaucu

SEQ ID NO: 1357721 - RNA, 12 nt, Mycobacterium tuberculosis H37Rv
uagcugccggcc

SEQ ID NO: 1357722 - RNA, 19 nt, Mycobacterium tuberculosis H37Rv
uagcucgcugaccuuguug

SEQ ID NO: 1357723 - RNA, 23 nt, Mycobacterium tuberculosis H37Rv
uagcucgucgaggaagaucaccu

SEQ ID NO: 1357724 - RNA, 18 nt, Mycobacterium tuberculosis H37Rv
uagcucgguaggccggca

SEQ ID NO: 1357725 - RNA, 19 nt, Mycobacterium tuberculosis H37Rv
uagcgucgucccagcgcgg

SEQ ID NO: 1357726 - RNA, 20 nt, Mycobacterium tuberculosis H37Rv
uagcguccgagcguaaugcu

SEQ ID NO: 1357727 - RNA, 18 nt, Mycobacterium tuberculosis H37Rv
uagcucacgguggccgca

SEQ ID NO: 1357728 - RNA, 22 nt, Mycobacterium tuberculosis H37Rv
uagcucaggguguucacguuca

SEQ ID NO: 1357729 - RNA, 22 nt, Mycobacterium tuberculosis H37Rv
uaggaccaccagcgcuccagca

SEQ ID NO: 1357730 - RNA, 16 nt, Mycobacterium tuberculosis H37Rv
uaggaccaccagcgcu

SEQ ID NO: 1357731 - RNA, 14 nt, Mycobacterium tuberculosis H37Rv
uaggaccaccagcg

SEQ ID NO: 1357732 - RNA, 15 nt, Mycobacterium tuberculosis H37Rv
uaggagaucagcacc

SEQ ID NO: 1357733 - RNA, 22 nt, Mycobacterium tuberculosis H37Rv
uaggcaaccuuuggccgcugug

SEQ ID NO: 1357734 - RNA, 21 nt, Mycobacterium tuberculosis H37Rv
uaggaucggauggcggccaca

SEQ ID NO: 1357735 - RNA, 13 nt, Mycobacterium tuberculosis H37Rv
uagcaugaggccc

SEQ ID NO: 1357736 - RNA, 13 nt, Mycobacterium tuberculosis H37Rv
uagcagcacccgg

SEQ ID NO: 1357737 - RNA, 12 nt, Mycobacterium tuberculosis H37Rv
uagcagcgcugc

SEQ ID NO: 1357738 - RNA, 13 nt, Mycobacterium tuberculosis H37Rv
uagcagccgcuga

SEQ ID NO: 1357739 - RNA, 17 nt, Mycobacterium tuberculosis H37Rv
uagcagcgccagcagcu

SEQ ID NO: 1357740 - RNA, 15 nt, Mycobacterium tuberculosis H37Rv
uagcagcgcggcuug

SEQ ID NO: 1357741 - RNA, 20 nt, Mycobacterium tuberculosis H37Rv
uagcagcgcggcuuggccaa

SEQ ID NO: 1357742 - RNA, 21 nt, Mycobacterium tuberculosis H37Rv
uagcagggugccggcgccgcc

SEQ ID NO: 1357743 - RNA, 17 nt, Mycobacterium tuberculosis H37Rv
uagcagguguaggugcc

SEQ ID NO: 1357744 - RNA, 15 nt, Mycobacterium tuberculosis H37Rv
uagcaaagccagcgc

SEQ ID NO: 1357745 - RNA, 20 nt, Mycobacterium tuberculosis H37Rv
uagcaaucggcaggauuccc

SEQ ID NO: 1357746 - RNA, 15 nt, Mycobacterium tuberculosis H37Rv
uagcaauccgcacag

SEQ ID NO: 1357747 - RNA, 12 nt, Mycobacterium tuberculosis H37Rv
uagcaccacauc

SEQ ID NO: 1357748 - RNA, 15 nt, Mycobacterium tuberculosis H37Rv
uagcaccacaucggu

SEQ ID NO: 1357749 - RNA, 16 nt, Mycobacterium tuberculosis H37Rv
uagcaccgcgccgaac

SEQ ID NO: 1357750 - RNA, 21 nt, Mycobacterium tuberculosis H37Rv
uagcaccgcgccgaacacgca

SEQ ID NO: 1357751 - RNA, 22 nt, Mycobacterium tuberculosis H37Rv
uagcacggcgauccccgacguc

SEQ ID NO: 1357752 - RNA, 14 nt, Mycobacterium tuberculosis H37Rv
uagaucugggcugg

SEQ ID NO: 1357753 - RNA, 16 nt, Mycobacterium tuberculosis H37Rv
uagaucaucuggcugg

SEQ ID NO: 1357754 - RNA, 18 nt, Mycobacterium tuberculosis H37Rv
uagaucaagaucugcuug

SEQ ID NO: 1357755 - RNA, 17 nt, Mycobacterium tuberculosis H37Rv
uagauggugguggcccg

SEQ ID NO: 1357756 - RNA, 16 nt, Mycobacterium tuberculosis H37Rv
uagaugacgggcucgu

SEQ ID NO: 1357757 - RNA, 13 nt, Mycobacterium tuberculosis H37Rv
uagagcagcagcg

SEQ ID NO: 1357758 - RNA, 19 nt, Mycobacterium tuberculosis H37Rv
uagaggacugcggucugga

SEQ ID NO: 1357759 - RNA, 18 nt, Mycobacterium tuberculosis H37Rv
uaccgcccgcgccaccgg

SEQ ID NO: 1357760 - RNA, 16 nt, Mycobacterium tuberculosis H37Rv
uaccgcgcguugaagu

SEQ ID NO: 1357761 - RNA, 18 nt, Mycobacterium tuberculosis H37Rv
uaccgccggccccaccgg

SEQ ID NO: 1357762 - RNA, 16 nt, Mycobacterium tuberculosis H37Rv
uaccgccgcgcagccg

SEQ ID NO: 1357763 - RNA, 14 nt, Mycobacterium tuberculosis H37Rv
uaccgccagcgcca

SEQ ID NO: 1357764 - RNA, 19 nt, Mycobacterium tuberculosis H37Rv
uaccgccggcuccgccguu

SEQ ID NO: 1357765 - RNA, 20 nt, Mycobacterium tuberculosis H37Rv
uaccaccgucuccggcgcca

SEQ ID NO: 1357766 - RNA, 20 nt, Mycobacterium tuberculosis H37Rv
uaccaccgucaccgccggca

SEQ ID NO: 1357767 - RNA, 16 nt, Mycobacterium tuberculosis H37Rv
uaccggcuggccaggu

SEQ ID NO: 1357768 - RNA, 15 nt, Mycobacterium tuberculosis H37Rv
uaccgggaucccacg

SEQ ID NO: 1357769 - RNA, 21 nt, Mycobacterium tuberculosis H37Rv
uaccggcgaucugcugugucg

SEQ ID NO: 1357770 - RNA, 19 nt, Mycobacterium tuberculosis H37Rv
uaccggcgcauaccggcgu

SEQ ID NO: 1357771 - RNA, 20 nt, Mycobacterium tuberculosis H37Rv
uaccggcgccgcgcggcuug

SEQ ID NO: 1357772 - RNA, 13 nt, Mycobacterium tuberculosis H37Rv
uaccggcggcgcc

SEQ ID NO: 1357773 - RNA, 16 nt, Mycobacterium tuberculosis H37Rv
uaccgguccagugugu

SEQ ID NO: 1357774 - RNA, 12 nt, Mycobacterium tuberculosis H37Rv
uaccucaccgaa

SEQ ID NO: 1357775 - RNA, 16 nt, Mycobacterium tuberculosis H37Rv
uacgaacucaccgcca

SEQ ID NO: 1357776 - RNA, 13 nt, Mycobacterium tuberculosis H37Rv
uacgggugaucuu

SEQ ID NO: 1357777 - RNA, 21 nt, Mycobacterium tuberculosis H37Rv
uacggugguaagacgccgaac

SEQ ID NO: 1357778 - RNA, 18 nt, Mycobacterium tuberculosis H37Rv
uagaccgcagucgcuggg

SEQ ID NO: 1357779 - RNA, 17 nt, Mycobacterium tuberculosis H37Rv
uagacaggaccgguggg

SEQ ID NO: 1357780 - RNA, 18 nt, Mycobacterium tuberculosis H37Rv
uagacauuggcuccgaac

SEQ ID NO: 1357781 - RNA, 15 nt, Mycobacterium tuberculosis H37Rv
uagacuugcugcucc

SEQ ID NO: 1357782 - RNA, 13 nt, Mycobacterium tuberculosis H37Rv
uagacgugcacca

SEQ ID NO: 1357783 - RNA, 20 nt, Mycobacterium tuberculosis H37Rv
uagacuagccgauccagcag

SEQ ID NO: 1357784 - RNA, 21 nt, Mycobacterium tuberculosis H37Rv
uagaccuuggugcccagcagg

SEQ ID NO: 1357785 - RNA, 15 nt, Mycobacterium tuberculosis H37Rv
uacuuggcuuccgga

SEQ ID NO: 1357786 - RNA, 16 nt, Mycobacterium tuberculosis H37Rv
uacuucgcuggaaacc

SEQ ID NO: 1357787 - RNA, 19 nt, Mycobacterium tuberculosis H37Rv
uacuggcguugccaccgga

SEQ ID NO: 1357788 - RNA, 17 nt, Mycobacterium tuberculosis H37Rv
uacuggcucucgggcgc

SEQ ID NO: 1357789 - RNA, 21 nt, Mycobacterium tuberculosis H37Rv
uacuccgacggcccggugagc

SEQ ID NO: 1357790 - RNA, 15 nt, Mycobacterium tuberculosis H37Rv
uaauuggcaacacag

SEQ ID NO: 1357791 - RNA, 23 nt, Mycobacterium tuberculosis H37Rv
uacaggcccgccagcagggccag

SEQ ID NO: 1357792 - RNA, 19 nt, Mycobacterium tuberculosis H37Rv
uacaggaagucgcggacgu

SEQ ID NO: 1357793 - RNA, 19 nt, Mycobacterium tuberculosis H37Rv
uacagcucggugcacggcg

SEQ ID NO: 1357794 - RNA, 14 nt, Mycobacterium tuberculosis H37Rv
uacagcgggauccc

SEQ ID NO: 1357795 - RNA, 22 nt, Mycobacterium tuberculosis H37Rv
uacagcgggaucccgaucguga

SEQ ID NO: 1357796 - RNA, 16 nt, Mycobacterium tuberculosis H37Rv
uacagcgccuggguga

SEQ ID NO: 1357797 - RNA, 16 nt, Mycobacterium tuberculosis H37Rv
uacagcacauccagcc

SEQ ID NO: 1357798 - RNA, 16 nt, Mycobacterium tuberculosis H37Rv
uacaugucacacccac

SEQ ID NO: 1357799 - RNA, 15 nt, Mycobacterium tuberculosis H37Rv
uacaccgcccggccc

SEQ ID NO: 1357800 - RNA, 14 nt, Mycobacterium tuberculosis H37Rv
uacacuuugcccgc

SEQ ID NO: 1357801 - RNA, 13 nt, Mycobacterium tuberculosis H37Rv
gugccguggugaa

SEQ ID NO: 1357802 - RNA, 17 nt, Mycobacterium tuberculosis H37Rv
gugccgucggugccgcg

SEQ ID NO: 1357803 - RNA, 13 nt, Mycobacterium tuberculosis H37Rv
gugccguggugga

SEQ ID NO: 1357804 - RNA, 18 nt, Mycobacterium tuberculosis H37Rv
gugccguguccagcaugc

SEQ ID NO: 1357805 - RNA, 22 nt, Mycobacterium tuberculosis H37Rv
gugccucgcguucgcugguccu

SEQ ID NO: 1357806 - RNA, 21 nt, Mycobacterium tuberculosis H37Rv
gugccucggcgaugggccggu

SEQ ID NO: 1357807 - RNA, 16 nt, Mycobacterium tuberculosis H37Rv
gugccugcggguggau

SEQ ID NO: 1357808 - RNA, 20 nt, Mycobacterium tuberculosis H37Rv
gugcgacaacacgaccucuu

SEQ ID NO: 1357809 - RNA, 16 nt, Mycobacterium tuberculosis H37Rv
gugccuggccggugcg

SEQ ID NO: 1357810 - RNA, 22 nt, Mycobacterium tuberculosis H37Rv
gugccuggccggugcgcaggua

SEQ ID NO: 1357811 - RNA, 21 nt, Mycobacterium tuberculosis H37Rv
gugccugucagaaggaucagc

SEQ ID NO: 1357812 - RNA, 22 nt, Mycobacterium tuberculosis H37Rv
gugccgccugcgccgccagcgc

SEQ ID NO: 1357813 - RNA, 15 nt, Mycobacterium tuberculosis H37Rv
gugccgccggccagu

SEQ ID NO: 1357814 - RNA, 14 nt, Mycobacterium tuberculosis H37Rv
gugccgcgcagcug

SEQ ID NO: 1357815 - RNA, 17 nt, Mycobacterium tuberculosis H37Rv
gugccgcggccaccgcc

SEQ ID NO: 1357816 - RNA, 13 nt, Mycobacterium tuberculosis H37Rv
gugccgcggccac

SEQ ID NO: 1357817 - RNA, 17 nt, Mycobacterium tuberculosis H37Rv
gugccgcccgcgccucc

SEQ ID NO: 1357818 - RNA, 17 nt, Mycobacterium tuberculosis H37Rv
gugccgcccucaccgcc

SEQ ID NO: 1357819 - RNA, 16 nt, Mycobacterium tuberculosis H37Rv
gugccgcccaggagca

SEQ ID NO: 1357820 - RNA, 20 nt, Mycobacterium tuberculosis H37Rv
gugccgcccgccucugucuu

SEQ ID NO: 1357821 - RNA, 16 nt, Mycobacterium tuberculosis H37Rv
gugccgccgcggccac

SEQ ID NO: 1357822 - RNA, 11 nt, Mycobacterium tuberculosis H37Rv
gugccgcccag

SEQ ID NO: 1357823 - RNA, 20 nt, Mycobacterium tuberculosis H37Rv
gugccgcccaccacacagcc

SEQ ID NO: 1357824 - RNA, 18 nt, Mycobacterium tuberculosis H37Rv
gugccgauuggccugcca

SEQ ID NO: 1357825 - RNA, 14 nt, Mycobacterium tuberculosis H37Rv
gugccgccagcaac

SEQ ID NO: 1357826 - RNA, 20 nt, Mycobacterium tuberculosis H37Rv
gugccggcgguguuggcgcc

SEQ ID NO: 1357827 - RNA, 16 nt, Mycobacterium tuberculosis H37Rv
gugccggcccugcucg

SEQ ID NO: 1357828 - RNA, 20 nt, Mycobacterium tuberculosis H37Rv
gugccggccgcacaugagcu

SEQ ID NO: 1357829 - RNA, 22 nt, Mycobacterium tuberculosis H37Rv
gugccgggccauucaccgcgca

SEQ ID NO: 1357830 - RNA, 16 nt, Mycobacterium tuberculosis H37Rv
gugccggcgccgcccu

SEQ ID NO: 1357831 - RNA, 22 nt, Mycobacterium tuberculosis H37Rv
gugccgucggcgugcagcagcu

SEQ ID NO: 1357832 - RNA, 21 nt, Mycobacterium tuberculosis H37Rv
gugccgucggcgugcagcagc

SEQ ID NO: 1357833 - RNA, 18 nt, Mycobacterium tuberculosis H37Rv
gugccgucggcgugcagc

SEQ ID NO: 1357834 - RNA, 17 nt, Mycobacterium tuberculosis H37Rv
gugccggugcuccucgg

SEQ ID NO: 1357835 - RNA, 19 nt, Mycobacterium tuberculosis H37Rv
gugccgggcgaugcugggc

SEQ ID NO: 1357836 - RNA, 22 nt, Mycobacterium tuberculosis H37Rv
gugccggggccccaugccgacc

SEQ ID NO: 1357837 - RNA, 20 nt, Mycobacterium tuberculosis H37Rv
gugccggucaccucgccggc

SEQ ID NO: 1357838 - RNA, 17 nt, Mycobacterium tuberculosis H37Rv
gugccgggguggcgcgc

SEQ ID NO: 1357839 - RNA, 19 nt, Mycobacterium tuberculosis H37Rv
gugccgggguggcgcgcca

SEQ ID NO: 1357840 - RNA, 19 nt, Mycobacterium tuberculosis H37Rv
gugccaauuccagcccccc

SEQ ID NO: 1357841 - RNA, 17 nt, Mycobacterium tuberculosis H37Rv
gugccaauuccagcccc

SEQ ID NO: 1357842 - RNA, 13 nt, Mycobacterium tuberculosis H37Rv
gugccacuuccac

SEQ ID NO: 1357843 - RNA, 15 nt, Mycobacterium tuberculosis H37Rv
gugccagcacuccac

SEQ ID NO: 1357844 - RNA, 20 nt, Mycobacterium tuberculosis H37Rv
gugccagcaggccgaagaaa

SEQ ID NO: 1357845 - RNA, 14 nt, Mycobacterium tuberculosis H37Rv
gugccagcagggga

SEQ ID NO: 1357846 - RNA, 16 nt, Mycobacterium tuberculosis H37Rv
gugccacuucuucacu

SEQ ID NO: 1357847 - RNA, 15 nt, Mycobacterium tuberculosis H37Rv
gugccaccggcuggu

SEQ ID NO: 1357848 - RNA, 17 nt, Mycobacterium tuberculosis H37Rv
gugccaccggcuggugc

SEQ ID NO: 1357849 - RNA, 17 nt, Mycobacterium tuberculosis H37Rv
gugccaccugggcgggc

SEQ ID NO: 1357850 - RNA, 15 nt, Mycobacterium tuberculosis H37Rv
gugccacgaucggcg

SEQ ID NO: 1357851 - RNA, 18 nt, Mycobacterium tuberculosis H37Rv
gugccagugccagcgucc

SEQ ID NO: 1357852 - RNA, 19 nt, Mycobacterium tuberculosis H37Rv
gugcccaaggccaggaucu

SEQ ID NO: 1357853 - RNA, 12 nt, Mycobacterium tuberculosis H37Rv
gugccagccgga

SEQ ID NO: 1357854 - RNA, 19 nt, Mycobacterium tuberculosis H37Rv
gugccaguacucggccagc

SEQ ID NO: 1357855 - RNA, 21 nt, Mycobacterium tuberculosis H37Rv
gugccaggucggcgggcgcgg

SEQ ID NO: 1357856 - RNA, 15 nt, Mycobacterium tuberculosis H37Rv
gugccgagaucccag

SEQ ID NO: 1357857 - RNA, 20 nt, Mycobacterium tuberculosis H37Rv
gugccgagcuugucgagcag

SEQ ID NO: 1357858 - RNA, 14 nt, Mycobacterium tuberculosis H37Rv
gugccgagcuggcg

SEQ ID NO: 1357859 - RNA, 13 nt, Mycobacterium tuberculosis H37Rv
gugccgagcuggc

SEQ ID NO: 1357860 - RNA, 12 nt, Mycobacterium tuberculosis H37Rv
gugccgcagcag

SEQ ID NO: 1357861 - RNA, 18 nt, Mycobacterium tuberculosis H37Rv
gugccgaugccggcgagg

SEQ ID NO: 1357862 - RNA, 22 nt, Mycobacterium tuberculosis H37Rv
gugccgaugccggcgagggcca

SEQ ID NO: 1357863 - RNA, 14 nt, Mycobacterium tuberculosis H37Rv
gugccgaacaggga

SEQ ID NO: 1357864 - RNA, 16 nt, Mycobacterium tuberculosis H37Rv
gugccgaacgccagac

SEQ ID NO: 1357865 - RNA, 21 nt, Mycobacterium tuberculosis H37Rv
gugcccuguccggcgccgagg

SEQ ID NO: 1357866 - RNA, 16 nt, Mycobacterium tuberculosis H37Rv
gugcccgucgugcggg

SEQ ID NO: 1357867 - RNA, 22 nt, Mycobacterium tuberculosis H37Rv
gugcccgucgugcggggguggu

SEQ ID NO: 1357868 - RNA, 15 nt, Mycobacterium tuberculosis H37Rv
gugcccgaaggaaaa

SEQ ID NO: 1357869 - RNA, 16 nt, Mycobacterium tuberculosis H37Rv
gugcccgcacugccgc

SEQ ID NO: 1357870 - RNA, 19 nt, Mycobacterium tuberculosis H37Rv
gugcccgcacugccgccgg

SEQ ID NO: 1357871 - RNA, 21 nt, Mycobacterium tuberculosis H37Rv
gugcccgcgcggcgcauuccg

SEQ ID NO: 1357872 - RNA, 20 nt, Mycobacterium tuberculosis H37Rv
gugcccgccagucccccgcu

SEQ ID NO: 1357873 - RNA, 23 nt, Mycobacterium tuberculosis H37Rv
gugcccgcgaacgaucccgccga

SEQ ID NO: 1357874 - RNA, 16 nt, Mycobacterium tuberculosis H37Rv
gugcccggccaaaaug

SEQ ID NO: 1357875 - RNA, 18 nt, Mycobacterium tuberculosis H37Rv
gugcccccggugccgccc

SEQ ID NO: 1357876 - RNA, 11 nt, Mycobacterium tuberculosis H37Rv
gugccccgccg

SEQ ID NO: 1357877 - RNA, 15 nt, Mycobacterium tuberculosis H37Rv
gugcccaugaugcuc

SEQ ID NO: 1357878 - RNA, 17 nt, Mycobacterium tuberculosis H37Rv
gugcccaagcaguccac

SEQ ID NO: 1357879 - RNA, 18 nt, Mycobacterium tuberculosis H37Rv
gugcauguauuuguugua

SEQ ID NO: 1357880 - RNA, 19 nt, Mycobacterium tuberculosis H37Rv
gugcauugucauaggagcu

SEQ ID NO: 1357881 - RNA, 18 nt, Mycobacterium tuberculosis H37Rv
gugcaucgacucacggau

SEQ ID NO: 1357882 - RNA, 15 nt, Mycobacterium tuberculosis H37Rv
gugcauaggccgcgu

SEQ ID NO: 1357883 - RNA, 21 nt, Mycobacterium tuberculosis H37Rv
gugcaggugcccggccaaaau

SEQ ID NO: 1357884 - RNA, 20 nt, Mycobacterium tuberculosis H37Rv
gugcaggugcccggccaaaa

SEQ ID NO: 1357885 - RNA, 23 nt, Mycobacterium tuberculosis H37Rv
gugcagcgcgucaaacaccucca

SEQ ID NO: 1357886 - RNA, 17 nt, Mycobacterium tuberculosis H37Rv
gugcagcgaucccggca

SEQ ID NO: 1357887 - RNA, 22 nt, Mycobacterium tuberculosis H37Rv
gugcaaccccaaguccagcagc

SEQ ID NO: 1357888 - RNA, 17 nt, Mycobacterium tuberculosis H37Rv
gugcaaccauggcggcu

SEQ ID NO: 1357889 - RNA, 17 nt, Mycobacterium tuberculosis H37Rv
gugcaaccacggcggca

SEQ ID NO: 1357890 - RNA, 12 nt, Mycobacterium tuberculosis H37Rv
gugcaccaggua

SEQ ID NO: 1357891 - RNA, 19 nt, Mycobacterium tuberculosis H37Rv
gugcaccgaagauggccag

SEQ ID NO: 1357892 - RNA, 22 nt, Mycobacterium tuberculosis H37Rv
gugcacagacacggcagcugca

SEQ ID NO: 1357893 - RNA, 21 nt, Mycobacterium tuberculosis H37Rv
gugcaaccauggcggcuccgc

SEQ ID NO: 1357894 - RNA, 22 nt, Mycobacterium tuberculosis H37Rv
gugcaaccauggcggcuccgcc

SEQ ID NO: 1357895 - RNA, 21 nt, Mycobacterium tuberculosis H37Rv
gugcagcgacuccguaccggg

SEQ ID NO: 1357896 - RNA, 14 nt, Mycobacterium tuberculosis H37Rv
gugcagcccgccgg

SEQ ID NO: 1357897 - RNA, 16 nt, Mycobacterium tuberculosis H37Rv
gugcagccgcaggugg

SEQ ID NO: 1357898 - RNA, 19 nt, Mycobacterium tuberculosis H37Rv
gugcagcccaaggcgacga

SEQ ID NO: 1357899 - RNA, 21 nt, Mycobacterium tuberculosis H37Rv
gugcagcacguccgcggagcu

SEQ ID NO: 1357900 - RNA, 21 nt, Mycobacterium tuberculosis H37Rv
gugcacgaaguccuggcagac

SEQ ID NO: 1357901 - RNA, 19 nt, Mycobacterium tuberculosis H37Rv
gugcaccuggaucagggcu

SEQ ID NO: 1357902 - RNA, 20 nt, Mycobacterium tuberculosis H37Rv
gugcagcaccagccaaauca

SEQ ID NO: 1357903 - RNA, 17 nt, Mycobacterium tuberculosis H37Rv
gugcagcaccagccacg

SEQ ID NO: 1357904 - RNA, 18 nt, Mycobacterium tuberculosis H37Rv
gucuagcugguggugcgg

SEQ ID NO: 1357905 - RNA, 16 nt, Mycobacterium tuberculosis H37Rv
gugaucaccgaugagc

SEQ ID NO: 1357906 - RNA, 21 nt, Mycobacterium tuberculosis H37Rv
gugaugaccgcguagagcagc

SEQ ID NO: 1357907 - RNA, 19 nt, Mycobacterium tuberculosis H37Rv
gugaugaauucgcuugcag

SEQ ID NO: 1357908 - RNA, 18 nt, Mycobacterium tuberculosis H37Rv
gugaucagcgcaucgccg

SEQ ID NO: 1357909 - RNA, 13 nt, Mycobacterium tuberculosis H37Rv
gugaucagcagca

SEQ ID NO: 1357910 - RNA, 19 nt, Mycobacterium tuberculosis H37Rv
gugaucagcaggacgauga

SEQ ID NO: 1357911 - RNA, 14 nt, Mycobacterium tuberculosis H37Rv
gugaugagucaggc

SEQ ID NO: 1357912 - RNA, 13 nt, Mycobacterium tuberculosis H37Rv
gugaugccgauga

SEQ ID NO: 1357913 - RNA, 13 nt, Mycobacterium tuberculosis H37Rv
gugaugcccuggg

SEQ ID NO: 1357914 - RNA, 17 nt, Mycobacterium tuberculosis H37Rv
gugaugcccugggggug

SEQ ID NO: 1357915 - RNA, 18 nt, Mycobacterium tuberculosis H37Rv
gugaugccacggcgucgc

SEQ ID NO: 1357916 - RNA, 18 nt, Mycobacterium tuberculosis H37Rv
gugaugcguucggccggg

SEQ ID NO: 1357917 - RNA, 19 nt, Mycobacterium tuberculosis H37Rv
gugauguagggcugcuccu

SEQ ID NO: 1357918 - RNA, 17 nt, Mycobacterium tuberculosis H37Rv
gugauguagggcugcuc

SEQ ID NO: 1357919 - RNA, 19 nt, Mycobacterium tuberculosis H37Rv
gugauggugugcagcagca

SEQ ID NO: 1357920 - RNA, 19 nt, Mycobacterium tuberculosis H37Rv
gugaugggggagccgguga

SEQ ID NO: 1357921 - RNA, 15 nt, Mycobacterium tuberculosis H37Rv
gugaugggccaggcg

SEQ ID NO: 1357922 - RNA, 19 nt, Mycobacterium tuberculosis H37Rv
gugcggcagcgguggcuug

SEQ ID NO: 1357923 - RNA, 14 nt, Mycobacterium tuberculosis H37Rv
gugcggccaccucc

SEQ ID NO: 1357924 - RNA, 13 nt, Mycobacterium tuberculosis H37Rv
gugcggcagcccg

SEQ ID NO: 1357925 - RNA, 15 nt, Mycobacterium tuberculosis H37Rv
gugcggcagcccgcu

SEQ ID NO: 1357926 - RNA, 15 nt, Mycobacterium tuberculosis H37Rv
gugcggaacaccgcc

SEQ ID NO: 1357927 - RNA, 20 nt, Mycobacterium tuberculosis H37Rv
gugcggaagcaucggcugcg

SEQ ID NO: 1357928 - RNA, 13 nt, Mycobacterium tuberculosis H37Rv
gugcgcuggaugu

SEQ ID NO: 1357929 - RNA, 18 nt, Mycobacterium tuberculosis H37Rv
gugcggcguuguggcgug

SEQ ID NO: 1357930 - RNA, 13 nt, Mycobacterium tuberculosis H37Rv
gugcggcggcugc

SEQ ID NO: 1357931 - RNA, 14 nt, Mycobacterium tuberculosis H37Rv
gugcggcggcugcc

SEQ ID NO: 1357932 - RNA, 21 nt, Mycobacterium tuberculosis H37Rv
gugcggcguauugcggccugu

SEQ ID NO: 1357933 - RNA, 22 nt, Mycobacterium tuberculosis H37Rv
gugcggcccaaccggucguggu

SEQ ID NO: 1357934 - RNA, 15 nt, Mycobacterium tuberculosis H37Rv
gugcggcgcaugcaa

SEQ ID NO: 1357935 - RNA, 13 nt, Mycobacterium tuberculosis H37Rv
gugcggcgcggcg

SEQ ID NO: 1357936 - RNA, 18 nt, Mycobacterium tuberculosis H37Rv
gugcggugagauggcggu

SEQ ID NO: 1357937 - RNA, 19 nt, Mycobacterium tuberculosis H37Rv
gugcggguaauacggcgcc

SEQ ID NO: 1357938 - RNA, 18 nt, Mycobacterium tuberculosis H37Rv
gugcggugccguggugga

SEQ ID NO: 1357939 - RNA, 20 nt, Mycobacterium tuberculosis H37Rv
gugcguagcccacccgggug

SEQ ID NO: 1357940 - RNA, 14 nt, Mycobacterium tuberculosis H37Rv
gugcguccggugcu

SEQ ID NO: 1357941 - RNA, 17 nt, Mycobacterium tuberculosis H37Rv
gugcgauaccuagcccc

SEQ ID NO: 1357942 - RNA, 13 nt, Mycobacterium tuberculosis H37Rv
gugcgauccccaa

SEQ ID NO: 1357943 - RNA, 16 nt, Mycobacterium tuberculosis H37Rv
gugcgauccccaacac

SEQ ID NO: 1357944 - RNA, 21 nt, Mycobacterium tuberculosis H37Rv
gugcgacugcgaaugcugggc

SEQ ID NO: 1357945 - RNA, 19 nt, Mycobacterium tuberculosis H37Rv
gugcgacucugcgucugcu

SEQ ID NO: 1357946 - RNA, 21 nt, Mycobacterium tuberculosis H37Rv
gugcgcauccgucguacacgc

SEQ ID NO: 1357947 - RNA, 20 nt, Mycobacterium tuberculosis H37Rv
gugcgcagaacaccaccgcc

SEQ ID NO: 1357948 - RNA, 22 nt, Mycobacterium tuberculosis H37Rv
gugcgcagacaucggagaucau

SEQ ID NO: 1357949 - RNA, 12 nt, Mycobacterium tuberculosis H37Rv
gugcgcagguac

SEQ ID NO: 1357950 - RNA, 20 nt, Mycobacterium tuberculosis H37Rv
gugcgccaaggucugccggg

SEQ ID NO: 1357951 - RNA, 13 nt, Mycobacterium tuberculosis H37Rv
gugcgccgcagcc

SEQ ID NO: 1357952 - RNA, 13 nt, Mycobacterium tuberculosis H37Rv
gugcgccgcagca

SEQ ID NO: 1357953 - RNA, 19 nt, Mycobacterium tuberculosis H37Rv
gugcgccggcuggcggccu

SEQ ID NO: 1357954 - RNA, 13 nt, Mycobacterium tuberculosis H37Rv
gugcgccgguccu

SEQ ID NO: 1357955 - RNA, 17 nt, Mycobacterium tuberculosis H37Rv
gugcgcgaccacccgcc

SEQ ID NO: 1357956 - RNA, 23 nt, Mycobacterium tuberculosis H37Rv
gugcgugcggucgauccggccag

SEQ ID NO: 1357957 - RNA, 17 nt, Mycobacterium tuberculosis H37Rv
gugcguuggaugaaguc

SEQ ID NO: 1357958 - RNA, 17 nt, Mycobacterium tuberculosis H37Rv
gugcucacauccgguca

SEQ ID NO: 1357959 - RNA, 15 nt, Mycobacterium tuberculosis H37Rv
gugcuauggccgcac

SEQ ID NO: 1357960 - RNA, 22 nt, Mycobacterium tuberculosis H37Rv
gugcucagcgcgcgccgcuggg

SEQ ID NO: 1357961 - RNA, 22 nt, Mycobacterium tuberculosis H37Rv
gugcucgccguaagcaccagcc

SEQ ID NO: 1357962 - RNA, 14 nt, Mycobacterium tuberculosis H37Rv
gugcucgccggcac

SEQ ID NO: 1357963 - RNA, 22 nt, Mycobacterium tuberculosis H37Rv
gugcucggaucggcucgccacc

SEQ ID NO: 1357964 - RNA, 15 nt, Mycobacterium tuberculosis H37Rv
gugcucucgcucgug

SEQ ID NO: 1357965 - RNA, 17 nt, Mycobacterium tuberculosis H37Rv
gugcucgucguacaugg

SEQ ID NO: 1357966 - RNA, 21 nt, Mycobacterium tuberculosis H37Rv
gugcugagucgguucagccac

SEQ ID NO: 1357967 - RNA, 15 nt, Mycobacterium tuberculosis H37Rv
gugcugaccccgccg

SEQ ID NO: 1357968 - RNA, 18 nt, Mycobacterium tuberculosis H37Rv
gugcugcaccgauucggg

SEQ ID NO: 1357969 - RNA, 13 nt, Mycobacterium tuberculosis H37Rv
gugcugccaagca

SEQ ID NO: 1357970 - RNA, 23 nt, Mycobacterium tuberculosis H37Rv
gugcugccaccggccggcgcagu

SEQ ID NO: 1357971 - RNA, 22 nt, Mycobacterium tuberculosis H37Rv
gugcuguuugguugcgccagga

SEQ ID NO: 1357972 - RNA, 21 nt, Mycobacterium tuberculosis H37Rv
gugcuggaaguaguccccaac

SEQ ID NO: 1357973 - RNA, 23 nt, Mycobacterium tuberculosis H37Rv
gugcugccggagacacccgccag

SEQ ID NO: 1357974 - RNA, 15 nt, Mycobacterium tuberculosis H37Rv
gugcugccgccuugg

SEQ ID NO: 1357975 - RNA, 12 nt, Mycobacterium tuberculosis H37Rv
gugcugcggcug

SEQ ID NO: 1357976 - RNA, 14 nt, Mycobacterium tuberculosis H37Rv
gugcugcgcgcggc

SEQ ID NO: 1357977 - RNA, 14 nt, Mycobacterium tuberculosis H37Rv
guggcccgcgguga

SEQ ID NO: 1357978 - RNA, 16 nt, Mycobacterium tuberculosis H37Rv
guggccgccggcgcug

SEQ ID NO: 1357979 - RNA, 16 nt, Mycobacterium tuberculosis H37Rv
guggccgcgcaggggc

SEQ ID NO: 1357980 - RNA, 20 nt, Mycobacterium tuberculosis H37Rv
guggccgcggcggucugggu

SEQ ID NO: 1357981 - RNA, 22 nt, Mycobacterium tuberculosis H37Rv
guggacggcauagcagccagcg

SEQ ID NO: 1357982 - RNA, 21 nt, Mycobacterium tuberculosis H37Rv
guggacgcgguuuugugcggg

SEQ ID NO: 1357983 - RNA, 15 nt, Mycobacterium tuberculosis H37Rv
guggacggcaggcgg

SEQ ID NO: 1357984 - RNA, 19 nt, Mycobacterium tuberculosis H37Rv
guggacagaugcauccagc

SEQ ID NO: 1357985 - RNA, 22 nt, Mycobacterium tuberculosis H37Rv
guggacaucgggcggcaccgcu

SEQ ID NO: 1357986 - RNA, 13 nt, Mycobacterium tuberculosis H37Rv
guggcggacggcg

SEQ ID NO: 1357987 - RNA, 16 nt, Mycobacterium tuberculosis H37Rv
guggcgccgaccugga

SEQ ID NO: 1357988 - RNA, 22 nt, Mycobacterium tuberculosis H37Rv
guggcgcccgucuccagcacca

SEQ ID NO: 1357989 - RNA, 20 nt, Mycobacterium tuberculosis H37Rv
guggcgccgaacgccagcag

SEQ ID NO: 1357990 - RNA, 22 nt, Mycobacterium tuberculosis H37Rv
guggccgugaagggauccggaa

SEQ ID NO: 1357991 - RNA, 16 nt, Mycobacterium tuberculosis H37Rv
guggccggggugccgg

SEQ ID NO: 1357992 - RNA, 19 nt, Mycobacterium tuberculosis H37Rv
guggccguuuaggccggaa

SEQ ID NO: 1357993 - RNA, 16 nt, Mycobacterium tuberculosis H37Rv
guggccgcugccagcc

SEQ ID NO: 1357994 - RNA, 20 nt, Mycobacterium tuberculosis H37Rv
guggccgggcgguaggcuug

SEQ ID NO: 1357995 - RNA, 14 nt, Mycobacterium tuberculosis H37Rv
guggcucggguggu

SEQ ID NO: 1357996 - RNA, 21 nt, Mycobacterium tuberculosis H37Rv
guggcuggacccgcauggcgc

SEQ ID NO: 1357997 - RNA, 22 nt, Mycobacterium tuberculosis H37Rv
guggcugcgauuuucggcacgg

SEQ ID NO: 1357998 - RNA, 14 nt, Mycobacterium tuberculosis H37Rv
guggcugcuggcgc

SEQ ID NO: 1357999 - RNA, 12 nt, Mycobacterium tuberculosis H37Rv
guggcggccagu

SEQ ID NO: 1358000 - RNA, 12 nt, Mycobacterium tuberculosis H37Rv
guggcggccucc

SEQ ID NO: 1358001 - RNA, 20 nt, Mycobacterium tuberculosis H37Rv
guggcugaacaccgcgggca

SEQ ID NO: 1358002 - RNA, 22 nt, Mycobacterium tuberculosis H37Rv
gugggaacuggaccacagccgc

SEQ ID NO: 1358003 - RNA, 14 nt, Mycobacterium tuberculosis H37Rv
guggcuucacccaa

SEQ ID NO: 1358004 - RNA, 23 nt, Mycobacterium tuberculosis H37Rv
gugggcgacggcggcgucgauga

SEQ ID NO: 1358005 - RNA, 15 nt, Mycobacterium tuberculosis H37Rv
gugggcgacgaggca

SEQ ID NO: 1358006 - RNA, 19 nt, Mycobacterium tuberculosis H37Rv
gugggcgacggccaagauc

SEQ ID NO: 1358007 - RNA, 17 nt, Mycobacterium tuberculosis H37Rv
gugggcgacggcggcgu

SEQ ID NO: 1358008 - RNA, 18 nt, Mycobacterium tuberculosis H37Rv
gugggccgcccaaagaaa

SEQ ID NO: 1358009 - RNA, 13 nt, Mycobacterium tuberculosis H37Rv
gugggcggccggg

SEQ ID NO: 1358010 - RNA, 13 nt, Mycobacterium tuberculosis H37Rv
gugggcgccgcaa

SEQ ID NO: 1358011 - RNA, 13 nt, Mycobacterium tuberculosis H37Rv
gugggcgccgucg

SEQ ID NO: 1358012 - RNA, 19 nt, Mycobacterium tuberculosis H37Rv
gugggcgugacguagugca

SEQ ID NO: 1358013 - RNA, 13 nt, Mycobacterium tuberculosis H37Rv
gugggcguggcug

SEQ ID NO: 1358014 - RNA, 19 nt, Mycobacterium tuberculosis H37Rv
guggguguugaugggcagc

SEQ ID NO: 1358015 - RNA, 16 nt, Mycobacterium tuberculosis H37Rv
gugguaaccagggcag

SEQ ID NO: 1358016 - RNA, 18 nt, Mycobacterium tuberculosis H37Rv
gugguaaccauauggccc

SEQ ID NO: 1358017 - RNA, 17 nt, Mycobacterium tuberculosis H37Rv
gugggcuuggcuguggu

SEQ ID NO: 1358018 - RNA, 18 nt, Mycobacterium tuberculosis H37Rv
guggucugccaaaagggc

SEQ ID NO: 1358019 - RNA, 18 nt, Mycobacterium tuberculosis H37Rv
guggucugccagcacccu

SEQ ID NO: 1358020 - RNA, 15 nt, Mycobacterium tuberculosis H37Rv
guggucugcgcggug

SEQ ID NO: 1358021 - RNA, 21 nt, Mycobacterium tuberculosis H37Rv
guggucgguggcuacgcccca

SEQ ID NO: 1358022 - RNA, 14 nt, Mycobacterium tuberculosis H37Rv
guggucggcgguga

SEQ ID NO: 1358023 - RNA, 16 nt, Mycobacterium tuberculosis H37Rv
guggugccaaccuggg

SEQ ID NO: 1358024 - RNA, 20 nt, Mycobacterium tuberculosis H37Rv
guggugccaggucggcgggc

SEQ ID NO: 1358025 - RNA, 16 nt, Mycobacterium tuberculosis H37Rv
guggucuuggcccggc

SEQ ID NO: 1358026 - RNA, 20 nt, Mycobacterium tuberculosis H37Rv
guggugaccgacgcggacag

SEQ ID NO: 1358027 - RNA, 19 nt, Mycobacterium tuberculosis H37Rv
guggugaaguagucggcgc

SEQ ID NO: 1358028 - RNA, 20 nt, Mycobacterium tuberculosis H37Rv
gugguccuuguuguggugga

SEQ ID NO: 1358029 - RNA, 14 nt, Mycobacterium tuberculosis H37Rv
gugguccaaccggg

SEQ ID NO: 1358030 - RNA, 15 nt, Mycobacterium tuberculosis H37Rv
guggucgacccggcc

SEQ ID NO: 1358031 - RNA, 17 nt, Mycobacterium tuberculosis H37Rv
guggucgagguggggug

SEQ ID NO: 1358032 - RNA, 15 nt, Mycobacterium tuberculosis H37Rv
guggucagcugcugc

SEQ ID NO: 1358033 - RNA, 22 nt, Mycobacterium tuberculosis H37Rv
guggucaccccuucgccagcgc

SEQ ID NO: 1358034 - RNA, 23 nt, Mycobacterium tuberculosis H37Rv
gugguaggucuuagcggcccgug

SEQ ID NO: 1358035 - RNA, 16 nt, Mycobacterium tuberculosis H37Rv
gugguagaggaacaga

SEQ ID NO: 1358036 - RNA, 23 nt, Mycobacterium tuberculosis H37Rv
gugguaccaacgcuucugccugc

SEQ ID NO: 1358037 - RNA, 16 nt, Mycobacterium tuberculosis H37Rv
gugguaccggcggcgc

SEQ ID NO: 1358038 - RNA, 13 nt, Mycobacterium tuberculosis H37Rv
gugguaggccggg

SEQ ID NO: 1358039 - RNA, 18 nt, Mycobacterium tuberculosis H37Rv
gugguuugcgcccugagc

SEQ ID NO: 1358040 - RNA, 20 nt, Mycobacterium tuberculosis H37Rv
guguacaccgcgcccgccga

SEQ ID NO: 1358041 - RNA, 21 nt, Mycobacterium tuberculosis H37Rv
guguccgccggauagcaccgg

SEQ ID NO: 1358042 - RNA, 16 nt, Mycobacterium tuberculosis H37Rv
gugucaaucacccagc

SEQ ID NO: 1358043 - RNA, 14 nt, Mycobacterium tuberculosis H37Rv
gugucaaugacacc

SEQ ID NO: 1358044 - RNA, 23 nt, Mycobacterium tuberculosis H37Rv
guuaaucaaggugaucagcagga

SEQ ID NO: 1358045 - RNA, 16 nt, Mycobacterium tuberculosis H37Rv
guguuuggguuuuguu

SEQ ID NO: 1358046 - RNA, 14 nt, Mycobacterium tuberculosis H37Rv
gugucgaugcgcgc

SEQ ID NO: 1358047 - RNA, 21 nt, Mycobacterium tuberculosis H37Rv
gugucgcccuguucggcccga

SEQ ID NO: 1358048 - RNA, 16 nt, Mycobacterium tuberculosis H37Rv
guguccucgguguccu

SEQ ID NO: 1358049 - RNA, 17 nt, Mycobacterium tuberculosis H37Rv
gugucgacggucauccc

SEQ ID NO: 1358050 - RNA, 19 nt, Mycobacterium tuberculosis H37Rv
gugucgagcgccgcaguga

SEQ ID NO: 1358051 - RNA, 23 nt, Mycobacterium tuberculosis H37Rv
guguugguggauucgaucaggcc

SEQ ID NO: 1358052 - RNA, 15 nt, Mycobacterium tuberculosis H37Rv
guguuuaugguugug

SEQ ID NO: 1358053 - RNA, 20 nt, Mycobacterium tuberculosis H37Rv
gugucggaaugggcgccaca

SEQ ID NO: 1358054 - RNA, 19 nt, Mycobacterium tuberculosis H37Rv
guuagcgcggccagcagca

SEQ ID NO: 1358055 - RNA, 14 nt, Mycobacterium tuberculosis H37Rv
guuagcggcgggca

SEQ ID NO: 1358056 - RNA, 18 nt, Mycobacterium tuberculosis H37Rv
guuagccgcggcccgcgu

SEQ ID NO: 1358057 - RNA, 13 nt, Mycobacterium tuberculosis H37Rv
guuauucggugcg

SEQ ID NO: 1358058 - RNA, 14 nt, Mycobacterium tuberculosis H37Rv
guuauccccuggcc

SEQ ID NO: 1358059 - RNA, 14 nt, Mycobacterium tuberculosis H37Rv
guuaucgaagcccg

SEQ ID NO: 1358060 - RNA, 16 nt, Mycobacterium tuberculosis H37Rv
guucgacugaaucaug

SEQ ID NO: 1358061 - RNA, 20 nt, Mycobacterium tuberculosis H37Rv
guucgaguccugguacccca

SEQ ID NO: 1358062 - RNA, 14 nt, Mycobacterium tuberculosis H37Rv
guucgauagcggcg

SEQ ID NO: 1358063 - RNA, 22 nt, Mycobacterium tuberculosis H37Rv
guucgauaagcagcucgguggc

SEQ ID NO: 1358064 - RNA, 23 nt, Mycobacterium tuberculosis H37Rv
guucgauggcaucggccaucucg

SEQ ID NO: 1358065 - RNA, 19 nt, Mycobacterium tuberculosis H37Rv
guucgcgggugcgcugcag

SEQ ID NO: 1358066 - RNA, 15 nt, Mycobacterium tuberculosis H37Rv
guucggcagcgggcu

SEQ ID NO: 1358067 - RNA, 17 nt, Mycobacterium tuberculosis H37Rv
guucggcacaaccaacg

SEQ ID NO: 1358068 - RNA, 22 nt, Mycobacterium tuberculosis H37Rv
guucgcucggggacucauggcc

SEQ ID NO: 1358069 - RNA, 13 nt, Mycobacterium tuberculosis H37Rv
guucgcucccccg

SEQ ID NO: 1358070 - RNA, 15 nt, Mycobacterium tuberculosis H37Rv
guucggugagguccu

SEQ ID NO: 1358071 - RNA, 20 nt, Mycobacterium tuberculosis H37Rv
guucggccgucauggcccga

SEQ ID NO: 1358072 - RNA, 16 nt, Mycobacterium tuberculosis H37Rv
guucccgggcagccgc

SEQ ID NO: 1358073 - RNA, 16 nt, Mycobacterium tuberculosis H37Rv
guucccgcucgggcaa

SEQ ID NO: 1358074 - RNA, 19 nt, Mycobacterium tuberculosis H37Rv
guuccguugaugccgccgg

SEQ ID NO: 1358075 - RNA, 19 nt, Mycobacterium tuberculosis H37Rv
guuccgugcgggucguccg

SEQ ID NO: 1358076 - RNA, 14 nt, Mycobacterium tuberculosis H37Rv
guuccucagcggcc

SEQ ID NO: 1358077 - RNA, 14 nt, Mycobacterium tuberculosis H37Rv
guuccagcggcacc

SEQ ID NO: 1358078 - RNA, 17 nt, Mycobacterium tuberculosis H37Rv
guuccagcgucugcacg

SEQ ID NO: 1358079 - RNA, 14 nt, Mycobacterium tuberculosis H37Rv
guucccgccggccc

SEQ ID NO: 1358080 - RNA, 19 nt, Mycobacterium tuberculosis H37Rv
guucccgccggcuccgcca

SEQ ID NO: 1358081 - RNA, 18 nt, Mycobacterium tuberculosis H37Rv
guucccaccaccaccgcc

SEQ ID NO: 1358082 - RNA, 13 nt, Mycobacterium tuberculosis H37Rv
guucagcaggccc

SEQ ID NO: 1358083 - RNA, 19 nt, Mycobacterium tuberculosis H37Rv
guucagcaggcccuucagu

SEQ ID NO: 1358084 - RNA, 17 nt, Mycobacterium tuberculosis H37Rv
guucuggauccccugau

SEQ ID NO: 1358085 - RNA, 15 nt, Mycobacterium tuberculosis H37Rv
guucgugagcggcca

SEQ ID NO: 1358086 - RNA, 16 nt, Mycobacterium tuberculosis H37Rv
guucgugacgugcaug

SEQ ID NO: 1358087 - RNA, 23 nt, Mycobacterium tuberculosis H37Rv
guugaaauugaugaucugcagcu

SEQ ID NO: 1358088 - RNA, 19 nt, Mycobacterium tuberculosis H37Rv
guugacgccgguccccgcc

SEQ ID NO: 1358089 - RNA, 18 nt, Mycobacterium tuberculosis H37Rv
guugacggucagccgcgg

SEQ ID NO: 1358090 - RNA, 20 nt, Mycobacterium tuberculosis H37Rv
guugaccgggucgccgauga

SEQ ID NO: 1358091 - RNA, 15 nt, Mycobacterium tuberculosis H37Rv
guugaccggccggac

SEQ ID NO: 1358092 - RNA, 22 nt, Mycobacterium tuberculosis H37Rv
guugaccucuucgggcagcgcg

SEQ ID NO: 1358093 - RNA, 21 nt, Mycobacterium tuberculosis H37Rv
guugaaucccagauaugcagg

SEQ ID NO: 1358094 - RNA, 14 nt, Mycobacterium tuberculosis H37Rv
guugaagaagcccg

SEQ ID NO: 1358095 - RNA, 18 nt, Mycobacterium tuberculosis H37Rv
guugaacgccgccagcag

SEQ ID NO: 1358096 - RNA, 14 nt, Mycobacterium tuberculosis H37Rv
guugaacgcgugcu

SEQ ID NO: 1358097 - RNA, 15 nt, Mycobacterium tuberculosis H37Rv
guugaucagccagac

SEQ ID NO: 1358098 - RNA, 16 nt, Mycobacterium tuberculosis H37Rv
guugaucagugccagg

SEQ ID NO: 1358099 - RNA, 13 nt, Mycobacterium tuberculosis H37Rv
guugaucggccac

SEQ ID NO: 1358100 - RNA, 19 nt, Mycobacterium tuberculosis H37Rv
guugaucgacaucaccacc

SEQ ID NO: 1358101 - RNA, 17 nt, Mycobacterium tuberculosis H37Rv
guugaugcggaugucgu

SEQ ID NO: 1358102 - RNA, 13 nt, Mycobacterium tuberculosis H37Rv
guugaugaacagu

SEQ ID NO: 1358103 - RNA, 19 nt, Mycobacterium tuberculosis H37Rv
guugauguugccggaguug

SEQ ID NO: 1358104 - RNA, 16 nt, Mycobacterium tuberculosis H37Rv
guuguuggugccagcc

SEQ ID NO: 1358105 - RNA, 19 nt, Mycobacterium tuberculosis H37Rv
guuguucccauagccagcc

SEQ ID NO: 1358106 - RNA, 15 nt, Mycobacterium tuberculosis H37Rv
guugugucggccugg

SEQ ID NO: 1358107 - RNA, 18 nt, Mycobacterium tuberculosis H37Rv
guugugucggccuggcag

SEQ ID NO: 1358108 - RNA, 20 nt, Mycobacterium tuberculosis H37Rv
guuguggucagcugcugcca

SEQ ID NO: 1358109 - RNA, 15 nt, Mycobacterium tuberculosis H37Rv
guuguggucgaguug

SEQ ID NO: 1358110 - RNA, 14 nt, Mycobacterium tuberculosis H37Rv
guugugcucgguga

SEQ ID NO: 1358111 - RNA, 18 nt, Mycobacterium tuberculosis H37Rv
guuuaggcgauucugcgu

SEQ ID NO: 1358112 - RNA, 23 nt, Mycobacterium tuberculosis H37Rv
guuuauaccucgccgcccugucc

SEQ ID NO: 1358113 - RNA, 20 nt, Mycobacterium tuberculosis H37Rv
guugcccccauugccgccgu

SEQ ID NO: 1358114 - RNA, 17 nt, Mycobacterium tuberculosis H37Rv
guugccccgaccgccgu

SEQ ID NO: 1358115 - RNA, 14 nt, Mycobacterium tuberculosis H37Rv
guugcccugcaacc

SEQ ID NO: 1358116 - RNA, 19 nt, Mycobacterium tuberculosis H37Rv
guugccaucaaggccaccu

SEQ ID NO: 1358117 - RNA, 14 nt, Mycobacterium tuberculosis H37Rv
guugccaggugcug

SEQ ID NO: 1358118 - RNA, 18 nt, Mycobacterium tuberculosis H37Rv
guugccaagcagcugggc

SEQ ID NO: 1358119 - RNA, 14 nt, Mycobacterium tuberculosis H37Rv
guugccaacaacau

SEQ ID NO: 1358120 - RNA, 23 nt, Mycobacterium tuberculosis H37Rv
guugccagcgacgcggucaucga

SEQ ID NO: 1358121 - RNA, 20 nt, Mycobacterium tuberculosis H37Rv
guuggcaaugaccccggcgu

SEQ ID NO: 1358122 - RNA, 14 nt, Mycobacterium tuberculosis H37Rv
guuggcagcccucu

SEQ ID NO: 1358123 - RNA, 13 nt, Mycobacterium tuberculosis H37Rv
guuggcagggcca

SEQ ID NO: 1358124 - RNA, 18 nt, Mycobacterium tuberculosis H37Rv
guugccgaucaacccccc

SEQ ID NO: 1358125 - RNA, 15 nt, Mycobacterium tuberculosis H37Rv
guugccgccagcgcc

SEQ ID NO: 1358126 - RNA, 12 nt, Mycobacterium tuberculosis H37Rv
guugccgcccgu

SEQ ID NO: 1358127 - RNA, 14 nt, Mycobacterium tuberculosis H37Rv
guugccgccgccuc

SEQ ID NO: 1358128 - RNA, 23 nt, Mycobacterium tuberculosis H37Rv
guuggagccgccaccgaggccgc

SEQ ID NO: 1358129 - RNA, 16 nt, Mycobacterium tuberculosis H37Rv
guuggaucccagcccg

SEQ ID NO: 1358130 - RNA, 23 nt, Mycobacterium tuberculosis H37Rv
guugugcgcacucuuuccuuccg

SEQ ID NO: 1358131 - RNA, 13 nt, Mycobacterium tuberculosis H37Rv
guugugcguccuc

SEQ ID NO: 1358132 - RNA, 16 nt, Mycobacterium tuberculosis H37Rv
guugucguugcuggug

SEQ ID NO: 1358133 - RNA, 23 nt, Mycobacterium tuberculosis H37Rv
guuguagcccaaaaacggcagca

SEQ ID NO: 1358134 - RNA, 16 nt, Mycobacterium tuberculosis H37Rv
guuguaccccagcauc

SEQ ID NO: 1358135 - RNA, 23 nt, Mycobacterium tuberculosis H37Rv
guugggcgagaccgcgagcagca

SEQ ID NO: 1358136 - RNA, 14 nt, Mycobacterium tuberculosis H37Rv
guuggcucgcuggg

SEQ ID NO: 1358137 - RNA, 18 nt, Mycobacterium tuberculosis H37Rv
guuggcuugcgcgcaggu

SEQ ID NO: 1358138 - RNA, 14 nt, Mycobacterium tuberculosis H37Rv
guugggugugcccg

SEQ ID NO: 1358139 - RNA, 19 nt, Mycobacterium tuberculosis H37Rv
guugguacccaccagggug

SEQ ID NO: 1358140 - RNA, 18 nt, Mycobacterium tuberculosis H37Rv
guuguaaaucuccucgga

SEQ ID NO: 1358141 - RNA, 20 nt, Mycobacterium tuberculosis H37Rv
uaaacauacaaaaacaccac

SEQ ID NO: 1358142 - RNA, 20 nt, Mycobacterium tuberculosis H37Rv
uaaaccuggcuaucgcagaa

SEQ ID NO: 1358143 - RNA, 12 nt, Mycobacterium tuberculosis H37Rv
uaaaccccuggc

SEQ ID NO: 1358144 - RNA, 12 nt, Mycobacterium tuberculosis H37Rv
uaaaccaggugg

SEQ ID NO: 1358145 - RNA, 15 nt, Mycobacterium tuberculosis H37Rv
uaacccagcggcgcc

SEQ ID NO: 1358146 - RNA, 14 nt, Mycobacterium tuberculosis H37Rv
uaacccagcaccac

SEQ ID NO: 1358147 - RNA, 13 nt, Mycobacterium tuberculosis H37Rv
uaacccagcacca

SEQ ID NO: 1358148 - RNA, 17 nt, Mycobacterium tuberculosis H37Rv
uaacaacaccaccagca

SEQ ID NO: 1358149 - RNA, 23 nt, Mycobacterium tuberculosis H37Rv
uaaaacucgggggcugcacgcuc

SEQ ID NO: 1358150 - RNA, 15 nt, Mycobacterium tuberculosis H37Rv
guuuggguuuuguuu

SEQ ID NO: 1358151 - RNA, 11 nt, Mycobacterium tuberculosis H37Rv
guuuggccagu

SEQ ID NO: 1358152 - RNA, 17 nt, Mycobacterium tuberculosis H37Rv
guuuggccaguucggug

SEQ ID NO: 1358153 - RNA, 19 nt, Mycobacterium tuberculosis H37Rv
guuuggugucgaucagcuc

SEQ ID NO: 1358154 - RNA, 20 nt, Mycobacterium tuberculosis H37Rv
guuuggugucgaucagcucc

SEQ ID NO: 1358155 - RNA, 14 nt, Mycobacterium tuberculosis H37Rv
aaaucagccaggcg

SEQ ID NO: 1358156 - RNA, 17 nt, Mycobacterium tuberculosis H37Rv
guuugaugcgggcggca

SEQ ID NO: 1358157 - RNA, 20 nt, Mycobacterium tuberculosis H37Rv
guuugcacgcaccacaaucc

SEQ ID NO: 1358158 - RNA, 16 nt, Mycobacterium tuberculosis H37Rv
guuugaucgcaacgau

SEQ ID NO: 1358159 - RNA, 16 nt, Mycobacterium tuberculosis H37Rv
guuugcagcgggauca

SEQ ID NO: 1358160 - RNA, 22 nt, Mycobacterium tuberculosis H37Rv
guuugccgauggaugggcugcg

SEQ ID NO: 1358161 - RNA, 20 nt, Mycobacterium tuberculosis H37Rv
aaauccagcgaggugauggu

SEQ ID NO: 1358162 - RNA, 14 nt, Mycobacterium tuberculosis H37Rv
uaaaaaccaccccc

SEQ ID NO: 1358163 - RNA, 15 nt, Mycobacterium tuberculosis H37Rv
uaaaaaccaccccca

SEQ ID NO: 1358164 - RNA, 15 nt, Mycobacterium tuberculosis H37Rv
uaaaaagcccagcga

SEQ ID NO: 1358165 - RNA, 20 nt, Mycobacterium tuberculosis H37Rv
uaaaaaggcaggacugaaca

SEQ ID NO: 1358166 - RNA, 16 nt, Mycobacterium tuberculosis H37Rv
guagacggcacccccg

SEQ ID NO: 1358167 - RNA, 16 nt, Mycobacterium tuberculosis H37Rv
guagacgccaugcacg

SEQ ID NO: 1358168 - RNA, 15 nt, Mycobacterium tuberculosis H37Rv
guagacuugcugcuc

SEQ ID NO: 1358169 - RNA, 21 nt, Mycobacterium tuberculosis H37Rv
guagaccagugaccgcagucc

SEQ ID NO: 1358170 - RNA, 15 nt, Mycobacterium tuberculosis H37Rv
guagaccaggcccag

SEQ ID NO: 1358171 - RNA, 23 nt, Mycobacterium tuberculosis H37Rv
guagaccccaaucgaccgcccgc

SEQ ID NO: 1358172 - RNA, 22 nt, Mycobacterium tuberculosis H37Rv
guagacccacaucaggucggcg

SEQ ID NO: 1358173 - RNA, 21 nt, Mycobacterium tuberculosis H37Rv
guagacagucugcgacuggau

SEQ ID NO: 1358174 - RNA, 16 nt, Mycobacterium tuberculosis H37Rv
guagacaccccaccac

SEQ ID NO: 1358175 - RNA, 19 nt, Mycobacterium tuberculosis H37Rv
guagacaccccaccacaga

SEQ ID NO: 1358176 - RNA, 19 nt, Mycobacterium tuberculosis H37Rv
guagaucaucuggcuggug

SEQ ID NO: 1358177 - RNA, 13 nt, Mycobacterium tuberculosis H37Rv
guagaugguggug

SEQ ID NO: 1358178 - RNA, 20 nt, Mycobacterium tuberculosis H37Rv
guagaugguggucaccacca

SEQ ID NO: 1358179 - RNA, 20 nt, Mycobacterium tuberculosis H37Rv
guagaucuucggccgcacug

SEQ ID NO: 1358180 - RNA, 15 nt, Mycobacterium tuberculosis H37Rv
guagcacccacggcg

SEQ ID NO: 1358181 - RNA, 14 nt, Mycobacterium tuberculosis H37Rv
guagcacagcagca

SEQ ID NO: 1358182 - RNA, 23 nt, Mycobacterium tuberculosis H37Rv
guagcacucgggauucggcagcg

SEQ ID NO: 1358183 - RNA, 16 nt, Mycobacterium tuberculosis H37Rv
guagcagcagcgggcc

SEQ ID NO: 1358184 - RNA, 13 nt, Mycobacterium tuberculosis H37Rv
guagcccaucggc

SEQ ID NO: 1358185 - RNA, 22 nt, Mycobacterium tuberculosis H37Rv
guagcccacccgggugggccag

SEQ ID NO: 1358186 - RNA, 22 nt, Mycobacterium tuberculosis H37Rv
guagccaaccugaagccagcgc

SEQ ID NO: 1358187 - RNA, 22 nt, Mycobacterium tuberculosis H37Rv
guagccaaugcccuuggccagc

SEQ ID NO: 1358188 - RNA, 23 nt, Mycobacterium tuberculosis H37Rv
guagccacgcccacaggggcagc

SEQ ID NO: 1358189 - RNA, 18 nt, Mycobacterium tuberculosis H37Rv
guagcagcgccagcagcu

SEQ ID NO: 1358190 - RNA, 14 nt, Mycobacterium tuberculosis H37Rv
guagcagcgcggcu

SEQ ID NO: 1358191 - RNA, 19 nt, Mycobacterium tuberculosis H37Rv
guagcaggucgugaaacca

SEQ ID NO: 1358192 - RNA, 22 nt, Mycobacterium tuberculosis H37Rv
guagcaggucgacggccacggu

SEQ ID NO: 1358193 - RNA, 18 nt, Mycobacterium tuberculosis H37Rv
guacuugagggucuugaa

SEQ ID NO: 1358194 - RNA, 17 nt, Mycobacterium tuberculosis H37Rv
guacuuggcuuccggau

SEQ ID NO: 1358195 - RNA, 14 nt, Mycobacterium tuberculosis H37Rv
guagaagcgcucca

SEQ ID NO: 1358196 - RNA, 19 nt, Mycobacterium tuberculosis H37Rv
guagaagcgcuccagcuga

SEQ ID NO: 1358197 - RNA, 15 nt, Mycobacterium tuberculosis H37Rv
guagaacccaggccg

SEQ ID NO: 1358198 - RNA, 23 nt, Mycobacterium tuberculosis H37Rv
guagaaacccucggggguccagu

SEQ ID NO: 1358199 - RNA, 19 nt, Mycobacterium tuberculosis H37Rv
guacugucgucgcccugac

SEQ ID NO: 1358200 - RNA, 17 nt, Mycobacterium tuberculosis H37Rv
guacucgcggcgcggcc

SEQ ID NO: 1358201 - RNA, 19 nt, Mycobacterium tuberculosis H37Rv
guacucggcauccaggcug

SEQ ID NO: 1358202 - RNA, 16 nt, Mycobacterium tuberculosis H37Rv
guacucggccagcgcc

SEQ ID NO: 1358203 - RNA, 13 nt, Mycobacterium tuberculosis H37Rv
guacuccauggca

SEQ ID NO: 1358204 - RNA, 21 nt, Mycobacterium tuberculosis H37Rv
guacucccccgaaccugcggc

SEQ ID NO: 1358205 - RNA, 16 nt, Mycobacterium tuberculosis H37Rv
guaguggugggcgugg

SEQ ID NO: 1358206 - RNA, 23 nt, Mycobacterium tuberculosis H37Rv
guagugcguaaggcugugccggc

SEQ ID NO: 1358207 - RNA, 18 nt, Mycobacterium tuberculosis H37Rv
guagugcagcugcaauga

SEQ ID NO: 1358208 - RNA, 21 nt, Mycobacterium tuberculosis H37Rv
guagugcccacaaccgcacca

SEQ ID NO: 1358209 - RNA, 23 nt, Mycobacterium tuberculosis H37Rv
guagugcccacaaccgcaccagg

SEQ ID NO: 1358210 - RNA, 22 nt, Mycobacterium tuberculosis H37Rv
guagucggccagcucgcgggcc

SEQ ID NO: 1358211 - RNA, 19 nt, Mycobacterium tuberculosis H37Rv
guagucgcgaccgcgggcc

SEQ ID NO: 1358212 - RNA, 17 nt, Mycobacterium tuberculosis H37Rv
guagucgccgggcggcc

SEQ ID NO: 1358213 - RNA, 14 nt, Mycobacterium tuberculosis H37Rv
guaguaguucagcc

SEQ ID NO: 1358214 - RNA, 22 nt, Mycobacterium tuberculosis H37Rv
guagucccacugccacuccuga

SEQ ID NO: 1358215 - RNA, 19 nt, Mycobacterium tuberculosis H37Rv
guaguccgcgccgacggcc

SEQ ID NO: 1358216 - RNA, 16 nt, Mycobacterium tuberculosis H37Rv
guaguccugcgggccg

SEQ ID NO: 1358217 - RNA, 13 nt, Mycobacterium tuberculosis H37Rv
guaguccagcacg

SEQ ID NO: 1358218 - RNA, 11 nt, Mycobacterium tuberculosis H37Rv
guaggggucug

SEQ ID NO: 1358219 - RNA, 17 nt, Mycobacterium tuberculosis H37Rv
guagggcagcgccaggc

SEQ ID NO: 1358220 - RNA, 20 nt, Mycobacterium tuberculosis H37Rv
guagggcggaaacggcaccg

SEQ ID NO: 1358221 - RNA, 23 nt, Mycobacterium tuberculosis H37Rv
guagguccuugucggccccggcc

SEQ ID NO: 1358222 - RNA, 18 nt, Mycobacterium tuberculosis H37Rv
guaggucgccgcuuugga

SEQ ID NO: 1358223 - RNA, 21 nt, Mycobacterium tuberculosis H37Rv
guagguccacguucggcugcg

SEQ ID NO: 1358224 - RNA, 15 nt, Mycobacterium tuberculosis H37Rv
guagguugcgccccg

SEQ ID NO: 1358225 - RNA, 17 nt, Mycobacterium tuberculosis H37Rv
guagguuuucggcggcu

SEQ ID NO: 1358226 - RNA, 18 nt, Mycobacterium tuberculosis H37Rv
guaggugcaugucgauga

SEQ ID NO: 1358227 - RNA, 21 nt, Mycobacterium tuberculosis H37Rv
guaggucugggcaagaccgcg

SEQ ID NO: 1358228 - RNA, 13 nt, Mycobacterium tuberculosis H37Rv
guaggugggcucg

SEQ ID NO: 1358229 - RNA, 18 nt, Mycobacterium tuberculosis H37Rv
guagguggggcacuucca

SEQ ID NO: 1358230 - RNA, 11 nt, Mycobacterium tuberculosis H37Rv
guagggacgcc

SEQ ID NO: 1358231 - RNA, 15 nt, Mycobacterium tuberculosis H37Rv
guaggcuuccagcuc

SEQ ID NO: 1358232 - RNA, 22 nt, Mycobacterium tuberculosis H37Rv
guaggcuucgaccguggugguc

SEQ ID NO: 1358233 - RNA, 17 nt, Mycobacterium tuberculosis H37Rv
guaggcgaugagcgugc

SEQ ID NO: 1358234 - RNA, 13 nt, Mycobacterium tuberculosis H37Rv
guaggcgccgcga

SEQ ID NO: 1358235 - RNA, 13 nt, Mycobacterium tuberculosis H37Rv
guaggcggcggcc

SEQ ID NO: 1358236 - RNA, 19 nt, Mycobacterium tuberculosis H37Rv
guaggccuccgcugccgcc

SEQ ID NO: 1358237 - RNA, 16 nt, Mycobacterium tuberculosis H37Rv
guaggccucggcagca

SEQ ID NO: 1358238 - RNA, 14 nt, Mycobacterium tuberculosis H37Rv
guagcgguccagcg

SEQ ID NO: 1358239 - RNA, 18 nt, Mycobacterium tuberculosis H37Rv
guagcgcaaugcggcccg

SEQ ID NO: 1358240 - RNA, 20 nt, Mycobacterium tuberculosis H37Rv
guagcgcucgaucagguugg

SEQ ID NO: 1358241 - RNA, 14 nt, Mycobacterium tuberculosis H37Rv
guagccggccgcuu

SEQ ID NO: 1358242 - RNA, 22 nt, Mycobacterium tuberculosis H37Rv
guagccgagguucaaagcagcg

SEQ ID NO: 1358243 - RNA, 20 nt, Mycobacterium tuberculosis H37Rv
guagcucuuugagugccgug

SEQ ID NO: 1358244 - RNA, 15 nt, Mycobacterium tuberculosis H37Rv
guagcugacggccug

SEQ ID NO: 1358245 - RNA, 19 nt, Mycobacterium tuberculosis H37Rv
guagcucgguaggccggca

SEQ ID NO: 1358246 - RNA, 16 nt, Mycobacterium tuberculosis H37Rv
guagcucgucgaggaa

SEQ ID NO: 1358247 - RNA, 20 nt, Mycobacterium tuberculosis H37Rv
guagcucgucgaggaagauc

SEQ ID NO: 1358248 - RNA, 15 nt, Mycobacterium tuberculosis H37Rv
guagcguucccacac

SEQ ID NO: 1358249 - RNA, 18 nt, Mycobacterium tuberculosis H37Rv
guagcuucggguccagcg

SEQ ID NO: 1358250 - RNA, 18 nt, Mycobacterium tuberculosis H37Rv
guagcuguggcccgcggu

SEQ ID NO: 1358251 - RNA, 19 nt, Mycobacterium tuberculosis H37Rv
guagcuggucccacaccuc

SEQ ID NO: 1358252 - RNA, 19 nt, Mycobacterium tuberculosis H37Rv
guagcugacggccugcaac

SEQ ID NO: 1358253 - RNA, 20 nt, Mycobacterium tuberculosis H37Rv
guaggcaggaucgccugagc

SEQ ID NO: 1358254 - RNA, 19 nt, Mycobacterium tuberculosis H37Rv
guaggagaacgucaaaccc

SEQ ID NO: 1358255 - RNA, 14 nt, Mycobacterium tuberculosis H37Rv
guaguucugauuca

SEQ ID NO: 1358256 - RNA, 18 nt, Mycobacterium tuberculosis H37Rv
guauaggccguugaucgu

SEQ ID NO: 1358257 - RNA, 23 nt, Mycobacterium tuberculosis H37Rv
guaucgaagcucaauuccaugca

SEQ ID NO: 1358258 - RNA, 14 nt, Mycobacterium tuberculosis H37Rv
guaucgagaugcca

SEQ ID NO: 1358259 - RNA, 23 nt, Mycobacterium tuberculosis H37Rv
guaugagcuuccgcgcgcagaug

SEQ ID NO: 1358260 - RNA, 17 nt, Mycobacterium tuberculosis H37Rv
guaugccgcccgcagcg

SEQ ID NO: 1358261 - RNA, 17 nt, Mycobacterium tuberculosis H37Rv
guaugcccggacgggga

SEQ ID NO: 1358262 - RNA, 22 nt, Mycobacterium tuberculosis H37Rv
guauggcggcgacggccgcucg

SEQ ID NO: 1358263 - RNA, 18 nt, Mycobacterium tuberculosis H37Rv
guauggacgaggagcuca

SEQ ID NO: 1358264 - RNA, 20 nt, Mycobacterium tuberculosis H37Rv
guauugaucgaauacaccug

SEQ ID NO: 1358265 - RNA, 19 nt, Mycobacterium tuberculosis H37Rv
guauugcaccgcggccagc

SEQ ID NO: 1358266 - RNA, 21 nt, Mycobacterium tuberculosis H37Rv
guauucccgcuuggcgugacc

SEQ ID NO: 1358267 - RNA, 22 nt, Mycobacterium tuberculosis H37Rv
guauucccgcuuggcgugaccu

SEQ ID NO: 1358268 - RNA, 14 nt, Mycobacterium tuberculosis H37Rv
guauucccacugca

SEQ ID NO: 1358269 - RNA, 15 nt, Mycobacterium tuberculosis H37Rv
guauuggucgguggg

SEQ ID NO: 1358270 - RNA, 16 nt, Mycobacterium tuberculosis H37Rv
gucaacacccgcccgg

SEQ ID NO: 1358271 - RNA, 18 nt, Mycobacterium tuberculosis H37Rv
gucaacacccgcccgggc

SEQ ID NO: 1358272 - RNA, 18 nt, Mycobacterium tuberculosis H37Rv
gucaacagcggcaagaag

SEQ ID NO: 1358273 - RNA, 18 nt, Mycobacterium tuberculosis H37Rv
gucaacagccagggcaac

SEQ ID NO: 1358274 - RNA, 22 nt, Mycobacterium tuberculosis H37Rv
gucaccgucugcaccggcaggc

SEQ ID NO: 1358275 - RNA, 19 nt, Mycobacterium tuberculosis H37Rv
gucaccggcgucgcugccu

SEQ ID NO: 1358276 - RNA, 20 nt, Mycobacterium tuberculosis H37Rv
gucaccggcuucuccuccag

SEQ ID NO: 1358277 - RNA, 13 nt, Mycobacterium tuberculosis H37Rv
gucaccggccgcc

SEQ ID NO: 1358278 - RNA, 14 nt, Mycobacterium tuberculosis H37Rv
gucaccggcgcacc

SEQ ID NO: 1358279 - RNA, 21 nt, Mycobacterium tuberculosis H37Rv
gucacccacguugaugaugcc

SEQ ID NO: 1358280 - RNA, 17 nt, Mycobacterium tuberculosis H37Rv
gucaccauagcucaggg

SEQ ID NO: 1358281 - RNA, 13 nt, Mycobacterium tuberculosis H37Rv
gucaccagcgcau

SEQ ID NO: 1358282 - RNA, 16 nt, Mycobacterium tuberculosis H37Rv
gucaccaaacccgaug

SEQ ID NO: 1358283 - RNA, 16 nt, Mycobacterium tuberculosis H37Rv
gucacugugacgccgg

SEQ ID NO: 1358284 - RNA, 14 nt, Mycobacterium tuberculosis H37Rv
gucacgaccugcuc

SEQ ID NO: 1358285 - RNA, 14 nt, Mycobacterium tuberculosis H37Rv
gucacuguaccggg

SEQ ID NO: 1358286 - RNA, 16 nt, Mycobacterium tuberculosis H37Rv
gucacuguaccgggcg

SEQ ID NO: 1358287 - RNA, 19 nt, Mycobacterium tuberculosis H37Rv
gucacgaucacgauguccu

SEQ ID NO: 1358288 - RNA, 20 nt, Mycobacterium tuberculosis H37Rv
gucaccuucuuggcggguga

SEQ ID NO: 1358289 - RNA, 16 nt, Mycobacterium tuberculosis H37Rv
gucaccugcugcaacc

SEQ ID NO: 1358290 - RNA, 15 nt, Mycobacterium tuberculosis H37Rv
gucaccugcugcaac

SEQ ID NO: 1358291 - RNA, 21 nt, Mycobacterium tuberculosis H37Rv
gucaacgacgacgacaagugc

SEQ ID NO: 1358292 - RNA, 23 nt, Mycobacterium tuberculosis H37Rv
gucaacgcuagcgucgugucggg

SEQ ID NO: 1358293 - RNA, 18 nt, Mycobacterium tuberculosis H37Rv
gucaaccaagcgugccug

SEQ ID NO: 1358294 - RNA, 12 nt, Mycobacterium tuberculosis H37Rv
gucaagucuggc

SEQ ID NO: 1358295 - RNA, 15 nt, Mycobacterium tuberculosis H37Rv
gucaagucugugcuc

SEQ ID NO: 1358296 - RNA, 13 nt, Mycobacterium tuberculosis H37Rv
gucacaguucugc

SEQ ID NO: 1358297 - RNA, 17 nt, Mycobacterium tuberculosis H37Rv
gucacacguuggcagcc

SEQ ID NO: 1358298 - RNA, 14 nt, Mycobacterium tuberculosis H37Rv
gucacacccacacc

SEQ ID NO: 1358299 - RNA, 15 nt, Mycobacterium tuberculosis H37Rv
gucacaagccugccg

SEQ ID NO: 1358300 - RNA, 17 nt, Mycobacterium tuberculosis H37Rv
gucagcacaaacccagu

SEQ ID NO: 1358301 - RNA, 19 nt, Mycobacterium tuberculosis H37Rv
gucagcacccaacccggcg

SEQ ID NO: 1358302 - RNA, 16 nt, Mycobacterium tuberculosis H37Rv
gucagcaccaccagca

SEQ ID NO: 1358303 - RNA, 12 nt, Mycobacterium tuberculosis H37Rv
gucagcgcgucg

SEQ ID NO: 1358304 - RNA, 12 nt, Mycobacterium tuberculosis H37Rv
gucagcggcggc

SEQ ID NO: 1358305 - RNA, 22 nt, Mycobacterium tuberculosis H37Rv
gucagcggcucggcgggggacc

SEQ ID NO: 1358306 - RNA, 14 nt, Mycobacterium tuberculosis H37Rv
gucagcggcugggc

SEQ ID NO: 1358307 - RNA, 14 nt, Mycobacterium tuberculosis H37Rv
gucagcgggcagca

SEQ ID NO: 1358308 - RNA, 19 nt, Mycobacterium tuberculosis H37Rv
gucagcucggcagcaucuc

SEQ ID NO: 1358309 - RNA, 15 nt, Mycobacterium tuberculosis H37Rv
gucagcucgaccuga

SEQ ID NO: 1358310 - RNA, 14 nt, Mycobacterium tuberculosis H37Rv
gucagaacggcggc

SEQ ID NO: 1358311 - RNA, 20 nt, Mycobacterium tuberculosis H37Rv
gucagaacaccggccaggcc

SEQ ID NO: 1358312 - RNA, 12 nt, Mycobacterium tuberculosis H37Rv
gucagacgccgg

SEQ ID NO: 1358313 - RNA, 22 nt, Mycobacterium tuberculosis H37Rv
gucagaauugugugcagcagca

SEQ ID NO: 1358314 - RNA, 14 nt, Mycobacterium tuberculosis H37Rv
gucagauagugcau

SEQ ID NO: 1358315 - RNA, 17 nt, Mycobacterium tuberculosis H37Rv
gucagauggccacccgc

SEQ ID NO: 1358316 - RNA, 20 nt, Mycobacterium tuberculosis H37Rv
gucagauggccacccgcgga

SEQ ID NO: 1358317 - RNA, 24 nt, Mycobacterium tuberculosis H37Rv
gucagcaauacggcggcgccgccc

SEQ ID NO: 1358318 - RNA, 13 nt, Mycobacterium tuberculosis H37Rv
gucaguagccacg

SEQ ID NO: 1358319 - RNA, 21 nt, Mycobacterium tuberculosis H37Rv
gucaguccucaucgagcgcgc

SEQ ID NO: 1358320 - RNA, 14 nt, Mycobacterium tuberculosis H37Rv
gucagucaccaacc

SEQ ID NO: 1358321 - RNA, 17 nt, Mycobacterium tuberculosis H37Rv
gucagugccccgcccgg

SEQ ID NO: 1358322 - RNA, 14 nt, Mycobacterium tuberculosis H37Rv
gucaugcccaggug

SEQ ID NO: 1358323 - RNA, 14 nt, Mycobacterium tuberculosis H37Rv
gucauacccagcuc

SEQ ID NO: 1358324 - RNA, 16 nt, Mycobacterium tuberculosis H37Rv
gucauagagcucgccg

SEQ ID NO: 1358325 - RNA, 22 nt, Mycobacterium tuberculosis H37Rv
gucauagagcucgccggugcgc

SEQ ID NO: 1358326 - RNA, 16 nt, Mycobacterium tuberculosis H37Rv
guccacugaucaggcc

SEQ ID NO: 1358327 - RNA, 15 nt, Mycobacterium tuberculosis H37Rv
guccacgcacugccg

SEQ ID NO: 1358328 - RNA, 20 nt, Mycobacterium tuberculosis H37Rv
guccagauaggccaaccggu

SEQ ID NO: 1358329 - RNA, 19 nt, Mycobacterium tuberculosis H37Rv
guccagcaacagcgagcgg

SEQ ID NO: 1358330 - RNA, 19 nt, Mycobacterium tuberculosis H37Rv
guccagcaccugccguucc

SEQ ID NO: 1358331 - RNA, 18 nt, Mycobacterium tuberculosis H37Rv
gucccgugcgcgcgcagc

SEQ ID NO: 1358332 - RNA, 18 nt, Mycobacterium tuberculosis H37Rv
gucccugaagccagcgca

SEQ ID NO: 1358333 - RNA, 23 nt, Mycobacterium tuberculosis H37Rv
gucccuuguggucugccagcacc

SEQ ID NO: 1358334 - RNA, 16 nt, Mycobacterium tuberculosis H37Rv
guccgaaagccgccga

SEQ ID NO: 1358335 - RNA, 15 nt, Mycobacterium tuberculosis H37Rv
guccgacuucuccag

SEQ ID NO: 1358336 - RNA, 15 nt, Mycobacterium tuberculosis H37Rv
gucccguugccgccc

SEQ ID NO: 1358337 - RNA, 23 nt, Mycobacterium tuberculosis H37Rv
guccccgcuuggcgagccacggc

SEQ ID NO: 1358338 - RNA, 21 nt, Mycobacterium tuberculosis H37Rv
guccccaggugggcagcaggc

SEQ ID NO: 1358339 - RNA, 19 nt, Mycobacterium tuberculosis H37Rv
guccccagacagaccccca

SEQ ID NO: 1358340 - RNA, 18 nt, Mycobacterium tuberculosis H37Rv
guccccgcccggccagcu

SEQ ID NO: 1358341 - RNA, 20 nt, Mycobacterium tuberculosis H37Rv
guccccgacgucaggcagcu

SEQ ID NO: 1358342 - RNA, 21 nt, Mycobacterium tuberculosis H37Rv
guccauguuuugcugcaugcc

SEQ ID NO: 1358343 - RNA, 16 nt, Mycobacterium tuberculosis H37Rv
guccaugugcccaggu

SEQ ID NO: 1358344 - RNA, 15 nt, Mycobacterium tuberculosis H37Rv
gucccacgccagcgc

SEQ ID NO: 1358345 - RNA, 20 nt, Mycobacterium tuberculosis H37Rv
gucccacaccuucggcuggu

SEQ ID NO: 1358346 - RNA, 14 nt, Mycobacterium tuberculosis H37Rv
gucccacggccggc

SEQ ID NO: 1358347 - RNA, 21 nt, Mycobacterium tuberculosis H37Rv
gucccacguugcugaugcccu

SEQ ID NO: 1358348 - RNA, 18 nt, Mycobacterium tuberculosis H37Rv
gucccauuugccuugagc

SEQ ID NO: 1358349 - RNA, 14 nt, Mycobacterium tuberculosis H37Rv
guccagggcgacga

SEQ ID NO: 1358350 - RNA, 16 nt, Mycobacterium tuberculosis H37Rv
guccaggguggucagu

SEQ ID NO: 1358351 - RNA, 16 nt, Mycobacterium tuberculosis H37Rv
guccaggucggccgcc

SEQ ID NO: 1358352 - RNA, 13 nt, Mycobacterium tuberculosis H37Rv
guccagggccugu

SEQ ID NO: 1358353 - RNA, 21 nt, Mycobacterium tuberculosis H37Rv
guccaggcggugacguggugg

SEQ ID NO: 1358354 - RNA, 22 nt, Mycobacterium tuberculosis H37Rv
guccacgcgcucggugccgccc

SEQ ID NO: 1358355 - RNA, 20 nt, Mycobacterium tuberculosis H37Rv
guccagcagcgacgcugccg

SEQ ID NO: 1358356 - RNA, 21 nt, Mycobacterium tuberculosis H37Rv
gucgaaucuucugagacugcc

SEQ ID NO: 1358357 - RNA, 20 nt, Mycobacterium tuberculosis H37Rv
gucgaagugguaguccaggg

SEQ ID NO: 1358358 - RNA, 16 nt, Mycobacterium tuberculosis H37Rv
gucgacaaacagcgcc

SEQ ID NO: 1358359 - RNA, 17 nt, Mycobacterium tuberculosis H37Rv
gucgacuucagcggccg

SEQ ID NO: 1358360 - RNA, 15 nt, Mycobacterium tuberculosis H37Rv
gucgacucggcggcg

SEQ ID NO: 1358361 - RNA, 22 nt, Mycobacterium tuberculosis H37Rv
gucgacuguucgggaugcagcu

SEQ ID NO: 1358362 - RNA, 17 nt, Mycobacterium tuberculosis H37Rv
gucgacaccgaggaccu

SEQ ID NO: 1358363 - RNA, 13 nt, Mycobacterium tuberculosis H37Rv
gucgaacugggcg

SEQ ID NO: 1358364 - RNA, 20 nt, Mycobacterium tuberculosis H37Rv
gucgaagaauaugccgauga

SEQ ID NO: 1358365 - RNA, 14 nt, Mycobacterium tuberculosis H37Rv
gucgaagcacaugc

SEQ ID NO: 1358366 - RNA, 17 nt, Mycobacterium tuberculosis H37Rv
gucgaagaucgccuggg

SEQ ID NO: 1358367 - RNA, 20 nt, Mycobacterium tuberculosis H37Rv
gucgaagccccucaccucgg

SEQ ID NO: 1358368 - RNA, 16 nt, Mycobacterium tuberculosis H37Rv
gucgagggagcgccgc

SEQ ID NO: 1358369 - RNA, 19 nt, Mycobacterium tuberculosis H37Rv
gucgagcaccuuggggugg

SEQ ID NO: 1358370 - RNA, 16 nt, Mycobacterium tuberculosis H37Rv
gucgagcacgcugcug

SEQ ID NO: 1358371 - RNA, 19 nt, Mycobacterium tuberculosis H37Rv
gucgagcaccugccgaucg

SEQ ID NO: 1358372 - RNA, 13 nt, Mycobacterium tuberculosis H37Rv
gucgacuugcagg

SEQ ID NO: 1358373 - RNA, 22 nt, Mycobacterium tuberculosis H37Rv
gucgagauagccgacgucgccg

SEQ ID NO: 1358374 - RNA, 20 nt, Mycobacterium tuberculosis H37Rv
gucgagcaacgugacccgga

SEQ ID NO: 1358375 - RNA, 21 nt, Mycobacterium tuberculosis H37Rv
gucgagauccucgucgagguc

SEQ ID NO: 1358376 - RNA, 14 nt, Mycobacterium tuberculosis H37Rv
gucgaugacgccgu

SEQ ID NO: 1358377 - RNA, 22 nt, Mycobacterium tuberculosis H37Rv
gucgagucgguccugccaaugc

SEQ ID NO: 1358378 - RNA, 16 nt, Mycobacterium tuberculosis H37Rv
gucgaugacgaacgga

SEQ ID NO: 1358379 - RNA, 21 nt, Mycobacterium tuberculosis H37Rv
gucgaugcgcugcucacgcag

SEQ ID NO: 1358380 - RNA, 17 nt, Mycobacterium tuberculosis H37Rv
gucgaugccggcugccg

SEQ ID NO: 1358381 - RNA, 15 nt, Mycobacterium tuberculosis H37Rv
gucgagguggggugg

SEQ ID NO: 1358382 - RNA, 12 nt, Mycobacterium tuberculosis H37Rv
gucgaggucggc

SEQ ID NO: 1358383 - RNA, 17 nt, Mycobacterium tuberculosis H37Rv
gucgaggucagugggcg

SEQ ID NO: 1358384 - RNA, 18 nt, Mycobacterium tuberculosis H37Rv
gucgagguccucgagguc

SEQ ID NO: 1358385 - RNA, 20 nt, Mycobacterium tuberculosis H37Rv
gucgagugccucgaccugga

SEQ ID NO: 1358386 - RNA, 22 nt, Mycobacterium tuberculosis H37Rv
gucgagugcggacuucgccgcc

SEQ ID NO: 1358387 - RNA, 19 nt, Mycobacterium tuberculosis H37Rv
gucgaguguggcgacgcac

SEQ ID NO: 1358388 - RNA, 22 nt, Mycobacterium tuberculosis H37Rv
gucgaguucgcagucgaugagu

SEQ ID NO: 1358389 - RNA, 20 nt, Mycobacterium tuberculosis H37Rv
gucgauugccaccgagauca

SEQ ID NO: 1358390 - RNA, 19 nt, Mycobacterium tuberculosis H37Rv
gucgauguccccggcggca

SEQ ID NO: 1358391 - RNA, 14 nt, Mycobacterium tuberculosis H37Rv
gucgcagcucgucg

SEQ ID NO: 1358392 - RNA, 15 nt, Mycobacterium tuberculosis H37Rv
gucgcagugcaagcg

SEQ ID NO: 1358393 - RNA, 16 nt, Mycobacterium tuberculosis H37Rv
gucgccaagugcaggg

SEQ ID NO: 1358394 - RNA, 22 nt, Mycobacterium tuberculosis H37Rv
gucgccaagaucggguggcggg

SEQ ID NO: 1358395 - RNA, 15 nt, Mycobacterium tuberculosis H37Rv
gucgccaagcccagg

SEQ ID NO: 1358396 - RNA, 22 nt, Mycobacterium tuberculosis H37Rv
gucgccaacgccagcaccagcg

SEQ ID NO: 1358397 - RNA, 15 nt, Mycobacterium tuberculosis H37Rv
gucgccaacgccagc

SEQ ID NO: 1358398 - RNA, 18 nt, Mycobacterium tuberculosis H37Rv
gucgaaccgccggcugcg

SEQ ID NO: 1358399 - RNA, 17 nt, Mycobacterium tuberculosis H37Rv
gucgaaccaguccucgg

SEQ ID NO: 1358400 - RNA, 22 nt, Mycobacterium tuberculosis H37Rv
gucgaacagcgaaccggcuggg

SEQ ID NO: 1358401 - RNA, 14 nt, Mycobacterium tuberculosis H37Rv
gucgaacaucaucg

SEQ ID NO: 1358402 - RNA, 22 nt, Mycobacterium tuberculosis H37Rv
guccuguccgggcugcaugcgg

SEQ ID NO: 1358403 - RNA, 18 nt, Mycobacterium tuberculosis H37Rv
gucgaaacgguacgccgc

SEQ ID NO: 1358404 - RNA, 23 nt, Mycobacterium tuberculosis H37Rv
guccucgucuucgucgguguccu

SEQ ID NO: 1358405 - RNA, 16 nt, Mycobacterium tuberculosis H37Rv
guccucgggcaggcgg

SEQ ID NO: 1358406 - RNA, 21 nt, Mycobacterium tuberculosis H37Rv
guccugaaucgguucggccag

SEQ ID NO: 1358407 - RNA, 22 nt, Mycobacterium tuberculosis H37Rv
guccugaaucgguucggccaga

SEQ ID NO: 1358408 - RNA, 19 nt, Mycobacterium tuberculosis H37Rv
guccgagcuuggccgccgc

SEQ ID NO: 1358409 - RNA, 21 nt, Mycobacterium tuberculosis H37Rv
guccgaugcgugccgacccgc

SEQ ID NO: 1358410 - RNA, 14 nt, Mycobacterium tuberculosis H37Rv
guccgcccagcacc

SEQ ID NO: 1358411 - RNA, 17 nt, Mycobacterium tuberculosis H37Rv
guccgccaccgcgagca

SEQ ID NO: 1358412 - RNA, 21 nt, Mycobacterium tuberculosis H37Rv
guccgcacgaucugcaggccc

SEQ ID NO: 1358413 - RNA, 20 nt, Mycobacterium tuberculosis H37Rv
guccgcgcgaacgucaaccg

SEQ ID NO: 1358414 - RNA, 22 nt, Mycobacterium tuberculosis H37Rv
guccgcggagaacaucccccgg

SEQ ID NO: 1358415 - RNA, 23 nt, Mycobacterium tuberculosis H37Rv
guccgcgcccaccggcuagcugu

SEQ ID NO: 1358416 - RNA, 15 nt, Mycobacterium tuberculosis H37Rv
guccgcgauggccgc

SEQ ID NO: 1358417 - RNA, 21 nt, Mycobacterium tuberculosis H37Rv
guccgcgaacgauuucggccc

SEQ ID NO: 1358418 - RNA, 12 nt, Mycobacterium tuberculosis H37Rv
guccgccgcaga

SEQ ID NO: 1358419 - RNA, 21 nt, Mycobacterium tuberculosis H37Rv
guccgccuaagcauucagcgc

SEQ ID NO: 1358420 - RNA, 17 nt, Mycobacterium tuberculosis H37Rv
guccguacuugccaccc

SEQ ID NO: 1358421 - RNA, 23 nt, Mycobacterium tuberculosis H37Rv
guccguagugaucgcaaaggccc

SEQ ID NO: 1358422 - RNA, 13 nt, Mycobacterium tuberculosis H37Rv
guccggugcuggu

SEQ ID NO: 1358423 - RNA, 15 nt, Mycobacterium tuberculosis H37Rv
guccgguccgucggg

SEQ ID NO: 1358424 - RNA, 22 nt, Mycobacterium tuberculosis H37Rv
guccggucgccucaccggcgcg

SEQ ID NO: 1358425 - RNA, 16 nt, Mycobacterium tuberculosis H37Rv
guccgguggacgcaga

SEQ ID NO: 1358426 - RNA, 19 nt, Mycobacterium tuberculosis H37Rv
guccgguggaauccaccag

SEQ ID NO: 1358427 - RNA, 14 nt, Mycobacterium tuberculosis H37Rv
guccgucggggaca

SEQ ID NO: 1358428 - RNA, 13 nt, Mycobacterium tuberculosis H37Rv
guccgucggggac

SEQ ID NO: 1358429 - RNA, 14 nt, Mycobacterium tuberculosis H37Rv
guccguccaugagg

SEQ ID NO: 1358430 - RNA, 15 nt, Mycobacterium tuberculosis H37Rv
guccguggacaagca

SEQ ID NO: 1358431 - RNA, 19 nt, Mycobacterium tuberculosis H37Rv
guccguucaccgucugcgg

SEQ ID NO: 1358432 - RNA, 21 nt, Mycobacterium tuberculosis H37Rv
guccucgagcggcagaugaau

SEQ ID NO: 1358433 - RNA, 22 nt, Mycobacterium tuberculosis H37Rv
guccucgagugccgccgucgcc

SEQ ID NO: 1358434 - RNA, 21 nt, Mycobacterium tuberculosis H37Rv
guccucgacccggcgcagcaa

SEQ ID NO: 1358435 - RNA, 22 nt, Mycobacterium tuberculosis H37Rv
guccucgcuauugggugcagug

SEQ ID NO: 1358436 - RNA, 13 nt, Mycobacterium tuberculosis H37Rv
gucgccaggucau

SEQ ID NO: 1358437 - RNA, 17 nt, Mycobacterium tuberculosis H37Rv
gucgccccaagcgccug

SEQ ID NO: 1358438 - RNA, 14 nt, Mycobacterium tuberculosis H37Rv
gucgccccaugcgg

SEQ ID NO: 1358439 - RNA, 18 nt, Mycobacterium tuberculosis H37Rv
gucgccauccucgagcug

SEQ ID NO: 1358440 - RNA, 14 nt, Mycobacterium tuberculosis H37Rv
gucgccaccgccgg

SEQ ID NO: 1358441 - RNA, 17 nt, Mycobacterium tuberculosis H37Rv
gucgccaagaucgggug

SEQ ID NO: 1358442 - RNA, 18 nt, Mycobacterium tuberculosis H37Rv
gucgccagggagcgcagc

SEQ ID NO: 1358443 - RNA, 13 nt, Mycobacterium tuberculosis H37Rv
gucgccagggccg

SEQ ID NO: 1358444 - RNA, 13 nt, Mycobacterium tuberculosis H37Rv
gucgcgguggugg

SEQ ID NO: 1358445 - RNA, 14 nt, Mycobacterium tuberculosis H37Rv
gucgcgcugaaggu

SEQ ID NO: 1358446 - RNA, 19 nt, Mycobacterium tuberculosis H37Rv
gucgcgggcgauggcgagc

SEQ ID NO: 1358447 - RNA, 21 nt, Mycobacterium tuberculosis H37Rv
gucgcgggcgauggcgagcug

SEQ ID NO: 1358448 - RNA, 21 nt, Mycobacterium tuberculosis H37Rv
gucgcgguaccaucaccgcgc

SEQ ID NO: 1358449 - RNA, 16 nt, Mycobacterium tuberculosis H37Rv
gucgcgcccucagccg

SEQ ID NO: 1358450 - RNA, 13 nt, Mycobacterium tuberculosis H37Rv
gucgcgccugccc

SEQ ID NO: 1358451 - RNA, 17 nt, Mycobacterium tuberculosis H37Rv
gucgcgcagcuccaccg

SEQ ID NO: 1358452 - RNA, 14 nt, Mycobacterium tuberculosis H37Rv
gucggaccagcugc

SEQ ID NO: 1358453 - RNA, 19 nt, Mycobacterium tuberculosis H37Rv
gucggaccagcugccggcg

SEQ ID NO: 1358454 - RNA, 23 nt, Mycobacterium tuberculosis H37Rv
gucggaggugaaccccgccggca

SEQ ID NO: 1358455 - RNA, 16 nt, Mycobacterium tuberculosis H37Rv
gucggagccggccacc

SEQ ID NO: 1358456 - RNA, 16 nt, Mycobacterium tuberculosis H37Rv
gucggagagcaugcgg

SEQ ID NO: 1358457 - RNA, 16 nt, Mycobacterium tuberculosis H37Rv
gucgcgucggcugccg

SEQ ID NO: 1358458 - RNA, 18 nt, Mycobacterium tuberculosis H37Rv
gucggaauacaacagcug

SEQ ID NO: 1358459 - RNA, 21 nt, Mycobacterium tuberculosis H37Rv
gucggaauacaacagcugggu

SEQ ID NO: 1358460 - RNA, 19 nt, Mycobacterium tuberculosis H37Rv
gucggccggcucguccggg

SEQ ID NO: 1358461 - RNA, 16 nt, Mycobacterium tuberculosis H37Rv
gucggccgcgcugcug

SEQ ID NO: 1358462 - RNA, 19 nt, Mycobacterium tuberculosis H37Rv
gucggccggggccacccgc

SEQ ID NO: 1358463 - RNA, 20 nt, Mycobacterium tuberculosis H37Rv
gucggccugcgccggcgcug

SEQ ID NO: 1358464 - RNA, 14 nt, Mycobacterium tuberculosis H37Rv
gucggccugcggca

SEQ ID NO: 1358465 - RNA, 21 nt, Mycobacterium tuberculosis H37Rv
gucggccuggcaggguggggc

SEQ ID NO: 1358466 - RNA, 19 nt, Mycobacterium tuberculosis H37Rv
gucggcgaccaccagcgcc

SEQ ID NO: 1358467 - RNA, 15 nt, Mycobacterium tuberculosis H37Rv
gucggcgaagcgggc

SEQ ID NO: 1358468 - RNA, 19 nt, Mycobacterium tuberculosis H37Rv
gucggcgaacgcguccagc

SEQ ID NO: 1358469 - RNA, 18 nt, Mycobacterium tuberculosis H37Rv
gucggcccgcucaccuug

SEQ ID NO: 1358470 - RNA, 16 nt, Mycobacterium tuberculosis H37Rv
gucggcaacgacccgc

SEQ ID NO: 1358471 - RNA, 16 nt, Mycobacterium tuberculosis H37Rv
gucggaucggcgccgc

SEQ ID NO: 1358472 - RNA, 14 nt, Mycobacterium tuberculosis H37Rv
gucguagagauacg

SEQ ID NO: 1358473 - RNA, 13 nt, Mycobacterium tuberculosis H37Rv
gucguaggccgca

SEQ ID NO: 1358474 - RNA, 20 nt, Mycobacterium tuberculosis H37Rv
gucguagaggugccuuugga

SEQ ID NO: 1358475 - RNA, 21 nt, Mycobacterium tuberculosis H37Rv
gucguagaggacugcggucug

SEQ ID NO: 1358476 - RNA, 21 nt, Mycobacterium tuberculosis H37Rv
gucgucaaacacucugaucug

SEQ ID NO: 1358477 - RNA, 23 nt, Mycobacterium tuberculosis H37Rv
gucggucggaucggcgccgcaua

SEQ ID NO: 1358478 - RNA, 12 nt, Mycobacterium tuberculosis H37Rv
gucgguccacuu

SEQ ID NO: 1358479 - RNA, 21 nt, Mycobacterium tuberculosis H37Rv
gucggugaaauucgcggcggu

SEQ ID NO: 1358480 - RNA, 22 nt, Mycobacterium tuberculosis H37Rv
gucggucagcugugcgacccgc

SEQ ID NO: 1358481 - RNA, 13 nt, Mycobacterium tuberculosis H37Rv
gucggucaccugg

SEQ ID NO: 1358482 - RNA, 17 nt, Mycobacterium tuberculosis H37Rv
gucggcgcuggccgucg

SEQ ID NO: 1358483 - RNA, 21 nt, Mycobacterium tuberculosis H37Rv
gucggguugguuggcucgcug

SEQ ID NO: 1358484 - RNA, 23 nt, Mycobacterium tuberculosis H37Rv
gucggguugguuggcucgcuggg

SEQ ID NO: 1358485 - RNA, 22 nt, Mycobacterium tuberculosis H37Rv
gucggcggcgaacagccccagg

SEQ ID NO: 1358486 - RNA, 13 nt, Mycobacterium tuberculosis H37Rv
gucggguggcugc

SEQ ID NO: 1358487 - RNA, 19 nt, Mycobacterium tuberculosis H37Rv
gucgggguuucaggcggca

SEQ ID NO: 1358488 - RNA, 15 nt, Mycobacterium tuberculosis H37Rv
gucggguaggccgcc

SEQ ID NO: 1358489 - RNA, 20 nt, Mycobacterium tuberculosis H37Rv
gucgggucaaugcuggcagc

SEQ ID NO: 1358490 - RNA, 17 nt, Mycobacterium tuberculosis H37Rv
gucggguccaacgccgc

SEQ ID NO: 1358491 - RNA, 17 nt, Mycobacterium tuberculosis H37Rv
gucgggugcagcacggc

SEQ ID NO: 1358492 - RNA, 20 nt, Mycobacterium tuberculosis H37Rv
gucggcgagcaauuccucag

SEQ ID NO: 1358493 - RNA, 19 nt, Mycobacterium tuberculosis H37Rv
gucggcgauggccagcacg

SEQ ID NO: 1358494 - RNA, 16 nt, Mycobacterium tuberculosis H37Rv
gucggcgauggccagc

SEQ ID NO: 1358495 - RNA, 12 nt, Mycobacterium tuberculosis H37Rv
gucggcgcgccg

SEQ ID NO: 1358496 - RNA, 20 nt, Mycobacterium tuberculosis H37Rv
gucggcgccgagcagcccgc

SEQ ID NO: 1358497 - RNA, 13 nt, Mycobacterium tuberculosis H37Rv
gucgucggccauc

SEQ ID NO: 1358498 - RNA, 22 nt, Mycobacterium tuberculosis H37Rv
gucgucggccccacaagucgcg

SEQ ID NO: 1358499 - RNA, 14 nt, Mycobacterium tuberculosis H37Rv
gucguccggccacg

SEQ ID NO: 1358500 - RNA, 13 nt, Mycobacterium tuberculosis H37Rv
gucgucggcggcg

SEQ ID NO: 1358501 - RNA, 23 nt, Mycobacterium tuberculosis H37Rv
gucgucggcggcgaacagcccca

SEQ ID NO: 1358502 - RNA, 16 nt, Mycobacterium tuberculosis H37Rv
gucgucgcggccgcuc

SEQ ID NO: 1358503 - RNA, 14 nt, Mycobacterium tuberculosis H37Rv
gucgucgccgccgg

SEQ ID NO: 1358504 - RNA, 16 nt, Mycobacterium tuberculosis H37Rv
gucgucgccggcgcuc

SEQ ID NO: 1358505 - RNA, 22 nt, Mycobacterium tuberculosis H37Rv
gucgucgccggcggcggugcgc

SEQ ID NO: 1358506 - RNA, 23 nt, Mycobacterium tuberculosis H37Rv
gucgucgaaguuggcgaagcccg

SEQ ID NO: 1358507 - RNA, 23 nt, Mycobacterium tuberculosis H37Rv
gucgucgauuagcccacccaugg

SEQ ID NO: 1358508 - RNA, 15 nt, Mycobacterium tuberculosis H37Rv
gucgucccagggcug

SEQ ID NO: 1358509 - RNA, 17 nt, Mycobacterium tuberculosis H37Rv
gucgucauccuggucac

SEQ ID NO: 1358510 - RNA, 19 nt, Mycobacterium tuberculosis H37Rv
gucgucccgauggcggugg

SEQ ID NO: 1358511 - RNA, 18 nt, Mycobacterium tuberculosis H37Rv
gucgucccagggcugccg

SEQ ID NO: 1358512 - RNA, 18 nt, Mycobacterium tuberculosis H37Rv
gucguccgccgcagcgca

SEQ ID NO: 1358513 - RNA, 13 nt, Mycobacterium tuberculosis H37Rv
gucuaaugagguc

SEQ ID NO: 1358514 - RNA, 17 nt, Mycobacterium tuberculosis H37Rv
gucuaaggaugaccuuc

SEQ ID NO: 1358515 - RNA, 18 nt, Mycobacterium tuberculosis H37Rv
gucguuuggcgccgccga

SEQ ID NO: 1358516 - RNA, 14 nt, Mycobacterium tuberculosis H37Rv
gguucggccagaac

SEQ ID NO: 1358517 - RNA, 20 nt, Mycobacterium tuberculosis H37Rv
gguucggagucacgcagccg

SEQ ID NO: 1358518 - RNA, 19 nt, Mycobacterium tuberculosis H37Rv
gguucggacacacaggcgg

SEQ ID NO: 1358519 - RNA, 15 nt, Mycobacterium tuberculosis H37Rv
gguucgcucggggac

SEQ ID NO: 1358520 - RNA, 16 nt, Mycobacterium tuberculosis H37Rv
gguucgccccugcaca

SEQ ID NO: 1358521 - RNA, 22 nt, Mycobacterium tuberculosis H37Rv
gguucgccgaagccggaccgca

SEQ ID NO: 1358522 - RNA, 18 nt, Mycobacterium tuberculosis H37Rv
gguucagccacgcagcac

SEQ ID NO: 1358523 - RNA, 18 nt, Mycobacterium tuberculosis H37Rv
gguucccgggcagccgca

SEQ ID NO: 1358524 - RNA, 22 nt, Mycobacterium tuberculosis H37Rv
gguuccgguguaggccugcccc

SEQ ID NO: 1358525 - RNA, 15 nt, Mycobacterium tuberculosis H37Rv
gguuccgccggcccc

SEQ ID NO: 1358526 - RNA, 13 nt, Mycobacterium tuberculosis H37Rv
gguuccggccggc

SEQ ID NO: 1358527 - RNA, 18 nt, Mycobacterium tuberculosis H37Rv
gguuccggcgugcagcac

SEQ ID NO: 1358528 - RNA, 16 nt, Mycobacterium tuberculosis H37Rv
gguuaucccagacugu

SEQ ID NO: 1358529 - RNA, 21 nt, Mycobacterium tuberculosis H37Rv
gguuaucgccgagauccgcgc

SEQ ID NO: 1358530 - RNA, 14 nt, Mycobacterium tuberculosis H37Rv
gguuagccgcggcc

SEQ ID NO: 1358531 - RNA, 15 nt, Mycobacterium tuberculosis H37Rv
gguucacccagcggc

SEQ ID NO: 1358532 - RNA, 13 nt, Mycobacterium tuberculosis H37Rv
gguucaccucccc

SEQ ID NO: 1358533 - RNA, 21 nt, Mycobacterium tuberculosis H37Rv
gguuagggacuuuccggcgca

SEQ ID NO: 1358534 - RNA, 16 nt, Mycobacterium tuberculosis H37Rv
gguuagggcgugucuu

SEQ ID NO: 1358535 - RNA, 14 nt, Mycobacterium tuberculosis H37Rv
ggugguaggccggg

SEQ ID NO: 1358536 - RNA, 22 nt, Mycobacterium tuberculosis H37Rv
ggugggugaacgccugcgggaa

SEQ ID NO: 1358537 - RNA, 21 nt, Mycobacterium tuberculosis H37Rv
gguggucacgccgugugugcg

SEQ ID NO: 1358538 - RNA, 17 nt, Mycobacterium tuberculosis H37Rv
gguggucucgguaggcg

SEQ ID NO: 1358539 - RNA, 21 nt, Mycobacterium tuberculosis H37Rv
gguggucagguuggcacgcug

SEQ ID NO: 1358540 - RNA, 13 nt, Mycobacterium tuberculosis H37Rv
ggugggugcagca

SEQ ID NO: 1358541 - RNA, 14 nt, Mycobacterium tuberculosis H37Rv
gguggucagguugg

SEQ ID NO: 1358542 - RNA, 21 nt, Mycobacterium tuberculosis H37Rv
gguggucgacccggccaggag

SEQ ID NO: 1358543 - RNA, 21 nt, Mycobacterium tuberculosis H37Rv
gguggugacacgacgugcagg

SEQ ID NO: 1358544 - RNA, 14 nt, Mycobacterium tuberculosis H37Rv
gguggugacgucga

SEQ ID NO: 1358545 - RNA, 13 nt, Mycobacterium tuberculosis H37Rv
ggugguggccggg

SEQ ID NO: 1358546 - RNA, 15 nt, Mycobacterium tuberculosis H37Rv
ggugguggccggggu

SEQ ID NO: 1358547 - RNA, 17 nt, Mycobacterium tuberculosis H37Rv
ggugguggccggggugc

SEQ ID NO: 1358548 - RNA, 16 nt, Mycobacterium tuberculosis H37Rv
gguggugaggaucaug

SEQ ID NO: 1358549 - RNA, 11 nt, Mycobacterium tuberculosis H37Rv
gguggugcucg

SEQ ID NO: 1358550 - RNA, 23 nt, Mycobacterium tuberculosis H37Rv
gguguccuccagcugcgcgggcg

SEQ ID NO: 1358551 - RNA, 18 nt, Mycobacterium tuberculosis H37Rv
ggugucgauuggcucgcc

SEQ ID NO: 1358552 - RNA, 22 nt, Mycobacterium tuberculosis H37Rv
ggugucggcuggucgcugcugc

SEQ ID NO: 1358553 - RNA, 14 nt, Mycobacterium tuberculosis H37Rv
ggugucgggcagca

SEQ ID NO: 1358554 - RNA, 19 nt, Mycobacterium tuberculosis H37Rv
ggugucgguggccgcggcg

SEQ ID NO: 1358555 - RNA, 18 nt, Mycobacterium tuberculosis H37Rv
ggugucgccgaacaccga

SEQ ID NO: 1358556 - RNA, 19 nt, Mycobacterium tuberculosis H37Rv
gguguaggccugcccccgg

SEQ ID NO: 1358557 - RNA, 13 nt, Mycobacterium tuberculosis H37Rv
gguguagagagcc

SEQ ID NO: 1358558 - RNA, 18 nt, Mycobacterium tuberculosis H37Rv
gguguagcccagccgggu

SEQ ID NO: 1358559 - RNA, 22 nt, Mycobacterium tuberculosis H37Rv
ggugugcuggcuaucugaucca

SEQ ID NO: 1358560 - RNA, 22 nt, Mycobacterium tuberculosis H37Rv
ggugugcuugcucgggucgugc

SEQ ID NO: 1358561 - RNA, 19 nt, Mycobacterium tuberculosis H37Rv
gguguggacuucagcaggc

SEQ ID NO: 1358562 - RNA, 22 nt, Mycobacterium tuberculosis H37Rv
ggugugcugccaccggccggcg

SEQ ID NO: 1358563 - RNA, 15 nt, Mycobacterium tuberculosis H37Rv
ggugugcgggcggug

SEQ ID NO: 1358564 - RNA, 14 nt, Mycobacterium tuberculosis H37Rv
ggugugcugcacgg

SEQ ID NO: 1358565 - RNA, 16 nt, Mycobacterium tuberculosis H37Rv
gguguggucgguggcg

SEQ ID NO: 1358566 - RNA, 13 nt, Mycobacterium tuberculosis H37Rv
ggugugucggguu

SEQ ID NO: 1358567 - RNA, 19 nt, Mycobacterium tuberculosis H37Rv
ggugugcaucgacucacgg

SEQ ID NO: 1358568 - RNA, 18 nt, Mycobacterium tuberculosis H37Rv
ggugucguucggcgagga

SEQ ID NO: 1358569 - RNA, 23 nt, Mycobacterium tuberculosis H37Rv
ggugucguucggcgaggacggcg

SEQ ID NO: 1358570 - RNA, 21 nt, Mycobacterium tuberculosis H37Rv
ggugucucccuugccgccauu

SEQ ID NO: 1358571 - RNA, 21 nt, Mycobacterium tuberculosis H37Rv
ggugucgucaucggggccugc

SEQ ID NO: 1358572 - RNA, 15 nt, Mycobacterium tuberculosis H37Rv
gguguucgggcagcu

SEQ ID NO: 1358573 - RNA, 13 nt, Mycobacterium tuberculosis H37Rv
gguguugaggccg

SEQ ID NO: 1358574 - RNA, 23 nt, Mycobacterium tuberculosis H37Rv
gguguugccggagacgucgccgc

SEQ ID NO: 1358575 - RNA, 21 nt, Mycobacterium tuberculosis H37Rv
gguguugcggcugaccuccca

SEQ ID NO: 1358576 - RNA, 21 nt, Mycobacterium tuberculosis H37Rv
gguguuuccgaaacccgccgc

SEQ ID NO: 1358577 - RNA, 18 nt, Mycobacterium tuberculosis H37Rv
gguugcucgagcgguggc

SEQ ID NO: 1358578 - RNA, 15 nt, Mycobacterium tuberculosis H37Rv
gguugcggcagcugg

SEQ ID NO: 1358579 - RNA, 14 nt, Mycobacterium tuberculosis H37Rv
gguugcgccaggaa

SEQ ID NO: 1358580 - RNA, 16 nt, Mycobacterium tuberculosis H37Rv
gguuggauacggugcg

SEQ ID NO: 1358581 - RNA, 18 nt, Mycobacterium tuberculosis H37Rv
gguuggccgaacagcugc

SEQ ID NO: 1358582 - RNA, 23 nt, Mycobacterium tuberculosis H37Rv
gguuggcauccaaaaucgccuga

SEQ ID NO: 1358583 - RNA, 16 nt, Mycobacterium tuberculosis H37Rv
gguuggcguugguggu

SEQ ID NO: 1358584 - RNA, 16 nt, Mycobacterium tuberculosis H37Rv
gguuggccgggcuggc

SEQ ID NO: 1358585 - RNA, 16 nt, Mycobacterium tuberculosis H37Rv
gguuggcugaugacgc

SEQ ID NO: 1358586 - RNA, 12 nt, Mycobacterium tuberculosis H37Rv
gguugggguggc

SEQ ID NO: 1358587 - RNA, 20 nt, Mycobacterium tuberculosis H37Rv
gguuggugauugcggccgcc

SEQ ID NO: 1358588 - RNA, 20 nt, Mycobacterium tuberculosis H37Rv
gguugucguugcuggugugc

SEQ ID NO: 1358589 - RNA, 16 nt, Mycobacterium tuberculosis H37Rv
gguugucgucgguggg

SEQ ID NO: 1358590 - RNA, 17 nt, Mycobacterium tuberculosis H37Rv
gguugugucggccuggc

SEQ ID NO: 1358591 - RNA, 15 nt, Mycobacterium tuberculosis H37Rv
gguuguggucagcug

SEQ ID NO: 1358592 - RNA, 16 nt, Mycobacterium tuberculosis H37Rv
gguugacgggcucggc

SEQ ID NO: 1358593 - RNA, 17 nt, Mycobacterium tuberculosis H37Rv
gguugacgucaggcuga

SEQ ID NO: 1358594 - RNA, 16 nt, Mycobacterium tuberculosis H37Rv
gguugaugaguuccuu

SEQ ID NO: 1358595 - RNA, 22 nt, Mycobacterium tuberculosis H37Rv
gguugaucagccagaccaacau

SEQ ID NO: 1358596 - RNA, 11 nt, Mycobacterium tuberculosis H37Rv
gguugcccuug

SEQ ID NO: 1358597 - RNA, 18 nt, Mycobacterium tuberculosis H37Rv
gguugccugugcggcggg

SEQ ID NO: 1358598 - RNA, 23 nt, Mycobacterium tuberculosis H37Rv
gguugccgucagggucagcuggg

SEQ ID NO: 1358599 - RNA, 18 nt, Mycobacterium tuberculosis H37Rv
gguugcccgcauugccaa

SEQ ID NO: 1358600 - RNA, 16 nt, Mycobacterium tuberculosis H37Rv
gguugccccgcagcau

SEQ ID NO: 1358601 - RNA, 15 nt, Mycobacterium tuberculosis H37Rv
gguugaucggccacg

SEQ ID NO: 1358602 - RNA, 17 nt, Mycobacterium tuberculosis H37Rv
gguugaaccgguacaac

SEQ ID NO: 1358603 - RNA, 15 nt, Mycobacterium tuberculosis H37Rv
gguugaccgaguuga

SEQ ID NO: 1358604 - RNA, 22 nt, Mycobacterium tuberculosis H37Rv
gguucuggauccccugauggac

SEQ ID NO: 1358605 - RNA, 18 nt, Mycobacterium tuberculosis H37Rv
gguuuccuccggcagcag

SEQ ID NO: 1358606 - RNA, 17 nt, Mycobacterium tuberculosis H37Rv
gguuuccggccugcacg

SEQ ID NO: 1358607 - RNA, 22 nt, Mycobacterium tuberculosis H37Rv
ggugcagugaccucgucggcga

SEQ ID NO: 1358608 - RNA, 12 nt, Mycobacterium tuberculosis H37Rv
ggugcaggugag

SEQ ID NO: 1358609 - RNA, 21 nt, Mycobacterium tuberculosis H37Rv
ggugcagucgauuucggcggc

SEQ ID NO: 1358610 - RNA, 16 nt, Mycobacterium tuberculosis H37Rv
ggugcagaccaccgcc

SEQ ID NO: 1358611 - RNA, 13 nt, Mycobacterium tuberculosis H37Rv
ggugcagcgacuc

SEQ ID NO: 1358612 - RNA, 16 nt, Mycobacterium tuberculosis H37Rv
ggugcagcgccgacag

SEQ ID NO: 1358613 - RNA, 19 nt, Mycobacterium tuberculosis H37Rv
ggugcagcgugcagcggcg

SEQ ID NO: 1358614 - RNA, 15 nt, Mycobacterium tuberculosis H37Rv
ggugcaggaccagaa

SEQ ID NO: 1358615 - RNA, 19 nt, Mycobacterium tuberculosis H37Rv
ggugcaccgaagauggcca

SEQ ID NO: 1358616 - RNA, 22 nt, Mycobacterium tuberculosis H37Rv
ggugcacgccuugagccgaggc

SEQ ID NO: 1358617 - RNA, 16 nt, Mycobacterium tuberculosis H37Rv
ggugcacgccuugagc

SEQ ID NO: 1358618 - RNA, 16 nt, Mycobacterium tuberculosis H37Rv
ggugcagcacggcgcc

SEQ ID NO: 1358619 - RNA, 14 nt, Mycobacterium tuberculosis H37Rv
ggugcagcccgccg

SEQ ID NO: 1358620 - RNA, 12 nt, Mycobacterium tuberculosis H37Rv
ggugccagcagg

SEQ ID NO: 1358621 - RNA, 14 nt, Mycobacterium tuberculosis H37Rv
ggugccaggucggc

SEQ ID NO: 1358622 - RNA, 15 nt, Mycobacterium tuberculosis H37Rv
ggugccaggucggcg

SEQ ID NO: 1358623 - RNA, 20 nt, Mycobacterium tuberculosis H37Rv
ggugccaguacucggccagc

SEQ ID NO: 1358624 - RNA, 22 nt, Mycobacterium tuberculosis H37Rv
ggugccaguacucggccagcgc

SEQ ID NO: 1358625 - RNA, 21 nt, Mycobacterium tuberculosis H37Rv
ggugccagaccagggcagcgg

SEQ ID NO: 1358626 - RNA, 22 nt, Mycobacterium tuberculosis H37Rv
ggugccagaucggcggguggcg

SEQ ID NO: 1358627 - RNA, 18 nt, Mycobacterium tuberculosis H37Rv
ggugccacguucgcgggc

SEQ ID NO: 1358628 - RNA, 11 nt, Mycobacterium tuberculosis H37Rv
ggugccagcag

SEQ ID NO: 1358629 - RNA, 22 nt, Mycobacterium tuberculosis H37Rv
ggugccagcaccacgucgacga

SEQ ID NO: 1358630 - RNA, 15 nt, Mycobacterium tuberculosis H37Rv
ggugcccggccgcca

SEQ ID NO: 1358631 - RNA, 17 nt, Mycobacterium tuberculosis H37Rv
ggugcccugccggcagc

SEQ ID NO: 1358632 - RNA, 23 nt, Mycobacterium tuberculosis H37Rv
ggugcccagcguggcuggcaccu

SEQ ID NO: 1358633 - RNA, 16 nt, Mycobacterium tuberculosis H37Rv
ggugccaucgggcgcg

SEQ ID NO: 1358634 - RNA, 22 nt, Mycobacterium tuberculosis H37Rv
ggugagugcgucucgguggcug

SEQ ID NO: 1358635 - RNA, 13 nt, Mycobacterium tuberculosis H37Rv
ggugagugcgucu

SEQ ID NO: 1358636 - RNA, 20 nt, Mycobacterium tuberculosis H37Rv
ggugaguccgcugagcgggc

SEQ ID NO: 1358637 - RNA, 20 nt, Mycobacterium tuberculosis H37Rv
ggugaggucgaucagcggcg

SEQ ID NO: 1358638 - RNA, 15 nt, Mycobacterium tuberculosis H37Rv
ggugaucagcaggau

SEQ ID NO: 1358639 - RNA, 16 nt, Mycobacterium tuberculosis H37Rv
ggugaucuucuucagg

SEQ ID NO: 1358640 - RNA, 22 nt, Mycobacterium tuberculosis H37Rv
ggugaugacgccgucggcgcgc

SEQ ID NO: 1358641 - RNA, 14 nt, Mycobacterium tuberculosis H37Rv
ggugaugagucagg

SEQ ID NO: 1358642 - RNA, 14 nt, Mycobacterium tuberculosis H37Rv
ggugaugaucgcgc

SEQ ID NO: 1358643 - RNA, 21 nt, Mycobacterium tuberculosis H37Rv
ggugaucgcggucgacagcuu

SEQ ID NO: 1358644 - RNA, 18 nt, Mycobacterium tuberculosis H37Rv
ggugaugcaugcuaggca

SEQ ID NO: 1358645 - RNA, 18 nt, Mycobacterium tuberculosis H37Rv
ggugaugcccagcgccga

SEQ ID NO: 1358646 - RNA, 19 nt, Mycobacterium tuberculosis H37Rv
ggugaugggcaugguggug

SEQ ID NO: 1358647 - RNA, 18 nt, Mycobacterium tuberculosis H37Rv
ggugaugggggagccggu

SEQ ID NO: 1358648 - RNA, 17 nt, Mycobacterium tuberculosis H37Rv
ggugauggcuuggacca

SEQ ID NO: 1358649 - RNA, 21 nt, Mycobacterium tuberculosis H37Rv
ggugauggugugcagcagcau

SEQ ID NO: 1358650 - RNA, 14 nt, Mycobacterium tuberculosis H37Rv
ggugcacagcagug

SEQ ID NO: 1358651 - RNA, 20 nt, Mycobacterium tuberculosis H37Rv
ggugcacaccgucgcaccca

SEQ ID NO: 1358652 - RNA, 17 nt, Mycobacterium tuberculosis H37Rv
ggugcacaacccgugca

SEQ ID NO: 1358653 - RNA, 18 nt, Mycobacterium tuberculosis H37Rv
ggugauugcggccgccga

SEQ ID NO: 1358654 - RNA, 20 nt, Mycobacterium tuberculosis H37Rv
ggugcaacacgccggcccgg

SEQ ID NO: 1358655 - RNA, 17 nt, Mycobacterium tuberculosis H37Rv
ggcucccuuuuccaaag

SEQ ID NO: 1358656 - RNA, 21 nt, Mycobacterium tuberculosis H37Rv
ggcuccgaacauggccagcau

SEQ ID NO: 1358657 - RNA, 19 nt, Mycobacterium tuberculosis H37Rv
ggcucccgcaauggggcgc

SEQ ID NO: 1358658 - RNA, 17 nt, Mycobacterium tuberculosis H37Rv
ggcuccgcagcgaagac

SEQ ID NO: 1358659 - RNA, 22 nt, Mycobacterium tuberculosis H37Rv
ggcuccgcccggcgugucgccg

SEQ ID NO: 1358660 - RNA, 14 nt, Mycobacterium tuberculosis H37Rv
ggcuccgcccagga

SEQ ID NO: 1358661 - RNA, 17 nt, Mycobacterium tuberculosis H37Rv
ggcucaggugcucagcu

SEQ ID NO: 1358662 - RNA, 17 nt, Mycobacterium tuberculosis H37Rv
ggcucagcugggccgcu

SEQ ID NO: 1358663 - RNA, 17 nt, Mycobacterium tuberculosis H37Rv
ggcucagcugguggcgg

SEQ ID NO: 1358664 - RNA, 17 nt, Mycobacterium tuberculosis H37Rv
ggcuccggcggcagcgg

SEQ ID NO: 1358665 - RNA, 13 nt, Mycobacterium tuberculosis H37Rv
ggcuccggccagg

SEQ ID NO: 1358666 - RNA, 15 nt, Mycobacterium tuberculosis H37Rv
ggcuccggccagggg

SEQ ID NO: 1358667 - RNA, 16 nt, Mycobacterium tuberculosis H37Rv
ggugaauaaggcugca

SEQ ID NO: 1358668 - RNA, 17 nt, Mycobacterium tuberculosis H37Rv
ggugaauccgugcaggg

SEQ ID NO: 1358669 - RNA, 23 nt, Mycobacterium tuberculosis H37Rv
ggcuccgugguugccgaagccgg

SEQ ID NO: 1358670 - RNA, 16 nt, Mycobacterium tuberculosis H37Rv
ggugacaucgcgaggc

SEQ ID NO: 1358671 - RNA, 22 nt, Mycobacterium tuberculosis H37Rv
ggugacaaguggugcccuugaa

SEQ ID NO: 1358672 - RNA, 23 nt, Mycobacterium tuberculosis H37Rv
ggugacccgcuauucggcggcau

SEQ ID NO: 1358673 - RNA, 16 nt, Mycobacterium tuberculosis H37Rv
ggugacccgcugggcc

SEQ ID NO: 1358674 - RNA, 17 nt, Mycobacterium tuberculosis H37Rv
ggugaccaggccgagcu

SEQ ID NO: 1358675 - RNA, 22 nt, Mycobacterium tuberculosis H37Rv
ggugaccaggccggcccgcaac

SEQ ID NO: 1358676 - RNA, 21 nt, Mycobacterium tuberculosis H37Rv
ggugaccacgccguggcccgc

SEQ ID NO: 1358677 - RNA, 19 nt, Mycobacterium tuberculosis H37Rv
ggugacguggugggcuugg

SEQ ID NO: 1358678 - RNA, 15 nt, Mycobacterium tuberculosis H37Rv
ggugacggcggcugu

SEQ ID NO: 1358679 - RNA, 19 nt, Mycobacterium tuberculosis H37Rv
ggugacgcccgcuccgcgg

SEQ ID NO: 1358680 - RNA, 17 nt, Mycobacterium tuberculosis H37Rv
ggugacgcgccguaaca

SEQ ID NO: 1358681 - RNA, 22 nt, Mycobacterium tuberculosis H37Rv
ggugaccuucgcuauggcggcu

SEQ ID NO: 1358682 - RNA, 19 nt, Mycobacterium tuberculosis H37Rv
ggugaccgacgcggacagg

SEQ ID NO: 1358683 - RNA, 14 nt, Mycobacterium tuberculosis H37Rv
ggugaccgagaucg

SEQ ID NO: 1358684 - RNA, 15 nt, Mycobacterium tuberculosis H37Rv
ggugaccucaccaac

SEQ ID NO: 1358685 - RNA, 23 nt, Mycobacterium tuberculosis H37Rv
ggugaccgguguuccgcccagcg

SEQ ID NO: 1358686 - RNA, 23 nt, Mycobacterium tuberculosis H37Rv
ggugaccucgugguucugcaggu

SEQ ID NO: 1358687 - RNA, 19 nt, Mycobacterium tuberculosis H37Rv
ggugacccgugcggccacg

SEQ ID NO: 1358688 - RNA, 18 nt, Mycobacterium tuberculosis H37Rv
ggugaggcgggucgccgc

SEQ ID NO: 1358689 - RNA, 23 nt, Mycobacterium tuberculosis H37Rv
ggugagcuggucggcgagcgccc

SEQ ID NO: 1358690 - RNA, 19 nt, Mycobacterium tuberculosis H37Rv
ggugagcuuagcgcauggg

SEQ ID NO: 1358691 - RNA, 18 nt, Mycobacterium tuberculosis H37Rv
ggugagcauggcuagggc

SEQ ID NO: 1358692 - RNA, 21 nt, Mycobacterium tuberculosis H37Rv
ggugagccucggcgagccgug

SEQ ID NO: 1358693 - RNA, 15 nt, Mycobacterium tuberculosis H37Rv
ggugagcgaccuggg

SEQ ID NO: 1358694 - RNA, 15 nt, Mycobacterium tuberculosis H37Rv
ggugagccgguggcc

SEQ ID NO: 1358695 - RNA, 20 nt, Mycobacterium tuberculosis H37Rv
ggugagccgguggcccgccg

SEQ ID NO: 1358696 - RNA, 23 nt, Mycobacterium tuberculosis H37Rv
ggugacgguguugguggucgggu

SEQ ID NO: 1358697 - RNA, 23 nt, Mycobacterium tuberculosis H37Rv
ggugacuccgcgcgcggacagca

SEQ ID NO: 1358698 - RNA, 13 nt, Mycobacterium tuberculosis H37Rv
ggugacuccggcu

SEQ ID NO: 1358699 - RNA, 20 nt, Mycobacterium tuberculosis H37Rv
ggugagaucaugaggugagc

SEQ ID NO: 1358700 - RNA, 22 nt, Mycobacterium tuberculosis H37Rv
ggugagacaaaggugccgaccg

SEQ ID NO: 1358701 - RNA, 23 nt, Mycobacterium tuberculosis H37Rv
ggugacuucgcugcggugggcca

SEQ ID NO: 1358702 - RNA, 21 nt, Mycobacterium tuberculosis H37Rv
ggugacuucguggccuugaca

SEQ ID NO: 1358703 - RNA, 21 nt, Mycobacterium tuberculosis H37Rv
gguggccagaucgaacgcagc

SEQ ID NO: 1358704 - RNA, 15 nt, Mycobacterium tuberculosis H37Rv
gguggcagcggcgau

SEQ ID NO: 1358705 - RNA, 16 nt, Mycobacterium tuberculosis H37Rv
gguggccagcgcggcg

SEQ ID NO: 1358706 - RNA, 21 nt, Mycobacterium tuberculosis H37Rv
gguggccaugacggcuccgau

SEQ ID NO: 1358707 - RNA, 21 nt, Mycobacterium tuberculosis H37Rv
gguggcccgccggcagugagu

SEQ ID NO: 1358708 - RNA, 18 nt, Mycobacterium tuberculosis H37Rv
gguggagccgaggugcug

SEQ ID NO: 1358709 - RNA, 23 nt, Mycobacterium tuberculosis H37Rv
gguggagcggcgcgggggugggc

SEQ ID NO: 1358710 - RNA, 21 nt, Mycobacterium tuberculosis H37Rv
gguggaguuuccgaagcccgg

SEQ ID NO: 1358711 - RNA, 14 nt, Mycobacterium tuberculosis H37Rv
gguggcagcgcggc

SEQ ID NO: 1358712 - RNA, 14 nt, Mycobacterium tuberculosis H37Rv
gguggcacggcccc

SEQ ID NO: 1358713 - RNA, 19 nt, Mycobacterium tuberculosis H37Rv
gguggcacgcugagcgucc

SEQ ID NO: 1358714 - RNA, 23 nt, Mycobacterium tuberculosis H37Rv
gguggcaaucgaggaaggugugc

SEQ ID NO: 1358715 - RNA, 19 nt, Mycobacterium tuberculosis H37Rv
gguggauucgaucaggccu

SEQ ID NO: 1358716 - RNA, 23 nt, Mycobacterium tuberculosis H37Rv
gguggacgaccgcgcggcacuug

SEQ ID NO: 1358717 - RNA, 15 nt, Mycobacterium tuberculosis H37Rv
gguggaaacccugca

SEQ ID NO: 1358718 - RNA, 12 nt, Mycobacterium tuberculosis H37Rv
gguggacagcaa

SEQ ID NO: 1358719 - RNA, 19 nt, Mycobacterium tuberculosis H37Rv
ggugcuggucgccgcggca

SEQ ID NO: 1358720 - RNA, 23 nt, Mycobacterium tuberculosis H37Rv
ggugcuguugcgcggucgcgcga

SEQ ID NO: 1358721 - RNA, 16 nt, Mycobacterium tuberculosis H37Rv
ggugcuguuugguugc

SEQ ID NO: 1358722 - RNA, 16 nt, Mycobacterium tuberculosis H37Rv
gguggaaaaagcccga

SEQ ID NO: 1358723 - RNA, 23 nt, Mycobacterium tuberculosis H37Rv
gguggaaaaagcccgacacgaaa

SEQ ID NO: 1358724 - RNA, 22 nt, Mycobacterium tuberculosis H37Rv
ggugcuuccucgcgagcucccu

SEQ ID NO: 1358725 - RNA, 17 nt, Mycobacterium tuberculosis H37Rv
gguggcggcgagcagca

SEQ ID NO: 1358726 - RNA, 10 nt, Mycobacterium tuberculosis H37Rv
gguggcggca

SEQ ID NO: 1358727 - RNA, 13 nt, Mycobacterium tuberculosis H37Rv
gguggcguggugg

SEQ ID NO: 1358728 - RNA, 22 nt, Mycobacterium tuberculosis H37Rv
gguggcguuugaugcgggcggc

SEQ ID NO: 1358729 - RNA, 22 nt, Mycobacterium tuberculosis H37Rv
gguggcgccaugaagccgggcg

SEQ ID NO: 1358730 - RNA, 15 nt, Mycobacterium tuberculosis H37Rv
gguggccucauccac

SEQ ID NO: 1358731 - RNA, 21 nt, Mycobacterium tuberculosis H37Rv
gguggcgccguugucggcggu

SEQ ID NO: 1358732 - RNA, 16 nt, Mycobacterium tuberculosis H37Rv
gguggcccgggccacc

SEQ ID NO: 1358733 - RNA, 15 nt, Mycobacterium tuberculosis H37Rv
gguggccgcggcggu

SEQ ID NO: 1358734 - RNA, 20 nt, Mycobacterium tuberculosis H37Rv
gguggcucgggugguuugcg

SEQ ID NO: 1358735 - RNA, 15 nt, Mycobacterium tuberculosis H37Rv
gguggcucggguggu

SEQ ID NO: 1358736 - RNA, 16 nt, Mycobacterium tuberculosis H37Rv
gguggcuuugcucgcc

SEQ ID NO: 1358737 - RNA, 19 nt, Mycobacterium tuberculosis H37Rv
ggugggacaggucggggcg

SEQ ID NO: 1358738 - RNA, 13 nt, Mycobacterium tuberculosis H37Rv
ggugggagcagcc

SEQ ID NO: 1358739 - RNA, 14 nt, Mycobacterium tuberculosis H37Rv
ggugggcagcaggc

SEQ ID NO: 1358740 - RNA, 12 nt, Mycobacterium tuberculosis H37Rv
ggugggcagcag

SEQ ID NO: 1358741 - RNA, 13 nt, Mycobacterium tuberculosis H37Rv
ggugggcgcuggg

SEQ ID NO: 1358742 - RNA, 14 nt, Mycobacterium tuberculosis H37Rv
gguggguagccagc

SEQ ID NO: 1358743 - RNA, 13 nt, Mycobacterium tuberculosis H37Rv
ggugggggcggcg

SEQ ID NO: 1358744 - RNA, 22 nt, Mycobacterium tuberculosis H37Rv
gguggggcgcacgauggugugc

SEQ ID NO: 1358745 - RNA, 15 nt, Mycobacterium tuberculosis H37Rv
ggugggcguggcugg

SEQ ID NO: 1358746 - RNA, 17 nt, Mycobacterium tuberculosis H37Rv
gguggggcgguggccgg

SEQ ID NO: 1358747 - RNA, 16 nt, Mycobacterium tuberculosis H37Rv
gguggggccggcgucg

SEQ ID NO: 1358748 - RNA, 15 nt, Mycobacterium tuberculosis H37Rv
ggugccgcagcaggg

SEQ ID NO: 1358749 - RNA, 19 nt, Mycobacterium tuberculosis H37Rv
ggugccgccaucgccgccg

SEQ ID NO: 1358750 - RNA, 20 nt, Mycobacterium tuberculosis H37Rv
ggugccgccaucgccgccgg

SEQ ID NO: 1358751 - RNA, 18 nt, Mycobacterium tuberculosis H37Rv
ggugccgaucagcagugg

SEQ ID NO: 1358752 - RNA, 14 nt, Mycobacterium tuberculosis H37Rv
ggugccgcagcagg

SEQ ID NO: 1358753 - RNA, 16 nt, Mycobacterium tuberculosis H37Rv
ggugccggggcugccg

SEQ ID NO: 1358754 - RNA, 18 nt, Mycobacterium tuberculosis H37Rv
ggugccggaaacgccagg

SEQ ID NO: 1358755 - RNA, 13 nt, Mycobacterium tuberculosis H37Rv
ggugccggcggcg

SEQ ID NO: 1358756 - RNA, 18 nt, Mycobacterium tuberculosis H37Rv
ggugccgccgccggcgcc

SEQ ID NO: 1358757 - RNA, 18 nt, Mycobacterium tuberculosis H37Rv
ggugccgccgcggccacc

SEQ ID NO: 1358758 - RNA, 16 nt, Mycobacterium tuberculosis H37Rv
ggugccgccgccggcg

SEQ ID NO: 1358759 - RNA, 17 nt, Mycobacterium tuberculosis H37Rv
ggugccgccgucgccgc

SEQ ID NO: 1358760 - RNA, 18 nt, Mycobacterium tuberculosis H37Rv
ggugccgcggccaccgcc

SEQ ID NO: 1358761 - RNA, 21 nt, Mycobacterium tuberculosis H37Rv
ggugccuacaccggcaagcca

SEQ ID NO: 1358762 - RNA, 13 nt, Mycobacterium tuberculosis H37Rv
ggugccugucaga

SEQ ID NO: 1358763 - RNA, 22 nt, Mycobacterium tuberculosis H37Rv
ggugccgugaucggcgcccggg

SEQ ID NO: 1358764 - RNA, 18 nt, Mycobacterium tuberculosis H37Rv
ggugccgucagcggcggc

SEQ ID NO: 1358765 - RNA, 14 nt, Mycobacterium tuberculosis H37Rv
ggugccggugcucc

SEQ ID NO: 1358766 - RNA, 15 nt, Mycobacterium tuberculosis H37Rv
ggugcgggguuggcc

SEQ ID NO: 1358767 - RNA, 16 nt, Mycobacterium tuberculosis H37Rv
ggugcgggugggcaca

SEQ ID NO: 1358768 - RNA, 18 nt, Mycobacterium tuberculosis H37Rv
ggugcuaaccgacgcuga

SEQ ID NO: 1358769 - RNA, 16 nt, Mycobacterium tuberculosis H37Rv
ggugcucaccuccacg

SEQ ID NO: 1358770 - RNA, 23 nt, Mycobacterium tuberculosis H37Rv
ggugcucucguggauggccgcca

SEQ ID NO: 1358771 - RNA, 16 nt, Mycobacterium tuberculosis H37Rv
ggugcugaccccgccg

SEQ ID NO: 1358772 - RNA, 17 nt, Mycobacterium tuberculosis H37Rv
ggugcugaccgcgccgg

SEQ ID NO: 1358773 - RNA, 13 nt, Mycobacterium tuberculosis H37Rv
ggugcuggcagga

SEQ ID NO: 1358774 - RNA, 20 nt, Mycobacterium tuberculosis H37Rv
ggugcugguccaggcgguga

SEQ ID NO: 1358775 - RNA, 16 nt, Mycobacterium tuberculosis H37Rv
ggugcugcgcgcggcg

SEQ ID NO: 1358776 - RNA, 18 nt, Mycobacterium tuberculosis H37Rv
ggugcugcgcgggugugg

SEQ ID NO: 1358777 - RNA, 14 nt, Mycobacterium tuberculosis H37Rv
ggugcugccaagca

SEQ ID NO: 1358778 - RNA, 15 nt, Mycobacterium tuberculosis H37Rv
ggugcgcgcggucga

SEQ ID NO: 1358779 - RNA, 14 nt, Mycobacterium tuberculosis H37Rv
ggugcgccgucagc

SEQ ID NO: 1358780 - RNA, 16 nt, Mycobacterium tuberculosis H37Rv
ggugcggaucugcugc

SEQ ID NO: 1358781 - RNA, 12 nt, Mycobacterium tuberculosis H37Rv
ggugcggccacu

SEQ ID NO: 1358782 - RNA, 16 nt, Mycobacterium tuberculosis H37Rv
ggugcgcuggcggcgc

SEQ ID NO: 1358783 - RNA, 18 nt, Mycobacterium tuberculosis H37Rv
ggugcgcuugcggccgcg

SEQ ID NO: 1358784 - RNA, 23 nt, Mycobacterium tuberculosis H37Rv
ggugcgcuugcggccgcgcgccg

SEQ ID NO: 1358785 - RNA, 20 nt, Mycobacterium tuberculosis H37Rv
ggugcgcugcgaucaccccc

SEQ ID NO: 1358786 - RNA, 22 nt, Mycobacterium tuberculosis H37Rv
ggugcggaacacgaugcgcggu

SEQ ID NO: 1358787 - RNA, 13 nt, Mycobacterium tuberculosis H37Rv
ggugcgcgaagga

SEQ ID NO: 1358788 - RNA, 22 nt, Mycobacterium tuberculosis H37Rv
ggugcgcgugacgaccagcccc

SEQ ID NO: 1358789 - RNA, 17 nt, Mycobacterium tuberculosis H37Rv
ggugcgcugaugacgcg

SEQ ID NO: 1358790 - RNA, 22 nt, Mycobacterium tuberculosis H37Rv
ggugcgcugaugacgcggggcg

SEQ ID NO: 1358791 - RNA, 17 nt, Mycobacterium tuberculosis H37Rv
guacggcacuaacggcg

SEQ ID NO: 1358792 - RNA, 22 nt, Mycobacterium tuberculosis H37Rv
guacggaccguggcagcugcuc

SEQ ID NO: 1358793 - RNA, 17 nt, Mycobacterium tuberculosis H37Rv
guacgggcaggccgcug

SEQ ID NO: 1358794 - RNA, 22 nt, Mycobacterium tuberculosis H37Rv
guacgggcaggccgcugggccg

SEQ ID NO: 1358795 - RNA, 12 nt, Mycobacterium tuberculosis H37Rv
guacgcggcugc

SEQ ID NO: 1358796 - RNA, 20 nt, Mycobacterium tuberculosis H37Rv
guacgccguaucggggcacc

SEQ ID NO: 1358797 - RNA, 19 nt, Mycobacterium tuberculosis H37Rv
guacgcccuggaaugccgc

SEQ ID NO: 1358798 - RNA, 16 nt, Mycobacterium tuberculosis H37Rv
guacgacaccgcagcg

SEQ ID NO: 1358799 - RNA, 18 nt, Mycobacterium tuberculosis H37Rv
guacgacccccgaucagg

SEQ ID NO: 1358800 - RNA, 16 nt, Mycobacterium tuberculosis H37Rv
guacgaauugggcucu

SEQ ID NO: 1358801 - RNA, 14 nt, Mycobacterium tuberculosis H37Rv
guacgaacugcuga

SEQ ID NO: 1358802 - RNA, 17 nt, Mycobacterium tuberculosis H37Rv
guacccguagcaccaca

SEQ ID NO: 1358803 - RNA, 15 nt, Mycobacterium tuberculosis H37Rv
guacccgaccagcac

SEQ ID NO: 1358804 - RNA, 14 nt, Mycobacterium tuberculosis H37Rv
guacccccagcacc

SEQ ID NO: 1358805 - RNA, 23 nt, Mycobacterium tuberculosis H37Rv
guaccccagcgcugucguaccgc

SEQ ID NO: 1358806 - RNA, 13 nt, Mycobacterium tuberculosis H37Rv
guacccaccuccc

SEQ ID NO: 1358807 - RNA, 13 nt, Mycobacterium tuberculosis H37Rv
guaccccagcgcc

SEQ ID NO: 1358808 - RNA, 15 nt, Mycobacterium tuberculosis H37Rv
guaccgagcagcaga

SEQ ID NO: 1358809 - RNA, 17 nt, Mycobacterium tuberculosis H37Rv
guaccgauccaguucac

SEQ ID NO: 1358810 - RNA, 15 nt, Mycobacterium tuberculosis H37Rv
guaccgauagccugc

SEQ ID NO: 1358811 - RNA, 16 nt, Mycobacterium tuberculosis H37Rv
guaccuaaggcucacc

SEQ ID NO: 1358812 - RNA, 19 nt, Mycobacterium tuberculosis H37Rv
guaccguagcucuuugagu

SEQ ID NO: 1358813 - RNA, 19 nt, Mycobacterium tuberculosis H37Rv
guaccgguugacgggcucg

SEQ ID NO: 1358814 - RNA, 16 nt, Mycobacterium tuberculosis H37Rv
guaccagagcagcuca

SEQ ID NO: 1358815 - RNA, 18 nt, Mycobacterium tuberculosis H37Rv
guaccaaccugcgcggcg

SEQ ID NO: 1358816 - RNA, 13 nt, Mycobacterium tuberculosis H37Rv
guacaugggcaga

SEQ ID NO: 1358817 - RNA, 16 nt, Mycobacterium tuberculosis H37Rv
guaccaauccaggcca

SEQ ID NO: 1358818 - RNA, 16 nt, Mycobacterium tuberculosis H37Rv
guacagucgcgcgcuc

SEQ ID NO: 1358819 - RNA, 17 nt, Mycobacterium tuberculosis H37Rv
guacagugucugccaug

SEQ ID NO: 1358820 - RNA, 15 nt, Mycobacterium tuberculosis H37Rv
guacagucgcgcgcu

SEQ ID NO: 1358821 - RNA, 15 nt, Mycobacterium tuberculosis H37Rv
guacaggucgccggg

SEQ ID NO: 1358822 - RNA, 16 nt, Mycobacterium tuberculosis H37Rv
guacaucgaggccacg

SEQ ID NO: 1358823 - RNA, 24 nt, Mycobacterium tuberculosis H37Rv
guacacguccaguggcagccagcg

SEQ ID NO: 1358824 - RNA, 21 nt, Mycobacterium tuberculosis H37Rv
guacacguccaguggcagcca

SEQ ID NO: 1358825 - RNA, 16 nt, Mycobacterium tuberculosis H37Rv
guaaucgagcgcggca

SEQ ID NO: 1358826 - RNA, 21 nt, Mycobacterium tuberculosis H37Rv
guaaucagccccguuucgcca

SEQ ID NO: 1358827 - RNA, 21 nt, Mycobacterium tuberculosis H37Rv
guaauucaacaagcgacagac

SEQ ID NO: 1358828 - RNA, 13 nt, Mycobacterium tuberculosis H37Rv
guacacacgauga

SEQ ID NO: 1358829 - RNA, 16 nt, Mycobacterium tuberculosis H37Rv
guacacaaauccgcac

SEQ ID NO: 1358830 - RNA, 23 nt, Mycobacterium tuberculosis H37Rv
guacaagucgaccaugagccggc

SEQ ID NO: 1358831 - RNA, 16 nt, Mycobacterium tuberculosis H37Rv
guacaccccaucgaua

SEQ ID NO: 1358832 - RNA, 17 nt, Mycobacterium tuberculosis H37Rv
guacacauaggugcggg

SEQ ID NO: 1358833 - RNA, 23 nt, Mycobacterium tuberculosis H37Rv
guacacgaucaagagguccuuga

SEQ ID NO: 1358834 - RNA, 13 nt, Mycobacterium tuberculosis H37Rv
guaagccugguuc

SEQ ID NO: 1358835 - RNA, 21 nt, Mycobacterium tuberculosis H37Rv
guaaguuauccgaccacucca

SEQ ID NO: 1358836 - RNA, 14 nt, Mycobacterium tuberculosis H37Rv
guaaccggcagcgg

SEQ ID NO: 1358837 - RNA, 13 nt, Mycobacterium tuberculosis H37Rv
guaaccuccucga

SEQ ID NO: 1358838 - RNA, 21 nt, Mycobacterium tuberculosis H37Rv
guaaccccaccuggaguccag

SEQ ID NO: 1358839 - RNA, 16 nt, Mycobacterium tuberculosis H37Rv
guaaccagcgccacga

SEQ ID NO: 1358840 - RNA, 23 nt, Mycobacterium tuberculosis H37Rv
guaacccguuaccgauuggcccg

SEQ ID NO: 1358841 - RNA, 14 nt, Mycobacterium tuberculosis H37Rv
guaacgccgcucau

SEQ ID NO: 1358842 - RNA, 12 nt, Mycobacterium tuberculosis H37Rv
guaagcaugccg

SEQ ID NO: 1358843 - RNA, 23 nt, Mycobacterium tuberculosis H37Rv
guaagacgccgaacgcgagguuc

SEQ ID NO: 1358844 - RNA, 15 nt, Mycobacterium tuberculosis H37Rv
guaacugcccgcggc

SEQ ID NO: 1358845 - RNA, 22 nt, Mycobacterium tuberculosis H37Rv
guaacucgaguagucgcuggcc

SEQ ID NO: 1358846 - RNA, 14 nt, Mycobacterium tuberculosis H37Rv
guaaaagccgauga

SEQ ID NO: 1358847 - RNA, 22 nt, Mycobacterium tuberculosis H37Rv
guaaacguugggaaaagcccgg

SEQ ID NO: 1358848 - RNA, 16 nt, Mycobacterium tuberculosis H37Rv
gcaacugggcggccug

SEQ ID NO: 1358849 - RNA, 12 nt, Mycobacterium tuberculosis H37Rv
gcaagaaucagc

SEQ ID NO: 1358850 - RNA, 15 nt, Mycobacterium tuberculosis H37Rv
gcaagaaucagcagc

SEQ ID NO: 1358851 - RNA, 23 nt, Mycobacterium tuberculosis H37Rv
gcaacuucuucagcagcggcgga

SEQ ID NO: 1358852 - RNA, 20 nt, Mycobacterium tuberculosis H37Rv
aaagcgccgaaacagcaccc

SEQ ID NO: 1358853 - RNA, 16 nt, Mycobacterium tuberculosis H37Rv
gcaacuacucauccag

SEQ ID NO: 1358854 - RNA, 16 nt, Mycobacterium tuberculosis H37Rv
gcaacuagccgcugcc

SEQ ID NO: 1358855 - RNA, 18 nt, Mycobacterium tuberculosis H37Rv
gcaacucguccagcagug

SEQ ID NO: 1358856 - RNA, 16 nt, Mycobacterium tuberculosis H37Rv
gcaacucguccagcag

SEQ ID NO: 1358857 - RNA, 15 nt, Mycobacterium tuberculosis H37Rv
gcaacucguccagca

SEQ ID NO: 1358858 - RNA, 23 nt, Mycobacterium tuberculosis H37Rv
gcaacuccggucaacacccgccc

SEQ ID NO: 1358859 - RNA, 22 nt, Mycobacterium tuberculosis H37Rv
gcaacucgccgaaaucggccag

SEQ ID NO: 1358860 - RNA, 22 nt, Mycobacterium tuberculosis H37Rv
gcaacucggccacggcgucggc

SEQ ID NO: 1358861 - RNA, 23 nt, Mycobacterium tuberculosis H37Rv
gcaacggcguuuucaauuucacu

SEQ ID NO: 1358862 - RNA, 15 nt, Mycobacterium tuberculosis H37Rv
gcaacggcagcgagg

SEQ ID NO: 1358863 - RNA, 18 nt, Mycobacterium tuberculosis H37Rv
gcaacggccagcgcugcu

SEQ ID NO: 1358864 - RNA, 21 nt, Mycobacterium tuberculosis H37Rv
gcaacggcggggccggcggcu

SEQ ID NO: 1358865 - RNA, 14 nt, Mycobacterium tuberculosis H37Rv
gcaacggcggggcc

SEQ ID NO: 1358866 - RNA, 13 nt, Mycobacterium tuberculosis H37Rv
gcaacggcggggc

SEQ ID NO: 1358867 - RNA, 14 nt, Mycobacterium tuberculosis H37Rv
gcaacgggucgggu

SEQ ID NO: 1358868 - RNA, 22 nt, Mycobacterium tuberculosis H37Rv
gcaacgggucgguccacuucag

SEQ ID NO: 1358869 - RNA, 24 nt, Mycobacterium tuberculosis H37Rv
gcaacgcccaacgucgccagguca

SEQ ID NO: 1358870 - RNA, 23 nt, Mycobacterium tuberculosis H37Rv
gcaacgcccaacgucgccagguc

SEQ ID NO: 1358871 - RNA, 18 nt, Mycobacterium tuberculosis H37Rv
gcaacgcuucggcagcuc

SEQ ID NO: 1358872 - RNA, 16 nt, Mycobacterium tuberculosis H37Rv
gcaacgcggucugcuc

SEQ ID NO: 1358873 - RNA, 15 nt, Mycobacterium tuberculosis H37Rv
gcaaccggcgugucg

SEQ ID NO: 1358874 - RNA, 15 nt, Mycobacterium tuberculosis H37Rv
gcaaccgccgccauu

SEQ ID NO: 1358875 - RNA, 18 nt, Mycobacterium tuberculosis H37Rv
gaucacacuggccugcuc

SEQ ID NO: 1358876 - RNA, 16 nt, Mycobacterium tuberculosis H37Rv
gcaaccgccccuuccc

SEQ ID NO: 1358877 - RNA, 17 nt, Mycobacterium tuberculosis H37Rv
gaucacaccccaggcac

SEQ ID NO: 1358878 - RNA, 20 nt, Mycobacterium tuberculosis H37Rv
gaucacaacgugcccaccaa

SEQ ID NO: 1358879 - RNA, 16 nt, Mycobacterium tuberculosis H37Rv
gcaacgacauccagau

SEQ ID NO: 1358880 - RNA, 13 nt, Mycobacterium tuberculosis H37Rv
gcaacgacacgcc

SEQ ID NO: 1358881 - RNA, 15 nt, Mycobacterium tuberculosis H37Rv
gcaacgaagccggcg

SEQ ID NO: 1358882 - RNA, 18 nt, Mycobacterium tuberculosis H37Rv
gcaacgaauagguucccu

SEQ ID NO: 1358883 - RNA, 17 nt, Mycobacterium tuberculosis H37Rv
gcaacgacccgccgccc

SEQ ID NO: 1358884 - RNA, 16 nt, Mycobacterium tuberculosis H37Rv
gcaacgaagagggcgc

SEQ ID NO: 1358885 - RNA, 21 nt, Mycobacterium tuberculosis H37Rv
gcaaccugccgggccacggcu

SEQ ID NO: 1358886 - RNA, 22 nt, Mycobacterium tuberculosis H37Rv
gcaaccuggacugcagcgccuc

SEQ ID NO: 1358887 - RNA, 20 nt, Mycobacterium tuberculosis H37Rv
gcaaccuaaauugccgggcc

SEQ ID NO: 1358888 - RNA, 20 nt, Mycobacterium tuberculosis H37Rv
gcaagucgcccagccgagcg

SEQ ID NO: 1358889 - RNA, 19 nt, Mycobacterium tuberculosis H37Rv
gcaagucgacgccgcagcg

SEQ ID NO: 1358890 - RNA, 18 nt, Mycobacterium tuberculosis H37Rv
gcaagugaauaccccaga

SEQ ID NO: 1358891 - RNA, 18 nt, Mycobacterium tuberculosis H37Rv
gcaaguccugcagcuggc

SEQ ID NO: 1358892 - RNA, 15 nt, Mycobacterium tuberculosis H37Rv
gcaagucauccaggu

SEQ ID NO: 1358893 - RNA, 12 nt, Mycobacterium tuberculosis H37Rv
gcaagguggcau

SEQ ID NO: 1358894 - RNA, 21 nt, Mycobacterium tuberculosis H37Rv
gcaagguugccaacgccuuga

SEQ ID NO: 1358895 - RNA, 17 nt, Mycobacterium tuberculosis H37Rv
gcaagugugagcagacc

SEQ ID NO: 1358896 - RNA, 22 nt, Mycobacterium tuberculosis H37Rv
gcaagugucuccggcaacagca

SEQ ID NO: 1358897 - RNA, 20 nt, Mycobacterium tuberculosis H37Rv
gcaauagccggguugccugc

SEQ ID NO: 1358898 - RNA, 14 nt, Mycobacterium tuberculosis H37Rv
gcaauagaccgcag

SEQ ID NO: 1358899 - RNA, 19 nt, Mycobacterium tuberculosis H37Rv
gcaauauccuccagcaggu

SEQ ID NO: 1358900 - RNA, 20 nt, Mycobacterium tuberculosis H37Rv
gcaauacggcggcgccgccc

SEQ ID NO: 1358901 - RNA, 22 nt, Mycobacterium tuberculosis H37Rv
gcaauacacguugccgaucccg

SEQ ID NO: 1358902 - RNA, 14 nt, Mycobacterium tuberculosis H37Rv
gcaagggccgacgu

SEQ ID NO: 1358903 - RNA, 14 nt, Mycobacterium tuberculosis H37Rv
gcaaggucaacggg

SEQ ID NO: 1358904 - RNA, 13 nt, Mycobacterium tuberculosis H37Rv
gcaagcugaccgc

SEQ ID NO: 1358905 - RNA, 12 nt, Mycobacterium tuberculosis H37Rv
gcaaggcccgca

SEQ ID NO: 1358906 - RNA, 17 nt, Mycobacterium tuberculosis H37Rv
gcaaggacaagccgcug

SEQ ID NO: 1358907 - RNA, 21 nt, Mycobacterium tuberculosis H37Rv
gcaaggacguggcgcuggacc

SEQ ID NO: 1358908 - RNA, 20 nt, Mycobacterium tuberculosis H37Rv
gcaagcacaccgccagcggc

SEQ ID NO: 1358909 - RNA, 20 nt, Mycobacterium tuberculosis H37Rv
gcaagagccgcagccacguc

SEQ ID NO: 1358910 - RNA, 15 nt, Mycobacterium tuberculosis H37Rv
gcaagagccgcagcc

SEQ ID NO: 1358911 - RNA, 12 nt, Mycobacterium tuberculosis H37Rv
gcaagcggaugu

SEQ ID NO: 1358912 - RNA, 15 nt, Mycobacterium tuberculosis H37Rv
gcaagccgccggugc

SEQ ID NO: 1358913 - RNA, 20 nt, Mycobacterium tuberculosis H37Rv
gcaagccaaccagcccggcc

SEQ ID NO: 1358914 - RNA, 12 nt, Mycobacterium tuberculosis H37Rv
gcaaucacauca

SEQ ID NO: 1358915 - RNA, 13 nt, Mycobacterium tuberculosis H37Rv
gcaaucacaucaa

SEQ ID NO: 1358916 - RNA, 16 nt, Mycobacterium tuberculosis H37Rv
gcaaucaggaaccgcu

SEQ ID NO: 1358917 - RNA, 17 nt, Mycobacterium tuberculosis H37Rv
gcaaucaggaaccgcuc

SEQ ID NO: 1358918 - RNA, 20 nt, Mycobacterium tuberculosis H37Rv
gcaaucccgccaucugccug

SEQ ID NO: 1358919 - RNA, 23 nt, Mycobacterium tuberculosis H37Rv
gcaauccgcaaaacgagcuucca

SEQ ID NO: 1358920 - RNA, 23 nt, Mycobacterium tuberculosis H37Rv
gcaaucccgcggucgaucaggcc

SEQ ID NO: 1358921 - RNA, 15 nt, Mycobacterium tuberculosis H37Rv
gcaaugaccugcagc

SEQ ID NO: 1358922 - RNA, 23 nt, Mycobacterium tuberculosis H37Rv
gcaaugaccccggcguugccgcc

SEQ ID NO: 1358923 - RNA, 14 nt, Mycobacterium tuberculosis H37Rv
gcaaucucccgaau

SEQ ID NO: 1358924 - RNA, 18 nt, Mycobacterium tuberculosis H37Rv
gcacaaacauacgccacc

SEQ ID NO: 1358925 - RNA, 12 nt, Mycobacterium tuberculosis H37Rv
gcaauuugccgu

SEQ ID NO: 1358926 - RNA, 20 nt, Mycobacterium tuberculosis H37Rv
gcaauugcucguagcccagg

SEQ ID NO: 1358927 - RNA, 20 nt, Mycobacterium tuberculosis H37Rv
gcaauuggcguagcaaccca

SEQ ID NO: 1358928 - RNA, 19 nt, Mycobacterium tuberculosis H37Rv
gcaauuccguuaggcucca

SEQ ID NO: 1358929 - RNA, 16 nt, Mycobacterium tuberculosis H37Rv
gcaaugguucgugcac

SEQ ID NO: 1358930 - RNA, 20 nt, Mycobacterium tuberculosis H37Rv
gcaaugcggcccggguggcc

SEQ ID NO: 1358931 - RNA, 15 nt, Mycobacterium tuberculosis H37Rv
gcaaugcccgaccgg

SEQ ID NO: 1358932 - RNA, 16 nt, Mycobacterium tuberculosis H37Rv
gcaauggcggccuugc

SEQ ID NO: 1358933 - RNA, 13 nt, Mycobacterium tuberculosis H37Rv
gcaauggcggccu

SEQ ID NO: 1358934 - RNA, 14 nt, Mycobacterium tuberculosis H37Rv
gcaauggcggccuu

SEQ ID NO: 1358935 - RNA, 14 nt, Mycobacterium tuberculosis H37Rv
gcacagugcggccc

SEQ ID NO: 1358936 - RNA, 15 nt, Mycobacterium tuberculosis H37Rv
gcacagugcggcccc

SEQ ID NO: 1358937 - RNA, 22 nt, Mycobacterium tuberculosis H37Rv
gcacagguccggguuggccacc

SEQ ID NO: 1358938 - RNA, 15 nt, Mycobacterium tuberculosis H37Rv
gcacagguccggguu

SEQ ID NO: 1358939 - RNA, 22 nt, Mycobacterium tuberculosis H37Rv
gcacaggucagcgcugccaccg

SEQ ID NO: 1358940 - RNA, 18 nt, Mycobacterium tuberculosis H37Rv
gcacaggcggccagcauc

SEQ ID NO: 1358941 - RNA, 15 nt, Mycobacterium tuberculosis H37Rv
gcacaggcggccagc

SEQ ID NO: 1358942 - RNA, 21 nt, Mycobacterium tuberculosis H37Rv
gcacaggcauuuucacugugc

SEQ ID NO: 1358943 - RNA, 12 nt, Mycobacterium tuberculosis H37Rv
gcacagcaccac

SEQ ID NO: 1358944 - RNA, 12 nt, Mycobacterium tuberculosis H37Rv
gcacagcaacaa

SEQ ID NO: 1358945 - RNA, 18 nt, Mycobacterium tuberculosis H37Rv
gcacagcagcgguugaug

SEQ ID NO: 1358946 - RNA, 17 nt, Mycobacterium tuberculosis H37Rv
gcacagccauggugggc

SEQ ID NO: 1358947 - RNA, 12 nt, Mycobacterium tuberculosis H37Rv
gcacagcccggc

SEQ ID NO: 1358948 - RNA, 14 nt, Mycobacterium tuberculosis H37Rv
gcacagcgcagccu

SEQ ID NO: 1358949 - RNA, 14 nt, Mycobacterium tuberculosis H37Rv
gcacaggauuuucu

SEQ ID NO: 1358950 - RNA, 23 nt, Mycobacterium tuberculosis H37Rv
gcacaggcaucguccgccgggcu

SEQ ID NO: 1358951 - RNA, 13 nt, Mycobacterium tuberculosis H37Rv
gcacauaggcgau

SEQ ID NO: 1358952 - RNA, 22 nt, Mycobacterium tuberculosis H37Rv
gcacaugcucgacgcccgccac

SEQ ID NO: 1358953 - RNA, 20 nt, Mycobacterium tuberculosis H37Rv
gcacaugcucgacgcccgcc

SEQ ID NO: 1358954 - RNA, 13 nt, Mycobacterium tuberculosis H37Rv
gcacauucagcgc

SEQ ID NO: 1358955 - RNA, 23 nt, Mycobacterium tuberculosis H37Rv
gcacaaacgggcgugggccgcug

SEQ ID NO: 1358956 - RNA, 13 nt, Mycobacterium tuberculosis H37Rv
gcacaagcccagc

SEQ ID NO: 1358957 - RNA, 17 nt, Mycobacterium tuberculosis H37Rv
gcacaacugcgccagca

SEQ ID NO: 1358958 - RNA, 19 nt, Mycobacterium tuberculosis H37Rv
gcacaauacggucagcaga

SEQ ID NO: 1358959 - RNA, 19 nt, Mycobacterium tuberculosis H37Rv
gcacaccaaccgagcgccc

SEQ ID NO: 1358960 - RNA, 22 nt, Mycobacterium tuberculosis H37Rv
gcacaccaaccgagcgcccucc

SEQ ID NO: 1358961 - RNA, 20 nt, Mycobacterium tuberculosis H37Rv
gcacacuccuagccaacgag

SEQ ID NO: 1358962 - RNA, 15 nt, Mycobacterium tuberculosis H37Rv
gcacacugccgcgcu

SEQ ID NO: 1358963 - RNA, 14 nt, Mycobacterium tuberculosis H37Rv
gcacacggccuugc

SEQ ID NO: 1358964 - RNA, 18 nt, Mycobacterium tuberculosis H37Rv
gcacaccgacagcaccca

SEQ ID NO: 1358965 - RNA, 19 nt, Mycobacterium tuberculosis H37Rv
gcacacccaucaccgccag

SEQ ID NO: 1358966 - RNA, 21 nt, Mycobacterium tuberculosis H37Rv
gcacacccaucagcccucggc

SEQ ID NO: 1358967 - RNA, 18 nt, Mycobacterium tuberculosis H37Rv
gcacacccccgucugcgu

SEQ ID NO: 1358968 - RNA, 23 nt, Mycobacterium tuberculosis H37Rv
gcacaccggcacugcccagcaga

SEQ ID NO: 1358969 - RNA, 19 nt, Mycobacterium tuberculosis H37Rv
gcacaccgguggacccggc

SEQ ID NO: 1358970 - RNA, 16 nt, Mycobacterium tuberculosis H37Rv
gcacaccugcgcggcg

SEQ ID NO: 1358971 - RNA, 21 nt, Mycobacterium tuberculosis H37Rv
gcacaccgaucggcaaaccgu

SEQ ID NO: 1358972 - RNA, 17 nt, Mycobacterium tuberculosis H37Rv
gcacaccgacgccgcca

SEQ ID NO: 1358973 - RNA, 16 nt, Mycobacterium tuberculosis H37Rv
gcacaccgccagcggc

SEQ ID NO: 1358974 - RNA, 13 nt, Mycobacterium tuberculosis H37Rv
gcacaccggcuuu

SEQ ID NO: 1358975 - RNA, 23 nt, Mycobacterium tuberculosis H37Rv
gcaccgcggauaggccgcgcggc

SEQ ID NO: 1358976 - RNA, 18 nt, Mycobacterium tuberculosis H37Rv
gcaccgcgguacgccggu

SEQ ID NO: 1358977 - RNA, 20 nt, Mycobacterium tuberculosis H37Rv
gcaccgcuguugcaucgccg

SEQ ID NO: 1358978 - RNA, 18 nt, Mycobacterium tuberculosis H37Rv
gcaccgcugccgcugccg

SEQ ID NO: 1358979 - RNA, 24 nt, Mycobacterium tuberculosis H37Rv
gcaccgcugaccccggcagcgccc

SEQ ID NO: 1358980 - RNA, 17 nt, Mycobacterium tuberculosis H37Rv
gcaccgcugaccgcaac

SEQ ID NO: 1358981 - RNA, 14 nt, Mycobacterium tuberculosis H37Rv
gcaccgcgccgcgc

SEQ ID NO: 1358982 - RNA, 16 nt, Mycobacterium tuberculosis H37Rv
gcaccgcggccagcac

SEQ ID NO: 1358983 - RNA, 23 nt, Mycobacterium tuberculosis H37Rv
gcaccgcggccagcgggaacaca

SEQ ID NO: 1358984 - RNA, 16 nt, Mycobacterium tuberculosis H37Rv
gcaccgccagccacca

SEQ ID NO: 1358985 - RNA, 14 nt, Mycobacterium tuberculosis H37Rv
gcaccgccagccac

SEQ ID NO: 1358986 - RNA, 15 nt, Mycobacterium tuberculosis H37Rv
gcaccgccagccacc

SEQ ID NO: 1358987 - RNA, 12 nt, Mycobacterium tuberculosis H37Rv
gcaccgccaggu

SEQ ID NO: 1358988 - RNA, 22 nt, Mycobacterium tuberculosis H37Rv
gcaccgccacccugaccaacau

SEQ ID NO: 1358989 - RNA, 22 nt, Mycobacterium tuberculosis H37Rv
gcaccgcauuguugaagaaagc

SEQ ID NO: 1358990 - RNA, 14 nt, Mycobacterium tuberculosis H37Rv
gcaccgccgcgccg

SEQ ID NO: 1358991 - RNA, 16 nt, Mycobacterium tuberculosis H37Rv
gcaccgccgcgccggc

SEQ ID NO: 1358992 - RNA, 23 nt, Mycobacterium tuberculosis H37Rv
gcaccgcccccgucggccuuggg

SEQ ID NO: 1358993 - RNA, 15 nt, Mycobacterium tuberculosis H37Rv
gcaccgccccgccgu

SEQ ID NO: 1358994 - RNA, 19 nt, Mycobacterium tuberculosis H37Rv
gcaccgcccuugccgccgu

SEQ ID NO: 1358995 - RNA, 20 nt, Mycobacterium tuberculosis H37Rv
gcaccgccgcgccggcggcc

SEQ ID NO: 1358996 - RNA, 23 nt, Mycobacterium tuberculosis H37Rv
gcaccgccgcgccggcggccacc

SEQ ID NO: 1358997 - RNA, 16 nt, Mycobacterium tuberculosis H37Rv
gcaccgccgcccccgc

SEQ ID NO: 1358998 - RNA, 19 nt, Mycobacterium tuberculosis H37Rv
gcaccgccggcgcccaggc

SEQ ID NO: 1358999 - RNA, 15 nt, Mycobacterium tuberculosis H37Rv
gcaccgccggcgccg

SEQ ID NO: 1359000 - RNA, 18 nt, Mycobacterium tuberculosis H37Rv
gcaccgccggcgccgccg

SEQ ID NO: 1359001 - RNA, 19 nt, Mycobacterium tuberculosis H37Rv
gcaccgccggcgccgccgu

SEQ ID NO: 1359002 - RNA, 23 nt, Mycobacterium tuberculosis H37Rv
gcaccgccgguggcgccggggcc

SEQ ID NO: 1359003 - RNA, 16 nt, Mycobacterium tuberculosis H37Rv
gcaccgccgguggcgc

SEQ ID NO: 1359004 - RNA, 21 nt, Mycobacterium tuberculosis H37Rv
gcaccgccgguggcgccgggg

SEQ ID NO: 1359005 - RNA, 12 nt, Mycobacterium tuberculosis H37Rv
gcaccgaugccg

SEQ ID NO: 1359006 - RNA, 20 nt, Mycobacterium tuberculosis H37Rv
gcaccgaugccgaagccccc

SEQ ID NO: 1359007 - RNA, 19 nt, Mycobacterium tuberculosis H37Rv
gcaccgaugccgaagcccc

SEQ ID NO: 1359008 - RNA, 16 nt, Mycobacterium tuberculosis H37Rv
gcaccgauggcgcacc

SEQ ID NO: 1359009 - RNA, 17 nt, Mycobacterium tuberculosis H37Rv
gcaccgauggcgcaccg

SEQ ID NO: 1359010 - RNA, 16 nt, Mycobacterium tuberculosis H37Rv
gcaccgaggccgccga

SEQ ID NO: 1359011 - RNA, 18 nt, Mycobacterium tuberculosis H37Rv
gcaccgaggccgccgaga

SEQ ID NO: 1359012 - RNA, 20 nt, Mycobacterium tuberculosis H37Rv
gcaccgaccgcaccgugccg

SEQ ID NO: 1359013 - RNA, 14 nt, Mycobacterium tuberculosis H37Rv
gcaccgacggcgca

SEQ ID NO: 1359014 - RNA, 18 nt, Mycobacterium tuberculosis H37Rv
gcaccgagcugagcggcc

SEQ ID NO: 1359015 - RNA, 12 nt, Mycobacterium tuberculosis H37Rv
gcaccgagccgu

SEQ ID NO: 1359016 - RNA, 21 nt, Mycobacterium tuberculosis H37Rv
gcaccgacgucggcuucaccu

SEQ ID NO: 1359017 - RNA, 13 nt, Mycobacterium tuberculosis H37Rv
gcaccgaagugca

SEQ ID NO: 1359018 - RNA, 24 nt, Mycobacterium tuberculosis H37Rv
gcaccgaauuacgcaccgaggccg

SEQ ID NO: 1359019 - RNA, 17 nt, Mycobacterium tuberculosis H37Rv
gcaccgaacccgccacc

SEQ ID NO: 1359020 - RNA, 19 nt, Mycobacterium tuberculosis H37Rv
gcaccgaagauggccagcg

SEQ ID NO: 1359021 - RNA, 17 nt, Mycobacterium tuberculosis H37Rv
gcaccgaaaaacaccag

SEQ ID NO: 1359022 - RNA, 18 nt, Mycobacterium tuberculosis H37Rv
gcacccuguuccagcggg

SEQ ID NO: 1359023 - RNA, 21 nt, Mycobacterium tuberculosis H37Rv
gcacccggugagaagaagccc

SEQ ID NO: 1359024 - RNA, 13 nt, Mycobacterium tuberculosis H37Rv
gcacccucaggca

SEQ ID NO: 1359025 - RNA, 23 nt, Mycobacterium tuberculosis H37Rv
gcacccucaggcaaucgcgggcg

SEQ ID NO: 1359026 - RNA, 24 nt, Mycobacterium tuberculosis H37Rv
gcacccugcgggccgagaucacgc

SEQ ID NO: 1359027 - RNA, 16 nt, Mycobacterium tuberculosis H37Rv
gcacccugcgugcggc

SEQ ID NO: 1359028 - RNA, 14 nt, Mycobacterium tuberculosis H37Rv
gcacccugcgggcc

SEQ ID NO: 1359029 - RNA, 15 nt, Mycobacterium tuberculosis H37Rv
gcacccugcgggccg

SEQ ID NO: 1359030 - RNA, 20 nt, Mycobacterium tuberculosis H37Rv
gcacccgucacaagcugaca

SEQ ID NO: 1359031 - RNA, 20 nt, Mycobacterium tuberculosis H37Rv
gcacccggugagaagaagcc

SEQ ID NO: 1359032 - RNA, 19 nt, Mycobacterium tuberculosis H37Rv
gcacccggugagaagaagc

SEQ ID NO: 1359033 - RNA, 23 nt, Mycobacterium tuberculosis H37Rv
gcacccggggugcccggccgcca

SEQ ID NO: 1359034 - RNA, 13 nt, Mycobacterium tuberculosis H37Rv
gcacccggggugc

SEQ ID NO: 1359035 - RNA, 22 nt, Mycobacterium tuberculosis H37Rv
gcacccgggugcgcucuucucc

SEQ ID NO: 1359036 - RNA, 18 nt, Mycobacterium tuberculosis H37Rv
gcaccgggaugugcggcu

SEQ ID NO: 1359037 - RNA, 17 nt, Mycobacterium tuberculosis H37Rv
gcaccggugcccaccac

SEQ ID NO: 1359038 - RNA, 19 nt, Mycobacterium tuberculosis H37Rv
gcaccggugcccaccaccg

SEQ ID NO: 1359039 - RNA, 19 nt, Mycobacterium tuberculosis H37Rv
gcaccggggugugcgggcg

SEQ ID NO: 1359040 - RNA, 17 nt, Mycobacterium tuberculosis H37Rv
gcaccgggugcgacggc

SEQ ID NO: 1359041 - RNA, 20 nt, Mycobacterium tuberculosis H37Rv
gcaccggguugagccgccgc

SEQ ID NO: 1359042 - RNA, 18 nt, Mycobacterium tuberculosis H37Rv
gcaccgguuuucgccggc

SEQ ID NO: 1359043 - RNA, 21 nt, Mycobacterium tuberculosis H37Rv
gcaccguagagcaugccgccc

SEQ ID NO: 1359044 - RNA, 17 nt, Mycobacterium tuberculosis H37Rv
gcaccguagccgcugca

SEQ ID NO: 1359045 - RNA, 21 nt, Mycobacterium tuberculosis H37Rv
gcaccggucgguuaauggguc

SEQ ID NO: 1359046 - RNA, 23 nt, Mycobacterium tuberculosis H37Rv
gcaccggucgguuaaugggucgg

SEQ ID NO: 1359047 - RNA, 20 nt, Mycobacterium tuberculosis H37Rv
gcaccgucggcaccagcagc

SEQ ID NO: 1359048 - RNA, 21 nt, Mycobacterium tuberculosis H37Rv
gcaccgucggcaccagcagcc

SEQ ID NO: 1359049 - RNA, 16 nt, Mycobacterium tuberculosis H37Rv
gcaccgucgcggguca

SEQ ID NO: 1359050 - RNA, 17 nt, Mycobacterium tuberculosis H37Rv
gcaccggcucgacugcc

SEQ ID NO: 1359051 - RNA, 22 nt, Mycobacterium tuberculosis H37Rv
gcaccggcgcgggcacgcccuc

SEQ ID NO: 1359052 - RNA, 22 nt, Mycobacterium tuberculosis H37Rv
gcaccggcggucugcagugcag

SEQ ID NO: 1359053 - RNA, 21 nt, Mycobacterium tuberculosis H37Rv
gcaccggcuugggccaggccc

SEQ ID NO: 1359054 - RNA, 16 nt, Mycobacterium tuberculosis H37Rv
gcaccggcuugggcca

SEQ ID NO: 1359055 - RNA, 19 nt, Mycobacterium tuberculosis H37Rv
gcaccggccgugccgccga

SEQ ID NO: 1359056 - RNA, 14 nt, Mycobacterium tuberculosis H37Rv
gcaccggccgugcc

SEQ ID NO: 1359057 - RNA, 14 nt, Mycobacterium tuberculosis H37Rv
gcaccggccgggug

SEQ ID NO: 1359058 - RNA, 22 nt, Mycobacterium tuberculosis H37Rv
gcaccggcccgaagaucuccuc

SEQ ID NO: 1359059 - RNA, 19 nt, Mycobacterium tuberculosis H37Rv
gcaccggcacccgcacggc

SEQ ID NO: 1359060 - RNA, 21 nt, Mycobacterium tuberculosis H37Rv
gcaccggagucgcccgguccg

SEQ ID NO: 1359061 - RNA, 18 nt, Mycobacterium tuberculosis H37Rv
gcaccgcucgguccagcc

SEQ ID NO: 1359062 - RNA, 16 nt, Mycobacterium tuberculosis H37Rv
gcaccugccguuccgg

SEQ ID NO: 1359063 - RNA, 16 nt, Mycobacterium tuberculosis H37Rv
gcaccgugugggcccc

SEQ ID NO: 1359064 - RNA, 18 nt, Mycobacterium tuberculosis H37Rv
gcaccgugugggccccgc

SEQ ID NO: 1359065 - RNA, 22 nt, Mycobacterium tuberculosis H37Rv
gcaccgugugggccccgccgau

SEQ ID NO: 1359066 - RNA, 18 nt, Mycobacterium tuberculosis H37Rv
gcaccgucgggcccagcc

SEQ ID NO: 1359067 - RNA, 15 nt, Mycobacterium tuberculosis H37Rv
gcaccuccagcacca

SEQ ID NO: 1359068 - RNA, 13 nt, Mycobacterium tuberculosis H37Rv
gcaccuccguaac

SEQ ID NO: 1359069 - RNA, 14 nt, Mycobacterium tuberculosis H37Rv
gcaccucgcccugc

SEQ ID NO: 1359070 - RNA, 23 nt, Mycobacterium tuberculosis H37Rv
gcacccgauaguucuggcccgca

SEQ ID NO: 1359071 - RNA, 22 nt, Mycobacterium tuberculosis H37Rv
gcacccgaguuauagaagccga

SEQ ID NO: 1359072 - RNA, 18 nt, Mycobacterium tuberculosis H37Rv
gcacccgagccgcacagc

SEQ ID NO: 1359073 - RNA, 22 nt, Mycobacterium tuberculosis H37Rv
gcacccgacucgucggccuggu

SEQ ID NO: 1359074 - RNA, 19 nt, Mycobacterium tuberculosis H37Rv
gcaccccgccgggggcacc

SEQ ID NO: 1359075 - RNA, 15 nt, Mycobacterium tuberculosis H37Rv
gcaccccggccgcgc

SEQ ID NO: 1359076 - RNA, 17 nt, Mycobacterium tuberculosis H37Rv
gcacccccgucgccacc

SEQ ID NO: 1359077 - RNA, 20 nt, Mycobacterium tuberculosis H37Rv
gcaccccuuugacgccgagc

SEQ ID NO: 1359078 - RNA, 23 nt, Mycobacterium tuberculosis H37Rv
gcacccaucccguucagcgacca

SEQ ID NO: 1359079 - RNA, 22 nt, Mycobacterium tuberculosis H37Rv
gcacccaucccguucagcgacc

SEQ ID NO: 1359080 - RNA, 21 nt, Mycobacterium tuberculosis H37Rv
gcacccagggcguuggcggcu

SEQ ID NO: 1359081 - RNA, 17 nt, Mycobacterium tuberculosis H37Rv
gcacccagucggcgccg

SEQ ID NO: 1359082 - RNA, 15 nt, Mycobacterium tuberculosis H37Rv
gcaccccauggccac

SEQ ID NO: 1359083 - RNA, 16 nt, Mycobacterium tuberculosis H37Rv
gcaccccgccgccugc

SEQ ID NO: 1359084 - RNA, 17 nt, Mycobacterium tuberculosis H37Rv
gcaccccgccgggggca

SEQ ID NO: 1359085 - RNA, 19 nt, Mycobacterium tuberculosis H37Rv
gcacccgcuccagcucggc

SEQ ID NO: 1359086 - RNA, 14 nt, Mycobacterium tuberculosis H37Rv
gcacccgcucggcc

SEQ ID NO: 1359087 - RNA, 13 nt, Mycobacterium tuberculosis H37Rv
gcacccgcacggu

SEQ ID NO: 1359088 - RNA, 14 nt, Mycobacterium tuberculosis H37Rv
gcacccgcagccgc

SEQ ID NO: 1359089 - RNA, 14 nt, Mycobacterium tuberculosis H37Rv
gcacccggccgcgc

SEQ ID NO: 1359090 - RNA, 23 nt, Mycobacterium tuberculosis H37Rv
gcacccggcagagcacgcgcggc

SEQ ID NO: 1359091 - RNA, 21 nt, Mycobacterium tuberculosis H37Rv
gcacccggaucuggugggugc

SEQ ID NO: 1359092 - RNA, 24 nt, Mycobacterium tuberculosis H37Rv
gcacccgcuggucgagcagugccu

SEQ ID NO: 1359093 - RNA, 15 nt, Mycobacterium tuberculosis H37Rv
gcacccaaccaggcc

SEQ ID NO: 1359094 - RNA, 12 nt, Mycobacterium tuberculosis H37Rv
gcacccaaccag

SEQ ID NO: 1359095 - RNA, 16 nt, Mycobacterium tuberculosis H37Rv
gcaccauguacaggcu

SEQ ID NO: 1359096 - RNA, 17 nt, Mycobacterium tuberculosis H37Rv
gcacccacaucagccgc

SEQ ID NO: 1359097 - RNA, 15 nt, Mycobacterium tuberculosis H37Rv
gcacccacaucagcc

SEQ ID NO: 1359098 - RNA, 17 nt, Mycobacterium tuberculosis H37Rv
gcacccaauccggcgcc
